United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 11

SEQ ID NO: 448131 - RNA, 22 nt, Human
aagaaacugaaaguggcuucau

SEQ ID NO: 448132 - RNA, 22 nt, Human
cagcacacagugacucgcaccu

SEQ ID NO: 448133 - RNA, 22 nt, Human
ccaggcagagggauccccaucc

SEQ ID NO: 448134 - RNA, 22 nt, Human
gccuggcaggccugggccagca

SEQ ID NO: 448135 - RNA, 22 nt, Human
ucccagaaaaaggaggcuauga

SEQ ID NO: 448136 - RNA, 22 nt, Human
gcauggcauuaacaagauggaa

SEQ ID NO: 448137 - RNA, 21 nt, Human
gccacguuucagucuucucag

SEQ ID NO: 448138 - RNA, 22 nt, Human
uuaucauugucgcagucuaauu

SEQ ID NO: 448139 - RNA, 22 nt, Human
auucucuguuuccaagaugaaa

SEQ ID NO: 448140 - RNA, 22 nt, Human
ucauccaguucacauggugagu

SEQ ID NO: 448141 - RNA, 22 nt, Human
gacucagugauuugacaugccu

SEQ ID NO: 448142 - RNA, 22 nt, Human
gugcuuaauacaugucaauaac

SEQ ID NO: 448143 - RNA, 22 nt, Human
ggcugccugccuccaagccggg

SEQ ID NO: 448144 - RNA, 22 nt, Human
agcccagcaaagggagguucag

SEQ ID NO: 448145 - RNA, 22 nt, Human
gaggagagaagcuaacggugcu

SEQ ID NO: 448146 - RNA, 22 nt, Human
augcuguguuuuaaauggaaau

SEQ ID NO: 448147 - RNA, 22 nt, Human
ugauacagucagcucacaauug

SEQ ID NO: 448148 - RNA, 22 nt, Human
gcagugaagccagaucugaaau

SEQ ID NO: 448149 - RNA, 22 nt, Human
ggccucucuggcauggcugccc

SEQ ID NO: 448150 - RNA, 22 nt, Human
cccaggcaguagaaagaagagg

SEQ ID NO: 448151 - RNA, 22 nt, Human
uccacauucucuguuacagaua

SEQ ID NO: 448152 - RNA, 22 nt, Human
gaggaggaaacccuguuccucu

SEQ ID NO: 448153 - RNA, 22 nt, Human
auucagcaaugagcuuggauuu

SEQ ID NO: 448154 - RNA, 22 nt, Human
ccuggcugcuauagcagcaugu

SEQ ID NO: 448155 - RNA, 22 nt, Human
gccugccuuugugaggaagcgg

SEQ ID NO: 448156 - RNA, 22 nt, Human
uagcuuuaagaugagaugugga

SEQ ID NO: 448157 - RNA, 21 nt, Human
ugggcacugagggugcugcuc

SEQ ID NO: 448158 - RNA, 22 nt, Human
ugauuuccugugcgcccuuagg

SEQ ID NO: 448159 - RNA, 22 nt, Human
accugagccuagggagguugag

SEQ ID NO: 448160 - RNA, 22 nt, Human
gcaccacaucaaugaggggagc

SEQ ID NO: 448161 - RNA, 22 nt, Human
ggguuucaugguucucacaaug

SEQ ID NO: 448162 - RNA, 22 nt, Human
gaggugagaagggggucagaug

SEQ ID NO: 448163 - RNA, 23 nt, Human
uggcucuguggaucccucaggag

SEQ ID NO: 448164 - RNA, 21 nt, Human
acaguucaugauaacuccauc

SEQ ID NO: 448165 - RNA, 22 nt, Human
ggcugagggccagggcuagucu

SEQ ID NO: 448166 - RNA, 22 nt, Human
ucagaggaucaugucccuacuc

SEQ ID NO: 448167 - RNA, 22 nt, Human
gggggcaguaaggauauggaaa

SEQ ID NO: 448168 - RNA, 22 nt, Human
aggucacacuuggaucauagaa

SEQ ID NO: 448169 - RNA, 22 nt, Human
ggagcugcucagagccaguccc

SEQ ID NO: 448170 - RNA, 23 nt, Human
gcugagguacauuuacaggaaga

SEQ ID NO: 448171 - RNA, 22 nt, Human
gcucccagggaccgcagggcag

SEQ ID NO: 448172 - RNA, 22 nt, Human
aacaaauguguuuuguaauuaa

SEQ ID NO: 448173 - RNA, 22 nt, Human
gcagugguccaguucacaccca

SEQ ID NO: 448174 - RNA, 22 nt, Human
aguuuauguagaauuggcaaua

SEQ ID NO: 448175 - RNA, 22 nt, Human
uggcagaguuauggguauuuau

SEQ ID NO: 448176 - RNA, 22 nt, Human
aggagccaagauggggcaagua

SEQ ID NO: 448177 - RNA, 22 nt, Human
caagaaauuucuuaagaacuaa

SEQ ID NO: 448178 - RNA, 22 nt, Human
gcucucugguuccagucaggaa

SEQ ID NO: 448179 - RNA, 21 nt, Human
ggcagccucuguggaagggga

SEQ ID NO: 448180 - RNA, 22 nt, Human
agcugccacaugcccaagggca

SEQ ID NO: 448181 - RNA, 22 nt, Human
gcacagaacuucucuuaguagg

SEQ ID NO: 448182 - RNA, 22 nt, Human
accaggcuugaugauuugcuua

SEQ ID NO: 448183 - RNA, 17 nt, Human
agccccucagcgucacc

SEQ ID NO: 448184 - RNA, 22 nt, Human
guuacaaaugccaaagcugaga

SEQ ID NO: 448185 - RNA, 22 nt, Human
ugcuggggagugauugaccauc

SEQ ID NO: 448186 - RNA, 22 nt, Human
uucagagagaaaccagugggaa

SEQ ID NO: 448187 - RNA, 22 nt, Human
agggcagagcugucuaaauggc

SEQ ID NO: 448188 - RNA, 22 nt, Human
caguucuaauuaauaggaguaa

SEQ ID NO: 448189 - RNA, 22 nt, Human
auucaaguccagcuucucuaca

SEQ ID NO: 448190 - RNA, 22 nt, Human
gucagcaccucuuuggggagcu

SEQ ID NO: 448191 - RNA, 22 nt, Human
gggcccuggauuuaagcaugga

SEQ ID NO: 448192 - RNA, 22 nt, Human
aaagaacaaauuagcuguuuua

SEQ ID NO: 448193 - RNA, 22 nt, Human
agcuccuccugugccaggccag

SEQ ID NO: 448194 - RNA, 22 nt, Human
ucuggcucuguguccccaccca

SEQ ID NO: 448195 - RNA, 22 nt, Human
agaggcuccaccuucucugucc

SEQ ID NO: 448196 - RNA, 22 nt, Human
ucacuugccuagcccaguucag

SEQ ID NO: 448197 - RNA, 22 nt, Human
gcuggcugcgucaucacagggc

SEQ ID NO: 448198 - RNA, 22 nt, Human
gucccagaugucuggaacuccc

SEQ ID NO: 448199 - RNA, 21 nt, Human
agagaauugccuuagauguuc

SEQ ID NO: 448200 - RNA, 22 nt, Human
uucacagacuuuccauagauug

SEQ ID NO: 448201 - RNA, 22 nt, Human
gcugagacuggcagcaggaagu

SEQ ID NO: 448202 - RNA, 22 nt, Human
gucccacugggcaacuagaaaa

SEQ ID NO: 448203 - RNA, 22 nt, Human
ucagagccaaucauggugcauu

SEQ ID NO: 448204 - RNA, 22 nt, Human
aggcccuguuaugagccacugu

SEQ ID NO: 448205 - RNA, 22 nt, Human
acuuugaaacuaaaauucauua

SEQ ID NO: 448206 - RNA, 22 nt, Human
uggcagagcccagacuccaguc

SEQ ID NO: 448207 - RNA, 22 nt, Human
gagacagaguuucacucuuguu

SEQ ID NO: 448208 - RNA, 22 nt, Human
gcaugguggccuuaggguagcc

SEQ ID NO: 448209 - RNA, 18 nt, Human
uggagcaggaagccuggc

SEQ ID NO: 448210 - RNA, 22 nt, Human
ucacacagauugguagagcuga

SEQ ID NO: 448211 - RNA, 22 nt, Human
cugccuuggcccuaguucaugg

SEQ ID NO: 448212 - RNA, 22 nt, Human
cuggcaggaaguuagaugguaa

SEQ ID NO: 448213 - RNA, 22 nt, Human
uggcugggccgggccuugugcc

SEQ ID NO: 448214 - RNA, 22 nt, Human
acacacagguaaaggagccugg

SEQ ID NO: 448215 - RNA, 22 nt, Human
aaaugcaucagcucauaagaga

SEQ ID NO: 448216 - RNA, 21 nt, Human
ucauuugugaucugauuucca

SEQ ID NO: 448217 - RNA, 22 nt, Human
ggagcugcauuuagggagccuu

SEQ ID NO: 448218 - RNA, 22 nt, Human
cagaagcaaaugccuugcugag

SEQ ID NO: 448219 - RNA, 22 nt, Human
uuugggaagaggaaucucugga

SEQ ID NO: 448220 - RNA, 22 nt, Human
gggcacugaaugccaagcuagg

SEQ ID NO: 448221 - RNA, 22 nt, Human
caggagcugggucuggaagcag

SEQ ID NO: 448222 - RNA, 22 nt, Human
augggaggcagacacuaaguuc

SEQ ID NO: 448223 - RNA, 22 nt, Human
aucuggcuuacgaagcacuggu

SEQ ID NO: 448224 - RNA, 22 nt, Human
gaguccaguucuuuccagcagu

SEQ ID NO: 448225 - RNA, 22 nt, Human
cagcugccccauaaaucacagu

SEQ ID NO: 448226 - RNA, 22 nt, Human
aaagcaaugaugguagacacgu

SEQ ID NO: 448227 - RNA, 22 nt, Human
gcagagugauggaaugugggug

SEQ ID NO: 448228 - RNA, 22 nt, Human
ggcauuugagccauuggccugu

SEQ ID NO: 448229 - RNA, 22 nt, Human
gcugccugauuuacauagugaa

SEQ ID NO: 448230 - RNA, 22 nt, Human
acagaauuaaugaaaauuacaa

SEQ ID NO: 448231 - RNA, 22 nt, Human
cacauguaguaagcaggcaaug

SEQ ID NO: 448232 - RNA, 20 nt, Human
aguagcagugugacauugac

SEQ ID NO: 448233 - RNA, 22 nt, Human
uuacaaagagaaguuguagaau

SEQ ID NO: 448234 - RNA, 22 nt, Human
accaucagucauugucaguggg

SEQ ID NO: 448235 - RNA, 22 nt, Human
cuccagggagcuguggagguuu

SEQ ID NO: 448236 - RNA, 22 nt, Human
ccauggccgccgcugcucagga

SEQ ID NO: 448237 - RNA, 22 nt, Human
uucagagaagcaaaggcagauu

SEQ ID NO: 448238 - RNA, 22 nt, Human
ggaaccaggaguuacacgaguu

SEQ ID NO: 448239 - RNA, 22 nt, Human
ugucccagacauaaguggacau

SEQ ID NO: 448240 - RNA, 22 nt, Human
uggcacugccaaccugcuaggu

SEQ ID NO: 448241 - RNA, 21 nt, Human
gcaaguacuaucaucauuauc

SEQ ID NO: 448242 - RNA, 22 nt, Human
acacagggauauuucagguggu

SEQ ID NO: 448243 - RNA, 22 nt, Human
gcaaaaacugcaauuacuuuug

SEQ ID NO: 448244 - RNA, 23 nt, Human
ucagggacaugaugugucauauc

SEQ ID NO: 448245 - RNA, 21 nt, Human
aguuugaugcaauuucugaga

SEQ ID NO: 448246 - RNA, 22 nt, Human
uauuagggaacugcaagacuaa

SEQ ID NO: 448247 - RNA, 22 nt, Human
gcugucuugcucacucuugcag

SEQ ID NO: 448248 - RNA, 22 nt, Human
uggcagggccugcucaucaucc

SEQ ID NO: 448249 - RNA, 21 nt, Human
gagcugggcgaggcuccgggg

SEQ ID NO: 448250 - RNA, 22 nt, Human
uggagcagcaucacuuugagcu

SEQ ID NO: 448251 - RNA, 22 nt, Human
cugaaaauguuacacaggaaga

SEQ ID NO: 448252 - RNA, 22 nt, Human
caggaaagggaugggcugccac

SEQ ID NO: 448253 - RNA, 22 nt, Human
cugugucccaguaccuugggua

SEQ ID NO: 448254 - RNA, 22 nt, Human
gagggugguggcuuaaggugcu

SEQ ID NO: 448255 - RNA, 22 nt, Human
uggcucuguucgccaucaggag

SEQ ID NO: 448256 - RNA, 22 nt, Human
cccagcuugcccaggacugagg

SEQ ID NO: 448257 - RNA, 22 nt, Human
gggcagcucucacagcagccaa

SEQ ID NO: 448258 - RNA, 19 nt, Human
gccucugcuggggacaggc

SEQ ID NO: 448259 - RNA, 22 nt, Human
uugaacaguuuugucagguuca

SEQ ID NO: 448260 - RNA, 22 nt, Human
uacccaggagaaacagcagggc

SEQ ID NO: 448261 - RNA, 22 nt, Human
cagggcagaaggcacucuacuc

SEQ ID NO: 448262 - RNA, 22 nt, Human
aaggcacugaaaaauugugugu

SEQ ID NO: 448263 - RNA, 22 nt, Human
aggcaugugacccuggacucag

SEQ ID NO: 448264 - RNA, 22 nt, Human
ccugcccuagagaugacacaau

SEQ ID NO: 448265 - RNA, 22 nt, Human
cauuucuaagaaggcugcacau

SEQ ID NO: 448266 - RNA, 22 nt, Human
agagccugugggagaugcagcu

SEQ ID NO: 448267 - RNA, 22 nt, Human
ucauuuguugaacuuuagugcg

SEQ ID NO: 448268 - RNA, 22 nt, Human
caaaggcuuccacugcauccuu

SEQ ID NO: 448269 - RNA, 22 nt, Human
gggucucucucggcuccacgcg

SEQ ID NO: 448270 - RNA, 22 nt, Human
cagccagaaccuaggaugagcu

SEQ ID NO: 448271 - RNA, 21 nt, Human
ggagaaggacaauguugagua

SEQ ID NO: 448272 - RNA, 22 nt, Human
ugucucaggggcauugaaauaa

SEQ ID NO: 448273 - RNA, 22 nt, Human
cugcaggcaucuaacugugggc

SEQ ID NO: 448274 - RNA, 22 nt, Human
uucuuuccacagaggggaugau

SEQ ID NO: 448275 - RNA, 21 nt, Human
acagagccgggcacaaagcug

SEQ ID NO: 448276 - RNA, 22 nt, Human
cuggagccagccagggcccucu

SEQ ID NO: 448277 - RNA, 21 nt, Human
cucaaagaccaaaaguguaga

SEQ ID NO: 448278 - RNA, 22 nt, Human
agagaaaagaguucaggcuuug

SEQ ID NO: 448279 - RNA, 22 nt, Human
guaaacaucgacccaacagggg

SEQ ID NO: 448280 - RNA, 22 nt, Human
cacagcugcccuacuccaugug

SEQ ID NO: 448281 - RNA, 22 nt, Human
accaggggaugguuggcacugu

SEQ ID NO: 448282 - RNA, 22 nt, Human
acagcuugcaauggcuuucaac

SEQ ID NO: 448283 - RNA, 23 nt, Human
ucacagggcacuggcugggguug

SEQ ID NO: 448284 - RNA, 22 nt, Human
ccaaaggccaggcacugagguu

SEQ ID NO: 448285 - RNA, 22 nt, Human
agguaaagacagugaaagaggg

SEQ ID NO: 448286 - RNA, 22 nt, Human
ugcagaagcagagccgguggcc

SEQ ID NO: 448287 - RNA, 21 nt, Human
gacaggggaagaagcaaggag

SEQ ID NO: 448288 - RNA, 17 nt, Human
aggccucccuccaggcc

SEQ ID NO: 448289 - RNA, 22 nt, Human
uucugcaucugaauuuaaguac

SEQ ID NO: 448290 - RNA, 22 nt, Human
cccuuccuugugacuggugggg

SEQ ID NO: 448291 - RNA, 22 nt, Human
gcacagaagagcuuuggaauga

SEQ ID NO: 448292 - RNA, 22 nt, Human
cucaggaugcaggucacaggac

SEQ ID NO: 448293 - RNA, 22 nt, Human
auguguaggugaaucgaggcug

SEQ ID NO: 448294 - RNA, 22 nt, Human
guccucuguguaggcugcagac

SEQ ID NO: 448295 - RNA, 22 nt, Human
guguguccaggcgggagucaag

SEQ ID NO: 448296 - RNA, 22 nt, Human
ucuauauuccagauacagauua

SEQ ID NO: 448297 - RNA, 22 nt, Human
guggccagcaagugcugccucu

SEQ ID NO: 448298 - RNA, 22 nt, Human
agccuucauaaucuugggcuuu

SEQ ID NO: 448299 - RNA, 22 nt, Human
cacauaauugaacgugaugagu

SEQ ID NO: 448300 - RNA, 22 nt, Human
gagauuuccauauuuuguaaca

SEQ ID NO: 448301 - RNA, 22 nt, Human
ucuggcucggauuugucuagca

SEQ ID NO: 448302 - RNA, 22 nt, Human
auuaagggccaauccuccagcc

SEQ ID NO: 448303 - RNA, 22 nt, Human
ugaccaaaggugguuuauuugg

SEQ ID NO: 448304 - RNA, 22 nt, Human
ggcagcucacugauuagcaauu

SEQ ID NO: 448305 - RNA, 22 nt, Human
ggcagauggaagaggcuggguc

SEQ ID NO: 448306 - RNA, 22 nt, Human
ccugccaggacauugcuugaag

SEQ ID NO: 448307 - RNA, 22 nt, Human
cacucccuucaggagccuagga

SEQ ID NO: 448308 - RNA, 22 nt, Human
acugggccuggauuggcguguc

SEQ ID NO: 448309 - RNA, 22 nt, Human
cagagguagaaggcaugcagug

SEQ ID NO: 448310 - RNA, 22 nt, Human
acugucuccucaucaugccugg

SEQ ID NO: 448311 - RNA, 19 nt, Human
acacugaauguagaauugg

SEQ ID NO: 448312 - RNA, 22 nt, Human
ucaguggauuggaugagaucug

SEQ ID NO: 448313 - RNA, 22 nt, Human
cagcuuccaucuccacugcccu

SEQ ID NO: 448314 - RNA, 22 nt, Human
ggcucaggacugcagcguagag

SEQ ID NO: 448315 - RNA, 22 nt, Human
ugaguccaccuuaguauauggg

SEQ ID NO: 448316 - RNA, 22 nt, Human
aggccagguuccucaaucuuga

SEQ ID NO: 448317 - RNA, 22 nt, Human
cauugcuuugugcauauuuaaa

SEQ ID NO: 448318 - RNA, 22 nt, Human
ggugcagaucuuucucuucagg

SEQ ID NO: 448319 - RNA, 22 nt, Human
ugcuguuauacuuagcugguua

SEQ ID NO: 448320 - RNA, 17 nt, Human
agccaggcauaugaagu

SEQ ID NO: 448321 - RNA, 20 nt, Human
aguuauaguaucuagccaug

SEQ ID NO: 448322 - RNA, 22 nt, Human
cugcucuguuaauuaaacuuug

SEQ ID NO: 448323 - RNA, 22 nt, Human
uagucucugcuuugcccuuggc

SEQ ID NO: 448324 - RNA, 22 nt, Human
ggcaggugugagaucgaggcca

SEQ ID NO: 448325 - RNA, 22 nt, Human
ucaaagucauggcuaguaauga

SEQ ID NO: 448326 - RNA, 22 nt, Human
gacagacauuuccugauccaau

SEQ ID NO: 448327 - RNA, 22 nt, Human
uaaggccaaacuauuauaguuc

SEQ ID NO: 448328 - RNA, 22 nt, Human
uaauuucuagggacuaaggugc

SEQ ID NO: 448329 - RNA, 22 nt, Human
aggagcugaaacuucucauaug

SEQ ID NO: 448330 - RNA, 23 nt, Human
ucuccuccuagauacagucaugg

SEQ ID NO: 448331 - RNA, 22 nt, Human
acagauuugacugguaccuggc

SEQ ID NO: 448332 - RNA, 22 nt, Human
ccaccagcuucagcagccgcgg

SEQ ID NO: 448333 - RNA, 22 nt, Human
ugcauaaacagauacuucaugu

SEQ ID NO: 448334 - RNA, 22 nt, Human
cgaugguucuggcugcuuguau

SEQ ID NO: 448335 - RNA, 22 nt, Human
ggacacaagcuccggggcugca

SEQ ID NO: 448336 - RNA, 22 nt, Human
aggggugaaggcccgauaggag

SEQ ID NO: 448337 - RNA, 22 nt, Human
auuuauuaagcaucugcuaugu

SEQ ID NO: 448338 - RNA, 22 nt, Human
uuuugaaagccagguuuguaug

SEQ ID NO: 448339 - RNA, 22 nt, Human
augggguggaguccgggcagcg

SEQ ID NO: 448340 - RNA, 22 nt, Human
ccaggccaaauucagucagcag

SEQ ID NO: 448341 - RNA, 18 nt, Human
ccuggcagccaugcgcgc

SEQ ID NO: 448342 - RNA, 22 nt, Human
acugcagccuagggaccacagu

SEQ ID NO: 448343 - RNA, 22 nt, Human
uacaaagucagaauaacaggug

SEQ ID NO: 448344 - RNA, 22 nt, Human
ucagagugugacuuggucauga

SEQ ID NO: 448345 - RNA, 22 nt, Human
agaugauggccauguccucucc

SEQ ID NO: 448346 - RNA, 22 nt, Human
cugggcucagaugagaggaagg

SEQ ID NO: 448347 - RNA, 22 nt, Human
accaaggaagagauucucaguu

SEQ ID NO: 448348 - RNA, 22 nt, Human
cccugagaugccucacccuagu

SEQ ID NO: 448349 - RNA, 22 nt, Human
agggcugcuauguugauucaga

SEQ ID NO: 448350 - RNA, 22 nt, Human
aauccagguggcggagguugug

SEQ ID NO: 448351 - RNA, 22 nt, Human
ugggcccugacuucaagcaucc

SEQ ID NO: 448352 - RNA, 22 nt, Human
uagagaaauaagcuuugccuug

SEQ ID NO: 448353 - RNA, 22 nt, Human
uugauguacagaauuguucaca

SEQ ID NO: 448354 - RNA, 22 nt, Human
gcacugcagccucagauggugg

SEQ ID NO: 448355 - RNA, 22 nt, Human
ggcagggcaggaaagucaggaa

SEQ ID NO: 448356 - RNA, 22 nt, Human
agcaauauuucagcuagcaggu

SEQ ID NO: 448357 - RNA, 22 nt, Human
gcacacacuguuuuccucacau

SEQ ID NO: 448358 - RNA, 22 nt, Human
uacagaauguguaucauuacca

SEQ ID NO: 448359 - RNA, 22 nt, Human
cugaggucaauuaaucaacaac

SEQ ID NO: 448360 - RNA, 19 nt, Human
cucagcuguagcucaugug

SEQ ID NO: 448361 - RNA, 22 nt, Human
acaggccucaagacacccaggu

SEQ ID NO: 448362 - RNA, 22 nt, Human
caggggcuuuuccucuauaagg

SEQ ID NO: 448363 - RNA, 22 nt, Human
aggguaggguaaaugaugcauc

SEQ ID NO: 448364 - RNA, 22 nt, Human
acacagggcaaugcuuugaccu

SEQ ID NO: 448365 - RNA, 22 nt, Human
guuauguaugggggccuuauga

SEQ ID NO: 448366 - RNA, 22 nt, Human
auucuuggcaaggagauuuaaa

SEQ ID NO: 448367 - RNA, 22 nt, Human
ugguaauuaauuugauagguuc

SEQ ID NO: 448368 - RNA, 19 nt, Human
augucccaccgccccugag

SEQ ID NO: 448369 - RNA, 20 nt, Human
uauuuagauucaaguaugga

SEQ ID NO: 448370 - RNA, 22 nt, Human
caaaacugucuagagagagaag

SEQ ID NO: 448371 - RNA, 22 nt, Human
gcuguggcugaagaugcaggga

SEQ ID NO: 448372 - RNA, 21 nt, Human
cuguccaguaauuccuggcac

SEQ ID NO: 448373 - RNA, 22 nt, Human
caguguggcugagacagaggcu

SEQ ID NO: 448374 - RNA, 20 nt, Human
aaaaacaguaaugcugaaga

SEQ ID NO: 448375 - RNA, 22 nt, Human
acuucuggugucauacugcauu

SEQ ID NO: 448376 - RNA, 22 nt, Human
uggcagagucugggcuugggca

SEQ ID NO: 448377 - RNA, 18 nt, Human
auuuugaacaaugcugua

SEQ ID NO: 448378 - RNA, 21 nt, Human
ggccucugccuugccccacuc

SEQ ID NO: 448379 - RNA, 22 nt, Human
gcgagggcacgcgguugaaggc

SEQ ID NO: 448380 - RNA, 22 nt, Human
cagagcugguguuacaagucca

SEQ ID NO: 448381 - RNA, 23 nt, Human
agucucagcuggaaacauguguc

SEQ ID NO: 448382 - RNA, 22 nt, Human
aaggcugagacagcacaggucc

SEQ ID NO: 448383 - RNA, 22 nt, Human
guuuagaauucuaacuuuaagg

SEQ ID NO: 448384 - RNA, 22 nt, Human
gccaugcuugguaugcugugag

SEQ ID NO: 448385 - RNA, 22 nt, Human
caggcagcaggagcccugcucg

SEQ ID NO: 448386 - RNA, 22 nt, Human
cagcugccagcuucucuccauc

SEQ ID NO: 448387 - RNA, 22 nt, Human
agauacauagcugugagcacac

SEQ ID NO: 448388 - RNA, 22 nt, Human
aaggggaaguagcaccagaggu

SEQ ID NO: 448389 - RNA, 22 nt, Human
gacuguguccaugugcuggauu

SEQ ID NO: 448390 - RNA, 22 nt, Human
cucugagcccgcugcagcccca

SEQ ID NO: 448391 - RNA, 22 nt, Human
ugagagugguucagcucagaag

SEQ ID NO: 448392 - RNA, 22 nt, Human
acugaaggaaagccuuugcaug

SEQ ID NO: 448393 - RNA, 22 nt, Human
ucacagacaauuguuuuggugu

SEQ ID NO: 448394 - RNA, 22 nt, Human
gcacagaacagagaaauagcca

SEQ ID NO: 448395 - RNA, 22 nt, Human
gaaaacuaacggaaaaguuagg

SEQ ID NO: 448396 - RNA, 22 nt, Human
uucauguauuuaucauguaaau

SEQ ID NO: 448397 - RNA, 22 nt, Human
aggccuggccccaguugcuagg

SEQ ID NO: 448398 - RNA, 22 nt, Human
gccacugcacuccagcccaggc

SEQ ID NO: 448399 - RNA, 22 nt, Human
caggggcuagcacuuaauguuu

SEQ ID NO: 448400 - RNA, 22 nt, Human
uggccugcccagagcagcucug

SEQ ID NO: 448401 - RNA, 22 nt, Human
ccugcucugguuuagucagucu

SEQ ID NO: 448402 - RNA, 22 nt, Human
ccacccuuggguucggaggccg

SEQ ID NO: 448403 - RNA, 22 nt, Human
ccugccuguaagauggguacaa

SEQ ID NO: 448404 - RNA, 21 nt, Human
guauucuuuaugaagugaaaa

SEQ ID NO: 448405 - RNA, 22 nt, Human
agcuuuauucaugauuucaggg

SEQ ID NO: 448406 - RNA, 22 nt, Human
ucuggcugcugcgugagugcuu

SEQ ID NO: 448407 - RNA, 22 nt, Human
caggaagagaacauggaggcug

SEQ ID NO: 448408 - RNA, 22 nt, Human
cuacauuuugugauuaugaaau

SEQ ID NO: 448409 - RNA, 22 nt, Human
ugccaggagagugcaugcaggg

SEQ ID NO: 448410 - RNA, 22 nt, Human
aggagucauaaaugugaacaaa

SEQ ID NO: 448411 - RNA, 22 nt, Human
gacccugccaugagugacaggg

SEQ ID NO: 448412 - RNA, 22 nt, Human
ucuccaagcagggcugcaaggc

SEQ ID NO: 448413 - RNA, 22 nt, Human
cuggagccaugucuugacugcu

SEQ ID NO: 448414 - RNA, 22 nt, Human
cagcugccacaccucuuucucu

SEQ ID NO: 448415 - RNA, 23 nt, Human
ggggccugcaccggucugcgcgg

SEQ ID NO: 448416 - RNA, 22 nt, Human
agcaggaacgaguucaugggga

SEQ ID NO: 448417 - RNA, 22 nt, Human
ucaaggaggugcuuggcuucac

SEQ ID NO: 448418 - RNA, 22 nt, Human
ugggggaagagcuuguuaaagu

SEQ ID NO: 448419 - RNA, 22 nt, Human
ugaagaagccaauugguaggcu

SEQ ID NO: 448420 - RNA, 22 nt, Human
gggcugucaugugucagugacc

SEQ ID NO: 448421 - RNA, 19 nt, Human
uagcugccuguuaccucca

SEQ ID NO: 448422 - RNA, 22 nt, Human
cuggggccacaacggcgcacgc

SEQ ID NO: 448423 - RNA, 22 nt, Human
ggccuggcucuugcccagccug

SEQ ID NO: 448424 - RNA, 22 nt, Human
acugcuuuucagagucugccug

SEQ ID NO: 448425 - RNA, 20 nt, Human
cccuccagcaaccaggacuu

SEQ ID NO: 448426 - RNA, 22 nt, Human
gcaguccucucauuggccuccu

SEQ ID NO: 448427 - RNA, 22 nt, Human
cacuggggugggccugguagag

SEQ ID NO: 448428 - RNA, 18 nt, Human
cagggccccagaauuauc

SEQ ID NO: 448429 - RNA, 20 nt, Human
caggcaguuugugguuaggg

SEQ ID NO: 448430 - RNA, 22 nt, Human
aauuccugucuuaacaguucug

SEQ ID NO: 448431 - RNA, 22 nt, Human
aguauuucuaguugguucuacu

SEQ ID NO: 448432 - RNA, 23 nt, Human
uggacgccgacuuuggaggcgcu

SEQ ID NO: 448433 - RNA, 22 nt, Human
ccagagugacgugaagugugaa

SEQ ID NO: 448434 - RNA, 22 nt, Human
gauucuuacuucuaagcaagcu

SEQ ID NO: 448435 - RNA, 22 nt, Human
ccagagagucgaugggggacac

SEQ ID NO: 448436 - RNA, 22 nt, Human
cagcugccugucuggaggcaau

SEQ ID NO: 448437 - RNA, 22 nt, Human
gcuugaaaauucauagguauuu

SEQ ID NO: 448438 - RNA, 22 nt, Human
aggcugcuuucauggccgcccc

SEQ ID NO: 448439 - RNA, 22 nt, Human
gccuggagggucccucucugga

SEQ ID NO: 448440 - RNA, 20 nt, Human
ugcuuuaugcuauacuuugu

SEQ ID NO: 448441 - RNA, 20 nt, Human
ugggccuguggcagaagucu

SEQ ID NO: 448442 - RNA, 22 nt, Human
uucuuaaaacuuauggacaggu

SEQ ID NO: 448443 - RNA, 22 nt, Human
caggaacagcaccaggagcuag

SEQ ID NO: 448444 - RNA, 19 nt, Human
ucccgcccacugagcgugc

SEQ ID NO: 448445 - RNA, 22 nt, Human
uggcaggggaggugcuugcuua

SEQ ID NO: 448446 - RNA, 22 nt, Human
ucugccuggauuuuggaaagcu

SEQ ID NO: 448447 - RNA, 22 nt, Human
accaugaugcauccuuaaggaa

SEQ ID NO: 448448 - RNA, 22 nt, Human
cugggcugugguguggcccaaa

SEQ ID NO: 448449 - RNA, 22 nt, Human
uaagacacaugcguacaagaua

SEQ ID NO: 448450 - RNA, 22 nt, Human
uuccucaugggguuccuucaga

SEQ ID NO: 448451 - RNA, 22 nt, Human
uccaggcauaaugcccaguggu

SEQ ID NO: 448452 - RNA, 22 nt, Human
cacaggcagccuuguagaagaa

SEQ ID NO: 448453 - RNA, 22 nt, Human
caguguuccaggcggcagugaa

SEQ ID NO: 448454 - RNA, 20 nt, Human
agaguaacuggcacauaggg

SEQ ID NO: 448455 - RNA, 22 nt, Human
aaacaguagaaguguauuuuau

SEQ ID NO: 448456 - RNA, 22 nt, Human
agugauuugggugucagaaagu

SEQ ID NO: 448457 - RNA, 22 nt, Human
ucuccugugcacccucccugug

SEQ ID NO: 448458 - RNA, 22 nt, Human
gaggcagcaaaauauaucauaa

SEQ ID NO: 448459 - RNA, 22 nt, Human
cucuggaguuagugaucugggc

SEQ ID NO: 448460 - RNA, 22 nt, Human
ggugggcaggcgaggcccaggu

SEQ ID NO: 448461 - RNA, 22 nt, Human
cuggggcugcagcgaucuucau

SEQ ID NO: 448462 - RNA, 22 nt, Human
ucaccaggcuggaaugcagugg

SEQ ID NO: 448463 - RNA, 22 nt, Human
uggguggcacuucuggggucca

SEQ ID NO: 448464 - RNA, 22 nt, Human
acagaggcagugugagauacug

SEQ ID NO: 448465 - RNA, 22 nt, Human
ugcuuuauaaccauuucugugg

SEQ ID NO: 448466 - RNA, 22 nt, Human
gcauuccugagaaugcagagug

SEQ ID NO: 448467 - RNA, 22 nt, Human
caggcagcuagauuuauaacaa

SEQ ID NO: 448468 - RNA, 22 nt, Human
aaaauccucuaauucuagaaua

SEQ ID NO: 448469 - RNA, 22 nt, Human
ggcagggaggaggugaaaguga

SEQ ID NO: 448470 - RNA, 22 nt, Human
gcugagugauugauauuuuagu

SEQ ID NO: 448471 - RNA, 22 nt, Human
gugugcagaagacacaagacau

SEQ ID NO: 448472 - RNA, 22 nt, Human
agucucugcaugccugcugugc

SEQ ID NO: 448473 - RNA, 22 nt, Human
cagggccucuccuccaggaacu

SEQ ID NO: 448474 - RNA, 22 nt, Human
uaacacacugaaggugagaugg

SEQ ID NO: 448475 - RNA, 22 nt, Human
aaggucauugguucugaauucu

SEQ ID NO: 448476 - RNA, 22 nt, Human
uaggagcuaaaauauuuuauau

SEQ ID NO: 448477 - RNA, 22 nt, Human
uacauugugauguuucaauaca

SEQ ID NO: 448478 - RNA, 22 nt, Human
agucauauguggcauuuucuaa

SEQ ID NO: 448479 - RNA, 22 nt, Human
ugcucccagggacucuggcugg

SEQ ID NO: 448480 - RNA, 22 nt, Human
uuuuaaucaugcuucuaugucc

SEQ ID NO: 448481 - RNA, 22 nt, Human
aucuggcucauucagggaacgg

SEQ ID NO: 448482 - RNA, 22 nt, Human
cauugcacuuuggguccaggac

SEQ ID NO: 448483 - RNA, 22 nt, Human
uuugacagacauuuacuacauu

SEQ ID NO: 448484 - RNA, 22 nt, Human
uggccuggaaccuggcagggac

SEQ ID NO: 448485 - RNA, 22 nt, Human
uuucagaucauuuuuuaaguac

SEQ ID NO: 448486 - RNA, 22 nt, Human
acauuucugcuagaauagguga

SEQ ID NO: 448487 - RNA, 22 nt, Human
ccacagggcacaagggagguug

SEQ ID NO: 448488 - RNA, 21 nt, Human
ggagcugcaggagccgaaggc

SEQ ID NO: 448489 - RNA, 22 nt, Human
gaaaggagggaaacagagcggu

SEQ ID NO: 448490 - RNA, 22 nt, Human
uuuacauggaauauugucuugu

SEQ ID NO: 448491 - RNA, 22 nt, Human
cucccugguguccccuccagga

SEQ ID NO: 448492 - RNA, 22 nt, Human
ugccugggaaccaauccuggcu

SEQ ID NO: 448493 - RNA, 22 nt, Human
ucucuguaguugggcagcugcu

SEQ ID NO: 448494 - RNA, 22 nt, Human
uguggcugacuccuggucccca

SEQ ID NO: 448495 - RNA, 22 nt, Human
ggcagcucaccucugguccagg

SEQ ID NO: 448496 - RNA, 22 nt, Human
uucauaguguuuccuuccagug

SEQ ID NO: 448497 - RNA, 22 nt, Human
ccuggagcacagcccaguccca

SEQ ID NO: 448498 - RNA, 22 nt, Human
cagcaucuuucucuucuggagu

SEQ ID NO: 448499 - RNA, 23 nt, Human
gccucugcucugcguuggggacu

SEQ ID NO: 448500 - RNA, 22 nt, Human
uauuuuagguaauauccauugu

SEQ ID NO: 448501 - RNA, 22 nt, Human
ccugggcauaaaucacuccaag

SEQ ID NO: 448502 - RNA, 22 nt, Human
cacccagcuuuugcauccuccg

SEQ ID NO: 448503 - RNA, 22 nt, Human
uuccucaucugugcaccucacu

SEQ ID NO: 448504 - RNA, 19 nt, Human
agggcugcucuggccuggg

SEQ ID NO: 448505 - RNA, 22 nt, Human
gccauuuucugucuuguuuauu

SEQ ID NO: 448506 - RNA, 22 nt, Human
gggccaugagagguucaucaac

SEQ ID NO: 448507 - RNA, 22 nt, Human
auccuugacacacuccaguacu

SEQ ID NO: 448508 - RNA, 22 nt, Human
ggcccagcacagugcuuggggg

SEQ ID NO: 448509 - RNA, 22 nt, Human
cagcaguguggaagcugagggg

SEQ ID NO: 448510 - RNA, 22 nt, Human
uuaagucauuucugauuauaga

SEQ ID NO: 448511 - RNA, 22 nt, Human
cugucucuguugccuguaggug

SEQ ID NO: 448512 - RNA, 22 nt, Human
gaggugggaugugugugcuacu

SEQ ID NO: 448513 - RNA, 22 nt, Human
uaacagaaauuuuaguuagggg

SEQ ID NO: 448514 - RNA, 22 nt, Human
gggagcuguaagggacagguag

SEQ ID NO: 448515 - RNA, 22 nt, Human
cccaggucugccagccuguggg

SEQ ID NO: 448516 - RNA, 20 nt, Human
acauugauuauguuuguaga

SEQ ID NO: 448517 - RNA, 22 nt, Human
cagcuuauucaguaagcacaua

SEQ ID NO: 448518 - RNA, 22 nt, Human
aucuggcucuuccuggaguucc

SEQ ID NO: 448519 - RNA, 22 nt, Human
aagaacauguuaaaagauucac

SEQ ID NO: 448520 - RNA, 17 nt, Human
uccagagcacagagcuc

SEQ ID NO: 448521 - RNA, 22 nt, Human
gcuccacuugcagcuaggcuug

SEQ ID NO: 448522 - RNA, 22 nt, Human
uggccugggccggcagauauac

SEQ ID NO: 448523 - RNA, 22 nt, Human
ugcucuguaacaaauugacaug

SEQ ID NO: 448524 - RNA, 22 nt, Human
uuggagcccugaggaucuggau

SEQ ID NO: 448525 - RNA, 22 nt, Human
aguucuuuugugaacauaugcu

SEQ ID NO: 448526 - RNA, 22 nt, Human
aaaggucauugaaaaggaggaa

SEQ ID NO: 448527 - RNA, 22 nt, Human
caggcugcggucggcucugguc

SEQ ID NO: 448528 - RNA, 22 nt, Human
cucacaggagaaagucaugguc

SEQ ID NO: 448529 - RNA, 22 nt, Human
acagaaauauucguggugcuug

SEQ ID NO: 448530 - RNA, 22 nt, Human
acuguggcgucaggaagaaauu

SEQ ID NO: 448531 - RNA, 22 nt, Human
uccagggagauggcagaggcug

SEQ ID NO: 448532 - RNA, 22 nt, Human
uugggcugaacccugcagcuga

SEQ ID NO: 448533 - RNA, 22 nt, Human
uggcucaggcuugaaaauagau

SEQ ID NO: 448534 - RNA, 22 nt, Human
uccagccuaggggaacagcugc

SEQ ID NO: 448535 - RNA, 22 nt, Human
gccagcucccaagugagccccu

SEQ ID NO: 448536 - RNA, 22 nt, Human
acugucuuccaggucuggaggu

SEQ ID NO: 448537 - RNA, 22 nt, Human
uaaggccaccguuauagaacca

SEQ ID NO: 448538 - RNA, 22 nt, Human
uggcugagaaaaaagagcuaua

SEQ ID NO: 448539 - RNA, 22 nt, Human
ggauccuuaacuaucacaguga

SEQ ID NO: 448540 - RNA, 22 nt, Human
cagagccuuccuagcagacucu

SEQ ID NO: 448541 - RNA, 22 nt, Human
uuacaaagcguugagacaagua

SEQ ID NO: 448542 - RNA, 22 nt, Human
cagggccaguucucgcagcagu

SEQ ID NO: 448543 - RNA, 22 nt, Human
ggagccaggcaaucuguacuuu

SEQ ID NO: 448544 - RNA, 22 nt, Human
ucccugggccacagcugugagc

SEQ ID NO: 448545 - RNA, 22 nt, Human
agagccuggagguucugcugaa

SEQ ID NO: 448546 - RNA, 22 nt, Human
ggcaggagcucagguugguucc

SEQ ID NO: 448547 - RNA, 22 nt, Human
acacuguguggucucucucgga

SEQ ID NO: 448548 - RNA, 23 nt, Human
agcuucauugaccuccgcagggg

SEQ ID NO: 448549 - RNA, 22 nt, Human
ucccuggggauguuggccugcc

SEQ ID NO: 448550 - RNA, 22 nt, Human
cagcugccacuugcucucggcu

SEQ ID NO: 448551 - RNA, 22 nt, Human
uccaugagacagauacuguaag

SEQ ID NO: 448552 - RNA, 22 nt, Human
uaaggcauucucaugcugugaa

SEQ ID NO: 448553 - RNA, 22 nt, Human
cggcagagcuuccugcucagcg

SEQ ID NO: 448554 - RNA, 21 nt, Human
ucuguacaucauugagucccc

SEQ ID NO: 448555 - RNA, 17 nt, Human
uuugaaaggaugucagu

SEQ ID NO: 448556 - RNA, 22 nt, Human
cucuuuccucagccacagucua

SEQ ID NO: 448557 - RNA, 22 nt, Human
agaugguguuuccccaggugga

SEQ ID NO: 448558 - RNA, 20 nt, Human
ccagcauguacacaugugga

SEQ ID NO: 448559 - RNA, 19 nt, Human
uggcugagcuggacugagg

SEQ ID NO: 448560 - RNA, 23 nt, Human
aggauguaggauguauggcagag

SEQ ID NO: 448561 - RNA, 22 nt, Human
agcuggcauacuuugcuaggaa

SEQ ID NO: 448562 - RNA, 22 nt, Human
ccacugggggcugcaggcacuc

SEQ ID NO: 448563 - RNA, 22 nt, Human
gcagagccagaauggccaggac

SEQ ID NO: 448564 - RNA, 22 nt, Human
agcugaggaggaaugaugggua

SEQ ID NO: 448565 - RNA, 22 nt, Human
ggucagggggaucugugaggua

SEQ ID NO: 448566 - RNA, 22 nt, Human
cagagacauuaagugccaugau

SEQ ID NO: 448567 - RNA, 22 nt, Human
uggcuucuuagaccaguggccu

SEQ ID NO: 448568 - RNA, 22 nt, Human
gccugcagggugaugggcugcc

SEQ ID NO: 448569 - RNA, 22 nt, Human
aacaugauggggaagaacaaga

SEQ ID NO: 448570 - RNA, 22 nt, Human
uucuuucacucaagaaggaucu

SEQ ID NO: 448571 - RNA, 22 nt, Human
cuggcucucugagauauugagu

SEQ ID NO: 448572 - RNA, 22 nt, Human
gccugugcauagcagcggacuc

SEQ ID NO: 448573 - RNA, 22 nt, Human
auaucacaaacaagucuguacu

SEQ ID NO: 448574 - RNA, 22 nt, Human
guacaaaaguuauugcgguuuu

SEQ ID NO: 448575 - RNA, 19 nt, Human
agccuggagggcuggucac

SEQ ID NO: 448576 - RNA, 22 nt, Human
aaagaguucuaugaucuuucca

SEQ ID NO: 448577 - RNA, 22 nt, Human
auggaaaggcuguggaaacuua

SEQ ID NO: 448578 - RNA, 22 nt, Human
ugcccuguuaucuuggaagagu

SEQ ID NO: 448579 - RNA, 22 nt, Human
uauauguguggauucuuguaga

SEQ ID NO: 448580 - RNA, 22 nt, Human
ucagaggaggcauuuaaacaga

SEQ ID NO: 448581 - RNA, 22 nt, Human
agggcucccgugaggugacugc

SEQ ID NO: 448582 - RNA, 22 nt, Human
cuguagccaguuuggccucacc

SEQ ID NO: 448583 - RNA, 22 nt, Human
uguguacauaucuauccuagau

SEQ ID NO: 448584 - RNA, 22 nt, Human
ggccuugggaggagggucagaa

SEQ ID NO: 448585 - RNA, 22 nt, Human
uggccuugggcagguggccugc

SEQ ID NO: 448586 - RNA, 22 nt, Human
aggucauuggggacuaucuccg

SEQ ID NO: 448587 - RNA, 21 nt, Human
gaaaggucuuaacuuacagag

SEQ ID NO: 448588 - RNA, 22 nt, Human
ccugaggcuuaaucugucccaa

SEQ ID NO: 448589 - RNA, 23 nt, Human
ugccagaggcagucacaguggug

SEQ ID NO: 448590 - RNA, 22 nt, Human
gugcauugcgaugcagacgacc

SEQ ID NO: 448591 - RNA, 22 nt, Human
gagcccucucuguaggcaagua

SEQ ID NO: 448592 - RNA, 22 nt, Human
ggagugggaacaaugacauggu

SEQ ID NO: 448593 - RNA, 22 nt, Human
cagccagggucaggcagcuucu

SEQ ID NO: 448594 - RNA, 22 nt, Human
gcagaggcuccauuuuacagau

SEQ ID NO: 448595 - RNA, 18 nt, Human
cguuuuuccgggauugca

SEQ ID NO: 448596 - RNA, 22 nt, Human
cuggccuuggugcuugcagaca

SEQ ID NO: 448597 - RNA, 22 nt, Human
agagcuggacgucugagcccua

SEQ ID NO: 448598 - RNA, 22 nt, Human
ucacauuuuaucuauuuuaagu

SEQ ID NO: 448599 - RNA, 22 nt, Human
cauuagggacugaggaauaagg

SEQ ID NO: 448600 - RNA, 22 nt, Human
cagugucuccagaugcuccaau

SEQ ID NO: 448601 - RNA, 22 nt, Human
gagccugaaauacaggucacug

SEQ ID NO: 448602 - RNA, 22 nt, Human
auuauuagauucuuaauuguaa

SEQ ID NO: 448603 - RNA, 22 nt, Human
ugcuuuauugcaucaguguggg

SEQ ID NO: 448604 - RNA, 22 nt, Human
guaggcagauaggagugcagcc

SEQ ID NO: 448605 - RNA, 21 nt, Human
aaagaacaggcagauguucuu

SEQ ID NO: 448606 - RNA, 22 nt, Human
ccaggugucuguggccagcccu

SEQ ID NO: 448607 - RNA, 22 nt, Human
gccaggcuccaggcccuccuga

SEQ ID NO: 448608 - RNA, 22 nt, Human
guugaguggguuaggaugcuga

SEQ ID NO: 448609 - RNA, 22 nt, Human
ucaugucaguuucuucuauaaa

SEQ ID NO: 448610 - RNA, 22 nt, Human
augaggcagucuggccugaggg

SEQ ID NO: 448611 - RNA, 21 nt, Human
agaaaauggcguuuuagauuu

SEQ ID NO: 448612 - RNA, 22 nt, Human
auucacaauuagaaguagauaa

SEQ ID NO: 448613 - RNA, 22 nt, Human
caggcugcagaggccuuucaug

SEQ ID NO: 448614 - RNA, 22 nt, Human
gaggcucaacccacagggguug

SEQ ID NO: 448615 - RNA, 22 nt, Human
uguucccaagauaagauuauga

SEQ ID NO: 448616 - RNA, 22 nt, Human
gugccagcaguuauggugauuu

SEQ ID NO: 448617 - RNA, 22 nt, Human
gcuggugccuuguuguuguuac

SEQ ID NO: 448618 - RNA, 22 nt, Human
agaagccacuggagguugagau

SEQ ID NO: 448619 - RNA, 22 nt, Human
ccugucugcaugaucccugcca

SEQ ID NO: 448620 - RNA, 22 nt, Human
cagcaggguagguuguaucagu

SEQ ID NO: 448621 - RNA, 22 nt, Human
ugcugccuuagcagccaggcaa

SEQ ID NO: 448622 - RNA, 22 nt, Human
aggcugagguaggaggaucgcu

SEQ ID NO: 448623 - RNA, 22 nt, Human
cuggggcugcgguggaggagcc

SEQ ID NO: 448624 - RNA, 22 nt, Human
cagcagcaacaacggaagccuu

SEQ ID NO: 448625 - RNA, 22 nt, Human
ccagccaggcauugcaaacuga

SEQ ID NO: 448626 - RNA, 22 nt, Human
cccuggagguggagguugcagg

SEQ ID NO: 448627 - RNA, 22 nt, Human
cagcaguggcugcaggcagcug

SEQ ID NO: 448628 - RNA, 22 nt, Human
augaaacaugagaaauggagag

SEQ ID NO: 448629 - RNA, 22 nt, Human
agagggcugccucagucagcua

SEQ ID NO: 448630 - RNA, 22 nt, Human
ugccugucagggggagugggaa

SEQ ID NO: 448631 - RNA, 22 nt, Human
uccucaggaucuaggagugcuu

SEQ ID NO: 448632 - RNA, 22 nt, Human
uagugaaauuuaugcacagcua

SEQ ID NO: 448633 - RNA, 22 nt, Human
ugaaggaaugagggaguggguc

SEQ ID NO: 448634 - RNA, 22 nt, Human
gaggaaacauuguagaagcagu

SEQ ID NO: 448635 - RNA, 22 nt, Human
gagggcucuacucaccacccug

SEQ ID NO: 448636 - RNA, 22 nt, Human
acuguacaaauauugcaaaaua

SEQ ID NO: 448637 - RNA, 22 nt, Human
gaugaggggucauuggcuggga

SEQ ID NO: 448638 - RNA, 21 nt, Human
aagcaggacauaugaugcccu

SEQ ID NO: 448639 - RNA, 22 nt, Human
gagcuuuagcugagaccugcuu

SEQ ID NO: 448640 - RNA, 22 nt, Human
gccuucaggaaaucaguccuug

SEQ ID NO: 448641 - RNA, 22 nt, Human
ucagcugaaguggagaagcaga

SEQ ID NO: 448642 - RNA, 22 nt, Human
gagagaagaauguuccgaggcc

SEQ ID NO: 448643 - RNA, 22 nt, Human
gcucuggagauggagccuugag

SEQ ID NO: 448644 - RNA, 22 nt, Human
uugugguuaaccgcacauuuuu

SEQ ID NO: 448645 - RNA, 22 nt, Human
ucugcagaauucgaggaagaaa

SEQ ID NO: 448646 - RNA, 22 nt, Human
gaggcucacuuucauccucuuc

SEQ ID NO: 448647 - RNA, 22 nt, Human
cccaggcagcccuucugacgca

SEQ ID NO: 448648 - RNA, 22 nt, Human
gaugcacagugacccugccagu

SEQ ID NO: 448649 - RNA, 22 nt, Human
uugcauugugauuacagaggug

SEQ ID NO: 448650 - RNA, 22 nt, Human
gaagccaggggccugacaggca

SEQ ID NO: 448651 - RNA, 22 nt, Human
gcugcucuacccaugcaucugu

SEQ ID NO: 448652 - RNA, 22 nt, Human
uuacuuuggauggucaagaaag

SEQ ID NO: 448653 - RNA, 22 nt, Human
gcugcagugagccaagaucgug

SEQ ID NO: 448654 - RNA, 22 nt, Human
aggagccaggaaaccugcucug

SEQ ID NO: 448655 - RNA, 22 nt, Human
agaaagaacgcacuugugcugc

SEQ ID NO: 448656 - RNA, 22 nt, Human
ccagcugucugguuccagagcc

SEQ ID NO: 448657 - RNA, 21 nt, Human
ucuuugcaucaguuguuuucu

SEQ ID NO: 448658 - RNA, 22 nt, Human
uuagaaaggagcuuauuucuuu

SEQ ID NO: 448659 - RNA, 22 nt, Human
uagaaacccauguuuauucagu

SEQ ID NO: 448660 - RNA, 22 nt, Human
caggcagcguccugcuuccugu

SEQ ID NO: 448661 - RNA, 22 nt, Human
aaacacaccuuuggaacuguga

SEQ ID NO: 448662 - RNA, 18 nt, Human
agccuggaggguugaagu

SEQ ID NO: 448663 - RNA, 22 nt, Human
cauacauuuugcauauuuacca

SEQ ID NO: 448664 - RNA, 22 nt, Human
augcacccagugucuggacuau

SEQ ID NO: 448665 - RNA, 22 nt, Human
uuauuaaugaguacaaguuauu

SEQ ID NO: 448666 - RNA, 22 nt, Human
uggcccuguguccugcugccag

SEQ ID NO: 448667 - RNA, 22 nt, Human
ggcucaccauuuucacucucug

SEQ ID NO: 448668 - RNA, 22 nt, Human
ggcagagaugugggucagaauc

SEQ ID NO: 448669 - RNA, 22 nt, Human
ucacauuuucuacuacuguacg

SEQ ID NO: 448670 - RNA, 22 nt, Human
ucauuacaguguuuauaugucu

SEQ ID NO: 448671 - RNA, 22 nt, Human
caccugcagggggagucaagag

SEQ ID NO: 448672 - RNA, 22 nt, Human
auaauuuaaauuaguaugugau

SEQ ID NO: 448673 - RNA, 22 nt, Human
gcugagcugcuguucauccugc

SEQ ID NO: 448674 - RNA, 22 nt, Human
ucugcagauuuaucagcagcug

SEQ ID NO: 448675 - RNA, 22 nt, Human
uccuuugacuucuugcagucca

SEQ ID NO: 448676 - RNA, 22 nt, Human
gggcacugcuuugcucugucac

SEQ ID NO: 448677 - RNA, 22 nt, Human
agagccuggacuuuucugagcc

SEQ ID NO: 448678 - RNA, 22 nt, Human
ugguccagacauuucugaggua

SEQ ID NO: 448679 - RNA, 22 nt, Human
cagcugagcucccaggccauca

SEQ ID NO: 448680 - RNA, 22 nt, Human
gaaaugcagauucugauucugu

SEQ ID NO: 448681 - RNA, 22 nt, Human
cucacugugccuuuucccaaac

SEQ ID NO: 448682 - RNA, 22 nt, Human
gaugguuugguaaaaguauguu

SEQ ID NO: 448683 - RNA, 22 nt, Human
gcuggcucagggacuagaguuu

SEQ ID NO: 448684 - RNA, 22 nt, Human
acugucuuguguuaaagaacca

SEQ ID NO: 448685 - RNA, 22 nt, Human
agagcugcccacacagcagauu

SEQ ID NO: 448686 - RNA, 22 nt, Human
gcagaagaccaugguggaaaga

SEQ ID NO: 448687 - RNA, 22 nt, Human
uggcagucggacuucuaucuca

SEQ ID NO: 448688 - RNA, 22 nt, Human
guccuggcccacuggcaggcug

SEQ ID NO: 448689 - RNA, 22 nt, Human
ccagaaggcggagauugcagug

SEQ ID NO: 448690 - RNA, 22 nt, Human
gucucagggacugcuucugggg

SEQ ID NO: 448691 - RNA, 22 nt, Human
uuacuucuuacaaaagaaauau

SEQ ID NO: 448692 - RNA, 22 nt, Human
cuggagcauccaugcccagggu

SEQ ID NO: 448693 - RNA, 22 nt, Human
ggcaugggguguauguggcacg

SEQ ID NO: 448694 - RNA, 22 nt, Human
aggcugaggcuuuccuuggaga

SEQ ID NO: 448695 - RNA, 22 nt, Human
uguacacaauucuuaacauaca

SEQ ID NO: 448696 - RNA, 22 nt, Human
ucuucuccagugcuucugcaca

SEQ ID NO: 448697 - RNA, 22 nt, Human
acucugcuuauugcugcaggca

SEQ ID NO: 448698 - RNA, 22 nt, Human
cugugcaagcccaagauaaaac

SEQ ID NO: 448699 - RNA, 22 nt, Human
ggggcccagcaccccuccucgc

SEQ ID NO: 448700 - RNA, 22 nt, Human
cagucccaccaggaucgcucuu

SEQ ID NO: 448701 - RNA, 22 nt, Human
aucaaaguccaucagaagguag

SEQ ID NO: 448702 - RNA, 22 nt, Human
ucugcucuaguugcuuccugcc

SEQ ID NO: 448703 - RNA, 22 nt, Human
gcagaggcauuucugacgcugc

SEQ ID NO: 448704 - RNA, 22 nt, Human
ggcacugagaggcucuuccuaa

SEQ ID NO: 448705 - RNA, 22 nt, Human
ccagcuuuccugcgaguugauu

SEQ ID NO: 448706 - RNA, 22 nt, Human
acagguggcauaggcaguuuga

SEQ ID NO: 448707 - RNA, 22 nt, Human
aaaugcuguaacugauauucug

SEQ ID NO: 448708 - RNA, 22 nt, Human
ugaaggagcucaaugaugaugc

SEQ ID NO: 448709 - RNA, 22 nt, Human
auuauuuuaugugcggccugau

SEQ ID NO: 448710 - RNA, 22 nt, Human
ccuuucucuuugcugaucaugu

SEQ ID NO: 448711 - RNA, 22 nt, Human
ugggccacuugaaaguggaugu

SEQ ID NO: 448712 - RNA, 22 nt, Human
agugcugucccgacaacugagg

SEQ ID NO: 448713 - RNA, 22 nt, Human
agccacagucaaccuguccaua

SEQ ID NO: 448714 - RNA, 22 nt, Human
uggaggcaucagagugcuuggc

SEQ ID NO: 448715 - RNA, 22 nt, Human
gcaaaggcuucuuuuauucucc

SEQ ID NO: 448716 - RNA, 22 nt, Human
ucuguacaaaggcuauuuggag

SEQ ID NO: 448717 - RNA, 22 nt, Human
ugcagggagggcccagcaaucu

SEQ ID NO: 448718 - RNA, 22 nt, Human
aucaggauccaccuugagccug

SEQ ID NO: 448719 - RNA, 22 nt, Human
agagccugggaauuugcauguu

SEQ ID NO: 448720 - RNA, 22 nt, Human
acagagguguguguaggacagu

SEQ ID NO: 448721 - RNA, 19 nt, Human
acuuucuccaggaccuguu

SEQ ID NO: 448722 - RNA, 22 nt, Human
augggaggaugcucgggugcuc

SEQ ID NO: 448723 - RNA, 23 nt, Human
ugaaggccuggaggacgcguugu

SEQ ID NO: 448724 - RNA, 22 nt, Human
gcagcuuucuugcccuaaucuu

SEQ ID NO: 448725 - RNA, 22 nt, Human
caugaauauacauccugauggc

SEQ ID NO: 448726 - RNA, 22 nt, Human
ccuuuauucaauuaguccuaau

SEQ ID NO: 448727 - RNA, 23 nt, Human
ucagagaaguuguaggcugggga

SEQ ID NO: 448728 - RNA, 22 nt, Human
cauguacacucauguaacuaua

SEQ ID NO: 448729 - RNA, 22 nt, Human
cagguggggagaguguggagca

SEQ ID NO: 448730 - RNA, 22 nt, Human
uaaugcaguacugauauaaaca

SEQ ID NO: 448731 - RNA, 22 nt, Human
uaguuuuuucaacaaauggugc

SEQ ID NO: 448732 - RNA, 22 nt, Human
caggguccaucuuucaucacug

SEQ ID NO: 448733 - RNA, 20 nt, Human
gccugagcuauugccaggau

SEQ ID NO: 448734 - RNA, 22 nt, Human
ccuuggcccuagccucaggcaa

SEQ ID NO: 448735 - RNA, 22 nt, Human
gugcucuguguauuaggauguc

SEQ ID NO: 448736 - RNA, 22 nt, Human
uucauauaaauggaaucagaau

SEQ ID NO: 448737 - RNA, 22 nt, Human
ucaggcugcuggccagcaggcu

SEQ ID NO: 448738 - RNA, 19 nt, Human
uuugugaagaaaaugaugc

SEQ ID NO: 448739 - RNA, 18 nt, Human
ggaaaccacaggguucug

SEQ ID NO: 448740 - RNA, 22 nt, Human
ggacuggccggcgcugaggccc

SEQ ID NO: 448741 - RNA, 22 nt, Human
acaguaauauugaugcucguca

SEQ ID NO: 448742 - RNA, 23 nt, Human
aggcagugucucuuauccugucc

SEQ ID NO: 448743 - RNA, 22 nt, Human
acuccuggggcugccaucacag

SEQ ID NO: 448744 - RNA, 22 nt, Human
ucaaaugcggucauggcuuuua

SEQ ID NO: 448745 - RNA, 22 nt, Human
ucaucacauguguagucauccc

SEQ ID NO: 448746 - RNA, 22 nt, Human
augauucagcaauuuuauaucu

SEQ ID NO: 448747 - RNA, 22 nt, Human
aaaucagugcucauuugaaagg

SEQ ID NO: 448748 - RNA, 22 nt, Human
uccauuuuguagguaugcuaca

SEQ ID NO: 448749 - RNA, 22 nt, Human
cuuaauuucaaacugcuaguga

SEQ ID NO: 448750 - RNA, 22 nt, Human
uaaaucaguuucucuuauuggu

SEQ ID NO: 448751 - RNA, 22 nt, Human
uagcauuucacugaucuucacu

SEQ ID NO: 448752 - RNA, 22 nt, Human
cagagcuguuacuauucaugaa

SEQ ID NO: 448753 - RNA, 22 nt, Human
uuuuaucuucauuccuaucuac

SEQ ID NO: 448754 - RNA, 22 nt, Human
gucccuuggcucacaaacagcu

SEQ ID NO: 448755 - RNA, 23 nt, Human
cagaccuggcagucauccucaac

SEQ ID NO: 448756 - RNA, 22 nt, Human
auacauuagcucauaugauuaa

SEQ ID NO: 448757 - RNA, 22 nt, Human
uugaaucauuacaauagauaag

SEQ ID NO: 448758 - RNA, 22 nt, Human
aaaaaugcugugguagcugugu

SEQ ID NO: 448759 - RNA, 23 nt, Human
agaggccaacuucuugccccucc

SEQ ID NO: 448760 - RNA, 22 nt, Human
ccugggagcuguggaaaggcug

SEQ ID NO: 448761 - RNA, 22 nt, Human
ccccuuccgucucuugaguguc

SEQ ID NO: 448762 - RNA, 22 nt, Human
aucaguuuaacugucaagagcc

SEQ ID NO: 448763 - RNA, 20 nt, Human
ucucaggccccaguuuucuu

SEQ ID NO: 448764 - RNA, 22 nt, Human
ggcuucugaaaucucugugcgu

SEQ ID NO: 448765 - RNA, 22 nt, Human
aggucaaguuuagauagaguua

SEQ ID NO: 448766 - RNA, 22 nt, Human
guauuagguuggugcaaaauug

SEQ ID NO: 448767 - RNA, 22 nt, Human
auggacagugugaagcagauag

SEQ ID NO: 448768 - RNA, 22 nt, Human
cagcugccccuccagggcuggg

SEQ ID NO: 448769 - RNA, 18 nt, Human
uuuuacucauagcaggcc

SEQ ID NO: 448770 - RNA, 22 nt, Human
gcuccuggcuccaggcagccaa

SEQ ID NO: 448771 - RNA, 22 nt, Human
uggcucugagacacaggcucuc

SEQ ID NO: 448772 - RNA, 22 nt, Human
uacacuuuuuacuacagauucu

SEQ ID NO: 448773 - RNA, 22 nt, Human
uuucuggcagcgggacaggggu

SEQ ID NO: 448774 - RNA, 22 nt, Human
gcaccugcaggaugagccaggg

SEQ ID NO: 448775 - RNA, 22 nt, Human
ugaggcaggagaauggcgggaa

SEQ ID NO: 448776 - RNA, 22 nt, Human
aucagcaagcaugguuaggugu

SEQ ID NO: 448777 - RNA, 22 nt, Human
agccagaggccagccugccuca

SEQ ID NO: 448778 - RNA, 22 nt, Human
acaggugaccugcucauaugaa

SEQ ID NO: 448779 - RNA, 17 nt, Human
accagccucuccugggg

SEQ ID NO: 448780 - RNA, 22 nt, Human
cugagagcagggacuugagcca

SEQ ID NO: 448781 - RNA, 22 nt, Human
uugucuguccaggcaccccaag

SEQ ID NO: 448782 - RNA, 22 nt, Human
gcagggacgcagcacucuccgu

SEQ ID NO: 448783 - RNA, 21 nt, Human
ugcaggcaggcagagaugcug

SEQ ID NO: 448784 - RNA, 22 nt, Human
aagggcucugugcuugucccau

SEQ ID NO: 448785 - RNA, 22 nt, Human
cuguuuauacgacagguggagg

SEQ ID NO: 448786 - RNA, 22 nt, Human
caguggagagacuuuuacucuu

SEQ ID NO: 448787 - RNA, 22 nt, Human
ucccagaggcaguugguaacuu

SEQ ID NO: 448788 - RNA, 22 nt, Human
agcagggcaaagucaggcuaac

SEQ ID NO: 448789 - RNA, 22 nt, Human
gguccccagcaguggcugcuuc

SEQ ID NO: 448790 - RNA, 22 nt, Human
gagaaaauagcauguguaguau

SEQ ID NO: 448791 - RNA, 22 nt, Human
auggcccaggccuccuguggcu

SEQ ID NO: 448792 - RNA, 22 nt, Human
ggccucugaggacagccuuggc

SEQ ID NO: 448793 - RNA, 22 nt, Human
ucugccagaaguucugagagua

SEQ ID NO: 448794 - RNA, 22 nt, Human
ccucucauagucuguauccuuu

SEQ ID NO: 448795 - RNA, 22 nt, Human
aaaugaacucuuccugcauccc

SEQ ID NO: 448796 - RNA, 21 nt, Human
aggcuguccuuugccagcccu

SEQ ID NO: 448797 - RNA, 22 nt, Human
aaaugucuuugaguauuucugc

SEQ ID NO: 448798 - RNA, 22 nt, Human
aggaacugauuuauaacuuuag

SEQ ID NO: 448799 - RNA, 22 nt, Human
gccuggaggggccaggguggua

SEQ ID NO: 448800 - RNA, 22 nt, Human
cuggagccacuuuuuauccuuu

SEQ ID NO: 448801 - RNA, 22 nt, Human
accagcuguguccuggcugcag

SEQ ID NO: 448802 - RNA, 21 nt, Human
ucagcagcaucugccuagagu

SEQ ID NO: 448803 - RNA, 22 nt, Human
ugagcuucaaaauaugugaauc

SEQ ID NO: 448804 - RNA, 22 nt, Human
uggggcagaguaggauuuuggc

SEQ ID NO: 448805 - RNA, 22 nt, Human
agcagcugcagagggcuccccc

SEQ ID NO: 448806 - RNA, 22 nt, Human
gggcacuguguucagagugcag

SEQ ID NO: 448807 - RNA, 22 nt, Human
uggccuuguguuuuagagaaag

SEQ ID NO: 448808 - RNA, 22 nt, Human
gcagggcagcugaagcuaggug

SEQ ID NO: 448809 - RNA, 22 nt, Human
guuaauuuaguagaguccagau

SEQ ID NO: 448810 - RNA, 22 nt, Human
uuaauuuucucaucugugaaau

SEQ ID NO: 448811 - RNA, 22 nt, Human
gccugcagccucaagggcugag

SEQ ID NO: 448812 - RNA, 22 nt, Human
agcagcucugagaggccagcac

SEQ ID NO: 448813 - RNA, 22 nt, Human
ccagcuuuggaguguuguugcu

SEQ ID NO: 448814 - RNA, 22 nt, Human
cacucugcagcugaagggcugg

SEQ ID NO: 448815 - RNA, 22 nt, Human
aagggcuccaagagguagcugg

SEQ ID NO: 448816 - RNA, 22 nt, Human
uuccuuccgggcaccaggcacu

SEQ ID NO: 448817 - RNA, 22 nt, Human
gcaggccugacuguagggggca

SEQ ID NO: 448818 - RNA, 22 nt, Human
uuucuguuaggcaucauuuuaa

SEQ ID NO: 448819 - RNA, 22 nt, Human
augcccaaugucacaauuuuug

SEQ ID NO: 448820 - RNA, 22 nt, Human
uaaggcacgcauaagagggggc

SEQ ID NO: 448821 - RNA, 22 nt, Human
aagaauguggguggauaugaug

SEQ ID NO: 448822 - RNA, 22 nt, Human
cccucuacagggaagcgcuuuc

SEQ ID NO: 448823 - RNA, 22 nt, Human
ucgggcucgcucuccuagcgga

SEQ ID NO: 448824 - RNA, 22 nt, Human
gcucccugaaaagaacaaaguc

SEQ ID NO: 448825 - RNA, 22 nt, Human
agugccaggagcaaggagcucc

SEQ ID NO: 448826 - RNA, 22 nt, Human
ugaugaaacugagguuccaaga

SEQ ID NO: 448827 - RNA, 23 nt, Human
agggguggucaguacccgcagug

SEQ ID NO: 448828 - RNA, 22 nt, Human
agccugagugcuuaggacuguu

SEQ ID NO: 448829 - RNA, 22 nt, Human
cauuucuagggaucauaaagua

SEQ ID NO: 448830 - RNA, 22 nt, Human
gguguccucaugauuuucuaga

SEQ ID NO: 448831 - RNA, 22 nt, Human
ucucccaguccucugugcuuac

SEQ ID NO: 448832 - RNA, 22 nt, Human
ugacagaaauaguucuuaauuu

SEQ ID NO: 448833 - RNA, 22 nt, Human
uuuuccuucugauacuccauuu

SEQ ID NO: 448834 - RNA, 22 nt, Human
gguguccuugcagaaggcggcg

SEQ ID NO: 448835 - RNA, 20 nt, Human
aagggagaauaaugauugua

SEQ ID NO: 448836 - RNA, 22 nt, Human
gggguugguuuaaaugcuugag

SEQ ID NO: 448837 - RNA, 22 nt, Human
ggaggccaggguggguggaucg

SEQ ID NO: 448838 - RNA, 22 nt, Human
aguacuuuacuucuuacaguuu

SEQ ID NO: 448839 - RNA, 22 nt, Human
cagagcucagagcugccaggca

SEQ ID NO: 448840 - RNA, 22 nt, Human
caguuucuucaucaguuaagca

SEQ ID NO: 448841 - RNA, 21 nt, Human
auuuucauuaauucagugugg

SEQ ID NO: 448842 - RNA, 22 nt, Human
uguguauucagcaagcgaaaca

SEQ ID NO: 448843 - RNA, 22 nt, Human
uggcucaggggucuggcucugu

SEQ ID NO: 448844 - RNA, 22 nt, Human
gagggcuccucacauucucuau

SEQ ID NO: 448845 - RNA, 22 nt, Human
aucuggcuauuucuggucgggg

SEQ ID NO: 448846 - RNA, 22 nt, Human
auugucuucuggucuuaucuuu

SEQ ID NO: 448847 - RNA, 22 nt, Human
aaugucugcucuacucaggagg

SEQ ID NO: 448848 - RNA, 20 nt, Human
ggaagccagcauccuugagg

SEQ ID NO: 448849 - RNA, 22 nt, Human
cggcagcaaaggaagccagguc

SEQ ID NO: 448850 - RNA, 22 nt, Human
cggcuggggcuguccccaugac

SEQ ID NO: 448851 - RNA, 22 nt, Human
uucugugaaucuuuuuucccac

SEQ ID NO: 448852 - RNA, 22 nt, Human
cugaggcaugaaugugggcuuu

SEQ ID NO: 448853 - RNA, 22 nt, Human
agacucugauaagcaacucuug

SEQ ID NO: 448854 - RNA, 22 nt, Human
ggaggaagagguuguucucuca

SEQ ID NO: 448855 - RNA, 22 nt, Human
agacaacaccaaaugcuagugu

SEQ ID NO: 448856 - RNA, 22 nt, Human
accagggcaaauguuuguacuc

SEQ ID NO: 448857 - RNA, 22 nt, Human
uuuaaaaaacuagucugagucu

SEQ ID NO: 448858 - RNA, 22 nt, Human
ccuggaugauccaugucaugga

SEQ ID NO: 448859 - RNA, 22 nt, Human
gaaaugcagaaccugagaccau

SEQ ID NO: 448860 - RNA, 22 nt, Human
agaaaucuaagaugcucaagga

SEQ ID NO: 448861 - RNA, 21 nt, Human
uaaaugugagcagggcugggc

SEQ ID NO: 448862 - RNA, 22 nt, Human
acaguaauuaaaauggaucugc

SEQ ID NO: 448863 - RNA, 22 nt, Human
gaaaugugaccuacuuccuugu

SEQ ID NO: 448864 - RNA, 18 nt, Human
gugugcaguugcaggggu

SEQ ID NO: 448865 - RNA, 22 nt, Human
gccaggcaggccacgcuguguu

SEQ ID NO: 448866 - RNA, 22 nt, Human
aagacauuuauuugaaucaauu

SEQ ID NO: 448867 - RNA, 22 nt, Human
aagccucuggggccucaucugu

SEQ ID NO: 448868 - RNA, 23 nt, Human
aggagccaggaaccagcuucccc

SEQ ID NO: 448869 - RNA, 22 nt, Human
ugaagcaggaaccagcagcauu

SEQ ID NO: 448870 - RNA, 22 nt, Human
uggcagcuggagggcaauggcc

SEQ ID NO: 448871 - RNA, 23 nt, Human
agggcuccuuguugauuagcauu

SEQ ID NO: 448872 - RNA, 22 nt, Human
ucccuggagauaacuucuggga

SEQ ID NO: 448873 - RNA, 22 nt, Human
gggcugagagcuggaaucugag

SEQ ID NO: 448874 - RNA, 22 nt, Human
aguacaaaggcccuugauuacu

SEQ ID NO: 448875 - RNA, 22 nt, Human
uuauuuaauuuucucacucaga

SEQ ID NO: 448876 - RNA, 22 nt, Human
ggucccaguccucucccugcua

SEQ ID NO: 448877 - RNA, 22 nt, Human
cugcagaggccucgccuccucu

SEQ ID NO: 448878 - RNA, 22 nt, Human
agggcagcuggaagguggcuuc

SEQ ID NO: 448879 - RNA, 22 nt, Human
ccuucugcucccuggccagggc

SEQ ID NO: 448880 - RNA, 22 nt, Human
cugagcugaaacuugagaggcu

SEQ ID NO: 448881 - RNA, 22 nt, Human
accucugccaagaugugcuccc

SEQ ID NO: 448882 - RNA, 22 nt, Human
ccuggagggcgccgcacagucc

SEQ ID NO: 448883 - RNA, 22 nt, Human
gcuucuaucccuccacugcacu

SEQ ID NO: 448884 - RNA, 22 nt, Human
caaggccaaagggccacuguca

SEQ ID NO: 448885 - RNA, 22 nt, Human
acugucugcaaaacucauacuc

SEQ ID NO: 448886 - RNA, 22 nt, Human
cccagggaagggcuaccugagg

SEQ ID NO: 448887 - RNA, 20 nt, Human
ccugucugcaauggagguca

SEQ ID NO: 448888 - RNA, 22 nt, Human
gaugcacuugccccuccucaga

SEQ ID NO: 448889 - RNA, 22 nt, Human
uucuuucagaacacaagugauu

SEQ ID NO: 448890 - RNA, 22 nt, Human
cagcaggcucugaguggcugcc

SEQ ID NO: 448891 - RNA, 21 nt, Human
agagaagggacucuuccaguc

SEQ ID NO: 448892 - RNA, 22 nt, Human
ccugccugauuccaggauggcu

SEQ ID NO: 448893 - RNA, 20 nt, Human
uguuucuuuuaaugagcggc

SEQ ID NO: 448894 - RNA, 22 nt, Human
gagcuuuaccuuagguucuguu

SEQ ID NO: 448895 - RNA, 20 nt, Human
ucuggcucuuugcuccuccc

SEQ ID NO: 448896 - RNA, 22 nt, Human
gggcuaggcuuggccagcacug

SEQ ID NO: 448897 - RNA, 22 nt, Human
ccuccaggaacuugagagacac

SEQ ID NO: 448898 - RNA, 22 nt, Human
ccagcugggauuaagggaaaau

SEQ ID NO: 448899 - RNA, 22 nt, Human
uguaugcagggcuuguaugcag

SEQ ID NO: 448900 - RNA, 21 nt, Human
ccagcuccaggaccuuggauc

SEQ ID NO: 448901 - RNA, 22 nt, Human
ccuuugggugaauuccucucuu

SEQ ID NO: 448902 - RNA, 22 nt, Human
agggaaggagguuagaacccac

SEQ ID NO: 448903 - RNA, 22 nt, Human
ucagaggaccuuacugagaacc

SEQ ID NO: 448904 - RNA, 22 nt, Human
uccaggacuagcauuucugaua

SEQ ID NO: 448905 - RNA, 22 nt, Human
gccugcagaacugugaggcaau

SEQ ID NO: 448906 - RNA, 22 nt, Human
cuggaagggucuacuuagcaga

SEQ ID NO: 448907 - RNA, 22 nt, Human
uugcagagaucagcagguuuga

SEQ ID NO: 448908 - RNA, 22 nt, Human
cuguguggacugguugaggccc

SEQ ID NO: 448909 - RNA, 17 nt, Human
gagugcugguggagcuc

SEQ ID NO: 448910 - RNA, 20 nt, Human
uggcccuguuuucuccaggc

SEQ ID NO: 448911 - RNA, 22 nt, Human
uggaaagaaaguaaaggcguau

SEQ ID NO: 448912 - RNA, 22 nt, Human
ucagcaguguaguuuaucauuc

SEQ ID NO: 448913 - RNA, 22 nt, Human
caguuucucucauacauauuug

SEQ ID NO: 448914 - RNA, 22 nt, Human
uggcccuguggaggucagugag

SEQ ID NO: 448915 - RNA, 17 nt, Human
ugaggccugcaucagug

SEQ ID NO: 448916 - RNA, 22 nt, Human
uuacaacauauuuagcuugauu

SEQ ID NO: 448917 - RNA, 22 nt, Human
gcucuguguccacagcuggaaa

SEQ ID NO: 448918 - RNA, 22 nt, Human
ggcagucagugugguucauaaa

SEQ ID NO: 448919 - RNA, 22 nt, Human
cuuauaaaguccaucugaacaa

SEQ ID NO: 448920 - RNA, 18 nt, Human
cccacggugcuguagggc

SEQ ID NO: 448921 - RNA, 22 nt, Human
acucugccccgaguucugggaa

SEQ ID NO: 448922 - RNA, 21 nt, Human
aggcagcaggauccagggaca

SEQ ID NO: 448923 - RNA, 22 nt, Human
gaggucaauaauaugugcuuua

SEQ ID NO: 448924 - RNA, 23 nt, Human
gggagccaggaccucgcgcccca

SEQ ID NO: 448925 - RNA, 18 nt, Human
acauuucucucugcguga

SEQ ID NO: 448926 - RNA, 22 nt, Human
agugcagagaccuggucaggca

SEQ ID NO: 448927 - RNA, 22 nt, Human
aaacucuguagcuaaacauaau

SEQ ID NO: 448928 - RNA, 19 nt, Human
aagaagcaauaagcuguga

SEQ ID NO: 448929 - RNA, 22 nt, Human
uucaagauggcaccagugagug

SEQ ID NO: 448930 - RNA, 22 nt, Human
caggcaccccaggugagcacug

SEQ ID NO: 448931 - RNA, 22 nt, Human
uuacacaaacacauuccagaua

SEQ ID NO: 448932 - RNA, 22 nt, Human
cagaguaaggagcugucaaacg

SEQ ID NO: 448933 - RNA, 22 nt, Human
ccaggcauccauugcuuccucu

SEQ ID NO: 448934 - RNA, 22 nt, Human
uggagcaggacugcugcccuca

SEQ ID NO: 448935 - RNA, 22 nt, Human
aggcacugugcugaugucuuau

SEQ ID NO: 448936 - RNA, 22 nt, Human
uuccauauguauauagcuguua

SEQ ID NO: 448937 - RNA, 22 nt, Human
uucauugugaacacauucugcc

SEQ ID NO: 448938 - RNA, 22 nt, Human
ucuuugcaaauguuauuaucuu

SEQ ID NO: 448939 - RNA, 22 nt, Human
ccagggcacguugggacaguac

SEQ ID NO: 448940 - RNA, 22 nt, Human
ggagagugggagcaacuguugc

SEQ ID NO: 448941 - RNA, 22 nt, Human
ucaagucuugaugagacaaacc

SEQ ID NO: 448942 - RNA, 22 nt, Human
gugcagcagggggaagacagug

SEQ ID NO: 448943 - RNA, 22 nt, Human
gcaguggcuaggagucuggcgu

SEQ ID NO: 448944 - RNA, 22 nt, Human
auauacuuggagacuaucauug

SEQ ID NO: 448945 - RNA, 22 nt, Human
uuauuauagauuaugcaagauu

SEQ ID NO: 448946 - RNA, 22 nt, Human
gucucuggguuaagcagugcau

SEQ ID NO: 448947 - RNA, 22 nt, Human
gugcauuggugcgccacuucac

SEQ ID NO: 448948 - RNA, 21 nt, Human
ccagcagcucaaggaucucuu

SEQ ID NO: 448949 - RNA, 22 nt, Human
cuggccuucagacucggacuga

SEQ ID NO: 448950 - RNA, 22 nt, Human
cgcugggggaacagcgagggug

SEQ ID NO: 448951 - RNA, 22 nt, Human
ucagcuuugcaaguuagaaaau

SEQ ID NO: 448952 - RNA, 22 nt, Human
gugcagugacccuggagagcug

SEQ ID NO: 448953 - RNA, 22 nt, Human
gcagugaaucuggcaagaauuu

SEQ ID NO: 448954 - RNA, 22 nt, Human
aacaacuugcguucagagaugu

SEQ ID NO: 448955 - RNA, 23 nt, Human
cagaagcaccuguugacugcugc

SEQ ID NO: 448956 - RNA, 22 nt, Human
aguggcagagccaaguagagcc

SEQ ID NO: 448957 - RNA, 22 nt, Human
uauuuguauuucaugcaguaaa

SEQ ID NO: 448958 - RNA, 21 nt, Human
ggcccugguuacgccuccucu

SEQ ID NO: 448959 - RNA, 21 nt, Human
gcucccuggcugugugaccug

SEQ ID NO: 448960 - RNA, 21 nt, Human
uccauaagagaccaucuccua

SEQ ID NO: 448961 - RNA, 22 nt, Human
caguguuugcuuaaguuauaug

SEQ ID NO: 448962 - RNA, 22 nt, Human
cugcuuugcauagcugccagag

SEQ ID NO: 448963 - RNA, 20 nt, Human
gcagggcaucuuggccccca

SEQ ID NO: 448964 - RNA, 20 nt, Human
gggcaguggcgcuaucucag

SEQ ID NO: 448965 - RNA, 22 nt, Human
agagggagcccagucauagcug

SEQ ID NO: 448966 - RNA, 22 nt, Human
cugaggaggggccugagugaga

SEQ ID NO: 448967 - RNA, 22 nt, Human
agucucugucguagaucagcgu

SEQ ID NO: 448968 - RNA, 20 nt, Human
gccugcagagaaggucagag

SEQ ID NO: 448969 - RNA, 22 nt, Human
auuccauuguguaaggauaucg

SEQ ID NO: 448970 - RNA, 22 nt, Human
gcucuguccagcgugcacagaa

SEQ ID NO: 448971 - RNA, 22 nt, Human
cagucucucagcuuucagcugu

SEQ ID NO: 448972 - RNA, 22 nt, Human
aaaacucugcaguuaguuucua

SEQ ID NO: 448973 - RNA, 22 nt, Human
cuggcuuccaugcuguaguggc

SEQ ID NO: 448974 - RNA, 22 nt, Human
cagugaaguuuaaaguguagau

SEQ ID NO: 448975 - RNA, 22 nt, Human
gucaaguuuauccgcucauuca

SEQ ID NO: 448976 - RNA, 22 nt, Human
caggcuggagugaguguagugg

SEQ ID NO: 448977 - RNA, 22 nt, Human
gcccagcuccucugcagacccu

SEQ ID NO: 448978 - RNA, 22 nt, Human
cagguggaucucuaaggacuga

SEQ ID NO: 448979 - RNA, 22 nt, Human
cugaaggauguguggugggagu

SEQ ID NO: 448980 - RNA, 21 nt, Human
aacugcuggucuuuucugucu

SEQ ID NO: 448981 - RNA, 22 nt, Human
cuggcccauggugagcucuggg

SEQ ID NO: 448982 - RNA, 17 nt, Human
uuccaguuuaguauugu

SEQ ID NO: 448983 - RNA, 22 nt, Human
ccagggccucguguucugagug

SEQ ID NO: 448984 - RNA, 22 nt, Human
cugucuccagggcaggugcagg

SEQ ID NO: 448985 - RNA, 22 nt, Human
ggcuuuauguuuuucauguggu

SEQ ID NO: 448986 - RNA, 22 nt, Human
aaguucuacuguggguaaaaug

SEQ ID NO: 448987 - RNA, 22 nt, Human
ggcuguggcauuaggugaggcc

SEQ ID NO: 448988 - RNA, 22 nt, Human
cuacagacccaccuuggaagaa

SEQ ID NO: 448989 - RNA, 22 nt, Human
aggggugauuugggacaggaca

SEQ ID NO: 448990 - RNA, 22 nt, Human
auacuguuucucuucuacauga

SEQ ID NO: 448991 - RNA, 22 nt, Human
uagaaaucagguuuuuagaaag

SEQ ID NO: 448992 - RNA, 22 nt, Human
cugccucuccccagaguggccc

SEQ ID NO: 448993 - RNA, 22 nt, Human
aaguguauauaugacuuauaaa

SEQ ID NO: 448994 - RNA, 22 nt, Human
uucaggaggugagcaagaaggg

SEQ ID NO: 448995 - RNA, 22 nt, Human
aaugggaagccagaagacaagg

SEQ ID NO: 448996 - RNA, 22 nt, Human
agcccugggaggccagcuugua

SEQ ID NO: 448997 - RNA, 20 nt, Human
ugaugguucuuuccggguug

SEQ ID NO: 448998 - RNA, 22 nt, Human
cacagcagagggagccauugaa

SEQ ID NO: 448999 - RNA, 22 nt, Human
ccugagaccaaguugcagccau

SEQ ID NO: 449000 - RNA, 22 nt, Human
ucccagcccagauuugugugac

SEQ ID NO: 449001 - RNA, 22 nt, Human
ucccagagcucugacaccagcu

SEQ ID NO: 449002 - RNA, 20 nt, Human
ggaagcagagaacuguuuuc

SEQ ID NO: 449003 - RNA, 22 nt, Human
auuucccuccagggaaagcuua

SEQ ID NO: 449004 - RNA, 22 nt, Human
cagcuggguuuaguggggugug

SEQ ID NO: 449005 - RNA, 22 nt, Human
ugucucagaauggcucauaaua

SEQ ID NO: 449006 - RNA, 18 nt, Human
cagcugccagcucaugga

SEQ ID NO: 449007 - RNA, 22 nt, Human
aagaacaguugggaggugagcc

SEQ ID NO: 449008 - RNA, 22 nt, Human
cugcagaggucuugcugauggu

SEQ ID NO: 449009 - RNA, 22 nt, Human
cccugccuuguuggagccuaug

SEQ ID NO: 449010 - RNA, 21 nt, Human
ucccacucuaaauggacugaa

SEQ ID NO: 449011 - RNA, 22 nt, Human
aaggcagcaccgccuccugaaa

SEQ ID NO: 449012 - RNA, 22 nt, Human
ccuggcuguggcggugcucuca

SEQ ID NO: 449013 - RNA, 21 nt, Human
ggcagaaguagcauggacggg

SEQ ID NO: 449014 - RNA, 22 nt, Human
acaggugauucaggcucuggga

SEQ ID NO: 449015 - RNA, 22 nt, Human
aaagagcucacaguccacugga

SEQ ID NO: 449016 - RNA, 22 nt, Human
cugagcugggcucucuugaggg

SEQ ID NO: 449017 - RNA, 22 nt, Human
agccagugggauuagagccucu

SEQ ID NO: 449018 - RNA, 22 nt, Human
agacaucaaugaucagagguag

SEQ ID NO: 449019 - RNA, 21 nt, Human
aaacugaccuugccugagaca

SEQ ID NO: 449020 - RNA, 22 nt, Human
agacagcauggagcugauaaca

SEQ ID NO: 449021 - RNA, 22 nt, Human
guugaaagaugucuugguuccc

SEQ ID NO: 449022 - RNA, 23 nt, Human
aggcugcagaagaauagggucau

SEQ ID NO: 449023 - RNA, 22 nt, Human
cacaaaugacugaaacgacugu

SEQ ID NO: 449024 - RNA, 22 nt, Human
cagcugugcuagaagccacgaa

SEQ ID NO: 449025 - RNA, 22 nt, Human
aguggcagaagucacuggguag

SEQ ID NO: 449026 - RNA, 22 nt, Human
ugaagccaaucugccaggcaga

SEQ ID NO: 449027 - RNA, 21 nt, Human
uccaaaucccauucuguaguc

SEQ ID NO: 449028 - RNA, 22 nt, Human
cugagcugguggaagcaugcag

SEQ ID NO: 449029 - RNA, 22 nt, Human
aauaauuuugagagccuggaaa

SEQ ID NO: 449030 - RNA, 22 nt, Human
cugcucuguuucuuagcugggu

SEQ ID NO: 449031 - RNA, 22 nt, Human
gccugggagggcagcagugugg

SEQ ID NO: 449032 - RNA, 22 nt, Human
ucagcaauaugauaggcuuugu

SEQ ID NO: 449033 - RNA, 22 nt, Human
cugucuuuucauacuuucccuc

SEQ ID NO: 449034 - RNA, 19 nt, Human
ucuggcuccgccucuuagu

SEQ ID NO: 449035 - RNA, 22 nt, Human
cccucccaggaguggccagaga

SEQ ID NO: 449036 - RNA, 22 nt, Human
acauacuaugaauacauguguc

SEQ ID NO: 449037 - RNA, 22 nt, Human
caguuuuucaaaauuacaugau

SEQ ID NO: 449038 - RNA, 22 nt, Human
ccaaaauguuugaaugcaugug

SEQ ID NO: 449039 - RNA, 22 nt, Human
agggucagugaugagggagccc

SEQ ID NO: 449040 - RNA, 22 nt, Human
gucugagaaucuugcauaucau

SEQ ID NO: 449041 - RNA, 23 nt, Human
cagugcagggcaacucagacucc

SEQ ID NO: 449042 - RNA, 22 nt, Human
cugcugugagugguucuugccu

SEQ ID NO: 449043 - RNA, 22 nt, Human
gcuggagcugaguucccugggc

SEQ ID NO: 449044 - RNA, 22 nt, Human
gcugugugacugagagccuggc

SEQ ID NO: 449045 - RNA, 22 nt, Human
cauagagugauguaagguaugu

SEQ ID NO: 449046 - RNA, 22 nt, Human
uccagcuugccuggucuuuugg

SEQ ID NO: 449047 - RNA, 22 nt, Human
auuauauugaguauaaccagag

SEQ ID NO: 449048 - RNA, 22 nt, Human
cugggccugucagggcuuuuug

SEQ ID NO: 449049 - RNA, 22 nt, Human
ggccucuggcaggcaggcccuc

SEQ ID NO: 449050 - RNA, 22 nt, Human
ucagggcucaccagccucugcc

SEQ ID NO: 449051 - RNA, 23 nt, Human
uugcuuagagaccuccucaucag

SEQ ID NO: 449052 - RNA, 22 nt, Human
ccucagaugucuuaaggcacug

SEQ ID NO: 449053 - RNA, 22 nt, Human
gcuggccugcaaagcccggcug

SEQ ID NO: 449054 - RNA, 22 nt, Human
cagagcaggcccacugcccucc

SEQ ID NO: 449055 - RNA, 22 nt, Human
uuuuccucugagcuuugaauaa

SEQ ID NO: 449056 - RNA, 22 nt, Human
ccagcccuugcugaaggguggc

SEQ ID NO: 449057 - RNA, 22 nt, Human
cagggcucccaaauaucucuuc

SEQ ID NO: 449058 - RNA, 22 nt, Human
cugccuccugccgugcagcuuc

SEQ ID NO: 449059 - RNA, 22 nt, Human
gugugccaggaacuggcugcug

SEQ ID NO: 449060 - RNA, 22 nt, Human
cuuagaaauuguuacucauuca

SEQ ID NO: 449061 - RNA, 22 nt, Human
ggcagaggaaggaugaauucac

SEQ ID NO: 449062 - RNA, 22 nt, Human
uacaguauuaugagugauugaa

SEQ ID NO: 449063 - RNA, 20 nt, Human
gcaaggcacagugaggaggg

SEQ ID NO: 449064 - RNA, 22 nt, Human
ucucagagauguuagggaagag

SEQ ID NO: 449065 - RNA, 22 nt, Human
ucaggcuggaaugcaguggggc

SEQ ID NO: 449066 - RNA, 22 nt, Human
ugagcccaggaguuggaggcug

SEQ ID NO: 449067 - RNA, 22 nt, Human
acaggggaauuuacugucauua

SEQ ID NO: 449068 - RNA, 22 nt, Human
ucccuggacaacagacuucacu

SEQ ID NO: 449069 - RNA, 22 nt, Human
agauguguuucuaguuccugca

SEQ ID NO: 449070 - RNA, 22 nt, Human
cugggccuagaggaagcugaca

SEQ ID NO: 449071 - RNA, 22 nt, Human
uagccucucuccuccacaaccu

SEQ ID NO: 449072 - RNA, 22 nt, Human
gcucagggaacuuuuugcaggc

SEQ ID NO: 449073 - RNA, 22 nt, Human
cccuucagcugagugggacagc

SEQ ID NO: 449074 - RNA, 20 nt, Human
gggcagccucgggagugggu

SEQ ID NO: 449075 - RNA, 22 nt, Human
gggcugggcaugguguucccuc

SEQ ID NO: 449076 - RNA, 23 nt, Human
gugauuucagggaacagaaucag

SEQ ID NO: 449077 - RNA, 22 nt, Human
gcugggagucgcgucuguggcc

SEQ ID NO: 449078 - RNA, 22 nt, Human
ugcucugggcaacagccucccu

SEQ ID NO: 449079 - RNA, 22 nt, Human
gauuucuguaacacuucagaua

SEQ ID NO: 449080 - RNA, 22 nt, Human
gugaggggaguaaagccauguu

SEQ ID NO: 449081 - RNA, 21 nt, Human
agcagcugcaguuucuaucug

SEQ ID NO: 449082 - RNA, 22 nt, Human
cagaggcugaugugggaugggc

SEQ ID NO: 449083 - RNA, 22 nt, Human
agccaggaaugcaugcucugcu

SEQ ID NO: 449084 - RNA, 22 nt, Human
ccuguauuagguagacaacuau

SEQ ID NO: 449085 - RNA, 22 nt, Human
uuuagggaugucagaacaggga

SEQ ID NO: 449086 - RNA, 22 nt, Human
auucagaaauagaaaauuugau

SEQ ID NO: 449087 - RNA, 22 nt, Human
aguuuguaucaauuugcuuuau

SEQ ID NO: 449088 - RNA, 22 nt, Human
ucagagagcagaacuuuuuuac

SEQ ID NO: 449089 - RNA, 23 nt, Human
acaguuauagcugugaauaacau

SEQ ID NO: 449090 - RNA, 22 nt, Human
ggucccaggaagugcggcggcg

SEQ ID NO: 449091 - RNA, 22 nt, Human
uccugccuagcaggugaccuau

SEQ ID NO: 449092 - RNA, 22 nt, Human
caggcuugcugcuagagcacuu

SEQ ID NO: 449093 - RNA, 22 nt, Human
acccaggguagagugcaguggc

SEQ ID NO: 449094 - RNA, 22 nt, Human
uguacaaagaguauagcuuuga

SEQ ID NO: 449095 - RNA, 22 nt, Human
ugaaugauuugggugcauucag

SEQ ID NO: 449096 - RNA, 22 nt, Human
gcugucacaagcaucuggggca

SEQ ID NO: 449097 - RNA, 23 nt, Human
cuuucauugugguuucacagagc

SEQ ID NO: 449098 - RNA, 22 nt, Human
acagauuuaggacuguagcgau

SEQ ID NO: 449099 - RNA, 22 nt, Human
agaggccaugcuagaggccugg

SEQ ID NO: 449100 - RNA, 22 nt, Human
gggugggaucuguggagccuca

SEQ ID NO: 449101 - RNA, 22 nt, Human
uggagacugugcuaagggaguu

SEQ ID NO: 449102 - RNA, 22 nt, Human
ccagggcagugggagaaggugc

SEQ ID NO: 449103 - RNA, 22 nt, Human
uacauaauaaggggcauggugu

SEQ ID NO: 449104 - RNA, 22 nt, Human
gagggcuguggggcaugaccag

SEQ ID NO: 449105 - RNA, 22 nt, Human
ucagaggagaccaaggggaaua

SEQ ID NO: 449106 - RNA, 22 nt, Human
guggcugcagagggcacagcau

SEQ ID NO: 449107 - RNA, 22 nt, Human
auaaggcaucucucaguuagca

SEQ ID NO: 449108 - RNA, 22 nt, Human
uuuguuuacucauucauugaug

SEQ ID NO: 449109 - RNA, 22 nt, Human
aaagcagcagcaccugcauuuc

SEQ ID NO: 449110 - RNA, 22 nt, Human
ucaccugggagggcugugguag

SEQ ID NO: 449111 - RNA, 22 nt, Human
acaguggaaaugugggagggga

SEQ ID NO: 449112 - RNA, 22 nt, Human
ccaggaguuggagguugcagug

SEQ ID NO: 449113 - RNA, 21 nt, Human
agaagccaugugguggagaac

SEQ ID NO: 449114 - RNA, 22 nt, Human
gcuggguggaucggaggcucug

SEQ ID NO: 449115 - RNA, 22 nt, Human
ugggccugaguuugggaacugg

SEQ ID NO: 449116 - RNA, 20 nt, Human
uaggcagagcugugcagccu

SEQ ID NO: 449117 - RNA, 22 nt, Human
ggagaaggugcuggucacugug

SEQ ID NO: 449118 - RNA, 22 nt, Human
uuuucauuguaaaucaggaaac

SEQ ID NO: 449119 - RNA, 22 nt, Human
uguagaaauuaguaagaucaac

SEQ ID NO: 449120 - RNA, 22 nt, Human
acaugauucuugauaggcauug

SEQ ID NO: 449121 - RNA, 21 nt, Human
agagucugcauuucugacaag

SEQ ID NO: 449122 - RNA, 22 nt, Human
gucccagggaugcagacaugag

SEQ ID NO: 449123 - RNA, 22 nt, Human
uuuaguagaaugauacagggca

SEQ ID NO: 449124 - RNA, 22 nt, Human
uugcaccauuucacuuccauua

SEQ ID NO: 449125 - RNA, 22 nt, Human
ccaaggcuggagugcaguggcg

SEQ ID NO: 449126 - RNA, 22 nt, Human
guccucugggcuuugagcaguc

SEQ ID NO: 449127 - RNA, 22 nt, Human
acaguguccuuguggucccugu

SEQ ID NO: 449128 - RNA, 22 nt, Human
cuggccacaugugugcugagca

SEQ ID NO: 449129 - RNA, 22 nt, Human
guggugaagccccaucucugcu

SEQ ID NO: 449130 - RNA, 22 nt, Human
ucccaggguccucuucuggaau

SEQ ID NO: 449131 - RNA, 23 nt, Human
agaauuguaaauagaauauaccu

SEQ ID NO: 449132 - RNA, 22 nt, Human
ugucaguguauacauacaguau

SEQ ID NO: 449133 - RNA, 22 nt, Human
cccuggaggcggagcuugcagu

SEQ ID NO: 449134 - RNA, 19 nt, Human
aggguccagggagcggcuc

SEQ ID NO: 449135 - RNA, 22 nt, Human
ugaugcugcugggaguggugcu

SEQ ID NO: 449136 - RNA, 21 nt, Human
ugagccaggcugacggcugug

SEQ ID NO: 449137 - RNA, 22 nt, Human
uuacaucauugagacauacaua

SEQ ID NO: 449138 - RNA, 22 nt, Human
gaguccaguguuuaccaggggu

SEQ ID NO: 449139 - RNA, 22 nt, Human
gaggcagaaguugcagugagca

SEQ ID NO: 449140 - RNA, 22 nt, Human
cugcugugcaggugccuaugau

SEQ ID NO: 449141 - RNA, 22 nt, Human
ggcuggcacugaggagagcucu

SEQ ID NO: 449142 - RNA, 22 nt, Human
accauuuaauaaguauuuccau

SEQ ID NO: 449143 - RNA, 22 nt, Human
gcucuugucaaaaauuaguuga

SEQ ID NO: 449144 - RNA, 22 nt, Human
ggcuucuuccugugaacauguu

SEQ ID NO: 449145 - RNA, 22 nt, Human
uggcugagguaacuaugaauaa

SEQ ID NO: 449146 - RNA, 22 nt, Human
ggccaugguuggggaagacaug

SEQ ID NO: 449147 - RNA, 22 nt, Human
aaagaacaauguggaaucuccu

SEQ ID NO: 449148 - RNA, 18 nt, Human
uccugccugugccccagg

SEQ ID NO: 449149 - RNA, 22 nt, Human
acagcuuuuuacuaauagauug

SEQ ID NO: 449150 - RNA, 22 nt, Human
aggggcucaaagugugcaggga

SEQ ID NO: 449151 - RNA, 22 nt, Human
acacauaagccuaaucaucucc

SEQ ID NO: 449152 - RNA, 18 nt, Human
agcagggcauuuugccau

SEQ ID NO: 449153 - RNA, 22 nt, Human
ggcuagaacuuuacacuuugca

SEQ ID NO: 449154 - RNA, 22 nt, Human
uuuuuccuaagcaguggagcug

SEQ ID NO: 449155 - RNA, 22 nt, Human
gaugccugcauuucaggagagu

SEQ ID NO: 449156 - RNA, 22 nt, Human
gccggggcuggggagagacaug

SEQ ID NO: 449157 - RNA, 22 nt, Human
uccuguggcguuaucaugugau

SEQ ID NO: 449158 - RNA, 22 nt, Human
ucagaaugaaauuucuuucaga

SEQ ID NO: 449159 - RNA, 22 nt, Human
aaacuguaaagcaggugaguag

SEQ ID NO: 449160 - RNA, 22 nt, Human
uguuuuguuuaugagagcacag

SEQ ID NO: 449161 - RNA, 22 nt, Human
ugcugagcgcauccggcggccg

SEQ ID NO: 449162 - RNA, 17 nt, Human
ucucuuucccuuucugc

SEQ ID NO: 449163 - RNA, 22 nt, Human
cuguguggccucaagccagccu

SEQ ID NO: 449164 - RNA, 22 nt, Human
acaguggaaagaacauggauuu

SEQ ID NO: 449165 - RNA, 22 nt, Human
ugcaagggcuuagggggcugug

SEQ ID NO: 449166 - RNA, 21 nt, Human
aauuacagauggaauuacaga

SEQ ID NO: 449167 - RNA, 22 nt, Human
agcugcccccagggcugugcuu

SEQ ID NO: 449168 - RNA, 22 nt, Human
ccugggaagagcugacaggagg

SEQ ID NO: 449169 - RNA, 22 nt, Human
ggagaagggacagacucagcuu

SEQ ID NO: 449170 - RNA, 22 nt, Human
caggggcaagaaugcugucagc

SEQ ID NO: 449171 - RNA, 22 nt, Human
uacaguaaagcugcuaugaauu

SEQ ID NO: 449172 - RNA, 23 nt, Human
uacauuguggauggaguccuggg

SEQ ID NO: 449173 - RNA, 22 nt, Human
uauucacaaaaugagguccuca

SEQ ID NO: 449174 - RNA, 20 nt, Human
uaacagaaguagaagugggu

SEQ ID NO: 449175 - RNA, 22 nt, Human
agacucaagcagauaggaauua

SEQ ID NO: 449176 - RNA, 22 nt, Human
gcugcucugugacagccuccgg

SEQ ID NO: 449177 - RNA, 22 nt, Human
gguagcacauugcauuaggaga

SEQ ID NO: 449178 - RNA, 20 nt, Human
cagcaguggaugagaguuuu

SEQ ID NO: 449179 - RNA, 22 nt, Human
caggcacagaguuauucauuua

SEQ ID NO: 449180 - RNA, 22 nt, Human
uuacaaagcaggucagcugaaa

SEQ ID NO: 449181 - RNA, 22 nt, Human
caacuuuaugauugguuuguca

SEQ ID NO: 449182 - RNA, 22 nt, Human
uuugcauuucucguaaggaaac

SEQ ID NO: 449183 - RNA, 22 nt, Human
cucuuucaguucugauagucuc

SEQ ID NO: 449184 - RNA, 22 nt, Human
aucaggauguuuggcugucaua

SEQ ID NO: 449185 - RNA, 22 nt, Human
uguuauugagguuacuuauaag

SEQ ID NO: 449186 - RNA, 17 nt, Human
uuccuggaagucauucc

SEQ ID NO: 449187 - RNA, 22 nt, Human
uagagcugaguugacuccauuu

SEQ ID NO: 449188 - RNA, 22 nt, Human
aaguggagucccuacaaccagc

SEQ ID NO: 449189 - RNA, 22 nt, Human
uuggcugagagaggaaaagggc

SEQ ID NO: 449190 - RNA, 22 nt, Human
caguaggaaggaugcagaaaaa

SEQ ID NO: 449191 - RNA, 22 nt, Human
agacagcugcucgcagagcuau

SEQ ID NO: 449192 - RNA, 17 nt, Human
cagucgaggaggaccug

SEQ ID NO: 449193 - RNA, 22 nt, Human
caaaguucucggcucaaguccu

SEQ ID NO: 449194 - RNA, 22 nt, Human
ugggccuguugccugaguccau

SEQ ID NO: 449195 - RNA, 22 nt, Human
cuccagggggcauccacacagc

SEQ ID NO: 449196 - RNA, 22 nt, Human
gcucaggaaauaguuuaguguu

SEQ ID NO: 449197 - RNA, 22 nt, Human
uaggcugggaagaaagauucuc

SEQ ID NO: 449198 - RNA, 22 nt, Human
cguguggucccggcaaggcaag

SEQ ID NO: 449199 - RNA, 22 nt, Human
gggcacugcuggaggcucccug

SEQ ID NO: 449200 - RNA, 22 nt, Human
acaucuguuugagaaaaagaag

SEQ ID NO: 449201 - RNA, 21 nt, Human
uagaaaucagcuggugccucu

SEQ ID NO: 449202 - RNA, 22 nt, Human
agggcugccugcucugcauuga

SEQ ID NO: 449203 - RNA, 22 nt, Human
cagcagguauguuuguucagca

SEQ ID NO: 449204 - RNA, 21 nt, Human
gcuuccaagauggcaccuuga

SEQ ID NO: 449205 - RNA, 22 nt, Human
gccagaagacuggagucagcug

SEQ ID NO: 449206 - RNA, 23 nt, Human
gccaggcacaugguggacacgca

SEQ ID NO: 449207 - RNA, 22 nt, Human
ccaaagugcugggguuacaggc

SEQ ID NO: 449208 - RNA, 22 nt, Human
agggccaccucucuggguuccc

SEQ ID NO: 449209 - RNA, 22 nt, Human
ucacagugaugacgugggagca

SEQ ID NO: 449210 - RNA, 22 nt, Human
ccagagccuaagaucugauccu

SEQ ID NO: 449211 - RNA, 22 nt, Human
agagcagugcugaagaguaggg

SEQ ID NO: 449212 - RNA, 22 nt, Human
agcugcaguaaagcucuccagg

SEQ ID NO: 449213 - RNA, 22 nt, Human
cauaauuuuuuuaagucagaac

SEQ ID NO: 449214 - RNA, 22 nt, Human
cagcucaaguuucccaggucag

SEQ ID NO: 449215 - RNA, 22 nt, Human
uagaaacacagaucugguguca

SEQ ID NO: 449216 - RNA, 22 nt, Human
gcagggcaaugaucccgagagg

SEQ ID NO: 449217 - RNA, 22 nt, Human
uucacagaauggcaaguuaugg

SEQ ID NO: 449218 - RNA, 22 nt, Human
cugagcugcggcaggcaccugg

SEQ ID NO: 449219 - RNA, 22 nt, Human
aggaggugacagccugcaucug

SEQ ID NO: 449220 - RNA, 22 nt, Human
ucuggcucaaaauacguacucu

SEQ ID NO: 449221 - RNA, 22 nt, Human
uguauuuaagcuuuaccuaaaa

SEQ ID NO: 449222 - RNA, 22 nt, Human
ggagcagccacgucucagggca

SEQ ID NO: 449223 - RNA, 22 nt, Human
cuauuauuuccucaucuauaaa

SEQ ID NO: 449224 - RNA, 22 nt, Human
uccgccaggacugagggcccau

SEQ ID NO: 449225 - RNA, 22 nt, Human
aucaguuuaaaugggcuguugg

SEQ ID NO: 449226 - RNA, 22 nt, Human
gaggccugcagcguggucccug

SEQ ID NO: 449227 - RNA, 22 nt, Human
cucaggcuugggaggaggccca

SEQ ID NO: 449228 - RNA, 22 nt, Human
agggccagaaucccucagucua

SEQ ID NO: 449229 - RNA, 22 nt, Human
gccuaggagacaagcgugaaag

SEQ ID NO: 449230 - RNA, 22 nt, Human
uuuuccucuguauuugaaaugc

SEQ ID NO: 449231 - RNA, 22 nt, Human
ggcagaguugguggagucaguu

SEQ ID NO: 449232 - RNA, 22 nt, Human
gaggccaggguaccaucaacau

SEQ ID NO: 449233 - RNA, 22 nt, Human
ggcuuuauauuguuugagcaga

SEQ ID NO: 449234 - RNA, 19 nt, Human
agcagagcccugaagaucc

SEQ ID NO: 449235 - RNA, 22 nt, Human
agggaccugucaaugacaguua

SEQ ID NO: 449236 - RNA, 22 nt, Human
aagugaaacauguaucucuuua

SEQ ID NO: 449237 - RNA, 22 nt, Human
uaaagguaacaugaacugcuuu

SEQ ID NO: 449238 - RNA, 22 nt, Human
ccagaggaggggggucuuucug

SEQ ID NO: 449239 - RNA, 22 nt, Human
ucuccgaucacagguuuucaau

SEQ ID NO: 449240 - RNA, 22 nt, Human
gaauuaguguugaaaucagggc

SEQ ID NO: 449241 - RNA, 22 nt, Human
cugcucuggcguacucggcauc

SEQ ID NO: 449242 - RNA, 22 nt, Human
aggcacaggaaugucauccagu

SEQ ID NO: 449243 - RNA, 22 nt, Human
auguuacagaaagcaaagauga

SEQ ID NO: 449244 - RNA, 22 nt, Human
ggcuccacccugcuuccagaag

SEQ ID NO: 449245 - RNA, 22 nt, Human
ugcucuggagggugaagcuuuu

SEQ ID NO: 449246 - RNA, 22 nt, Human
aggagccaugagugacaucaca

SEQ ID NO: 449247 - RNA, 22 nt, Human
ggguccaggucuucaggcagag

SEQ ID NO: 449248 - RNA, 22 nt, Human
aggaccagccuccaggucucuu

SEQ ID NO: 449249 - RNA, 22 nt, Human
ccaggcugugguuuagauagag

SEQ ID NO: 449250 - RNA, 22 nt, Human
gugccugcagcaauccauggca

SEQ ID NO: 449251 - RNA, 22 nt, Human
ucuucuuccuccacagggccca

SEQ ID NO: 449252 - RNA, 22 nt, Human
agcugccaccucugccuuuggg

SEQ ID NO: 449253 - RNA, 22 nt, Human
aaaaacugcaauuacuuuuguc

SEQ ID NO: 449254 - RNA, 22 nt, Human
cagagcauuaaaaccagcucug

SEQ ID NO: 449255 - RNA, 22 nt, Human
uccaggcaucuguauuuuuuaa

SEQ ID NO: 449256 - RNA, 22 nt, Human
agccaggacguugcucagcucc

SEQ ID NO: 449257 - RNA, 22 nt, Human
agucagugaaggcauugcucaa

SEQ ID NO: 449258 - RNA, 21 nt, Human
ggccucugucauccugggaag

SEQ ID NO: 449259 - RNA, 22 nt, Human
uuugcauuuguucaaguauuga

SEQ ID NO: 449260 - RNA, 22 nt, Human
ugggaguguucuuggcuugcuu

SEQ ID NO: 449261 - RNA, 22 nt, Human
uucuaccagaccccagacuugu

SEQ ID NO: 449262 - RNA, 20 nt, Human
uggagcuguaaucuugucug

SEQ ID NO: 449263 - RNA, 22 nt, Human
ucuuguccuaagagcuggauuc

SEQ ID NO: 449264 - RNA, 22 nt, Human
gcccugggauuggguggaggcu

SEQ ID NO: 449265 - RNA, 22 nt, Human
caguggaggcucaagugugcuu

SEQ ID NO: 449266 - RNA, 18 nt, Human
ggcugugcguggaggcug

SEQ ID NO: 449267 - RNA, 22 nt, Human
agauaugacuagaagcucauuu

SEQ ID NO: 449268 - RNA, 22 nt, Human
cuuuuuccagcuucaggguggg

SEQ ID NO: 449269 - RNA, 19 nt, Human
uggaggagaggaaaaguca

SEQ ID NO: 449270 - RNA, 22 nt, Human
gccuggagggcucuagagaggc

SEQ ID NO: 449271 - RNA, 22 nt, Human
gggaccugaggagggguuucag

SEQ ID NO: 449272 - RNA, 22 nt, Human
caggcacuguguuaggcacugu

SEQ ID NO: 449273 - RNA, 22 nt, Human
aauguacaaaagucagccaacu

SEQ ID NO: 449274 - RNA, 22 nt, Human
ccugccagugaagcugacgggc

SEQ ID NO: 449275 - RNA, 22 nt, Human
accugcagguguuuccacacuu

SEQ ID NO: 449276 - RNA, 22 nt, Human
agugacugacaccuguaauccc

SEQ ID NO: 449277 - RNA, 22 nt, Human
cuggaauguagagacagcuuag

SEQ ID NO: 449278 - RNA, 22 nt, Human
auggacaggaacucccuuggca

SEQ ID NO: 449279 - RNA, 20 nt, Human
ucagugauuaucucugagug

SEQ ID NO: 449280 - RNA, 22 nt, Human
ucaaaugcugccuuugugugcc

SEQ ID NO: 449281 - RNA, 22 nt, Human
cauguuaaaauauacauucuga

SEQ ID NO: 449282 - RNA, 22 nt, Human
caaugugugcuuacaggccagu

SEQ ID NO: 449283 - RNA, 23 nt, Human
auucuucauuaucuucuagaaaa

SEQ ID NO: 449284 - RNA, 22 nt, Human
agaagcugacagaugcagcagg

SEQ ID NO: 449285 - RNA, 22 nt, Human
aagagcuggauggaaucuggga

SEQ ID NO: 449286 - RNA, 22 nt, Human
agcaggcuuguuaugucugaga

SEQ ID NO: 449287 - RNA, 22 nt, Human
cauacauugcucauucaguauc

SEQ ID NO: 449288 - RNA, 22 nt, Human
acaguggaggccauaugguccu

SEQ ID NO: 449289 - RNA, 22 nt, Human
ccaagggaaaccgagaggcugg

SEQ ID NO: 449290 - RNA, 22 nt, Human
cagggagcuggcuggcgugagu

SEQ ID NO: 449291 - RNA, 22 nt, Human
uccuucaaagcuccuagugagc

SEQ ID NO: 449292 - RNA, 22 nt, Human
guuccaggcaagugggauagga

SEQ ID NO: 449293 - RNA, 22 nt, Human
cugccuuugcccuugacacugu

SEQ ID NO: 449294 - RNA, 22 nt, Human
uuuuaucagcagggauaacaag

SEQ ID NO: 449295 - RNA, 22 nt, Human
acagugugaugggccugccuga

SEQ ID NO: 449296 - RNA, 22 nt, Human
uaaaggcuuuuagugaugguaa

SEQ ID NO: 449297 - RNA, 22 nt, Human
acagcuguauccccagagcuca

SEQ ID NO: 449298 - RNA, 22 nt, Human
uccaguggugguuugaagggca

SEQ ID NO: 449299 - RNA, 20 nt, Human
uguugauuggugucaucuca

SEQ ID NO: 449300 - RNA, 22 nt, Human
cagggcuggcuguggcaaucuc

SEQ ID NO: 449301 - RNA, 22 nt, Human
caggaaagguagucacaaugua

SEQ ID NO: 449302 - RNA, 22 nt, Human
ccaaggagcugcaggcacuugu

SEQ ID NO: 449303 - RNA, 22 nt, Human
auuuccuagccucucuugcagu

SEQ ID NO: 449304 - RNA, 22 nt, Human
uuccauaaaggugauaguauac

SEQ ID NO: 449305 - RNA, 22 nt, Human
cagggcuggcucaugaaaaguu

SEQ ID NO: 449306 - RNA, 22 nt, Human
auguuucaaauauauagaguug

SEQ ID NO: 449307 - RNA, 22 nt, Human
uucuguuuugcacagacuugaa

SEQ ID NO: 449308 - RNA, 22 nt, Human
ccucagagguguggcaucucug

SEQ ID NO: 449309 - RNA, 22 nt, Human
uauguuuuucaagugcacacua

SEQ ID NO: 449310 - RNA, 16 nt, Human
ugggaccuguggccaa

SEQ ID NO: 449311 - RNA, 21 nt, Human
uguucacauggagcagaaugu

SEQ ID NO: 449312 - RNA, 22 nt, Human
gcucccuccaugaggcagaccg

SEQ ID NO: 449313 - RNA, 20 nt, Human
ugcuccaucuaaagugauua

SEQ ID NO: 449314 - RNA, 22 nt, Human
acccagaggugucuagcaagcu

SEQ ID NO: 449315 - RNA, 22 nt, Human
ggagcugggacccugucaucug

SEQ ID NO: 449316 - RNA, 22 nt, Human
uggagccaaggccaguucucag

SEQ ID NO: 449317 - RNA, 22 nt, Human
ugcagucuuccagcugcacaaa

SEQ ID NO: 449318 - RNA, 22 nt, Human
aggugcagcugguggagucugg

SEQ ID NO: 449319 - RNA, 18 nt, Human
gugacagcugcuagcuca

SEQ ID NO: 449320 - RNA, 22 nt, Human
aagaaaagaaaccugaggcuuu

SEQ ID NO: 449321 - RNA, 22 nt, Human
gguaacaguauguagaguaaga

SEQ ID NO: 449322 - RNA, 22 nt, Human
acauauuuccaugcagcauguc

SEQ ID NO: 449323 - RNA, 22 nt, Human
agggucccgaaggagacagcaa

SEQ ID NO: 449324 - RNA, 22 nt, Human
gugucauuaaccaccaugcaaa

SEQ ID NO: 449325 - RNA, 22 nt, Human
gcucuguacgcaggaugagggg

SEQ ID NO: 449326 - RNA, 22 nt, Human
aaauugugagcuauagaucuag

SEQ ID NO: 449327 - RNA, 22 nt, Human
ccuuggagcggucagcacuggu

SEQ ID NO: 449328 - RNA, 22 nt, Human
gccagagcacaggcugguagua

SEQ ID NO: 449329 - RNA, 22 nt, Human
ugguggccaauucacagggcuc

SEQ ID NO: 449330 - RNA, 22 nt, Human
ggcaggcugcuugggucauguc

SEQ ID NO: 449331 - RNA, 23 nt, Human
aggcagcagguuguccaggguga

SEQ ID NO: 449332 - RNA, 22 nt, Human
acagcuguggccacuugcaucc

SEQ ID NO: 449333 - RNA, 22 nt, Human
ucagcauaucuugagcuucaug

SEQ ID NO: 449334 - RNA, 22 nt, Human
ggcucuggcguccaauggagcg

SEQ ID NO: 449335 - RNA, 22 nt, Human
agaaaugugaauuucauuuccu

SEQ ID NO: 449336 - RNA, 20 nt, Human
auugucagccuucagaggag

SEQ ID NO: 449337 - RNA, 22 nt, Human
ggacuccucuagaaguugaggc

SEQ ID NO: 449338 - RNA, 22 nt, Human
aaucuggcucagaagaagauga

SEQ ID NO: 449339 - RNA, 22 nt, Human
cacaguggcagguguggguugu

SEQ ID NO: 449340 - RNA, 22 nt, Human
gacugccagaaugugaggccug

SEQ ID NO: 449341 - RNA, 22 nt, Human
auauuucaugggguuccauacu

SEQ ID NO: 449342 - RNA, 22 nt, Human
ccagcuuuucuuaucauuauaa

SEQ ID NO: 449343 - RNA, 22 nt, Human
uuagggcuuuucugaauaggcc

SEQ ID NO: 449344 - RNA, 22 nt, Human
ggcucugcuucagaaggcucau

SEQ ID NO: 449345 - RNA, 22 nt, Human
uucuuguauguaugcaaaauca

SEQ ID NO: 449346 - RNA, 20 nt, Human
agggucagagagcgugagug

SEQ ID NO: 449347 - RNA, 22 nt, Human
accacccucagcagagcugaaa

SEQ ID NO: 449348 - RNA, 22 nt, Human
uccauugucuuugguccuagcc

SEQ ID NO: 449349 - RNA, 22 nt, Human
agagcaggcauaaagcuuugaa

SEQ ID NO: 449350 - RNA, 22 nt, Human
agcugcugagagucugccgggc

SEQ ID NO: 449351 - RNA, 22 nt, Human
aaagggagcauggcugcaggga

SEQ ID NO: 449352 - RNA, 22 nt, Human
gcugcccaggguggagccggcu

SEQ ID NO: 449353 - RNA, 22 nt, Human
aagcugcccaagacugaagcau

SEQ ID NO: 449354 - RNA, 22 nt, Human
ggagaggcgaugagucacagcc

SEQ ID NO: 449355 - RNA, 22 nt, Human
aagaguuuucuauaaucuuggc

SEQ ID NO: 449356 - RNA, 22 nt, Human
ggaggugggagacauaggcggc

SEQ ID NO: 449357 - RNA, 22 nt, Human
cugccugcugccuguggagggu

SEQ ID NO: 449358 - RNA, 22 nt, Human
guguuuccucuagaagccaugg

SEQ ID NO: 449359 - RNA, 22 nt, Human
cuuuggaacauacugcugagcu

SEQ ID NO: 449360 - RNA, 22 nt, Human
uaaaugcaguuaguacuugcca

SEQ ID NO: 449361 - RNA, 22 nt, Human
cugaggcuggggaagggaagug

SEQ ID NO: 449362 - RNA, 22 nt, Human
uaaggccagccagcaaaucugu

SEQ ID NO: 449363 - RNA, 22 nt, Human
ugccugggagugaccaagacuc

SEQ ID NO: 449364 - RNA, 22 nt, Human
cuggccugcugggugagguccu

SEQ ID NO: 449365 - RNA, 22 nt, Human
ugagcugggaguggugaugagg

SEQ ID NO: 449366 - RNA, 22 nt, Human
auaaauggcuuucauuccuagg

SEQ ID NO: 449367 - RNA, 22 nt, Human
agccacagucugaugccugaga

SEQ ID NO: 449368 - RNA, 22 nt, Human
gagccagccuucuucugagguc

SEQ ID NO: 449369 - RNA, 18 nt, Human
ccuggaccugucuccuuu

SEQ ID NO: 449370 - RNA, 22 nt, Human
uccagcucaggguuggcucaag

SEQ ID NO: 449371 - RNA, 22 nt, Human
guuuccauggcucuguuaaugg

SEQ ID NO: 449372 - RNA, 22 nt, Human
gguggagcuggaccaggagagg

SEQ ID NO: 449373 - RNA, 22 nt, Human
uggcaucucaaacaggcagauu

SEQ ID NO: 449374 - RNA, 22 nt, Human
guggccuggauagacuccaucu

SEQ ID NO: 449375 - RNA, 22 nt, Human
cacagccuugagcgaggacaag

SEQ ID NO: 449376 - RNA, 22 nt, Human
gaggggcucuuuaauaguaaca

SEQ ID NO: 449377 - RNA, 22 nt, Human
auuguacaaugccuggaacauu

SEQ ID NO: 449378 - RNA, 22 nt, Human
ggaaaaggccauuguuucucug

SEQ ID NO: 449379 - RNA, 22 nt, Human
agccuggagguaaugaggaaac

SEQ ID NO: 449380 - RNA, 22 nt, Human
uguggccucaaggcugcccuca

SEQ ID NO: 449381 - RNA, 22 nt, Human
acucagaggcagcugcucaccc

SEQ ID NO: 449382 - RNA, 22 nt, Human
aaaaaugugaccacaggguguu

SEQ ID NO: 449383 - RNA, 22 nt, Human
agagcccuuucuccaggcaccu

SEQ ID NO: 449384 - RNA, 22 nt, Human
agagcuggaaucagaccucagg

SEQ ID NO: 449385 - RNA, 22 nt, Human
accuuuuuucagaacucuaaag

SEQ ID NO: 449386 - RNA, 22 nt, Human
ugccucugguuaucugguaccu

SEQ ID NO: 449387 - RNA, 22 nt, Human
ggcaggugaccuggccucccag

SEQ ID NO: 449388 - RNA, 22 nt, Human
uuuguuuagaaagagauuggug

SEQ ID NO: 449389 - RNA, 22 nt, Human
cacugaaggcugcagcucagcc

SEQ ID NO: 449390 - RNA, 22 nt, Human
gagaggaguaggcugauggugc

SEQ ID NO: 449391 - RNA, 23 nt, Human
cacuccuguuucuaagccagcau

SEQ ID NO: 449392 - RNA, 22 nt, Human
uauguacacacacaugcaugua

SEQ ID NO: 449393 - RNA, 22 nt, Human
cgcauacauagaaacacacaga

SEQ ID NO: 449394 - RNA, 22 nt, Human
cuuuucaugagucuguuauggg

SEQ ID NO: 449395 - RNA, 22 nt, Human
gaugcagaaaguagacaccauc

SEQ ID NO: 449396 - RNA, 22 nt, Human
auuuccuauagauauggugagu

SEQ ID NO: 449397 - RNA, 22 nt, Human
aaguucaaggcucuagaguucc

SEQ ID NO: 449398 - RNA, 22 nt, Human
agugugugcaugcauucgugca

SEQ ID NO: 449399 - RNA, 22 nt, Human
ccagcuuucauaucaugaggua

SEQ ID NO: 449400 - RNA, 22 nt, Human
agacucaagacugcagaagacg

SEQ ID NO: 449401 - RNA, 22 nt, Human
gagguggccucaagcagucuuc

SEQ ID NO: 449402 - RNA, 22 nt, Human
ucuguucuauuggucuaugugu

SEQ ID NO: 449403 - RNA, 22 nt, Human
aacagcaauagcacuauucauu

SEQ ID NO: 449404 - RNA, 22 nt, Human
augucuuucaaauucugccuag

SEQ ID NO: 449405 - RNA, 22 nt, Human
cggcuggugucgggcacagcaa

SEQ ID NO: 449406 - RNA, 21 nt, Human
uauuugcugccaucuuugagg

SEQ ID NO: 449407 - RNA, 22 nt, Human
gccugagaaggacacagcaggu

SEQ ID NO: 449408 - RNA, 22 nt, Human
gcuggcagaagagcugguucaa

SEQ ID NO: 449409 - RNA, 22 nt, Human
ucucugaguucuccuccagccc

SEQ ID NO: 449410 - RNA, 22 nt, Human
uuuuuccuuggaugugucucuc

SEQ ID NO: 449411 - RNA, 22 nt, Human
gcucagccgaacuucagagcag

SEQ ID NO: 449412 - RNA, 22 nt, Human
aggaggcugguucaggccauau

SEQ ID NO: 449413 - RNA, 22 nt, Human
cagaggcugggaccucaggcau

SEQ ID NO: 449414 - RNA, 22 nt, Human
gccuucaguaguauccucauga

SEQ ID NO: 449415 - RNA, 22 nt, Human
auuguggcuagacagucacaau

SEQ ID NO: 449416 - RNA, 22 nt, Human
aggcgcaggguuuggacccagg

SEQ ID NO: 449417 - RNA, 22 nt, Human
uagaaaagauaacauucugugc

SEQ ID NO: 449418 - RNA, 22 nt, Human
ccugagccugaguggugcaggg

SEQ ID NO: 449419 - RNA, 22 nt, Human
cagcaggcugcgauugcucauu

SEQ ID NO: 449420 - RNA, 22 nt, Human
aucagcaagauguaauuucuau

SEQ ID NO: 449421 - RNA, 22 nt, Human
uuccucagccaaggcugggauc

SEQ ID NO: 449422 - RNA, 22 nt, Human
caagggcagaggcagggccccg

SEQ ID NO: 449423 - RNA, 22 nt, Human
ucaaaggcgguccaggaauaaa

SEQ ID NO: 449424 - RNA, 22 nt, Human
acccaggacucucuuccaguag

SEQ ID NO: 449425 - RNA, 22 nt, Human
gaaaaugugccuuuggguauug

SEQ ID NO: 449426 - RNA, 22 nt, Human
gauucugagcugguguuuuacg

SEQ ID NO: 449427 - RNA, 22 nt, Human
aagccagggauuccugagggag

SEQ ID NO: 449428 - RNA, 22 nt, Human
ggcuucagugagcugagcucac

SEQ ID NO: 449429 - RNA, 22 nt, Human
gcacagggaggcuggccuggcc

SEQ ID NO: 449430 - RNA, 22 nt, Human
gcagagcagcaaauggaaagga

SEQ ID NO: 449431 - RNA, 22 nt, Human
ccucugaggucauggacuuggc

SEQ ID NO: 449432 - RNA, 22 nt, Human
caguccaggccuggaggagcca

SEQ ID NO: 449433 - RNA, 22 nt, Human
cagcugugcugauugcucagua

SEQ ID NO: 449434 - RNA, 22 nt, Human
auuuaucaccaguuagcugacu

SEQ ID NO: 449435 - RNA, 22 nt, Human
ccagcucuuggugcacuuacau

SEQ ID NO: 449436 - RNA, 22 nt, Human
caggugggagcggagacugauu

SEQ ID NO: 449437 - RNA, 18 nt, Human
gugccaggaggcgcagcc

SEQ ID NO: 449438 - RNA, 22 nt, Human
accagagcuggcucugagcacc

SEQ ID NO: 449439 - RNA, 22 nt, Human
ugaggcagcaauuguauuguau

SEQ ID NO: 449440 - RNA, 22 nt, Human
ggccugagcagacagcaugaug

SEQ ID NO: 449441 - RNA, 22 nt, Human
gggagaagaaugugucaauugu

SEQ ID NO: 449442 - RNA, 22 nt, Human
gcucccaccaggcagaccuacc

SEQ ID NO: 449443 - RNA, 22 nt, Human
ggagaggcuuggcccagccugg

SEQ ID NO: 449444 - RNA, 22 nt, Human
gcagcugaagcugcaguuccag

SEQ ID NO: 449445 - RNA, 22 nt, Human
uugguuuagagagugugguuac

SEQ ID NO: 449446 - RNA, 22 nt, Human
cguuggagacacuugaggacuu

SEQ ID NO: 449447 - RNA, 22 nt, Human
ccucagggaggccucuguggcu

SEQ ID NO: 449448 - RNA, 22 nt, Human
gaguccuucuggcuggcaggau

SEQ ID NO: 449449 - RNA, 22 nt, Human
uccaguucuaggucacucucug

SEQ ID NO: 449450 - RNA, 22 nt, Human
gcugcucugcuguguaagcagg

SEQ ID NO: 449451 - RNA, 22 nt, Human
uuccucagccagcacuuagggg

SEQ ID NO: 449452 - RNA, 22 nt, Human
aggcugagaaagugggaagaug

SEQ ID NO: 449453 - RNA, 22 nt, Human
gagcuuggugaugccuccuggu

SEQ ID NO: 449454 - RNA, 22 nt, Human
uccaggaggccucauuuccugu

SEQ ID NO: 449455 - RNA, 22 nt, Human
ccaggguggcguagaugcuggg

SEQ ID NO: 449456 - RNA, 22 nt, Human
gguuucaacuaaaucaagaagg

SEQ ID NO: 449457 - RNA, 22 nt, Human
gacccagcuaaccaggugggga

SEQ ID NO: 449458 - RNA, 22 nt, Human
uagaggugacacugagaccaua

SEQ ID NO: 449459 - RNA, 22 nt, Human
ucucaguguuaucuaucugccu

SEQ ID NO: 449460 - RNA, 22 nt, Human
guccuuugaaggcaaaaggaga

SEQ ID NO: 449461 - RNA, 22 nt, Human
guucagggagggacagaugaag

SEQ ID NO: 449462 - RNA, 21 nt, Human
cugaggcagcacagcuaguca

SEQ ID NO: 449463 - RNA, 23 nt, Human
uauuagggccaggacuggcaaau

SEQ ID NO: 449464 - RNA, 22 nt, Human
ucacagggcauuauggcuccag

SEQ ID NO: 449465 - RNA, 22 nt, Human
ccaaagugcugagauuacaggu

SEQ ID NO: 449466 - RNA, 22 nt, Human
ucuucuuccucauuuauacaua

SEQ ID NO: 449467 - RNA, 22 nt, Human
ggggaccuggccacccauccuu

SEQ ID NO: 449468 - RNA, 22 nt, Human
cuccaguaucuguaggaaaagg

SEQ ID NO: 449469 - RNA, 22 nt, Human
ugcauaaacuucucugguguga

SEQ ID NO: 449470 - RNA, 22 nt, Human
gcugcucuggcucugcaguguc

SEQ ID NO: 449471 - RNA, 22 nt, Human
cucagaguucuccugggaggug

SEQ ID NO: 449472 - RNA, 22 nt, Human
agggucagagucaggugcagua

SEQ ID NO: 449473 - RNA, 20 nt, Human
ucagguagaucuuugagguc

SEQ ID NO: 449474 - RNA, 22 nt, Human
cagggcagagccaggauuucaa

SEQ ID NO: 449475 - RNA, 22 nt, Human
uagcuuuaggaugguucucuug

SEQ ID NO: 449476 - RNA, 22 nt, Human
ucauuuucacacauaaauagca

SEQ ID NO: 449477 - RNA, 22 nt, Human
gcucaggaaacagcagggcuug

SEQ ID NO: 449478 - RNA, 18 nt, Human
uguuuauuuuucucuuac

SEQ ID NO: 449479 - RNA, 22 nt, Human
ugcacacacucugcauauacuu

SEQ ID NO: 449480 - RNA, 22 nt, Human
augcuguguuugagaaccuagg

SEQ ID NO: 449481 - RNA, 17 nt, Human
ggccuugggcugcucuu

SEQ ID NO: 449482 - RNA, 22 nt, Human
acagagcuguacaugugccaug

SEQ ID NO: 449483 - RNA, 22 nt, Human
ucauuucuccgaccugcugucc

SEQ ID NO: 449484 - RNA, 22 nt, Human
caggguggaagcuguagagugg

SEQ ID NO: 449485 - RNA, 20 nt, Human
ugccagggccagcagaggcu

SEQ ID NO: 449486 - RNA, 22 nt, Human
acaguucccgucuugcacagcu

SEQ ID NO: 449487 - RNA, 22 nt, Human
aggcuucagaugaccuuagcau

SEQ ID NO: 449488 - RNA, 22 nt, Human
aaugaacacagcccucuacuuu

SEQ ID NO: 449489 - RNA, 22 nt, Human
uguaggauuuucaccagaccuu

SEQ ID NO: 449490 - RNA, 23 nt, Human
guuuucaacacaauaaauguaac

SEQ ID NO: 449491 - RNA, 22 nt, Human
gaggcucauugcauugugcauu

SEQ ID NO: 449492 - RNA, 19 nt, Human
ucaguuuuagucaucaguu

SEQ ID NO: 449493 - RNA, 21 nt, Human
aaagugguaaggauuauuuug

SEQ ID NO: 449494 - RNA, 22 nt, Human
uuuuccucugcaauaaaagcag

SEQ ID NO: 449495 - RNA, 22 nt, Human
cugcuuuggcucagugacauca

SEQ ID NO: 449496 - RNA, 22 nt, Human
cgcugccaggauccccugccgg

SEQ ID NO: 449497 - RNA, 22 nt, Human
cagaagaguagcugaacaaguu

SEQ ID NO: 449498 - RNA, 22 nt, Human
ugcaauaaguuguguuaucacu

SEQ ID NO: 449499 - RNA, 22 nt, Human
acacaguaugaaaagucuaguu

SEQ ID NO: 449500 - RNA, 22 nt, Human
gaagaagguggcccagggguag

SEQ ID NO: 449501 - RNA, 22 nt, Human
ggguguguuccuaaggaaacca

SEQ ID NO: 449502 - RNA, 22 nt, Human
cugagcuuggccaggaaugaau

SEQ ID NO: 449503 - RNA, 22 nt, Human
auucaguucuaaggucagugcc

SEQ ID NO: 449504 - RNA, 22 nt, Human
caugcacaaagguaagaugcgu

SEQ ID NO: 449505 - RNA, 20 nt, Human
cccuggccuguuucaugccc

SEQ ID NO: 449506 - RNA, 22 nt, Human
ccaggccucuggcugcuuaguc

SEQ ID NO: 449507 - RNA, 22 nt, Human
gcagacuguaucaaugucagua

SEQ ID NO: 449508 - RNA, 22 nt, Human
agcaccugcuuaaugugcagug

SEQ ID NO: 449509 - RNA, 17 nt, Human
auuuccucagggcugag

SEQ ID NO: 449510 - RNA, 22 nt, Human
auggagacgcaagggaccuagg

SEQ ID NO: 449511 - RNA, 22 nt, Human
uggggguguccuggugcacaca

SEQ ID NO: 449512 - RNA, 22 nt, Human
gggaugucacugugccuggcac

SEQ ID NO: 449513 - RNA, 22 nt, Human
uuuccuuccaaaugcccgggag

SEQ ID NO: 449514 - RNA, 22 nt, Human
ggagcuggucagccuugagcau

SEQ ID NO: 449515 - RNA, 21 nt, Human
uuucugaaggcaacaucuauc

SEQ ID NO: 449516 - RNA, 22 nt, Human
cugucaguaggcucccaucauu

SEQ ID NO: 449517 - RNA, 22 nt, Human
ugcuuuaucugacuuggcgcug

SEQ ID NO: 449518 - RNA, 22 nt, Human
agggcaugcuggaggagagaca

SEQ ID NO: 449519 - RNA, 22 nt, Human
ucacauuuguucuugaaucuaa

SEQ ID NO: 449520 - RNA, 22 nt, Human
ccuuagagaguacugggcugcc

SEQ ID NO: 449521 - RNA, 21 nt, Human
agccaggcaagcacccccacu

SEQ ID NO: 449522 - RNA, 22 nt, Human
ccggggacuuaaagugaaggaa

SEQ ID NO: 449523 - RNA, 22 nt, Human
agggcgaggagacggaggcaca

SEQ ID NO: 449524 - RNA, 22 nt, Human
uuccaguugguagaauguaagg

SEQ ID NO: 449525 - RNA, 19 nt, Human
gggcuccuugggccucucu

SEQ ID NO: 449526 - RNA, 22 nt, Human
gcagggugauagugaggcucag

SEQ ID NO: 449527 - RNA, 22 nt, Human
ucacauuuuccuugguaucugu

SEQ ID NO: 449528 - RNA, 22 nt, Human
cuggcagcauggagccugugcu

SEQ ID NO: 449529 - RNA, 22 nt, Human
caaauaucuuuggcaaagagaa

SEQ ID NO: 449530 - RNA, 22 nt, Human
gggcuugcugauuugggcagga

SEQ ID NO: 449531 - RNA, 22 nt, Human
uggcagaguucgcugugccuuu

SEQ ID NO: 449532 - RNA, 22 nt, Human
cagugcaugaaacaauaugcag

SEQ ID NO: 449533 - RNA, 20 nt, Human
agcagcuguguuuucauccu

SEQ ID NO: 449534 - RNA, 22 nt, Human
aaggucauuuuuuccucuguug

SEQ ID NO: 449535 - RNA, 22 nt, Human
gaggccuggagccgccuaggcg

SEQ ID NO: 449536 - RNA, 22 nt, Human
agccaaggacacggagccuccu

SEQ ID NO: 449537 - RNA, 22 nt, Human
augacacaauuuuagagcugaa

SEQ ID NO: 449538 - RNA, 22 nt, Human
cucccaagcugugcugaacugu

SEQ ID NO: 449539 - RNA, 22 nt, Human
uccucuggcccagcugccucug

SEQ ID NO: 449540 - RNA, 22 nt, Human
ccucacaguuuggcuaacugug

SEQ ID NO: 449541 - RNA, 22 nt, Human
uucacaggugacuggggauaac

SEQ ID NO: 449542 - RNA, 22 nt, Human
cacagcuucuccuugauaucgc

SEQ ID NO: 449543 - RNA, 19 nt, Human
cugcucaggucagucuguc

SEQ ID NO: 449544 - RNA, 22 nt, Human
uacauuaacuuacguccacaug

SEQ ID NO: 449545 - RNA, 22 nt, Human
acauuguauaaugauuaucaca

SEQ ID NO: 449546 - RNA, 22 nt, Human
cguguacagucuaucuuuuuuc

SEQ ID NO: 449547 - RNA, 22 nt, Human
acagaagagcacauuuaguaug

SEQ ID NO: 449548 - RNA, 22 nt, Human
guauuuuauggcaugcaguggc

SEQ ID NO: 449549 - RNA, 22 nt, Human
gcccacacaccagcucaggagg

SEQ ID NO: 449550 - RNA, 20 nt, Human
aucagcaacugccacucagu

SEQ ID NO: 449551 - RNA, 22 nt, Human
gugguaauuuaauccuacacug

SEQ ID NO: 449552 - RNA, 22 nt, Human
aggcaguguguagcuggaagag

SEQ ID NO: 449553 - RNA, 22 nt, Human
ucacugcaaggaggcuucucaa

SEQ ID NO: 449554 - RNA, 22 nt, Human
ggcugagcguggcugccguggg

SEQ ID NO: 449555 - RNA, 22 nt, Human
caggguggaauggaaugcuggc

SEQ ID NO: 449556 - RNA, 22 nt, Human
ucaacagaagugauagcuauua

SEQ ID NO: 449557 - RNA, 22 nt, Human
aaagucugagcagaauuucuca

SEQ ID NO: 449558 - RNA, 22 nt, Human
cugugggcugaaagugcucccg

SEQ ID NO: 449559 - RNA, 20 nt, Human
accagguggcugaugacacc

SEQ ID NO: 449560 - RNA, 22 nt, Human
ucaguuuuucuauacuuuguag

SEQ ID NO: 449561 - RNA, 21 nt, Human
acaggcuuuagaaaaugacuc

SEQ ID NO: 449562 - RNA, 22 nt, Human
ccugugugcacacgaggccaug

SEQ ID NO: 449563 - RNA, 22 nt, Human
acagacauuuucuguauugccu

SEQ ID NO: 449564 - RNA, 22 nt, Human
ggagcagacauaaccuuacaga

SEQ ID NO: 449565 - RNA, 21 nt, Human
aagagcuggaucaaggauaag

SEQ ID NO: 449566 - RNA, 22 nt, Human
aaacaaguguaaacuagucugu

SEQ ID NO: 449567 - RNA, 19 nt, Human
gagcagcugcacccauuga

SEQ ID NO: 449568 - RNA, 22 nt, Human
aggccuuaccauagcuguagca

SEQ ID NO: 449569 - RNA, 22 nt, Human
auaauuaauuucaguaaucucc

SEQ ID NO: 449570 - RNA, 22 nt, Human
augggcaguguauuggaaggaa

SEQ ID NO: 449571 - RNA, 22 nt, Human
aaaacuguaggaauugggugcc

SEQ ID NO: 449572 - RNA, 22 nt, Human
cugaaggauucaaaauggcagg

SEQ ID NO: 449573 - RNA, 22 nt, Human
cucuccagaucugcugagccag

SEQ ID NO: 449574 - RNA, 22 nt, Human
ucucugagcaugccauauugcu

SEQ ID NO: 449575 - RNA, 22 nt, Human
cauaucauaggucuuggauaau

SEQ ID NO: 449576 - RNA, 22 nt, Human
gagcugggacauggguccucuc

SEQ ID NO: 449577 - RNA, 22 nt, Human
agcucccaauugacuugaacua

SEQ ID NO: 449578 - RNA, 22 nt, Human
ucuagaaacaugacauugaucu

SEQ ID NO: 449579 - RNA, 22 nt, Human
cucugaccauucccuugauuuu

SEQ ID NO: 449580 - RNA, 21 nt, Human
gagccuucccucugcccuuuc

SEQ ID NO: 449581 - RNA, 22 nt, Human
uugggcucaggaguuugagacc

SEQ ID NO: 449582 - RNA, 22 nt, Human
caggucagagucccccuguccu

SEQ ID NO: 449583 - RNA, 22 nt, Human
uuauggcauauuccucauugua

SEQ ID NO: 449584 - RNA, 22 nt, Human
uggguagaggaauugggcuacc

SEQ ID NO: 449585 - RNA, 22 nt, Human
gauuuauugucccuguccugcu

SEQ ID NO: 449586 - RNA, 22 nt, Human
caggccuggguucaaaucccuu

SEQ ID NO: 449587 - RNA, 22 nt, Human
aagagagaacucccuucgccag

SEQ ID NO: 449588 - RNA, 22 nt, Human
cagggcuggauccuccagacuc

SEQ ID NO: 449589 - RNA, 22 nt, Human
ucucagaguuuacggggcugaa

SEQ ID NO: 449590 - RNA, 21 nt, Human
uuucacaaaaguaugugacaa

SEQ ID NO: 449591 - RNA, 22 nt, Human
uaaaucuccuguuuuucaucua

SEQ ID NO: 449592 - RNA, 20 nt, Human
agcauuugaaauaugacuau

SEQ ID NO: 449593 - RNA, 22 nt, Human
uagcagcucacagccucccauu

SEQ ID NO: 449594 - RNA, 18 nt, Human
cucugcuaaugggcagcu

SEQ ID NO: 449595 - RNA, 22 nt, Human
ugcagggaauccagucuagggu

SEQ ID NO: 449596 - RNA, 22 nt, Human
agaaaagguugaaaguaggauu

SEQ ID NO: 449597 - RNA, 22 nt, Human
aaggcccuaauagagcacauau

SEQ ID NO: 449598 - RNA, 22 nt, Human
aggcugugagcaagaacaccua

SEQ ID NO: 449599 - RNA, 22 nt, Human
uacaagagguauauagaaacag

SEQ ID NO: 449600 - RNA, 22 nt, Human
gcugauuauuacaugucugugg

SEQ ID NO: 449601 - RNA, 22 nt, Human
auuuuucucuccacuccauuaa

SEQ ID NO: 449602 - RNA, 22 nt, Human
cgcagcagccccgugguaggug

SEQ ID NO: 449603 - RNA, 22 nt, Human
uuccuguauuuugcgaauuuuc

SEQ ID NO: 449604 - RNA, 22 nt, Human
cccuggaguagcacugggucgc

SEQ ID NO: 449605 - RNA, 22 nt, Human
gggcuggaggagauccagaggc

SEQ ID NO: 449606 - RNA, 22 nt, Human
caggguggggaaauagcgcccu

SEQ ID NO: 449607 - RNA, 22 nt, Human
gcucugugggugaguagaaucu

SEQ ID NO: 449608 - RNA, 22 nt, Human
cuggcccagucucagaguguca

SEQ ID NO: 449609 - RNA, 22 nt, Human
auguuaaaugguuuauuauuaa

SEQ ID NO: 449610 - RNA, 22 nt, Human
guaggaagcucugaggcuaguu

SEQ ID NO: 449611 - RNA, 22 nt, Human
gggcuguggagccgcgagggcu

SEQ ID NO: 449612 - RNA, 22 nt, Human
gcagggcaaacccagguguuca

SEQ ID NO: 449613 - RNA, 22 nt, Human
aagggcucuucuauuuauggcc

SEQ ID NO: 449614 - RNA, 22 nt, Human
guaauugacucagcucuguuca

SEQ ID NO: 449615 - RNA, 22 nt, Human
ccaaaauuaagccucuuauguu

SEQ ID NO: 449616 - RNA, 22 nt, Human
uccuucagcuuauuucuuagga

SEQ ID NO: 449617 - RNA, 22 nt, Human
uggugguuaugcgcuuuguggg

SEQ ID NO: 449618 - RNA, 22 nt, Human
ggcuuucuaugaacucaaaggc

SEQ ID NO: 449619 - RNA, 22 nt, Human
gccugucugcagggcugucauu

SEQ ID NO: 449620 - RNA, 22 nt, Human
ugggcacuauggcucugugcac

SEQ ID NO: 449621 - RNA, 22 nt, Human
agccucugucaagcuuuucaaa

SEQ ID NO: 449622 - RNA, 22 nt, Human
cacauuugaaggaauuagcauu

SEQ ID NO: 449623 - RNA, 22 nt, Human
ccaggccuccugugaguggacc

SEQ ID NO: 449624 - RNA, 22 nt, Human
agagcuguggauaguccuggau

SEQ ID NO: 449625 - RNA, 22 nt, Human
ugguccugagcaccagccugac

SEQ ID NO: 449626 - RNA, 19 nt, Human
uacauuuguguacacuugu

SEQ ID NO: 449627 - RNA, 22 nt, Human
agucccagaucuccauucgguc

SEQ ID NO: 449628 - RNA, 22 nt, Human
cugugcuuaccugcccagguga

SEQ ID NO: 449629 - RNA, 22 nt, Human
agacaggcagaggcugcagagg

SEQ ID NO: 449630 - RNA, 22 nt, Human
caggguugcaugcaucuguggg

SEQ ID NO: 449631 - RNA, 22 nt, Human
ugaggaagcaaaggcuugugug

SEQ ID NO: 449632 - RNA, 22 nt, Human
cagcuuuagagaaaacauauuu

SEQ ID NO: 449633 - RNA, 22 nt, Human
caccagggcucugagcucugaa

SEQ ID NO: 449634 - RNA, 22 nt, Human
gaagcaaaaugucugcacauau

SEQ ID NO: 449635 - RNA, 22 nt, Human
uggagugaaguaaagaggacaa

SEQ ID NO: 449636 - RNA, 22 nt, Human
uccucugcucagcauuccucac

SEQ ID NO: 449637 - RNA, 22 nt, Human
ugucucagauacgccaucaagg

SEQ ID NO: 449638 - RNA, 22 nt, Human
acguuuucagccuuaauguaga

SEQ ID NO: 449639 - RNA, 22 nt, Human
uuuucucaggugcuuaucuaag

SEQ ID NO: 449640 - RNA, 22 nt, Human
cagagguagccgagugcaaucg

SEQ ID NO: 449641 - RNA, 22 nt, Human
aucuuaaucgaguccaugaaaa

SEQ ID NO: 449642 - RNA, 22 nt, Human
ucucccaggcugcccuguggac

SEQ ID NO: 449643 - RNA, 22 nt, Human
aagcaucucuauguggagagug

SEQ ID NO: 449644 - RNA, 22 nt, Human
aggcagaggaaggguggauuug

SEQ ID NO: 449645 - RNA, 20 nt, Human
ggcagccaaucagcgugccg

SEQ ID NO: 449646 - RNA, 22 nt, Human
ggggcagggagguuaucgccga

SEQ ID NO: 449647 - RNA, 18 nt, Human
uggguggcuagggaguuu

SEQ ID NO: 449648 - RNA, 22 nt, Human
ucaggauguuaauauagcauua

SEQ ID NO: 449649 - RNA, 22 nt, Human
agcagagccaggucucucugua

SEQ ID NO: 449650 - RNA, 23 nt, Human
uccuggugacaugccugagcauc

SEQ ID NO: 449651 - RNA, 22 nt, Human
cagagcucuauguucauggagg

SEQ ID NO: 449652 - RNA, 22 nt, Human
uuguguccugauuugacacaau

SEQ ID NO: 449653 - RNA, 22 nt, Human
guuucauuuacaucuguaggua

SEQ ID NO: 449654 - RNA, 22 nt, Human
gcuggcccagggucaccuagga

SEQ ID NO: 449655 - RNA, 22 nt, Human
ucaaaugcuucuacuccuaaga

SEQ ID NO: 449656 - RNA, 22 nt, Human
ggaagggcaauaaaaucucagg

SEQ ID NO: 449657 - RNA, 22 nt, Human
gggcugagagugacuguucugu

SEQ ID NO: 449658 - RNA, 22 nt, Human
ucaguuuuuaaaugauauaauu

SEQ ID NO: 449659 - RNA, 22 nt, Human
acagaggccgccucucucacgg

SEQ ID NO: 449660 - RNA, 19 nt, Human
uggaagaggaagggaaaua

SEQ ID NO: 449661 - RNA, 22 nt, Human
ugggaggcuuccagaccuugcu

SEQ ID NO: 449662 - RNA, 22 nt, Human
aggcaggucacaugcuuggcga

SEQ ID NO: 449663 - RNA, 22 nt, Human
aagagggcugcaaucuuauugc

SEQ ID NO: 449664 - RNA, 22 nt, Human
cuggugcuggagccuagucccu

SEQ ID NO: 449665 - RNA, 22 nt, Human
agcugccaaguuucucaguuua

SEQ ID NO: 449666 - RNA, 22 nt, Human
aagauuucuuacuuauugaugc

SEQ ID NO: 449667 - RNA, 22 nt, Human
gggcugacgaaggccaugugug

SEQ ID NO: 449668 - RNA, 22 nt, Human
cuggugggaggcaagguggaag

SEQ ID NO: 449669 - RNA, 22 nt, Human
ccagagccggauugugaagugc

SEQ ID NO: 449670 - RNA, 20 nt, Human
ucccaggcugggcuccagcu

SEQ ID NO: 449671 - RNA, 22 nt, Human
ugagcuggucacuccuucugaa

SEQ ID NO: 449672 - RNA, 22 nt, Human
agccccucuguggcucugccuc

SEQ ID NO: 449673 - RNA, 18 nt, Human
caaagcucacguuccauc

SEQ ID NO: 449674 - RNA, 22 nt, Human
uguggcuguguccaccugcugc

SEQ ID NO: 449675 - RNA, 22 nt, Human
ugauggcuaucccuggaagggc

SEQ ID NO: 449676 - RNA, 22 nt, Human
gcagagccugugucugagcaaa

SEQ ID NO: 449677 - RNA, 22 nt, Human
uggacaggaucugagacugaga

SEQ ID NO: 449678 - RNA, 22 nt, Human
acauuucuuccacaugcugcug

SEQ ID NO: 449679 - RNA, 22 nt, Human
ggaagccaguugcuuggugugg

SEQ ID NO: 449680 - RNA, 22 nt, Human
aggcagcaauugaaaucauugu

SEQ ID NO: 449681 - RNA, 21 nt, Human
ggugucaguuuuggucauuag

SEQ ID NO: 449682 - RNA, 22 nt, Human
caguauuuucaggauuuggaag

SEQ ID NO: 449683 - RNA, 22 nt, Human
gaaaauuauugaaaauggcucu

SEQ ID NO: 449684 - RNA, 22 nt, Human
cagggacaauggcagagccuga

SEQ ID NO: 449685 - RNA, 22 nt, Human
aaagcucacaguaauacaaggc

SEQ ID NO: 449686 - RNA, 22 nt, Human
guucauuuaugauguaacaugu

SEQ ID NO: 449687 - RNA, 22 nt, Human
agggcuggccacaugauuuggu

SEQ ID NO: 449688 - RNA, 22 nt, Human
acaggccuuggcaggcauguga

SEQ ID NO: 449689 - RNA, 23 nt, Human
agcagcaaaaauuuaucuuucug

SEQ ID NO: 449690 - RNA, 22 nt, Human
aagcugaggcccauggcaaggu

SEQ ID NO: 449691 - RNA, 22 nt, Human
agaagccagucgcucucccgca

SEQ ID NO: 449692 - RNA, 22 nt, Human
ugaagcagcaaaugaugggaga

SEQ ID NO: 449693 - RNA, 22 nt, Human
ccuccucugggaagauucagag

SEQ ID NO: 449694 - RNA, 22 nt, Human
ugcucccaaacgaccuacugug

SEQ ID NO: 449695 - RNA, 22 nt, Human
agccuggaagaaccugaagucu

SEQ ID NO: 449696 - RNA, 22 nt, Human
uauuaggguaaauuugacaugc

SEQ ID NO: 449697 - RNA, 22 nt, Human
ugggcuccggcggccucaggcu

SEQ ID NO: 449698 - RNA, 22 nt, Human
aucgagggugaguacagcggac

SEQ ID NO: 449699 - RNA, 22 nt, Human
ggcagggcccugauuccugggg

SEQ ID NO: 449700 - RNA, 22 nt, Human
caggguuucaccauguuagcag

SEQ ID NO: 449701 - RNA, 22 nt, Human
uucaauucaauucuaaauauau

SEQ ID NO: 449702 - RNA, 22 nt, Human
ggagucaggagcaggcugggcu

SEQ ID NO: 449703 - RNA, 22 nt, Human
gccugcuggcuguccauugcag

SEQ ID NO: 449704 - RNA, 20 nt, Human
ccugaggguuuguguucuuu

SEQ ID NO: 449705 - RNA, 22 nt, Human
gcuggcaccugcaccaagcagg

SEQ ID NO: 449706 - RNA, 22 nt, Human
ggccgggcaggucucagccagc

SEQ ID NO: 449707 - RNA, 22 nt, Human
ucaguuuugauuccugguucuc

SEQ ID NO: 449708 - RNA, 22 nt, Human
acuuuuuuauaaggaagaagau

SEQ ID NO: 449709 - RNA, 22 nt, Human
ggaggagacaguaaaaagcacg

SEQ ID NO: 449710 - RNA, 22 nt, Human
gcugucaggccaugugggccuu

SEQ ID NO: 449711 - RNA, 18 nt, Human
agggucagugucacuggc

SEQ ID NO: 449712 - RNA, 22 nt, Human
cugagcugagccaaaucugucu

SEQ ID NO: 449713 - RNA, 20 nt, Human
ugaggcaggagaauggcaug

SEQ ID NO: 449714 - RNA, 22 nt, Human
aaaguuugagugauuugacaca

SEQ ID NO: 449715 - RNA, 22 nt, Human
ugucccagcacuuugggagucu

SEQ ID NO: 449716 - RNA, 22 nt, Human
uagaacagaggguugcccagau

SEQ ID NO: 449717 - RNA, 22 nt, Human
auucuccagcucacuguccaua

SEQ ID NO: 449718 - RNA, 22 nt, Human
cccagacuccucuggcuggugg

SEQ ID NO: 449719 - RNA, 22 nt, Human
ugucccaguuuaucugggacug

SEQ ID NO: 449720 - RNA, 22 nt, Human
uuugaaguccaucuggcccagu

SEQ ID NO: 449721 - RNA, 22 nt, Human
ccaagggcucugacuugccugc

SEQ ID NO: 449722 - RNA, 22 nt, Human
agucaguguagaaagcccaggc

SEQ ID NO: 449723 - RNA, 22 nt, Human
ucuuuugugauucuucaguuac

SEQ ID NO: 449724 - RNA, 22 nt, Human
aaaugugcuugugaucagcugu

SEQ ID NO: 449725 - RNA, 22 nt, Human
gucaaguuaagauaaggucaug

SEQ ID NO: 449726 - RNA, 22 nt, Human
gaggccuggaauuccagccugg

SEQ ID NO: 449727 - RNA, 22 nt, Human
cugaggucuagacaccccaggg

SEQ ID NO: 449728 - RNA, 16 nt, Human
ugggcagaugagaaga

SEQ ID NO: 449729 - RNA, 22 nt, Human
aggaccugcuaaugugccaagu

SEQ ID NO: 449730 - RNA, 18 nt, Human
uggagcagguaggcauga

SEQ ID NO: 449731 - RNA, 22 nt, Human
cuggcucuucagugcuugguuc

SEQ ID NO: 449732 - RNA, 22 nt, Human
caggugggagcgaggagcuacu

SEQ ID NO: 449733 - RNA, 22 nt, Human
uccagggaugccagccauguug

SEQ ID NO: 449734 - RNA, 22 nt, Human
ggcagggaguggagacucccua

SEQ ID NO: 449735 - RNA, 22 nt, Human
cagcuggcuccaccucugggcu

SEQ ID NO: 449736 - RNA, 17 nt, Human
gcaaucucagucuccuu

SEQ ID NO: 449737 - RNA, 22 nt, Human
aaagccagagcaagcugucaca

SEQ ID NO: 449738 - RNA, 22 nt, Human
cagcuggcagaaccugcaucca

SEQ ID NO: 449739 - RNA, 22 nt, Human
agccagggagguggagguugca

SEQ ID NO: 449740 - RNA, 22 nt, Human
agccuggcacugccccauccau

SEQ ID NO: 449741 - RNA, 22 nt, Human
aaauguuccauuauuguguaau

SEQ ID NO: 449742 - RNA, 22 nt, Human
ccagccacugggccacugccag

SEQ ID NO: 449743 - RNA, 22 nt, Human
ucaggcagagcuguggagcucu

SEQ ID NO: 449744 - RNA, 18 nt, Human
acauuucuaugcuucugg

SEQ ID NO: 449745 - RNA, 22 nt, Human
aaagccaguucuuagagaaagc

SEQ ID NO: 449746 - RNA, 22 nt, Human
uggccugucuuguugugcuaga

SEQ ID NO: 449747 - RNA, 22 nt, Human
augcauugucugguuucauuuu

SEQ ID NO: 449748 - RNA, 19 nt, Human
uccauaagcuuguguucau

SEQ ID NO: 449749 - RNA, 22 nt, Human
acugugcaaugaguaauaaacu

SEQ ID NO: 449750 - RNA, 22 nt, Human
ucaaaugcacguagagaaaaua

SEQ ID NO: 449751 - RNA, 22 nt, Human
guccagugucuucuacauaaca

SEQ ID NO: 449752 - RNA, 22 nt, Human
gcacagagggcagugagccucu

SEQ ID NO: 449753 - RNA, 22 nt, Human
gccagccugugggggcucugug

SEQ ID NO: 449754 - RNA, 22 nt, Human
ugagccugaguucaaggcugca

SEQ ID NO: 449755 - RNA, 21 nt, Human
aggaggaacccguggcugggc

SEQ ID NO: 449756 - RNA, 22 nt, Human
agguguguauaaacauacauau

SEQ ID NO: 449757 - RNA, 20 nt, Human
ucccuggaggugguggcauc

SEQ ID NO: 449758 - RNA, 21 nt, Human
ucucuggaguuagcagagaga

SEQ ID NO: 449759 - RNA, 22 nt, Human
cuccagggagcugcgggagcca

SEQ ID NO: 449760 - RNA, 22 nt, Human
uacuacauuaauaaaacauuca

SEQ ID NO: 449761 - RNA, 22 nt, Human
cccagcucuuuuagcggcaucu

SEQ ID NO: 449762 - RNA, 22 nt, Human
uucacaauaggagcaugcaaau

SEQ ID NO: 449763 - RNA, 22 nt, Human
auuuggcaacauuaauugaauc

SEQ ID NO: 449764 - RNA, 22 nt, Human
agaacagcagcacgucaagcug

SEQ ID NO: 449765 - RNA, 19 nt, Human
ggaagagaggaaaggugga

SEQ ID NO: 449766 - RNA, 22 nt, Human
agggagaagguuuagcugugag

SEQ ID NO: 449767 - RNA, 22 nt, Human
cgggcuccgggucuuugcaguc

SEQ ID NO: 449768 - RNA, 22 nt, Human
gcaaggagacuguagggccaag

SEQ ID NO: 449769 - RNA, 22 nt, Human
gggggaagacugggcuagugau

SEQ ID NO: 449770 - RNA, 22 nt, Human
uuccuauuuccaugaaacacaa

SEQ ID NO: 449771 - RNA, 22 nt, Human
uagggcugcugcagaugacagg

SEQ ID NO: 449772 - RNA, 22 nt, Human
gucccaggcuuauguggagcuu

SEQ ID NO: 449773 - RNA, 22 nt, Human
cuggcuuccucaggagcagugg

SEQ ID NO: 449774 - RNA, 22 nt, Human
uggccuggggaccugugagacc

SEQ ID NO: 449775 - RNA, 22 nt, Human
aaauuucuaagcagccacuucc

SEQ ID NO: 449776 - RNA, 22 nt, Human
uaguacuuaucucugucauugu

SEQ ID NO: 449777 - RNA, 22 nt, Human
gagauggggaauaggagcaagc

SEQ ID NO: 449778 - RNA, 22 nt, Human
gccccagguugccugucccagg

SEQ ID NO: 449779 - RNA, 22 nt, Human
ucagcuuucucuucuaucgaua

SEQ ID NO: 449780 - RNA, 22 nt, Human
ugaggcuguucuaccagggcca

SEQ ID NO: 449781 - RNA, 19 nt, Human
uuggaaggagccagagugg

SEQ ID NO: 449782 - RNA, 22 nt, Human
ucaguuuuaagguuugagaauu

SEQ ID NO: 449783 - RNA, 22 nt, Human
ggcuuuauuucacuguaccaua

SEQ ID NO: 449784 - RNA, 20 nt, Human
agcccuguuuccuggagaga

SEQ ID NO: 449785 - RNA, 21 nt, Human
ccugggagaucagcugccuuc

SEQ ID NO: 449786 - RNA, 22 nt, Human
ucaucaguuuagaaaaaauaug

SEQ ID NO: 449787 - RNA, 23 nt, Human
ccugaagggucaggguccucagc

SEQ ID NO: 449788 - RNA, 22 nt, Human
aggcugugcacagggcaccugc

SEQ ID NO: 449789 - RNA, 18 nt, Human
uggagccagcucuaggau

SEQ ID NO: 449790 - RNA, 22 nt, Human
ucugagcuacgaugccugucac

SEQ ID NO: 449791 - RNA, 22 nt, Human
acuuugcugcagguuuaaagag

SEQ ID NO: 449792 - RNA, 22 nt, Human
cugggagagaagcgaagcuggg

SEQ ID NO: 449793 - RNA, 22 nt, Human
agaccaagacuauaaugagagg

SEQ ID NO: 449794 - RNA, 22 nt, Human
aucagcaaucaaauugcagagu

SEQ ID NO: 449795 - RNA, 22 nt, Human
ugccaggcuguccugggccugg

SEQ ID NO: 449796 - RNA, 22 nt, Human
uauuucaugugcaccauaauuc

SEQ ID NO: 449797 - RNA, 22 nt, Human
gggcccagcgugguuccaucug

SEQ ID NO: 449798 - RNA, 22 nt, Human
aaucuguuuaguucugcguaug

SEQ ID NO: 449799 - RNA, 22 nt, Human
uggagcugggaguccugggcug

SEQ ID NO: 449800 - RNA, 22 nt, Human
aguuuucuguucuacaauuuga

SEQ ID NO: 449801 - RNA, 22 nt, Human
uccccagccgugaaggagagga

SEQ ID NO: 449802 - RNA, 22 nt, Human
aaagccuucaaguagauguaag

SEQ ID NO: 449803 - RNA, 22 nt, Human
cugcagagguugguucuaagau

SEQ ID NO: 449804 - RNA, 22 nt, Human
uuuaucuuuaggacuuugcaga

SEQ ID NO: 449805 - RNA, 22 nt, Human
cugaggccggagcacugaagag

SEQ ID NO: 449806 - RNA, 22 nt, Human
auccucaguguuucugacaucu

SEQ ID NO: 449807 - RNA, 22 nt, Human
cuuacaaauacacuuaggagag

SEQ ID NO: 449808 - RNA, 22 nt, Human
aguggugcugcgcgcggagcuc

SEQ ID NO: 449809 - RNA, 22 nt, Human
guccucuccaggaggcucugau

SEQ ID NO: 449810 - RNA, 22 nt, Human
gguuucaaauuaaagucuuaag

SEQ ID NO: 449811 - RNA, 22 nt, Human
gaggcagagucacaaagagucu

SEQ ID NO: 449812 - RNA, 22 nt, Human
guuagggagggugcauaugugu

SEQ ID NO: 449813 - RNA, 17 nt, Human
ucuggccuuccugaacu

SEQ ID NO: 449814 - RNA, 22 nt, Human
augggaggcagcagagcccagc

SEQ ID NO: 449815 - RNA, 21 nt, Human
gggugggaggacacagcaggc

SEQ ID NO: 449816 - RNA, 22 nt, Human
cauugcacucuggcuggaacgg

SEQ ID NO: 449817 - RNA, 22 nt, Human
uauucacagcugccgcacucag

SEQ ID NO: 449818 - RNA, 22 nt, Human
uuggaaggagucaaccagcuga

SEQ ID NO: 449819 - RNA, 22 nt, Human
aacagaauaguugauguacagu

SEQ ID NO: 449820 - RNA, 23 nt, Human
uuucacaaugagcauuacagaau

SEQ ID NO: 449821 - RNA, 23 nt, Human
augcaguauaugucaguaguuua

SEQ ID NO: 449822 - RNA, 22 nt, Human
aucaguuucugugaagaacaca

SEQ ID NO: 449823 - RNA, 22 nt, Human
aauuaugauuggucuaaaccag

SEQ ID NO: 449824 - RNA, 22 nt, Human
aggcugccuguuccaaucuccu

SEQ ID NO: 449825 - RNA, 22 nt, Human
auacauguaacugcauuguaau

SEQ ID NO: 449826 - RNA, 22 nt, Human
ccagggcaauaggaacacuuuu

SEQ ID NO: 449827 - RNA, 22 nt, Human
gagcagggccacuucuguaccu

SEQ ID NO: 449828 - RNA, 22 nt, Human
agggggcaggagagaccugcug

SEQ ID NO: 449829 - RNA, 22 nt, Human
aagauuucugcuuuuggaggca

SEQ ID NO: 449830 - RNA, 22 nt, Human
agccagaguugaaugugagucu

SEQ ID NO: 449831 - RNA, 22 nt, Human
cucagaguggggcucccugagg

SEQ ID NO: 449832 - RNA, 22 nt, Human
ugcaggaauagcuacagagcug

SEQ ID NO: 449833 - RNA, 22 nt, Human
gaaaucugaacucuguauccuu

SEQ ID NO: 449834 - RNA, 22 nt, Human
auuaaacaauguaaaguucuug

SEQ ID NO: 449835 - RNA, 22 nt, Human
cugggcuguucugccccugggu

SEQ ID NO: 449836 - RNA, 18 nt, Human
uggcucuggacuugcucc

SEQ ID NO: 449837 - RNA, 22 nt, Human
cucaggccauucuuccagcugc

SEQ ID NO: 449838 - RNA, 21 nt, Human
ccuggcuucagggugcacugg

SEQ ID NO: 449839 - RNA, 22 nt, Human
ccugcagguugcagaggcggaa

SEQ ID NO: 449840 - RNA, 22 nt, Human
gucucagauucagacaucuaca

SEQ ID NO: 449841 - RNA, 22 nt, Human
uccugcagagacagaggccuca

SEQ ID NO: 449842 - RNA, 21 nt, Human
ucacuagugccuucugucauu

SEQ ID NO: 449843 - RNA, 22 nt, Human
agucaccaacaugguucccagg

SEQ ID NO: 449844 - RNA, 22 nt, Human
ggcagggucuggacugaaagcu

SEQ ID NO: 449845 - RNA, 22 nt, Human
uuggccacacucacuagagccc

SEQ ID NO: 449846 - RNA, 22 nt, Human
aagccaggccauucucugguuc

SEQ ID NO: 449847 - RNA, 22 nt, Human
ucccaaggugcucggcaacagg

SEQ ID NO: 449848 - RNA, 19 nt, Human
ccucccacggauuccuucc

SEQ ID NO: 449849 - RNA, 22 nt, Human
auguagcaucuauccugauaaa

SEQ ID NO: 449850 - RNA, 18 nt, Human
ugggauggagaguaacug

SEQ ID NO: 449851 - RNA, 22 nt, Human
aguguauugauuggaacagccu

SEQ ID NO: 449852 - RNA, 18 nt, Human
guuaauuuugaaguucau

SEQ ID NO: 449853 - RNA, 22 nt, Human
gguucacauauugagaguauuc

SEQ ID NO: 449854 - RNA, 22 nt, Human
ucuguaucacccguucccagaa

SEQ ID NO: 449855 - RNA, 22 nt, Human
cuucuggggauggagcccagaa

SEQ ID NO: 449856 - RNA, 22 nt, Human
cagggacagccuugggguggcg

SEQ ID NO: 449857 - RNA, 22 nt, Human
ugugcccauuacacagaggcau

SEQ ID NO: 449858 - RNA, 22 nt, Human
ucauggagacuuugagccuguu

SEQ ID NO: 449859 - RNA, 22 nt, Human
aauaugcauuaacuguguacau

SEQ ID NO: 449860 - RNA, 22 nt, Human
gaggaagaaagcauaggugggg

SEQ ID NO: 449861 - RNA, 16 nt, Human
uagggcugggaaggag

SEQ ID NO: 449862 - RNA, 22 nt, Human
uaaugugugucaucaguagagu

SEQ ID NO: 449863 - RNA, 22 nt, Human
ugaggccugcuuggaauugaau

SEQ ID NO: 449864 - RNA, 22 nt, Human
agcaugaaagcauaggacaguc

SEQ ID NO: 449865 - RNA, 22 nt, Human
ugaaggccagcucuuuaucagc

SEQ ID NO: 449866 - RNA, 22 nt, Human
uuugagguuagcuagcagauca

SEQ ID NO: 449867 - RNA, 19 nt, Human
cuggggcuuugguacugcc

SEQ ID NO: 449868 - RNA, 22 nt, Human
ucuaguucuagaucccugagga

SEQ ID NO: 449869 - RNA, 22 nt, Human
acauagcuuaaaugagaagaua

SEQ ID NO: 449870 - RNA, 22 nt, Human
acaggcuuuuuuagaaugacau

SEQ ID NO: 449871 - RNA, 22 nt, Human
cagcucuguaaauuccuucauc

SEQ ID NO: 449872 - RNA, 22 nt, Human
agaggcagcagucauacuacag

SEQ ID NO: 449873 - RNA, 22 nt, Human
uggcacauagcagguacucagu

SEQ ID NO: 449874 - RNA, 19 nt, Human
cugcagggaugugcagagu

SEQ ID NO: 449875 - RNA, 22 nt, Human
ucccagaggacuguuggugcua

SEQ ID NO: 449876 - RNA, 16 nt, Human
uggcagagguucagcc

SEQ ID NO: 449877 - RNA, 22 nt, Human
acaugauuggacuccuuccccu

SEQ ID NO: 449878 - RNA, 22 nt, Human
aagcugccagcugagcugaggc

SEQ ID NO: 449879 - RNA, 22 nt, Human
ucuuuccuagaggcugaugagu

SEQ ID NO: 449880 - RNA, 22 nt, Human
uggcaguggcucagagugcaga

SEQ ID NO: 449881 - RNA, 22 nt, Human
ccagccugguucagaauuggcu

SEQ ID NO: 449882 - RNA, 23 nt, Human
agcagccauagggaagcaauaca

SEQ ID NO: 449883 - RNA, 22 nt, Human
ugaagcagagugaaggugaauu

SEQ ID NO: 449884 - RNA, 22 nt, Human
acugggccuugccauggcagcc

SEQ ID NO: 449885 - RNA, 22 nt, Human
agcugcucugauaaaccuacuu

SEQ ID NO: 449886 - RNA, 22 nt, Human
gcugccuguguggccacucacu

SEQ ID NO: 449887 - RNA, 22 nt, Human
cagcuggcauaccugggcccgg

SEQ ID NO: 449888 - RNA, 22 nt, Human
augaugguggguaauguguaaa

SEQ ID NO: 449889 - RNA, 22 nt, Human
ucaggcugaaggaggccuaucu

SEQ ID NO: 449890 - RNA, 22 nt, Human
ggaccugccagaacucaggcua

SEQ ID NO: 449891 - RNA, 22 nt, Human
caagggcagcagccucaagcgg

SEQ ID NO: 449892 - RNA, 22 nt, Human
gcaggccucuguugagggccuu

SEQ ID NO: 449893 - RNA, 22 nt, Human
cccagccuggugcacugugggg

SEQ ID NO: 449894 - RNA, 20 nt, Human
cugccuggaggccucuaccu

SEQ ID NO: 449895 - RNA, 22 nt, Human
auugacaauguauuuguaucug

SEQ ID NO: 449896 - RNA, 22 nt, Human
accucaggauguggacacagaa

SEQ ID NO: 449897 - RNA, 22 nt, Human
uugaaggacauccuauuucuag

SEQ ID NO: 449898 - RNA, 22 nt, Human
aaagaaaccuaucagccacaug

SEQ ID NO: 449899 - RNA, 22 nt, Human
ggaggcagaauagagugugggu

SEQ ID NO: 449900 - RNA, 21 nt, Human
ugggaugggucugggaccagc

SEQ ID NO: 449901 - RNA, 19 nt, Human
aggccugggguuuugcacu

SEQ ID NO: 449902 - RNA, 22 nt, Human
augucuuuauaaauguauaaug

SEQ ID NO: 449903 - RNA, 22 nt, Human
aaaaaugaaacggcugguuggc

SEQ ID NO: 449904 - RNA, 20 nt, Human
aacuuuagacauaaucucuu

SEQ ID NO: 449905 - RNA, 22 nt, Human
uccuuuuuaagucguuguggua

SEQ ID NO: 449906 - RNA, 22 nt, Human
agggaggaguccucaaagucau

SEQ ID NO: 449907 - RNA, 22 nt, Human
agucucagcuacuugggaggcu

SEQ ID NO: 449908 - RNA, 22 nt, Human
uggcagcaguggagguagaaag

SEQ ID NO: 449909 - RNA, 22 nt, Human
caguuucuauggcugggcucug

SEQ ID NO: 449910 - RNA, 22 nt, Human
uaacagaauccuguuauugcca

SEQ ID NO: 449911 - RNA, 22 nt, Human
gcagggacagggcagggccuuu

SEQ ID NO: 449912 - RNA, 22 nt, Human
ucccagagcagaugugcuaaag

SEQ ID NO: 449913 - RNA, 22 nt, Human
gccuggaggggacagucucugg

SEQ ID NO: 449914 - RNA, 22 nt, Human
uccucaggcugccuggaagacu

SEQ ID NO: 449915 - RNA, 22 nt, Human
guccucuguuagaaaugugcuu

SEQ ID NO: 449916 - RNA, 22 nt, Human
uguauuuucugaagauaaucaa

SEQ ID NO: 449917 - RNA, 18 nt, Human
acacacacaccuguguau

SEQ ID NO: 449918 - RNA, 22 nt, Human
accaucaguacuggaugcugac

SEQ ID NO: 449919 - RNA, 20 nt, Human
gauuacaaaaugaaaugcau

SEQ ID NO: 449920 - RNA, 22 nt, Human
uugagaagaauguguugaguuu

SEQ ID NO: 449921 - RNA, 22 nt, Human
uagggcagagcuuguacacgau

SEQ ID NO: 449922 - RNA, 22 nt, Human
gccuggagugguccugcugccc

SEQ ID NO: 449923 - RNA, 19 nt, Human
uggcaucuguaaaauggug

SEQ ID NO: 449924 - RNA, 22 nt, Human
ucccagcagggccgaccagccu

SEQ ID NO: 449925 - RNA, 22 nt, Human
ggcuuccuuucacuacccucag

SEQ ID NO: 449926 - RNA, 22 nt, Human
uagcaggguaaauguagaugga

SEQ ID NO: 449927 - RNA, 22 nt, Human
ggcagcagaacuggcccuguau

SEQ ID NO: 449928 - RNA, 22 nt, Human
gagacacacacaggagguggca

SEQ ID NO: 449929 - RNA, 22 nt, Human
agugagcauucguuuggaaccc

SEQ ID NO: 449930 - RNA, 22 nt, Human
uggccucugugggagcugagca

SEQ ID NO: 449931 - RNA, 22 nt, Human
uucaugugaauauauuugucuu

SEQ ID NO: 449932 - RNA, 22 nt, Human
cagcuugcaguacuuguuuuug

SEQ ID NO: 449933 - RNA, 20 nt, Human
gcagagccucacugcaaggg

SEQ ID NO: 449934 - RNA, 22 nt, Human
gaaaggugccccauaggcagga

SEQ ID NO: 449935 - RNA, 22 nt, Human
uagcauuuggcaccaguuauuu

SEQ ID NO: 449936 - RNA, 22 nt, Human
gagggaaagguuaauacaugau

SEQ ID NO: 449937 - RNA, 22 nt, Human
aggcagcaugcucugcuucuac

SEQ ID NO: 449938 - RNA, 22 nt, Human
ugaaggcuguuggauggggaag

SEQ ID NO: 449939 - RNA, 22 nt, Human
uggcugaguucuccaggaguag

SEQ ID NO: 449940 - RNA, 22 nt, Human
aagaaucauccugcaagagucu

SEQ ID NO: 449941 - RNA, 22 nt, Human
ggcugccugcuccuccugcacg

SEQ ID NO: 449942 - RNA, 22 nt, Human
ucugggugcccuuugcucuguu

SEQ ID NO: 449943 - RNA, 22 nt, Human
ggcauggcucggagucagaaca

SEQ ID NO: 449944 - RNA, 22 nt, Human
auuuuucucuuuccacugagau

SEQ ID NO: 449945 - RNA, 22 nt, Human
ucaagucuggagaucuggaacu

SEQ ID NO: 449946 - RNA, 22 nt, Human
gggccuguguguucaggagccu

SEQ ID NO: 449947 - RNA, 22 nt, Human
aaagcagggaugaggcuagagg

SEQ ID NO: 449948 - RNA, 22 nt, Human
gaaaaaugagcugaugucaggg

SEQ ID NO: 449949 - RNA, 22 nt, Human
gagcacagaaucuucccaugca

SEQ ID NO: 449950 - RNA, 22 nt, Human
auggaaagccaguguuccauca

SEQ ID NO: 449951 - RNA, 22 nt, Human
uaagaagcuucugcuaaugccu

SEQ ID NO: 449952 - RNA, 22 nt, Human
agaaugcaguuugaaauaaggu

SEQ ID NO: 449953 - RNA, 22 nt, Human
ucagagccccuccgcuguccca

SEQ ID NO: 449954 - RNA, 22 nt, Human
uuugucauaucacacaauuuug

SEQ ID NO: 449955 - RNA, 22 nt, Human
acucucucacagcuuggcugau

SEQ ID NO: 449956 - RNA, 22 nt, Human
ccagcagaggggcggagugcag

SEQ ID NO: 449957 - RNA, 22 nt, Human
ucaguaacuuacuuauucaccu

SEQ ID NO: 449958 - RNA, 22 nt, Human
cucaaggacuuauucaugccug

SEQ ID NO: 449959 - RNA, 22 nt, Human
gggaagguauuuagcugcugaa

SEQ ID NO: 449960 - RNA, 22 nt, Human
cuggcaggaagaggaaagguca

SEQ ID NO: 449961 - RNA, 22 nt, Human
ucugucacccgagcaggcgaga

SEQ ID NO: 449962 - RNA, 22 nt, Human
ggcagugaaucugagagccugg

SEQ ID NO: 449963 - RNA, 20 nt, Human
cccagggaccugagcuccau

SEQ ID NO: 449964 - RNA, 22 nt, Human
gcugucaguuuuacccacagac

SEQ ID NO: 449965 - RNA, 22 nt, Human
aaaucaguuagugguaggauug

SEQ ID NO: 449966 - RNA, 22 nt, Human
aggcugaggagggauguugcuu

SEQ ID NO: 449967 - RNA, 22 nt, Human
uggagaaggggcagggucucca

SEQ ID NO: 449968 - RNA, 22 nt, Human
agagcccucuucacugccccuu

SEQ ID NO: 449969 - RNA, 22 nt, Human
cucugggcaaguuucuucauga

SEQ ID NO: 449970 - RNA, 22 nt, Human
cucugggcaaguaugauagaaa

SEQ ID NO: 449971 - RNA, 22 nt, Human
ccagaagaccccguccaccucc

SEQ ID NO: 449972 - RNA, 22 nt, Human
uuuagggacaagggucuggggu

SEQ ID NO: 449973 - RNA, 22 nt, Human
agauuucccaaauacuuguuau

SEQ ID NO: 449974 - RNA, 22 nt, Human
aaucaagaaaaugaggauucuu

SEQ ID NO: 449975 - RNA, 22 nt, Human
auaacagauacucucugugagg

SEQ ID NO: 449976 - RNA, 22 nt, Human
ggagcugaaggggugggcucag

SEQ ID NO: 449977 - RNA, 22 nt, Human
ggugaggcagguggcugcugag

SEQ ID NO: 449978 - RNA, 22 nt, Human
aagcgccaugguuccugcgcag

SEQ ID NO: 449979 - RNA, 22 nt, Human
cccugccuucuuggccuuuaaa

SEQ ID NO: 449980 - RNA, 22 nt, Human
cccagggucccugcucucugug

SEQ ID NO: 449981 - RNA, 22 nt, Human
ccaggagcagggcuggcugcac

SEQ ID NO: 449982 - RNA, 22 nt, Human
cuguuaaucugcuugcaugaug

SEQ ID NO: 449983 - RNA, 22 nt, Human
ugagccagaguggagugugccu

SEQ ID NO: 449984 - RNA, 22 nt, Human
ggcacugaucugauuucccucc

SEQ ID NO: 449985 - RNA, 22 nt, Human
ucuguuccaguagaaaggugca

SEQ ID NO: 449986 - RNA, 22 nt, Human
cggggacacacuggcagcuccu

SEQ ID NO: 449987 - RNA, 18 nt, Human
ugugguggagcugccuuc

SEQ ID NO: 449988 - RNA, 22 nt, Human
gggguggauuccuacaggucca

SEQ ID NO: 449989 - RNA, 22 nt, Human
gaaguggaauuacugggucaua

SEQ ID NO: 449990 - RNA, 22 nt, Human
gggaauuauagcugucacaggc

SEQ ID NO: 449991 - RNA, 22 nt, Human
agaaggaguguacaggucaugc

SEQ ID NO: 449992 - RNA, 19 nt, Human
cugucaggggcuggauguu

SEQ ID NO: 449993 - RNA, 22 nt, Human
ucuacuguagugaugcugcagu

SEQ ID NO: 449994 - RNA, 22 nt, Human
agaagugcuccagugaguuggg

SEQ ID NO: 449995 - RNA, 22 nt, Human
cagaagaaaguggggagacaag

SEQ ID NO: 449996 - RNA, 22 nt, Human
acccagcaaagauaaacuuaug

SEQ ID NO: 449997 - RNA, 22 nt, Human
cacaggaaugaacagggaaaga

SEQ ID NO: 449998 - RNA, 22 nt, Human
aaggcccuggcaggaagcagga

SEQ ID NO: 449999 - RNA, 20 nt, Human
ugaaaaggucaggagacaug

SEQ ID NO: 450000 - RNA, 22 nt, Human
ucagaggaugcuguucuuuaau

SEQ ID NO: 450001 - RNA, 22 nt, Human
uaaagccacuucauucuagucu

SEQ ID NO: 450002 - RNA, 22 nt, Human
uugcauaaaagaguauaucuua

SEQ ID NO: 450003 - RNA, 22 nt, Human
caguguccucagccagcagcua

SEQ ID NO: 450004 - RNA, 22 nt, Human
cuuccuguugucacagucugcg

SEQ ID NO: 450005 - RNA, 22 nt, Human
gcacagccagcaucugagggau

SEQ ID NO: 450006 - RNA, 22 nt, Human
cagcccuggcuagggcgagggc

SEQ ID NO: 450007 - RNA, 22 nt, Human
caggauccccaggucgccgucc

SEQ ID NO: 450008 - RNA, 22 nt, Human
cagagccucagaauccugugga

SEQ ID NO: 450009 - RNA, 22 nt, Human
gugccucagcaccgccugcagc

SEQ ID NO: 450010 - RNA, 17 nt, Human
ccucccacaccgcccug

SEQ ID NO: 450011 - RNA, 22 nt, Human
agguuauaugucauacugaagu

SEQ ID NO: 450012 - RNA, 22 nt, Human
uuuccaaagcugaguugagcaa

SEQ ID NO: 450013 - RNA, 22 nt, Human
ggcucccacccauagggcgagu

SEQ ID NO: 450014 - RNA, 22 nt, Human
gagggcaggggucuugcacggu

SEQ ID NO: 450015 - RNA, 22 nt, Human
auuauuagugauguuguuacug

SEQ ID NO: 450016 - RNA, 22 nt, Human
uuuauuagugcuuguaucacug

SEQ ID NO: 450017 - RNA, 22 nt, Human
cagcugccuguauuguccucau

SEQ ID NO: 450018 - RNA, 22 nt, Human
ggcaguagccagggacuggcag

SEQ ID NO: 450019 - RNA, 22 nt, Human
ugagguguguccccagggaggu

SEQ ID NO: 450020 - RNA, 20 nt, Human
ggcacuggaagcacacagga

SEQ ID NO: 450021 - RNA, 22 nt, Human
agggcagccaugagccuucagg

SEQ ID NO: 450022 - RNA, 22 nt, Human
gagcagcugcagugcagacccu

SEQ ID NO: 450023 - RNA, 22 nt, Human
caguaugagaguugaaucaagg

SEQ ID NO: 450024 - RNA, 22 nt, Human
uggcagaguucgcuccuauuca

SEQ ID NO: 450025 - RNA, 22 nt, Human
ugggcacaaacaucugccuguu

SEQ ID NO: 450026 - RNA, 22 nt, Human
cagagagagugggguguggauu

SEQ ID NO: 450027 - RNA, 22 nt, Human
ggcugcaggcaggguauccacu

SEQ ID NO: 450028 - RNA, 22 nt, Human
auaugcacacucugcccacaga

SEQ ID NO: 450029 - RNA, 22 nt, Human
guuaaauucgaugauggauaaa

SEQ ID NO: 450030 - RNA, 22 nt, Human
aggcuuuaaguggccuacagcu

SEQ ID NO: 450031 - RNA, 22 nt, Human
cacaguccagacuccuggaguu

SEQ ID NO: 450032 - RNA, 22 nt, Human
ucccagcagagccagcaagccg

SEQ ID NO: 450033 - RNA, 22 nt, Human
ucucuggaagcgcagaucuguu

SEQ ID NO: 450034 - RNA, 22 nt, Human
agagugaaggccagguuacagu

SEQ ID NO: 450035 - RNA, 22 nt, Human
ccucacagggccaggccccuca

SEQ ID NO: 450036 - RNA, 22 nt, Human
aggaggccgcugaugggcuccc

SEQ ID NO: 450037 - RNA, 22 nt, Human
aguaaugugccugaaauacuug

SEQ ID NO: 450038 - RNA, 22 nt, Human
gccuggcuccuaaggacuggcu

SEQ ID NO: 450039 - RNA, 22 nt, Human
gcuggccucgcaggcaggaugu

SEQ ID NO: 450040 - RNA, 22 nt, Human
aaaucaguaaauguucauuaac

SEQ ID NO: 450041 - RNA, 22 nt, Human
cagcugggugaucuugggcagg

SEQ ID NO: 450042 - RNA, 20 nt, Human
ucauuguguugccaauuccc

SEQ ID NO: 450043 - RNA, 22 nt, Human
uguaucaaaccaaauuaauucu

SEQ ID NO: 450044 - RNA, 22 nt, Human
aacaaauguaaaaugcagaugc

SEQ ID NO: 450045 - RNA, 22 nt, Human
caguagcaggcacucagcacgu

SEQ ID NO: 450046 - RNA, 22 nt, Human
uggaggcaguuuaagucugaga

SEQ ID NO: 450047 - RNA, 22 nt, Human
acucaagauagggaaaguacaa

SEQ ID NO: 450048 - RNA, 22 nt, Human
ccacccagcagaggaggcaaga

SEQ ID NO: 450049 - RNA, 22 nt, Human
ucagaggaaagggaacauaguc

SEQ ID NO: 450050 - RNA, 22 nt, Human
cucagagcaaugaacaugcaaa

SEQ ID NO: 450051 - RNA, 22 nt, Human
uggcacugccuggcagggcccc

SEQ ID NO: 450052 - RNA, 22 nt, Human
cugcccugucuuuuucugauga

SEQ ID NO: 450053 - RNA, 22 nt, Human
ugcccacauucaaaaggugaug

SEQ ID NO: 450054 - RNA, 22 nt, Human
gcugccacgaucucugcuguag

SEQ ID NO: 450055 - RNA, 22 nt, Human
aguaaaauuucugcugaggaga

SEQ ID NO: 450056 - RNA, 22 nt, Human
gagcugccggcccacaguacua

SEQ ID NO: 450057 - RNA, 22 nt, Human
acacaccaugauuuauuuaccc

SEQ ID NO: 450058 - RNA, 22 nt, Human
agcagcucuguuuaccuggagg

SEQ ID NO: 450059 - RNA, 22 nt, Human
gcuaccugagcaagagcuucaa

SEQ ID NO: 450060 - RNA, 20 nt, Human
gccugagcuccgccuccugu

SEQ ID NO: 450061 - RNA, 22 nt, Human
cugcugagcccuggcacaggug

SEQ ID NO: 450062 - RNA, 17 nt, Human
uucucuuccuggauagu

SEQ ID NO: 450063 - RNA, 22 nt, Human
agccaagcugaucuccugcuga

SEQ ID NO: 450064 - RNA, 19 nt, Human
gccacuccugaugcugccc

SEQ ID NO: 450065 - RNA, 22 nt, Human
aggggcugccuggcuuggcacu

SEQ ID NO: 450066 - RNA, 20 nt, Human
uuucagugguuugugccuag

SEQ ID NO: 450067 - RNA, 22 nt, Human
aaugcuagugugauauguaagg

SEQ ID NO: 450068 - RNA, 22 nt, Human
cugagccauccauaccagcuua

SEQ ID NO: 450069 - RNA, 22 nt, Human
uccuucagccaugggcucucca

SEQ ID NO: 450070 - RNA, 22 nt, Human
cccagugccaggcacaggcagc

SEQ ID NO: 450071 - RNA, 22 nt, Human
cggcagagacggcgcuuugaac

SEQ ID NO: 450072 - RNA, 22 nt, Human
agagccacugggagacagagca

SEQ ID NO: 450073 - RNA, 22 nt, Human
gugccuggagcuaauguguaua

SEQ ID NO: 450074 - RNA, 22 nt, Human
caggcagaugcugacaagaguu

SEQ ID NO: 450075 - RNA, 22 nt, Human
cauccaggcaccacaaccagcu

SEQ ID NO: 450076 - RNA, 22 nt, Human
uuguuuuuaugaacauccagga

SEQ ID NO: 450077 - RNA, 22 nt, Human
cugcuggccuagcccauccucu

SEQ ID NO: 450078 - RNA, 22 nt, Human
cuggccagacuacacaugugug

SEQ ID NO: 450079 - RNA, 22 nt, Human
ugggcagggucucuguuaucag

SEQ ID NO: 450080 - RNA, 22 nt, Human
cugggcacaggggagcagaguc

SEQ ID NO: 450081 - RNA, 22 nt, Human
uccaggcaugucugaguccuuc

SEQ ID NO: 450082 - RNA, 22 nt, Human
ugggccuggaguuuguccagag

SEQ ID NO: 450083 - RNA, 22 nt, Human
gcuggccauucucuuugagaug

SEQ ID NO: 450084 - RNA, 22 nt, Human
aggcucugaucagguggcugug

SEQ ID NO: 450085 - RNA, 20 nt, Human
acauccuggugacuagaacu

SEQ ID NO: 450086 - RNA, 22 nt, Human
guguauaacuaucuaucuagua

SEQ ID NO: 450087 - RNA, 22 nt, Human
gagagggccagggugagaacua

SEQ ID NO: 450088 - RNA, 22 nt, Human
agcagagguuuguuggaaaccu

SEQ ID NO: 450089 - RNA, 22 nt, Human
ucugggcucuuaguguacccuc

SEQ ID NO: 450090 - RNA, 22 nt, Human
aaaugucuguuagucauaucau

SEQ ID NO: 450091 - RNA, 22 nt, Human
ucauugaacgaagagcuccauu

SEQ ID NO: 450092 - RNA, 22 nt, Human
uguuuuucaaauauugcucugu

SEQ ID NO: 450093 - RNA, 22 nt, Human
cagcugaguguuggcauguuca

SEQ ID NO: 450094 - RNA, 22 nt, Human
cuucccacagaauucaaucagu

SEQ ID NO: 450095 - RNA, 22 nt, Human
uuuguucacugagcaaugauua

SEQ ID NO: 450096 - RNA, 22 nt, Human
gauuuccuaauguggaucucug

SEQ ID NO: 450097 - RNA, 22 nt, Human
aggugucugggcuuuggaguca

SEQ ID NO: 450098 - RNA, 23 nt, Human
uaguuauuuucucuguaauuugc

SEQ ID NO: 450099 - RNA, 22 nt, Human
cccugcaggggaccugcagccu

SEQ ID NO: 450100 - RNA, 23 nt, Human
uucaaagcuuaagcucuuuccac

SEQ ID NO: 450101 - RNA, 22 nt, Human
cugcaagauuggaagaugcaau

SEQ ID NO: 450102 - RNA, 22 nt, Human
gaagucugacucuuuguaagcu

SEQ ID NO: 450103 - RNA, 22 nt, Human
caggugucaaaauacuaagugg

SEQ ID NO: 450104 - RNA, 22 nt, Human
aggguccugggugcaguugcuu

SEQ ID NO: 450105 - RNA, 22 nt, Human
aucaguuuugggggacauacug

SEQ ID NO: 450106 - RNA, 22 nt, Human
agcugccccaugagaggcaggu

SEQ ID NO: 450107 - RNA, 22 nt, Human
acauuuaaugauccuacuguga

SEQ ID NO: 450108 - RNA, 21 nt, Human
cagaggcaggcucugugugug

SEQ ID NO: 450109 - RNA, 22 nt, Human
acacuaauuaagcugcuuuacu

SEQ ID NO: 450110 - RNA, 22 nt, Human
ccuuucucuuggauaccgauug

SEQ ID NO: 450111 - RNA, 22 nt, Human
auugacaaauggauguugacau

SEQ ID NO: 450112 - RNA, 22 nt, Human
gccuggcuccuaagagcacaac

SEQ ID NO: 450113 - RNA, 22 nt, Human
gugcugcucacaucuggaggua

SEQ ID NO: 450114 - RNA, 23 nt, Human
ugauuuccagugagucaguggga

SEQ ID NO: 450115 - RNA, 22 nt, Human
ucauccaguaugacuggugucu

SEQ ID NO: 450116 - RNA, 22 nt, Human
gaaagcaguaaaugggucccau

SEQ ID NO: 450117 - RNA, 22 nt, Human
ucaggauggcuucugcaucaaa

SEQ ID NO: 450118 - RNA, 22 nt, Human
cuugcuuuguccagaaauucag

SEQ ID NO: 450119 - RNA, 22 nt, Human
uguauagaguuggaagaugacu

SEQ ID NO: 450120 - RNA, 22 nt, Human
ggagagcaggguccugagauac

SEQ ID NO: 450121 - RNA, 22 nt, Human
cccuggaggaaaaucugaggcu

SEQ ID NO: 450122 - RNA, 22 nt, Human
aucugccugcaguggagguggg

SEQ ID NO: 450123 - RNA, 22 nt, Human
cuggagcuggcuuccuuccacu

SEQ ID NO: 450124 - RNA, 22 nt, Human
aagccaagaguuaacuauuugu

SEQ ID NO: 450125 - RNA, 22 nt, Human
gaguuauucuagguccuuugua

SEQ ID NO: 450126 - RNA, 22 nt, Human
aguucucagcuuaguaugcugu

SEQ ID NO: 450127 - RNA, 22 nt, Human
gacacagggggauguguggacg

SEQ ID NO: 450128 - RNA, 22 nt, Human
ucugaagaacugaguaaacaug

SEQ ID NO: 450129 - RNA, 22 nt, Human
uuugggaaacuuaggggucaga

SEQ ID NO: 450130 - RNA, 22 nt, Human
gcccagcuuuucacuuccacac

SEQ ID NO: 450131 - RNA, 22 nt, Human
caggaaccuaaugaaggcucac

SEQ ID NO: 450132 - RNA, 22 nt, Human
gaguccaguuagugaggcuggg

SEQ ID NO: 450133 - RNA, 22 nt, Human
aaaucaguuggaacacaagcag

SEQ ID NO: 450134 - RNA, 22 nt, Human
agauuucccucuuguauuugca

SEQ ID NO: 450135 - RNA, 22 nt, Human
uuugugcagauguauauuugug

SEQ ID NO: 450136 - RNA, 22 nt, Human
agaaaaggcuugaagagguuuu

SEQ ID NO: 450137 - RNA, 22 nt, Human
cagggcaggacagauacauuac

SEQ ID NO: 450138 - RNA, 22 nt, Human
acacaguaccccaaggcugggc

SEQ ID NO: 450139 - RNA, 22 nt, Human
uggagcugaacuuugaggccag

SEQ ID NO: 450140 - RNA, 22 nt, Human
agcuugaguuuuggaugaagug

SEQ ID NO: 450141 - RNA, 22 nt, Human
aaucaguuguucacucugaaaa

SEQ ID NO: 450142 - RNA, 22 nt, Human
uacaaagucacauugaaaugaa

SEQ ID NO: 450143 - RNA, 22 nt, Human
aagucacagcuaaauagcuaag

SEQ ID NO: 450144 - RNA, 22 nt, Human
agacuguacuuucugcagcucu

SEQ ID NO: 450145 - RNA, 22 nt, Human
cacagaaaaaggcuugaaaauc

SEQ ID NO: 450146 - RNA, 23 nt, Human
uggcugagauccuacuguuugcu

SEQ ID NO: 450147 - RNA, 22 nt, Human
uucccaguuagucauuuuuaca

SEQ ID NO: 450148 - RNA, 22 nt, Human
caguuucuuaucuucaaaauug

SEQ ID NO: 450149 - RNA, 22 nt, Human
gugggagcuuuggcaucaggcu

SEQ ID NO: 450150 - RNA, 22 nt, Human
caggcagcagccacucugguau

SEQ ID NO: 450151 - RNA, 22 nt, Human
agcccaugcaacaggccuagcg

SEQ ID NO: 450152 - RNA, 21 nt, Human
gcacagugccaggcacacagu

SEQ ID NO: 450153 - RNA, 20 nt, Human
cucuggcuccgcgugaccgc

SEQ ID NO: 450154 - RNA, 22 nt, Human
uguguccuuuggaggaucagcg

SEQ ID NO: 450155 - RNA, 21 nt, Human
uccucagggccccagagcacu

SEQ ID NO: 450156 - RNA, 22 nt, Human
acagguggggaggcugagguuc

SEQ ID NO: 450157 - RNA, 22 nt, Human
gggccuccggggugagcugugg

SEQ ID NO: 450158 - RNA, 22 nt, Human
cagugauggauauggagaaguc

SEQ ID NO: 450159 - RNA, 22 nt, Human
aauaauuuccagccaacuggaa

SEQ ID NO: 450160 - RNA, 22 nt, Human
ccucuggggguccucagagucu

SEQ ID NO: 450161 - RNA, 22 nt, Human
gggaagccaugcucagagguac

SEQ ID NO: 450162 - RNA, 22 nt, Human
gauuucaaguaucuugggcgag

SEQ ID NO: 450163 - RNA, 22 nt, Human
cacaggaggaggccagagcgua

SEQ ID NO: 450164 - RNA, 23 nt, Human
acaaaugcccauacaucuaguuc

SEQ ID NO: 450165 - RNA, 22 nt, Human
acacugaauguuuaagaacuug

SEQ ID NO: 450166 - RNA, 22 nt, Human
augcaguaaaauaggagguaau

SEQ ID NO: 450167 - RNA, 22 nt, Human
cuacugaguccuucagcugcca

SEQ ID NO: 450168 - RNA, 22 nt, Human
uggggaagggcacccuggagac

SEQ ID NO: 450169 - RNA, 20 nt, Human
ggcugugcccuuccguggcc

SEQ ID NO: 450170 - RNA, 22 nt, Human
cugccagcucucuggaggcucu

SEQ ID NO: 450171 - RNA, 22 nt, Human
ugcucccaggcucuguggucug

SEQ ID NO: 450172 - RNA, 22 nt, Human
cucugugagggucuguacagaa

SEQ ID NO: 450173 - RNA, 22 nt, Human
guguccaucagcagccacugug

SEQ ID NO: 450174 - RNA, 22 nt, Human
uuuauguacauauccacaagga

SEQ ID NO: 450175 - RNA, 22 nt, Human
augaagcugguuuuggcuuggg

SEQ ID NO: 450176 - RNA, 22 nt, Human
cucagggccaaggaugcuguug

SEQ ID NO: 450177 - RNA, 23 nt, Human
aacaauagguuuuggcagaauag

SEQ ID NO: 450178 - RNA, 19 nt, Human
ucaguggagaaaggggaag

SEQ ID NO: 450179 - RNA, 22 nt, Human
aggacaguguggaagagggugc

SEQ ID NO: 450180 - RNA, 22 nt, Human
cugccagccaggccagguaggc

SEQ ID NO: 450181 - RNA, 22 nt, Human
caagcagagacuagauagcugu

SEQ ID NO: 450182 - RNA, 22 nt, Human
augcuguagaucuuagccucua

SEQ ID NO: 450183 - RNA, 21 nt, Human
agcaggaggcagucacagcuc

SEQ ID NO: 450184 - RNA, 22 nt, Human
uggugaagucagcggagcccgg

SEQ ID NO: 450185 - RNA, 22 nt, Human
ccagugcccagucucccugguc

SEQ ID NO: 450186 - RNA, 22 nt, Human
aggcucagcaucugauucauau

SEQ ID NO: 450187 - RNA, 23 nt, Human
ugagaagccaggggagcgugagg

SEQ ID NO: 450188 - RNA, 22 nt, Human
ggcccugagcugaaguacugug

SEQ ID NO: 450189 - RNA, 22 nt, Human
agccagagcagggaauuggaca

SEQ ID NO: 450190 - RNA, 22 nt, Human
agguaguguagcugagugggau

SEQ ID NO: 450191 - RNA, 22 nt, Human
uggcucagcgguggcagcagac

SEQ ID NO: 450192 - RNA, 22 nt, Human
agucccaguucgguucuuccuc

SEQ ID NO: 450193 - RNA, 22 nt, Human
cccagccucuguuugcuccucu

SEQ ID NO: 450194 - RNA, 22 nt, Human
aggccagcaagaaagagagucu

SEQ ID NO: 450195 - RNA, 22 nt, Human
cacuggugacuucugagcugga

SEQ ID NO: 450196 - RNA, 22 nt, Human
aggaaaaaccuguuaaugguag

SEQ ID NO: 450197 - RNA, 22 nt, Human
acugugugggccgcucacuggg

SEQ ID NO: 450198 - RNA, 22 nt, Human
accugcagccacuucucuccuu

SEQ ID NO: 450199 - RNA, 22 nt, Human
uggcagugccccuugaccagug

SEQ ID NO: 450200 - RNA, 22 nt, Human
ugucacauaggcaaaauguuuu

SEQ ID NO: 450201 - RNA, 21 nt, Human
cccagggaagccgcagucacc

SEQ ID NO: 450202 - RNA, 22 nt, Human
cagagcagagugauuguucugg

SEQ ID NO: 450203 - RNA, 22 nt, Human
ugcuggcuguauaugugagagu

SEQ ID NO: 450204 - RNA, 22 nt, Human
cuggagcucuguguguuccuga

SEQ ID NO: 450205 - RNA, 22 nt, Human
gcuggcuguguuucaucucuga

SEQ ID NO: 450206 - RNA, 22 nt, Human
ucugaagggcugaguggaggag

SEQ ID NO: 450207 - RNA, 22 nt, Human
gaggcugcggggaggagccugc

SEQ ID NO: 450208 - RNA, 22 nt, Human
guguuuccuaguuuaaugaaug

SEQ ID NO: 450209 - RNA, 22 nt, Human
aaggcacuagcagaauuaguga

SEQ ID NO: 450210 - RNA, 16 nt, Human
cagaguguaaacagga

SEQ ID NO: 450211 - RNA, 22 nt, Human
gcuggcucuucaguggagauag

SEQ ID NO: 450212 - RNA, 22 nt, Human
gaggagagggcugcgggcccac

SEQ ID NO: 450213 - RNA, 22 nt, Human
ccucugcucccuggugucugag

SEQ ID NO: 450214 - RNA, 22 nt, Human
agaggccaggcugcagagggau

SEQ ID NO: 450215 - RNA, 22 nt, Human
augcugugccuggaaagcggcu

SEQ ID NO: 450216 - RNA, 22 nt, Human
augggaggaagagaagaugucu

SEQ ID NO: 450217 - RNA, 22 nt, Human
caaaggcuucaucucagagcag

SEQ ID NO: 450218 - RNA, 22 nt, Human
aggugcugccccgagaaggaug

SEQ ID NO: 450219 - RNA, 21 nt, Human
gcuccuggugcugcguggcgc

SEQ ID NO: 450220 - RNA, 19 nt, Human
ugcucaggccaaggagccc

SEQ ID NO: 450221 - RNA, 22 nt, Human
cucuggaguggguggccgggag

SEQ ID NO: 450222 - RNA, 22 nt, Human
uagggcagccuuauagcuccca

SEQ ID NO: 450223 - RNA, 19 nt, Human
ugggaguggggaagguccu

SEQ ID NO: 450224 - RNA, 22 nt, Human
gggugcugacuggggccugaaa

SEQ ID NO: 450225 - RNA, 22 nt, Human
cccugcagagaccacugaccuu

SEQ ID NO: 450226 - RNA, 22 nt, Human
cauuuauucucagauccuuguc

SEQ ID NO: 450227 - RNA, 22 nt, Human
ucccagauuguugauggcuuaa

SEQ ID NO: 450228 - RNA, 22 nt, Human
acagauccugguuacagccauu

SEQ ID NO: 450229 - RNA, 22 nt, Human
agcugcuguccuaggcacugua

SEQ ID NO: 450230 - RNA, 22 nt, Human
acagauuuauugaagcugcugc

SEQ ID NO: 450231 - RNA, 22 nt, Human
aggagggugauccgggcugguc

SEQ ID NO: 450232 - RNA, 22 nt, Human
caggugcugcguggcggagcug

SEQ ID NO: 450233 - RNA, 22 nt, Human
gccucaggacuggcauacucau

SEQ ID NO: 450234 - RNA, 22 nt, Human
agccuggagaggcgccauacac

SEQ ID NO: 450235 - RNA, 22 nt, Human
acauuucucaucuaguagagua

SEQ ID NO: 450236 - RNA, 21 nt, Human
agagacugucacugcaguacc

SEQ ID NO: 450237 - RNA, 22 nt, Human
uagccaggucacacuguguguu

SEQ ID NO: 450238 - RNA, 22 nt, Human
ugggcagaggcucugaagucca

SEQ ID NO: 450239 - RNA, 22 nt, Human
cuauuacauuucuggacauuca

SEQ ID NO: 450240 - RNA, 19 nt, Human
ccaggccuccugggagguc

SEQ ID NO: 450241 - RNA, 20 nt, Human
uacuugaauguugcagcagu

SEQ ID NO: 450242 - RNA, 22 nt, Human
caggagugagaugcgaucacuu

SEQ ID NO: 450243 - RNA, 22 nt, Human
agagacaggguuuugccauguu

SEQ ID NO: 450244 - RNA, 22 nt, Human
ugcuggcccuggcucagggaac

SEQ ID NO: 450245 - RNA, 22 nt, Human
cuuccagucuagagcuaucugu

SEQ ID NO: 450246 - RNA, 22 nt, Human
aaauguuccuuuggauuaaacu

SEQ ID NO: 450247 - RNA, 22 nt, Human
accaggcagagcugggccuuaa

SEQ ID NO: 450248 - RNA, 22 nt, Human
gcacagguugcaaaaguucaca

SEQ ID NO: 450249 - RNA, 22 nt, Human
agaggaugguugaggaagaccu

SEQ ID NO: 450250 - RNA, 22 nt, Human
ugacagaaugugacucucagau

SEQ ID NO: 450251 - RNA, 21 nt, Human
ugcugccaucaugcagagaug

SEQ ID NO: 450252 - RNA, 17 nt, Human
acagagguuauacagac

SEQ ID NO: 450253 - RNA, 21 nt, Human
ucacagacuggucagugaggc

SEQ ID NO: 450254 - RNA, 22 nt, Human
cuuccucugcggcgccgggcgc

SEQ ID NO: 450255 - RNA, 22 nt, Human
agucagcagccuggccaggaga

SEQ ID NO: 450256 - RNA, 22 nt, Human
agugggguccucaguaugguuc

SEQ ID NO: 450257 - RNA, 22 nt, Human
ccuggcagcauugguagagauu

SEQ ID NO: 450258 - RNA, 22 nt, Human
cugaggaugguguggucuucuc

SEQ ID NO: 450259 - RNA, 22 nt, Human
aaauuguugaucuacaguaagg

SEQ ID NO: 450260 - RNA, 22 nt, Human
ucagugucuugaccugggugug

SEQ ID NO: 450261 - RNA, 22 nt, Human
cuggccuuggaagggagcccgu

SEQ ID NO: 450262 - RNA, 22 nt, Human
gcagcuggaagugacacucugu

SEQ ID NO: 450263 - RNA, 19 nt, Human
gguagaagggaaguguuuu

SEQ ID NO: 450264 - RNA, 22 nt, Human
ccucuccuugcacccgucccgc

SEQ ID NO: 450265 - RNA, 22 nt, Human
gccuggcugagguggggaggca

SEQ ID NO: 450266 - RNA, 19 nt, Human
gcuuuuuguugucaaaggu

SEQ ID NO: 450267 - RNA, 22 nt, Human
gaggcucaccuagggagcacug

SEQ ID NO: 450268 - RNA, 22 nt, Human
guggcuucuggcugggccucag

SEQ ID NO: 450269 - RNA, 22 nt, Human
gaaggccauugcguccugggau

SEQ ID NO: 450270 - RNA, 22 nt, Human
uacauuccauguguguguauuc

SEQ ID NO: 450271 - RNA, 22 nt, Human
ggcucuggcaaggggaggcuac

SEQ ID NO: 450272 - RNA, 22 nt, Human
cuugaaagucagcagaguggau

SEQ ID NO: 450273 - RNA, 22 nt, Human
uuccucagagggcgcuggggaa

SEQ ID NO: 450274 - RNA, 22 nt, Human
acacugugacaaaggcuguucu

SEQ ID NO: 450275 - RNA, 22 nt, Human
cuguggaguggggaguacuggu

SEQ ID NO: 450276 - RNA, 22 nt, Human
cugccuuccaaccccagacucc

SEQ ID NO: 450277 - RNA, 22 nt, Human
guuacaaagcacuucaagugaa

SEQ ID NO: 450278 - RNA, 22 nt, Human
acauuucuaucauccuguaaug

SEQ ID NO: 450279 - RNA, 22 nt, Human
gccacucaugggaggugugcaa

SEQ ID NO: 450280 - RNA, 22 nt, Human
ugcuggggucauggggcgcccg

SEQ ID NO: 450281 - RNA, 22 nt, Human
ggcugagcucaggggcagcagg

SEQ ID NO: 450282 - RNA, 20 nt, Human
acccagcucugugcccuggg

SEQ ID NO: 450283 - RNA, 22 nt, Human
ggcaaaaaccauaauuacuuuu

SEQ ID NO: 450284 - RNA, 22 nt, Human
gugugggcugcagaggcacagc

SEQ ID NO: 450285 - RNA, 19 nt, Human
ugaagcagcaaacucucag

SEQ ID NO: 450286 - RNA, 20 nt, Human
acugccuugguucaguaggu

SEQ ID NO: 450287 - RNA, 22 nt, Human
ucccuagucgcaucuguggaga

SEQ ID NO: 450288 - RNA, 22 nt, Human
ucccuggcagcuaagggugguc

SEQ ID NO: 450289 - RNA, 22 nt, Human
uaguggaggguguagcugcugg

SEQ ID NO: 450290 - RNA, 22 nt, Human
gguuggaggugggaauagcuag

SEQ ID NO: 450291 - RNA, 20 nt, Human
agugucuggugcagggccuc

SEQ ID NO: 450292 - RNA, 22 nt, Human
cagcauggcuugaguguuuccu

SEQ ID NO: 450293 - RNA, 22 nt, Human
agcuggugcugaagcucuugag

SEQ ID NO: 450294 - RNA, 22 nt, Human
aagaggaaaugauugacuauau

SEQ ID NO: 450295 - RNA, 22 nt, Human
ucccagccuuccagucugguuu

SEQ ID NO: 450296 - RNA, 22 nt, Human
agggaucaaaaaauguacaugc

SEQ ID NO: 450297 - RNA, 22 nt, Human
uccagccaagggagguuacuag

SEQ ID NO: 450298 - RNA, 22 nt, Human
gccucccuggcccacagcagcg

SEQ ID NO: 450299 - RNA, 22 nt, Human
cagagccagcaguggggacagg

SEQ ID NO: 450300 - RNA, 22 nt, Human
ccagugccugugggcauggugc

SEQ ID NO: 450301 - RNA, 22 nt, Human
ucuccuuuaagauuuccucagg

SEQ ID NO: 450302 - RNA, 22 nt, Human
cauauuucagucuaagaugugu

SEQ ID NO: 450303 - RNA, 22 nt, Human
uggagcaggcaucuuucucucu

SEQ ID NO: 450304 - RNA, 22 nt, Human
cagugauguuucugcaucagag

SEQ ID NO: 450305 - RNA, 22 nt, Human
gcagccugaugaucuggguugu

SEQ ID NO: 450306 - RNA, 22 nt, Human
gggcugcuuuuuucuuagcaga

SEQ ID NO: 450307 - RNA, 22 nt, Human
auuugucuucaguagguucuuc

SEQ ID NO: 450308 - RNA, 18 nt, Human
gggcucugauccuucacc

SEQ ID NO: 450309 - RNA, 22 nt, Human
cugggagcugucaggagcgugu

SEQ ID NO: 450310 - RNA, 17 nt, Human
agguggguggaucaccu

SEQ ID NO: 450311 - RNA, 20 nt, Human
uguauauuuucugguguaaa

SEQ ID NO: 450312 - RNA, 23 nt, Human
acacaauagaguacuauucagcc

SEQ ID NO: 450313 - RNA, 22 nt, Human
aaguuacaggagaaagagauca

SEQ ID NO: 450314 - RNA, 19 nt, Human
ggugaccaccuggucagug

SEQ ID NO: 450315 - RNA, 22 nt, Human
ugcuggggguucagaugaguaa

SEQ ID NO: 450316 - RNA, 22 nt, Human
ccagagcuucggggcggcugua

SEQ ID NO: 450317 - RNA, 20 nt, Human
uggcaggaggcagcagugga

SEQ ID NO: 450318 - RNA, 21 nt, Human
acagugugcuucucucccucc

SEQ ID NO: 450319 - RNA, 22 nt, Human
cagcuggcagcccuggcccugc

SEQ ID NO: 450320 - RNA, 22 nt, Human
caggcccauucuaggcuugcua

SEQ ID NO: 450321 - RNA, 22 nt, Human
ccugggcucuauccugacccag

SEQ ID NO: 450322 - RNA, 22 nt, Human
gaaaauguuuccuguuauuugc

SEQ ID NO: 450323 - RNA, 22 nt, Human
caggaacauuuaaccacagggu

SEQ ID NO: 450324 - RNA, 22 nt, Human
gaggagaaauuuggggaccuga

SEQ ID NO: 450325 - RNA, 22 nt, Human
auugcaccuuggguuuugaaag

SEQ ID NO: 450326 - RNA, 22 nt, Human
uuugcauugcauacaaggaacu

SEQ ID NO: 450327 - RNA, 22 nt, Human
uugcacagaugagggugaugcu

SEQ ID NO: 450328 - RNA, 22 nt, Human
ccugggugaaaucucuccugca

SEQ ID NO: 450329 - RNA, 20 nt, Human
ccagucccugagcaccaggg

SEQ ID NO: 450330 - RNA, 22 nt, Human
caguacuucuuggaaacuggau

SEQ ID NO: 450331 - RNA, 22 nt, Human
agggcagacuaggauggaagug

SEQ ID NO: 450332 - RNA, 22 nt, Human
cucuguccacagguuugucccu

SEQ ID NO: 450333 - RNA, 22 nt, Human
acugaaggguaaugugggagcc

SEQ ID NO: 450334 - RNA, 20 nt, Human
aggcacuggggauagguaag

SEQ ID NO: 450335 - RNA, 22 nt, Human
ccauuguaguaucuguuuuagu

SEQ ID NO: 450336 - RNA, 22 nt, Human
guguacaugagaaaucaacuuu

SEQ ID NO: 450337 - RNA, 19 nt, Human
ugcuuccucaccaucuccc

SEQ ID NO: 450338 - RNA, 22 nt, Human
ucaggagcuugguagugugauu

SEQ ID NO: 450339 - RNA, 22 nt, Human
cagugcccaagaugugccaugc

SEQ ID NO: 450340 - RNA, 22 nt, Human
agagugaucagauaucaggugu

SEQ ID NO: 450341 - RNA, 22 nt, Human
cccaggagguggagcuugcagu

SEQ ID NO: 450342 - RNA, 17 nt, Human
uggcuucccugggccac

SEQ ID NO: 450343 - RNA, 22 nt, Human
uugagaagaaauaguuugcaau

SEQ ID NO: 450344 - RNA, 22 nt, Human
aggaccuguguuuuccuugaau

SEQ ID NO: 450345 - RNA, 22 nt, Human
cagagcagugaggaguugugua

SEQ ID NO: 450346 - RNA, 20 nt, Human
cugaacacagaauaagcaca

SEQ ID NO: 450347 - RNA, 20 nt, Human
gugcuucagaagccauugcu

SEQ ID NO: 450348 - RNA, 18 nt, Human
gaagggagcuggaaugca

SEQ ID NO: 450349 - RNA, 22 nt, Human
caguuucuguuuuaaauagcag

SEQ ID NO: 450350 - RNA, 22 nt, Human
gccagaaacauacacaucacuu

SEQ ID NO: 450351 - RNA, 18 nt, Human
cugucuuuuuucucucca

SEQ ID NO: 450352 - RNA, 22 nt, Human
caguggaagcuggcugugaaga

SEQ ID NO: 450353 - RNA, 17 nt, Human
gggcugacaguggccuc

SEQ ID NO: 450354 - RNA, 22 nt, Human
ccagguggaaggucugugcucu

SEQ ID NO: 450355 - RNA, 22 nt, Human
gggggcuguccugugcauugua

SEQ ID NO: 450356 - RNA, 20 nt, Human
agacccucuggacugggccc

SEQ ID NO: 450357 - RNA, 22 nt, Human
cagcuugggucaggugccugcu

SEQ ID NO: 450358 - RNA, 22 nt, Human
gagcgggaggaacggcucgggc

SEQ ID NO: 450359 - RNA, 22 nt, Human
gugcagugaaaaaagaaugucc

SEQ ID NO: 450360 - RNA, 22 nt, Human
cuggugucugcucccucacagc

SEQ ID NO: 450361 - RNA, 22 nt, Human
ccaggcucaggugcgagagaca

SEQ ID NO: 450362 - RNA, 23 nt, Human
cuuuuaacuugaucugagaccag

SEQ ID NO: 450363 - RNA, 22 nt, Human
gagggcugcaaugagacagaga

SEQ ID NO: 450364 - RNA, 22 nt, Human
ugugaggagaggcccagcuccc

SEQ ID NO: 450365 - RNA, 22 nt, Human
gacagggcgcccagccuguuuc

SEQ ID NO: 450366 - RNA, 22 nt, Human
cagcuuuauuucacguguuugu

SEQ ID NO: 450367 - RNA, 22 nt, Human
uggcucagcugacucggcuucu

SEQ ID NO: 450368 - RNA, 22 nt, Human
uacaacauguaaagugguuuaa

SEQ ID NO: 450369 - RNA, 22 nt, Human
ggcugcugcccaccccugcaug

SEQ ID NO: 450370 - RNA, 22 nt, Human
aaggccaacuaggaugagcuag

SEQ ID NO: 450371 - RNA, 21 nt, Human
uaagaacauuaucuucuuccu

SEQ ID NO: 450372 - RNA, 22 nt, Human
aggugucuuugcggcccgccgc

SEQ ID NO: 450373 - RNA, 23 nt, Human
agggcaugaagcagaggacgugg

SEQ ID NO: 450374 - RNA, 22 nt, Human
guccuggguccccgcaggucag

SEQ ID NO: 450375 - RNA, 22 nt, Human
acuuugaaggggaacauuuuaa

SEQ ID NO: 450376 - RNA, 22 nt, Human
uccugcagcugaagcucaugug

SEQ ID NO: 450377 - RNA, 22 nt, Human
agcagaacugaugagacuugag

SEQ ID NO: 450378 - RNA, 22 nt, Human
ucugagagagggucagaugcua

SEQ ID NO: 450379 - RNA, 22 nt, Human
cauuucuguucucuuccuguac

SEQ ID NO: 450380 - RNA, 22 nt, Human
ccuccaguacuccaguccagcg

SEQ ID NO: 450381 - RNA, 22 nt, Human
gguguagcucugugucccacug

SEQ ID NO: 450382 - RNA, 22 nt, Human
aaggaagagaauccuucucaga

SEQ ID NO: 450383 - RNA, 22 nt, Human
acagcuguggggacucuugccc

SEQ ID NO: 450384 - RNA, 20 nt, Human
gaaggaagggggcaagguga

SEQ ID NO: 450385 - RNA, 17 nt, Human
uauguaguacuuauaaa

SEQ ID NO: 450386 - RNA, 19 nt, Human
uaguggagugacaaguucu

SEQ ID NO: 450387 - RNA, 21 nt, Human
gccacugcacuccagccuggg

SEQ ID NO: 450388 - RNA, 22 nt, Human
ggggccugcgagguucaacuuc

SEQ ID NO: 450389 - RNA, 22 nt, Human
ugaggcaggaauggggaaaagu

SEQ ID NO: 450390 - RNA, 20 nt, Human
ucagaggcugccagcugggg

SEQ ID NO: 450391 - RNA, 22 nt, Human
auacaucuaugccuuucugaca

SEQ ID NO: 450392 - RNA, 23 nt, Human
auugaugacuugauuacacuuuu

SEQ ID NO: 450393 - RNA, 21 nt, Human
ggagucagggucuggcugggg

SEQ ID NO: 450394 - RNA, 18 nt, Human
aggagccuuugcacugga

SEQ ID NO: 450395 - RNA, 22 nt, Human
auagcuguuagauuggggucga

SEQ ID NO: 450396 - RNA, 22 nt, Human
uguggugagaaacugguagauu

SEQ ID NO: 450397 - RNA, 22 nt, Human
uuuauauagagauuugugcaug

SEQ ID NO: 450398 - RNA, 22 nt, Human
agggcccuagggaaugagacau

SEQ ID NO: 450399 - RNA, 22 nt, Human
ggcauccaaauaccaagaugua

SEQ ID NO: 450400 - RNA, 22 nt, Human
cuugucagccaauuguggauuu

SEQ ID NO: 450401 - RNA, 22 nt, Human
aggccuggguguucaccagaag

SEQ ID NO: 450402 - RNA, 22 nt, Human
uuuccucugggcccugccaccc

SEQ ID NO: 450403 - RNA, 22 nt, Human
aacaugaagguaggaugguuuu

SEQ ID NO: 450404 - RNA, 22 nt, Human
aggaggaggcuggaguacaccc

SEQ ID NO: 450405 - RNA, 22 nt, Human
ucugggagguaaccaugcugau

SEQ ID NO: 450406 - RNA, 22 nt, Human
gcugucucauacaaggcccugc

SEQ ID NO: 450407 - RNA, 22 nt, Human
guggcauucucggcaccaucug

SEQ ID NO: 450408 - RNA, 22 nt, Human
cauuuguuuagaagucuuuaua

SEQ ID NO: 450409 - RNA, 22 nt, Human
ccugaagagcacucuagaguug

SEQ ID NO: 450410 - RNA, 22 nt, Human
uggaccugcguaggugcugggc

SEQ ID NO: 450411 - RNA, 22 nt, Human
guggagcccugguagggacccc

SEQ ID NO: 450412 - RNA, 22 nt, Human
gcucucuguuauuaagaucuuu

SEQ ID NO: 450413 - RNA, 22 nt, Human
aagauacauaaagguagagucu

SEQ ID NO: 450414 - RNA, 22 nt, Human
aaaaguguccagauuaugaaga

SEQ ID NO: 450415 - RNA, 22 nt, Human
cagcugucuaaguugagcagga

SEQ ID NO: 450416 - RNA, 22 nt, Human
uggccugguuguugcugccguu

SEQ ID NO: 450417 - RNA, 22 nt, Human
agaagaaaugugaaggccacug

SEQ ID NO: 450418 - RNA, 22 nt, Human
uuauucugcacuuuuaaaauau

SEQ ID NO: 450419 - RNA, 22 nt, Human
ucugggcagcagcagcuaguag

SEQ ID NO: 450420 - RNA, 22 nt, Human
caggguagacaguaggugucug

SEQ ID NO: 450421 - RNA, 22 nt, Human
cugggaggcggagguuguagug

SEQ ID NO: 450422 - RNA, 20 nt, Human
cucucccagcacagcuuccu

SEQ ID NO: 450423 - RNA, 22 nt, Human
cagaggcauuacugaaaaggug

SEQ ID NO: 450424 - RNA, 22 nt, Human
ugcugccuuugggaccuggccu

SEQ ID NO: 450425 - RNA, 22 nt, Human
ugcagggaggccccgcagcccu

SEQ ID NO: 450426 - RNA, 23 nt, Human
ucucaggacacacaugucuauca

SEQ ID NO: 450427 - RNA, 22 nt, Human
uaaggcaccauaauauauuuaa

SEQ ID NO: 450428 - RNA, 22 nt, Human
ggcugccucugaugugcagacg

SEQ ID NO: 450429 - RNA, 22 nt, Human
ugggggagccuucacaguagcu

SEQ ID NO: 450430 - RNA, 22 nt, Human
cuauuaggcuuccauuucaugc

SEQ ID NO: 450431 - RNA, 22 nt, Human
gaaaugcaggcuuggauucagc

SEQ ID NO: 450432 - RNA, 22 nt, Human
auacaugucaucauauguuugu

SEQ ID NO: 450433 - RNA, 20 nt, Human
cugagcugagcuccaugggu

SEQ ID NO: 450434 - RNA, 22 nt, Human
ugaaggcccuaucuccauauac

SEQ ID NO: 450435 - RNA, 22 nt, Human
gggagagaugcugauugccaau

SEQ ID NO: 450436 - RNA, 22 nt, Human
ugccugaguuuaacccucagag

SEQ ID NO: 450437 - RNA, 22 nt, Human
agcaauaacagaaaacuuuccu

SEQ ID NO: 450438 - RNA, 22 nt, Human
aguauggggcugugugugcaca

SEQ ID NO: 450439 - RNA, 22 nt, Human
ugccagggcugcuacuggcuga

SEQ ID NO: 450440 - RNA, 22 nt, Human
augcaucuauucccaagggcag

SEQ ID NO: 450441 - RNA, 22 nt, Human
ccagugcauaaucaauacagcc

SEQ ID NO: 450442 - RNA, 22 nt, Human
gacagagugcagggcuagaaga

SEQ ID NO: 450443 - RNA, 22 nt, Human
auugaaagaguuuucugcugca

SEQ ID NO: 450444 - RNA, 22 nt, Human
ugucccagucaaggcugucauc

SEQ ID NO: 450445 - RNA, 22 nt, Human
ggggccagcuucgcgugcucuu

SEQ ID NO: 450446 - RNA, 22 nt, Human
ucagucucuggggcuucuguuu

SEQ ID NO: 450447 - RNA, 20 nt, Human
ccaccuggccaaggcugugc

SEQ ID NO: 450448 - RNA, 22 nt, Human
aagggacccuggaucaaaugga

SEQ ID NO: 450449 - RNA, 19 nt, Human
ucccuggcgccucucgggc

SEQ ID NO: 450450 - RNA, 22 nt, Human
uggcucagcgcggccuggucuu

SEQ ID NO: 450451 - RNA, 22 nt, Human
aagcagagccaccagcuuugga

SEQ ID NO: 450452 - RNA, 22 nt, Human
cagggaguuuuuguuccucuag

SEQ ID NO: 450453 - RNA, 22 nt, Human
aucagcaaguccuguuaauucu

SEQ ID NO: 450454 - RNA, 22 nt, Human
cuuuucaugccagcccaucaca

SEQ ID NO: 450455 - RNA, 22 nt, Human
ugaauggucacugagcaucugu

SEQ ID NO: 450456 - RNA, 21 nt, Human
uggcugagccaggugugugga

SEQ ID NO: 450457 - RNA, 22 nt, Human
ccuguacaagcucuuggugaca

SEQ ID NO: 450458 - RNA, 22 nt, Human
gcugucaccaaagcaggcacug

SEQ ID NO: 450459 - RNA, 22 nt, Human
ucagaagcaaacaucacucuag

SEQ ID NO: 450460 - RNA, 22 nt, Human
uuuaauuuuccugguaggccug

SEQ ID NO: 450461 - RNA, 22 nt, Human
uggcucagccauucguguugcc

SEQ ID NO: 450462 - RNA, 22 nt, Human
ucagcagggagaggagaaugca

SEQ ID NO: 450463 - RNA, 22 nt, Human
uccaggcugggcugaagggugc

SEQ ID NO: 450464 - RNA, 22 nt, Human
ccucccagugccuccagagcag

SEQ ID NO: 450465 - RNA, 22 nt, Human
ggucauugaaaucagaaggguu

SEQ ID NO: 450466 - RNA, 22 nt, Human
uccagcuggggacaugggcuuc

SEQ ID NO: 450467 - RNA, 22 nt, Human
agcaggguuccaggaguugcag

SEQ ID NO: 450468 - RNA, 20 nt, Human
aagggcagagggaacagacu

SEQ ID NO: 450469 - RNA, 22 nt, Human
augauuucuauauaaacuuaaa

SEQ ID NO: 450470 - RNA, 22 nt, Human
uguaaguaguaauggaaggaca

SEQ ID NO: 450471 - RNA, 22 nt, Human
cuaugaccccagcaugaauaag

SEQ ID NO: 450472 - RNA, 22 nt, Human
ugaaaguugcacauaagagaau

SEQ ID NO: 450473 - RNA, 22 nt, Human
agucccagcucugccacuuacu

SEQ ID NO: 450474 - RNA, 19 nt, Human
ccugugacuaucuuuguaa

SEQ ID NO: 450475 - RNA, 22 nt, Human
aaauguguuccuuugcuacaga

SEQ ID NO: 450476 - RNA, 22 nt, Human
agggcagagggugccucaccug

SEQ ID NO: 450477 - RNA, 21 nt, Human
uccugcagggcagcagagugg

SEQ ID NO: 450478 - RNA, 19 nt, Human
ucagggcaguccggucccc

SEQ ID NO: 450479 - RNA, 22 nt, Human
uuuaccaaauagauuaugucag

SEQ ID NO: 450480 - RNA, 22 nt, Human
ugucauuuucuaaucuguuguc

SEQ ID NO: 450481 - RNA, 22 nt, Human
uuaacagagugccuggcaugua

SEQ ID NO: 450482 - RNA, 21 nt, Human
auauuucucauaagguuaugg

SEQ ID NO: 450483 - RNA, 22 nt, Human
aaauguguguauguacauauau

SEQ ID NO: 450484 - RNA, 20 nt, Human
aaaauauguauaacucuucu

SEQ ID NO: 450485 - RNA, 22 nt, Human
acauuuaaauaugccuuauauu

SEQ ID NO: 450486 - RNA, 22 nt, Human
uguccugcaacugaaggagaag

SEQ ID NO: 450487 - RNA, 20 nt, Human
guugaaaguaauaugaugcu

SEQ ID NO: 450488 - RNA, 22 nt, Human
ugguggcaauguccuggagaag

SEQ ID NO: 450489 - RNA, 22 nt, Human
gaagccacaacuuuuucuuagc

SEQ ID NO: 450490 - RNA, 19 nt, Human
agcaccugugagagccugg

SEQ ID NO: 450491 - RNA, 22 nt, Human
agcucuggaauaaugaugugau

SEQ ID NO: 450492 - RNA, 22 nt, Human
ccuguacaucugcucucauugc

SEQ ID NO: 450493 - RNA, 18 nt, Human
gugagcagagagcaucac

SEQ ID NO: 450494 - RNA, 22 nt, Human
caugucuuuguuaugcucacca

SEQ ID NO: 450495 - RNA, 22 nt, Human
uaauuucacugauaugaaguca

SEQ ID NO: 450496 - RNA, 22 nt, Human
gcaccaggcagcugagcaggcc

SEQ ID NO: 450497 - RNA, 22 nt, Human
caguugaugggacucauguggg

SEQ ID NO: 450498 - RNA, 22 nt, Human
ucaggcugcuguacugugaaug

SEQ ID NO: 450499 - RNA, 22 nt, Human
aaggugucggcagagccgcuuc

SEQ ID NO: 450500 - RNA, 22 nt, Human
gagaugaauguaaacaaaggca

SEQ ID NO: 450501 - RNA, 22 nt, Human
ugacacagaaauuaagcuguca

SEQ ID NO: 450502 - RNA, 22 nt, Human
ucucagaggcccgacguucucc

SEQ ID NO: 450503 - RNA, 22 nt, Human
auuuuccagccuuucuagaacu

SEQ ID NO: 450504 - RNA, 22 nt, Human
caguggguccuaaguacaguuc

SEQ ID NO: 450505 - RNA, 22 nt, Human
aaaggccaugguuggaguguuu

SEQ ID NO: 450506 - RNA, 22 nt, Human
guguuuccucacuucucugacu

SEQ ID NO: 450507 - RNA, 22 nt, Human
ggaggccauaguuugggaguca

SEQ ID NO: 450508 - RNA, 22 nt, Human
gcuggagguuucaccugaguuu

SEQ ID NO: 450509 - RNA, 19 nt, Human
auuccucaaggacagaaau

SEQ ID NO: 450510 - RNA, 22 nt, Human
aaaggcuaugagauagaagaua

SEQ ID NO: 450511 - RNA, 22 nt, Human
acagggcagcaacuuugugccu

SEQ ID NO: 450512 - RNA, 22 nt, Human
uauaguaaaauuuucauuuaug

SEQ ID NO: 450513 - RNA, 19 nt, Human
gcaugcuugguggcuucug

SEQ ID NO: 450514 - RNA, 22 nt, Human
gcagagccccucaagccagccu

SEQ ID NO: 450515 - RNA, 20 nt, Human
gcaugaggaaucauugcagc

SEQ ID NO: 450516 - RNA, 22 nt, Human
uagaaacagaaaacuguaauag

SEQ ID NO: 450517 - RNA, 22 nt, Human
aaguaaaacacacaguccaccg

SEQ ID NO: 450518 - RNA, 21 nt, Human
agaugcugugcuccaggagca

SEQ ID NO: 450519 - RNA, 22 nt, Human
acugagcucuugacugggaguu

SEQ ID NO: 450520 - RNA, 22 nt, Human
caccuagggcaucccugcccca

SEQ ID NO: 450521 - RNA, 22 nt, Human
acuuugcagagccagaagagaa

SEQ ID NO: 450522 - RNA, 22 nt, Human
uucaggauggaguaccuuuuau

SEQ ID NO: 450523 - RNA, 22 nt, Human
uagcugcugcagcacagggagg

SEQ ID NO: 450524 - RNA, 22 nt, Human
uggucaguugcaucagagaagu

SEQ ID NO: 450525 - RNA, 22 nt, Human
gcaggcagguggcaucuuguga

SEQ ID NO: 450526 - RNA, 22 nt, Human
cagucccacuagugccaauacc

SEQ ID NO: 450527 - RNA, 22 nt, Human
gucugucucucuccagagugca

SEQ ID NO: 450528 - RNA, 22 nt, Human
caucagcacuaugauuaaagua

SEQ ID NO: 450529 - RNA, 22 nt, Human
uuuauccauucaccaguugaac

SEQ ID NO: 450530 - RNA, 22 nt, Human
aagggcugagcacagugagcca

SEQ ID NO: 450531 - RNA, 22 nt, Human
ucuggcucuccagugcucuuag

SEQ ID NO: 450532 - RNA, 22 nt, Human
cagcaguggaacuacccaggga

SEQ ID NO: 450533 - RNA, 22 nt, Human
caguauuuguucccuaucaaug

SEQ ID NO: 450534 - RNA, 22 nt, Human
guuacaaauguaaauucugggg

SEQ ID NO: 450535 - RNA, 22 nt, Human
ccacagaguuacaaaacaguca

SEQ ID NO: 450536 - RNA, 22 nt, Human
gccccuggcuggccagcuccuc

SEQ ID NO: 450537 - RNA, 22 nt, Human
acagauauaugauuguguaaau

SEQ ID NO: 450538 - RNA, 22 nt, Human
ugaggaaacuuacaaggcagaa

SEQ ID NO: 450539 - RNA, 22 nt, Human
ccacaggaccagaggagaucac

SEQ ID NO: 450540 - RNA, 22 nt, Human
gccucccuguucuuccacaaua

SEQ ID NO: 450541 - RNA, 22 nt, Human
gcugagagcaaagcaugucuag

SEQ ID NO: 450542 - RNA, 22 nt, Human
caagauggaguccgggaaugug

SEQ ID NO: 450543 - RNA, 22 nt, Human
gcagggugugucucauacaguu

SEQ ID NO: 450544 - RNA, 22 nt, Human
ucagggcacguuucugcaaugc

SEQ ID NO: 450545 - RNA, 22 nt, Human
uuagcucagaaaauuuaaacuu

SEQ ID NO: 450546 - RNA, 22 nt, Human
aagccuuccugagugcaaggcc

SEQ ID NO: 450547 - RNA, 22 nt, Human
caggguggcacucagcgcaucu

SEQ ID NO: 450548 - RNA, 22 nt, Human
augcacgccccacacuggugug

SEQ ID NO: 450549 - RNA, 22 nt, Human
ggagagcagggaggcugcucug

SEQ ID NO: 450550 - RNA, 22 nt, Human
gugcuuuccauccucccugcug

SEQ ID NO: 450551 - RNA, 22 nt, Human
aaguuucauguggagguagacu

SEQ ID NO: 450552 - RNA, 19 nt, Human
gggcuuggggcugaagccu

SEQ ID NO: 450553 - RNA, 22 nt, Human
caguggcaugguugacugcagu

SEQ ID NO: 450554 - RNA, 22 nt, Human
gccaggcaaauuaaggaaugca

SEQ ID NO: 450555 - RNA, 22 nt, Human
ucuggcucauacaagccugcaa

SEQ ID NO: 450556 - RNA, 22 nt, Human
ccuggaggcucugggagggcag

SEQ ID NO: 450557 - RNA, 22 nt, Human
auccaggguguggagagagcuc

SEQ ID NO: 450558 - RNA, 22 nt, Human
gcugaagggagugcugagucug

SEQ ID NO: 450559 - RNA, 22 nt, Human
ucucagagugacaaugagaauu

SEQ ID NO: 450560 - RNA, 22 nt, Human
uaugagaaaauaaauaucuguu

SEQ ID NO: 450561 - RNA, 22 nt, Human
gcagcugaauguccauugcugc

SEQ ID NO: 450562 - RNA, 22 nt, Human
ucuccuccuuuuuucaacauag

SEQ ID NO: 450563 - RNA, 22 nt, Human
ccaggagcauuaagagaacaua

SEQ ID NO: 450564 - RNA, 22 nt, Human
auuucuacaguacacaugcauu

SEQ ID NO: 450565 - RNA, 18 nt, Human
gccugggaggaggaaaug

SEQ ID NO: 450566 - RNA, 23 nt, Human
gccagccuugcucuccugcagcc

SEQ ID NO: 450567 - RNA, 22 nt, Human
gaggcucaguuaugucaucagg

SEQ ID NO: 450568 - RNA, 22 nt, Human
acaggcugcccgcuccccaccu

SEQ ID NO: 450569 - RNA, 22 nt, Human
cauacuuuugcccugacauucu

SEQ ID NO: 450570 - RNA, 22 nt, Human
gcuguucugcgucccaggcugg

SEQ ID NO: 450571 - RNA, 22 nt, Human
caagagagaugcagcucacuca

SEQ ID NO: 450572 - RNA, 22 nt, Human
cagcagccuacaaugcacagaa

SEQ ID NO: 450573 - RNA, 22 nt, Human
aagucauuaucucuucuaaucu

SEQ ID NO: 450574 - RNA, 22 nt, Human
aagauuucugcuccugagagaa

SEQ ID NO: 450575 - RNA, 22 nt, Human
gccuucugauugcuggacugac

SEQ ID NO: 450576 - RNA, 22 nt, Human
ugugaaaggggucacagggaaa

SEQ ID NO: 450577 - RNA, 20 nt, Human
ugggccugagccugugggcu

SEQ ID NO: 450578 - RNA, 22 nt, Human
accaggcagcaccaaagccggu

SEQ ID NO: 450579 - RNA, 22 nt, Human
ugcccagcacugugccagucac

SEQ ID NO: 450580 - RNA, 22 nt, Human
uagggaggcuacuucuuguagg

SEQ ID NO: 450581 - RNA, 22 nt, Human
uguggcaggcaagauguacaga

SEQ ID NO: 450582 - RNA, 22 nt, Human
ccaggugugccagcagggacug

SEQ ID NO: 450583 - RNA, 22 nt, Human
cugcugccggcgagccucccuu

SEQ ID NO: 450584 - RNA, 22 nt, Human
gaggaagcagggcuuggcugag

SEQ ID NO: 450585 - RNA, 22 nt, Human
agcuuuauauuuaaugaauucu

SEQ ID NO: 450586 - RNA, 22 nt, Human
accuggcacuacaggcaccugu

SEQ ID NO: 450587 - RNA, 21 nt, Human
acagagcauaaugguguggca

SEQ ID NO: 450588 - RNA, 22 nt, Human
uccauuuucaucucauguauaa

SEQ ID NO: 450589 - RNA, 22 nt, Human
uucaucuugauggcuuccuaau

SEQ ID NO: 450590 - RNA, 22 nt, Human
agagggcugcugcacagugcuc

SEQ ID NO: 450591 - RNA, 22 nt, Human
agggccugacacccuugccagc

SEQ ID NO: 450592 - RNA, 22 nt, Human
auaaacacuucuagggcacaca

SEQ ID NO: 450593 - RNA, 22 nt, Human
gggccugggaacuugcauuuag

SEQ ID NO: 450594 - RNA, 22 nt, Human
uccaggcuggacaugaggcggg

SEQ ID NO: 450595 - RNA, 22 nt, Human
acaguguguuggaggagacugu

SEQ ID NO: 450596 - RNA, 19 nt, Human
uagcagcugccaaaggaga

SEQ ID NO: 450597 - RNA, 22 nt, Human
acauucaugucccacuucuagc

SEQ ID NO: 450598 - RNA, 18 nt, Human
uggcagggaggaaauaua

SEQ ID NO: 450599 - RNA, 22 nt, Human
ggaagccagaaagugagaauau

SEQ ID NO: 450600 - RNA, 20 nt, Human
ucaaaggcaaaggugggugu

SEQ ID NO: 450601 - RNA, 22 nt, Human
uggagaugaauauguguaccug

SEQ ID NO: 450602 - RNA, 22 nt, Human
agaaugcauuuuguguagcuau

SEQ ID NO: 450603 - RNA, 22 nt, Human
uaaguuuuaagcaaucugauaa

SEQ ID NO: 450604 - RNA, 22 nt, Human
ccagagcugaugggcccagggu

SEQ ID NO: 450605 - RNA, 22 nt, Human
aaauccuaagcagaggaauuua

SEQ ID NO: 450606 - RNA, 22 nt, Human
ucaggcugcaucuguaagggug

SEQ ID NO: 450607 - RNA, 22 nt, Human
ccucaggggucacugugaggag

SEQ ID NO: 450608 - RNA, 22 nt, Human
ugggauaguggccaggaccccc

SEQ ID NO: 450609 - RNA, 22 nt, Human
ucugaacauccagcaaugcaca

SEQ ID NO: 450610 - RNA, 22 nt, Human
acccagcuguuucccgugucau

SEQ ID NO: 450611 - RNA, 22 nt, Human
ccugccuggcuuccagaagaga

SEQ ID NO: 450612 - RNA, 22 nt, Human
aagaauuauugcaauacuagau

SEQ ID NO: 450613 - RNA, 22 nt, Human
uaugcauaugaccccaagcuug

SEQ ID NO: 450614 - RNA, 22 nt, Human
acagcuuuucugauagauccug

SEQ ID NO: 450615 - RNA, 22 nt, Human
auauauuuacucuccuguugca

SEQ ID NO: 450616 - RNA, 22 nt, Human
caaaauuagaaaugcagcuguu

SEQ ID NO: 450617 - RNA, 22 nt, Human
gggccuggggacaccaccauga

SEQ ID NO: 450618 - RNA, 22 nt, Human
acauuucucauaggagagccac

SEQ ID NO: 450619 - RNA, 22 nt, Human
caccaggugcuggaggacauca

SEQ ID NO: 450620 - RNA, 22 nt, Human
uacaugcuccacuuucuccugu

SEQ ID NO: 450621 - RNA, 22 nt, Human
ccugcugggccugagcaaugag

SEQ ID NO: 450622 - RNA, 22 nt, Human
uggagaugcacgagcaggugga

SEQ ID NO: 450623 - RNA, 23 nt, Human
gagggcucugagugcuugggcca

SEQ ID NO: 450624 - RNA, 22 nt, Human
cagggcaguaacgggaacaucu

SEQ ID NO: 450625 - RNA, 23 nt, Human
gaggccacauuccccugcuugag

SEQ ID NO: 450626 - RNA, 22 nt, Human
aauaauguugacgauagucuua

SEQ ID NO: 450627 - RNA, 22 nt, Human
ucuccacucugagugccuuuca

SEQ ID NO: 450628 - RNA, 22 nt, Human
guuuauuagaguuuucugucug

SEQ ID NO: 450629 - RNA, 22 nt, Human
ggcuucucucuucacauggcuu

SEQ ID NO: 450630 - RNA, 20 nt, Human
ugcagcugguuucacaggga

SEQ ID NO: 450631 - RNA, 22 nt, Human
aggccuguuggcgugggcucua

SEQ ID NO: 450632 - RNA, 22 nt, Human
cuggcucacaggugagaugcau

SEQ ID NO: 450633 - RNA, 22 nt, Human
gcucccagacugaccagaggug

SEQ ID NO: 450634 - RNA, 22 nt, Human
uuggccuucccuaccugggcca

SEQ ID NO: 450635 - RNA, 22 nt, Human
acagacagauuuugucugaugu

SEQ ID NO: 450636 - RNA, 22 nt, Human
augggaggaucacuugaggcca

SEQ ID NO: 450637 - RNA, 22 nt, Human
uagagaaaagcagggaucagga

SEQ ID NO: 450638 - RNA, 22 nt, Human
uggagcaggugccaggugugug

SEQ ID NO: 450639 - RNA, 22 nt, Human
aaaggucagcugccaucguucu

SEQ ID NO: 450640 - RNA, 22 nt, Human
uccaguggagugugggggugaa

SEQ ID NO: 450641 - RNA, 19 nt, Human
ugaguucugugguucucaa

SEQ ID NO: 450642 - RNA, 22 nt, Human
gcccaucaucacuguggaggcu

SEQ ID NO: 450643 - RNA, 22 nt, Human
ggccucgcggcuucugguggcu

SEQ ID NO: 450644 - RNA, 22 nt, Human
aggagggcuaggaaaaccagga

SEQ ID NO: 450645 - RNA, 22 nt, Human
aacccagccguguagcugccgc

SEQ ID NO: 450646 - RNA, 22 nt, Human
caguuuauaugucagagcugua

SEQ ID NO: 450647 - RNA, 22 nt, Human
gaaggccauuuuuagguagaau

SEQ ID NO: 450648 - RNA, 22 nt, Human
uuuaauuuguauuucuagaggg

SEQ ID NO: 450649 - RNA, 22 nt, Human
ugaaugaugcaguauaaugaua

SEQ ID NO: 450650 - RNA, 22 nt, Human
cgagaguuagcuaggagucaca

SEQ ID NO: 450651 - RNA, 22 nt, Human
uccagcucuaacaugcugggcc

SEQ ID NO: 450652 - RNA, 22 nt, Human
uuauuauuuuguguacagcaaa

SEQ ID NO: 450653 - RNA, 22 nt, Human
gaaggcuaaaggggcagagguu

SEQ ID NO: 450654 - RNA, 22 nt, Human
aaaaaugcuuggacuuaauaaa

SEQ ID NO: 450655 - RNA, 22 nt, Human
uacacauguuuggcaaguaugu

SEQ ID NO: 450656 - RNA, 22 nt, Human
ccagggugagugucauggguua

SEQ ID NO: 450657 - RNA, 22 nt, Human
gaagcccagcaaacugugauca

SEQ ID NO: 450658 - RNA, 22 nt, Human
uacagauugagguuuuuaauau

SEQ ID NO: 450659 - RNA, 22 nt, Human
cuucccugauaagagccucaga

SEQ ID NO: 450660 - RNA, 22 nt, Human
aagggcaggagaagacggauau

SEQ ID NO: 450661 - RNA, 19 nt, Human
uucacauuggaagaaguag

SEQ ID NO: 450662 - RNA, 23 nt, Human
ggaguuggauuguacuugcugcu

SEQ ID NO: 450663 - RNA, 22 nt, Human
uagaauaugauuaauuuucuua

SEQ ID NO: 450664 - RNA, 22 nt, Human
caggagugcagguggugaggca

SEQ ID NO: 450665 - RNA, 21 nt, Human
ggcuuuaugcucacccagccu

SEQ ID NO: 450666 - RNA, 22 nt, Human
aauuagggaggacaaagguaca

SEQ ID NO: 450667 - RNA, 22 nt, Human
ucacugcaaucucugccuucca

SEQ ID NO: 450668 - RNA, 22 nt, Human
auuagggaaacugacuugucuc

SEQ ID NO: 450669 - RNA, 22 nt, Human
uuucucauagucaugccucuua

SEQ ID NO: 450670 - RNA, 22 nt, Human
cuuggccucuucucaggguggg

SEQ ID NO: 450671 - RNA, 20 nt, Human
acagaaagagagaaugucag

SEQ ID NO: 450672 - RNA, 22 nt, Human
cauuucugggagacaugcuaga

SEQ ID NO: 450673 - RNA, 22 nt, Human
ugcccugugugugcaagcacug

SEQ ID NO: 450674 - RNA, 23 nt, Human
aggcccugccugucccucuuuuu

SEQ ID NO: 450675 - RNA, 21 nt, Human
cugguguagcacucaggugcu

SEQ ID NO: 450676 - RNA, 22 nt, Human
uccugcaggcuugaguccucag

SEQ ID NO: 450677 - RNA, 23 nt, Human
aggcuuccuaucuuagagcuggg

SEQ ID NO: 450678 - RNA, 22 nt, Human
ccagagagguagcuuacccucu

SEQ ID NO: 450679 - RNA, 22 nt, Human
acuaaagaagccaaaguuuucu

SEQ ID NO: 450680 - RNA, 22 nt, Human
ucagcuuugccaccagcuguaa

SEQ ID NO: 450681 - RNA, 21 nt, Human
agggucaggaaccaggguacc

SEQ ID NO: 450682 - RNA, 22 nt, Human
gucucagagagcuacucucuua

SEQ ID NO: 450683 - RNA, 22 nt, Human
agccccaguccgcugcgggcgg

SEQ ID NO: 450684 - RNA, 22 nt, Human
uaggagaggugaauggcacacu

SEQ ID NO: 450685 - RNA, 21 nt, Human
cagggcacacagaggauggua

SEQ ID NO: 450686 - RNA, 22 nt, Human
aaaaaucuaugacugcuucucc

SEQ ID NO: 450687 - RNA, 22 nt, Human
cagaccugagguugaguaccag

SEQ ID NO: 450688 - RNA, 22 nt, Human
ucuaccacuaagugugcuuuga

SEQ ID NO: 450689 - RNA, 22 nt, Human
acaaagucaaauugcagccgcc

SEQ ID NO: 450690 - RNA, 22 nt, Human
uccagccaccaccuugauugcc

SEQ ID NO: 450691 - RNA, 22 nt, Human
gcucucuggguggugggcaaca

SEQ ID NO: 450692 - RNA, 22 nt, Human
gagggggagaugugcacacacu

SEQ ID NO: 450693 - RNA, 22 nt, Human
gccuggcaggccucaugagggg

SEQ ID NO: 450694 - RNA, 22 nt, Human
gaggaaggcuaaggggcuuaga

SEQ ID NO: 450695 - RNA, 23 nt, Human
ugcuucucugcuugacaguucug

SEQ ID NO: 450696 - RNA, 20 nt, Human
acaaaugcauucugugacau

SEQ ID NO: 450697 - RNA, 22 nt, Human
ucaggcaggcucagaggaaaac

SEQ ID NO: 450698 - RNA, 22 nt, Human
ggcugccuacuuucccagaguu

SEQ ID NO: 450699 - RNA, 22 nt, Human
uugcauguguaauuuuucuaaa

SEQ ID NO: 450700 - RNA, 22 nt, Human
uuuauguaaguggaaugaugcc

SEQ ID NO: 450701 - RNA, 19 nt, Human
gaucagagugucagcuugu

SEQ ID NO: 450702 - RNA, 22 nt, Human
ucaggaauccagacagggcaca

SEQ ID NO: 450703 - RNA, 22 nt, Human
aggucaggguauucacgucugu

SEQ ID NO: 450704 - RNA, 22 nt, Human
gcaugugucuccccaguggagg

SEQ ID NO: 450705 - RNA, 22 nt, Human
gcauagucaguaggauucucaa

SEQ ID NO: 450706 - RNA, 22 nt, Human
acuuccuguguuggucuugcug

SEQ ID NO: 450707 - RNA, 22 nt, Human
gacaggcuuccuaagugccaga

SEQ ID NO: 450708 - RNA, 22 nt, Human
gggcuggaggaccggccucgga

SEQ ID NO: 450709 - RNA, 22 nt, Human
agagccuggggauuggcaaggg

SEQ ID NO: 450710 - RNA, 22 nt, Human
uggguggaauaaaucaguucug

SEQ ID NO: 450711 - RNA, 22 nt, Human
aagggcucuguugccauuucag

SEQ ID NO: 450712 - RNA, 22 nt, Human
ggcuagaguggaacuggagcgg

SEQ ID NO: 450713 - RNA, 23 nt, Human
gccugccugaccugugcaaaguc

SEQ ID NO: 450714 - RNA, 22 nt, Human
auggggugagacuaggauuaaa

SEQ ID NO: 450715 - RNA, 22 nt, Human
uucaggauaugugauaucugaa

SEQ ID NO: 450716 - RNA, 20 nt, Human
ccuggaagagcuccccaggc

SEQ ID NO: 450717 - RNA, 17 nt, Human
agaugcuggccacaugu

SEQ ID NO: 450718 - RNA, 22 nt, Human
ccagcagagcauggggaggaag

SEQ ID NO: 450719 - RNA, 22 nt, Human
gcagggaccagggccagaucca

SEQ ID NO: 450720 - RNA, 22 nt, Human
ggcugagccaugggcacugcag

SEQ ID NO: 450721 - RNA, 22 nt, Human
acauuuguaugcguuuuuacug

SEQ ID NO: 450722 - RNA, 22 nt, Human
agggcucccgcgguguccggga

SEQ ID NO: 450723 - RNA, 22 nt, Human
ugcagggcuuccucuuggaguu

SEQ ID NO: 450724 - RNA, 22 nt, Human
agaggccaucugcucugugggg

SEQ ID NO: 450725 - RNA, 22 nt, Human
ccaaagucagugcucagucguc

SEQ ID NO: 450726 - RNA, 22 nt, Human
ucaaaguccuugcuuuuucugu

SEQ ID NO: 450727 - RNA, 17 nt, Human
uccaggcagcaacugag

SEQ ID NO: 450728 - RNA, 22 nt, Human
agaagccaacagggcaggagag

SEQ ID NO: 450729 - RNA, 22 nt, Human
ucaguauccacaaaugcucaaa

SEQ ID NO: 450730 - RNA, 22 nt, Human
uuuuucauugcagccucucucc

SEQ ID NO: 450731 - RNA, 22 nt, Human
ccagagcagauguggccuuggu

SEQ ID NO: 450732 - RNA, 22 nt, Human
acagagcaugcucaguguguga

SEQ ID NO: 450733 - RNA, 22 nt, Human
cuauuucuaaaccuauaaguga

SEQ ID NO: 450734 - RNA, 22 nt, Human
ucagagugaggcccagcaaucu

SEQ ID NO: 450735 - RNA, 20 nt, Human
ccucaguguccuggacuggg

SEQ ID NO: 450736 - RNA, 22 nt, Human
gggcguggauggucagugcagg

SEQ ID NO: 450737 - RNA, 22 nt, Human
cccugcagagggaugggggcag

SEQ ID NO: 450738 - RNA, 22 nt, Human
uggcugagugauauuugcaaag

SEQ ID NO: 450739 - RNA, 22 nt, Human
uccuugaaugaagagaggugac

SEQ ID NO: 450740 - RNA, 22 nt, Human
agagggcauuaacucugucuug

SEQ ID NO: 450741 - RNA, 22 nt, Human
ggcuggaaaagacaaagcuauu

SEQ ID NO: 450742 - RNA, 22 nt, Human
uggcagcuacagacagagguga

SEQ ID NO: 450743 - RNA, 22 nt, Human
aggugcuuggcucgugcacaca

SEQ ID NO: 450744 - RNA, 19 nt, Human
ccugggagucagcugaagg

SEQ ID NO: 450745 - RNA, 22 nt, Human
agugaaauccuggucaacaggu

SEQ ID NO: 450746 - RNA, 22 nt, Human
cagggcugagaauuuagagaca

SEQ ID NO: 450747 - RNA, 20 nt, Human
agaagcugauacugauggaa

SEQ ID NO: 450748 - RNA, 20 nt, Human
ggcagagggccugggagaag

SEQ ID NO: 450749 - RNA, 22 nt, Human
uccuggaguugugcagugcaca

SEQ ID NO: 450750 - RNA, 22 nt, Human
ucuuuccacauucucuguuuag

SEQ ID NO: 450751 - RNA, 22 nt, Human
ugcuagaauaccuaccuggagg

SEQ ID NO: 450752 - RNA, 22 nt, Human
caggacauugauccauuggcac

SEQ ID NO: 450753 - RNA, 19 nt, Human
cucucacucgccacauccu

SEQ ID NO: 450754 - RNA, 19 nt, Human
aauucuguuucagcagauc

SEQ ID NO: 450755 - RNA, 22 nt, Human
agccacagcgaaccucucuucc

SEQ ID NO: 450756 - RNA, 22 nt, Human
cugaaggagcauagucaguuuu

SEQ ID NO: 450757 - RNA, 22 nt, Human
acacaucagaaauaugaaugag

SEQ ID NO: 450758 - RNA, 22 nt, Human
gcagacagacugcagugauuuu

SEQ ID NO: 450759 - RNA, 22 nt, Human
ugauuuccuaggucuggagaag

SEQ ID NO: 450760 - RNA, 22 nt, Human
aaggguggauuucugagcucua

SEQ ID NO: 450761 - RNA, 22 nt, Human
ugcagaccucccauggcugccu

SEQ ID NO: 450762 - RNA, 22 nt, Human
agcugccauccgaggugucaga

SEQ ID NO: 450763 - RNA, 22 nt, Human
acagccuggccugaguuaaggc

SEQ ID NO: 450764 - RNA, 22 nt, Human
cagcuuuaccaauauuuggaaa

SEQ ID NO: 450765 - RNA, 22 nt, Human
ugccagaguuacaugaggguca

SEQ ID NO: 450766 - RNA, 22 nt, Human
aaagccagcucugagcugcacc

SEQ ID NO: 450767 - RNA, 22 nt, Human
aggcacugaaggaagcuugcgc

SEQ ID NO: 450768 - RNA, 22 nt, Human
gggcugaggcuaccacuggucu

SEQ ID NO: 450769 - RNA, 22 nt, Human
uauuuugagguauuuuugagcu

SEQ ID NO: 450770 - RNA, 22 nt, Human
aaaugucugagacuucugaacu

SEQ ID NO: 450771 - RNA, 22 nt, Human
cauuccuuaacguggggagucu

SEQ ID NO: 450772 - RNA, 22 nt, Human
uauagagguggaaacugagguu

SEQ ID NO: 450773 - RNA, 22 nt, Human
ucucagggcagcaaggaagcau

SEQ ID NO: 450774 - RNA, 22 nt, Human
aacucaguuacauauuagaaua

SEQ ID NO: 450775 - RNA, 22 nt, Human
uguauuuugugaggaucacucu

SEQ ID NO: 450776 - RNA, 22 nt, Human
uguagcauguaaauugguuauu

SEQ ID NO: 450777 - RNA, 22 nt, Human
ccagaggcuggguucaccucag

SEQ ID NO: 450778 - RNA, 22 nt, Human
ucacugcaaccucugccuuccg

SEQ ID NO: 450779 - RNA, 22 nt, Human
acuauacauugaauguuaaggu

SEQ ID NO: 450780 - RNA, 22 nt, Human
caggagcaguuagaagcccacu

SEQ ID NO: 450781 - RNA, 22 nt, Human
ggaaggagggcggcaaugauga

SEQ ID NO: 450782 - RNA, 22 nt, Human
aggcagcccacaggacacagga

SEQ ID NO: 450783 - RNA, 22 nt, Human
ucccacucccaggcaggccucu

SEQ ID NO: 450784 - RNA, 22 nt, Human
cugggcaguaugaauauucaaa

SEQ ID NO: 450785 - RNA, 22 nt, Human
ccugugucuuccccacuggugu

SEQ ID NO: 450786 - RNA, 19 nt, Human
ggaggccuggguauuugcc

SEQ ID NO: 450787 - RNA, 18 nt, Human
cccagcuccacuucccuc

SEQ ID NO: 450788 - RNA, 16 nt, Human
cagccugcagugguca

SEQ ID NO: 450789 - RNA, 22 nt, Human
uagcugccaaaagggugggcua

SEQ ID NO: 450790 - RNA, 22 nt, Human
caucuggcuagcuaucauugug

SEQ ID NO: 450791 - RNA, 22 nt, Human
ucuuuuauuaggcugaaauggg

SEQ ID NO: 450792 - RNA, 22 nt, Human
acuguguccucauguggcagaa

SEQ ID NO: 450793 - RNA, 22 nt, Human
ucacaucuuauuagaguaucuc

SEQ ID NO: 450794 - RNA, 18 nt, Human
cucagagaugcccuuauu

SEQ ID NO: 450795 - RNA, 22 nt, Human
uggggcugugagacuacaggau

SEQ ID NO: 450796 - RNA, 22 nt, Human
aaaaguaauugcaauuuuguag

SEQ ID NO: 450797 - RNA, 22 nt, Human
agagccuguaacaucuuucuua

SEQ ID NO: 450798 - RNA, 22 nt, Human
uuugcuuguucaagauuucugu

SEQ ID NO: 450799 - RNA, 22 nt, Human
gggagggaaggaccuuaugaau

SEQ ID NO: 450800 - RNA, 22 nt, Human
aauuugauuuucuuaaaccaua

SEQ ID NO: 450801 - RNA, 19 nt, Human
aaaguuuuauucucauuug

SEQ ID NO: 450802 - RNA, 21 nt, Human
aucccagcacccaggagugca

SEQ ID NO: 450803 - RNA, 22 nt, Human
aauguguauaugaacauacagg

SEQ ID NO: 450804 - RNA, 20 nt, Human
gugcaauggcucagucucag

SEQ ID NO: 450805 - RNA, 22 nt, Human
agcugccagggacugggcaugg

SEQ ID NO: 450806 - RNA, 22 nt, Human
cagggugccucccgcucgccgg

SEQ ID NO: 450807 - RNA, 22 nt, Human
gaggcagcaugguaccuuggag

SEQ ID NO: 450808 - RNA, 22 nt, Human
aaugugguuaacccauuuaaga

SEQ ID NO: 450809 - RNA, 22 nt, Human
gggcugagugucccaggccgaa

SEQ ID NO: 450810 - RNA, 22 nt, Human
ugccugccaugcagaaagcuga

SEQ ID NO: 450811 - RNA, 22 nt, Human
ccagggugcucuguggcgucgc

SEQ ID NO: 450812 - RNA, 22 nt, Human
ugcagcucauugcuggggucug

SEQ ID NO: 450813 - RNA, 20 nt, Human
agaaucugacccagagagac

SEQ ID NO: 450814 - RNA, 19 nt, Human
cagcaauaaugccagaugg

SEQ ID NO: 450815 - RNA, 22 nt, Human
accuggccauccagcuggcauc

SEQ ID NO: 450816 - RNA, 22 nt, Human
agccugcuucccuuugugcccc

SEQ ID NO: 450817 - RNA, 23 nt, Human
cuuuccuuucuuugacacccagc

SEQ ID NO: 450818 - RNA, 22 nt, Human
cauggaaggcaaaagacacaga

SEQ ID NO: 450819 - RNA, 22 nt, Human
caggcagcugcuggguucagcc

SEQ ID NO: 450820 - RNA, 22 nt, Human
aaguauauuuuuugaagcauau

SEQ ID NO: 450821 - RNA, 22 nt, Human
ugguccaggguguaguacagag

SEQ ID NO: 450822 - RNA, 22 nt, Human
agggcugagcccaggcauguag

SEQ ID NO: 450823 - RNA, 22 nt, Human
uuuccauauuuggucuuuggga

SEQ ID NO: 450824 - RNA, 22 nt, Human
gccagcuggagugagagugggc

SEQ ID NO: 450825 - RNA, 22 nt, Human
uuguucaugguuguaaguuuga

SEQ ID NO: 450826 - RNA, 22 nt, Human
gcugccuuuuaaagccucgcuu

SEQ ID NO: 450827 - RNA, 22 nt, Human
ucucacugcaaauauuauguau

SEQ ID NO: 450828 - RNA, 22 nt, Human
gagggcugauaacaggaauaca

SEQ ID NO: 450829 - RNA, 20 nt, Human
cagaggcaaggagacuugga

SEQ ID NO: 450830 - RNA, 21 nt, Human
ucaaagcacauauuugcacau

SEQ ID NO: 450831 - RNA, 22 nt, Human
gccaggcauuauuccgaucccu

SEQ ID NO: 450832 - RNA, 22 nt, Human
ugaggcagguaagcaaguuuug

SEQ ID NO: 450833 - RNA, 22 nt, Human
uagucaaaccucagaauacccc

SEQ ID NO: 450834 - RNA, 22 nt, Human
cuggcuccauccuugagcucug

SEQ ID NO: 450835 - RNA, 22 nt, Human
uccuggaguauuucuguggugu

SEQ ID NO: 450836 - RNA, 22 nt, Human
ugggccacggggguggagagcu

SEQ ID NO: 450837 - RNA, 22 nt, Human
cauuuguaguuaaaaaugucuc

SEQ ID NO: 450838 - RNA, 20 nt, Human
uccagcugggaacagcugau

SEQ ID NO: 450839 - RNA, 22 nt, Human
ccagcccuccuccaucagagga

SEQ ID NO: 450840 - RNA, 22 nt, Human
gccaugccugugucuccaggcc

SEQ ID NO: 450841 - RNA, 22 nt, Human
aguggcaguggggcagggcccu

SEQ ID NO: 450842 - RNA, 22 nt, Human
uucaaaauuguucuaagcucug

SEQ ID NO: 450843 - RNA, 22 nt, Human
ugcucucucaggccuggcccac

SEQ ID NO: 450844 - RNA, 22 nt, Human
ucauugcauuuauucacuggca

SEQ ID NO: 450845 - RNA, 22 nt, Human
agccaaggagugcagguggcuu

SEQ ID NO: 450846 - RNA, 22 nt, Human
agcugucugucuccugaggaga

SEQ ID NO: 450847 - RNA, 22 nt, Human
augauuuccaguuguugcuaag

SEQ ID NO: 450848 - RNA, 23 nt, Human
uggggagaguuacccuggaagcg

SEQ ID NO: 450849 - RNA, 22 nt, Human
ugaggcagccugcauuaaagag

SEQ ID NO: 450850 - RNA, 22 nt, Human
auguguagaacuguaaugccca

SEQ ID NO: 450851 - RNA, 23 nt, Human
cccagagcacagccuccagaugc

SEQ ID NO: 450852 - RNA, 22 nt, Human
uuuugaaagaguccugcuacag

SEQ ID NO: 450853 - RNA, 22 nt, Human
uaauuuuacuuccugagcaccu

SEQ ID NO: 450854 - RNA, 22 nt, Human
ccagcagcuuuauuggcucucc

SEQ ID NO: 450855 - RNA, 22 nt, Human
ugucauguguucuuaaauacau

SEQ ID NO: 450856 - RNA, 22 nt, Human
uugugcauuucucugagugugu

SEQ ID NO: 450857 - RNA, 22 nt, Human
gaggcaggcagauugcuugagg

SEQ ID NO: 450858 - RNA, 22 nt, Human
uugcauguuauuuaaucuguau

SEQ ID NO: 450859 - RNA, 22 nt, Human
aggcugagugcuccccuagaug

SEQ ID NO: 450860 - RNA, 22 nt, Human
gggcagguuauuggaguaggga

SEQ ID NO: 450861 - RNA, 22 nt, Human
uauguacauguuaaagggcaaa

SEQ ID NO: 450862 - RNA, 22 nt, Human
cccucccaagcacucugacaua

SEQ ID NO: 450863 - RNA, 22 nt, Human
ccugggagagucuguggucucc

SEQ ID NO: 450864 - RNA, 22 nt, Human
ucugagaguccaucuccaagcc

SEQ ID NO: 450865 - RNA, 22 nt, Human
acuuagaacaggcagaauucca

SEQ ID NO: 450866 - RNA, 20 nt, Human
agaggcuuccuugggaggag

SEQ ID NO: 450867 - RNA, 21 nt, Human
cuugaaagguagagucuacag

SEQ ID NO: 450868 - RNA, 22 nt, Human
uuugaaagagcugauacaugaa

SEQ ID NO: 450869 - RNA, 22 nt, Human
ugagagucucagaccuccuggu

SEQ ID NO: 450870 - RNA, 22 nt, Human
uggccugguaccacauagauuu

SEQ ID NO: 450871 - RNA, 22 nt, Human
ccagagcaauucucacagaacu

SEQ ID NO: 450872 - RNA, 22 nt, Human
cuuucauucuuagauauuagug

SEQ ID NO: 450873 - RNA, 21 nt, Human
ugcaugcuauguuuuuauuuc

SEQ ID NO: 450874 - RNA, 22 nt, Human
aaugucugagucucuguauccc

SEQ ID NO: 450875 - RNA, 22 nt, Human
gcugugugcucacguaguggaa

SEQ ID NO: 450876 - RNA, 22 nt, Human
cagcagaggaaagcaaaucuaa

SEQ ID NO: 450877 - RNA, 22 nt, Human
gccccagcucugccacaacuag

SEQ ID NO: 450878 - RNA, 22 nt, Human
aucaggaaauacuuauuuauaa

SEQ ID NO: 450879 - RNA, 22 nt, Human
uggaaggcaugggaacuguucu

SEQ ID NO: 450880 - RNA, 22 nt, Human
auggaaagcuaagccauuuacc

SEQ ID NO: 450881 - RNA, 23 nt, Human
aggugccaacugagagcugagag

SEQ ID NO: 450882 - RNA, 22 nt, Human
acucugagcaucccaagucuua

SEQ ID NO: 450883 - RNA, 22 nt, Human
acagaacugagaauucucuauc

SEQ ID NO: 450884 - RNA, 22 nt, Human
cagcugugggccugacguggca

SEQ ID NO: 450885 - RNA, 22 nt, Human
ccugcagaccacacucaguccu

SEQ ID NO: 450886 - RNA, 22 nt, Human
aggcacugaagugguaaaugua

SEQ ID NO: 450887 - RNA, 22 nt, Human
uccugagggcgauucagcaggu

SEQ ID NO: 450888 - RNA, 22 nt, Human
ccagagucuaugaguccucauu

SEQ ID NO: 450889 - RNA, 22 nt, Human
gccagggcaggggagcaucugc

SEQ ID NO: 450890 - RNA, 22 nt, Human
uggccuggcagagcaaggccug

SEQ ID NO: 450891 - RNA, 19 nt, Human
cagagccucagagcuagaa

SEQ ID NO: 450892 - RNA, 22 nt, Human
cuguccauuuucgugccuccuu

SEQ ID NO: 450893 - RNA, 22 nt, Human
ucacugucugaaagaaauggcc

SEQ ID NO: 450894 - RNA, 22 nt, Human
ucacuuagauggggaucaucac

SEQ ID NO: 450895 - RNA, 22 nt, Human
ccugccagcccgcguucaugcc

SEQ ID NO: 450896 - RNA, 22 nt, Human
augcaguaaauguuaagaaaaa

SEQ ID NO: 450897 - RNA, 22 nt, Human
gguucccggaucuccgaguccc

SEQ ID NO: 450898 - RNA, 22 nt, Human
aagggcucugggcuacgcacug

SEQ ID NO: 450899 - RNA, 22 nt, Human
ugggacugcucuugcugggguc

SEQ ID NO: 450900 - RNA, 22 nt, Human
ugacacaggcagcucccagcac

SEQ ID NO: 450901 - RNA, 22 nt, Human
uacaaaugaguuguaugaacca

SEQ ID NO: 450902 - RNA, 22 nt, Human
ugucucugguauuaggugaaaa

SEQ ID NO: 450903 - RNA, 22 nt, Human
agguggagaagagaugggcagu

SEQ ID NO: 450904 - RNA, 22 nt, Human
agcugggaggugggcagugaga

SEQ ID NO: 450905 - RNA, 22 nt, Human
aaugauggauuuagacaagcug

SEQ ID NO: 450906 - RNA, 22 nt, Human
aggcuccaugcaaaggcuguuu

SEQ ID NO: 450907 - RNA, 22 nt, Human
ugagaggcagaauggugccugc

SEQ ID NO: 450908 - RNA, 22 nt, Human
cagcugccugcaacacaagcuu

SEQ ID NO: 450909 - RNA, 22 nt, Human
uugaagcaggaaaauuucuauu

SEQ ID NO: 450910 - RNA, 22 nt, Human
caggcagagcaacugguccaga

SEQ ID NO: 450911 - RNA, 22 nt, Human
uggcagcagggaggccaguguu

SEQ ID NO: 450912 - RNA, 22 nt, Human
cgucuuccucuuacgaugcgcu

SEQ ID NO: 450913 - RNA, 22 nt, Human
ggucaggguuccagguaucuuc

SEQ ID NO: 450914 - RNA, 22 nt, Human
cuggacagaaaaggccacugga

SEQ ID NO: 450915 - RNA, 22 nt, Human
gaggggcagaaugugaucaggg

SEQ ID NO: 450916 - RNA, 22 nt, Human
acaggcagagaacucagccaga

SEQ ID NO: 450917 - RNA, 22 nt, Human
cccaggaguuugaguucagcau

SEQ ID NO: 450918 - RNA, 22 nt, Human
cuagagaggcagauguccugug

SEQ ID NO: 450919 - RNA, 22 nt, Human
uggccagguugggcuuugcagc

SEQ ID NO: 450920 - RNA, 22 nt, Human
acacugaaugcuguuuagaaau

SEQ ID NO: 450921 - RNA, 22 nt, Human
uccauauuaacuaaaacuagaa

SEQ ID NO: 450922 - RNA, 22 nt, Human
aagcuuuaagugucagucagcc

SEQ ID NO: 450923 - RNA, 22 nt, Human
uuugcauuguuucaaaagugaa

SEQ ID NO: 450924 - RNA, 23 nt, Human
acucacaaagcaggaucauguug

SEQ ID NO: 450925 - RNA, 22 nt, Human
uggcuuucucccccagcuucuc

SEQ ID NO: 450926 - RNA, 22 nt, Human
cugcaggggccucgagcacagg

SEQ ID NO: 450927 - RNA, 23 nt, Human
uggccuggagagaaaagaugagu

SEQ ID NO: 450928 - RNA, 22 nt, Human
agucucagaguaccugagggac

SEQ ID NO: 450929 - RNA, 22 nt, Human
uucacaaaaaugcugaacaguu

SEQ ID NO: 450930 - RNA, 22 nt, Human
aaggcaggaugcggacccaucu

SEQ ID NO: 450931 - RNA, 21 nt, Human
aaugugugcuauuuaucuuuu

SEQ ID NO: 450932 - RNA, 23 nt, Human
gccuggccaccccagggcugcuu

SEQ ID NO: 450933 - RNA, 22 nt, Human
aaggccaucuacuuacggaauu

SEQ ID NO: 450934 - RNA, 22 nt, Human
auauaaaguguuuagaaagcug

SEQ ID NO: 450935 - RNA, 22 nt, Human
cagcaggggaacugugggccag

SEQ ID NO: 450936 - RNA, 22 nt, Human
agaggccacuuugccugugaug

SEQ ID NO: 450937 - RNA, 22 nt, Human
cccaggugggcaccucgaggaa

SEQ ID NO: 450938 - RNA, 22 nt, Human
ucagauggguuuugaaggaugu

SEQ ID NO: 450939 - RNA, 22 nt, Human
uaaaugugcacagguuagaagg

SEQ ID NO: 450940 - RNA, 22 nt, Human
cucuccagccacagaagcugcu

SEQ ID NO: 450941 - RNA, 22 nt, Human
gaugccuccaaaugagggcaga

SEQ ID NO: 450942 - RNA, 22 nt, Human
ucagaaaugaucguuauucauu

SEQ ID NO: 450943 - RNA, 22 nt, Human
ggcugaguugagaggauuacuu

SEQ ID NO: 450944 - RNA, 22 nt, Human
ccuggcagcaggugggcccgug

SEQ ID NO: 450945 - RNA, 22 nt, Human
uggcagcaguagccaccccagc

SEQ ID NO: 450946 - RNA, 21 nt, Human
agaaaaacacgauauaagccc

SEQ ID NO: 450947 - RNA, 22 nt, Human
ggcgcuggccacgguggcucug

SEQ ID NO: 450948 - RNA, 22 nt, Human
cagagugaacagugggaugugc

SEQ ID NO: 450949 - RNA, 22 nt, Human
ccugcaggcugcaggccaguuc

SEQ ID NO: 450950 - RNA, 22 nt, Human
ucuguuuaggcaaaauagcuac

SEQ ID NO: 450951 - RNA, 22 nt, Human
ggcugggcugcugggucagagc

SEQ ID NO: 450952 - RNA, 22 nt, Human
caggcccagcccagcccuucga

SEQ ID NO: 450953 - RNA, 22 nt, Human
ggccaggagauggacaccacau

SEQ ID NO: 450954 - RNA, 21 nt, Human
ccucugcucgggcaugcguuu

SEQ ID NO: 450955 - RNA, 22 nt, Human
cagccuucugaaugaacguacu

SEQ ID NO: 450956 - RNA, 22 nt, Human
gaggggaaagugugaggcugcg

SEQ ID NO: 450957 - RNA, 20 nt, Human
gaaaugugaccucuucugug

SEQ ID NO: 450958 - RNA, 22 nt, Human
ugggcucauggcccagcacugg

SEQ ID NO: 450959 - RNA, 22 nt, Human
guggauggauugaggcaguggg

SEQ ID NO: 450960 - RNA, 22 nt, Human
ugcagugccucggcagugcagc

SEQ ID NO: 450961 - RNA, 22 nt, Human
cauggcagagaaggggaacugg

SEQ ID NO: 450962 - RNA, 22 nt, Human
ggcccaaggcccaggucgagcu

SEQ ID NO: 450963 - RNA, 22 nt, Human
cagcugagucugagguucuuug

SEQ ID NO: 450964 - RNA, 22 nt, Human
uggcugaggcuuuucuuaaaga

SEQ ID NO: 450965 - RNA, 22 nt, Human
ucaggcugugggcacuggccau

SEQ ID NO: 450966 - RNA, 18 nt, Human
gagaggcccggcugugcc

SEQ ID NO: 450967 - RNA, 22 nt, Human
ggaggcuccacugcucuuccug

SEQ ID NO: 450968 - RNA, 22 nt, Human
ccuggaaggcaggcauggauug

SEQ ID NO: 450969 - RNA, 22 nt, Human
gaggccaaguuggagaccaggu

SEQ ID NO: 450970 - RNA, 23 nt, Human
gcagacagagcagacuaagacaa

SEQ ID NO: 450971 - RNA, 22 nt, Human
ggccagagucuauaugcagaca

SEQ ID NO: 450972 - RNA, 22 nt, Human
aaaauccugcugacucgagaug

SEQ ID NO: 450973 - RNA, 22 nt, Human
gcagccacuaguuuuccuguuu

SEQ ID NO: 450974 - RNA, 22 nt, Human
uggggcugucccgguuuggcga

SEQ ID NO: 450975 - RNA, 22 nt, Human
gggcuggcucccagguguugaa

SEQ ID NO: 450976 - RNA, 20 nt, Human
aggcucaggguguuuaggaa

SEQ ID NO: 450977 - RNA, 22 nt, Human
caggguggaaaagcuaguugga

SEQ ID NO: 450978 - RNA, 22 nt, Human
cagcugugaauugucuuaucua

SEQ ID NO: 450979 - RNA, 22 nt, Human
cacuuagucucaccaguucagu

SEQ ID NO: 450980 - RNA, 22 nt, Human
acagcuguggucuccuuagugu

SEQ ID NO: 450981 - RNA, 22 nt, Human
agggcugcaucugccuggugaa

SEQ ID NO: 450982 - RNA, 19 nt, Human
acauuuaaauucagaucuc

SEQ ID NO: 450983 - RNA, 22 nt, Human
gagaaccucuccacaagucugg

SEQ ID NO: 450984 - RNA, 22 nt, Human
cugccagcucgccacaaugaca

SEQ ID NO: 450985 - RNA, 22 nt, Human
cugggagcccugacuagccugg

SEQ ID NO: 450986 - RNA, 22 nt, Human
uggccugacugucaggcuguau

SEQ ID NO: 450987 - RNA, 22 nt, Human
gggcugagcacauacugacagc

SEQ ID NO: 450988 - RNA, 22 nt, Human
ucugucuuagcaucuuugcuca

SEQ ID NO: 450989 - RNA, 22 nt, Human
ugaccugcagucaagaggggaa

SEQ ID NO: 450990 - RNA, 22 nt, Human
guauuuucaagagcaguaguau

SEQ ID NO: 450991 - RNA, 22 nt, Human
ucuuaaaaguaugccaauugga

SEQ ID NO: 450992 - RNA, 22 nt, Human
acaggggauugauuggaagucu

SEQ ID NO: 450993 - RNA, 22 nt, Human
uaacagcuggcguuauaggaau

SEQ ID NO: 450994 - RNA, 22 nt, Human
augucuuuuaugauuacgggau

SEQ ID NO: 450995 - RNA, 22 nt, Human
ucauugcaccccagucccagcu

SEQ ID NO: 450996 - RNA, 22 nt, Human
uacuuuuugucucuuugaaugu

SEQ ID NO: 450997 - RNA, 22 nt, Human
agcaggagcugugggaagaugg

SEQ ID NO: 450998 - RNA, 22 nt, Human
auuaauuuuucugacagccaca

SEQ ID NO: 450999 - RNA, 22 nt, Human
auaucuuuguaugguucagcag

SEQ ID NO: 451000 - RNA, 22 nt, Human
ugccaggcuuagagcaggggcu

SEQ ID NO: 451001 - RNA, 22 nt, Human
uccaucaccauuucugcgagcu

SEQ ID NO: 451002 - RNA, 20 nt, Human
aaagucuuaugguuaauuuu

SEQ ID NO: 451003 - RNA, 22 nt, Human
agggcugcaccggggcuucgcg

SEQ ID NO: 451004 - RNA, 22 nt, Human
agccugcuggaccaagcucaug

SEQ ID NO: 451005 - RNA, 22 nt, Human
ugcaaucucggcacuuugggag

SEQ ID NO: 451006 - RNA, 22 nt, Human
cucagaaguucagccuagagua

SEQ ID NO: 451007 - RNA, 22 nt, Human
ugagagagccugaaucucuuac

SEQ ID NO: 451008 - RNA, 22 nt, Human
gaaucacgguauucugcacggg

SEQ ID NO: 451009 - RNA, 22 nt, Human
caagaaaugggauuugacugcc

SEQ ID NO: 451010 - RNA, 23 nt, Human
ucuuuacauacugaugaguucuc

SEQ ID NO: 451011 - RNA, 22 nt, Human
uuugcauuuugauaagaucacu

SEQ ID NO: 451012 - RNA, 22 nt, Human
gaaggaagucauuagugcagac

SEQ ID NO: 451013 - RNA, 22 nt, Human
ggaaagaggauaguggguaggu

SEQ ID NO: 451014 - RNA, 22 nt, Human
ggccugagcucuggggaggcaa

SEQ ID NO: 451015 - RNA, 22 nt, Human
gggaaccagccgcuuccgccuc

SEQ ID NO: 451016 - RNA, 20 nt, Human
uauuuacaacuuagagccuc

SEQ ID NO: 451017 - RNA, 19 nt, Human
auuugaaagcugugcuugc

SEQ ID NO: 451018 - RNA, 22 nt, Human
gcagauggcagcccaggcuggg

SEQ ID NO: 451019 - RNA, 22 nt, Human
uccagugguaguaaagaggucu

SEQ ID NO: 451020 - RNA, 22 nt, Human
ugauuuccaaaaggcuucuaag

SEQ ID NO: 451021 - RNA, 22 nt, Human
uuuuaauccucuugguaucuua

SEQ ID NO: 451022 - RNA, 22 nt, Human
gaaacuuuuaaaccucaugagu

SEQ ID NO: 451023 - RNA, 20 nt, Human
cagccuccacucacucagcu

SEQ ID NO: 451024 - RNA, 22 nt, Human
auauuucuugagcaccugguau

SEQ ID NO: 451025 - RNA, 20 nt, Human
caguagcaauaauuagaagc

SEQ ID NO: 451026 - RNA, 22 nt, Human
gcaggcaggagcccaacugccu

SEQ ID NO: 451027 - RNA, 22 nt, Human
cugccaucugagccaaaagugc

SEQ ID NO: 451028 - RNA, 22 nt, Human
ggcugcaggaugcccagccgug

SEQ ID NO: 451029 - RNA, 22 nt, Human
acaaagugaauugcaucgaguu

SEQ ID NO: 451030 - RNA, 22 nt, Human
acagggcagagugaaaugcuau

SEQ ID NO: 451031 - RNA, 21 nt, Human
acagaugggaugagcacacug

SEQ ID NO: 451032 - RNA, 22 nt, Human
gcuggcuguguuccuucugcca

SEQ ID NO: 451033 - RNA, 22 nt, Human
aggcagggugaugauaaugauu

SEQ ID NO: 451034 - RNA, 20 nt, Human
ucugcccaccccggcuccca

SEQ ID NO: 451035 - RNA, 22 nt, Human
aucaggaucugcaucauaagaa

SEQ ID NO: 451036 - RNA, 22 nt, Human
ccugagagcauuccacacugaa

SEQ ID NO: 451037 - RNA, 22 nt, Human
aagggcagcuauuaucgucauc

SEQ ID NO: 451038 - RNA, 22 nt, Human
ccagggaggguccuguggcuuc

SEQ ID NO: 451039 - RNA, 22 nt, Human
aucuaggauuugaaugcacagu

SEQ ID NO: 451040 - RNA, 22 nt, Human
agcagccagaaagggcagucga

SEQ ID NO: 451041 - RNA, 22 nt, Human
ucugaggcauacccaggccccc

SEQ ID NO: 451042 - RNA, 22 nt, Human
ggucauugucagagccuguacu

SEQ ID NO: 451043 - RNA, 22 nt, Human
ccagcuccagguagaugggcag

SEQ ID NO: 451044 - RNA, 22 nt, Human
aagcaauaagccagauuuggau

SEQ ID NO: 451045 - RNA, 22 nt, Human
ucugucacccaggcuggagugc

SEQ ID NO: 451046 - RNA, 22 nt, Human
cuccaggccauggcugcggagg

SEQ ID NO: 451047 - RNA, 22 nt, Human
uggcugccuagugucugagcag

SEQ ID NO: 451048 - RNA, 22 nt, Human
auauucacugagcauaaagcca

SEQ ID NO: 451049 - RNA, 22 nt, Human
aggccagcuguuacuagagcca

SEQ ID NO: 451050 - RNA, 22 nt, Human
agccucugacugucagcaaggu

SEQ ID NO: 451051 - RNA, 22 nt, Human
ugcugccucagcuuccugggcu

SEQ ID NO: 451052 - RNA, 22 nt, Human
agaaauguuguggguuuuguua

SEQ ID NO: 451053 - RNA, 22 nt, Human
aagggcagcugacagaugcuua

SEQ ID NO: 451054 - RNA, 22 nt, Human
ucuggaguccagauccauuugg

SEQ ID NO: 451055 - RNA, 22 nt, Human
agcugccucagcaacacagacc

SEQ ID NO: 451056 - RNA, 22 nt, Human
gccugguguccagaggcgagug

SEQ ID NO: 451057 - RNA, 19 nt, Human
ccagcagcuuugauucucu

SEQ ID NO: 451058 - RNA, 23 nt, Human
ucugucacuuucugcuguggagu

SEQ ID NO: 451059 - RNA, 22 nt, Human
uccagcagcccgaaggcccauc

SEQ ID NO: 451060 - RNA, 22 nt, Human
accgggaaguccugcacugggc

SEQ ID NO: 451061 - RNA, 22 nt, Human
ggcugugaacccuggcagugug

SEQ ID NO: 451062 - RNA, 17 nt, Human
ugcauguccuuuguucc

SEQ ID NO: 451063 - RNA, 22 nt, Human
agccaacuaggagauuaaggua

SEQ ID NO: 451064 - RNA, 22 nt, Human
acagagcaauucuuggguguuu

SEQ ID NO: 451065 - RNA, 22 nt, Human
gcagggcaugggcccugucugc

SEQ ID NO: 451066 - RNA, 22 nt, Human
aaggagucucagcugggccuga

SEQ ID NO: 451067 - RNA, 22 nt, Human
ccagggcugcugugggacucca

SEQ ID NO: 451068 - RNA, 22 nt, Human
guaaacaugcuguguacucagc

SEQ ID NO: 451069 - RNA, 22 nt, Human
ucugcagcuucuugccagagag

SEQ ID NO: 451070 - RNA, 23 nt, Human
ucaugcccaggcuccagauguca

SEQ ID NO: 451071 - RNA, 22 nt, Human
uggagcucaaaggccuguggga

SEQ ID NO: 451072 - RNA, 22 nt, Human
ccugucugcagauaucucaggu

SEQ ID NO: 451073 - RNA, 22 nt, Human
uagcagcuuaaguaauuagaau

SEQ ID NO: 451074 - RNA, 22 nt, Human
ccuggcagguggcgcccucggc

SEQ ID NO: 451075 - RNA, 22 nt, Human
cccugcaguccuuucuuggcuc

SEQ ID NO: 451076 - RNA, 22 nt, Human
acuccugguuuguguccuggcu

SEQ ID NO: 451077 - RNA, 22 nt, Human
gggcagguggcagggucucugg

SEQ ID NO: 451078 - RNA, 22 nt, Human
agucucagcaagcauggcuagu

SEQ ID NO: 451079 - RNA, 22 nt, Human
cagugagggcauucagugcugg

SEQ ID NO: 451080 - RNA, 22 nt, Human
cagcugccuaugaccuagccuc

SEQ ID NO: 451081 - RNA, 23 nt, Human
ccuggcuggauucucugcauuca

SEQ ID NO: 451082 - RNA, 22 nt, Human
cugcugagcaucagggcugccc

SEQ ID NO: 451083 - RNA, 22 nt, Human
ggcuucccaaggagccaggaug

SEQ ID NO: 451084 - RNA, 22 nt, Human
ccugccugcaaaaugggacaag

SEQ ID NO: 451085 - RNA, 22 nt, Human
caaaugcagucccuuuguugcu

SEQ ID NO: 451086 - RNA, 22 nt, Human
ccagcagaagcucccgcugggu

SEQ ID NO: 451087 - RNA, 22 nt, Human
uauacagaaccgccugaagucu

SEQ ID NO: 451088 - RNA, 22 nt, Human
gggagggaagguaccuguguga

SEQ ID NO: 451089 - RNA, 22 nt, Human
cccucugcugccuggcuggguc

SEQ ID NO: 451090 - RNA, 22 nt, Human
gcacugaaugccaaaguguagg

SEQ ID NO: 451091 - RNA, 22 nt, Human
gccugcagauauauaggauggu

SEQ ID NO: 451092 - RNA, 22 nt, Human
agaauuagguaaguucaucuga

SEQ ID NO: 451093 - RNA, 22 nt, Human
guuuacaugcagaaaaucaaug

SEQ ID NO: 451094 - RNA, 22 nt, Human
cagcugcaugucuguggugguc

SEQ ID NO: 451095 - RNA, 22 nt, Human
acaggcaggcgggacagcccga

SEQ ID NO: 451096 - RNA, 22 nt, Human
cuguggcauugccgaggcuggc

SEQ ID NO: 451097 - RNA, 22 nt, Human
cagcuggccugaucccuguggc

SEQ ID NO: 451098 - RNA, 22 nt, Human
aguccggggucuggacaccugg

SEQ ID NO: 451099 - RNA, 22 nt, Human
gaaggccaagaggcuccaagau

SEQ ID NO: 451100 - RNA, 22 nt, Human
uccuuuccaugcuucuagaggc

SEQ ID NO: 451101 - RNA, 22 nt, Human
uacaaaaguaauuacgguuuuu

SEQ ID NO: 451102 - RNA, 22 nt, Human
uuuuuaagcuccuuugauguca

SEQ ID NO: 451103 - RNA, 22 nt, Human
ggaaagccaggugcucuggugu

SEQ ID NO: 451104 - RNA, 22 nt, Human
auuauguagcuaaaaauugugu

SEQ ID NO: 451105 - RNA, 22 nt, Human
cuauuagguuggugcaaaagua

SEQ ID NO: 451106 - RNA, 22 nt, Human
ggugaagggccuuaggagacag

SEQ ID NO: 451107 - RNA, 22 nt, Human
cauggcaggugcagauucugug

SEQ ID NO: 451108 - RNA, 22 nt, Human
ugcagaagacacaagguaacgu

SEQ ID NO: 451109 - RNA, 22 nt, Human
ucugucugcgcuugcccuggug

SEQ ID NO: 451110 - RNA, 19 nt, Human
gcauuucucuuuacagcca

SEQ ID NO: 451111 - RNA, 22 nt, Human
auucaguuaaaaacuguacuuc

SEQ ID NO: 451112 - RNA, 22 nt, Human
uucauuaguucugaagaugucu

SEQ ID NO: 451113 - RNA, 22 nt, Human
aaggcaguuugggccaccaucu

SEQ ID NO: 451114 - RNA, 22 nt, Human
ggagaggugaauggcugcucua

SEQ ID NO: 451115 - RNA, 19 nt, Human
uggcuccugccugccuucu

SEQ ID NO: 451116 - RNA, 22 nt, Human
cugcccugagggccuguguguu

SEQ ID NO: 451117 - RNA, 22 nt, Human
agcuucuugaccaagccuguaa

SEQ ID NO: 451118 - RNA, 22 nt, Human
ugacauuuuaucaauaucacag

SEQ ID NO: 451119 - RNA, 22 nt, Human
ugugccagaaaauaugcugagg

SEQ ID NO: 451120 - RNA, 22 nt, Human
aaaugcauuuuuaauuagaccc

SEQ ID NO: 451121 - RNA, 22 nt, Human
gggcuagaaauucugcagugga

SEQ ID NO: 451122 - RNA, 22 nt, Human
gccagguggcugagcagcugca

SEQ ID NO: 451123 - RNA, 22 nt, Human
caaggccaguuucuccuaguca

SEQ ID NO: 451124 - RNA, 22 nt, Human
ugucccaguucccaggguugcu

SEQ ID NO: 451125 - RNA, 22 nt, Human
agcagugggggaguguuaguuu

SEQ ID NO: 451126 - RNA, 22 nt, Human
caguauuuauggcuugaguauu

SEQ ID NO: 451127 - RNA, 22 nt, Human
uggaggaaaaaaccaggcagag

SEQ ID NO: 451128 - RNA, 22 nt, Human
cagccagggagggcaaaugaga

SEQ ID NO: 451129 - RNA, 22 nt, Human
uaauguguugaauauuuguaca

SEQ ID NO: 451130 - RNA, 22 nt, Human
agggugcagaaggagccuagga

SEQ ID NO: 451131 - RNA, 22 nt, Human
cuccucugucuggcccugagcc

SEQ ID NO: 451132 - RNA, 22 nt, Human
gucucagaguccuacuuauucc

SEQ ID NO: 451133 - RNA, 22 nt, Human
cucugcaugccuugcucagaca

SEQ ID NO: 451134 - RNA, 22 nt, Human
uggcugcugcuuggucuucuuc

SEQ ID NO: 451135 - RNA, 22 nt, Human
uucauucccaagaguaaacaua

SEQ ID NO: 451136 - RNA, 22 nt, Human
caggaugugaggaggccauuug

SEQ ID NO: 451137 - RNA, 22 nt, Human
agauuucagaugcucggcaguu

SEQ ID NO: 451138 - RNA, 22 nt, Human
aaggaaccauuugugugcaugg

SEQ ID NO: 451139 - RNA, 22 nt, Human
uggcagcaaguucuugggaggu

SEQ ID NO: 451140 - RNA, 22 nt, Human
uggcaggaaaaacauuggagau

SEQ ID NO: 451141 - RNA, 22 nt, Human
aaguguuuggggaucauuuuaa

SEQ ID NO: 451142 - RNA, 21 nt, Human
ccuggcugcacaguugcuggu

SEQ ID NO: 451143 - RNA, 22 nt, Human
agccagcaggugagugcagccu

SEQ ID NO: 451144 - RNA, 22 nt, Human
agagagcccgggccagggcaca

SEQ ID NO: 451145 - RNA, 22 nt, Human
ucccagagacagagccuccucc

SEQ ID NO: 451146 - RNA, 22 nt, Human
accucugcaacccuggaauggg

SEQ ID NO: 451147 - RNA, 22 nt, Human
gcccagaaguugaggcugcagu

SEQ ID NO: 451148 - RNA, 22 nt, Human
uggcucucagcucccagcagcc

SEQ ID NO: 451149 - RNA, 22 nt, Human
ccaucccuucucuggccagcag

SEQ ID NO: 451150 - RNA, 22 nt, Human
cagaguggcacucugcuggaug

SEQ ID NO: 451151 - RNA, 22 nt, Human
agcaggaguuugaugcuuuuau

SEQ ID NO: 451152 - RNA, 22 nt, Human
ggcuucagugacuggugcccuc

SEQ ID NO: 451153 - RNA, 22 nt, Human
ggccucaguuucuccauggguu

SEQ ID NO: 451154 - RNA, 18 nt, Human
uccgaggcaccauaaaaa

SEQ ID NO: 451155 - RNA, 22 nt, Human
ucucaagcuuguugguauguuu

SEQ ID NO: 451156 - RNA, 22 nt, Human
aggcucugugacaaucaagcug

SEQ ID NO: 451157 - RNA, 22 nt, Human
uggcuucuugggaugggucauu

SEQ ID NO: 451158 - RNA, 22 nt, Human
uggcucagaggggaagugguuu

SEQ ID NO: 451159 - RNA, 22 nt, Human
cagagaaagggugaauuccuuc

SEQ ID NO: 451160 - RNA, 22 nt, Human
gaagcccauuuguacagcacau

SEQ ID NO: 451161 - RNA, 22 nt, Human
uuaaagggccgauuuccaggcc

SEQ ID NO: 451162 - RNA, 22 nt, Human
cucuuaaagcuuccaguuucaa

SEQ ID NO: 451163 - RNA, 22 nt, Human
uugcaucuagggcaacccagag

SEQ ID NO: 451164 - RNA, 22 nt, Human
ucuuuuuauauugacaaaaggu

SEQ ID NO: 451165 - RNA, 23 nt, Human
ugagaagccauuagagcaggugg

SEQ ID NO: 451166 - RNA, 22 nt, Human
gaagcccuauccucuccuggga

SEQ ID NO: 451167 - RNA, 19 nt, Human
uguuggugcggauguggag

SEQ ID NO: 451168 - RNA, 22 nt, Human
agcaggguauguuagagcugua

SEQ ID NO: 451169 - RNA, 22 nt, Human
ucucagugcuauccauauucca

SEQ ID NO: 451170 - RNA, 22 nt, Human
ugaagcaguuacuggguguuaa

SEQ ID NO: 451171 - RNA, 22 nt, Human
ggugcagugguguggcaaaggg

SEQ ID NO: 451172 - RNA, 22 nt, Human
aggaccuguagggccugcaucc

SEQ ID NO: 451173 - RNA, 22 nt, Human
cuggccugagcacagcggcugc

SEQ ID NO: 451174 - RNA, 21 nt, Human
guggcucugccaggacugaaa

SEQ ID NO: 451175 - RNA, 22 nt, Human
ucucugagcugcuucuugcaua

SEQ ID NO: 451176 - RNA, 22 nt, Human
ugguggcaucacucagccuccc

SEQ ID NO: 451177 - RNA, 22 nt, Human
ccuguacauuagcugugaauug

SEQ ID NO: 451178 - RNA, 22 nt, Human
caauuucucgaacucuaaucca

SEQ ID NO: 451179 - RNA, 21 nt, Human
aggugcaggccucaagcccca

SEQ ID NO: 451180 - RNA, 19 nt, Human
ucauucaggaccaguggau

SEQ ID NO: 451181 - RNA, 21 nt, Human
ucagcuuugcaacugcacauc

SEQ ID NO: 451182 - RNA, 22 nt, Human
uuuguacauauauaaaaucugu

SEQ ID NO: 451183 - RNA, 22 nt, Human
ucugucucaaguucuugcacuc

SEQ ID NO: 451184 - RNA, 22 nt, Human
ucacacgugagguucuauccug

SEQ ID NO: 451185 - RNA, 22 nt, Human
aguuucuauuuucaugucuguu

SEQ ID NO: 451186 - RNA, 22 nt, Human
uacagaauuagauuauuagaga

SEQ ID NO: 451187 - RNA, 22 nt, Human
aaccaggacaauuuugaaagua

SEQ ID NO: 451188 - RNA, 22 nt, Human
gggaggaaagagaaguggucca

SEQ ID NO: 451189 - RNA, 22 nt, Human
ggcucuggaaaguguccuugau

SEQ ID NO: 451190 - RNA, 22 nt, Human
gccaggcuguuuuuauuacugu

SEQ ID NO: 451191 - RNA, 22 nt, Human
agaagugccauacuguggucca

SEQ ID NO: 451192 - RNA, 22 nt, Human
gaaaagggcaagagagagggca

SEQ ID NO: 451193 - RNA, 22 nt, Human
cacauaaguggguuccauugca

SEQ ID NO: 451194 - RNA, 22 nt, Human
guguaucaaagcacagacuuca

SEQ ID NO: 451195 - RNA, 21 nt, Human
uuucaauguguucuuuguagu

SEQ ID NO: 451196 - RNA, 22 nt, Human
ucugucuuugagaucucagccu

SEQ ID NO: 451197 - RNA, 22 nt, Human
cugucuguuuuaccuucuccag

SEQ ID NO: 451198 - RNA, 22 nt, Human
gaggggcucuugggcaugaagg

SEQ ID NO: 451199 - RNA, 22 nt, Human
ggcuucccuuuccgagaggaga

SEQ ID NO: 451200 - RNA, 22 nt, Human
gugggaugcaguggugaguggc

SEQ ID NO: 451201 - RNA, 22 nt, Human
ggucucugacuuagagauggau

SEQ ID NO: 451202 - RNA, 22 nt, Human
aaauugcaaaaguacuuuuagg

SEQ ID NO: 451203 - RNA, 20 nt, Human
agcaccagugggggcagccc

SEQ ID NO: 451204 - RNA, 23 nt, Human
agacagaggcugaggcuggccgc

SEQ ID NO: 451205 - RNA, 22 nt, Human
cuggcagcugugugaagaacug

SEQ ID NO: 451206 - RNA, 22 nt, Human
cuuccaaauguaaauaaguuuc

SEQ ID NO: 451207 - RNA, 22 nt, Human
cugggcagcuaccaccacugcu

SEQ ID NO: 451208 - RNA, 22 nt, Human
aauuuagauugauaaacaugga

SEQ ID NO: 451209 - RNA, 22 nt, Human
cagccuguagaauacaguaaau

SEQ ID NO: 451210 - RNA, 23 nt, Human
ggaaagagaggaguugugcauag

SEQ ID NO: 451211 - RNA, 22 nt, Human
ucugagggugggagaaggagcu

SEQ ID NO: 451212 - RNA, 22 nt, Human
guuauuuuaucucugagagguu

SEQ ID NO: 451213 - RNA, 22 nt, Human
cagcucucuaaggucuugcuuu

SEQ ID NO: 451214 - RNA, 22 nt, Human
ggccugaggccaccagcagccc

SEQ ID NO: 451215 - RNA, 22 nt, Human
ccugcaggggagagacuucuag

SEQ ID NO: 451216 - RNA, 22 nt, Human
auucuggccuuggcucugucac

SEQ ID NO: 451217 - RNA, 20 nt, Human
ccagcuuucccugcagcauc

SEQ ID NO: 451218 - RNA, 22 nt, Human
uucaugugaucacagauuguaa

SEQ ID NO: 451219 - RNA, 19 nt, Human
agcagccaucgaccaugga

SEQ ID NO: 451220 - RNA, 21 nt, Human
uaucuacuggugucuuucaga

SEQ ID NO: 451221 - RNA, 22 nt, Human
uggagcugagagccaggcuggc

SEQ ID NO: 451222 - RNA, 22 nt, Human
gccaggcuggucuugaacuccu

SEQ ID NO: 451223 - RNA, 22 nt, Human
agaguggggaagguguugagaa

SEQ ID NO: 451224 - RNA, 22 nt, Human
ucagaggacgcacuaggguugu

SEQ ID NO: 451225 - RNA, 22 nt, Human
gccucccuguagaggccagccu

SEQ ID NO: 451226 - RNA, 22 nt, Human
agaggcccucucucuccugaug

SEQ ID NO: 451227 - RNA, 22 nt, Human
ccagcaccuugaucuuggaguu

SEQ ID NO: 451228 - RNA, 22 nt, Human
ucuuaaaccacaaaauucagag

SEQ ID NO: 451229 - RNA, 22 nt, Human
gcauccagucuuggcuccugga

SEQ ID NO: 451230 - RNA, 22 nt, Human
aucuggcuugacuuugcgacuu

SEQ ID NO: 451231 - RNA, 22 nt, Human
acaugauuaaaagauuuuaaag

SEQ ID NO: 451232 - RNA, 22 nt, Human
ccagugggugcugggcucugcc

SEQ ID NO: 451233 - RNA, 22 nt, Human
cagcagagcuuauguuggguca

SEQ ID NO: 451234 - RNA, 22 nt, Human
uuagcuaaacuguaacuagaau

SEQ ID NO: 451235 - RNA, 22 nt, Human
uuuagaguugaguauucauugg

SEQ ID NO: 451236 - RNA, 22 nt, Human
gccaggcacugcucuaagcccu

SEQ ID NO: 451237 - RNA, 19 nt, Human
cccucaggucugagcaguc

SEQ ID NO: 451238 - RNA, 20 nt, Human
gacaucauguacacauugcc

SEQ ID NO: 451239 - RNA, 22 nt, Human
gcugucacaucaaggcacuaaa

SEQ ID NO: 451240 - RNA, 18 nt, Human
acagacaaaauggaaaug

SEQ ID NO: 451241 - RNA, 22 nt, Human
guugaaagagcauggacuugaa

SEQ ID NO: 451242 - RNA, 22 nt, Human
gggcagcucuggcugugggaag

SEQ ID NO: 451243 - RNA, 22 nt, Human
aguucuagaagacuuuuccauu

SEQ ID NO: 451244 - RNA, 22 nt, Human
ggcucaggcuggagugcagugg

SEQ ID NO: 451245 - RNA, 22 nt, Human
ugggacaguuguccuccacucu

SEQ ID NO: 451246 - RNA, 22 nt, Human
caggaugagguagaggcagaua

SEQ ID NO: 451247 - RNA, 22 nt, Human
cuguuuaucuaggaguugcagg

SEQ ID NO: 451248 - RNA, 22 nt, Human
gcacacaguauaugcucauuaa

SEQ ID NO: 451249 - RNA, 22 nt, Human
cagcaaaauuugaggauugccu

SEQ ID NO: 451250 - RNA, 22 nt, Human
ccuauugacaauucucuucucc

SEQ ID NO: 451251 - RNA, 22 nt, Human
ggccuggccuccagaugugggc

SEQ ID NO: 451252 - RNA, 22 nt, Human
cccagcucaagcagagagcuaa

SEQ ID NO: 451253 - RNA, 22 nt, Human
aacaggcaaacugugggauccc

SEQ ID NO: 451254 - RNA, 19 nt, Human
cucuuaaauugucucuugc

SEQ ID NO: 451255 - RNA, 22 nt, Human
aaggcaguacuuuauguccaua

SEQ ID NO: 451256 - RNA, 22 nt, Human
uuccagaauuuuguucugcuug

SEQ ID NO: 451257 - RNA, 22 nt, Human
agcagcugcagggagggucugc

SEQ ID NO: 451258 - RNA, 22 nt, Human
ucucucagcuuugagaccugcu

SEQ ID NO: 451259 - RNA, 22 nt, Human
ccagggugugggcgucggcacg

SEQ ID NO: 451260 - RNA, 17 nt, Human
uuuucucucuuggauuc

SEQ ID NO: 451261 - RNA, 22 nt, Human
ugguugccucucagagauuccg

SEQ ID NO: 451262 - RNA, 22 nt, Human
cucagaauuuagggcucugagg

SEQ ID NO: 451263 - RNA, 22 nt, Human
cagaggccaccuguggccacug

SEQ ID NO: 451264 - RNA, 21 nt, Human
agcagaggcugccuggugacu

SEQ ID NO: 451265 - RNA, 22 nt, Human
ugugugccugagccgugccugg

SEQ ID NO: 451266 - RNA, 22 nt, Human
agaauuuuugauuaucuacucg

SEQ ID NO: 451267 - RNA, 22 nt, Human
agacaucauguuacagauuaag

SEQ ID NO: 451268 - RNA, 22 nt, Human
guuuuuaucuaauagcaguuau

SEQ ID NO: 451269 - RNA, 22 nt, Human
gcagccagccccucugaccucu

SEQ ID NO: 451270 - RNA, 22 nt, Human
agagaggcgaguuaccugugcu

SEQ ID NO: 451271 - RNA, 22 nt, Human
uucugucucccugauguagagc

SEQ ID NO: 451272 - RNA, 22 nt, Human
gcuaucuucauggaaauacagg

SEQ ID NO: 451273 - RNA, 22 nt, Human
uccuuuuugguccaaggugacc

SEQ ID NO: 451274 - RNA, 22 nt, Human
uuccauaauaaccugagagaaa

SEQ ID NO: 451275 - RNA, 22 nt, Human
cuucagaggggacucaaaguca

SEQ ID NO: 451276 - RNA, 22 nt, Human
aucuguaaaugcaaauguagcu

SEQ ID NO: 451277 - RNA, 22 nt, Human
ucauuugugugagugauuugac

SEQ ID NO: 451278 - RNA, 22 nt, Human
aagauucucagagugaaagaau

SEQ ID NO: 451279 - RNA, 22 nt, Human
cauuucuauggcaaugggaaaa

SEQ ID NO: 451280 - RNA, 22 nt, Human
ucaugcccagagcaguaaauua

SEQ ID NO: 451281 - RNA, 22 nt, Human
cagggagaagucuggucagucc

SEQ ID NO: 451282 - RNA, 22 nt, Human
gucugcccucacgccagcuggg

SEQ ID NO: 451283 - RNA, 22 nt, Human
gcugccugcacagagcugcuuu

SEQ ID NO: 451284 - RNA, 22 nt, Human
uccugcagccaagggucaucga

SEQ ID NO: 451285 - RNA, 22 nt, Human
caaaggcaacauauacuuguuu

SEQ ID NO: 451286 - RNA, 22 nt, Human
acuuugugcccaacagaaagaa

SEQ ID NO: 451287 - RNA, 22 nt, Human
gcagcugcuggaaguuccugcc

SEQ ID NO: 451288 - RNA, 22 nt, Human
gggcagugguccaggcuacagc

SEQ ID NO: 451289 - RNA, 22 nt, Human
gcagcuuucugggacagaaagg

SEQ ID NO: 451290 - RNA, 23 nt, Human
aggagaagagauuuccacaugca

SEQ ID NO: 451291 - RNA, 22 nt, Human
ccagagagauugcuucuaaaga

SEQ ID NO: 451292 - RNA, 22 nt, Human
agcagccagaaauccagaggug

SEQ ID NO: 451293 - RNA, 20 nt, Human
guauuaggagguaaauguaa

SEQ ID NO: 451294 - RNA, 22 nt, Human
ucugucauaaacacacacaagc

SEQ ID NO: 451295 - RNA, 22 nt, Human
uucacaaagcuggagcauuucc

SEQ ID NO: 451296 - RNA, 22 nt, Human
uggagggcaucuguggucaggc

SEQ ID NO: 451297 - RNA, 22 nt, Human
ccugacgaaaggcgugcuggag

SEQ ID NO: 451298 - RNA, 19 nt, Human
uucaggauugacccuacug

SEQ ID NO: 451299 - RNA, 22 nt, Human
auauucuuccaaaacaucauuu

SEQ ID NO: 451300 - RNA, 22 nt, Human
guccugggaaggaagccaggga

SEQ ID NO: 451301 - RNA, 22 nt, Human
ggcacugacugugcagcgcacc

SEQ ID NO: 451302 - RNA, 22 nt, Human
auacaaaaauuagccgggagua

SEQ ID NO: 451303 - RNA, 22 nt, Human
aggagaaguaaggcuagaugau

SEQ ID NO: 451304 - RNA, 22 nt, Human
ugcuggcucaguuugcagacuc

SEQ ID NO: 451305 - RNA, 22 nt, Human
cacugcaguuccccagugcgca

SEQ ID NO: 451306 - RNA, 19 nt, Human
agacucugccacucuucuc

SEQ ID NO: 451307 - RNA, 22 nt, Human
gugaaggacuagcauggagggc

SEQ ID NO: 451308 - RNA, 22 nt, Human
uaccaaauguaaucauucuaau

SEQ ID NO: 451309 - RNA, 22 nt, Human
cuguguccugcgucaagccaau

SEQ ID NO: 451310 - RNA, 22 nt, Human
gcucugagccgggggccugucc

SEQ ID NO: 451311 - RNA, 22 nt, Human
cccagcccagcguucgaggggu

SEQ ID NO: 451312 - RNA, 20 nt, Human
accucugcaucaauccuuug

SEQ ID NO: 451313 - RNA, 22 nt, Human
agaggucauaucucagaagaga

SEQ ID NO: 451314 - RNA, 22 nt, Human
ucuguaucuaauuuuacaguag

SEQ ID NO: 451315 - RNA, 23 nt, Human
aagcugccuucgcaguuggucug

SEQ ID NO: 451316 - RNA, 21 nt, Human
acagggcaugcagcuggcugu

SEQ ID NO: 451317 - RNA, 22 nt, Human
aaggugucacugggacaggaaa

SEQ ID NO: 451318 - RNA, 22 nt, Human
ccaggcaucacgggcauguggc

SEQ ID NO: 451319 - RNA, 21 nt, Human
gcaggggauagaaauggucug

SEQ ID NO: 451320 - RNA, 22 nt, Human
caaugacauggauaaucauauu

SEQ ID NO: 451321 - RNA, 22 nt, Human
aucaggauuauuaaaucuggau

SEQ ID NO: 451322 - RNA, 22 nt, Human
caggaagcugagcugcacugca

SEQ ID NO: 451323 - RNA, 22 nt, Human
ugggcaggggcccugcuuccgu

SEQ ID NO: 451324 - RNA, 23 nt, Human
uguaaaaugggguaguguuacca

SEQ ID NO: 451325 - RNA, 23 nt, Human
ucuguacacaucagcaucuccca

SEQ ID NO: 451326 - RNA, 22 nt, Human
ccaaggagcucauauucuuguu

SEQ ID NO: 451327 - RNA, 22 nt, Human
guggguggaggcgucgagggca

SEQ ID NO: 451328 - RNA, 22 nt, Human
aagggcuggcccugggaagagu

SEQ ID NO: 451329 - RNA, 22 nt, Human
guccucagcaccagaacuaggg

SEQ ID NO: 451330 - RNA, 22 nt, Human
uggcaggauuugcccggaagga

SEQ ID NO: 451331 - RNA, 22 nt, Human
uuuauuauagugguggggacug

SEQ ID NO: 451332 - RNA, 17 nt, Human
gcaguggagggguaguu

SEQ ID NO: 451333 - RNA, 22 nt, Human
gcccucagcuccuggacacaug

SEQ ID NO: 451334 - RNA, 22 nt, Human
acagaacugcaggaggaaaagc

SEQ ID NO: 451335 - RNA, 22 nt, Human
ugggaggaucgcuugagcccag

SEQ ID NO: 451336 - RNA, 22 nt, Human
agguggagugaaggaaaggcag

SEQ ID NO: 451337 - RNA, 22 nt, Human
aucuacaggcugaggugggagg

SEQ ID NO: 451338 - RNA, 22 nt, Human
aucaggauuacacggggaugcu

SEQ ID NO: 451339 - RNA, 22 nt, Human
cacguuuuaugacagaagaagc

SEQ ID NO: 451340 - RNA, 22 nt, Human
ugaagcaggugaauggaugucg

SEQ ID NO: 451341 - RNA, 22 nt, Human
ggcagagcuuguuccuucuguu

SEQ ID NO: 451342 - RNA, 22 nt, Human
ugccugggccucugaggaaggc

SEQ ID NO: 451343 - RNA, 22 nt, Human
agaaagaacguugguuaucuua

SEQ ID NO: 451344 - RNA, 22 nt, Human
gugcauuugugcaugcacaugu

SEQ ID NO: 451345 - RNA, 22 nt, Human
ggcuggcuggcugguagacaag

SEQ ID NO: 451346 - RNA, 22 nt, Human
ccacccagaccagggaucuggg

SEQ ID NO: 451347 - RNA, 22 nt, Human
agccuccacagaugcaaagggc

SEQ ID NO: 451348 - RNA, 18 nt, Human
ggcaugugagugcugagg

SEQ ID NO: 451349 - RNA, 22 nt, Human
gagcccagguucugcuuccagc

SEQ ID NO: 451350 - RNA, 22 nt, Human
guuauguacuuuuuaaaucuug

SEQ ID NO: 451351 - RNA, 22 nt, Human
uauagaaguaagcauugugaug

SEQ ID NO: 451352 - RNA, 22 nt, Human
ugccagucucacccuggguccu

SEQ ID NO: 451353 - RNA, 22 nt, Human
ucaggggcccuucccucagcag

SEQ ID NO: 451354 - RNA, 22 nt, Human
cagcauggggcuuggagucagc

SEQ ID NO: 451355 - RNA, 22 nt, Human
gcugcugcgcuugucuacuguu

SEQ ID NO: 451356 - RNA, 22 nt, Human
gagcagcucgagaaggaagcag

SEQ ID NO: 451357 - RNA, 22 nt, Human
guccucuggccuuucccaggac

SEQ ID NO: 451358 - RNA, 22 nt, Human
uggcucagucuggguugacuga

SEQ ID NO: 451359 - RNA, 22 nt, Human
aggcccugaagucggccccuca

SEQ ID NO: 451360 - RNA, 22 nt, Human
auccuugagccaaugacugauu

SEQ ID NO: 451361 - RNA, 22 nt, Human
acagagauguggaugagggauu

SEQ ID NO: 451362 - RNA, 22 nt, Human
ccuccuggugggcgcuucuggc

SEQ ID NO: 451363 - RNA, 22 nt, Human
accaggcacucuuguggcagug

SEQ ID NO: 451364 - RNA, 22 nt, Human
ggcggggguccaggagccugca

SEQ ID NO: 451365 - RNA, 22 nt, Human
agaaugcaagauaaacuuuauu

SEQ ID NO: 451366 - RNA, 19 nt, Human
gagcacagcggcauuuggu

SEQ ID NO: 451367 - RNA, 20 nt, Human
cuguggcaucugucauggug

SEQ ID NO: 451368 - RNA, 22 nt, Human
cuggagggugagccucaucucu

SEQ ID NO: 451369 - RNA, 22 nt, Human
uagacacauccguggaagcuuc

SEQ ID NO: 451370 - RNA, 22 nt, Human
augcaucauggaaaacucaguu

SEQ ID NO: 451371 - RNA, 22 nt, Human
cggggcugcucguccuccugug

SEQ ID NO: 451372 - RNA, 22 nt, Human
agaagugccgaaaggaagacag

SEQ ID NO: 451373 - RNA, 22 nt, Human
ggugaggcuaagugacacaggg

SEQ ID NO: 451374 - RNA, 22 nt, Human
ggacacagauaaucacacagau

SEQ ID NO: 451375 - RNA, 22 nt, Human
uccucugccccagaugaaauuu

SEQ ID NO: 451376 - RNA, 22 nt, Human
ccaggccuggaccaugccaggg

SEQ ID NO: 451377 - RNA, 22 nt, Human
ggcuccugggaugggacugagc

SEQ ID NO: 451378 - RNA, 22 nt, Human
agcuguguagggaaucagagaa

SEQ ID NO: 451379 - RNA, 22 nt, Human
ucggagcuguagaugaaacccu

SEQ ID NO: 451380 - RNA, 22 nt, Human
gccaaaucacagggccaaaagc

SEQ ID NO: 451381 - RNA, 22 nt, Human
cugggcagcuguaucagggagu

SEQ ID NO: 451382 - RNA, 17 nt, Human
gagagcugcugcuuccg

SEQ ID NO: 451383 - RNA, 22 nt, Human
gggacuggcacagggcugggag

SEQ ID NO: 451384 - RNA, 22 nt, Human
ugaaggcacuugccuaggggca

SEQ ID NO: 451385 - RNA, 22 nt, Human
uuaguaauguguuaauaugaau

SEQ ID NO: 451386 - RNA, 21 nt, Human
uuuuuucuugcgugaggccug

SEQ ID NO: 451387 - RNA, 22 nt, Human
caguggccaugguggcaggggu

SEQ ID NO: 451388 - RNA, 22 nt, Human
cuggggcugcggacgggagccc

SEQ ID NO: 451389 - RNA, 22 nt, Human
uuugaaaggaaguuaauacuuu

SEQ ID NO: 451390 - RNA, 22 nt, Human
ggaagagagggcugggccucaa

SEQ ID NO: 451391 - RNA, 22 nt, Human
acacagggcagagagcuggcuc

SEQ ID NO: 451392 - RNA, 22 nt, Human
agcuguguggugucugacagcu

SEQ ID NO: 451393 - RNA, 22 nt, Human
ggccuugggauguggcugcagc

SEQ ID NO: 451394 - RNA, 22 nt, Human
uuugcauuucuaaugagcuccg

SEQ ID NO: 451395 - RNA, 22 nt, Human
agggccagaugaagccacaagc

SEQ ID NO: 451396 - RNA, 22 nt, Human
ggcagcagggcugucucccuac

SEQ ID NO: 451397 - RNA, 22 nt, Human
cugcugggcuccucaugugacu

SEQ ID NO: 451398 - RNA, 22 nt, Human
aaaugcagguaguauuuauuuu

SEQ ID NO: 451399 - RNA, 22 nt, Human
agacccugucaguguuaggaaa

SEQ ID NO: 451400 - RNA, 22 nt, Human
ccuggagcuuggucacgcugcg

SEQ ID NO: 451401 - RNA, 22 nt, Human
cugcugugggcaggguagcugg

SEQ ID NO: 451402 - RNA, 22 nt, Human
cugcaggcucgaagacacggau

SEQ ID NO: 451403 - RNA, 22 nt, Human
uggccuccccuaacagccucuu

SEQ ID NO: 451404 - RNA, 22 nt, Human
agaaauacuaggaauauucaua

SEQ ID NO: 451405 - RNA, 22 nt, Human
ugaaagaacuagcaucuucaag

SEQ ID NO: 451406 - RNA, 22 nt, Human
cauuuuauccucugggaagcua

SEQ ID NO: 451407 - RNA, 22 nt, Human
cucuuccuacagucugcuaugc

SEQ ID NO: 451408 - RNA, 22 nt, Human
augauugcagcccuacagcugu

SEQ ID NO: 451409 - RNA, 22 nt, Human
cagggccaugaggcacaggguc

SEQ ID NO: 451410 - RNA, 22 nt, Human
ugggccugggcuccuguccucu

SEQ ID NO: 451411 - RNA, 22 nt, Human
gccgugcgugcgcaggugcugu

SEQ ID NO: 451412 - RNA, 22 nt, Human
gcuggccucaucacugacuucu

SEQ ID NO: 451413 - RNA, 20 nt, Human
cagaccugcacccacuucga

SEQ ID NO: 451414 - RNA, 22 nt, Human
uggcugcagaucaagggcaggc

SEQ ID NO: 451415 - RNA, 22 nt, Human
ugcccacaggaagacaccagcg

SEQ ID NO: 451416 - RNA, 22 nt, Human
uucacaguggcugugccauuug

SEQ ID NO: 451417 - RNA, 22 nt, Human
ccagugcacagccaggcaggug

SEQ ID NO: 451418 - RNA, 22 nt, Human
uaaugcuuuguuuugaucuaac

SEQ ID NO: 451419 - RNA, 22 nt, Human
gcagggcuauuggaaggagaug

SEQ ID NO: 451420 - RNA, 22 nt, Human
ccugccaggcuuugggcuucug

SEQ ID NO: 451421 - RNA, 22 nt, Human
ucuguggccuguguccaagugc

SEQ ID NO: 451422 - RNA, 22 nt, Human
agauggguaacuggagucugcu

SEQ ID NO: 451423 - RNA, 22 nt, Human
agagccaggaaguggcgugggg

SEQ ID NO: 451424 - RNA, 22 nt, Human
uggcagugggaagcuggaaguc

SEQ ID NO: 451425 - RNA, 22 nt, Human
gcagagcauguccucaggacag

SEQ ID NO: 451426 - RNA, 22 nt, Human
agagaacacgugcaucugcaau

SEQ ID NO: 451427 - RNA, 18 nt, Human
uggccuggagacaacucu

SEQ ID NO: 451428 - RNA, 20 nt, Human
agcugaggcaccugagguua

SEQ ID NO: 451429 - RNA, 22 nt, Human
ugcacacaaaugugaacgugcc

SEQ ID NO: 451430 - RNA, 22 nt, Human
auugaaagguuuugagcagaua

SEQ ID NO: 451431 - RNA, 22 nt, Human
aaggcacuagcaagcugccugg

SEQ ID NO: 451432 - RNA, 22 nt, Human
gagagaggccuccauguacuga

SEQ ID NO: 451433 - RNA, 22 nt, Human
gcguaaggccucuggucucgga

SEQ ID NO: 451434 - RNA, 22 nt, Human
acaggcuguugggguccagggu

SEQ ID NO: 451435 - RNA, 22 nt, Human
cacugcuuauaaauucuaggca

SEQ ID NO: 451436 - RNA, 22 nt, Human
gugaggugggcuggccagagac

SEQ ID NO: 451437 - RNA, 22 nt, Human
gggcagagacucagaaacagaa

SEQ ID NO: 451438 - RNA, 22 nt, Human
aacaguaucuuuuaucagaaau

SEQ ID NO: 451439 - RNA, 22 nt, Human
gugcauauaugcacauaugugu

SEQ ID NO: 451440 - RNA, 22 nt, Human
ccucacagcuuuucaaagugga

SEQ ID NO: 451441 - RNA, 22 nt, Human
caggccaggcugcauuugcccc

SEQ ID NO: 451442 - RNA, 22 nt, Human
uuccaaagaaauugaccaagac

SEQ ID NO: 451443 - RNA, 22 nt, Human
uggaaggagcuaaggaccuggg

SEQ ID NO: 451444 - RNA, 22 nt, Human
guugacagcuggugagcugcua

SEQ ID NO: 451445 - RNA, 22 nt, Human
cagaauuugaaguaauauucca

SEQ ID NO: 451446 - RNA, 22 nt, Human
ucaccagggcuccagccagccu

SEQ ID NO: 451447 - RNA, 22 nt, Human
cccagcucucugcucuuagccu

SEQ ID NO: 451448 - RNA, 22 nt, Human
uggaggcaguaacugagcaaca

SEQ ID NO: 451449 - RNA, 22 nt, Human
aggcucagcccaagguggagag

SEQ ID NO: 451450 - RNA, 22 nt, Human
ggaggagacggagugauuagug

SEQ ID NO: 451451 - RNA, 22 nt, Human
gcuccugggcucuaccuugcua

SEQ ID NO: 451452 - RNA, 21 nt, Human
aagaacuauugagguacacag

SEQ ID NO: 451453 - RNA, 22 nt, Human
uacaaaguauauuucuagcugu

SEQ ID NO: 451454 - RNA, 22 nt, Human
cuccugguucagagagcugaga

SEQ ID NO: 451455 - RNA, 22 nt, Human
gaagagcugcaguuuccugggc

SEQ ID NO: 451456 - RNA, 19 nt, Human
gcacacccugcaccaccau

SEQ ID NO: 451457 - RNA, 22 nt, Human
ccucucccacguggcagaggcu

SEQ ID NO: 451458 - RNA, 22 nt, Human
gcugucacucuccggccuuccc

SEQ ID NO: 451459 - RNA, 22 nt, Human
uuuguuuucaaugugucauuca

SEQ ID NO: 451460 - RNA, 20 nt, Human
cucuuaaauguaaaguaggc

SEQ ID NO: 451461 - RNA, 22 nt, Human
gccaggccugcaagugcuggug

SEQ ID NO: 451462 - RNA, 22 nt, Human
ggaggcacuucccgucucagcc

SEQ ID NO: 451463 - RNA, 22 nt, Human
ccagggcaacgcugucucagag

SEQ ID NO: 451464 - RNA, 22 nt, Human
ucaagagauugaauaauaacug

SEQ ID NO: 451465 - RNA, 22 nt, Human
ucucuuauuuugccuuugacaa

SEQ ID NO: 451466 - RNA, 22 nt, Human
gaggcugguaggaaaggaaaca

SEQ ID NO: 451467 - RNA, 22 nt, Human
acuggcagcuguaggaugcaug

SEQ ID NO: 451468 - RNA, 20 nt, Human
ggggcugcaugcagagaaga

SEQ ID NO: 451469 - RNA, 22 nt, Human
agagccuggaccugagcuacaa

SEQ ID NO: 451470 - RNA, 22 nt, Human
gcaaaggccacuggggcgaugg

SEQ ID NO: 451471 - RNA, 22 nt, Human
aggcaccuugagagcaggagcu

SEQ ID NO: 451472 - RNA, 19 nt, Human
cugagagaugcuucacaca

SEQ ID NO: 451473 - RNA, 22 nt, Human
ucuaggagaaccaucagggagg

SEQ ID NO: 451474 - RNA, 20 nt, Human
ugcugcaguuucaugggacu

SEQ ID NO: 451475 - RNA, 20 nt, Human
cagaaggucuaagcuuuaga

SEQ ID NO: 451476 - RNA, 22 nt, Human
ugagcaucuuuuuacagguuua

SEQ ID NO: 451477 - RNA, 22 nt, Human
aguguuccugcucucaggaagc

SEQ ID NO: 451478 - RNA, 22 nt, Human
acuaagaccuagauacuagggg

SEQ ID NO: 451479 - RNA, 22 nt, Human
cagaggaaaguauuucuggaag

SEQ ID NO: 451480 - RNA, 22 nt, Human
gcacuaaaccaacauguaauaa

SEQ ID NO: 451481 - RNA, 22 nt, Human
ccacagggcacagacaggaagc

SEQ ID NO: 451482 - RNA, 22 nt, Human
ggcugccuggaccuccucuuuc

SEQ ID NO: 451483 - RNA, 22 nt, Human
aguauuucugcucaugaaagag

SEQ ID NO: 451484 - RNA, 22 nt, Human
cccagcagccagaaugaggagc

SEQ ID NO: 451485 - RNA, 22 nt, Human
ugcuggaggccugacuguguuu

SEQ ID NO: 451486 - RNA, 22 nt, Human
gagggcuccacacgggcccagc

SEQ ID NO: 451487 - RNA, 22 nt, Human
gcuguacaaauuccacaagaga

SEQ ID NO: 451488 - RNA, 22 nt, Human
gaagccacagagauuguggggg

SEQ ID NO: 451489 - RNA, 22 nt, Human
cugcugcugagagcucagccug

SEQ ID NO: 451490 - RNA, 22 nt, Human
ccagggcucaggcucccagugg

SEQ ID NO: 451491 - RNA, 19 nt, Human
ugcaagugucuuggacaag

SEQ ID NO: 451492 - RNA, 22 nt, Human
ucugccuguugcuagaauguca

SEQ ID NO: 451493 - RNA, 22 nt, Human
aguuuauagcccagauucaugg

SEQ ID NO: 451494 - RNA, 20 nt, Human
guaaaauauggucuuugggu

SEQ ID NO: 451495 - RNA, 22 nt, Human
ugaggcuuagagaagaugggau

SEQ ID NO: 451496 - RNA, 22 nt, Human
cuggaaggucuguccccacugc

SEQ ID NO: 451497 - RNA, 22 nt, Human
ccagcugcugugcagggaggcu

SEQ ID NO: 451498 - RNA, 16 nt, Human
agcagggcgggaagga

SEQ ID NO: 451499 - RNA, 22 nt, Human
cagcugcccaggccaccuggag

SEQ ID NO: 451500 - RNA, 22 nt, Human
ucauucuccucuggaaaaggca

SEQ ID NO: 451501 - RNA, 23 nt, Human
ugacacauuuccuuuccacugca

SEQ ID NO: 451502 - RNA, 22 nt, Human
gcuguauuccugcacuguauag

SEQ ID NO: 451503 - RNA, 22 nt, Human
gguuucaacuucaaccucucca

SEQ ID NO: 451504 - RNA, 22 nt, Human
uuucagaugcaauuaauuuuca

SEQ ID NO: 451505 - RNA, 22 nt, Human
gugcagagaaaugagaagucga

SEQ ID NO: 451506 - RNA, 22 nt, Human
uauuacugagguuuuauggagu

SEQ ID NO: 451507 - RNA, 22 nt, Human
ugccugucucugacugccauua

SEQ ID NO: 451508 - RNA, 22 nt, Human
agggaauguagcaagaugccaa

SEQ ID NO: 451509 - RNA, 22 nt, Human
agaaugcuccagagcugaaaga

SEQ ID NO: 451510 - RNA, 22 nt, Human
gaggaagggcugccugccgggc

SEQ ID NO: 451511 - RNA, 22 nt, Human
ccucugcucugguccaugugcu

SEQ ID NO: 451512 - RNA, 20 nt, Human
ugcucugucuaaaacuuccc

SEQ ID NO: 451513 - RNA, 22 nt, Human
ggggacaguuaaagaccaagac

SEQ ID NO: 451514 - RNA, 22 nt, Human
auugaaagcacaaagaacaagu

SEQ ID NO: 451515 - RNA, 22 nt, Human
aagucauugguagcuugauagg

SEQ ID NO: 451516 - RNA, 22 nt, Human
uaauacuuaccuugcagagucu

SEQ ID NO: 451517 - RNA, 22 nt, Human
gguggccuccagggcauaggug

SEQ ID NO: 451518 - RNA, 22 nt, Human
cacagggcagagaccugggugc

SEQ ID NO: 451519 - RNA, 22 nt, Human
uucacuuaacaucauaucauga

SEQ ID NO: 451520 - RNA, 22 nt, Human
agccugagccccauccagcuga

SEQ ID NO: 451521 - RNA, 22 nt, Human
gaugcacuuucuuuucaacagu

SEQ ID NO: 451522 - RNA, 22 nt, Human
acuuuuuacaggguguauacca

SEQ ID NO: 451523 - RNA, 22 nt, Human
ugaggcaggacugagcgggaug

SEQ ID NO: 451524 - RNA, 23 nt, Human
uggcugagcccacuaucuuggcc

SEQ ID NO: 451525 - RNA, 22 nt, Human
gguuugguuuuggccaucuucc

SEQ ID NO: 451526 - RNA, 22 nt, Human
aaaguucugggggagaagaacg

SEQ ID NO: 451527 - RNA, 22 nt, Human
cauuuguagcuauuuacuguau

SEQ ID NO: 451528 - RNA, 22 nt, Human
agaaaaaucuuggcgcuugucu

SEQ ID NO: 451529 - RNA, 22 nt, Human
ggagcacccugcucagccaagc

SEQ ID NO: 451530 - RNA, 22 nt, Human
gacagcagggacauguaggaag

SEQ ID NO: 451531 - RNA, 17 nt, Human
agaaagaggauccacag

SEQ ID NO: 451532 - RNA, 22 nt, Human
auacuuuggucacuauuauugg

SEQ ID NO: 451533 - RNA, 22 nt, Human
aggcagaugguaacugugauau

SEQ ID NO: 451534 - RNA, 22 nt, Human
agggagguaggagcuucuagcu

SEQ ID NO: 451535 - RNA, 22 nt, Human
ugcagaggagucagccugggca

SEQ ID NO: 451536 - RNA, 21 nt, Human
gccauuguuuucuaccuggag

SEQ ID NO: 451537 - RNA, 22 nt, Human
ucuguaguagguuguaguucuu

SEQ ID NO: 451538 - RNA, 22 nt, Human
uccaaacacccuccaugcugca

SEQ ID NO: 451539 - RNA, 22 nt, Human
auucauuugcuauuguguaugg

SEQ ID NO: 451540 - RNA, 22 nt, Human
gcucagaggcacgaccucuugg

SEQ ID NO: 451541 - RNA, 22 nt, Human
gcuggccugaccagccacaggc

SEQ ID NO: 451542 - RNA, 22 nt, Human
augggggccugaacaggcaaaa

SEQ ID NO: 451543 - RNA, 22 nt, Human
ucacugcucuccaauguggagu

SEQ ID NO: 451544 - RNA, 22 nt, Human
cugucaucacaguugagcagcc

SEQ ID NO: 451545 - RNA, 22 nt, Human
uaugcacauugguuuccucauu

SEQ ID NO: 451546 - RNA, 20 nt, Human
cacaagagaauacacacugg

SEQ ID NO: 451547 - RNA, 22 nt, Human
ccugcagggaaucgaggcagaa

SEQ ID NO: 451548 - RNA, 22 nt, Human
cauugacaucaggcuuggccaa

SEQ ID NO: 451549 - RNA, 22 nt, Human
aggcgcagaaggccaggggccu

SEQ ID NO: 451550 - RNA, 22 nt, Human
uuuacacaaaagauagcacacc

SEQ ID NO: 451551 - RNA, 22 nt, Human
agaauucugacaauagaauugg

SEQ ID NO: 451552 - RNA, 22 nt, Human
gggucuccauguuaacaucacu

SEQ ID NO: 451553 - RNA, 22 nt, Human
cacugcagaucagaggcugaga

SEQ ID NO: 451554 - RNA, 22 nt, Human
auuuuagagaaacaaacguagg

SEQ ID NO: 451555 - RNA, 22 nt, Human
ucccugggcaucacguugcuuc

SEQ ID NO: 451556 - RNA, 22 nt, Human
gcagcugagagaagaacagggc

SEQ ID NO: 451557 - RNA, 22 nt, Human
aggcugaguuucucauucucgc

SEQ ID NO: 451558 - RNA, 22 nt, Human
acagcaagccagcuugucacug

SEQ ID NO: 451559 - RNA, 22 nt, Human
cacugaagaugcgacuagugcu

SEQ ID NO: 451560 - RNA, 23 nt, Human
gaagcagaugucugaguaggcag

SEQ ID NO: 451561 - RNA, 19 nt, Human
augucuguugaauuucaua

SEQ ID NO: 451562 - RNA, 22 nt, Human
ucaaggcuaaacuuucagagua

SEQ ID NO: 451563 - RNA, 22 nt, Human
cuguggcuuucucugccuccuu

SEQ ID NO: 451564 - RNA, 22 nt, Human
guggaggagaggcgccuugcgg

SEQ ID NO: 451565 - RNA, 18 nt, Human
aggccugggaagcugagg

SEQ ID NO: 451566 - RNA, 22 nt, Human
acagacuguuugguucaugucu

SEQ ID NO: 451567 - RNA, 20 nt, Human
cagagaccugucuucacaga

SEQ ID NO: 451568 - RNA, 22 nt, Human
caggugggaccaugauagggca

SEQ ID NO: 451569 - RNA, 22 nt, Human
gaagcaaagagcuagugccgcu

SEQ ID NO: 451570 - RNA, 20 nt, Human
ucucugagcuucucuugggg

SEQ ID NO: 451571 - RNA, 22 nt, Human
uccagccuuucuacucacugag

SEQ ID NO: 451572 - RNA, 22 nt, Human
ggggcagcuaccggaaguaggg

SEQ ID NO: 451573 - RNA, 17 nt, Human
acacagggagagggagc

SEQ ID NO: 451574 - RNA, 22 nt, Human
ucauuuaauugguuuugcucgu

SEQ ID NO: 451575 - RNA, 20 nt, Human
cccugagaccagagagcagc

SEQ ID NO: 451576 - RNA, 22 nt, Human
ugaagcccugugucagcuucca

SEQ ID NO: 451577 - RNA, 22 nt, Human
gcauguguggaggagaugugcu

SEQ ID NO: 451578 - RNA, 22 nt, Human
ugagcccaggaguuggagaccg

SEQ ID NO: 451579 - RNA, 22 nt, Human
uagcugucagcaaucaaguggu

SEQ ID NO: 451580 - RNA, 22 nt, Human
uguccacaucacucacuuguca

SEQ ID NO: 451581 - RNA, 20 nt, Human
aggagcugaauuagaggguu

SEQ ID NO: 451582 - RNA, 22 nt, Human
uaugcacaauaugaucuauuug

SEQ ID NO: 451583 - RNA, 22 nt, Human
ggccucugguucacagggagga

SEQ ID NO: 451584 - RNA, 22 nt, Human
gccugagcaggcguggaccaug

SEQ ID NO: 451585 - RNA, 22 nt, Human
guuucuuagguaaauucuuuga

SEQ ID NO: 451586 - RNA, 22 nt, Human
agggacuauuuacccaucucac

SEQ ID NO: 451587 - RNA, 21 nt, Human
ccauaauuuuguuucagaagu

SEQ ID NO: 451588 - RNA, 22 nt, Human
ugcaggugccucuugagcuugu

SEQ ID NO: 451589 - RNA, 22 nt, Human
uggcucaggaucuaagcagaau

SEQ ID NO: 451590 - RNA, 22 nt, Human
aucuggguucaccaugcuccug

SEQ ID NO: 451591 - RNA, 21 nt, Human
uggaccuguccuucucgcugu

SEQ ID NO: 451592 - RNA, 22 nt, Human
uguccucuuccagugcuccuuc

SEQ ID NO: 451593 - RNA, 22 nt, Human
gcaggaagaggcucgaagcccc

SEQ ID NO: 451594 - RNA, 22 nt, Human
ggccagagaagucagacccuug

SEQ ID NO: 451595 - RNA, 22 nt, Human
cugucagguuggucucagagcu

SEQ ID NO: 451596 - RNA, 22 nt, Human
ucccagagacaucauuucuccg

SEQ ID NO: 451597 - RNA, 22 nt, Human
auuucuuuucaagagggugcuu

SEQ ID NO: 451598 - RNA, 22 nt, Human
aagauuuacuagcauaauagcu

SEQ ID NO: 451599 - RNA, 22 nt, Human
augcaguagauaggcacuuuua

SEQ ID NO: 451600 - RNA, 22 nt, Human
agcuggggguuggauaagggua

SEQ ID NO: 451601 - RNA, 22 nt, Human
cuagggcacuaggacucaugug

SEQ ID NO: 451602 - RNA, 22 nt, Human
cuaaaugccuuuccuaccuaac

SEQ ID NO: 451603 - RNA, 22 nt, Human
uggggcagcuccaucuauucca

SEQ ID NO: 451604 - RNA, 23 nt, Human
acagugugguggacaaggagcag

SEQ ID NO: 451605 - RNA, 22 nt, Human
gcagagccaggagcccaggauc

SEQ ID NO: 451606 - RNA, 22 nt, Human
uagggcucacugagaugaauau

SEQ ID NO: 451607 - RNA, 22 nt, Human
gccuggguccacugaucaugcu

SEQ ID NO: 451608 - RNA, 22 nt, Human
cagagaaagaagcccauucauu

SEQ ID NO: 451609 - RNA, 19 nt, Human
agccagugagccucugggu

SEQ ID NO: 451610 - RNA, 22 nt, Human
uccugggaagagaccugagcau

SEQ ID NO: 451611 - RNA, 22 nt, Human
cccugggcagucugcacuucag

SEQ ID NO: 451612 - RNA, 22 nt, Human
uauaacaguuuaggugguguca

SEQ ID NO: 451613 - RNA, 22 nt, Human
ccuggcagguggagguugcagu

SEQ ID NO: 451614 - RNA, 22 nt, Human
gguuggggcgagcuggaggccc

SEQ ID NO: 451615 - RNA, 22 nt, Human
gcugcucuuuucagagaugaga

SEQ ID NO: 451616 - RNA, 22 nt, Human
uaauccaauggcacaauguaug

SEQ ID NO: 451617 - RNA, 22 nt, Human
cucuggagugcagccugguggc

SEQ ID NO: 451618 - RNA, 22 nt, Human
uugauacagcagccugugaucc

SEQ ID NO: 451619 - RNA, 19 nt, Human
gcugugggacagcagggug

SEQ ID NO: 451620 - RNA, 20 nt, Human
uuguuucugcuauuuucuaa

SEQ ID NO: 451621 - RNA, 22 nt, Human
gccucugcucggacuuugccuc

SEQ ID NO: 451622 - RNA, 22 nt, Human
aaaaugaacagaacaaugggga

SEQ ID NO: 451623 - RNA, 22 nt, Human
auucuaggcuugaaacaugaag

SEQ ID NO: 451624 - RNA, 22 nt, Human
guggcugggcuccgagcggcuu

SEQ ID NO: 451625 - RNA, 22 nt, Human
ccugcagacacuuguccagcaa

SEQ ID NO: 451626 - RNA, 21 nt, Human
ugacauuuccaauauaaagcc

SEQ ID NO: 451627 - RNA, 22 nt, Human
ggccaggcugcugggaccccgc

SEQ ID NO: 451628 - RNA, 22 nt, Human
cccucugccugggaccaagucc

SEQ ID NO: 451629 - RNA, 22 nt, Human
uagucuuuuuaauaaauaaugc

SEQ ID NO: 451630 - RNA, 22 nt, Human
cugagcagccccaccagccauu

SEQ ID NO: 451631 - RNA, 22 nt, Human
gcuguccugggaacaggcacua

SEQ ID NO: 451632 - RNA, 17 nt, Human
cccugccaccaggaagc

SEQ ID NO: 451633 - RNA, 22 nt, Human
gccugccuagaauugcagcuuu

SEQ ID NO: 451634 - RNA, 22 nt, Human
agggaccugcucacugccuggc

SEQ ID NO: 451635 - RNA, 21 nt, Human
gacaaagugaagcaggcagga

SEQ ID NO: 451636 - RNA, 22 nt, Human
ggcugggagcuggacaggccgg

SEQ ID NO: 451637 - RNA, 22 nt, Human
uggccugaggcucggcaugggu

SEQ ID NO: 451638 - RNA, 22 nt, Human
aagggcugggucugguuaaccc

SEQ ID NO: 451639 - RNA, 22 nt, Human
ccuggcugaaccaaugaagugg

SEQ ID NO: 451640 - RNA, 22 nt, Human
uaggcagggauuaggguugauu

SEQ ID NO: 451641 - RNA, 22 nt, Human
ugcuggaggggccugaccagga

SEQ ID NO: 451642 - RNA, 20 nt, Human
ggagagcagggaagacagua

SEQ ID NO: 451643 - RNA, 22 nt, Human
gaagcagcucagauugacugaa

SEQ ID NO: 451644 - RNA, 22 nt, Human
gaggcugcugagagcccuguuu

SEQ ID NO: 451645 - RNA, 22 nt, Human
aaaucugggagcagcucggcca

SEQ ID NO: 451646 - RNA, 22 nt, Human
ggggcuguuuuuggaauggcug

SEQ ID NO: 451647 - RNA, 22 nt, Human
gccagccuucuguggccugcaa

SEQ ID NO: 451648 - RNA, 22 nt, Human
uccuguggagaggacuggaggu

SEQ ID NO: 451649 - RNA, 22 nt, Human
uccagccuaauguucuucccac

SEQ ID NO: 451650 - RNA, 22 nt, Human
agagucagcuuaugacacaguc

SEQ ID NO: 451651 - RNA, 22 nt, Human
aucuccaggcauuucaagagac

SEQ ID NO: 451652 - RNA, 22 nt, Human
uuuacauugcauuagguauuau

SEQ ID NO: 451653 - RNA, 22 nt, Human
agaugagggguagaaaggacuu

SEQ ID NO: 451654 - RNA, 22 nt, Human
auuuccaccggcucaggaaguu

SEQ ID NO: 451655 - RNA, 19 nt, Human
ucuuucauuucuagcucug

SEQ ID NO: 451656 - RNA, 22 nt, Human
aggcagguguuaacccucugag

SEQ ID NO: 451657 - RNA, 22 nt, Human
auuauuucucacucacauaaua

SEQ ID NO: 451658 - RNA, 22 nt, Human
acagagcuaauguugcauaggc

SEQ ID NO: 451659 - RNA, 22 nt, Human
cuguccuccggccaccuacagu

SEQ ID NO: 451660 - RNA, 22 nt, Human
ugcuuaaaauaguucauuuuug

SEQ ID NO: 451661 - RNA, 21 nt, Human
ggccuuggcgggggccgaauu

SEQ ID NO: 451662 - RNA, 22 nt, Human
cucucccagucaggcucaggau

SEQ ID NO: 451663 - RNA, 22 nt, Human
gaugagggccugguggcugugc

SEQ ID NO: 451664 - RNA, 22 nt, Human
ucaguuuucaauuucaucagag

SEQ ID NO: 451665 - RNA, 19 nt, Human
agcauuuggaauucuacac

SEQ ID NO: 451666 - RNA, 22 nt, Human
gccaggcugacucccccggccu

SEQ ID NO: 451667 - RNA, 22 nt, Human
uaauccaaaacugaaucugugg

SEQ ID NO: 451668 - RNA, 22 nt, Human
cugggaggcaccgcgucgugcu

SEQ ID NO: 451669 - RNA, 22 nt, Human
gcuggcagagagcuggugagga

SEQ ID NO: 451670 - RNA, 23 nt, Human
aggaaggagguccuaacaguauc

SEQ ID NO: 451671 - RNA, 21 nt, Human
ggagauggguaucgccugggc

SEQ ID NO: 451672 - RNA, 20 nt, Human
ugagugauggaggcggguca

SEQ ID NO: 451673 - RNA, 19 nt, Human
accaggcuuauggucagug

SEQ ID NO: 451674 - RNA, 22 nt, Human
ucuuuauuuuaugcuugugcaa

SEQ ID NO: 451675 - RNA, 22 nt, Human
ugcuggccaacaaggcuccaag

SEQ ID NO: 451676 - RNA, 22 nt, Human
auuuacagaugaugcuauuuga

SEQ ID NO: 451677 - RNA, 18 nt, Human
gcaaggcucaggccaggc

SEQ ID NO: 451678 - RNA, 22 nt, Human
uccucagggggccaacccagcc

SEQ ID NO: 451679 - RNA, 22 nt, Human
gcccagcacagcuggaagaguc

SEQ ID NO: 451680 - RNA, 22 nt, Human
agcuggcuccagaaggagucgu

SEQ ID NO: 451681 - RNA, 22 nt, Human
cacauccuucagcugagcccag

SEQ ID NO: 451682 - RNA, 22 nt, Human
gcugagggcauguguggcgacu

SEQ ID NO: 451683 - RNA, 22 nt, Human
uucuuacagcccuauuacuaaa

SEQ ID NO: 451684 - RNA, 22 nt, Human
ggcugccucuggaagcuggaga

SEQ ID NO: 451685 - RNA, 22 nt, Human
ccugggaggcggagguugcagg

SEQ ID NO: 451686 - RNA, 22 nt, Human
gaaaacugugauuagaaugccu

SEQ ID NO: 451687 - RNA, 22 nt, Human
gcucugcugcuuacuagauggu

SEQ ID NO: 451688 - RNA, 22 nt, Human
uggggcuguggauucucacgaa

SEQ ID NO: 451689 - RNA, 22 nt, Human
ugaaagcucugucaucauuccu

SEQ ID NO: 451690 - RNA, 22 nt, Human
acacuucucccaucuccuguug

SEQ ID NO: 451691 - RNA, 22 nt, Human
uuucuuuguuguuaucacauca

SEQ ID NO: 451692 - RNA, 22 nt, Human
uccaaacgggagccaaaugagc

SEQ ID NO: 451693 - RNA, 22 nt, Human
auacaagacucagcacagacgg

SEQ ID NO: 451694 - RNA, 22 nt, Human
cgccuggaaccucuaggaccag

SEQ ID NO: 451695 - RNA, 22 nt, Human
agcucagcuuccucuccaugcu

SEQ ID NO: 451696 - RNA, 22 nt, Human
gugcaugugucuuuauaguaga

SEQ ID NO: 451697 - RNA, 23 nt, Human
ugcucccaggugacgcugcuguu

SEQ ID NO: 451698 - RNA, 22 nt, Human
aacaguaaaaaucauuuaguug

SEQ ID NO: 451699 - RNA, 17 nt, Human
agccugcugaucucaca

SEQ ID NO: 451700 - RNA, 22 nt, Human
aaucaggaugacugucauuuca

SEQ ID NO: 451701 - RNA, 22 nt, Human
aggccugaaguguggagugggg

SEQ ID NO: 451702 - RNA, 22 nt, Human
gcaguggggaaugcuggggaga

SEQ ID NO: 451703 - RNA, 22 nt, Human
aggguggcaguuacuggagcaa

SEQ ID NO: 451704 - RNA, 22 nt, Human
cucagugguugagagccugggc

SEQ ID NO: 451705 - RNA, 21 nt, Human
uuagaagcuaaugcagcuggu

SEQ ID NO: 451706 - RNA, 22 nt, Human
caggguacagaguuuucuaaac

SEQ ID NO: 451707 - RNA, 22 nt, Human
agggcagaggcggacacggaag

SEQ ID NO: 451708 - RNA, 22 nt, Human
gcaggagcuggaaagugauguu

SEQ ID NO: 451709 - RNA, 22 nt, Human
gaggaagaauugguuauuggag

SEQ ID NO: 451710 - RNA, 22 nt, Human
cccacaggcuagggguagggca

SEQ ID NO: 451711 - RNA, 22 nt, Human
cucacugugaccucagcagaca

SEQ ID NO: 451712 - RNA, 22 nt, Human
gugcuuccccaagccacagccu

SEQ ID NO: 451713 - RNA, 22 nt, Human
ucacugcucucuaagcaucgcc

SEQ ID NO: 451714 - RNA, 22 nt, Human
guggccugccagcagauggcgc

SEQ ID NO: 451715 - RNA, 22 nt, Human
caaagagcuguucagugucgcu

SEQ ID NO: 451716 - RNA, 22 nt, Human
uuucacauaucaacucuauccu

SEQ ID NO: 451717 - RNA, 22 nt, Human
uuucuccaauguaucagcacac

SEQ ID NO: 451718 - RNA, 22 nt, Human
ggagauuuauagcacacuucag

SEQ ID NO: 451719 - RNA, 22 nt, Human
uaaauguaccuucugccuuacu

SEQ ID NO: 451720 - RNA, 22 nt, Human
gaacauuuccagaaaggaacua

SEQ ID NO: 451721 - RNA, 22 nt, Human
guccugggccugcugaggcuga

SEQ ID NO: 451722 - RNA, 22 nt, Human
cagagcugggcauggugaaagg

SEQ ID NO: 451723 - RNA, 22 nt, Human
ccuaugccugucacucugcgcu

SEQ ID NO: 451724 - RNA, 22 nt, Human
aaaaguuuaagacucauucuag

SEQ ID NO: 451725 - RNA, 22 nt, Human
ccagcuuuauagcuucaaagga

SEQ ID NO: 451726 - RNA, 22 nt, Human
gggcagcugccaagugcaucgc

SEQ ID NO: 451727 - RNA, 21 nt, Human
guggcccugccgcagugucca

SEQ ID NO: 451728 - RNA, 22 nt, Human
aaaauccuuagccgagugaggu

SEQ ID NO: 451729 - RNA, 21 nt, Human
guuugcaugaacaagucagcc

SEQ ID NO: 451730 - RNA, 22 nt, Human
acuggcucagaguuccuagaga

SEQ ID NO: 451731 - RNA, 22 nt, Human
uuucccaauugagagguucugu

SEQ ID NO: 451732 - RNA, 22 nt, Human
ugccugggccuucccaccucug

SEQ ID NO: 451733 - RNA, 22 nt, Human
cagaccagaaggaagccgacaa

SEQ ID NO: 451734 - RNA, 22 nt, Human
gacaagacuauguagaaaguau

SEQ ID NO: 451735 - RNA, 19 nt, Human
cugaggugcaguaagaggc

SEQ ID NO: 451736 - RNA, 21 nt, Human
uucaaagagugggcauuguca

SEQ ID NO: 451737 - RNA, 23 nt, Human
uuccuuaacuguuaagauugucu

SEQ ID NO: 451738 - RNA, 22 nt, Human
gauacauuuuaucuccuaacag

SEQ ID NO: 451739 - RNA, 23 nt, Human
cccuggccuuggggcacaggcug

SEQ ID NO: 451740 - RNA, 22 nt, Human
caggaucccuggccuccgccca

SEQ ID NO: 451741 - RNA, 19 nt, Human
agaggccucagcagcuggc

SEQ ID NO: 451742 - RNA, 22 nt, Human
agcaugaagacuucagagcuag

SEQ ID NO: 451743 - RNA, 22 nt, Human
uuuccauauucugcgucugcca

SEQ ID NO: 451744 - RNA, 22 nt, Human
cagaaagaccugggcucaagag

SEQ ID NO: 451745 - RNA, 20 nt, Human
agcuggagaagggcccuucc

SEQ ID NO: 451746 - RNA, 22 nt, Human
cugagccuguguuucucuggca

SEQ ID NO: 451747 - RNA, 22 nt, Human
guggccuggaguuugauguagg

SEQ ID NO: 451748 - RNA, 22 nt, Human
cagcagagcugugugggaaggg

SEQ ID NO: 451749 - RNA, 22 nt, Human
agagaaaacucauugagguguc

SEQ ID NO: 451750 - RNA, 22 nt, Human
auaauucagguuuucuggcaca

SEQ ID NO: 451751 - RNA, 18 nt, Human
uuucacagauucaugacu

SEQ ID NO: 451752 - RNA, 22 nt, Human
gcugugcagucuuuggugugcc

SEQ ID NO: 451753 - RNA, 22 nt, Human
uccugccucuugccuucuucac

SEQ ID NO: 451754 - RNA, 22 nt, Human
ucucagagauuuuguuucccuu

SEQ ID NO: 451755 - RNA, 22 nt, Human
gaaccaaguaggauacaaggag

SEQ ID NO: 451756 - RNA, 22 nt, Human
ccacagcugaccgcaggugagc

SEQ ID NO: 451757 - RNA, 22 nt, Human
agacuucuuugugagcauuuuc

SEQ ID NO: 451758 - RNA, 22 nt, Human
gaacagaauuaccgaagaucug

SEQ ID NO: 451759 - RNA, 22 nt, Human
aguuucuguuaccauauuugac

SEQ ID NO: 451760 - RNA, 22 nt, Human
gcuccugucuuggggcacuggc

SEQ ID NO: 451761 - RNA, 22 nt, Human
aguaacaagugccaacguuaga

SEQ ID NO: 451762 - RNA, 22 nt, Human
aggucauuccagccauuccccu

SEQ ID NO: 451763 - RNA, 22 nt, Human
cccagggacagcuagguggggc

SEQ ID NO: 451764 - RNA, 22 nt, Human
ggugaggaaagauggugacagu

SEQ ID NO: 451765 - RNA, 22 nt, Human
agccacagggggugagggacaa

SEQ ID NO: 451766 - RNA, 22 nt, Human
aauauaauuuuauuccuagagu

SEQ ID NO: 451767 - RNA, 19 nt, Human
ucucagaggaaaaauugcu

SEQ ID NO: 451768 - RNA, 22 nt, Human
aaucaguuucuuggcaaguuua

SEQ ID NO: 451769 - RNA, 22 nt, Human
aaguccaucucugccccacaca

SEQ ID NO: 451770 - RNA, 22 nt, Human
caaauccagaucccagucguag

SEQ ID NO: 451771 - RNA, 22 nt, Human
ugcccuguuccugccuccagcu

SEQ ID NO: 451772 - RNA, 22 nt, Human
aggagguggccugagcgugccc

SEQ ID NO: 451773 - RNA, 22 nt, Human
cuggugcaggaaggagcuggca

SEQ ID NO: 451774 - RNA, 20 nt, Human
cccucugcacauggcugugg

SEQ ID NO: 451775 - RNA, 22 nt, Human
agagauguucauucagcauguu

SEQ ID NO: 451776 - RNA, 22 nt, Human
agggcuccuaugaugcucugcc

SEQ ID NO: 451777 - RNA, 22 nt, Human
ugcugggcuaggguggagcucu

SEQ ID NO: 451778 - RNA, 22 nt, Human
gaucauuugcaggaaacauuaa

SEQ ID NO: 451779 - RNA, 22 nt, Human
ucucuuccaguaagagucuuua

SEQ ID NO: 451780 - RNA, 22 nt, Human
ugggcuccagcaccugugcucu

SEQ ID NO: 451781 - RNA, 22 nt, Human
uggaggaugagugugggcucug

SEQ ID NO: 451782 - RNA, 22 nt, Human
ggcaaggccuugcccagcauuc

SEQ ID NO: 451783 - RNA, 22 nt, Human
agucccagugagaugagccacg

SEQ ID NO: 451784 - RNA, 22 nt, Human
gcugcugguccucagagcucau

SEQ ID NO: 451785 - RNA, 22 nt, Human
uagaaaucauuuagaaguauug

SEQ ID NO: 451786 - RNA, 22 nt, Human
cagugcauagauccugaggccu

SEQ ID NO: 451787 - RNA, 22 nt, Human
guuuauuauacaacaaaagcua

SEQ ID NO: 451788 - RNA, 22 nt, Human
ugggcagaggacagggaagauc

SEQ ID NO: 451789 - RNA, 20 nt, Human
agggcagagggauuacaggc

SEQ ID NO: 451790 - RNA, 22 nt, Human
agggugcauguuugcaagagug

SEQ ID NO: 451791 - RNA, 21 nt, Human
cauuucuauugaugagaaaag

SEQ ID NO: 451792 - RNA, 22 nt, Human
uccugccucaggcucuggagua

SEQ ID NO: 451793 - RNA, 23 nt, Human
ggacagggcccugcccuauggcc

SEQ ID NO: 451794 - RNA, 22 nt, Human
ggaccugaacauaaaacgaggc

SEQ ID NO: 451795 - RNA, 18 nt, Human
ugaacagaugaguugaag

SEQ ID NO: 451796 - RNA, 22 nt, Human
cacaguccuacagagaucagag

SEQ ID NO: 451797 - RNA, 22 nt, Human
auaaacaguagagaaagguggu

SEQ ID NO: 451798 - RNA, 22 nt, Human
accaggcaacugugaaugggcu

SEQ ID NO: 451799 - RNA, 22 nt, Human
ugcaguggaaucuggagagcag

SEQ ID NO: 451800 - RNA, 20 nt, Human
accaauguuagcuuaguacu

SEQ ID NO: 451801 - RNA, 22 nt, Human
agcuaagacuuagugacuuagu

SEQ ID NO: 451802 - RNA, 22 nt, Human
gggcugaccccaccccucacuc

SEQ ID NO: 451803 - RNA, 22 nt, Human
gaggaguggaguugcuggguug

SEQ ID NO: 451804 - RNA, 22 nt, Human
uaagcauucaaugcuuagcacu

SEQ ID NO: 451805 - RNA, 22 nt, Human
ucaagcaucuuggucuacgauc

SEQ ID NO: 451806 - RNA, 22 nt, Human
ccuuucucuaucgacccaucgc

SEQ ID NO: 451807 - RNA, 22 nt, Human
auguguccacaggugugagaga

SEQ ID NO: 451808 - RNA, 22 nt, Human
ugcagcuguaacagaggccuca

SEQ ID NO: 451809 - RNA, 22 nt, Human
gaggccugucgcuaggccucug

SEQ ID NO: 451810 - RNA, 22 nt, Human
cagagcauugagggucugccaa

SEQ ID NO: 451811 - RNA, 18 nt, Human
gggaucaggcugccuagg

SEQ ID NO: 451812 - RNA, 22 nt, Human
aaacaccagucccaguauacac

SEQ ID NO: 451813 - RNA, 22 nt, Human
cugcuuugaaaauaaacuuguc

SEQ ID NO: 451814 - RNA, 22 nt, Human
uauauguaagcuauguaagagu

SEQ ID NO: 451815 - RNA, 22 nt, Human
gggcuggggcucaauaauuugu

SEQ ID NO: 451816 - RNA, 22 nt, Human
ucagagcuuuggagaccaggaa

SEQ ID NO: 451817 - RNA, 22 nt, Human
uggccuggugcucaggcaguag

SEQ ID NO: 451818 - RNA, 19 nt, Human
gccugcagaaaaggcaggg

SEQ ID NO: 451819 - RNA, 22 nt, Human
ucagaggagggacucagaccca

SEQ ID NO: 451820 - RNA, 22 nt, Human
gcugggagccguaccugucacg

SEQ ID NO: 451821 - RNA, 22 nt, Human
caaggaaaacagaugaucaaca

SEQ ID NO: 451822 - RNA, 22 nt, Human
gucagaggggcagcugccaggc

SEQ ID NO: 451823 - RNA, 22 nt, Human
agagcuguucaacguagcaaug

SEQ ID NO: 451824 - RNA, 22 nt, Human
agccuggcuaaauucucccaug

SEQ ID NO: 451825 - RNA, 22 nt, Human
ucucccacagccgugcuucaag

SEQ ID NO: 451826 - RNA, 22 nt, Human
agcagaaccugcagaccugucu

SEQ ID NO: 451827 - RNA, 22 nt, Human
uuaggaaaaucaugagagauga

SEQ ID NO: 451828 - RNA, 22 nt, Human
uaagaacauaaauucauacggg

SEQ ID NO: 451829 - RNA, 22 nt, Human
aucagagaaguuucacuggcau

SEQ ID NO: 451830 - RNA, 22 nt, Human
ugacacauuaaaugcucacaaa

SEQ ID NO: 451831 - RNA, 22 nt, Human
guucacauccuugugaggauuu

SEQ ID NO: 451832 - RNA, 17 nt, Human
uuauuuuuugggcugag

SEQ ID NO: 451833 - RNA, 22 nt, Human
gccuuggccaacaccuugcaaa

SEQ ID NO: 451834 - RNA, 21 nt, Human
uggccucccacacuuccaugg

SEQ ID NO: 451835 - RNA, 22 nt, Human
uuagccauuaaauuacaaggug

SEQ ID NO: 451836 - RNA, 22 nt, Human
aggaugaauaacugaaauggug

SEQ ID NO: 451837 - RNA, 22 nt, Human
guuuucuuugaaugcuucuaga

SEQ ID NO: 451838 - RNA, 22 nt, Human
ggugacuggagggacccaggcc

SEQ ID NO: 451839 - RNA, 22 nt, Human
gugaagagcuguugcagagauu

SEQ ID NO: 451840 - RNA, 22 nt, Human
cacccagcacagagggaggcga

SEQ ID NO: 451841 - RNA, 22 nt, Human
cugcucucuguuccccuggauc

SEQ ID NO: 451842 - RNA, 22 nt, Human
uugaaaggugacauuguuagag

SEQ ID NO: 451843 - RNA, 22 nt, Human
uauuuguugcgggaauugcuau

SEQ ID NO: 451844 - RNA, 22 nt, Human
ccucagggaaugggaggcuggg

SEQ ID NO: 451845 - RNA, 22 nt, Human
gccuuucaguuccaucaaagga

SEQ ID NO: 451846 - RNA, 22 nt, Human
aguggcagagaccccagccagc

SEQ ID NO: 451847 - RNA, 21 nt, Human
gccagagcaguacaaugaggu

SEQ ID NO: 451848 - RNA, 18 nt, Human
gcuuuauuucuuggggaa

SEQ ID NO: 451849 - RNA, 22 nt, Human
aggcucagucccggcccgcgcc

SEQ ID NO: 451850 - RNA, 22 nt, Human
agccaggccuuuucucaagguu

SEQ ID NO: 451851 - RNA, 22 nt, Human
uggcugcuuguuuuagugaggc

SEQ ID NO: 451852 - RNA, 22 nt, Human
cacaucuucuuaacuccaaagu

SEQ ID NO: 451853 - RNA, 22 nt, Human
aagcagccuggacuugggcugg

SEQ ID NO: 451854 - RNA, 22 nt, Human
ucucagagagaugaaacuucca

SEQ ID NO: 451855 - RNA, 22 nt, Human
cuugaaagucacaugcagcccu

SEQ ID NO: 451856 - RNA, 20 nt, Human
ggccuuggguuucgccuguu

SEQ ID NO: 451857 - RNA, 22 nt, Human
uuuauugcauacacaaauguca

SEQ ID NO: 451858 - RNA, 22 nt, Human
ugccuggguucccaccccaaag

SEQ ID NO: 451859 - RNA, 22 nt, Human
aaguuacuggcaagggcugcag

SEQ ID NO: 451860 - RNA, 22 nt, Human
uggcuuccuggacagaugcggu

SEQ ID NO: 451861 - RNA, 22 nt, Human
aggaccugaaauucuugcuuuu

SEQ ID NO: 451862 - RNA, 19 nt, Human
ggcugcugguuacagaggc

SEQ ID NO: 451863 - RNA, 22 nt, Human
uuaaacauuuauggaggcagca

SEQ ID NO: 451864 - RNA, 22 nt, Human
cccaggcagccugcagggaagg

SEQ ID NO: 451865 - RNA, 22 nt, Human
agaggagugggaagcagugcaa

SEQ ID NO: 451866 - RNA, 22 nt, Human
ccugcugugaaacuggcauaug

SEQ ID NO: 451867 - RNA, 22 nt, Human
ucccagaggcuccagucucuau

SEQ ID NO: 451868 - RNA, 22 nt, Human
ugggagcaagcuggugcuggag

SEQ ID NO: 451869 - RNA, 22 nt, Human
caaugauguuuagauaaaaucc

SEQ ID NO: 451870 - RNA, 22 nt, Human
cccagguggcagaagcugcagu

SEQ ID NO: 451871 - RNA, 22 nt, Human
augcaguacagauaauucuaca

SEQ ID NO: 451872 - RNA, 22 nt, Human
ugugcagcuaguccuggacuug

SEQ ID NO: 451873 - RNA, 23 nt, Human
gcagagcugcccuauugccuugg

SEQ ID NO: 451874 - RNA, 22 nt, Human
uuuaaauuauaguuaaugucug

SEQ ID NO: 451875 - RNA, 22 nt, Human
ccucaguguuaggauaagagaa

SEQ ID NO: 451876 - RNA, 22 nt, Human
gcagcuuuuuggaugucaguua

SEQ ID NO: 451877 - RNA, 22 nt, Human
caaaauuagggagugagcugga

SEQ ID NO: 451878 - RNA, 22 nt, Human
agucucuuuaaucacagugucu

SEQ ID NO: 451879 - RNA, 22 nt, Human
uauuaguagcuugaaauuggug

SEQ ID NO: 451880 - RNA, 22 nt, Human
aguggccagugcugcucugggg

SEQ ID NO: 451881 - RNA, 23 nt, Human
ugggaccuguuugcccacagaug

SEQ ID NO: 451882 - RNA, 22 nt, Human
cguagguggcucagcaccuggg

SEQ ID NO: 451883 - RNA, 22 nt, Human
uacccagcuucaagucaggacu

SEQ ID NO: 451884 - RNA, 22 nt, Human
caggaaggcgcggcugugccug

SEQ ID NO: 451885 - RNA, 22 nt, Human
ucaggauccauagacucccaaa

SEQ ID NO: 451886 - RNA, 22 nt, Human
gcucuggacuggggccugagaa

SEQ ID NO: 451887 - RNA, 22 nt, Human
cugagccacugcuuguucagug

SEQ ID NO: 451888 - RNA, 22 nt, Human
cagaugagaguggccaggguuc

SEQ ID NO: 451889 - RNA, 22 nt, Human
caugcuuucuguccaaauguua

SEQ ID NO: 451890 - RNA, 20 nt, Human
cuucaggacccauccucccc

SEQ ID NO: 451891 - RNA, 21 nt, Human
aaaugaaugugguagugcaag

SEQ ID NO: 451892 - RNA, 22 nt, Human
cuuaacagauacaucugugguu

SEQ ID NO: 451893 - RNA, 22 nt, Human
agcaaaguagcugcuguucuua

SEQ ID NO: 451894 - RNA, 22 nt, Human
ggaaaguggugguggaaagagg

SEQ ID NO: 451895 - RNA, 19 nt, Human
caguggagauuggaggagg

SEQ ID NO: 451896 - RNA, 22 nt, Human
augaggcagguggaggcugcca

SEQ ID NO: 451897 - RNA, 22 nt, Human
ccagagcuaaacacacaggcug

SEQ ID NO: 451898 - RNA, 22 nt, Human
cacauuuaauccuuuauaagua

SEQ ID NO: 451899 - RNA, 22 nt, Human
uaaaugcaguacaaauuguucu

SEQ ID NO: 451900 - RNA, 22 nt, Human
ugggccagcaauugcugcucag

SEQ ID NO: 451901 - RNA, 22 nt, Human
ccuggagcacauggcaggaggc

SEQ ID NO: 451902 - RNA, 22 nt, Human
caguccugagccaaucaugaug

SEQ ID NO: 451903 - RNA, 22 nt, Human
agcuggaggauaacucacuucu

SEQ ID NO: 451904 - RNA, 22 nt, Human
gaaaguuucuucauuaagaugu

SEQ ID NO: 451905 - RNA, 22 nt, Human
ucucugagacaguagccucugc

SEQ ID NO: 451906 - RNA, 22 nt, Human
ccuccaggauaagucagggccu

SEQ ID NO: 451907 - RNA, 22 nt, Human
gaaaggucaguuccacuuccau

SEQ ID NO: 451908 - RNA, 22 nt, Human
uguguacucaauugagccauuu

SEQ ID NO: 451909 - RNA, 22 nt, Human
agccagugcaacagcagugaag

SEQ ID NO: 451910 - RNA, 21 nt, Human
uggcucaguugcugggcacag

SEQ ID NO: 451911 - RNA, 22 nt, Human
agagcagaggcauggccguggg

SEQ ID NO: 451912 - RNA, 22 nt, Human
gaaggccuagggaugcucugcg

SEQ ID NO: 451913 - RNA, 22 nt, Human
guguaauugaaauugagaacca

SEQ ID NO: 451914 - RNA, 22 nt, Human
cgggcuggcugcagcugcugga

SEQ ID NO: 451915 - RNA, 22 nt, Human
ucucuggagcugcagauccagg

SEQ ID NO: 451916 - RNA, 22 nt, Human
cagggcccaagacacaaugagg

SEQ ID NO: 451917 - RNA, 22 nt, Human
aaagacugggacugcagcaggc

SEQ ID NO: 451918 - RNA, 22 nt, Human
augcaguaaauguucuaguuug

SEQ ID NO: 451919 - RNA, 22 nt, Human
gagcuuugcuggaagccugggg

SEQ ID NO: 451920 - RNA, 22 nt, Human
gcugggagugggcaagaugaga

SEQ ID NO: 451921 - RNA, 22 nt, Human
uggagcugauacagcuggcuuu

SEQ ID NO: 451922 - RNA, 22 nt, Human
gaugugggguugagggaccagc

SEQ ID NO: 451923 - RNA, 22 nt, Human
cuugcaggcagggccuccugga

SEQ ID NO: 451924 - RNA, 22 nt, Human
gugaggugguacaauauuaacu

SEQ ID NO: 451925 - RNA, 20 nt, Human
uccaggcagcucagaguguc

SEQ ID NO: 451926 - RNA, 20 nt, Human
ccaggcacugucccaugcag

SEQ ID NO: 451927 - RNA, 22 nt, Human
uggcccugugugcaggcugcac

SEQ ID NO: 451928 - RNA, 22 nt, Human
ugagccaggaguuugaggcugu

SEQ ID NO: 451929 - RNA, 22 nt, Human
caggaaagaaaugagaacacca

SEQ ID NO: 451930 - RNA, 22 nt, Human
uaauuucuucaucucugcagcu

SEQ ID NO: 451931 - RNA, 22 nt, Human
uuccuccacgugacaggagcca

SEQ ID NO: 451932 - RNA, 22 nt, Human
gcugccugaagugucuacacug

SEQ ID NO: 451933 - RNA, 22 nt, Human
ucucugagguuguuuccagcac

SEQ ID NO: 451934 - RNA, 22 nt, Human
ggcuguggccagcggggcugag

SEQ ID NO: 451935 - RNA, 22 nt, Human
cccugcagggaggauucugaag

SEQ ID NO: 451936 - RNA, 22 nt, Human
gccucugcaugcucagcaccca

SEQ ID NO: 451937 - RNA, 22 nt, Human
acauuucugcauguaggguaau

SEQ ID NO: 451938 - RNA, 22 nt, Human
agaguucugcucuucucaguga

SEQ ID NO: 451939 - RNA, 22 nt, Human
aaguucaaggaagccuccaguu

SEQ ID NO: 451940 - RNA, 22 nt, Human
gaaggcaacaccaggaugcacu

SEQ ID NO: 451941 - RNA, 22 nt, Human
cacaugcauaaggauaauuacu

SEQ ID NO: 451942 - RNA, 22 nt, Human
guccaguguguuuaucuuggau

SEQ ID NO: 451943 - RNA, 22 nt, Human
aaaauuuugcccuauccuucau

SEQ ID NO: 451944 - RNA, 22 nt, Human
cuggggacuugcagacacaauu

SEQ ID NO: 451945 - RNA, 19 nt, Human
gggcaguggcacuagggag

SEQ ID NO: 451946 - RNA, 22 nt, Human
uauccaaagagauucauguucu

SEQ ID NO: 451947 - RNA, 22 nt, Human
uuucacauacaguguauaguag

SEQ ID NO: 451948 - RNA, 22 nt, Human
ugauuuccuagcugacaugaaa

SEQ ID NO: 451949 - RNA, 22 nt, Human
caugucuguguacacaugcaca

SEQ ID NO: 451950 - RNA, 17 nt, Human
uggcacagaggugcuau

SEQ ID NO: 451951 - RNA, 22 nt, Human
accagcagaguugaggaggaca

SEQ ID NO: 451952 - RNA, 22 nt, Human
ucuguacaccaggggccauucu

SEQ ID NO: 451953 - RNA, 22 nt, Human
cuggcucaggguggucuggguc

SEQ ID NO: 451954 - RNA, 22 nt, Human
agaggccagggacacugcucaa

SEQ ID NO: 451955 - RNA, 22 nt, Human
cuaguucuuaacuguuaugauu

SEQ ID NO: 451956 - RNA, 22 nt, Human
gcugccuuugugagccaagggg

SEQ ID NO: 451957 - RNA, 22 nt, Human
acuuucuuaggcuguauaaaug

SEQ ID NO: 451958 - RNA, 22 nt, Human
aaaauuuccaccaucuuugugu

SEQ ID NO: 451959 - RNA, 22 nt, Human
cuguaaauaugaagaauauaug

SEQ ID NO: 451960 - RNA, 22 nt, Human
cccugggcaagcccuauuuucc

SEQ ID NO: 451961 - RNA, 22 nt, Human
gggccccaaaaugccaggcucu

SEQ ID NO: 451962 - RNA, 19 nt, Human
uugguggugguuuugguuc

SEQ ID NO: 451963 - RNA, 22 nt, Human
caaggccagagccagcgauaag

SEQ ID NO: 451964 - RNA, 22 nt, Human
agaagccagaggcaguggguac

SEQ ID NO: 451965 - RNA, 20 nt, Human
ggagcugcccugggcuggag

SEQ ID NO: 451966 - RNA, 22 nt, Human
cuggagugaagucuggcagcuu

SEQ ID NO: 451967 - RNA, 22 nt, Human
agggcaaguugagugugcgugg

SEQ ID NO: 451968 - RNA, 22 nt, Human
ggccugaggcgucccagcugug

SEQ ID NO: 451969 - RNA, 22 nt, Human
aucuggcugagcgaggcccaca

SEQ ID NO: 451970 - RNA, 23 nt, Human
cuggcuccgaagacuccaggauc

SEQ ID NO: 451971 - RNA, 22 nt, Human
agcaguggccuggggcucugug

SEQ ID NO: 451972 - RNA, 22 nt, Human
acaccauacucauguugguucc

SEQ ID NO: 451973 - RNA, 18 nt, Human
gcccugguggagcuggug

SEQ ID NO: 451974 - RNA, 22 nt, Human
ucuguacauuuguguugugaau

SEQ ID NO: 451975 - RNA, 22 nt, Human
auguucuaaucccugcuaugua

SEQ ID NO: 451976 - RNA, 22 nt, Human
cauguuaaugaauuuuugcagu

SEQ ID NO: 451977 - RNA, 22 nt, Human
uucucuggaacugaaacaagau

SEQ ID NO: 451978 - RNA, 22 nt, Human
aacauuaauuacagucaaacau

SEQ ID NO: 451979 - RNA, 18 nt, Human
gucaccuggaucagauua

SEQ ID NO: 451980 - RNA, 22 nt, Human
caggcugcagcagcaguggccc

SEQ ID NO: 451981 - RNA, 21 nt, Human
gggccuggcugcgcaggacgg

SEQ ID NO: 451982 - RNA, 22 nt, Human
aaggcugaguaaaacagagaac

SEQ ID NO: 451983 - RNA, 22 nt, Human
uccuuucccuuuccauccuggc

SEQ ID NO: 451984 - RNA, 22 nt, Human
uccaggcaaggauaauaaacau

SEQ ID NO: 451985 - RNA, 22 nt, Human
acaaagucuuuuacaacaguca

SEQ ID NO: 451986 - RNA, 22 nt, Human
uugaaaggugcugugugcugau

SEQ ID NO: 451987 - RNA, 22 nt, Human
cagggcagccaggccccguggg

SEQ ID NO: 451988 - RNA, 22 nt, Human
cagccaucccagccugugguuc

SEQ ID NO: 451989 - RNA, 19 nt, Human
ccaggccugcgggcguugg

SEQ ID NO: 451990 - RNA, 22 nt, Human
aguggagaagaggauggucucc

SEQ ID NO: 451991 - RNA, 22 nt, Human
uaaaugugagugaugcggugaa

SEQ ID NO: 451992 - RNA, 22 nt, Human
gccagcuggagacuggcagggg

SEQ ID NO: 451993 - RNA, 19 nt, Human
caaggccaccauuucuccg

SEQ ID NO: 451994 - RNA, 22 nt, Human
aaaugcacaauaaaguaaaggc

SEQ ID NO: 451995 - RNA, 22 nt, Human
cuagaaaaauacuuuauuguga

SEQ ID NO: 451996 - RNA, 22 nt, Human
uuugcauucuagaaaaauuucu

SEQ ID NO: 451997 - RNA, 22 nt, Human
uacauauacugagugauuugcu

SEQ ID NO: 451998 - RNA, 22 nt, Human
cugggagaugacucagagcagg

SEQ ID NO: 451999 - RNA, 22 nt, Human
aagaaauuaaugugccauuacu

SEQ ID NO: 452000 - RNA, 22 nt, Human
gaaaggucuuccggucuuccag

SEQ ID NO: 452001 - RNA, 22 nt, Human
cagaggaaguuccuugaugaga

SEQ ID NO: 452002 - RNA, 22 nt, Human
guccugucccccaaggcugugg

SEQ ID NO: 452003 - RNA, 22 nt, Human
uaccaaaagcuuguuucauaca

SEQ ID NO: 452004 - RNA, 22 nt, Human
auacauguuguaccauauguuu

SEQ ID NO: 452005 - RNA, 22 nt, Human
aucucccagccacagcauucuu

SEQ ID NO: 452006 - RNA, 22 nt, Human
cacuguaucuuuuccaaagucu

SEQ ID NO: 452007 - RNA, 22 nt, Human
agucccagacuccaguuuucug

SEQ ID NO: 452008 - RNA, 22 nt, Human
ggagccuguuaguugagugcuc

SEQ ID NO: 452009 - RNA, 22 nt, Human
cauggggagacaccuagggaaa

SEQ ID NO: 452010 - RNA, 22 nt, Human
cauguacauucuguagauggag

SEQ ID NO: 452011 - RNA, 22 nt, Human
uacccagggcuuuucugaugca

SEQ ID NO: 452012 - RNA, 22 nt, Human
uucagauguggcuuugucaggc

SEQ ID NO: 452013 - RNA, 22 nt, Human
ggcuggaaguccaagaucaagg

SEQ ID NO: 452014 - RNA, 22 nt, Human
agugaccaaucaugguuagauu

SEQ ID NO: 452015 - RNA, 22 nt, Human
ggcagcaaauauugucagcugu

SEQ ID NO: 452016 - RNA, 22 nt, Human
uagcagggccaggcugggaacc

SEQ ID NO: 452017 - RNA, 21 nt, Human
gcaggguccuuuccauuccua

SEQ ID NO: 452018 - RNA, 22 nt, Human
gccugcuggauguggccaggcc

SEQ ID NO: 452019 - RNA, 22 nt, Human
accugcaggcacaggugugcgc

SEQ ID NO: 452020 - RNA, 22 nt, Human
ugcagaguaaaagcagaugcua

SEQ ID NO: 452021 - RNA, 22 nt, Human
uugcuauuuugagagucauagu

SEQ ID NO: 452022 - RNA, 23 nt, Human
uuuuaauuuggacauaagaagau

SEQ ID NO: 452023 - RNA, 22 nt, Human
ucuggccuauuucugucagauc

SEQ ID NO: 452024 - RNA, 22 nt, Human
ggcugccauaacugauaccaua

SEQ ID NO: 452025 - RNA, 22 nt, Human
cagcugcaggaacaaaaaugug

SEQ ID NO: 452026 - RNA, 22 nt, Human
ggcaggguggcagaggcucaga

SEQ ID NO: 452027 - RNA, 22 nt, Human
ccaggcccugcuccucacacca

SEQ ID NO: 452028 - RNA, 22 nt, Human
uaacagaaaggggacagaaaua

SEQ ID NO: 452029 - RNA, 22 nt, Human
ucagaguggugguuuugccuuc

SEQ ID NO: 452030 - RNA, 22 nt, Human
cuguccucuguccucagcagga

SEQ ID NO: 452031 - RNA, 22 nt, Human
aaguccaguuucauuugagguc

SEQ ID NO: 452032 - RNA, 22 nt, Human
agaguguuuuucugucaaggac

SEQ ID NO: 452033 - RNA, 22 nt, Human
ccaguucugacacaagcacagu

SEQ ID NO: 452034 - RNA, 22 nt, Human
ucucuuucuauugcaccaugcu

SEQ ID NO: 452035 - RNA, 22 nt, Human
gcucccagcaauugaggcagcc

SEQ ID NO: 452036 - RNA, 22 nt, Human
cagcuuuauugagguauaauug

SEQ ID NO: 452037 - RNA, 19 nt, Human
ucccuuccugucgggcucc

SEQ ID NO: 452038 - RNA, 22 nt, Human
auuuccauacacccauuucuga

SEQ ID NO: 452039 - RNA, 22 nt, Human
cuccagugggggugagccuaga

SEQ ID NO: 452040 - RNA, 22 nt, Human
agguaaggcuguaagcuaagcc

SEQ ID NO: 452041 - RNA, 22 nt, Human
cugugccaggcccagcugacuu

SEQ ID NO: 452042 - RNA, 22 nt, Human
agagccaguuacaacuguggag

SEQ ID NO: 452043 - RNA, 20 nt, Human
agcaggaaugaugcuuucau

SEQ ID NO: 452044 - RNA, 22 nt, Human
uguccucuaauuggccucuugc

SEQ ID NO: 452045 - RNA, 21 nt, Human
uuacuuuugcagcaaccuaau

SEQ ID NO: 452046 - RNA, 22 nt, Human
ugcagccaauucauucauucuu

SEQ ID NO: 452047 - RNA, 22 nt, Human
uagggcucugcucaucaguugu

SEQ ID NO: 452048 - RNA, 22 nt, Human
ucucaguggacgugucugucuu

SEQ ID NO: 452049 - RNA, 22 nt, Human
aguugaagguuggcugauccau

SEQ ID NO: 452050 - RNA, 22 nt, Human
ucagggacgugagcucagaguc

SEQ ID NO: 452051 - RNA, 22 nt, Human
auuuagaaauuccaaaaguauu

SEQ ID NO: 452052 - RNA, 22 nt, Human
ucuggagcaacagagcaggaca

SEQ ID NO: 452053 - RNA, 17 nt, Human
cccagagaugcugccuu

SEQ ID NO: 452054 - RNA, 22 nt, Human
ugcuggcuacugauggcaggcc

SEQ ID NO: 452055 - RNA, 22 nt, Human
ccaggccauucccagaguugcu

SEQ ID NO: 452056 - RNA, 17 nt, Human
cgagggcuugcuggcuc

SEQ ID NO: 452057 - RNA, 22 nt, Human
uggcagcaauuugugauguuga

SEQ ID NO: 452058 - RNA, 22 nt, Human
uuuccaaaggcuaaacucaguu

SEQ ID NO: 452059 - RNA, 21 nt, Human
aaaaagcuggggcaugcaugc

SEQ ID NO: 452060 - RNA, 22 nt, Human
ucacagaaggcaucacagaaga

SEQ ID NO: 452061 - RNA, 22 nt, Human
uaaguucagaguucucauuugu

SEQ ID NO: 452062 - RNA, 22 nt, Human
gugcauuucucauacacuaaau

SEQ ID NO: 452063 - RNA, 22 nt, Human
ucuggcucccuggagcuccaca

SEQ ID NO: 452064 - RNA, 22 nt, Human
uacaguuuguuacauuguuagu

SEQ ID NO: 452065 - RNA, 22 nt, Human
acucaggaagaaagcagcuggu

SEQ ID NO: 452066 - RNA, 22 nt, Human
agggacacacuccaguguuauu

SEQ ID NO: 452067 - RNA, 22 nt, Human
guccucugggcagcugccccac

SEQ ID NO: 452068 - RNA, 22 nt, Human
cagggagggacaauugucaccu

SEQ ID NO: 452069 - RNA, 22 nt, Human
aguacagaccugucucuuccug

SEQ ID NO: 452070 - RNA, 22 nt, Human
gaacccaguccaggugcagccu

SEQ ID NO: 452071 - RNA, 22 nt, Human
aggcuccuugcucacaggcuca

SEQ ID NO: 452072 - RNA, 22 nt, Human
gagagugagauccuccugggga

SEQ ID NO: 452073 - RNA, 22 nt, Human
gagcuuuacuucugacuggugc

SEQ ID NO: 452074 - RNA, 22 nt, Human
uacaggaagcacucaagaaaug

SEQ ID NO: 452075 - RNA, 22 nt, Human
ccagccuuacugcccuucagug

SEQ ID NO: 452076 - RNA, 22 nt, Human
ggcucaguguuuguggaacaua

SEQ ID NO: 452077 - RNA, 23 nt, Human
uccugcagauaagcugguugaca

SEQ ID NO: 452078 - RNA, 22 nt, Human
aggcagcagacuguuaaucaga

SEQ ID NO: 452079 - RNA, 17 nt, Human
gcuggcugacccaugcc

SEQ ID NO: 452080 - RNA, 22 nt, Human
aucaguuuggaacauucaggcc

SEQ ID NO: 452081 - RNA, 22 nt, Human
aaggcacuugcccagagcugca

SEQ ID NO: 452082 - RNA, 22 nt, Human
ucuccucuauuucuguauguau

SEQ ID NO: 452083 - RNA, 23 nt, Human
cccagcagagaugaggagggguc

SEQ ID NO: 452084 - RNA, 22 nt, Human
ucucuggaauuuugagagugac

SEQ ID NO: 452085 - RNA, 22 nt, Human
ggagauagacuuggugagccac

SEQ ID NO: 452086 - RNA, 22 nt, Human
uauauagaaaagcagauguugg

SEQ ID NO: 452087 - RNA, 22 nt, Human
ccaagaugaucuuuacaguguu

SEQ ID NO: 452088 - RNA, 22 nt, Human
cuuccccaaccccgacugugug

SEQ ID NO: 452089 - RNA, 22 nt, Human
cacccaggacaggccagaugug

SEQ ID NO: 452090 - RNA, 17 nt, Human
uucaaugauuaaugcau

SEQ ID NO: 452091 - RNA, 22 nt, Human
uggaagcacuuggguuuuguug

SEQ ID NO: 452092 - RNA, 22 nt, Human
gccaggcuguggggaacuugaa

SEQ ID NO: 452093 - RNA, 22 nt, Human
cuacuuuaauuuucugcagaga

SEQ ID NO: 452094 - RNA, 22 nt, Human
agaccauagggaccucagguug

SEQ ID NO: 452095 - RNA, 22 nt, Human
gccuggcccagggcuccgcagg

SEQ ID NO: 452096 - RNA, 22 nt, Human
uugcugaaaucuaugacauccu

SEQ ID NO: 452097 - RNA, 22 nt, Human
cugagagucagcuucuccuccu

SEQ ID NO: 452098 - RNA, 22 nt, Human
ugauuuccuggcuuuggaguuc

SEQ ID NO: 452099 - RNA, 22 nt, Human
aggcucaggaggagcugccgga

SEQ ID NO: 452100 - RNA, 22 nt, Human
gggauggcucaaaggagucagg

SEQ ID NO: 452101 - RNA, 22 nt, Human
cuuguacauagagaagaagccu

SEQ ID NO: 452102 - RNA, 22 nt, Human
gagaaggcugauccuuggaguu

SEQ ID NO: 452103 - RNA, 22 nt, Human
gagagcuguaauagucaugucu

SEQ ID NO: 452104 - RNA, 22 nt, Human
uguccucacaggaaugaacuuu

SEQ ID NO: 452105 - RNA, 22 nt, Human
gccagggagucugggccacaga

SEQ ID NO: 452106 - RNA, 22 nt, Human
uccaucuguuuacuauaaagau

SEQ ID NO: 452107 - RNA, 22 nt, Human
ucccaagugucuuggaccaggg

SEQ ID NO: 452108 - RNA, 22 nt, Human
uacuuuagaaggaaauaaguuc

SEQ ID NO: 452109 - RNA, 22 nt, Human
auuccaaagacagaagcagcug

SEQ ID NO: 452110 - RNA, 22 nt, Human
ccugccuguacuagagacccag

SEQ ID NO: 452111 - RNA, 21 nt, Human
guuauuuuaagugagcuuugc

SEQ ID NO: 452112 - RNA, 22 nt, Human
aggcugggaaauguauuccagc

SEQ ID NO: 452113 - RNA, 18 nt, Human
ucugagggugcgggagcu

SEQ ID NO: 452114 - RNA, 22 nt, Human
ccacugcccaccccgacgucua

SEQ ID NO: 452115 - RNA, 22 nt, Human
agccccacacucucucugagaa

SEQ ID NO: 452116 - RNA, 22 nt, Human
guggaggguuugcaaugugcag

SEQ ID NO: 452117 - RNA, 22 nt, Human
gugucaugggguuuguuauaca

SEQ ID NO: 452118 - RNA, 22 nt, Human
acagaccaaguuuccagcaggu

SEQ ID NO: 452119 - RNA, 22 nt, Human
aacauugcagcuuaauugcagg

SEQ ID NO: 452120 - RNA, 22 nt, Human
uacuguacauuccguuuguugc

SEQ ID NO: 452121 - RNA, 22 nt, Human
ucacuuauaaaaugcaagaucu

SEQ ID NO: 452122 - RNA, 22 nt, Human
gccacaugcaauugcagcacgu

SEQ ID NO: 452123 - RNA, 22 nt, Human
aguuauucauuuauucuguaca

SEQ ID NO: 452124 - RNA, 22 nt, Human
gccugcagggcccuuguggguc

SEQ ID NO: 452125 - RNA, 22 nt, Human
uaaggcacccuucugaguagag

SEQ ID NO: 452126 - RNA, 22 nt, Human
ugaggccugcauugaacuagaa

SEQ ID NO: 452127 - RNA, 22 nt, Human
uuccauuguuucugucuucacu

SEQ ID NO: 452128 - RNA, 22 nt, Human
ucuuugcaacucccauuuccau

SEQ ID NO: 452129 - RNA, 22 nt, Human
ggggaaggauugaguugaccca

SEQ ID NO: 452130 - RNA, 22 nt, Human
ccucaggaaccacauugcugcu

SEQ ID NO: 452131 - RNA, 22 nt, Human
ucagcuggagaugagaaccgaa

SEQ ID NO: 452132 - RNA, 22 nt, Human
agugaaauuuguuuagauaggu

SEQ ID NO: 452133 - RNA, 22 nt, Human
gggcaggugcccagggccagag

SEQ ID NO: 452134 - RNA, 22 nt, Human
uacaugcucaguaacuuucagu

SEQ ID NO: 452135 - RNA, 22 nt, Human
aggggcuggcuuaucugagagu

SEQ ID NO: 452136 - RNA, 22 nt, Human
auguaucaacaaauuguacagu

SEQ ID NO: 452137 - RNA, 22 nt, Human
auguuucagauacagaucaaau

SEQ ID NO: 452138 - RNA, 22 nt, Human
agcagguguagggcucuuugua

SEQ ID NO: 452139 - RNA, 22 nt, Human
uccagggcuggguuggcucagc

SEQ ID NO: 452140 - RNA, 22 nt, Human
gccugccuguuggcugaggugc

SEQ ID NO: 452141 - RNA, 22 nt, Human
uggcagggugggcuucagcccc

SEQ ID NO: 452142 - RNA, 22 nt, Human
cagagcugugauaaauagauau

SEQ ID NO: 452143 - RNA, 22 nt, Human
ggugaaggucagagcaggaaaa

SEQ ID NO: 452144 - RNA, 21 nt, Human
gcucccugcucagcuccuggg

SEQ ID NO: 452145 - RNA, 22 nt, Human
gugucaugcacacucaguguug

SEQ ID NO: 452146 - RNA, 22 nt, Human
ucugcagaaguggcugggccac

SEQ ID NO: 452147 - RNA, 22 nt, Human
ccccuuccaggaagcagaaucg

SEQ ID NO: 452148 - RNA, 22 nt, Human
guuauguaucuugauugggugg

SEQ ID NO: 452149 - RNA, 22 nt, Human
cuccucuggcuuccuggaggca

SEQ ID NO: 452150 - RNA, 22 nt, Human
cagggacauugguggccagguu

SEQ ID NO: 452151 - RNA, 22 nt, Human
uuaaaaugcagauucugauuca

SEQ ID NO: 452152 - RNA, 21 nt, Human
cagagcuguccaaacccugac

SEQ ID NO: 452153 - RNA, 22 nt, Human
aguuuuuccguggcuacgauaa

SEQ ID NO: 452154 - RNA, 22 nt, Human
ccugagggaaggaugcuaccca

SEQ ID NO: 452155 - RNA, 22 nt, Human
acagccuguguaccagcuggga

SEQ ID NO: 452156 - RNA, 22 nt, Human
ugcuuuauucgacaucugguag

SEQ ID NO: 452157 - RNA, 22 nt, Human
ucucuggggauggaccugggag

SEQ ID NO: 452158 - RNA, 22 nt, Human
agagccaggaugucuucugggg

SEQ ID NO: 452159 - RNA, 22 nt, Human
ccucagagccuccagaaggaau

SEQ ID NO: 452160 - RNA, 22 nt, Human
ggcagcuccucaaaaaauuaaa

SEQ ID NO: 452161 - RNA, 22 nt, Human
ucaaggugcugugcugugcuag

SEQ ID NO: 452162 - RNA, 20 nt, Human
acugcuucuuucucugaccu

SEQ ID NO: 452163 - RNA, 22 nt, Human
acagguccuuauaagagcacuc

SEQ ID NO: 452164 - RNA, 22 nt, Human
gcuggcuguaucaccuggccag

SEQ ID NO: 452165 - RNA, 22 nt, Human
cuguccagucuuuagcaagcug

SEQ ID NO: 452166 - RNA, 22 nt, Human
agggcaugaagcaguggacagc

SEQ ID NO: 452167 - RNA, 23 nt, Human
gggcuccagucucugcucaguug

SEQ ID NO: 452168 - RNA, 19 nt, Human
cagaaauagcgaaguguaa

SEQ ID NO: 452169 - RNA, 22 nt, Human
gcagcuggcccugacacgcaga

SEQ ID NO: 452170 - RNA, 22 nt, Human
uggcucaguaaucgagucuccu

SEQ ID NO: 452171 - RNA, 16 nt, Human
gcagaggaaaggggag

SEQ ID NO: 452172 - RNA, 22 nt, Human
uaaccauauuuuccauuaaguu

SEQ ID NO: 452173 - RNA, 22 nt, Human
aacauuucuucugaaacugagu

SEQ ID NO: 452174 - RNA, 22 nt, Human
agcaggaacucagggaguucuc

SEQ ID NO: 452175 - RNA, 22 nt, Human
ugcucacagcccagaacauaau

SEQ ID NO: 452176 - RNA, 22 nt, Human
acagggucaagggugcuacaag

SEQ ID NO: 452177 - RNA, 22 nt, Human
aguggcagagcaggugcuggaa

SEQ ID NO: 452178 - RNA, 22 nt, Human
uaauuucuggagggagaaagag

SEQ ID NO: 452179 - RNA, 22 nt, Human
cagccagccucucaaccaugca

SEQ ID NO: 452180 - RNA, 22 nt, Human
caaaauucugcauuucuaauaa

SEQ ID NO: 452181 - RNA, 21 nt, Human
cccugcaggccagggcugagc

SEQ ID NO: 452182 - RNA, 22 nt, Human
cuguucucuggcgguggcuguu

SEQ ID NO: 452183 - RNA, 22 nt, Human
agggucagguuaagggagucau

SEQ ID NO: 452184 - RNA, 19 nt, Human
agaaaucucgagauuuguu

SEQ ID NO: 452185 - RNA, 22 nt, Human
uuugaaagucaaccuuccaguu

SEQ ID NO: 452186 - RNA, 21 nt, Human
agacagaacaacugcucucca

SEQ ID NO: 452187 - RNA, 22 nt, Human
uucauuacugcgguagucacac

SEQ ID NO: 452188 - RNA, 20 nt, Human
ccucucugaagaggucaucu

SEQ ID NO: 452189 - RNA, 22 nt, Human
uugcauugaugucuauacgcug

SEQ ID NO: 452190 - RNA, 22 nt, Human
gcccucucggcauagcaggggc

SEQ ID NO: 452191 - RNA, 22 nt, Human
agugaaauaugcccauugcugu

SEQ ID NO: 452192 - RNA, 23 nt, Human
ucugucaccuauggcugcucuuc

SEQ ID NO: 452193 - RNA, 22 nt, Human
gccugccuuuuggaggcacauu

SEQ ID NO: 452194 - RNA, 19 nt, Human
guggccagggcaggggcug

SEQ ID NO: 452195 - RNA, 23 nt, Human
uggcugagguccagguaguuuca

SEQ ID NO: 452196 - RNA, 22 nt, Human
ugcauuauaacugaauguuguu

SEQ ID NO: 452197 - RNA, 22 nt, Human
caagagcugugaccucauucac

SEQ ID NO: 452198 - RNA, 22 nt, Human
cccaggcacaccccgaacggaa

SEQ ID NO: 452199 - RNA, 22 nt, Human
caggaugagaggcccagggaag

SEQ ID NO: 452200 - RNA, 22 nt, Human
caaggagauaaaauguugagcu

SEQ ID NO: 452201 - RNA, 22 nt, Human
augugaggcagcacggagauua

SEQ ID NO: 452202 - RNA, 22 nt, Human
caaagguauaaguuaauauaca

SEQ ID NO: 452203 - RNA, 22 nt, Human
uggcucagagcagggacucugg

SEQ ID NO: 452204 - RNA, 22 nt, Human
guuagaaagugucugcuugggu

SEQ ID NO: 452205 - RNA, 22 nt, Human
agcccagaggcugggcgugcau

SEQ ID NO: 452206 - RNA, 22 nt, Human
aggagagaauguuccaggcuug

SEQ ID NO: 452207 - RNA, 22 nt, Human
gcagcagcccagggcucucaga

SEQ ID NO: 452208 - RNA, 22 nt, Human
ggcuccuguccccucagcugcu

SEQ ID NO: 452209 - RNA, 22 nt, Human
ugaaagguuaaaaguaguauug

SEQ ID NO: 452210 - RNA, 22 nt, Human
gcagggcagggcaagaacuggg

SEQ ID NO: 452211 - RNA, 22 nt, Human
uggcagagaugaagaguuguuu

SEQ ID NO: 452212 - RNA, 22 nt, Human
cagggugccaaagaacaaauau

SEQ ID NO: 452213 - RNA, 22 nt, Human
uuccaaagucauguugcugaua

SEQ ID NO: 452214 - RNA, 22 nt, Human
ccugccaggccagugagcuucc

SEQ ID NO: 452215 - RNA, 22 nt, Human
ggcagaggugaaguucacaagg

SEQ ID NO: 452216 - RNA, 19 nt, Human
gaaggcugaaaugaagcac

SEQ ID NO: 452217 - RNA, 22 nt, Human
ucugucacuuuuauuuacugaa

SEQ ID NO: 452218 - RNA, 22 nt, Human
cugaaggagguagagugacaua

SEQ ID NO: 452219 - RNA, 20 nt, Human
ucagagagagggugccacuu

SEQ ID NO: 452220 - RNA, 22 nt, Human
agccaggaagaaggucacacca

SEQ ID NO: 452221 - RNA, 22 nt, Human
agcugccuguccuaggccauca

SEQ ID NO: 452222 - RNA, 20 nt, Human
ugccaugguaacagagugug

SEQ ID NO: 452223 - RNA, 22 nt, Human
gucuuuauuugagauugucauu

SEQ ID NO: 452224 - RNA, 22 nt, Human
gaaggccugugguagugagacg

SEQ ID NO: 452225 - RNA, 22 nt, Human
ccugggcagguguggcuucccc

SEQ ID NO: 452226 - RNA, 22 nt, Human
gugugcagggggccagcgcagc

SEQ ID NO: 452227 - RNA, 22 nt, Human
gcagggccuuagcagcggcugc

SEQ ID NO: 452228 - RNA, 22 nt, Human
caaggccauaagagauacaaaa

SEQ ID NO: 452229 - RNA, 21 nt, Human
aagccucaagcagaagacaga

SEQ ID NO: 452230 - RNA, 19 nt, Human
guggccugcgcugggugcg

SEQ ID NO: 452231 - RNA, 23 nt, Human
cacacccaucacuaagagcuccu

SEQ ID NO: 452232 - RNA, 22 nt, Human
agcugcuacugcucugccagag

SEQ ID NO: 452233 - RNA, 23 nt, Human
uggcucugagcuuccugguggcc

SEQ ID NO: 452234 - RNA, 22 nt, Human
aaagcagcagcacguggaagag

SEQ ID NO: 452235 - RNA, 22 nt, Human
uuaaaguucauuaaaugagcca

SEQ ID NO: 452236 - RNA, 22 nt, Human
ugggcuccaauuuguccuuuca

SEQ ID NO: 452237 - RNA, 23 nt, Human
cagggccaggcagcagcugucac

SEQ ID NO: 452238 - RNA, 22 nt, Human
auaauaaaccaggaugggucug

SEQ ID NO: 452239 - RNA, 22 nt, Human
gagauuggccuggcuugccaac

SEQ ID NO: 452240 - RNA, 22 nt, Human
gagcaggcauucuaguggcuga

SEQ ID NO: 452241 - RNA, 22 nt, Human
cuggcucauccagguguugcuc

SEQ ID NO: 452242 - RNA, 22 nt, Human
ucagcuuucuauguugcuaaac

SEQ ID NO: 452243 - RNA, 22 nt, Human
cagcauggugccagugagucca

SEQ ID NO: 452244 - RNA, 22 nt, Human
uggcugagaccaucagggugua

SEQ ID NO: 452245 - RNA, 22 nt, Human
cuccauugaacauccucucaga

SEQ ID NO: 452246 - RNA, 22 nt, Human
acugccaggauggcacuagagg

SEQ ID NO: 452247 - RNA, 22 nt, Human
cugcucuggggaagccagaugu

SEQ ID NO: 452248 - RNA, 22 nt, Human
uggccugcagcucucagggaag

SEQ ID NO: 452249 - RNA, 22 nt, Human
uuuccucugucaugacagcuga

SEQ ID NO: 452250 - RNA, 22 nt, Human
ggccagaaaguuaagcuguggc

SEQ ID NO: 452251 - RNA, 22 nt, Human
ucucuguacaguacaugccgug

SEQ ID NO: 452252 - RNA, 23 nt, Human
ggguccagagacaggcaugggug

SEQ ID NO: 452253 - RNA, 22 nt, Human
aggcugagcugguagugaguac

SEQ ID NO: 452254 - RNA, 22 nt, Human
uuagucuucuuccuuauauguu

SEQ ID NO: 452255 - RNA, 22 nt, Human
gcagaggcaaucagguaugugg

SEQ ID NO: 452256 - RNA, 22 nt, Human
gucaggcugccagucuuuauug

SEQ ID NO: 452257 - RNA, 22 nt, Human
gugcuuccugccuggugccuuu

SEQ ID NO: 452258 - RNA, 18 nt, Human
ucaagacaucaugaaaua

SEQ ID NO: 452259 - RNA, 22 nt, Human
aacuguaagacaaaugacuucu

SEQ ID NO: 452260 - RNA, 22 nt, Human
gccaggcuggaaagaacagaca

SEQ ID NO: 452261 - RNA, 22 nt, Human
ucugccuuuucacugccacuaa

SEQ ID NO: 452262 - RNA, 22 nt, Human
gucaaacaaauuaacauaucca

SEQ ID NO: 452263 - RNA, 22 nt, Human
ccagagcccgggaccuggacuu

SEQ ID NO: 452264 - RNA, 22 nt, Human
uaaggccaauuaacaaccaggg

SEQ ID NO: 452265 - RNA, 22 nt, Human
agaggucagaacaggaaagugu

SEQ ID NO: 452266 - RNA, 22 nt, Human
gggcaguggcucacgccuguaa

SEQ ID NO: 452267 - RNA, 22 nt, Human
aaaagagguuaaccaggugugu

SEQ ID NO: 452268 - RNA, 22 nt, Human
uccaugucuucaugugucuaac

SEQ ID NO: 452269 - RNA, 22 nt, Human
aaugaucuggcucaggauauca

SEQ ID NO: 452270 - RNA, 18 nt, Human
uguacaguuaugagcauu

SEQ ID NO: 452271 - RNA, 22 nt, Human
ggcagcaguggcugcuauuguc

SEQ ID NO: 452272 - RNA, 22 nt, Human
caaaagauacuugcaucuaacu

SEQ ID NO: 452273 - RNA, 22 nt, Human
uccuucaguucaauuaguccgu

SEQ ID NO: 452274 - RNA, 22 nt, Human
ccagcccugaacccugcugcau

SEQ ID NO: 452275 - RNA, 22 nt, Human
acuuccuguuaugugugccucu

SEQ ID NO: 452276 - RNA, 22 nt, Human
cccaggucugugccagcucuga

SEQ ID NO: 452277 - RNA, 22 nt, Human
agguaacacuacuuaguauacu

SEQ ID NO: 452278 - RNA, 18 nt, Human
gcagagugcgucucugug

SEQ ID NO: 452279 - RNA, 23 nt, Human
uucaagauacgguuuccaggcug

SEQ ID NO: 452280 - RNA, 23 nt, Human
ucuccagugucucuucauugagu

SEQ ID NO: 452281 - RNA, 20 nt, Human
agugacagagacuguguggc

SEQ ID NO: 452282 - RNA, 22 nt, Human
gcagccacugggagugcuuaua

SEQ ID NO: 452283 - RNA, 22 nt, Human
ugaaaucuacccuauucagggu

SEQ ID NO: 452284 - RNA, 22 nt, Human
augaguucaauuguuucaguca

SEQ ID NO: 452285 - RNA, 22 nt, Human
auuaaauuagcaaacugugaaa

SEQ ID NO: 452286 - RNA, 22 nt, Human
uaugcacacaucgcagcaggaa

SEQ ID NO: 452287 - RNA, 22 nt, Human
aaauccuaaggagaauaugauu

SEQ ID NO: 452288 - RNA, 22 nt, Human
cagagcugauuggauccagaga

SEQ ID NO: 452289 - RNA, 22 nt, Human
agggcagcaaugcagcugcugc

SEQ ID NO: 452290 - RNA, 22 nt, Human
ccaggugguucaggucaccaua

SEQ ID NO: 452291 - RNA, 22 nt, Human
aaguguuuacuuaaagucaugg

SEQ ID NO: 452292 - RNA, 19 nt, Human
aucagcaagguaggaugug

SEQ ID NO: 452293 - RNA, 22 nt, Human
uuaauuuuuauguauagugugu

SEQ ID NO: 452294 - RNA, 22 nt, Human
uccaggcaggguuaaggguccu

SEQ ID NO: 452295 - RNA, 22 nt, Human
gaggggcagagguagagaacaa

SEQ ID NO: 452296 - RNA, 22 nt, Human
gccuguguggaugcgccggugc

SEQ ID NO: 452297 - RNA, 22 nt, Human
accugagaccuaaucugacugu

SEQ ID NO: 452298 - RNA, 22 nt, Human
agcagagguguuuauuauggga

SEQ ID NO: 452299 - RNA, 22 nt, Human
aguggcagggcuggcugcugca

SEQ ID NO: 452300 - RNA, 22 nt, Human
auuguaucuugucauuaugcau

SEQ ID NO: 452301 - RNA, 22 nt, Human
aauguacaaaccuucuuuguag

SEQ ID NO: 452302 - RNA, 22 nt, Human
aggcugagcggggucccagagc

SEQ ID NO: 452303 - RNA, 22 nt, Human
auauucguggucaaguaaggcc

SEQ ID NO: 452304 - RNA, 22 nt, Human
uccuuccuggggucucugcugc

SEQ ID NO: 452305 - RNA, 22 nt, Human
ggccaggcgaugaccccuccac

SEQ ID NO: 452306 - RNA, 22 nt, Human
agaacagaggccuuauguuuca

SEQ ID NO: 452307 - RNA, 22 nt, Human
uauugaguuacagaaaauacuu

SEQ ID NO: 452308 - RNA, 22 nt, Human
ggaggaguguggggcacucugc

SEQ ID NO: 452309 - RNA, 22 nt, Human
uaaaggcuuuuacaggagugca

SEQ ID NO: 452310 - RNA, 22 nt, Human
aaauggauggaauugacauuua

SEQ ID NO: 452311 - RNA, 22 nt, Human
ugaaggagggaagaaggcucug

SEQ ID NO: 452312 - RNA, 22 nt, Human
caguguuuguauagaauaugca

SEQ ID NO: 452313 - RNA, 22 nt, Human
gcuggccaguguggugaccacc

SEQ ID NO: 452314 - RNA, 22 nt, Human
gggugggagucuggcccucaaa

SEQ ID NO: 452315 - RNA, 22 nt, Human
ccuggagcacucucccuggcug

SEQ ID NO: 452316 - RNA, 22 nt, Human
acuuuugguucuguaacuguga

SEQ ID NO: 452317 - RNA, 22 nt, Human
ugucagcagcugguuugcuguu

SEQ ID NO: 452318 - RNA, 22 nt, Human
uugugugguagcuucauugaac

SEQ ID NO: 452319 - RNA, 22 nt, Human
uuucacauaaauauuaugccua

SEQ ID NO: 452320 - RNA, 22 nt, Human
ccucagccuuggccccaggcag

SEQ ID NO: 452321 - RNA, 22 nt, Human
uggcuugucauguaucugaggc

SEQ ID NO: 452322 - RNA, 22 nt, Human
uaguuacagcaggcaggauaua

SEQ ID NO: 452323 - RNA, 22 nt, Human
cugggaggauacacaagaucag

SEQ ID NO: 452324 - RNA, 21 nt, Human
uguaugcacgcacaugcacac

SEQ ID NO: 452325 - RNA, 22 nt, Human
gagcugucuggggacucugggu

SEQ ID NO: 452326 - RNA, 22 nt, Human
caggaggcagaggaugcccagu

SEQ ID NO: 452327 - RNA, 22 nt, Human
ccaggagguggagauugcagug

SEQ ID NO: 452328 - RNA, 22 nt, Human
ugcacacaguucucaggaaaga

SEQ ID NO: 452329 - RNA, 22 nt, Human
aucccaugagaccacguuggcu

SEQ ID NO: 452330 - RNA, 22 nt, Human
gagucacaaagccuuucuuauu

SEQ ID NO: 452331 - RNA, 22 nt, Human
cugccagcucaaagcgcagcua

SEQ ID NO: 452332 - RNA, 21 nt, Human
cagugcucaaucugacagugg

SEQ ID NO: 452333 - RNA, 22 nt, Human
guggagcaaucagagggucagu

SEQ ID NO: 452334 - RNA, 22 nt, Human
ccagucacuggaaaaugggaau

SEQ ID NO: 452335 - RNA, 22 nt, Human
gaggccugcuuuggcacucugg

SEQ ID NO: 452336 - RNA, 22 nt, Human
gccaggcauuuguuaggugcug

SEQ ID NO: 452337 - RNA, 22 nt, Human
gcucaagggaugggagugggug

SEQ ID NO: 452338 - RNA, 22 nt, Human
cucuggcuuugcucaugcaucc

SEQ ID NO: 452339 - RNA, 22 nt, Human
ggggcagagucuggacuguugu

SEQ ID NO: 452340 - RNA, 22 nt, Human
uggcgugcccuccagacuuggc

SEQ ID NO: 452341 - RNA, 22 nt, Human
gucugcugcagagcauggcuuu

SEQ ID NO: 452342 - RNA, 22 nt, Human
uccuaguucucugccagucgcu

SEQ ID NO: 452343 - RNA, 22 nt, Human
ggcccaucucuugcucuggguu

SEQ ID NO: 452344 - RNA, 22 nt, Human
accagagcgcucaagccuuccc

SEQ ID NO: 452345 - RNA, 22 nt, Human
gugaccaucagagaauaacaaa

SEQ ID NO: 452346 - RNA, 22 nt, Human
cugggcuccuaaccauccaggu

SEQ ID NO: 452347 - RNA, 22 nt, Human
uuucuaguccucaugcaucauu

SEQ ID NO: 452348 - RNA, 22 nt, Human
gggcuggcaucaguugccgaga

SEQ ID NO: 452349 - RNA, 22 nt, Human
ccuggaaggugaugguacagca

SEQ ID NO: 452350 - RNA, 22 nt, Human
cuggcugcaggaaggagugggc

SEQ ID NO: 452351 - RNA, 22 nt, Human
gcugcaggcauuuuccugggca

SEQ ID NO: 452352 - RNA, 22 nt, Human
uccagaccaugugagaggcgca

SEQ ID NO: 452353 - RNA, 22 nt, Human
ugcagggcacggugcgcguggg

SEQ ID NO: 452354 - RNA, 22 nt, Human
ucccagggacugggcuaggcuu

SEQ ID NO: 452355 - RNA, 22 nt, Human
gggccagguggaccccagccuc

SEQ ID NO: 452356 - RNA, 22 nt, Human
cuauuuuaacuugauuaccucu

SEQ ID NO: 452357 - RNA, 22 nt, Human
uugacaaaaaccucauuucacc

SEQ ID NO: 452358 - RNA, 22 nt, Human
auugucuuuggugcuuccagga

SEQ ID NO: 452359 - RNA, 22 nt, Human
aagcagaauuucccacuaguug

SEQ ID NO: 452360 - RNA, 18 nt, Human
cugucaccgccaccacac

SEQ ID NO: 452361 - RNA, 23 nt, Human
guggccuccccggaaugccucgc

SEQ ID NO: 452362 - RNA, 22 nt, Human
uuuucacacaaggugauaaguu

SEQ ID NO: 452363 - RNA, 19 nt, Human
gcugcucugggucucaucu

SEQ ID NO: 452364 - RNA, 22 nt, Human
caggagacaaguuagcagcuga

SEQ ID NO: 452365 - RNA, 22 nt, Human
agagcagccugugaugaugcac

SEQ ID NO: 452366 - RNA, 22 nt, Human
aaugcuuugacuauaucuauaa

SEQ ID NO: 452367 - RNA, 22 nt, Human
aaaggaagaugccaggacucug

SEQ ID NO: 452368 - RNA, 22 nt, Human
aaagcaaucagauucagauguc

SEQ ID NO: 452369 - RNA, 22 nt, Human
ggugggcacauucagucucugu

SEQ ID NO: 452370 - RNA, 22 nt, Human
aaggagucugggccauucagag

SEQ ID NO: 452371 - RNA, 22 nt, Human
guucucucugcuuccaagaugg

SEQ ID NO: 452372 - RNA, 22 nt, Human
acaaaguuugugguauuccaag

SEQ ID NO: 452373 - RNA, 22 nt, Human
cccagcagaaucugaugagggc

SEQ ID NO: 452374 - RNA, 22 nt, Human
guacaugucaaaaaaugcauaa

SEQ ID NO: 452375 - RNA, 22 nt, Human
uggacucagugcugccauuccc

SEQ ID NO: 452376 - RNA, 22 nt, Human
agggcagcagcggcccaggccu

SEQ ID NO: 452377 - RNA, 22 nt, Human
caguauguacucuuaucaugua

SEQ ID NO: 452378 - RNA, 22 nt, Human
gagagcugauagaugagcuacu

SEQ ID NO: 452379 - RNA, 20 nt, Human
uccaagcccuccuuccauuc

SEQ ID NO: 452380 - RNA, 22 nt, Human
agcuuccugaugcaagagggcu

SEQ ID NO: 452381 - RNA, 22 nt, Human
gccugaagaacagcugugagga

SEQ ID NO: 452382 - RNA, 22 nt, Human
cacaggcuccggccuugcagcc

SEQ ID NO: 452383 - RNA, 22 nt, Human
agggaggcaggaaaguugucug

SEQ ID NO: 452384 - RNA, 22 nt, Human
cagacaggcuagccagacucac

SEQ ID NO: 452385 - RNA, 22 nt, Human
ggccaggagcaagccaggcucu

SEQ ID NO: 452386 - RNA, 19 nt, Human
auaaggcaggaggaaauuu

SEQ ID NO: 452387 - RNA, 22 nt, Human
aggccucaggaagguaaagaag

SEQ ID NO: 452388 - RNA, 22 nt, Human
gugcccugaguggguaggagag

SEQ ID NO: 452389 - RNA, 22 nt, Human
ggcugucucugugacugccacc

SEQ ID NO: 452390 - RNA, 22 nt, Human
uugucugucccagcuugugcau

SEQ ID NO: 452391 - RNA, 21 nt, Human
uggcccuggccacggcugcca

SEQ ID NO: 452392 - RNA, 22 nt, Human
auauguguacgugcaguauaua

SEQ ID NO: 452393 - RNA, 22 nt, Human
gaaaggcaguacagcugagccu

SEQ ID NO: 452394 - RNA, 22 nt, Human
cugagaggcacaaggcauuucg

SEQ ID NO: 452395 - RNA, 22 nt, Human
ucaaaaguuucacauagagaua

SEQ ID NO: 452396 - RNA, 22 nt, Human
aagcuuuagagaugaguuccuu

SEQ ID NO: 452397 - RNA, 22 nt, Human
agcuuccucaccucagaggucu

SEQ ID NO: 452398 - RNA, 22 nt, Human
ugugugcauucacaugcaugcc

SEQ ID NO: 452399 - RNA, 22 nt, Human
aagauucuacaguagguacauu

SEQ ID NO: 452400 - RNA, 22 nt, Human
ccagcagcgauagggugagugc

SEQ ID NO: 452401 - RNA, 22 nt, Human
gaagggugugugugagggacac

SEQ ID NO: 452402 - RNA, 22 nt, Human
uggccgggccgggcgccuccac

SEQ ID NO: 452403 - RNA, 22 nt, Human
uuaugcaacaggugagcagaca

SEQ ID NO: 452404 - RNA, 22 nt, Human
guucauauuacuuugagugcag

SEQ ID NO: 452405 - RNA, 22 nt, Human
uucaauucuaaacuaauauucu

SEQ ID NO: 452406 - RNA, 22 nt, Human
gcugcagcccggcgcgccugag

SEQ ID NO: 452407 - RNA, 22 nt, Human
aaaaucaguacacuuuauuuug

SEQ ID NO: 452408 - RNA, 22 nt, Human
cagaggcauacucccagucuug

SEQ ID NO: 452409 - RNA, 22 nt, Human
cugugcuuccaggauggcagcu

SEQ ID NO: 452410 - RNA, 22 nt, Human
ggaggagcacuucugagcucag

SEQ ID NO: 452411 - RNA, 22 nt, Human
cauuuguacagaacagcuuuau

SEQ ID NO: 452412 - RNA, 22 nt, Human
aagcacuuagaagagugccugc

SEQ ID NO: 452413 - RNA, 22 nt, Human
cugguuccaggauggaucuuuc

SEQ ID NO: 452414 - RNA, 20 nt, Human
uccugagauuuaagggguuc

SEQ ID NO: 452415 - RNA, 22 nt, Human
ggcuggccuguguggccgccac

SEQ ID NO: 452416 - RNA, 22 nt, Human
cuuguggcccauggcuuccugc

SEQ ID NO: 452417 - RNA, 22 nt, Human
gaguccaguuguucacagaggc

SEQ ID NO: 452418 - RNA, 22 nt, Human
agggcagcauugccuuucucca

SEQ ID NO: 452419 - RNA, 22 nt, Human
guuauauauaguauuucucuga

SEQ ID NO: 452420 - RNA, 22 nt, Human
uggcuggggagccccgacuccc

SEQ ID NO: 452421 - RNA, 22 nt, Human
ucagcaguggcucucaugcagu

SEQ ID NO: 452422 - RNA, 22 nt, Human
uauuuugucuucugcucaucac

SEQ ID NO: 452423 - RNA, 22 nt, Human
cauaagaaauaaugaugaugac

SEQ ID NO: 452424 - RNA, 22 nt, Human
caggaccuggaaugcuugugaa

SEQ ID NO: 452425 - RNA, 22 nt, Human
ccacaggggucucuguagcuga

SEQ ID NO: 452426 - RNA, 22 nt, Human
agaagccauagucugggaggca

SEQ ID NO: 452427 - RNA, 22 nt, Human
ggugccagccuagugcaguggu

SEQ ID NO: 452428 - RNA, 22 nt, Human
gcucugcuguguuuguucagca

SEQ ID NO: 452429 - RNA, 22 nt, Human
ggccugccucacagucagcacc

SEQ ID NO: 452430 - RNA, 19 nt, Human
aggugcaggucacagggga

SEQ ID NO: 452431 - RNA, 22 nt, Human
uuuccucuuuguaccuugacua

SEQ ID NO: 452432 - RNA, 22 nt, Human
agaggcagccguauuucaaagg

SEQ ID NO: 452433 - RNA, 22 nt, Human
cauuuguaucauauguaucuua

SEQ ID NO: 452434 - RNA, 22 nt, Human
gcagcuuuaaacauuggaaaua

SEQ ID NO: 452435 - RNA, 20 nt, Human
cacguuuuuccacuagcaaa

SEQ ID NO: 452436 - RNA, 22 nt, Human
uugaaagaggcaaaguuugauc

SEQ ID NO: 452437 - RNA, 22 nt, Human
ggcugccacgucgaggguccaa

SEQ ID NO: 452438 - RNA, 22 nt, Human
uaggcuggaggaagcagugccu

SEQ ID NO: 452439 - RNA, 18 nt, Human
acccucuggcuucugagc

SEQ ID NO: 452440 - RNA, 22 nt, Human
aaucaguuaggguguuaaugag

SEQ ID NO: 452441 - RNA, 22 nt, Human
aggcaauccccugaggauacuu

SEQ ID NO: 452442 - RNA, 22 nt, Human
cuggccuggcaggggaccucua

SEQ ID NO: 452443 - RNA, 19 nt, Human
gcaggcacagcccugggug

SEQ ID NO: 452444 - RNA, 19 nt, Human
aucugccuuagugcugcug

SEQ ID NO: 452445 - RNA, 22 nt, Human
cuguaugaggaucagacuggac

SEQ ID NO: 452446 - RNA, 22 nt, Human
caggguggcaggcaccauggcc

SEQ ID NO: 452447 - RNA, 22 nt, Human
ccugggaggcuguuuccagccu

SEQ ID NO: 452448 - RNA, 22 nt, Human
cugccaggacugacgucuucag

SEQ ID NO: 452449 - RNA, 22 nt, Human
cccagcauccucagggagcggg

SEQ ID NO: 452450 - RNA, 22 nt, Human
ucaaggagcccacagucuaaug

SEQ ID NO: 452451 - RNA, 20 nt, Human
ucucaggguucagcaaagua

SEQ ID NO: 452452 - RNA, 22 nt, Human
aacagcuuugcuucuggagaca

SEQ ID NO: 452453 - RNA, 22 nt, Human
uugcauaaaugcuuaaaauuug

SEQ ID NO: 452454 - RNA, 20 nt, Human
gcuuuuucuaauagcagucc

SEQ ID NO: 452455 - RNA, 22 nt, Human
gcugccuugaacuuggccuggg

SEQ ID NO: 452456 - RNA, 23 nt, Human
cagugugacgaggugaggcaggc

SEQ ID NO: 452457 - RNA, 22 nt, Human
acaggcugcugagccauuugcu

SEQ ID NO: 452458 - RNA, 21 nt, Human
ucacuuauaauguauuugcug

SEQ ID NO: 452459 - RNA, 22 nt, Human
agugacucacuagcucucagug

SEQ ID NO: 452460 - RNA, 22 nt, Human
uggcagaaguucacuaguagcu

SEQ ID NO: 452461 - RNA, 22 nt, Human
uagggcuauaagagaauaagac

SEQ ID NO: 452462 - RNA, 22 nt, Human
aaggcauaugcuguguacaguu

SEQ ID NO: 452463 - RNA, 22 nt, Human
gggagcuguaguccagauaccg

SEQ ID NO: 452464 - RNA, 23 nt, Human
uagggcagcugggagggacaugc

SEQ ID NO: 452465 - RNA, 22 nt, Human
ucuggcucuaacuaggcaucag

SEQ ID NO: 452466 - RNA, 22 nt, Human
ggcagugaacagaaaugcagaa

SEQ ID NO: 452467 - RNA, 22 nt, Human
auaaggaaugauguaucaguuu

SEQ ID NO: 452468 - RNA, 22 nt, Human
cauaccuuucucaagcacaugu

SEQ ID NO: 452469 - RNA, 22 nt, Human
uuccaguucccaugaggauuaa

SEQ ID NO: 452470 - RNA, 22 nt, Human
gggaccugccauugcucacagg

SEQ ID NO: 452471 - RNA, 22 nt, Human
aaaucaguuaagaugaggccau

SEQ ID NO: 452472 - RNA, 22 nt, Human
uacauggguagguuaagucaua

SEQ ID NO: 452473 - RNA, 22 nt, Human
ggugcuggacacguggcacucc

SEQ ID NO: 452474 - RNA, 22 nt, Human
cugggccucauccucagaguuu

SEQ ID NO: 452475 - RNA, 22 nt, Human
guggccucuguuggcuccuagg

SEQ ID NO: 452476 - RNA, 22 nt, Human
uggccugccugggagcagcagg

SEQ ID NO: 452477 - RNA, 22 nt, Human
agcugccugcuuaugagcucca

SEQ ID NO: 452478 - RNA, 22 nt, Human
caguaaaagauggaaauagaau

SEQ ID NO: 452479 - RNA, 22 nt, Human
uuuaccauccucuuuuagaauu

SEQ ID NO: 452480 - RNA, 22 nt, Human
aaggcacucagccuugggacag

SEQ ID NO: 452481 - RNA, 22 nt, Human
cccuuucccuucuggcucaggg

SEQ ID NO: 452482 - RNA, 22 nt, Human
gccaggcagacaggucaucagg

SEQ ID NO: 452483 - RNA, 22 nt, Human
ccagggugaggaggcucccacg

SEQ ID NO: 452484 - RNA, 22 nt, Human
gggcagguguugucaaucuaau

SEQ ID NO: 452485 - RNA, 20 nt, Human
gaguuccccauuucuccugg

SEQ ID NO: 452486 - RNA, 22 nt, Human
ugguaaaguguacugaauauga

SEQ ID NO: 452487 - RNA, 22 nt, Human
acagagcuuaauucaggagcuu

SEQ ID NO: 452488 - RNA, 22 nt, Human
uccucaggucaaagcaggagaa

SEQ ID NO: 452489 - RNA, 22 nt, Human
cacugggcaauucugagccuaa

SEQ ID NO: 452490 - RNA, 22 nt, Human
cugcucugaagccaggauucug

SEQ ID NO: 452491 - RNA, 22 nt, Human
ucacauaaauuauacaauuuca

SEQ ID NO: 452492 - RNA, 16 nt, Human
uggcugagagaggguu

SEQ ID NO: 452493 - RNA, 22 nt, Human
cauuaucucuucuauaugcuag

SEQ ID NO: 452494 - RNA, 22 nt, Human
ggaggccaugaggcucuaggug

SEQ ID NO: 452495 - RNA, 22 nt, Human
gcagcuuucuaagcuuuauugc

SEQ ID NO: 452496 - RNA, 22 nt, Human
auagaaaacagauguccuuaaa

SEQ ID NO: 452497 - RNA, 22 nt, Human
uuuacacauaccucuuuaaagu

SEQ ID NO: 452498 - RNA, 22 nt, Human
ccagcuuucugggugguuucug

SEQ ID NO: 452499 - RNA, 22 nt, Human
cuuggcagauccaaaaaugaca

SEQ ID NO: 452500 - RNA, 21 nt, Human
agcaacucugacuagaugagg

SEQ ID NO: 452501 - RNA, 22 nt, Human
cugcaggguuuuucaaggacaa

SEQ ID NO: 452502 - RNA, 22 nt, Human
uggagcauauucuggagcuugg

SEQ ID NO: 452503 - RNA, 22 nt, Human
aggggagcuaacaccagagccc

SEQ ID NO: 452504 - RNA, 22 nt, Human
uugaaaguccuucuugaguuac

SEQ ID NO: 452505 - RNA, 22 nt, Human
agggaggauaguagucaguuua

SEQ ID NO: 452506 - RNA, 21 nt, Human
agauuguauggaggugagagg

SEQ ID NO: 452507 - RNA, 22 nt, Human
cagagcugacccaaggauugaa

SEQ ID NO: 452508 - RNA, 22 nt, Human
caggggaaggagccuugaaacu

SEQ ID NO: 452509 - RNA, 22 nt, Human
ggcugggcucgcugauuggcug

SEQ ID NO: 452510 - RNA, 22 nt, Human
gccaggcuggugcaaggauauu

SEQ ID NO: 452511 - RNA, 22 nt, Human
cuuagaaauaaugguuucaguu

SEQ ID NO: 452512 - RNA, 22 nt, Human
aggagaaggaagugcaucacua

SEQ ID NO: 452513 - RNA, 22 nt, Human
caggccucaggggcucaggcug

SEQ ID NO: 452514 - RNA, 22 nt, Human
uaaagguaguuuuaaaggugcu

SEQ ID NO: 452515 - RNA, 22 nt, Human
ugcagggccuucuagaccaugg

SEQ ID NO: 452516 - RNA, 22 nt, Human
uccugcagguggaugauucucu

SEQ ID NO: 452517 - RNA, 22 nt, Human
ccagucugaggccuggugaggg

SEQ ID NO: 452518 - RNA, 22 nt, Human
gagcagugggaaggaacagggu

SEQ ID NO: 452519 - RNA, 22 nt, Human
ucucagugauggcccauuugga

SEQ ID NO: 452520 - RNA, 21 nt, Human
acagucuccccagaucucucc

SEQ ID NO: 452521 - RNA, 22 nt, Human
gccaggcagcugggagggugcc

SEQ ID NO: 452522 - RNA, 22 nt, Human
aaaggucagacuuaggcugggc

SEQ ID NO: 452523 - RNA, 18 nt, Human
ugagaggcagguagagga

SEQ ID NO: 452524 - RNA, 22 nt, Human
cugcugagguccuugcucagac

SEQ ID NO: 452525 - RNA, 22 nt, Human
uucuuuccucccagccuuugga

SEQ ID NO: 452526 - RNA, 22 nt, Human
aaauguguauaugaaacaugau

SEQ ID NO: 452527 - RNA, 20 nt, Human
ggcucugcuugugagcagcc

SEQ ID NO: 452528 - RNA, 19 nt, Human
ucucaauguucagaaagcu

SEQ ID NO: 452529 - RNA, 22 nt, Human
acagggcaaccucugggagacu

SEQ ID NO: 452530 - RNA, 22 nt, Human
cccacagguccccaugaacucg

SEQ ID NO: 452531 - RNA, 22 nt, Human
cugcagcuuuggaaaccuguuu

SEQ ID NO: 452532 - RNA, 22 nt, Human
cacaugggcguaauguccaugg

SEQ ID NO: 452533 - RNA, 22 nt, Human
gcugaguguaaugauggcagag

SEQ ID NO: 452534 - RNA, 22 nt, Human
ggcucagacucccaggcccucu

SEQ ID NO: 452535 - RNA, 22 nt, Human
agccacaccuguccugccagcu

SEQ ID NO: 452536 - RNA, 22 nt, Human
cagcuguguaugagagcaugcu

SEQ ID NO: 452537 - RNA, 22 nt, Human
cagguaagagacggauuggccc

SEQ ID NO: 452538 - RNA, 22 nt, Human
ggccucuguucugcauuccucc

SEQ ID NO: 452539 - RNA, 22 nt, Human
cacagggcagaggguccguggc

SEQ ID NO: 452540 - RNA, 22 nt, Human
ucucaguguuguucugcagaug

SEQ ID NO: 452541 - RNA, 22 nt, Human
aggcucaggcaggaauggcgga

SEQ ID NO: 452542 - RNA, 22 nt, Human
caucagagugguggccuggugu

SEQ ID NO: 452543 - RNA, 22 nt, Human
agggcccuccccgcucagggca

SEQ ID NO: 452544 - RNA, 22 nt, Human
aggcaggaaaaucgcuugaacc

SEQ ID NO: 452545 - RNA, 22 nt, Human
uuuucucuacaaaauaaccagc

SEQ ID NO: 452546 - RNA, 22 nt, Human
gugcuuucugcugcauuccucu

SEQ ID NO: 452547 - RNA, 22 nt, Human
acaggacauguaccaggugguc

SEQ ID NO: 452548 - RNA, 18 nt, Human
ccagguggugacagagau

SEQ ID NO: 452549 - RNA, 19 nt, Human
agggccaggauucuggaac

SEQ ID NO: 452550 - RNA, 22 nt, Human
agccaaagaucagugugcaagu

SEQ ID NO: 452551 - RNA, 22 nt, Human
gaaaagcuaggccaguucagcu

SEQ ID NO: 452552 - RNA, 22 nt, Human
gaugguuuggaaugaaguagcu

SEQ ID NO: 452553 - RNA, 18 nt, Human
caugggugacagguggau

SEQ ID NO: 452554 - RNA, 22 nt, Human
gcagagccuugcgucaugugcc

SEQ ID NO: 452555 - RNA, 22 nt, Human
agggcugcuccuccuucaggcc

SEQ ID NO: 452556 - RNA, 22 nt, Human
aggcugaggcagguggaucacu

SEQ ID NO: 452557 - RNA, 22 nt, Human
auugauaucaguuugcugauug

SEQ ID NO: 452558 - RNA, 22 nt, Human
ugcugccaccccucaccagagc

SEQ ID NO: 452559 - RNA, 19 nt, Human
uccuucagucagaucuggg

SEQ ID NO: 452560 - RNA, 22 nt, Human
aucugccuggcuccaggugagc

SEQ ID NO: 452561 - RNA, 22 nt, Human
ugaagcagaggggucuugagcu

SEQ ID NO: 452562 - RNA, 22 nt, Human
ugcuuuauguggcugauacuca

SEQ ID NO: 452563 - RNA, 22 nt, Human
uccuggagagugggcgagcaca

SEQ ID NO: 452564 - RNA, 22 nt, Human
ccagguguagcacugcucacag

SEQ ID NO: 452565 - RNA, 19 nt, Human
ucaaggcucccugagggau

SEQ ID NO: 452566 - RNA, 22 nt, Human
augcuucagugcuaccuucaaa

SEQ ID NO: 452567 - RNA, 22 nt, Human
ugcaucuuacguuuugaaaggg

SEQ ID NO: 452568 - RNA, 22 nt, Human
acagccauagaugcuuauguaa

SEQ ID NO: 452569 - RNA, 19 nt, Human
gggaugggcccucacccuc

SEQ ID NO: 452570 - RNA, 22 nt, Human
ucucgacagccuggcacagugg

SEQ ID NO: 452571 - RNA, 22 nt, Human
ucucccuggagcccugaagcau

SEQ ID NO: 452572 - RNA, 22 nt, Human
acccaggggcagccuugcugug

SEQ ID NO: 452573 - RNA, 22 nt, Human
aaugccucuuggaagaagacuu

SEQ ID NO: 452574 - RNA, 22 nt, Human
ggccugaggcaauagucagaca

SEQ ID NO: 452575 - RNA, 22 nt, Human
agagccagguguagucucggag

SEQ ID NO: 452576 - RNA, 22 nt, Human
agccccaguaagggagggccug

SEQ ID NO: 452577 - RNA, 18 nt, Human
aaguaacagaagagcaca

SEQ ID NO: 452578 - RNA, 22 nt, Human
ugcaggugcguuuucaagccuc

SEQ ID NO: 452579 - RNA, 22 nt, Human
agaaaacauuacauaggugugu

SEQ ID NO: 452580 - RNA, 22 nt, Human
acaggccugugugcacacgagg

SEQ ID NO: 452581 - RNA, 22 nt, Human
aggcugaaaacgagauggcaau

SEQ ID NO: 452582 - RNA, 22 nt, Human
ggcucugcuggauugaggccag

SEQ ID NO: 452583 - RNA, 17 nt, Human
cugaagauaauggcaac

SEQ ID NO: 452584 - RNA, 22 nt, Human
aaaaaugaauucuucaguggca

SEQ ID NO: 452585 - RNA, 22 nt, Human
gaaacuguauguaguuuuuggg

SEQ ID NO: 452586 - RNA, 22 nt, Human
uuagauaauguagagauaugag

SEQ ID NO: 452587 - RNA, 22 nt, Human
ucccuguccugggcaaucccag

SEQ ID NO: 452588 - RNA, 22 nt, Human
caggacugauguuccuccagcc

SEQ ID NO: 452589 - RNA, 22 nt, Human
ggcuuuauaggguagaggauca

SEQ ID NO: 452590 - RNA, 22 nt, Human
uggagggaacccaggcugcucu

SEQ ID NO: 452591 - RNA, 22 nt, Human
aacacuguacuggaagauggac

SEQ ID NO: 452592 - RNA, 22 nt, Human
ccauccugcauugcuauucaga

SEQ ID NO: 452593 - RNA, 22 nt, Human
cacacagaugguaagggaggga

SEQ ID NO: 452594 - RNA, 22 nt, Human
gaguucaguaguuauagucuag

SEQ ID NO: 452595 - RNA, 22 nt, Human
gcucccagggcagcgcagaaga

SEQ ID NO: 452596 - RNA, 22 nt, Human
uuuaacuugaucaguagagcau

SEQ ID NO: 452597 - RNA, 22 nt, Human
gagcagcucugggugacccagu

SEQ ID NO: 452598 - RNA, 22 nt, Human
uagcauuuauggucaugugucc

SEQ ID NO: 452599 - RNA, 22 nt, Human
augcucuggaguacgugaaauu

SEQ ID NO: 452600 - RNA, 22 nt, Human
aaaugcacagaggccagagagg

SEQ ID NO: 452601 - RNA, 22 nt, Human
cucaggauuuaaaggggcacuc

SEQ ID NO: 452602 - RNA, 22 nt, Human
ggcagcucugugucugggaagc

SEQ ID NO: 452603 - RNA, 22 nt, Human
cuggaagugggguuggcuugaa

SEQ ID NO: 452604 - RNA, 22 nt, Human
ccugugcccucagccuggcucu

SEQ ID NO: 452605 - RNA, 22 nt, Human
gcaagcaagcagguagagcuga

SEQ ID NO: 452606 - RNA, 22 nt, Human
ucucagggaccaugaugaugac

SEQ ID NO: 452607 - RNA, 22 nt, Human
ggcuccugaaagacuaugggaa

SEQ ID NO: 452608 - RNA, 21 nt, Human
agcuggugucagagcucuggg

SEQ ID NO: 452609 - RNA, 22 nt, Human
aggggcugacuggaaagugcca

SEQ ID NO: 452610 - RNA, 22 nt, Human
ucaaguauaucuagucauuagg

SEQ ID NO: 452611 - RNA, 22 nt, Human
gcugccuccugaaagcgcucug

SEQ ID NO: 452612 - RNA, 22 nt, Human
uagggcucagaguccaguuucu

SEQ ID NO: 452613 - RNA, 22 nt, Human
gggcaugguggcaggcaccugu

SEQ ID NO: 452614 - RNA, 22 nt, Human
uacauguauugauuucucuucu

SEQ ID NO: 452615 - RNA, 22 nt, Human
aauuauauuguggugugaaugu

SEQ ID NO: 452616 - RNA, 21 nt, Human
gcagggacaaagcuucaggag

SEQ ID NO: 452617 - RNA, 22 nt, Human
gggccccuuguaucucuggcuc

SEQ ID NO: 452618 - RNA, 22 nt, Human
ugauguucuguauaucauauag

SEQ ID NO: 452619 - RNA, 22 nt, Human
caggagccgccaggcacguugg

SEQ ID NO: 452620 - RNA, 22 nt, Human
uuucaaauggagucgugaaaug

SEQ ID NO: 452621 - RNA, 22 nt, Human
ggcugagacuagagugaggcau

SEQ ID NO: 452622 - RNA, 22 nt, Human
uuucuacauucaaaaacuacca

SEQ ID NO: 452623 - RNA, 22 nt, Human
uauaaaguuucgaaagauguau

SEQ ID NO: 452624 - RNA, 22 nt, Human
ccucagggccaucucugucccu

SEQ ID NO: 452625 - RNA, 22 nt, Human
ucaccccuacauuucccuugcu

SEQ ID NO: 452626 - RNA, 17 nt, Human
agaggcagauacuugga

SEQ ID NO: 452627 - RNA, 22 nt, Human
auggcagaauuaggauuucaag

SEQ ID NO: 452628 - RNA, 22 nt, Human
aaauuugauaagccauuguuac

SEQ ID NO: 452629 - RNA, 22 nt, Human
uagcagcucugauucugggccc

SEQ ID NO: 452630 - RNA, 22 nt, Human
gccaccucggcuuucucugcuc

SEQ ID NO: 452631 - RNA, 22 nt, Human
uucaaugauuuuuagggaucau

SEQ ID NO: 452632 - RNA, 22 nt, Human
agggcuccuaugccccauggac

SEQ ID NO: 452633 - RNA, 22 nt, Human
aggcuccuaucgcuuucagcaa

SEQ ID NO: 452634 - RNA, 22 nt, Human
agaggccuaaccaagauguccu

SEQ ID NO: 452635 - RNA, 22 nt, Human
ucaaugauagacaagaucuaag

SEQ ID NO: 452636 - RNA, 22 nt, Human
agaacugguggugaucaguuau

SEQ ID NO: 452637 - RNA, 22 nt, Human
gggcaguguggucgugccuuug

SEQ ID NO: 452638 - RNA, 20 nt, Human
ugcuugucaugcacucaggc

SEQ ID NO: 452639 - RNA, 20 nt, Human
gguagcagcugcugucaucc

SEQ ID NO: 452640 - RNA, 18 nt, Human
ugagagugugugcucuug

SEQ ID NO: 452641 - RNA, 22 nt, Human
gagcuuccugaugccgaccagu

SEQ ID NO: 452642 - RNA, 22 nt, Human
gcacugaacuuuaaucauuucu

SEQ ID NO: 452643 - RNA, 22 nt, Human
gccaccaggagcccaguccaaa

SEQ ID NO: 452644 - RNA, 22 nt, Human
acuuuguauaagacaauaaaga

SEQ ID NO: 452645 - RNA, 22 nt, Human
aaguuugagagccuuuaguaua

SEQ ID NO: 452646 - RNA, 22 nt, Human
cagcaaucgggugauaugcaau

SEQ ID NO: 452647 - RNA, 22 nt, Human
ugccagggugucaggagagcua

SEQ ID NO: 452648 - RNA, 22 nt, Human
gaaucucaaggcuugugaggau

SEQ ID NO: 452649 - RNA, 22 nt, Human
uccuccagugucuggggccuug

SEQ ID NO: 452650 - RNA, 22 nt, Human
uggccugccuucgcugagcuga

SEQ ID NO: 452651 - RNA, 22 nt, Human
ugcagggauuauguagggguug

SEQ ID NO: 452652 - RNA, 22 nt, Human
ccagcuccugggucuuagucag

SEQ ID NO: 452653 - RNA, 22 nt, Human
cugagcugacaucuuccucuuu

SEQ ID NO: 452654 - RNA, 22 nt, Human
ggccaggaagggaagaucagca

SEQ ID NO: 452655 - RNA, 22 nt, Human
ucauuucucugagucugauaau

SEQ ID NO: 452656 - RNA, 22 nt, Human
ugggcugcugcggugcucuugg

SEQ ID NO: 452657 - RNA, 22 nt, Human
aacaaguaaguuuauauauauu

SEQ ID NO: 452658 - RNA, 19 nt, Human
caguggccuggaggucucu

SEQ ID NO: 452659 - RNA, 22 nt, Human
aauuagggaaaacauuugcuuu

SEQ ID NO: 452660 - RNA, 22 nt, Human
ccagcccuguaaggaugaggca

SEQ ID NO: 452661 - RNA, 22 nt, Human
aagaggcagcccgcugaggcug

SEQ ID NO: 452662 - RNA, 22 nt, Human
ccaaaggccaagcucagguaaa

SEQ ID NO: 452663 - RNA, 22 nt, Human
gugucauguagaaauugaugaa

SEQ ID NO: 452664 - RNA, 19 nt, Human
uggcauugguccagauaaa

SEQ ID NO: 452665 - RNA, 22 nt, Human
gcuuccuaaaugcacagggcag

SEQ ID NO: 452666 - RNA, 22 nt, Human
ugcccauguuucucuguauccc

SEQ ID NO: 452667 - RNA, 22 nt, Human
agcagccaggaaucugcagagc

SEQ ID NO: 452668 - RNA, 22 nt, Human
uucucacuauguauguagauug

SEQ ID NO: 452669 - RNA, 22 nt, Human
gucauugcaguggcaaaucaca

SEQ ID NO: 452670 - RNA, 22 nt, Human
ccuggcaggcuggggacagugc

SEQ ID NO: 452671 - RNA, 22 nt, Human
cuuugaaagcucccaggacuua

SEQ ID NO: 452672 - RNA, 22 nt, Human
acagccuggacuggcucucugc

SEQ ID NO: 452673 - RNA, 22 nt, Human
uugaauaguuuuggauagcaua

SEQ ID NO: 452674 - RNA, 22 nt, Human
ucaucaaagcgcuuggaguagg

SEQ ID NO: 452675 - RNA, 22 nt, Human
agggccagaguacaucagggcu

SEQ ID NO: 452676 - RNA, 22 nt, Human
uucuuucccuuccagcagcucc

SEQ ID NO: 452677 - RNA, 22 nt, Human
agggcugaaacauaauccuucu

SEQ ID NO: 452678 - RNA, 22 nt, Human
ggcacugggcaccggcugaggg

SEQ ID NO: 452679 - RNA, 22 nt, Human
gcuguggccgucagggaaaugg

SEQ ID NO: 452680 - RNA, 22 nt, Human
ggaagggccucgggcgugggac

SEQ ID NO: 452681 - RNA, 22 nt, Human
uuauuagggugguuuauguucu

SEQ ID NO: 452682 - RNA, 22 nt, Human
agcugcccuuaauaggcauuca

SEQ ID NO: 452683 - RNA, 22 nt, Human
uaucuugagagacaacacagca

SEQ ID NO: 452684 - RNA, 22 nt, Human
uccaggcaagggaggagcaugg

SEQ ID NO: 452685 - RNA, 22 nt, Human
aguuuuucugcuggucucacua

SEQ ID NO: 452686 - RNA, 22 nt, Human
cuggcagguccagcuggacuca

SEQ ID NO: 452687 - RNA, 22 nt, Human
gccuggaguucagccaaguccc

SEQ ID NO: 452688 - RNA, 22 nt, Human
uguuucuucucacacaaacuca

SEQ ID NO: 452689 - RNA, 22 nt, Human
gcugguccacucccuggaggcu

SEQ ID NO: 452690 - RNA, 22 nt, Human
ugucuccuacugccuguggauc

SEQ ID NO: 452691 - RNA, 22 nt, Human
ugaggccuuuucugucuggcua

SEQ ID NO: 452692 - RNA, 22 nt, Human
gaggcagcggcucacagagaaa

SEQ ID NO: 452693 - RNA, 22 nt, Human
uaauuauaacaguuacaucuua

SEQ ID NO: 452694 - RNA, 22 nt, Human
cacaugcaucugucauguuugg

SEQ ID NO: 452695 - RNA, 22 nt, Human
uggcaccugaacuuagaggugu

SEQ ID NO: 452696 - RNA, 22 nt, Human
guggcagggugcucaucaugca

SEQ ID NO: 452697 - RNA, 22 nt, Human
auuuuuuagaaccuggccugau

SEQ ID NO: 452698 - RNA, 22 nt, Human
aagaauguucauuaaacuguug

SEQ ID NO: 452699 - RNA, 22 nt, Human
acagagcuucccagccugagca

SEQ ID NO: 452700 - RNA, 20 nt, Human
caucagugccugacaggucc

SEQ ID NO: 452701 - RNA, 22 nt, Human
acuuguguaacacagaaagaac

SEQ ID NO: 452702 - RNA, 22 nt, Human
ggaccagagaagugagcaccug

SEQ ID NO: 452703 - RNA, 22 nt, Human
gccuggagacaaggacaaaggg

SEQ ID NO: 452704 - RNA, 21 nt, Human
aaacugaagagacaggaacuu

SEQ ID NO: 452705 - RNA, 22 nt, Human
caagagcugcaaauagcgugac

SEQ ID NO: 452706 - RNA, 22 nt, Human
agaagccaccagcugaggaaga

SEQ ID NO: 452707 - RNA, 22 nt, Human
agcauugccugccuauugcuaa

SEQ ID NO: 452708 - RNA, 22 nt, Human
agcuuuaucuucaccugggaau

SEQ ID NO: 452709 - RNA, 22 nt, Human
agcuuuaucacaauauuggcua

SEQ ID NO: 452710 - RNA, 22 nt, Human
agaggcugaaugaugucaucau

SEQ ID NO: 452711 - RNA, 22 nt, Human
acccagcaugacaccugcacau

SEQ ID NO: 452712 - RNA, 22 nt, Human
ugagccuggagucguggagggg

SEQ ID NO: 452713 - RNA, 22 nt, Human
aauuucaaugcacucaugguug

SEQ ID NO: 452714 - RNA, 23 nt, Human
uccucccaaauuucagccucauu

SEQ ID NO: 452715 - RNA, 22 nt, Human
ccagcucuggcuucuugcuggg

SEQ ID NO: 452716 - RNA, 22 nt, Human
cuguccuguagcuccaucaguc

SEQ ID NO: 452717 - RNA, 22 nt, Human
aggacccugaggucuccuguga

SEQ ID NO: 452718 - RNA, 22 nt, Human
cagcuguggagauggggugcau

SEQ ID NO: 452719 - RNA, 22 nt, Human
agggucagagaucggccaugug

SEQ ID NO: 452720 - RNA, 22 nt, Human
ucaguguagcagacuuguagcc

SEQ ID NO: 452721 - RNA, 22 nt, Human
agccaggcuacuccuugcugac

SEQ ID NO: 452722 - RNA, 22 nt, Human
cugcccugacugaccuuuugaa

SEQ ID NO: 452723 - RNA, 22 nt, Human
aaagguuugcauggaauuuacc

SEQ ID NO: 452724 - RNA, 22 nt, Human
aggcuauuuccacucuucucau

SEQ ID NO: 452725 - RNA, 22 nt, Human
uggcuggcuagugggcaggauu

SEQ ID NO: 452726 - RNA, 22 nt, Human
ucagaagccggaagugcuccuc

SEQ ID NO: 452727 - RNA, 22 nt, Human
ggcucagguuuccuucccagcu

SEQ ID NO: 452728 - RNA, 22 nt, Human
uuugcauuuauaaguuggugga

SEQ ID NO: 452729 - RNA, 22 nt, Human
ucucccacgguacaggauaaac

SEQ ID NO: 452730 - RNA, 22 nt, Human
aacuucuugguccugagcuguu

SEQ ID NO: 452731 - RNA, 22 nt, Human
ggaccugcucucccaguucucu

SEQ ID NO: 452732 - RNA, 22 nt, Human
ugaggaaguugaucucaucagu

SEQ ID NO: 452733 - RNA, 22 nt, Human
caugaauauuuaguauuuacuu

SEQ ID NO: 452734 - RNA, 22 nt, Human
aguuucauauuaccaugucacc

SEQ ID NO: 452735 - RNA, 22 nt, Human
cuccucacuuuccagacugggc

SEQ ID NO: 452736 - RNA, 22 nt, Human
gcacugcaucuacuggcaagua

SEQ ID NO: 452737 - RNA, 20 nt, Human
uggagccacagucagguucc

SEQ ID NO: 452738 - RNA, 17 nt, Human
cacaggugugguuugag

SEQ ID NO: 452739 - RNA, 22 nt, Human
guggcagcugguaugcagacag

SEQ ID NO: 452740 - RNA, 22 nt, Human
ucaguggaacugucugggugag

SEQ ID NO: 452741 - RNA, 22 nt, Human
agggcugaagggaggugcucau

SEQ ID NO: 452742 - RNA, 22 nt, Human
gagggcagaaaauuaugcggug

SEQ ID NO: 452743 - RNA, 22 nt, Human
gagccagcgccuugccucuggg

SEQ ID NO: 452744 - RNA, 22 nt, Human
cccagccuuugcuuccugguuc

SEQ ID NO: 452745 - RNA, 22 nt, Human
acaauguaggauauguacuugu

SEQ ID NO: 452746 - RNA, 22 nt, Human
aaucaguuguccaaaguucaca

SEQ ID NO: 452747 - RNA, 22 nt, Human
caguggcugugaccagggaccu

SEQ ID NO: 452748 - RNA, 22 nt, Human
ggagucccagcaaagccuuccc

SEQ ID NO: 452749 - RNA, 22 nt, Human
agggcagcucucaccucuggcc

SEQ ID NO: 452750 - RNA, 22 nt, Human
agcugccacauggugucacugu

SEQ ID NO: 452751 - RNA, 22 nt, Human
gggagaaggagcuaguucuuga

SEQ ID NO: 452752 - RNA, 19 nt, Human
uguuuuguuaaagcagucc

SEQ ID NO: 452753 - RNA, 22 nt, Human
acagagagcugugauugaguua

SEQ ID NO: 452754 - RNA, 22 nt, Human
aggcccugcccagugccacaag

SEQ ID NO: 452755 - RNA, 22 nt, Human
cagaaggcaaacaaaaggauuu

SEQ ID NO: 452756 - RNA, 22 nt, Human
auacuuacuuuucuucagacua

SEQ ID NO: 452757 - RNA, 21 nt, Human
uucaaaguuugccuaaagauu

SEQ ID NO: 452758 - RNA, 22 nt, Human
ccagaggaaaaauaucucccua

SEQ ID NO: 452759 - RNA, 22 nt, Human
agggcagcacagcugugcuccu

SEQ ID NO: 452760 - RNA, 22 nt, Human
gcagggcucauucuaguacaau

SEQ ID NO: 452761 - RNA, 22 nt, Human
ucuggcucuauaacuccuagcu

SEQ ID NO: 452762 - RNA, 22 nt, Human
ggcucugcagugacuugagggg

SEQ ID NO: 452763 - RNA, 22 nt, Human
caguguuuaaucauugugaauu

SEQ ID NO: 452764 - RNA, 22 nt, Human
aggcagguccccuggaaggcac

SEQ ID NO: 452765 - RNA, 22 nt, Human
gucagcagugucagcucugggg

SEQ ID NO: 452766 - RNA, 22 nt, Human
accaguccgcggagcuccgggg

SEQ ID NO: 452767 - RNA, 22 nt, Human
uuuccaauaaagugucauuguu

SEQ ID NO: 452768 - RNA, 22 nt, Human
agcugggucuugggccaggaga

SEQ ID NO: 452769 - RNA, 22 nt, Human
aagaaauuaaggaaugcaacga

SEQ ID NO: 452770 - RNA, 22 nt, Human
auuuguuccacacauauuuacu

SEQ ID NO: 452771 - RNA, 22 nt, Human
uggcaggagguuuucuccagga

SEQ ID NO: 452772 - RNA, 22 nt, Human
uucuuaaagaggcaaaacacag

SEQ ID NO: 452773 - RNA, 22 nt, Human
uaacagaauuugcuaaacuccg

SEQ ID NO: 452774 - RNA, 22 nt, Human
gccucugcaucaucacuccagc

SEQ ID NO: 452775 - RNA, 22 nt, Human
cacuguuuuauuccaacauagg

SEQ ID NO: 452776 - RNA, 22 nt, Human
aggcagcuggcagcacccaggg

SEQ ID NO: 452777 - RNA, 22 nt, Human
guaucacuuuugagagugagaa

SEQ ID NO: 452778 - RNA, 22 nt, Human
aauguuguuuuucugcaugucu

SEQ ID NO: 452779 - RNA, 22 nt, Human
gcucccacaaccuucuugcucc

SEQ ID NO: 452780 - RNA, 19 nt, Human
ugcagcucagggcaggggc

SEQ ID NO: 452781 - RNA, 22 nt, Human
aggccuuccucggagacaggga

SEQ ID NO: 452782 - RNA, 22 nt, Human
acagagauggcacagagaaggu

SEQ ID NO: 452783 - RNA, 18 nt, Human
gucacuguguuucugagc

SEQ ID NO: 452784 - RNA, 22 nt, Human
cagaaggcuuuguggaguagac

SEQ ID NO: 452785 - RNA, 20 nt, Human
cuaucuccuggcgugccuuc

SEQ ID NO: 452786 - RNA, 22 nt, Human
agagcuggccagggaucacucu

SEQ ID NO: 452787 - RNA, 22 nt, Human
gcuggcugggucccugagaggc

SEQ ID NO: 452788 - RNA, 22 nt, Human
caggugggccgggguuuguucu

SEQ ID NO: 452789 - RNA, 17 nt, Human
agggucaggugaaguuc

SEQ ID NO: 452790 - RNA, 22 nt, Human
ucucaggcuaccuugcacaagg

SEQ ID NO: 452791 - RNA, 22 nt, Human
gaggcucugugaugugccaggc

SEQ ID NO: 452792 - RNA, 22 nt, Human
gcacagggccuggcacauaaga

SEQ ID NO: 452793 - RNA, 17 nt, Human
uagcugccccgaaugcu

SEQ ID NO: 452794 - RNA, 19 nt, Human
acaggcagaauugggugug

SEQ ID NO: 452795 - RNA, 22 nt, Human
caggcaggugcagauuccucuu

SEQ ID NO: 452796 - RNA, 22 nt, Human
aggucacauggauaaugaucag

SEQ ID NO: 452797 - RNA, 22 nt, Human
uaggcaggugugcacugcccac

SEQ ID NO: 452798 - RNA, 21 nt, Human
gccagggaagagaguuggcug

SEQ ID NO: 452799 - RNA, 22 nt, Human
agggccagcugcagaauuagca

SEQ ID NO: 452800 - RNA, 22 nt, Human
uggagagcaagucgcagacaug

SEQ ID NO: 452801 - RNA, 22 nt, Human
cuauuagguaugcagccuauuu

SEQ ID NO: 452802 - RNA, 22 nt, Human
uggccaggggaguuccccucca

SEQ ID NO: 452803 - RNA, 22 nt, Human
gagcugccugaacaagcagcag

SEQ ID NO: 452804 - RNA, 22 nt, Human
ucccuggacagccuugccuggg

SEQ ID NO: 452805 - RNA, 22 nt, Human
gaaggccucacucugcagcaua

SEQ ID NO: 452806 - RNA, 22 nt, Human
gaggaagcugcguggcauuuca

SEQ ID NO: 452807 - RNA, 22 nt, Human
uguauguaaaguuuguaauaga

SEQ ID NO: 452808 - RNA, 22 nt, Human
ccuggauucaagucuuucuuuc

SEQ ID NO: 452809 - RNA, 22 nt, Human
cuggagcagcagguggccaggg

SEQ ID NO: 452810 - RNA, 22 nt, Human
ccagcuccccucagcagguaau

SEQ ID NO: 452811 - RNA, 22 nt, Human
agcucuccacacauaggacuag

SEQ ID NO: 452812 - RNA, 22 nt, Human
ccaggcugcuguugguguccgc

SEQ ID NO: 452813 - RNA, 22 nt, Human
ugaguccaucgcagggaagugg

SEQ ID NO: 452814 - RNA, 22 nt, Human
uugcagagcaguaggaauauag

SEQ ID NO: 452815 - RNA, 22 nt, Human
aggcaguuguagagagggcucu

SEQ ID NO: 452816 - RNA, 22 nt, Human
agccucucuuuauucccagcua

SEQ ID NO: 452817 - RNA, 22 nt, Human
gcaggcugggguagccccacuu

SEQ ID NO: 452818 - RNA, 22 nt, Human
uuugcaaauaccaugaaacuug

SEQ ID NO: 452819 - RNA, 22 nt, Human
gccucugggcucugccccuggc

SEQ ID NO: 452820 - RNA, 22 nt, Human
cuagaaauacaggcacgugcca

SEQ ID NO: 452821 - RNA, 22 nt, Human
cagcagcugggaaggaggcuga

SEQ ID NO: 452822 - RNA, 22 nt, Human
agagcugauuugauuacagugc

SEQ ID NO: 452823 - RNA, 22 nt, Human
ugucaugcccaggagcaaggua

SEQ ID NO: 452824 - RNA, 22 nt, Human
uagagcugauaaugaggccaag

SEQ ID NO: 452825 - RNA, 22 nt, Human
caagaugaucccugaaggcagc

SEQ ID NO: 452826 - RNA, 22 nt, Human
uaugaagacaaugauagcauga

SEQ ID NO: 452827 - RNA, 22 nt, Human
gcugccuguggcccuucugggu

SEQ ID NO: 452828 - RNA, 22 nt, Human
ccaucagcuccaguaucuucug

SEQ ID NO: 452829 - RNA, 22 nt, Human
cccaggaggucgaagcugcagu

SEQ ID NO: 452830 - RNA, 22 nt, Human
cccagaaggucgaggcugcagu

SEQ ID NO: 452831 - RNA, 22 nt, Human
aaggcagccucugccagccggg

SEQ ID NO: 452832 - RNA, 22 nt, Human
uguuugcucugacuaucuugcg

SEQ ID NO: 452833 - RNA, 18 nt, Human
aggcccuggccucgaaca

SEQ ID NO: 452834 - RNA, 22 nt, Human
gaaagagaaccugggccuagau

SEQ ID NO: 452835 - RNA, 23 nt, Human
cugcuguguuggucucgauggga

SEQ ID NO: 452836 - RNA, 22 nt, Human
ucucugagcgcauuccuccggc

SEQ ID NO: 452837 - RNA, 22 nt, Human
cugaaggacuuggugauaguug

SEQ ID NO: 452838 - RNA, 22 nt, Human
aagggcaggaaaagauggaugu

SEQ ID NO: 452839 - RNA, 22 nt, Human
cagagacuggagugcaguggcg

SEQ ID NO: 452840 - RNA, 22 nt, Human
uuuuauucucaagacaauggga

SEQ ID NO: 452841 - RNA, 21 nt, Human
agcagccauggaugguaugua

SEQ ID NO: 452842 - RNA, 22 nt, Human
gggaaggagguggcuugaagug

SEQ ID NO: 452843 - RNA, 22 nt, Human
augaccccuaaaauuuacuguc

SEQ ID NO: 452844 - RNA, 22 nt, Human
cagcugagaaauggggaaaggg

SEQ ID NO: 452845 - RNA, 22 nt, Human
gcaggcagucaucuuucauauu

SEQ ID NO: 452846 - RNA, 22 nt, Human
gagcucccaggccccagcaagg

SEQ ID NO: 452847 - RNA, 22 nt, Human
gcaguaaaaaaggauaugugca

SEQ ID NO: 452848 - RNA, 22 nt, Human
agcuuuaugcuuccuacaagcu

SEQ ID NO: 452849 - RNA, 22 nt, Human
cugccuggaccggcagcccucc

SEQ ID NO: 452850 - RNA, 22 nt, Human
cccuggaggagcuuagagcuug

SEQ ID NO: 452851 - RNA, 22 nt, Human
agggagacacaugaggaaguca

SEQ ID NO: 452852 - RNA, 22 nt, Human
caggggcucugagauugucuaa

SEQ ID NO: 452853 - RNA, 22 nt, Human
ugagcauggugggugcagagca

SEQ ID NO: 452854 - RNA, 22 nt, Human
gggucaggcucagcagggcagc

SEQ ID NO: 452855 - RNA, 22 nt, Human
gccuggagaagauggaacuagc

SEQ ID NO: 452856 - RNA, 22 nt, Human
aagaggucauaccagauaaggg

SEQ ID NO: 452857 - RNA, 23 nt, Human
uuucuguuggguauauauccaag

SEQ ID NO: 452858 - RNA, 19 nt, Human
agcaaauauaauaguguuc

SEQ ID NO: 452859 - RNA, 22 nt, Human
aagauuauggcagauaacaauu

SEQ ID NO: 452860 - RNA, 22 nt, Human
agcagggcagugcuucagcucu

SEQ ID NO: 452861 - RNA, 22 nt, Human
ccuugcaggggaacaggcagug

SEQ ID NO: 452862 - RNA, 22 nt, Human
aaaguuuccugcuaagugcuau

SEQ ID NO: 452863 - RNA, 22 nt, Human
agccaagcaccacuggcacucg

SEQ ID NO: 452864 - RNA, 22 nt, Human
ggucccaggaaucuguguucua

SEQ ID NO: 452865 - RNA, 22 nt, Human
gagggcagagucuaaugaugca

SEQ ID NO: 452866 - RNA, 21 nt, Human
gccaccccuggcacaggugcu

SEQ ID NO: 452867 - RNA, 22 nt, Human
cagguggcaugacugccuacaa

SEQ ID NO: 452868 - RNA, 22 nt, Human
ucucccaggugggugccuggag

SEQ ID NO: 452869 - RNA, 22 nt, Human
aguguggcugcguagggcucuc

SEQ ID NO: 452870 - RNA, 22 nt, Human
acaggcagguaauuuacauauu

SEQ ID NO: 452871 - RNA, 22 nt, Human
ggucccaguugcccaggucagg

SEQ ID NO: 452872 - RNA, 22 nt, Human
ugauuuccacgugcacccaggu

SEQ ID NO: 452873 - RNA, 22 nt, Human
caguagcacucugucagugaag

SEQ ID NO: 452874 - RNA, 19 nt, Human
gagguggguccccgcagcc

SEQ ID NO: 452875 - RNA, 22 nt, Human
ugggagaugguucugagacuuu

SEQ ID NO: 452876 - RNA, 22 nt, Human
cccagcccugaccuauuggaaa

SEQ ID NO: 452877 - RNA, 22 nt, Human
cuccuugguguaguacugagca

SEQ ID NO: 452878 - RNA, 19 nt, Human
gccugagccagccaugcaa

SEQ ID NO: 452879 - RNA, 17 nt, Human
cccagcuggcagugccg

SEQ ID NO: 452880 - RNA, 19 nt, Human
ccucugccagcccgccucu

SEQ ID NO: 452881 - RNA, 19 nt, Human
gucacauuugucucccagg

SEQ ID NO: 452882 - RNA, 22 nt, Human
uggcacugggacagaugcucuc

SEQ ID NO: 452883 - RNA, 22 nt, Human
ugaugguugauuauaaaucagu

SEQ ID NO: 452884 - RNA, 19 nt, Human
ccuuggaguuccaggugga

SEQ ID NO: 452885 - RNA, 22 nt, Human
agaccacagucaggcuccuggu

SEQ ID NO: 452886 - RNA, 22 nt, Human
uguuuguucccucucuuuccug

SEQ ID NO: 452887 - RNA, 20 nt, Human
uguuaaaggacacuugcuuu

SEQ ID NO: 452888 - RNA, 22 nt, Human
agagacagaggcaauauagcuu

SEQ ID NO: 452889 - RNA, 22 nt, Human
auucuucugccuacuuucaucc

SEQ ID NO: 452890 - RNA, 22 nt, Human
cuacauaaucuggauuugucug

SEQ ID NO: 452891 - RNA, 22 nt, Human
cacugugucaguuugguuagac

SEQ ID NO: 452892 - RNA, 22 nt, Human
gcugcucugaaaaugacuguug

SEQ ID NO: 452893 - RNA, 22 nt, Human
aaucgguugaacccaggaagug

SEQ ID NO: 452894 - RNA, 22 nt, Human
gcagagcccuggggguauggug

SEQ ID NO: 452895 - RNA, 21 nt, Human
ggcuccugcuuugugaggggc

SEQ ID NO: 452896 - RNA, 22 nt, Human
uugcauugaucccagcuugggc

SEQ ID NO: 452897 - RNA, 22 nt, Human
ccugucugaaggcagggggaug

SEQ ID NO: 452898 - RNA, 22 nt, Human
augggcaguuaggaggccagga

SEQ ID NO: 452899 - RNA, 22 nt, Human
uauuccuauuucuaaacauaug

SEQ ID NO: 452900 - RNA, 22 nt, Human
cauucauuuacuuucaacagcu

SEQ ID NO: 452901 - RNA, 22 nt, Human
cagagugagggccugcaccugc

SEQ ID NO: 452902 - RNA, 22 nt, Human
cagagccaaaugcugugguuau

SEQ ID NO: 452903 - RNA, 22 nt, Human
accugccucuaagcagcaggug

SEQ ID NO: 452904 - RNA, 22 nt, Human
acaguggaagaagcacugaacu

SEQ ID NO: 452905 - RNA, 22 nt, Human
cauuauguucaguagcuuaaaa

SEQ ID NO: 452906 - RNA, 22 nt, Human
cauccacuagaaugacagaguu

SEQ ID NO: 452907 - RNA, 22 nt, Human
augucacagcucccauuccucc

SEQ ID NO: 452908 - RNA, 22 nt, Human
agggcacaucugcugggaaugg

SEQ ID NO: 452909 - RNA, 22 nt, Human
cagaguguuucuuugggugggu

SEQ ID NO: 452910 - RNA, 22 nt, Human
gcagcugggccccagccucucc

SEQ ID NO: 452911 - RNA, 17 nt, Human
ccugggaggaguuauga

SEQ ID NO: 452912 - RNA, 22 nt, Human
cugaugcuauaagccacagugg

SEQ ID NO: 452913 - RNA, 20 nt, Human
cagcuuggaugagaggcuga

SEQ ID NO: 452914 - RNA, 22 nt, Human
ugcccugcagugagugcgucug

SEQ ID NO: 452915 - RNA, 22 nt, Human
aucagagaccggucaagucaug

SEQ ID NO: 452916 - RNA, 22 nt, Human
cccuguccuggaugggagcacu

SEQ ID NO: 452917 - RNA, 22 nt, Human
agcugcuguggggcucggccug

SEQ ID NO: 452918 - RNA, 22 nt, Human
guacuuccguggacuaauuguu

SEQ ID NO: 452919 - RNA, 22 nt, Human
gauuucaaagguucugcaugcc

SEQ ID NO: 452920 - RNA, 20 nt, Human
augccucuaauuuugcaaac

SEQ ID NO: 452921 - RNA, 22 nt, Human
uugaagcauuugcuauagcauu

SEQ ID NO: 452922 - RNA, 22 nt, Human
uagggcagaguccaggaugggc

SEQ ID NO: 452923 - RNA, 22 nt, Human
ucaaaauuucagcacuagcccu

SEQ ID NO: 452924 - RNA, 20 nt, Human
gcaggcagggaaugggggug

SEQ ID NO: 452925 - RNA, 22 nt, Human
acugaaggaaacuuuuguguuu

SEQ ID NO: 452926 - RNA, 22 nt, Human
ugaaggagcugauguaaggggu

SEQ ID NO: 452927 - RNA, 22 nt, Human
cugcccugggaguaccuguccu

SEQ ID NO: 452928 - RNA, 22 nt, Human
gacaagacugguuuauuuaagg

SEQ ID NO: 452929 - RNA, 22 nt, Human
gaggcagaggaagguggucucu

SEQ ID NO: 452930 - RNA, 19 nt, Human
cugaggcccauguaccaug

SEQ ID NO: 452931 - RNA, 22 nt, Human
ugucuguacaaauuuucugugu

SEQ ID NO: 452932 - RNA, 22 nt, Human
cagggagaucuuggcuccuggu

SEQ ID NO: 452933 - RNA, 22 nt, Human
gggaaggagccugcuugcuaga

SEQ ID NO: 452934 - RNA, 22 nt, Human
aacaggcaacaguugacucuga

SEQ ID NO: 452935 - RNA, 22 nt, Human
ggagcuguugcgcaugcgcucg

SEQ ID NO: 452936 - RNA, 22 nt, Human
acaaugcaccagcaucuucacc

SEQ ID NO: 452937 - RNA, 22 nt, Human
acagcagccugcagcccugugu

SEQ ID NO: 452938 - RNA, 22 nt, Human
acaggcagcgucauugcugcuc

SEQ ID NO: 452939 - RNA, 22 nt, Human
ggcaggagcucuccaguuugcc

SEQ ID NO: 452940 - RNA, 22 nt, Human
cagauuuaccuaacuccaaguu

SEQ ID NO: 452941 - RNA, 22 nt, Human
caagauggguguugugaugguu

SEQ ID NO: 452942 - RNA, 22 nt, Human
accaaagggcagaacaugagca

SEQ ID NO: 452943 - RNA, 22 nt, Human
uuucacaucagagguagauuag

SEQ ID NO: 452944 - RNA, 22 nt, Human
cugcccucuagaggaggacuga

SEQ ID NO: 452945 - RNA, 22 nt, Human
caguuucucucaauaagcaucg

SEQ ID NO: 452946 - RNA, 22 nt, Human
acagagccacuuuggugccuac

SEQ ID NO: 452947 - RNA, 22 nt, Human
ucagggcauggcugcacuuggc

SEQ ID NO: 452948 - RNA, 22 nt, Human
cugagaggaugcugcaguggag

SEQ ID NO: 452949 - RNA, 22 nt, Human
ggcagcugauuagcaucaagga

SEQ ID NO: 452950 - RNA, 22 nt, Human
uugcauugggagugaggagacc

SEQ ID NO: 452951 - RNA, 22 nt, Human
gggcuggagccagcuguggcug

SEQ ID NO: 452952 - RNA, 22 nt, Human
uguuccaucaguuuuugguuga

SEQ ID NO: 452953 - RNA, 22 nt, Human
ucagagaguuacacaaauuguu

SEQ ID NO: 452954 - RNA, 22 nt, Human
cagacccucgggugaguuggcc

SEQ ID NO: 452955 - RNA, 22 nt, Human
uggcagagcuggcugcggauga

SEQ ID NO: 452956 - RNA, 22 nt, Human
gcagcagagcuuuguccuggcu

SEQ ID NO: 452957 - RNA, 22 nt, Human
uagcuuuaauaagcugcugaau

SEQ ID NO: 452958 - RNA, 22 nt, Human
cccugccuugggguccacaccg

SEQ ID NO: 452959 - RNA, 22 nt, Human
agggcagagagaugaaugggau

SEQ ID NO: 452960 - RNA, 20 nt, Human
agugggagagggcagacugc

SEQ ID NO: 452961 - RNA, 19 nt, Human
cucuccagcuccaguagcu

SEQ ID NO: 452962 - RNA, 22 nt, Human
gcaaggcugcugccacccaucu

SEQ ID NO: 452963 - RNA, 20 nt, Human
cucugcagcaaggccugggu

SEQ ID NO: 452964 - RNA, 22 nt, Human
guguuccauguuugagguaguu

SEQ ID NO: 452965 - RNA, 22 nt, Human
gagaagcaaucgugacaucucc

SEQ ID NO: 452966 - RNA, 22 nt, Human
cuguucaugcugauucuguaug

SEQ ID NO: 452967 - RNA, 22 nt, Human
agcugccaucagccuuuggaug

SEQ ID NO: 452968 - RNA, 22 nt, Human
ccagggucuuggagaggagugc

SEQ ID NO: 452969 - RNA, 22 nt, Human
guggccugccgugugguauggg

SEQ ID NO: 452970 - RNA, 22 nt, Human
uccugagauucugcauuucuaa

SEQ ID NO: 452971 - RNA, 22 nt, Human
gccugagagucugcauuucuaa

SEQ ID NO: 452972 - RNA, 22 nt, Human
ugcaagcacucaaugcaaacag

SEQ ID NO: 452973 - RNA, 22 nt, Human
accaugccaguggcagccagac

SEQ ID NO: 452974 - RNA, 22 nt, Human
ucagcuuggacagcuugguuga

SEQ ID NO: 452975 - RNA, 22 nt, Human
gcaggguauaauacuuagguga

SEQ ID NO: 452976 - RNA, 22 nt, Human
aggcaguggagcuggaauaggc

SEQ ID NO: 452977 - RNA, 20 nt, Human
uggagccaaggugugucugg

SEQ ID NO: 452978 - RNA, 22 nt, Human
ucagggacugcagagggaagcu

SEQ ID NO: 452979 - RNA, 17 nt, Human
ugagcaguagaagaugc

SEQ ID NO: 452980 - RNA, 22 nt, Human
uucagugugugauaccugcugu

SEQ ID NO: 452981 - RNA, 22 nt, Human
ucagggcauucaagaggccugg

SEQ ID NO: 452982 - RNA, 21 nt, Human
gcagccagacgggauucaguu

SEQ ID NO: 452983 - RNA, 22 nt, Human
uucuaguucccacauaguugcc

SEQ ID NO: 452984 - RNA, 21 nt, Human
auccauccaucuuggccuaac

SEQ ID NO: 452985 - RNA, 22 nt, Human
uugauagguuuuauguauaguu

SEQ ID NO: 452986 - RNA, 21 nt, Human
uccuuccuugagguccuuucc

SEQ ID NO: 452987 - RNA, 22 nt, Human
agaaaugggccuugggacacaa

SEQ ID NO: 452988 - RNA, 22 nt, Human
ccuuccaggugcaggcaagccu

SEQ ID NO: 452989 - RNA, 22 nt, Human
caguggucugugcuucuguaca

SEQ ID NO: 452990 - RNA, 22 nt, Human
ggguaauuggggccuugcagug

SEQ ID NO: 452991 - RNA, 22 nt, Human
ugcuucaggagaugucaccaug

SEQ ID NO: 452992 - RNA, 22 nt, Human
caaugugucaggaaaagggcca

SEQ ID NO: 452993 - RNA, 22 nt, Human
uauuucugauugcucaugaggc

SEQ ID NO: 452994 - RNA, 20 nt, Human
cugccaugauugauagagug

SEQ ID NO: 452995 - RNA, 22 nt, Human
cuauugaaaguguacaauucaa

SEQ ID NO: 452996 - RNA, 22 nt, Human
aaaugcauguagaauaauagag

SEQ ID NO: 452997 - RNA, 22 nt, Human
uuagauaacaguagaauaucaa

SEQ ID NO: 452998 - RNA, 22 nt, Human
gcaggcaggcuuccuugaacug

SEQ ID NO: 452999 - RNA, 22 nt, Human
uggaggaaguggcuggccagaa

SEQ ID NO: 453000 - RNA, 22 nt, Human
cugacccauauaagaguggagg

SEQ ID NO: 453001 - RNA, 22 nt, Human
agcagagcccuuccauggccuu

SEQ ID NO: 453002 - RNA, 22 nt, Human
ugugcucuggaguugccuucac

SEQ ID NO: 453003 - RNA, 23 nt, Human
uuuuccagaaucgacucuguaga

SEQ ID NO: 453004 - RNA, 22 nt, Human
agguauagaauugaaaggguuu

SEQ ID NO: 453005 - RNA, 22 nt, Human
gcagagaguugggcugcgccag

SEQ ID NO: 453006 - RNA, 20 nt, Human
ggaccagguggggcgguggc

SEQ ID NO: 453007 - RNA, 20 nt, Human
aggcacuggauuucuuauau

SEQ ID NO: 453008 - RNA, 22 nt, Human
ugccaggcgugguggugcgcac

SEQ ID NO: 453009 - RNA, 21 nt, Human
ucagaguguguuacagcaagc

SEQ ID NO: 453010 - RNA, 22 nt, Human
ggcugcagauagccagccacca

SEQ ID NO: 453011 - RNA, 22 nt, Human
ucuggcucugaauucacuucug

SEQ ID NO: 453012 - RNA, 22 nt, Human
gucagagagggcacgugcacac

SEQ ID NO: 453013 - RNA, 19 nt, Human
ucucuggggacacuuucac

SEQ ID NO: 453014 - RNA, 22 nt, Human
cagagcaguccuugucaaucag

SEQ ID NO: 453015 - RNA, 22 nt, Human
aggauccuguauggagaagcug

SEQ ID NO: 453016 - RNA, 22 nt, Human
agaagcuugaaggagcagugac

SEQ ID NO: 453017 - RNA, 22 nt, Human
ccugggagggcaagugcugaug

SEQ ID NO: 453018 - RNA, 22 nt, Human
agcagggccuggcacuccuggg

SEQ ID NO: 453019 - RNA, 22 nt, Human
ucaaauaugugauagaagcuaa

SEQ ID NO: 453020 - RNA, 22 nt, Human
gagagggccgggggccagcucc

SEQ ID NO: 453021 - RNA, 22 nt, Human
uguugagacugagggagucagc

SEQ ID NO: 453022 - RNA, 22 nt, Human
uucaggaugcagagguuguagu

SEQ ID NO: 453023 - RNA, 22 nt, Human
ugucuuuauauauuuggaaaau

SEQ ID NO: 453024 - RNA, 22 nt, Human
agaaagcacucugucuuuuacc

SEQ ID NO: 453025 - RNA, 22 nt, Human
cagaguggcgacccccucagcu

SEQ ID NO: 453026 - RNA, 22 nt, Human
uaaaugugcacuuuacuuuuca

SEQ ID NO: 453027 - RNA, 20 nt, Human
auguagaugaaagcaaaggc

SEQ ID NO: 453028 - RNA, 19 nt, Human
aggagaagacucucucccc

SEQ ID NO: 453029 - RNA, 22 nt, Human
ugcauauuuguaugauguuuag

SEQ ID NO: 453030 - RNA, 22 nt, Human
uacuguauuugauaagugaagu

SEQ ID NO: 453031 - RNA, 22 nt, Human
ggagcagccgcgucucagggca

SEQ ID NO: 453032 - RNA, 22 nt, Human
cugaggcaguuuaauuuuugaa

SEQ ID NO: 453033 - RNA, 22 nt, Human
ucaugacaacuauauuauucca

SEQ ID NO: 453034 - RNA, 22 nt, Human
gccaccagggggugcaaggucc

SEQ ID NO: 453035 - RNA, 22 nt, Human
cagggacaugacuggucucugu

SEQ ID NO: 453036 - RNA, 22 nt, Human
uuucacaaguaaaguccuaagu

SEQ ID NO: 453037 - RNA, 22 nt, Human
uuaucacuuaugagcuuuuugc

SEQ ID NO: 453038 - RNA, 22 nt, Human
uuccucucucuugccagaaugu

SEQ ID NO: 453039 - RNA, 22 nt, Human
aacauuucagcaaauaagaaca

SEQ ID NO: 453040 - RNA, 22 nt, Human
gggcugccuuucuucugggagc

SEQ ID NO: 453041 - RNA, 22 nt, Human
cucagaguccauaguuuacagu

SEQ ID NO: 453042 - RNA, 22 nt, Human
aagaacauuuuguagaaugaca

SEQ ID NO: 453043 - RNA, 22 nt, Human
gggcugggauggcuugaagauu

SEQ ID NO: 453044 - RNA, 22 nt, Human
uuuugauaucaugaugaacaga

SEQ ID NO: 453045 - RNA, 22 nt, Human
gucacaggccuggaugaggggc

SEQ ID NO: 453046 - RNA, 22 nt, Human
uacauggugguggcacuugacu

SEQ ID NO: 453047 - RNA, 22 nt, Human
aguguacauguuuacagcaucu

SEQ ID NO: 453048 - RNA, 22 nt, Human
gagccuggauugucaccgacuu

SEQ ID NO: 453049 - RNA, 22 nt, Human
ucuggcuccacuuucuucauuu

SEQ ID NO: 453050 - RNA, 22 nt, Human
ucugcuguaaagaauuucugcc

SEQ ID NO: 453051 - RNA, 22 nt, Human
gcagcuuuaaucugaauaagua

SEQ ID NO: 453052 - RNA, 22 nt, Human
gggugggccugucuggccaugu

SEQ ID NO: 453053 - RNA, 22 nt, Human
acaagagacaagagguucuucu

SEQ ID NO: 453054 - RNA, 22 nt, Human
uguccuuuucuuuagugcagcu

SEQ ID NO: 453055 - RNA, 22 nt, Human
cccuggaggcggauguugcagu

SEQ ID NO: 453056 - RNA, 22 nt, Human
aaaucuaggcucauccuggucc

SEQ ID NO: 453057 - RNA, 22 nt, Human
ugccaggcccagcuccagagcu

SEQ ID NO: 453058 - RNA, 22 nt, Human
cugaagccacgauagcuuccua

SEQ ID NO: 453059 - RNA, 22 nt, Human
agugggcagugcgcucggaugc

SEQ ID NO: 453060 - RNA, 22 nt, Human
uauuucugggaguucagaaauu

SEQ ID NO: 453061 - RNA, 22 nt, Human
gcagaggccaucaacuuugcca

SEQ ID NO: 453062 - RNA, 22 nt, Human
acaaaauuaccuaguuauuuuc

SEQ ID NO: 453063 - RNA, 22 nt, Human
agaggaggcagcuuaacucagu

SEQ ID NO: 453064 - RNA, 22 nt, Human
acaaaguccugguguauggcca

SEQ ID NO: 453065 - RNA, 20 nt, Human
uucauucauuccacaacuuc

SEQ ID NO: 453066 - RNA, 22 nt, Human
uggcucagugcauucacaguaa

SEQ ID NO: 453067 - RNA, 22 nt, Human
uucucauucugacucaguguag

SEQ ID NO: 453068 - RNA, 22 nt, Human
ucacugcugcugccaugaugga

SEQ ID NO: 453069 - RNA, 22 nt, Human
aguggggaagagcaugggcccu

SEQ ID NO: 453070 - RNA, 22 nt, Human
ugccagaagugcuuuauaagug

SEQ ID NO: 453071 - RNA, 22 nt, Human
ugaggcucaagaauagacagua

SEQ ID NO: 453072 - RNA, 21 nt, Human
ugaaugaggaggauggcauuu

SEQ ID NO: 453073 - RNA, 22 nt, Human
ugcuccauucucuagccagugc

SEQ ID NO: 453074 - RNA, 22 nt, Human
cauugcucaggcccagcaggaa

SEQ ID NO: 453075 - RNA, 22 nt, Human
ugugcagcucuagagccaagcc

SEQ ID NO: 453076 - RNA, 22 nt, Human
aaacagacugaagaguugaagc

SEQ ID NO: 453077 - RNA, 22 nt, Human
ucaggcagcuccaggaauggua

SEQ ID NO: 453078 - RNA, 22 nt, Human
cauugcacugcagcccgggcaa

SEQ ID NO: 453079 - RNA, 22 nt, Human
gcaggcuccaggccggccccuu

SEQ ID NO: 453080 - RNA, 22 nt, Human
agggaagaaaauccaucgcugc

SEQ ID NO: 453081 - RNA, 22 nt, Human
ugagcuuccucccugcauccau

SEQ ID NO: 453082 - RNA, 22 nt, Human
ccucccaccauuuagagagagc

SEQ ID NO: 453083 - RNA, 22 nt, Human
gcauuuagcuuuaaaauauuuc

SEQ ID NO: 453084 - RNA, 22 nt, Human
agcauuuaugacuaauguaaaa

SEQ ID NO: 453085 - RNA, 22 nt, Human
ggcucugcgcgguaaagugacu

SEQ ID NO: 453086 - RNA, 17 nt, Human
agggacagcaguuuagg

SEQ ID NO: 453087 - RNA, 22 nt, Human
acaucucaugaaugauaaauca

SEQ ID NO: 453088 - RNA, 22 nt, Human
gcagggugaaggucacauagaa

SEQ ID NO: 453089 - RNA, 22 nt, Human
auaauuuacaacugcuuuuaau

SEQ ID NO: 453090 - RNA, 22 nt, Human
gcaggugaaugauggacuagga

SEQ ID NO: 453091 - RNA, 23 nt, Human
ccaggcaguagcuauugaaguga

SEQ ID NO: 453092 - RNA, 22 nt, Human
acucaggaaauugagauaaugg

SEQ ID NO: 453093 - RNA, 18 nt, Human
uauauuucacacauauuc

SEQ ID NO: 453094 - RNA, 22 nt, Human
acuguccauucacucauauuca

SEQ ID NO: 453095 - RNA, 22 nt, Human
guggggaaaggaguggggcuca

SEQ ID NO: 453096 - RNA, 22 nt, Human
ucugagaggauuccugucccga

SEQ ID NO: 453097 - RNA, 22 nt, Human
ggcaggcaggagcgugcuuggg

SEQ ID NO: 453098 - RNA, 22 nt, Human
uaaaguucagugcaugaaugug

SEQ ID NO: 453099 - RNA, 22 nt, Human
aucuacagcugucugcacagua

SEQ ID NO: 453100 - RNA, 22 nt, Human
agagugaaguuuuugaaaguga

SEQ ID NO: 453101 - RNA, 22 nt, Human
uaguuucauaugcaaaauagua

SEQ ID NO: 453102 - RNA, 22 nt, Human
uccuggagauaauugcagugaa

SEQ ID NO: 453103 - RNA, 22 nt, Human
ggcccugggaugcucagcagug

SEQ ID NO: 453104 - RNA, 22 nt, Human
cauucauuagaauagauaugua

SEQ ID NO: 453105 - RNA, 22 nt, Human
aggcugcuggcaggcguggacg

SEQ ID NO: 453106 - RNA, 22 nt, Human
uggcccugacagguccugggca

SEQ ID NO: 453107 - RNA, 22 nt, Human
uguaggccuauguccagcaauu

SEQ ID NO: 453108 - RNA, 22 nt, Human
aucuagaaaguguugaagauca

SEQ ID NO: 453109 - RNA, 22 nt, Human
uccaggcagucauuaaucucua

SEQ ID NO: 453110 - RNA, 22 nt, Human
guucaaggaagggaggaaagcc

SEQ ID NO: 453111 - RNA, 22 nt, Human
uccuucaggccucauucucaua

SEQ ID NO: 453112 - RNA, 22 nt, Human
cugggaggacaacuuggagcuc

SEQ ID NO: 453113 - RNA, 22 nt, Human
caagagcucccagaccugggca

SEQ ID NO: 453114 - RNA, 23 nt, Human
ccagcugugccuggcccaggagc

SEQ ID NO: 453115 - RNA, 23 nt, Human
ugcauuauccucucugaagacca

SEQ ID NO: 453116 - RNA, 22 nt, Human
agggggcccuugcaggugagcg

SEQ ID NO: 453117 - RNA, 22 nt, Human
cagugaggaguccagggcagag

SEQ ID NO: 453118 - RNA, 22 nt, Human
aaguucaauggaaaagcuuuag

SEQ ID NO: 453119 - RNA, 22 nt, Human
ggcucccugccuguccucaguc

SEQ ID NO: 453120 - RNA, 22 nt, Human
acacaugagaaacaucaguugu

SEQ ID NO: 453121 - RNA, 22 nt, Human
uggagccaggagccugggaguc

SEQ ID NO: 453122 - RNA, 22 nt, Human
gaggcaguuugccaugccagga

SEQ ID NO: 453123 - RNA, 21 nt, Human
gcugucucuggcuccugggaa

SEQ ID NO: 453124 - RNA, 22 nt, Human
auguacaguuucuagacucaaa

SEQ ID NO: 453125 - RNA, 22 nt, Human
gcuguggcuugcagcuggggcu

SEQ ID NO: 453126 - RNA, 22 nt, Human
ggaggccaguccuggccgggcu

SEQ ID NO: 453127 - RNA, 22 nt, Human
gcaaaugaguuguaacauaaaa

SEQ ID NO: 453128 - RNA, 22 nt, Human
gcagccacacuguuacagaaug

SEQ ID NO: 453129 - RNA, 22 nt, Human
ugauuuccaauaaggagaaugu

SEQ ID NO: 453130 - RNA, 20 nt, Human
ucugcucagcccucaguggc

SEQ ID NO: 453131 - RNA, 22 nt, Human
cuuccucacggugcaacaggaa

SEQ ID NO: 453132 - RNA, 22 nt, Human
ugcagggcaguuuguuucggca

SEQ ID NO: 453133 - RNA, 22 nt, Human
ucuuccugaaacccuguuccag

SEQ ID NO: 453134 - RNA, 22 nt, Human
agaugguuuugucuuuaugauu

SEQ ID NO: 453135 - RNA, 18 nt, Human
ggccugaggauuucagca

SEQ ID NO: 453136 - RNA, 22 nt, Human
auccaguuuaugucauauucuu

SEQ ID NO: 453137 - RNA, 20 nt, Human
ucagaugggagugagccauc

SEQ ID NO: 453138 - RNA, 22 nt, Human
cccaguggagauaggagugugg

SEQ ID NO: 453139 - RNA, 22 nt, Human
aaguuauuuccucgugacugaa

SEQ ID NO: 453140 - RNA, 22 nt, Human
gucucuuuuauggugaguugau

SEQ ID NO: 453141 - RNA, 22 nt, Human
ggcccucccugagccagguggg

SEQ ID NO: 453142 - RNA, 22 nt, Human
agagcccugaagcagagcuaaa

SEQ ID NO: 453143 - RNA, 22 nt, Human
cagccaggccuggugaccaaag

SEQ ID NO: 453144 - RNA, 22 nt, Human
ugaguccauguggaggggaggu

SEQ ID NO: 453145 - RNA, 22 nt, Human
agggcugcaggcaagauauggc

SEQ ID NO: 453146 - RNA, 21 nt, Human
uagagaaaagaagcuguuccu

SEQ ID NO: 453147 - RNA, 22 nt, Human
agaccaagugcaggugccacua

SEQ ID NO: 453148 - RNA, 22 nt, Human
ucaaacuagccugacugguauu

SEQ ID NO: 453149 - RNA, 22 nt, Human
guuuuacacaccuaugaaagac

SEQ ID NO: 453150 - RNA, 22 nt, Human
caucagcagucacaugaugcug

SEQ ID NO: 453151 - RNA, 22 nt, Human
ucuguccuguuuccuccugaca

SEQ ID NO: 453152 - RNA, 22 nt, Human
cauugcaccacauugcaucccu

SEQ ID NO: 453153 - RNA, 22 nt, Human
caggccugaguguggaagucuu

SEQ ID NO: 453154 - RNA, 23 nt, Human
gggcagguuuuuauaggcuucag

SEQ ID NO: 453155 - RNA, 20 nt, Human
cacaggcuauaugagagcca

SEQ ID NO: 453156 - RNA, 22 nt, Human
uugaaaguagcagcugcauaug

SEQ ID NO: 453157 - RNA, 22 nt, Human
agccuggcuguaaccucauggu

SEQ ID NO: 453158 - RNA, 22 nt, Human
uccaggcaguuuuccagguugu

SEQ ID NO: 453159 - RNA, 22 nt, Human
ucagcuuuuuacaugugaaaua

SEQ ID NO: 453160 - RNA, 22 nt, Human
uuugcuauaaaagggucacacg

SEQ ID NO: 453161 - RNA, 22 nt, Human
cucacugacgaggaagcugaga

SEQ ID NO: 453162 - RNA, 22 nt, Human
ugaaacaaaaguauguagcuug

SEQ ID NO: 453163 - RNA, 22 nt, Human
auuguacagaugagguaaguga

SEQ ID NO: 453164 - RNA, 22 nt, Human
ucuggcuccacaccucacugca

SEQ ID NO: 453165 - RNA, 22 nt, Human
cagaaacuauguaagaaaguga

SEQ ID NO: 453166 - RNA, 22 nt, Human
uugaaagugccaaguccuagug

SEQ ID NO: 453167 - RNA, 22 nt, Human
ugccaggcccucccacagauua

SEQ ID NO: 453168 - RNA, 22 nt, Human
gcccugcugucuucagaguaua

SEQ ID NO: 453169 - RNA, 22 nt, Human
ggacccugggcuugcuccuggg

SEQ ID NO: 453170 - RNA, 22 nt, Human
caggggccggcuguccgugccc

SEQ ID NO: 453171 - RNA, 22 nt, Human
gcuggggcugggcugaggaaga

SEQ ID NO: 453172 - RNA, 21 nt, Human
uccacaaguuagaaggaaauu

SEQ ID NO: 453173 - RNA, 22 nt, Human
guuccacaaaauguacccaguu

SEQ ID NO: 453174 - RNA, 22 nt, Human
aaaucuggccccuugccuauuu

SEQ ID NO: 453175 - RNA, 22 nt, Human
ugcagggauuguuggcauccau

SEQ ID NO: 453176 - RNA, 23 nt, Human
gugcucugcggucugcuagucug

SEQ ID NO: 453177 - RNA, 22 nt, Human
aguuuuucugggaggcacugcu

SEQ ID NO: 453178 - RNA, 22 nt, Human
ggggaccuuuccauuucugaga

SEQ ID NO: 453179 - RNA, 23 nt, Human
ugugaagguggguccaagggcug

SEQ ID NO: 453180 - RNA, 22 nt, Human
cuguccugauggugccacuggu

SEQ ID NO: 453181 - RNA, 22 nt, Human
aaggagaaaugguagaugugca

SEQ ID NO: 453182 - RNA, 22 nt, Human
ccucaggauacaggagccacag

SEQ ID NO: 453183 - RNA, 22 nt, Human
ugggggucaggaugaggccuug

SEQ ID NO: 453184 - RNA, 22 nt, Human
ggcuggcucagggcuugagaga

SEQ ID NO: 453185 - RNA, 22 nt, Human
uggaccugaagaauaggaagua

SEQ ID NO: 453186 - RNA, 22 nt, Human
ggcugcuucucacucauuugca

SEQ ID NO: 453187 - RNA, 22 nt, Human
ucagccucucugaguccagacc

SEQ ID NO: 453188 - RNA, 22 nt, Human
agcuguggcagcagccguggca

SEQ ID NO: 453189 - RNA, 22 nt, Human
cugucuguuucugauucaaccu

SEQ ID NO: 453190 - RNA, 22 nt, Human
agcugagcuaguaguuccagug

SEQ ID NO: 453191 - RNA, 21 nt, Human
ugaggccucuccugggcuggc

SEQ ID NO: 453192 - RNA, 22 nt, Human
uccugcagcugcagaccugggg

SEQ ID NO: 453193 - RNA, 22 nt, Human
ugaguccacuuuaaaaugucag

SEQ ID NO: 453194 - RNA, 22 nt, Human
ucuggauggucagcucuuccug

SEQ ID NO: 453195 - RNA, 22 nt, Human
aacaucagaauauccauguugg

SEQ ID NO: 453196 - RNA, 22 nt, Human
agggcagagaucugagugggca

SEQ ID NO: 453197 - RNA, 22 nt, Human
agaaggcagaugggacggagca

SEQ ID NO: 453198 - RNA, 22 nt, Human
uccugaggcacaauccuagaau

SEQ ID NO: 453199 - RNA, 22 nt, Human
agugaagaggaaguggggcaca

SEQ ID NO: 453200 - RNA, 22 nt, Human
gaguuauuaauggcugaguuug

SEQ ID NO: 453201 - RNA, 22 nt, Human
agcugaggcucugagagggaag

SEQ ID NO: 453202 - RNA, 22 nt, Human
gaaggcaggcuucugauuaggu

SEQ ID NO: 453203 - RNA, 22 nt, Human
ugccucuguggaaauggugguc

SEQ ID NO: 453204 - RNA, 22 nt, Human
gagaaacuuggaguuauucugg

SEQ ID NO: 453205 - RNA, 21 nt, Human
agacagagugcagucuacaua

SEQ ID NO: 453206 - RNA, 22 nt, Human
cuccagaagacccauccucaug

SEQ ID NO: 453207 - RNA, 22 nt, Human
ccaggaaugaaauguagauaaa

SEQ ID NO: 453208 - RNA, 22 nt, Human
uggacagguugaguaggaggag

SEQ ID NO: 453209 - RNA, 22 nt, Human
uugacacagaucaauauucaac

SEQ ID NO: 453210 - RNA, 23 nt, Human
aguuuuucugcaugguucuguau

SEQ ID NO: 453211 - RNA, 22 nt, Human
gucaggauuuuaaaaucccagu

SEQ ID NO: 453212 - RNA, 22 nt, Human
cuguccuugcuggccagguaug

SEQ ID NO: 453213 - RNA, 22 nt, Human
ggcugaaguguaguggcucacu

SEQ ID NO: 453214 - RNA, 22 nt, Human
cacaggagaacccacagauucu

SEQ ID NO: 453215 - RNA, 22 nt, Human
ugcauauuauguguaucugucu

SEQ ID NO: 453216 - RNA, 22 nt, Human
ggcagaggugacagugucuuuu

SEQ ID NO: 453217 - RNA, 20 nt, Human
cugagcccccagccugcagg

SEQ ID NO: 453218 - RNA, 22 nt, Human
ggagucaccaaguaggagucuu

SEQ ID NO: 453219 - RNA, 22 nt, Human
cacaaaauaucaagcacuuuua

SEQ ID NO: 453220 - RNA, 22 nt, Human
ggcugccagugagugcagaccg

SEQ ID NO: 453221 - RNA, 22 nt, Human
cucagaaucugccaaguucagg

SEQ ID NO: 453222 - RNA, 22 nt, Human
uuaguuagucccugguaccuuu

SEQ ID NO: 453223 - RNA, 22 nt, Human
gcuuuaaaccucuacucugucc

SEQ ID NO: 453224 - RNA, 18 nt, Human
ugacucacccugucagug

SEQ ID NO: 453225 - RNA, 22 nt, Human
agaguggagagaaacaacucug

SEQ ID NO: 453226 - RNA, 22 nt, Human
gccuaauaugcaaaauugauac

SEQ ID NO: 453227 - RNA, 22 nt, Human
acagcuggcaggggggcaugaa

SEQ ID NO: 453228 - RNA, 22 nt, Human
ugaacccaggagguugcaguga

SEQ ID NO: 453229 - RNA, 22 nt, Human
gacagcauggugucuguucagg

SEQ ID NO: 453230 - RNA, 22 nt, Human
uccuggaggcaaaugagcacau

SEQ ID NO: 453231 - RNA, 18 nt, Human
ucagagagaauaguaauu

SEQ ID NO: 453232 - RNA, 22 nt, Human
ccagcugcgggcaucgagaguu

SEQ ID NO: 453233 - RNA, 22 nt, Human
gaggccuguagucauggaugua

SEQ ID NO: 453234 - RNA, 22 nt, Human
aacuguaaggcuuagaacagca

SEQ ID NO: 453235 - RNA, 22 nt, Human
ugguuuugcuccaguauaaaua

SEQ ID NO: 453236 - RNA, 22 nt, Human
ugcaauaacccaguaucuguga

SEQ ID NO: 453237 - RNA, 22 nt, Human
ugggcuacucugggagccuaac

SEQ ID NO: 453238 - RNA, 22 nt, Human
ggggcagagcauagcuccaauu

SEQ ID NO: 453239 - RNA, 22 nt, Human
uggcuuccacugugugcccccu

SEQ ID NO: 453240 - RNA, 18 nt, Human
cagauccaggcagcuauu

SEQ ID NO: 453241 - RNA, 22 nt, Human
gcagcugauggaaguccuauug

SEQ ID NO: 453242 - RNA, 22 nt, Human
gcaccugggcaaggauucagag

SEQ ID NO: 453243 - RNA, 22 nt, Human
caggauggccccggggcugugc

SEQ ID NO: 453244 - RNA, 23 nt, Human
cccagcuuucccacugccgagag

SEQ ID NO: 453245 - RNA, 22 nt, Human
gcagagcuccccaagacaccaa

SEQ ID NO: 453246 - RNA, 22 nt, Human
uccagggaagagcagaggcuac

SEQ ID NO: 453247 - RNA, 22 nt, Human
uuaauaaacaggugcagcugaa

SEQ ID NO: 453248 - RNA, 22 nt, Human
augaagcugaccuugucuugcu

SEQ ID NO: 453249 - RNA, 22 nt, Human
cagcauugaucccaggcugugg

SEQ ID NO: 453250 - RNA, 22 nt, Human
aguuuuuccugauuuuacagaa

SEQ ID NO: 453251 - RNA, 20 nt, Human
cuccagggaacagacuggag

SEQ ID NO: 453252 - RNA, 19 nt, Human
ccagaggacuguuaaugaa

SEQ ID NO: 453253 - RNA, 22 nt, Human
acagaguagcucaagaagauug

SEQ ID NO: 453254 - RNA, 22 nt, Human
auuucugauaaacguaagcugc

SEQ ID NO: 453255 - RNA, 22 nt, Human
aagguacaaaguauuauuuaaa

SEQ ID NO: 453256 - RNA, 22 nt, Human
agggccagagucuguguagaua

SEQ ID NO: 453257 - RNA, 22 nt, Human
gccagagguucaacaacugucu

SEQ ID NO: 453258 - RNA, 22 nt, Human
uggggcucaccuaggcuggaag

SEQ ID NO: 453259 - RNA, 22 nt, Human
aaauacaguguguguucuuuga

SEQ ID NO: 453260 - RNA, 22 nt, Human
cucagcagcagggaagagguca

SEQ ID NO: 453261 - RNA, 22 nt, Human
auguucaaacuuuuuacacacc

SEQ ID NO: 453262 - RNA, 22 nt, Human
cucuuaguuuaucuuugacaaa

SEQ ID NO: 453263 - RNA, 22 nt, Human
ggcucugccugcccagcagcac

SEQ ID NO: 453264 - RNA, 22 nt, Human
ugagcuucuuuauuuggccaga

SEQ ID NO: 453265 - RNA, 22 nt, Human
ucagggcaagucucagaagguu

SEQ ID NO: 453266 - RNA, 22 nt, Human
ugcacacacgcggcacaucugu

SEQ ID NO: 453267 - RNA, 22 nt, Human
ucagugucuugggcuugaaugc

SEQ ID NO: 453268 - RNA, 22 nt, Human
cagcugccaagaaucuuuucua

SEQ ID NO: 453269 - RNA, 22 nt, Human
cagaguguuagcgcugguuggg

SEQ ID NO: 453270 - RNA, 22 nt, Human
uacugccuggagcauuggugcu

SEQ ID NO: 453271 - RNA, 22 nt, Human
gcugugcagauguagggagugg

SEQ ID NO: 453272 - RNA, 22 nt, Human
cucagggcuugaguguccagga

SEQ ID NO: 453273 - RNA, 22 nt, Human
ugcagaggagcuggaaggcugg

SEQ ID NO: 453274 - RNA, 22 nt, Human
acucaggaauggggcugggacu

SEQ ID NO: 453275 - RNA, 22 nt, Human
aaggccugggaggccucucuuc

SEQ ID NO: 453276 - RNA, 22 nt, Human
aucugccucuucuucauugcga

SEQ ID NO: 453277 - RNA, 22 nt, Human
ggccaccuuccaguugccugca

SEQ ID NO: 453278 - RNA, 22 nt, Human
acccugagucagacagccugac

SEQ ID NO: 453279 - RNA, 20 nt, Human
accaggagauggaggcaggg

SEQ ID NO: 453280 - RNA, 22 nt, Human
cuuauguaaacuacagauaaua

SEQ ID NO: 453281 - RNA, 22 nt, Human
ugggcugcugucugcacaugcu

SEQ ID NO: 453282 - RNA, 22 nt, Human
ucugucugcaccuaagcacagu

SEQ ID NO: 453283 - RNA, 22 nt, Human
gcauuguccugcuucugagugu

SEQ ID NO: 453284 - RNA, 22 nt, Human
aauauguuccacuuaaagcugg

SEQ ID NO: 453285 - RNA, 22 nt, Human
accucugcucaagaccccuccg

SEQ ID NO: 453286 - RNA, 22 nt, Human
cagauaaaggcuuacuaguagu

SEQ ID NO: 453287 - RNA, 22 nt, Human
aucaggaucugggagccugaaa

SEQ ID NO: 453288 - RNA, 22 nt, Human
agagcugugcuuugcaccacgu

SEQ ID NO: 453289 - RNA, 22 nt, Human
uaggccagaggagcagcuuugg

SEQ ID NO: 453290 - RNA, 22 nt, Human
gcaagcugcuuaagcucauugu

SEQ ID NO: 453291 - RNA, 22 nt, Human
cagggcccaggccacuggguug

SEQ ID NO: 453292 - RNA, 22 nt, Human
ccagcagcagcguccaaggaga

SEQ ID NO: 453293 - RNA, 18 nt, Human
uggagcugagugcugugc

SEQ ID NO: 453294 - RNA, 22 nt, Human
gggcuccagcccgggaccaggu

SEQ ID NO: 453295 - RNA, 22 nt, Human
ccagguggcuucugcccgaugu

SEQ ID NO: 453296 - RNA, 22 nt, Human
gggagggaggugcugguucacg

SEQ ID NO: 453297 - RNA, 22 nt, Human
ccucuggggugagugggccacu

SEQ ID NO: 453298 - RNA, 20 nt, Human
aggcugccaggucucacauc

SEQ ID NO: 453299 - RNA, 22 nt, Human
acuaaggaauaugacaaacuca

SEQ ID NO: 453300 - RNA, 22 nt, Human
uugccuugauucuucucaugug

SEQ ID NO: 453301 - RNA, 22 nt, Human
aagccaggcaugcuuggacagu

SEQ ID NO: 453302 - RNA, 22 nt, Human
ggaggaccccagcagcucccca

SEQ ID NO: 453303 - RNA, 22 nt, Human
ccuggcuuccuggagcucacaa

SEQ ID NO: 453304 - RNA, 22 nt, Human
ugugccauuucuauucugcagc

SEQ ID NO: 453305 - RNA, 22 nt, Human
gccuccccugcaauuguccuug

SEQ ID NO: 453306 - RNA, 22 nt, Human
ccuggcagcuaagugcuuugag

SEQ ID NO: 453307 - RNA, 22 nt, Human
aaaguguagagacuuuggaacc

SEQ ID NO: 453308 - RNA, 19 nt, Human
agcuguggaugugggauuu

SEQ ID NO: 453309 - RNA, 22 nt, Human
gucaccaggucugaugcagcca

SEQ ID NO: 453310 - RNA, 22 nt, Human
gcuguacauucuguggguuugg

SEQ ID NO: 453311 - RNA, 22 nt, Human
cgggcagauugggaagguucau

SEQ ID NO: 453312 - RNA, 22 nt, Human
ucuuugcaugugcuucuuggcc

SEQ ID NO: 453313 - RNA, 22 nt, Human
agccuggaccaggggccucaga

SEQ ID NO: 453314 - RNA, 22 nt, Human
gccagagguaucaaagauagua

SEQ ID NO: 453315 - RNA, 22 nt, Human
uuccgcuggggccgccuggcgg

SEQ ID NO: 453316 - RNA, 22 nt, Human
cauuagggucucucagcugaau

SEQ ID NO: 453317 - RNA, 22 nt, Human
cuggagagaaaugacaaagcua

SEQ ID NO: 453318 - RNA, 22 nt, Human
ucucagagaucuuucugcaugu

SEQ ID NO: 453319 - RNA, 22 nt, Human
gaguccagacaccauaccugau

SEQ ID NO: 453320 - RNA, 21 nt, Human
gcagagccugagguucuugag

SEQ ID NO: 453321 - RNA, 22 nt, Human
ugucagugguagacccagaggu

SEQ ID NO: 453322 - RNA, 22 nt, Human
cauggcagugauucagccuuug

SEQ ID NO: 453323 - RNA, 22 nt, Human
uggcccugcuggccaaaggcua

SEQ ID NO: 453324 - RNA, 22 nt, Human
uauugucuguccgggucaaagc

SEQ ID NO: 453325 - RNA, 22 nt, Human
gcaggggcugagcaccagcggg

SEQ ID NO: 453326 - RNA, 22 nt, Human
uacugugaauacaaaauaaauu

SEQ ID NO: 453327 - RNA, 22 nt, Human
cagggucuuauaaggccaauuu

SEQ ID NO: 453328 - RNA, 22 nt, Human
gucauuucuguuucuucagugc

SEQ ID NO: 453329 - RNA, 22 nt, Human
acugaaggcuuucccaagguca

SEQ ID NO: 453330 - RNA, 22 nt, Human
ggaggccaucagggagggcauu

SEQ ID NO: 453331 - RNA, 22 nt, Human
gaggcucacuaggcauccuggg

SEQ ID NO: 453332 - RNA, 23 nt, Human
augcucugggcugugggaccugc

SEQ ID NO: 453333 - RNA, 22 nt, Human
ugagggaggcccuuugagcaga

SEQ ID NO: 453334 - RNA, 22 nt, Human
cacaggagcuguggggcagugu

SEQ ID NO: 453335 - RNA, 22 nt, Human
uccuggcccacuaugccagcau

SEQ ID NO: 453336 - RNA, 22 nt, Human
ugggccaggauuucaagacccu

SEQ ID NO: 453337 - RNA, 22 nt, Human
acuugguugaugucauaagguu

SEQ ID NO: 453338 - RNA, 22 nt, Human
aaugaugguuucaucacuugaa

SEQ ID NO: 453339 - RNA, 22 nt, Human
gcaagcuggcuguuagaggaug

SEQ ID NO: 453340 - RNA, 22 nt, Human
uuugaaagggacaaagucacug

SEQ ID NO: 453341 - RNA, 22 nt, Human
ccugugucagccccugccucca

SEQ ID NO: 453342 - RNA, 22 nt, Human
ugcuuuauucaggguuuacccc

SEQ ID NO: 453343 - RNA, 22 nt, Human
gcccagcuuuuugaggcaggca

SEQ ID NO: 453344 - RNA, 21 nt, Human
uggagcugaauuuuuggcauc

SEQ ID NO: 453345 - RNA, 22 nt, Human
acaguaaaucaacagaauaucu

SEQ ID NO: 453346 - RNA, 22 nt, Human
gggccuggcaugcagccccguu

SEQ ID NO: 453347 - RNA, 22 nt, Human
uugggguguuggauggagcaag

SEQ ID NO: 453348 - RNA, 22 nt, Human
agcuggguguguaucagauaaa

SEQ ID NO: 453349 - RNA, 22 nt, Human
ccaggccuucugaggacacucu

SEQ ID NO: 453350 - RNA, 18 nt, Human
cugaggcuggcaggagcc

SEQ ID NO: 453351 - RNA, 22 nt, Human
ugcccaggauugugaggucagg

SEQ ID NO: 453352 - RNA, 22 nt, Human
cagagcugcagauugaaggcau

SEQ ID NO: 453353 - RNA, 22 nt, Human
gaauacaaauaauaccaaggug

SEQ ID NO: 453354 - RNA, 22 nt, Human
uauaucaccaaaaacaguucug

SEQ ID NO: 453355 - RNA, 22 nt, Human
ugcuguggcaguuuauguauag

SEQ ID NO: 453356 - RNA, 22 nt, Human
ucuaccacuuauuagcucugug

SEQ ID NO: 453357 - RNA, 22 nt, Human
uuaauuuuaaccuguuuguguc

SEQ ID NO: 453358 - RNA, 22 nt, Human
acugccuugaaagauuguugag

SEQ ID NO: 453359 - RNA, 22 nt, Human
acccaggaugauaauguucaca

SEQ ID NO: 453360 - RNA, 22 nt, Human
ucaaugaugcugaagguagcgu

SEQ ID NO: 453361 - RNA, 19 nt, Human
acagaaauuaguuauuuuc

SEQ ID NO: 453362 - RNA, 23 nt, Human
uccagggauuaaugaagucaguc

SEQ ID NO: 453363 - RNA, 22 nt, Human
auaauuuaauuuucacaguggu

SEQ ID NO: 453364 - RNA, 22 nt, Human
ugcagggccaugguggcggcug

SEQ ID NO: 453365 - RNA, 22 nt, Human
aaauuucuguuguuuugagcca

SEQ ID NO: 453366 - RNA, 22 nt, Human
aguaucaaggaucuccagcacc

SEQ ID NO: 453367 - RNA, 17 nt, Human
uuccccugaccaagccu

SEQ ID NO: 453368 - RNA, 20 nt, Human
ugcuguaagauuagagagcu

SEQ ID NO: 453369 - RNA, 22 nt, Human
aaacuguaggagggaaaggaag

SEQ ID NO: 453370 - RNA, 22 nt, Human
uucugggacaucuggacaguuu

SEQ ID NO: 453371 - RNA, 22 nt, Human
uuuccucugagugagcugggag

SEQ ID NO: 453372 - RNA, 21 nt, Human
ggagggcagcccagacuggcu

SEQ ID NO: 453373 - RNA, 22 nt, Human
ucuuuccauggccacacagucu

SEQ ID NO: 453374 - RNA, 22 nt, Human
cagggugccuguccucagcaaa

SEQ ID NO: 453375 - RNA, 22 nt, Human
agcauuuauuucuuagaaauug

SEQ ID NO: 453376 - RNA, 21 nt, Human
uggccaaaaccauauuauuaa

SEQ ID NO: 453377 - RNA, 22 nt, Human
cuaauacucauuucuguaacuc

SEQ ID NO: 453378 - RNA, 22 nt, Human
acaggcauauuucuagauuaca

SEQ ID NO: 453379 - RNA, 22 nt, Human
agucccagaucuacaggaggga

SEQ ID NO: 453380 - RNA, 22 nt, Human
agcuguggcaaccuugucagac

SEQ ID NO: 453381 - RNA, 22 nt, Human
aggggacacggcuucuccaggg

SEQ ID NO: 453382 - RNA, 22 nt, Human
ggcuccuggcaucuggugggua

SEQ ID NO: 453383 - RNA, 21 nt, Human
ugucagagcuuguaggacauu

SEQ ID NO: 453384 - RNA, 22 nt, Human
gagccuggauagccuuguucca

SEQ ID NO: 453385 - RNA, 22 nt, Human
gcucugagucucagcuaccaca

SEQ ID NO: 453386 - RNA, 22 nt, Human
uuugaacaugcugcaugauaau

SEQ ID NO: 453387 - RNA, 22 nt, Human
cacaaaaguaggaggcaggcgg

SEQ ID NO: 453388 - RNA, 22 nt, Human
gccuguuggugacuuucuguug

SEQ ID NO: 453389 - RNA, 22 nt, Human
ggcuugcuucuuguccaggaau

SEQ ID NO: 453390 - RNA, 22 nt, Human
ggcugugccucaaggcuacuca

SEQ ID NO: 453391 - RNA, 23 nt, Human
uggcucugagagguucagaugcu

SEQ ID NO: 453392 - RNA, 22 nt, Human
cagcagcugauggggaagugau

SEQ ID NO: 453393 - RNA, 22 nt, Human
ccacagcaugcaggccugacac

SEQ ID NO: 453394 - RNA, 22 nt, Human
ucugagcuuuuauuaucaaccu

SEQ ID NO: 453395 - RNA, 23 nt, Human
cccagcgcugagcccugcaggca

SEQ ID NO: 453396 - RNA, 22 nt, Human
cuggacuuuggcccaucugcca

SEQ ID NO: 453397 - RNA, 22 nt, Human
caggcagccugcggucugcaca

SEQ ID NO: 453398 - RNA, 22 nt, Human
gaguuguucaacgugugugaaa

SEQ ID NO: 453399 - RNA, 22 nt, Human
guguuaaccagcuaaacuuugc

SEQ ID NO: 453400 - RNA, 22 nt, Human
acagcacaaucugagucccaga

SEQ ID NO: 453401 - RNA, 22 nt, Human
gccucacugcagccccaggaag

SEQ ID NO: 453402 - RNA, 18 nt, Human
guaggucaguaccaagca

SEQ ID NO: 453403 - RNA, 22 nt, Human
agagcagguggcaacucuggga

SEQ ID NO: 453404 - RNA, 22 nt, Human
cacaguggauugggugaugccc

SEQ ID NO: 453405 - RNA, 22 nt, Human
ccucccacauugaggacaugcu

SEQ ID NO: 453406 - RNA, 22 nt, Human
gaggccugguuuccagcauccu

SEQ ID NO: 453407 - RNA, 22 nt, Human
auccagcuuugucuggucuucg

SEQ ID NO: 453408 - RNA, 22 nt, Human
ccagcucucagcgggagacuca

SEQ ID NO: 453409 - RNA, 22 nt, Human
uuuuaucuaccuaugcucauuu

SEQ ID NO: 453410 - RNA, 22 nt, Human
aagcagugcgcucaucuaaggg

SEQ ID NO: 453411 - RNA, 22 nt, Human
uggagggcucuuucaccuggua

SEQ ID NO: 453412 - RNA, 22 nt, Human
ccagggcagaaaaagagggaau

SEQ ID NO: 453413 - RNA, 22 nt, Human
cagcuuuccagagaccugcccc

SEQ ID NO: 453414 - RNA, 22 nt, Human
uccuccuucgggacugcuugac

SEQ ID NO: 453415 - RNA, 22 nt, Human
acacugaagagcacuuucaaag

SEQ ID NO: 453416 - RNA, 22 nt, Human
ucagcagcagcucagcauguuu

SEQ ID NO: 453417 - RNA, 22 nt, Human
ggugcccaccugucuuccugga

SEQ ID NO: 453418 - RNA, 22 nt, Human
caggcagaguuagugauuuagg

SEQ ID NO: 453419 - RNA, 22 nt, Human
uccugucugucuuuggucccuu

SEQ ID NO: 453420 - RNA, 22 nt, Human
auggcagauggcuggagcaggu

SEQ ID NO: 453421 - RNA, 22 nt, Human
acuuugcaaugggcagaaccca

SEQ ID NO: 453422 - RNA, 22 nt, Human
aucagcaagcauuuauugagug

SEQ ID NO: 453423 - RNA, 22 nt, Human
guccuggggaauacagaagccg

SEQ ID NO: 453424 - RNA, 22 nt, Human
auuagcugaccucuaaggagcc

SEQ ID NO: 453425 - RNA, 22 nt, Human
uacagagaguacagcauccaca

SEQ ID NO: 453426 - RNA, 22 nt, Human
cagcagagacgguaagcagaac

SEQ ID NO: 453427 - RNA, 22 nt, Human
uuuuauuggagugauaccaagc

SEQ ID NO: 453428 - RNA, 22 nt, Human
cagucucugugccagauccugg

SEQ ID NO: 453429 - RNA, 19 nt, Human
cuggcucuuggguggagga

SEQ ID NO: 453430 - RNA, 22 nt, Human
caggcccagugaucagggcucu

SEQ ID NO: 453431 - RNA, 22 nt, Human
uggcuccuaggauggugccugg

SEQ ID NO: 453432 - RNA, 22 nt, Human
cuucacauguuggaguccuuug

SEQ ID NO: 453433 - RNA, 22 nt, Human
gcugccuguugaagggucugug

SEQ ID NO: 453434 - RNA, 23 nt, Human
gggcugcuccaggccaaggcugg

SEQ ID NO: 453435 - RNA, 22 nt, Human
cuuucacacacauacauuugga

SEQ ID NO: 453436 - RNA, 22 nt, Human
agcugggagcagagccacagcc

SEQ ID NO: 453437 - RNA, 22 nt, Human
ugggacacccucacgccugcac

SEQ ID NO: 453438 - RNA, 22 nt, Human
agaagccauugaagcagaccuc

SEQ ID NO: 453439 - RNA, 22 nt, Human
agcagggcuggggcacgagcca

SEQ ID NO: 453440 - RNA, 22 nt, Human
uaaaggcuucugcagggacuga

SEQ ID NO: 453441 - RNA, 22 nt, Human
uaugcacgucuauuuaugaaga

SEQ ID NO: 453442 - RNA, 22 nt, Human
uagcauuuggacauugucaccu

SEQ ID NO: 453443 - RNA, 22 nt, Human
cuggcaggcggcagagcccagg

SEQ ID NO: 453444 - RNA, 22 nt, Human
caggcacuggggaugcugggau

SEQ ID NO: 453445 - RNA, 22 nt, Human
aaaguguaaaagcauguuaggg

SEQ ID NO: 453446 - RNA, 22 nt, Human
agcugcucuugggugacuucaa

SEQ ID NO: 453447 - RNA, 22 nt, Human
gcuguacaguuuacuagguggg

SEQ ID NO: 453448 - RNA, 22 nt, Human
ccacagggaacaugacagccuu

SEQ ID NO: 453449 - RNA, 22 nt, Human
gcaccugguuuauauaaucaua

SEQ ID NO: 453450 - RNA, 21 nt, Human
ucugagaacuucugcugcagc

SEQ ID NO: 453451 - RNA, 22 nt, Human
cucagcccagcccaggaccagg

SEQ ID NO: 453452 - RNA, 22 nt, Human
uaaggcagaaauaugagcaggg

SEQ ID NO: 453453 - RNA, 23 nt, Human
ccugugugcccuuaauucacagc

SEQ ID NO: 453454 - RNA, 22 nt, Human
gcaguguuguuaaaagauuaga

SEQ ID NO: 453455 - RNA, 22 nt, Human
gcugucacacaugggaucucag

SEQ ID NO: 453456 - RNA, 22 nt, Human
ugcugggggcuuucuggauacc

SEQ ID NO: 453457 - RNA, 22 nt, Human
gagcccuggcagucugggaugg

SEQ ID NO: 453458 - RNA, 22 nt, Human
guaauuaggaauaaaaugggaa

SEQ ID NO: 453459 - RNA, 21 nt, Human
aacauuucugggagaacucac

SEQ ID NO: 453460 - RNA, 22 nt, Human
ucacuggggccuuuggucagga

SEQ ID NO: 453461 - RNA, 22 nt, Human
ggggcaggagcccuucuucagc

SEQ ID NO: 453462 - RNA, 22 nt, Human
guuagggaagcgcuguguucuu

SEQ ID NO: 453463 - RNA, 20 nt, Human
ccuggagccuggaaggaguc

SEQ ID NO: 453464 - RNA, 22 nt, Human
cucuccuccaacagcccugccg

SEQ ID NO: 453465 - RNA, 22 nt, Human
aucaggaagccagucuaaugga

SEQ ID NO: 453466 - RNA, 22 nt, Human
cagagcugguaagugguagagg

SEQ ID NO: 453467 - RNA, 22 nt, Human
agcugagcacauucaaacaggu

SEQ ID NO: 453468 - RNA, 22 nt, Human
ucuguccucuuugaagcugcuc

SEQ ID NO: 453469 - RNA, 20 nt, Human
ccugccuguguuugugauga

SEQ ID NO: 453470 - RNA, 22 nt, Human
cagggugacugcccuggccacu

SEQ ID NO: 453471 - RNA, 21 nt, Human
ccugugugucugacugggcua

SEQ ID NO: 453472 - RNA, 22 nt, Human
ucagcuuuccugcagcuaaggg

SEQ ID NO: 453473 - RNA, 22 nt, Human
gagaggcuaugagguucugugu

SEQ ID NO: 453474 - RNA, 21 nt, Human
uuuauuaacaacuguggacgu

SEQ ID NO: 453475 - RNA, 23 nt, Human
aggaggaaaaguuaucugcugag

SEQ ID NO: 453476 - RNA, 22 nt, Human
ccagcugguguuccuuaggacc

SEQ ID NO: 453477 - RNA, 22 nt, Human
gagcugagaucgugccauugca

SEQ ID NO: 453478 - RNA, 22 nt, Human
agugggcaugaucuggugucug

SEQ ID NO: 453479 - RNA, 22 nt, Human
uagcagagcagggaucagagcc

SEQ ID NO: 453480 - RNA, 22 nt, Human
cagaaacuucuggugucaaaua

SEQ ID NO: 453481 - RNA, 22 nt, Human
aggauccuuuggccacuucuua

SEQ ID NO: 453482 - RNA, 22 nt, Human
cuguccuuacugcuucuggcuu

SEQ ID NO: 453483 - RNA, 22 nt, Human
gaaucucaguggaagcaggaag

SEQ ID NO: 453484 - RNA, 22 nt, Human
uguaugcuuguguauaauauaa

SEQ ID NO: 453485 - RNA, 22 nt, Human
aggcugucugaccccagagccc

SEQ ID NO: 453486 - RNA, 22 nt, Human
cacugcaguaacucuaggacug

SEQ ID NO: 453487 - RNA, 22 nt, Human
ggugcugguucaggguggcugu

SEQ ID NO: 453488 - RNA, 22 nt, Human
aucuauuaugcugagaaacugu

SEQ ID NO: 453489 - RNA, 22 nt, Human
cggcagagcccugagucagccu

SEQ ID NO: 453490 - RNA, 22 nt, Human
gcagcugcaggcaggcuugcug

SEQ ID NO: 453491 - RNA, 22 nt, Human
ggggcagccuccaggaaagcug

SEQ ID NO: 453492 - RNA, 22 nt, Human
ucccagccugacagugcaucaa

SEQ ID NO: 453493 - RNA, 22 nt, Human
aaggucauuguugcauguucuc

SEQ ID NO: 453494 - RNA, 22 nt, Human
uaaguucaguuggucgaaguag

SEQ ID NO: 453495 - RNA, 22 nt, Human
caggaagauuagaccaagagcu

SEQ ID NO: 453496 - RNA, 22 nt, Human
agcagggccaacaguaaacacc

SEQ ID NO: 453497 - RNA, 23 nt, Human
cuggaagugcuuuuauagcuuug

SEQ ID NO: 453498 - RNA, 22 nt, Human
ccagcagacacacaggcguggg

SEQ ID NO: 453499 - RNA, 22 nt, Human
agaauucuccuucagggcagga

SEQ ID NO: 453500 - RNA, 22 nt, Human
acucacuuuccauucaagcacc

SEQ ID NO: 453501 - RNA, 23 nt, Human
ucucagaggauuccugggccuug

SEQ ID NO: 453502 - RNA, 22 nt, Human
gggcugaguuccugccucacuc

SEQ ID NO: 453503 - RNA, 22 nt, Human
ggucacaggggagaagagugau

SEQ ID NO: 453504 - RNA, 22 nt, Human
agaaguaggcagggcuguauca

SEQ ID NO: 453505 - RNA, 22 nt, Human
gggagguucuguucgcacuuga

SEQ ID NO: 453506 - RNA, 22 nt, Human
uaaaauguagcuucuaggcugg

SEQ ID NO: 453507 - RNA, 22 nt, Human
ugccugucuuggaguccuggcc

SEQ ID NO: 453508 - RNA, 22 nt, Human
augaaaacggaccagagcuauu

SEQ ID NO: 453509 - RNA, 22 nt, Human
cccuccagccauggacccaggu

SEQ ID NO: 453510 - RNA, 22 nt, Human
agccaguguuaagugacugguu

SEQ ID NO: 453511 - RNA, 22 nt, Human
gugucaugggagucagaaguga

SEQ ID NO: 453512 - RNA, 22 nt, Human
ugcaguggaggccgugagacag

SEQ ID NO: 453513 - RNA, 22 nt, Human
cuccagggaaaggggcguccgc

SEQ ID NO: 453514 - RNA, 22 nt, Human
uuccuguccgcaauggccuggg

SEQ ID NO: 453515 - RNA, 22 nt, Human
aggacagagggaccagagccca

SEQ ID NO: 453516 - RNA, 22 nt, Human
uggcugggagcuggaacugggc

SEQ ID NO: 453517 - RNA, 18 nt, Human
cagaaaucacaccagcac

SEQ ID NO: 453518 - RNA, 22 nt, Human
acaugcaugucuaugggcaggu

SEQ ID NO: 453519 - RNA, 22 nt, Human
guggcccucugauagggucagg

SEQ ID NO: 453520 - RNA, 22 nt, Human
ugcccaggaucuggcgaugcuc

SEQ ID NO: 453521 - RNA, 22 nt, Human
uguacaauagcuauuaucucca

SEQ ID NO: 453522 - RNA, 18 nt, Human
gaaaggagagacaguagg

SEQ ID NO: 453523 - RNA, 22 nt, Human
ggcuuuaugcacagcagauggu

SEQ ID NO: 453524 - RNA, 23 nt, Human
ccucccaggcugcgagucccgag

SEQ ID NO: 453525 - RNA, 22 nt, Human
ugcucccaggcauucucuguug

SEQ ID NO: 453526 - RNA, 22 nt, Human
aagggcucugugugccucccca

SEQ ID NO: 453527 - RNA, 22 nt, Human
ucauuuguacuugugugcuugu

SEQ ID NO: 453528 - RNA, 21 nt, Human
gcugcugccccuagugaggcc

SEQ ID NO: 453529 - RNA, 21 nt, Human
uuuaauuugcauguaugacgc

SEQ ID NO: 453530 - RNA, 22 nt, Human
acacagaaccucauagccucuc

SEQ ID NO: 453531 - RNA, 22 nt, Human
ccagaagucaggaaugagucuu

SEQ ID NO: 453532 - RNA, 22 nt, Human
ggcagcaguccauggcccaagg

SEQ ID NO: 453533 - RNA, 22 nt, Human
ucuggagcuuccucauuuacag

SEQ ID NO: 453534 - RNA, 22 nt, Human
ccugggcaucucaugcaccugc

SEQ ID NO: 453535 - RNA, 22 nt, Human
cugggagggguagccaauccua

SEQ ID NO: 453536 - RNA, 21 nt, Human
uugaaaguaaauucagcagcu

SEQ ID NO: 453537 - RNA, 22 nt, Human
agcugcaggcccaugcucaguc

SEQ ID NO: 453538 - RNA, 22 nt, Human
ggaggcaggaaagacagguuca

SEQ ID NO: 453539 - RNA, 22 nt, Human
uuguuucaaauauuucagaaua

SEQ ID NO: 453540 - RNA, 22 nt, Human
gagcuggugaucagcuggagga

SEQ ID NO: 453541 - RNA, 22 nt, Human
aggccagaugucgggcuagaag

SEQ ID NO: 453542 - RNA, 22 nt, Human
aaggcaguuaauuuggcuagaa

SEQ ID NO: 453543 - RNA, 22 nt, Human
gggcugcuuccuggggaaugcu

SEQ ID NO: 453544 - RNA, 22 nt, Human
agucugcacucagguggagguc

SEQ ID NO: 453545 - RNA, 19 nt, Human
aaaaggaauauucuuuggg

SEQ ID NO: 453546 - RNA, 22 nt, Human
caauagcagcuucugaaugcaa

SEQ ID NO: 453547 - RNA, 22 nt, Human
gcaaggcugugcacuuugcauu

SEQ ID NO: 453548 - RNA, 22 nt, Human
cccugcugucaggugcugggag

SEQ ID NO: 453549 - RNA, 22 nt, Human
gggcacuggaaggcucucaggc

SEQ ID NO: 453550 - RNA, 22 nt, Human
uccaggcaugguguaauuuugc

SEQ ID NO: 453551 - RNA, 22 nt, Human
aaaugcaugagaaaguauucug

SEQ ID NO: 453552 - RNA, 22 nt, Human
uccagggacagcgcuggagcua

SEQ ID NO: 453553 - RNA, 22 nt, Human
uggcucuguugugcugagccag

SEQ ID NO: 453554 - RNA, 22 nt, Human
ucaaaggcuugugguucuggga

SEQ ID NO: 453555 - RNA, 19 nt, Human
ugucacugucauggcccag

SEQ ID NO: 453556 - RNA, 20 nt, Human
agagaauucccuuuggagau

SEQ ID NO: 453557 - RNA, 22 nt, Human
ugcucuguaaggucagaaaagg

SEQ ID NO: 453558 - RNA, 22 nt, Human
uuacauuuuaguuaaccuguga

SEQ ID NO: 453559 - RNA, 22 nt, Human
ugccugucuucaggagugucac

SEQ ID NO: 453560 - RNA, 22 nt, Human
auaauuuacuaagcucuaccuu

SEQ ID NO: 453561 - RNA, 22 nt, Human
gcagagcuguuaauggagcuga

SEQ ID NO: 453562 - RNA, 22 nt, Human
aggcuggggaauugaauuugcu

SEQ ID NO: 453563 - RNA, 20 nt, Human
uccuggccuucucgggcagu

SEQ ID NO: 453564 - RNA, 22 nt, Human
acagagcugggugcccccugga

SEQ ID NO: 453565 - RNA, 22 nt, Human
agaggcaacauggggaacagau

SEQ ID NO: 453566 - RNA, 22 nt, Human
auuuuaucugcuuacuuucagg

SEQ ID NO: 453567 - RNA, 22 nt, Human
auugacaagacaauggcucuua

SEQ ID NO: 453568 - RNA, 22 nt, Human
agcugcugcgccucacccuggc

SEQ ID NO: 453569 - RNA, 22 nt, Human
aggcucagcugguggugaucgc

SEQ ID NO: 453570 - RNA, 22 nt, Human
cagcuuuguggccuugaccucg

SEQ ID NO: 453571 - RNA, 22 nt, Human
ucucagggugaggaaagaauuu

SEQ ID NO: 453572 - RNA, 19 nt, Human
ucucagagcccuagaggcc

SEQ ID NO: 453573 - RNA, 22 nt, Human
gcugagguggagauugcaguga

SEQ ID NO: 453574 - RNA, 22 nt, Human
gcuggcagguccaagauagagc

SEQ ID NO: 453575 - RNA, 22 nt, Human
gagagggcucuguguggguacu

SEQ ID NO: 453576 - RNA, 22 nt, Human
ccaccaggacagcccugagggg

SEQ ID NO: 453577 - RNA, 20 nt, Human
ccaagagcaugcaugaggaa

SEQ ID NO: 453578 - RNA, 19 nt, Human
ugagacagggauucaggug

SEQ ID NO: 453579 - RNA, 22 nt, Human
aaagaggauggaguagucagcu

SEQ ID NO: 453580 - RNA, 22 nt, Human
gaggcacaccagggagucuugu

SEQ ID NO: 453581 - RNA, 22 nt, Human
uucuuuccccauggaguucgga

SEQ ID NO: 453582 - RNA, 22 nt, Human
ucuggcuccaggaccgggcaca

SEQ ID NO: 453583 - RNA, 22 nt, Human
acagguggccccgagggagugg

SEQ ID NO: 453584 - RNA, 22 nt, Human
cagaaguaagauuacugugaga

SEQ ID NO: 453585 - RNA, 21 nt, Human
augaagucuaugcuucugugu

SEQ ID NO: 453586 - RNA, 23 nt, Human
ccuccugggcacaggccugaugg

SEQ ID NO: 453587 - RNA, 22 nt, Human
cccaggcagggacgugcucugg

SEQ ID NO: 453588 - RNA, 22 nt, Human
caguuuauuuccaagaugacaa

SEQ ID NO: 453589 - RNA, 22 nt, Human
ggggaccuucccagagcaguug

SEQ ID NO: 453590 - RNA, 22 nt, Human
cccuggcaaaacacucucuuga

SEQ ID NO: 453591 - RNA, 22 nt, Human
cacagggcagugcugcccacuc

SEQ ID NO: 453592 - RNA, 22 nt, Human
auggggcugggauucuccucgg

SEQ ID NO: 453593 - RNA, 22 nt, Human
gccuggagcucggcugagggcg

SEQ ID NO: 453594 - RNA, 22 nt, Human
aagcucugcucagcagacuagg

SEQ ID NO: 453595 - RNA, 22 nt, Human
agagugaagguugacacuucac

SEQ ID NO: 453596 - RNA, 22 nt, Human
cagggccaaguuggugccuuuu

SEQ ID NO: 453597 - RNA, 22 nt, Human
acugagcugcuugaagugaacu

SEQ ID NO: 453598 - RNA, 22 nt, Human
aagcugcagacccccugucuca

SEQ ID NO: 453599 - RNA, 22 nt, Human
gcucacuggccugaagaggacg

SEQ ID NO: 453600 - RNA, 22 nt, Human
agggccagggaaacgaucagca

SEQ ID NO: 453601 - RNA, 22 nt, Human
ucaguggauuguagaaggcuua

SEQ ID NO: 453602 - RNA, 22 nt, Human
caggauggagggagggcuguua

SEQ ID NO: 453603 - RNA, 22 nt, Human
uuguuucaugaguguaaaggga

SEQ ID NO: 453604 - RNA, 22 nt, Human
gucugucaucugagauggagug

SEQ ID NO: 453605 - RNA, 22 nt, Human
caggcagccugagggaucuggg

SEQ ID NO: 453606 - RNA, 18 nt, Human
acauuucuaggugaaagc

SEQ ID NO: 453607 - RNA, 22 nt, Human
cccaggcagucuggcucuaaag

SEQ ID NO: 453608 - RNA, 23 nt, Human
agggcugaaugcagagaagcaga

SEQ ID NO: 453609 - RNA, 22 nt, Human
ggcugggcaggucugcacaggg

SEQ ID NO: 453610 - RNA, 22 nt, Human
ugaggccugggcacauaaccuc

SEQ ID NO: 453611 - RNA, 22 nt, Human
cugucagcacucuacuacagau

SEQ ID NO: 453612 - RNA, 22 nt, Human
cuggaagguuccucccagcucc

SEQ ID NO: 453613 - RNA, 22 nt, Human
agcagggcuuuggcuggcuuuc

SEQ ID NO: 453614 - RNA, 22 nt, Human
uucuccccugacccugaugagg

SEQ ID NO: 453615 - RNA, 22 nt, Human
ucugcaggacugaggccuguuu

SEQ ID NO: 453616 - RNA, 22 nt, Human
gacaugcaugaaugcaggucuc

SEQ ID NO: 453617 - RNA, 22 nt, Human
uuguuuucuccacugcaucuua

SEQ ID NO: 453618 - RNA, 22 nt, Human
caguacuuggucaaggaagcag

SEQ ID NO: 453619 - RNA, 22 nt, Human
aaagccuugcccgucacuggga

SEQ ID NO: 453620 - RNA, 22 nt, Human
gauuucaccugaucuugucauc

SEQ ID NO: 453621 - RNA, 20 nt, Human
aguaccuuuuguauguuacc

SEQ ID NO: 453622 - RNA, 22 nt, Human
ugggcacaggggaauggaugaa

SEQ ID NO: 453623 - RNA, 22 nt, Human
uggcccucagucuugcuccugc

SEQ ID NO: 453624 - RNA, 22 nt, Human
acuguacaacugcugagcagaa

SEQ ID NO: 453625 - RNA, 22 nt, Human
gggcugcuuauacugaugauaa

SEQ ID NO: 453626 - RNA, 22 nt, Human
ucaguguaaguuauguagaugu

SEQ ID NO: 453627 - RNA, 22 nt, Human
accugcaggggugcucucuggg

SEQ ID NO: 453628 - RNA, 22 nt, Human
acagagaugcaaguguguauuu

SEQ ID NO: 453629 - RNA, 22 nt, Human
aacuagaacgucuaguugcugg

SEQ ID NO: 453630 - RNA, 22 nt, Human
uccagugguuugaaaggggugu

SEQ ID NO: 453631 - RNA, 22 nt, Human
aaggcuuuugggaauuuucaac

SEQ ID NO: 453632 - RNA, 22 nt, Human
cagcugccacaggacuuucuga

SEQ ID NO: 453633 - RNA, 22 nt, Human
aucauaaagugcuaucugauug

SEQ ID NO: 453634 - RNA, 22 nt, Human
agacaaagacagcaucucaggu

SEQ ID NO: 453635 - RNA, 22 nt, Human
gguuccccaggcggcccuugga

SEQ ID NO: 453636 - RNA, 22 nt, Human
gccuccuggccuuugcuccuca

SEQ ID NO: 453637 - RNA, 22 nt, Human
ugagccuggguggucgaggcug

SEQ ID NO: 453638 - RNA, 22 nt, Human
gggcugagcuaagcuggguuga

SEQ ID NO: 453639 - RNA, 22 nt, Human
guguggcuaccucagaggagca

SEQ ID NO: 453640 - RNA, 22 nt, Human
augaggcaguacacacaaagcc

SEQ ID NO: 453641 - RNA, 22 nt, Human
ugagugaggaagcgguggagga

SEQ ID NO: 453642 - RNA, 22 nt, Human
agcagcuguacuuucaucuguu

SEQ ID NO: 453643 - RNA, 22 nt, Human
gcagugguggagcuuacauauc

SEQ ID NO: 453644 - RNA, 22 nt, Human
uauguacauggagagcaauuga

SEQ ID NO: 453645 - RNA, 22 nt, Human
uaaggucauggugaauaauaag

SEQ ID NO: 453646 - RNA, 22 nt, Human
acacauuucucuuuuuguaagu

SEQ ID NO: 453647 - RNA, 21 nt, Human
ccuggcagaagccugauaugc

SEQ ID NO: 453648 - RNA, 22 nt, Human
ucagagugaggcgucaacauga

SEQ ID NO: 453649 - RNA, 22 nt, Human
gauggggaugagaagugagcag

SEQ ID NO: 453650 - RNA, 22 nt, Human
ggaggccuagccagcuccaguu

SEQ ID NO: 453651 - RNA, 22 nt, Human
ucagaccauccugcuguuagug

SEQ ID NO: 453652 - RNA, 22 nt, Human
uuucacaaugcaauccuacuuc

SEQ ID NO: 453653 - RNA, 22 nt, Human
cugagguggaacagaggugaag

SEQ ID NO: 453654 - RNA, 22 nt, Human
ggcucugggucuguggggagcg

SEQ ID NO: 453655 - RNA, 22 nt, Human
ucaggagagaaagaauacaauu

SEQ ID NO: 453656 - RNA, 22 nt, Human
ccugccuggaucagccauccug

SEQ ID NO: 453657 - RNA, 22 nt, Human
caggcagauuugcugcccucca

SEQ ID NO: 453658 - RNA, 22 nt, Human
uaaaugcaaugugcuuuaccag

SEQ ID NO: 453659 - RNA, 22 nt, Human
guuugcauaaaguggaugcagg

SEQ ID NO: 453660 - RNA, 19 nt, Human
ggaugagggucaggcauag

SEQ ID NO: 453661 - RNA, 22 nt, Human
agcaccaucagaugcaauaucu

SEQ ID NO: 453662 - RNA, 22 nt, Human
uggugcugauaauggcaggauu

SEQ ID NO: 453663 - RNA, 22 nt, Human
acaaguggguccuacauaaagc

SEQ ID NO: 453664 - RNA, 22 nt, Human
uaugacaagguggaguaugagu

SEQ ID NO: 453665 - RNA, 22 nt, Human
gucccagaaacauauugcuggu

SEQ ID NO: 453666 - RNA, 22 nt, Human
cacagacccagaagggaugaag

SEQ ID NO: 453667 - RNA, 22 nt, Human
ugcagggccuuguugaugugcu

SEQ ID NO: 453668 - RNA, 18 nt, Human
ucugucuguacaaguauc

SEQ ID NO: 453669 - RNA, 22 nt, Human
aaauguguuucuuugugaaugg

SEQ ID NO: 453670 - RNA, 22 nt, Human
guugaaagcuuuucauuuaguu

SEQ ID NO: 453671 - RNA, 22 nt, Human
cacccuagcugucauuucaguu

SEQ ID NO: 453672 - RNA, 22 nt, Human
uuuugucuaagaacuuugcaaa

SEQ ID NO: 453673 - RNA, 22 nt, Human
uuauguacucugcaauguuuga

SEQ ID NO: 453674 - RNA, 22 nt, Human
uuagaaacccagacucuuaggu

SEQ ID NO: 453675 - RNA, 22 nt, Human
ccagaggaugcuggucagccuc

SEQ ID NO: 453676 - RNA, 19 nt, Human
uagucuuuauucuuaauuu

SEQ ID NO: 453677 - RNA, 22 nt, Human
aggugaguuacaggaggagguc

SEQ ID NO: 453678 - RNA, 20 nt, Human
ccacaggaguccagucgacc

SEQ ID NO: 453679 - RNA, 22 nt, Human
caguucagcuagaagaaacaaa

SEQ ID NO: 453680 - RNA, 22 nt, Human
uaaguuuaaauguacaugaagc

SEQ ID NO: 453681 - RNA, 22 nt, Human
uugcagaggcaaaaaugaacuc

SEQ ID NO: 453682 - RNA, 22 nt, Human
uaggcaggcugaauguagauuu

SEQ ID NO: 453683 - RNA, 22 nt, Human
gagcagugguugaacagaggca

SEQ ID NO: 453684 - RNA, 22 nt, Human
uguggcagcuggagguggagaa

SEQ ID NO: 453685 - RNA, 18 nt, Human
acaaauguagugucuuaa

SEQ ID NO: 453686 - RNA, 20 nt, Human
gagggcucguggauggauaa

SEQ ID NO: 453687 - RNA, 22 nt, Human
ccagggcaaaugagaucauagc

SEQ ID NO: 453688 - RNA, 22 nt, Human
uuuagggaagaagcccauggcc

SEQ ID NO: 453689 - RNA, 22 nt, Human
uugcagcagggugaauucacuc

SEQ ID NO: 453690 - RNA, 22 nt, Human
cucuugggagugcucuggagaa

SEQ ID NO: 453691 - RNA, 19 nt, Human
uugaaauuguuugauaugg

SEQ ID NO: 453692 - RNA, 22 nt, Human
acagaauucuaguauguggcuu

SEQ ID NO: 453693 - RNA, 22 nt, Human
ugguggcuucugaggauggcga

SEQ ID NO: 453694 - RNA, 21 nt, Human
cagagguggccugaccucuga

SEQ ID NO: 453695 - RNA, 22 nt, Human
ccagagcagggcagcagggcuc

SEQ ID NO: 453696 - RNA, 22 nt, Human
ucccacugugccuguuguaauc

SEQ ID NO: 453697 - RNA, 22 nt, Human
guccuggggauuauagaguguu

SEQ ID NO: 453698 - RNA, 22 nt, Human
ccugcucagccccagcucaccc

SEQ ID NO: 453699 - RNA, 22 nt, Human
gaggcccaggucaagcagccac

SEQ ID NO: 453700 - RNA, 22 nt, Human
uacuguacucaacaugugaguu

SEQ ID NO: 453701 - RNA, 22 nt, Human
gugcuugggggaaguaacagac

SEQ ID NO: 453702 - RNA, 22 nt, Human
uagaggcauuaaugaauaaaca

SEQ ID NO: 453703 - RNA, 22 nt, Human
cagaagucacccucagaauaac

SEQ ID NO: 453704 - RNA, 22 nt, Human
caccugagcacuggggccgccc

SEQ ID NO: 453705 - RNA, 22 nt, Human
ccagcuccuucugucuguggag

SEQ ID NO: 453706 - RNA, 22 nt, Human
gccucucucuacccaguaugau

SEQ ID NO: 453707 - RNA, 22 nt, Human
acauguggucaaucuguguagg

SEQ ID NO: 453708 - RNA, 22 nt, Human
guauuuauaggggaaugagagu

SEQ ID NO: 453709 - RNA, 22 nt, Human
gcagagguggcaucugggcucu

SEQ ID NO: 453710 - RNA, 22 nt, Human
gagagcuguccggcugagcagc

SEQ ID NO: 453711 - RNA, 22 nt, Human
cacugaaggacaguaggaaggg

SEQ ID NO: 453712 - RNA, 22 nt, Human
gcagcuuugucacggagugucg

SEQ ID NO: 453713 - RNA, 22 nt, Human
uuugcaaauauguguuucuauu

SEQ ID NO: 453714 - RNA, 22 nt, Human
agaggggcucauauccugucau

SEQ ID NO: 453715 - RNA, 22 nt, Human
acagugucugacacauuguagc

SEQ ID NO: 453716 - RNA, 22 nt, Human
aacaaagucguugccuagaaga

SEQ ID NO: 453717 - RNA, 22 nt, Human
aaacuuuaagacaguccucaag

SEQ ID NO: 453718 - RNA, 22 nt, Human
guuguauucuucaauaucagag

SEQ ID NO: 453719 - RNA, 22 nt, Human
gggcugagacgauggggucuuc

SEQ ID NO: 453720 - RNA, 22 nt, Human
uuggaaggugagucccuggguu

SEQ ID NO: 453721 - RNA, 22 nt, Human
agggucugacuccucuggcaag

SEQ ID NO: 453722 - RNA, 22 nt, Human
acagcagcuaaccccugggcca

SEQ ID NO: 453723 - RNA, 23 nt, Human
gucagggcuggggucagagugac

SEQ ID NO: 453724 - RNA, 22 nt, Human
cacucuccagcacaccccauuu

SEQ ID NO: 453725 - RNA, 22 nt, Human
acccuggacuggggcugaggcu

SEQ ID NO: 453726 - RNA, 22 nt, Human
aagcagccagccaucaugcccg

SEQ ID NO: 453727 - RNA, 22 nt, Human
uagcauuucccaaaugcauuug

SEQ ID NO: 453728 - RNA, 22 nt, Human
gcugucugagaacaugguggaa

SEQ ID NO: 453729 - RNA, 22 nt, Human
cuccagcugccaccagauguuu

SEQ ID NO: 453730 - RNA, 22 nt, Human
gagugcaggccugagcaccauc

SEQ ID NO: 453731 - RNA, 22 nt, Human
acauacuuaacauuaaagucau

SEQ ID NO: 453732 - RNA, 23 nt, Human
uggaccugaaccagugccucugu

SEQ ID NO: 453733 - RNA, 22 nt, Human
ugcuuuauuggaaccucauccu

SEQ ID NO: 453734 - RNA, 22 nt, Human
aagccaggcugcacuugcuggg

SEQ ID NO: 453735 - RNA, 20 nt, Human
cagcucugggaaagaggcca

SEQ ID NO: 453736 - RNA, 22 nt, Human
uccagggguaccggccaggcag

SEQ ID NO: 453737 - RNA, 22 nt, Human
ucugaaaguaucuggaucuuuu

SEQ ID NO: 453738 - RNA, 22 nt, Human
ugugcuucaucacuucucaguu

SEQ ID NO: 453739 - RNA, 22 nt, Human
uuucaaugacacaaaagagaaa

SEQ ID NO: 453740 - RNA, 22 nt, Human
cacagcuuccauuagaaugaga

SEQ ID NO: 453741 - RNA, 22 nt, Human
acuggcaguuugagaaugcauu

SEQ ID NO: 453742 - RNA, 22 nt, Human
uggagcugagaaguggagcucu

SEQ ID NO: 453743 - RNA, 22 nt, Human
cuggugagacgguugacaggag

SEQ ID NO: 453744 - RNA, 22 nt, Human
aucugacaaccuauugacuuga

SEQ ID NO: 453745 - RNA, 22 nt, Human
cugcccuguuuggacagcccgg

SEQ ID NO: 453746 - RNA, 17 nt, Human
agcugagcuggccaggg

SEQ ID NO: 453747 - RNA, 22 nt, Human
cuacuucugugaugaaacuaca

SEQ ID NO: 453748 - RNA, 22 nt, Human
agcugcucuuugaaggacacuu

SEQ ID NO: 453749 - RNA, 22 nt, Human
gccuaggaguacagaaugguuu

SEQ ID NO: 453750 - RNA, 22 nt, Human
cauugcacuccacccuaggcaa

SEQ ID NO: 453751 - RNA, 22 nt, Human
cgggcagugcccagcggggcag

SEQ ID NO: 453752 - RNA, 18 nt, Human
ugcucuggucucacuugg

SEQ ID NO: 453753 - RNA, 22 nt, Human
uucacauuggugauauguuucu

SEQ ID NO: 453754 - RNA, 22 nt, Human
gagggagugccagagggccagc

SEQ ID NO: 453755 - RNA, 22 nt, Human
auccugugcaaugacugcaucu

SEQ ID NO: 453756 - RNA, 22 nt, Human
ccugagggcgccgagcucccag

SEQ ID NO: 453757 - RNA, 22 nt, Human
ggcaaaaaccgcaauaacuucu

SEQ ID NO: 453758 - RNA, 22 nt, Human
acugaaggucucagcaaggaug

SEQ ID NO: 453759 - RNA, 22 nt, Human
aaauuuaagaagugugugcgug

SEQ ID NO: 453760 - RNA, 22 nt, Human
gaguggggucugggcaucaguc

SEQ ID NO: 453761 - RNA, 22 nt, Human
uggcuggcaaggcuggagucag

SEQ ID NO: 453762 - RNA, 22 nt, Human
auaaauuuauaauuguuuccug

SEQ ID NO: 453763 - RNA, 22 nt, Human
ccugugccauccugagcauccc

SEQ ID NO: 453764 - RNA, 22 nt, Human
gagggccagcagccucagcaug

SEQ ID NO: 453765 - RNA, 22 nt, Human
gaaggagggugcggaucugagc

SEQ ID NO: 453766 - RNA, 22 nt, Human
agcuucuggaagccuggcagca

SEQ ID NO: 453767 - RNA, 18 nt, Human
cccagccucuccuuucua

SEQ ID NO: 453768 - RNA, 22 nt, Human
uucacagacauugcagacugaa

SEQ ID NO: 453769 - RNA, 22 nt, Human
guggcuugaccaucccugcuac

SEQ ID NO: 453770 - RNA, 22 nt, Human
agucucugcacaguaagaagca

SEQ ID NO: 453771 - RNA, 22 nt, Human
cugaguccagggacagaggcgu

SEQ ID NO: 453772 - RNA, 22 nt, Human
aggugcagcugacaccaugugg

SEQ ID NO: 453773 - RNA, 22 nt, Human
uguacaguauauuucaaagcca

SEQ ID NO: 453774 - RNA, 22 nt, Human
agcugcccugggucuugcugcu

SEQ ID NO: 453775 - RNA, 22 nt, Human
aaggcucucugauggcagcagu

SEQ ID NO: 453776 - RNA, 22 nt, Human
gaaauugucagcuucuuucagu

SEQ ID NO: 453777 - RNA, 22 nt, Human
aguauguauuuuauacuuacag

SEQ ID NO: 453778 - RNA, 22 nt, Human
cuguggcugcagccuugguccu

SEQ ID NO: 453779 - RNA, 23 nt, Human
agccucuuuucuccugcccugca

SEQ ID NO: 453780 - RNA, 22 nt, Human
gaggggcugcccuggugucagg

SEQ ID NO: 453781 - RNA, 22 nt, Human
gcugucacucaccaggccugca

SEQ ID NO: 453782 - RNA, 22 nt, Human
uacaguucacaguaucauaaau

SEQ ID NO: 453783 - RNA, 22 nt, Human
ggggcacacuuuugguagauau

SEQ ID NO: 453784 - RNA, 22 nt, Human
gagagcuggccagcuucaguau

SEQ ID NO: 453785 - RNA, 22 nt, Human
ugaggccucuugguauggugug

SEQ ID NO: 453786 - RNA, 22 nt, Human
ggacagcccauacacaugucug

SEQ ID NO: 453787 - RNA, 22 nt, Human
acuuccugcuaugagcuucugu

SEQ ID NO: 453788 - RNA, 22 nt, Human
ucagucuccuuuccucuagaca

SEQ ID NO: 453789 - RNA, 22 nt, Human
aaagagcccuuccaugacucuu

SEQ ID NO: 453790 - RNA, 22 nt, Human
acugggaguucuccaugucccu

SEQ ID NO: 453791 - RNA, 22 nt, Human
uauucacauucucaggccuggu

SEQ ID NO: 453792 - RNA, 22 nt, Human
cuccucuggaaauuccucugcc

SEQ ID NO: 453793 - RNA, 22 nt, Human
cugucuccuccacugcauggga

SEQ ID NO: 453794 - RNA, 22 nt, Human
uugaggaguguuuagggugagg

SEQ ID NO: 453795 - RNA, 22 nt, Human
gggcaggaugcaguuucagaga

SEQ ID NO: 453796 - RNA, 22 nt, Human
ucugucacugagcucaggauuc

SEQ ID NO: 453797 - RNA, 22 nt, Human
aggucauugaaguuauuuucuu

SEQ ID NO: 453798 - RNA, 22 nt, Human
accucugcuucccggguucaag

SEQ ID NO: 453799 - RNA, 22 nt, Human
gcuggagcuugagaggacaggg

SEQ ID NO: 453800 - RNA, 22 nt, Human
ugaggccucauuuagggagagg

SEQ ID NO: 453801 - RNA, 22 nt, Human
aaaugguguuucuaaugcuaga

SEQ ID NO: 453802 - RNA, 23 nt, Human
ugcugguguuuuugggaccaggg

SEQ ID NO: 453803 - RNA, 22 nt, Human
ucaugaaaauagaucagaaauu

SEQ ID NO: 453804 - RNA, 22 nt, Human
gggaggagugaagauucaccug

SEQ ID NO: 453805 - RNA, 22 nt, Human
agccucugcacgggcacgggug

SEQ ID NO: 453806 - RNA, 22 nt, Human
gacacagagauaggccuguguu

SEQ ID NO: 453807 - RNA, 22 nt, Human
aggaccugagaguuggaaaucc

SEQ ID NO: 453808 - RNA, 22 nt, Human
aaaugcagcagcuaauugaaaa

SEQ ID NO: 453809 - RNA, 18 nt, Human
ugaauuaguuugugguuu

SEQ ID NO: 453810 - RNA, 22 nt, Human
gccuucagcccugacuggccag

SEQ ID NO: 453811 - RNA, 22 nt, Human
cuggggaggcagggcugccccu

SEQ ID NO: 453812 - RNA, 22 nt, Human
aggaagccugcaggugacugcu

SEQ ID NO: 453813 - RNA, 22 nt, Human
uauuacaguucgaguuucuagg

SEQ ID NO: 453814 - RNA, 19 nt, Human
ccucuccgcccaccagccc

SEQ ID NO: 453815 - RNA, 22 nt, Human
acaaacuaccuacagauguuca

SEQ ID NO: 453816 - RNA, 22 nt, Human
cugccuguuagucuagcaguua

SEQ ID NO: 453817 - RNA, 22 nt, Human
caguacuuugcaucauuccacu

SEQ ID NO: 453818 - RNA, 22 nt, Human
ugggcugccggcaggcucugcc

SEQ ID NO: 453819 - RNA, 22 nt, Human
cuuaagaauauugaaguugugg

SEQ ID NO: 453820 - RNA, 22 nt, Human
auccaaaccuggacaugagugg

SEQ ID NO: 453821 - RNA, 20 nt, Human
cagcccuccaguggaggcag

SEQ ID NO: 453822 - RNA, 22 nt, Human
gcucccaccuccagccugaguu

SEQ ID NO: 453823 - RNA, 22 nt, Human
aagugacacauggcacuucuau

SEQ ID NO: 453824 - RNA, 18 nt, Human
gugcugugggcaguggcc

SEQ ID NO: 453825 - RNA, 22 nt, Human
agggccuggaacugugggcagg

SEQ ID NO: 453826 - RNA, 22 nt, Human
uccaggcagagcaacaaaauau

SEQ ID NO: 453827 - RNA, 22 nt, Human
ggaggccaaggaggagcuugcc

SEQ ID NO: 453828 - RNA, 22 nt, Human
cgagcaugaugacggcuguggc

SEQ ID NO: 453829 - RNA, 22 nt, Human
cagagagcaugggaggcccgag

SEQ ID NO: 453830 - RNA, 22 nt, Human
ccagcugcccaagaggcauccu

SEQ ID NO: 453831 - RNA, 22 nt, Human
guggccuggaaaggcuggucug

SEQ ID NO: 453832 - RNA, 22 nt, Human
aggagcugcauggauaccuggu

SEQ ID NO: 453833 - RNA, 22 nt, Human
ggugugccuggggcuuagcugc

SEQ ID NO: 453834 - RNA, 18 nt, Human
ggcuuugcugggguuucu

SEQ ID NO: 453835 - RNA, 22 nt, Human
acuuuggguaagccaggugcua

SEQ ID NO: 453836 - RNA, 22 nt, Human
acucacauuucaucaggccaag

SEQ ID NO: 453837 - RNA, 19 nt, Human
agacaaguuuccagaagcc

SEQ ID NO: 453838 - RNA, 22 nt, Human
gcugcugugugggagacaggcg

SEQ ID NO: 453839 - RNA, 21 nt, Human
ucucacaauaugaugccagau

SEQ ID NO: 453840 - RNA, 22 nt, Human
cugcugugugaccauggacagg

SEQ ID NO: 453841 - RNA, 22 nt, Human
cagggcucccucuggcucccag

SEQ ID NO: 453842 - RNA, 22 nt, Human
uggcucagcaagacauugaccu

SEQ ID NO: 453843 - RNA, 22 nt, Human
ugaccaaagaguugcuuguauu

SEQ ID NO: 453844 - RNA, 22 nt, Human
cuggagggggaaauguucauug

SEQ ID NO: 453845 - RNA, 22 nt, Human
uucugucacuuaggaggucaua

SEQ ID NO: 453846 - RNA, 20 nt, Human
guggccuguccuguuguggg

SEQ ID NO: 453847 - RNA, 22 nt, Human
aagaauguucuuguagucauga

SEQ ID NO: 453848 - RNA, 22 nt, Human
agacuucucaguuuuauuagua

SEQ ID NO: 453849 - RNA, 22 nt, Human
aaagucaaaaugcucuccuguc

SEQ ID NO: 453850 - RNA, 17 nt, Human
gccuggcccagccuggc

SEQ ID NO: 453851 - RNA, 22 nt, Human
auguacauuuguaguaauauca

SEQ ID NO: 453852 - RNA, 22 nt, Human
gcucccagaaccaaggcugggg

SEQ ID NO: 453853 - RNA, 22 nt, Human
uggagaagucaaagugaacagg

SEQ ID NO: 453854 - RNA, 19 nt, Human
aggaaagguggccuuagca

SEQ ID NO: 453855 - RNA, 22 nt, Human
ugaaaucuuagccauucugccu

SEQ ID NO: 453856 - RNA, 22 nt, Human
cagcagcccacgcgugcugucc

SEQ ID NO: 453857 - RNA, 22 nt, Human
uccuggagggaggcggugcuac

SEQ ID NO: 453858 - RNA, 23 nt, Human
aagcuuccuucacgucuccuggg

SEQ ID NO: 453859 - RNA, 22 nt, Human
acacuucuauucccugcacaaa

SEQ ID NO: 453860 - RNA, 22 nt, Human
aggggaggagcuuuucuugccu

SEQ ID NO: 453861 - RNA, 22 nt, Human
ggcgaggccgggacaggcugga

SEQ ID NO: 453862 - RNA, 22 nt, Human
auggcucauuuaucuugcagcc

SEQ ID NO: 453863 - RNA, 22 nt, Human
uaugugcaguuugcucuuaaca

SEQ ID NO: 453864 - RNA, 22 nt, Human
cacagggcaggccccaggccuc

SEQ ID NO: 453865 - RNA, 22 nt, Human
caggggccaggcugucugcugu

SEQ ID NO: 453866 - RNA, 22 nt, Human
cugccugugugugccugcagaa

SEQ ID NO: 453867 - RNA, 22 nt, Human
ugcuauaagaauuauauuacuc

SEQ ID NO: 453868 - RNA, 22 nt, Human
acauuuaaauaccuauguuucu

SEQ ID NO: 453869 - RNA, 19 nt, Human
gcucugugaugcugagggg

SEQ ID NO: 453870 - RNA, 22 nt, Human
gccuggaguacuccuugaagug

SEQ ID NO: 453871 - RNA, 20 nt, Human
cugggcagguguuugaucuc

SEQ ID NO: 453872 - RNA, 22 nt, Human
ccagugcaggugagcaccaggu

SEQ ID NO: 453873 - RNA, 23 nt, Human
acagagguccaaacaguauaagc

SEQ ID NO: 453874 - RNA, 21 nt, Human
aaggcagaagcauggaaugag

SEQ ID NO: 453875 - RNA, 20 nt, Human
agccaggcucaagcuccccc

SEQ ID NO: 453876 - RNA, 22 nt, Human
agggggugcuacuuccagaguu

SEQ ID NO: 453877 - RNA, 22 nt, Human
aaaggccaagcaugagguggac

SEQ ID NO: 453878 - RNA, 22 nt, Human
aggagucagauaugggaaaguu

SEQ ID NO: 453879 - RNA, 22 nt, Human
aaggccagccugagagcuaaca

SEQ ID NO: 453880 - RNA, 23 nt, Human
gcucagagguuuuucucuggaug

SEQ ID NO: 453881 - RNA, 21 nt, Human
gccucugcugucuuauuguga

SEQ ID NO: 453882 - RNA, 22 nt, Human
gaggcucaguuauuuuagccug

SEQ ID NO: 453883 - RNA, 22 nt, Human
aagagccagugggaaagucuug

SEQ ID NO: 453884 - RNA, 22 nt, Human
ucugccuuggcaaccacagcuu

SEQ ID NO: 453885 - RNA, 22 nt, Human
uggccagguguggguucucaga

SEQ ID NO: 453886 - RNA, 22 nt, Human
guacaaaguggaccugauagua

SEQ ID NO: 453887 - RNA, 22 nt, Human
gcagcuggugcaaaugucacuc

SEQ ID NO: 453888 - RNA, 22 nt, Human
gucagugucuuaacagagauua

SEQ ID NO: 453889 - RNA, 22 nt, Human
gagggcucugucuggaagggaa

SEQ ID NO: 453890 - RNA, 22 nt, Human
aggcacugugcagucccaagca

SEQ ID NO: 453891 - RNA, 22 nt, Human
gaggagguuccggguggagaag

SEQ ID NO: 453892 - RNA, 23 nt, Human
gcagauggccccagagugcugcc

SEQ ID NO: 453893 - RNA, 22 nt, Human
agcugagcauuugauccaccuc

SEQ ID NO: 453894 - RNA, 22 nt, Human
aggcccugcuuuccagagcuca

SEQ ID NO: 453895 - RNA, 22 nt, Human
cuugaaagaagggucuuuuaau

SEQ ID NO: 453896 - RNA, 22 nt, Human
agcuggcagagcauuuguggcc

SEQ ID NO: 453897 - RNA, 22 nt, Human
auguucuguuuuguaauucaua

SEQ ID NO: 453898 - RNA, 22 nt, Human
accucccagcucugagcuuggg

SEQ ID NO: 453899 - RNA, 22 nt, Human
agcugagccagcagcaacagga

SEQ ID NO: 453900 - RNA, 22 nt, Human
uggcugagggggcucugcucag

SEQ ID NO: 453901 - RNA, 22 nt, Human
gggcaugagaggcaggcaagug

SEQ ID NO: 453902 - RNA, 22 nt, Human
gaugcugagagguggagggaac

SEQ ID NO: 453903 - RNA, 22 nt, Human
cucucagacugaagggccugug

SEQ ID NO: 453904 - RNA, 22 nt, Human
uuagccauugucagcacauggc

SEQ ID NO: 453905 - RNA, 22 nt, Human
acguuuucuagagaauaugcag

SEQ ID NO: 453906 - RNA, 22 nt, Human
agcugacugaugaagaggccuu

SEQ ID NO: 453907 - RNA, 22 nt, Human
agacuuugagcucuuagagaag

SEQ ID NO: 453908 - RNA, 22 nt, Human
gugggccucuugaggguggcua

SEQ ID NO: 453909 - RNA, 18 nt, Human
cagucccaaaccuuagga

SEQ ID NO: 453910 - RNA, 22 nt, Human
auguccaguuucuacacacaua

SEQ ID NO: 453911 - RNA, 22 nt, Human
gaguggagaucgugccacugca

SEQ ID NO: 453912 - RNA, 22 nt, Human
uuuacucuugcuacacaacugu

SEQ ID NO: 453913 - RNA, 22 nt, Human
uagcuuuagaaauauucucaga

SEQ ID NO: 453914 - RNA, 22 nt, Human
cggcugaggaucuccaggccug

SEQ ID NO: 453915 - RNA, 22 nt, Human
ugcugcuccugccuggcuccca

SEQ ID NO: 453916 - RNA, 22 nt, Human
acagugucaugucguguucccc

SEQ ID NO: 453917 - RNA, 22 nt, Human
aagggcugaaagaccuugggca

SEQ ID NO: 453918 - RNA, 22 nt, Human
uaaagucaucuuuacaucuuug

SEQ ID NO: 453919 - RNA, 22 nt, Human
ggcucagguuaccagucccucc

SEQ ID NO: 453920 - RNA, 22 nt, Human
acagggcaugugcaagagacau

SEQ ID NO: 453921 - RNA, 23 nt, Human
uagagcagggaaaucugucagag

SEQ ID NO: 453922 - RNA, 22 nt, Human
uagcacaucuggcgcuuauagg

SEQ ID NO: 453923 - RNA, 22 nt, Human
agcaggaaggcuuuggggguuc

SEQ ID NO: 453924 - RNA, 20 nt, Human
cugugcuuuggaaccuggaa

SEQ ID NO: 453925 - RNA, 20 nt, Human
caggcacacucauuccugcu

SEQ ID NO: 453926 - RNA, 22 nt, Human
agcugggcagacugcagugguu

SEQ ID NO: 453927 - RNA, 22 nt, Human
aggguagggcccggagacagac

SEQ ID NO: 453928 - RNA, 21 nt, Human
gaaaagcaagggaguagaaca

SEQ ID NO: 453929 - RNA, 22 nt, Human
uggcucagcagguuagaaacua

SEQ ID NO: 453930 - RNA, 22 nt, Human
caaggccagggaauuuuucugg

SEQ ID NO: 453931 - RNA, 22 nt, Human
uuuuccucuguuauuaguguga

SEQ ID NO: 453932 - RNA, 22 nt, Human
agggaagagcuugcaagaaacc

SEQ ID NO: 453933 - RNA, 23 nt, Human
uuucauaugguguggaugaagaa

SEQ ID NO: 453934 - RNA, 22 nt, Human
aggcuggaguacaguggcuauu

SEQ ID NO: 453935 - RNA, 22 nt, Human
gagagcuguguucauucuacca

SEQ ID NO: 453936 - RNA, 22 nt, Human
gaggcagcagggcugguuccuu

SEQ ID NO: 453937 - RNA, 22 nt, Human
ucagggcaaagggcagaguuug

SEQ ID NO: 453938 - RNA, 22 nt, Human
agauguggccggcuagggagag

SEQ ID NO: 453939 - RNA, 22 nt, Human
ccacacagggggaugaguuauu

SEQ ID NO: 453940 - RNA, 22 nt, Human
gcuggggagcuagaccucagca

SEQ ID NO: 453941 - RNA, 22 nt, Human
gaauccaggguuguuugagcua

SEQ ID NO: 453942 - RNA, 22 nt, Human
gcagcaggcuuuucauaccuug

SEQ ID NO: 453943 - RNA, 22 nt, Human
aauuagggagccaucauaaggu

SEQ ID NO: 453944 - RNA, 16 nt, Human
uggaaggggucuccgg

SEQ ID NO: 453945 - RNA, 22 nt, Human
cucaguuucuucauauuguagg

SEQ ID NO: 453946 - RNA, 22 nt, Human
ccucaggggugcccacagcugc

SEQ ID NO: 453947 - RNA, 22 nt, Human
uuuccucuccggggccuccagg

SEQ ID NO: 453948 - RNA, 22 nt, Human
gagggcucugaaaggaggucac

SEQ ID NO: 453949 - RNA, 23 nt, Human
agcaauaagaagggauacaugug

SEQ ID NO: 453950 - RNA, 22 nt, Human
cuuuauuagauguagacuuucu

SEQ ID NO: 453951 - RNA, 22 nt, Human
agcaguggcugaagauguuccu

SEQ ID NO: 453952 - RNA, 22 nt, Human
uuuuuccuagcgauuugucagc

SEQ ID NO: 453953 - RNA, 21 nt, Human
acagcagacaggcuuaggacc

SEQ ID NO: 453954 - RNA, 23 nt, Human
gggauauggaccuuggaggaguc

SEQ ID NO: 453955 - RNA, 22 nt, Human
ucuucagagacucugagccccu

SEQ ID NO: 453956 - RNA, 22 nt, Human
acagaaugcguagugcauguug

SEQ ID NO: 453957 - RNA, 22 nt, Human
uagucccauuuugagguauuug

SEQ ID NO: 453958 - RNA, 22 nt, Human
gaacagcuucuugggagcuggg

SEQ ID NO: 453959 - RNA, 22 nt, Human
cucauggauauaagaacuguuu

SEQ ID NO: 453960 - RNA, 22 nt, Human
auuaaauuaaguggcuaauuua

SEQ ID NO: 453961 - RNA, 22 nt, Human
ugggacagagugagcuuuggcc

SEQ ID NO: 453962 - RNA, 22 nt, Human
uuaacauuguccuuagcagauu

SEQ ID NO: 453963 - RNA, 21 nt, Human
ccacauucucauucugacugc

SEQ ID NO: 453964 - RNA, 22 nt, Human
uugaaagucacaauggcauuaa

SEQ ID NO: 453965 - RNA, 22 nt, Human
uuacaguuuaguccaagccaga

SEQ ID NO: 453966 - RNA, 21 nt, Human
gcagcaguguucuagaauacu

SEQ ID NO: 453967 - RNA, 22 nt, Human
uaaugcuucaauuuccuugauu

SEQ ID NO: 453968 - RNA, 22 nt, Human
cugagccagggccacacaugga

SEQ ID NO: 453969 - RNA, 22 nt, Human
uuucuaaaugguggcugcauug

SEQ ID NO: 453970 - RNA, 22 nt, Human
ugauucacagacuucacaaggc

SEQ ID NO: 453971 - RNA, 22 nt, Human
ccaaagucuggagcagcagagc

SEQ ID NO: 453972 - RNA, 21 nt, Human
auggagucaggggaaugggcc

SEQ ID NO: 453973 - RNA, 22 nt, Human
ucagaggagaaguugggaaaau

SEQ ID NO: 453974 - RNA, 20 nt, Human
uucuggaggcuacaagucug

SEQ ID NO: 453975 - RNA, 22 nt, Human
ugaugauguuuaucuugguauu

SEQ ID NO: 453976 - RNA, 22 nt, Human
gagggcugcugccagauaugcc

SEQ ID NO: 453977 - RNA, 22 nt, Human
acacugugagcugaagggcugc

SEQ ID NO: 453978 - RNA, 22 nt, Human
agugaaaucagguuuugacugc

SEQ ID NO: 453979 - RNA, 22 nt, Human
agaauuagucacaauuauagga

SEQ ID NO: 453980 - RNA, 22 nt, Human
agcagagccagaauuggaccag

SEQ ID NO: 453981 - RNA, 22 nt, Human
ugucccuggaacuauggcucca

SEQ ID NO: 453982 - RNA, 22 nt, Human
aggaagugcuaagagaacauca

SEQ ID NO: 453983 - RNA, 21 nt, Human
ugccagcauuaaacagucauu

SEQ ID NO: 453984 - RNA, 22 nt, Human
caguggaaaucagagugagagu

SEQ ID NO: 453985 - RNA, 19 nt, Human
ggcugucuggcguguggau

SEQ ID NO: 453986 - RNA, 22 nt, Human
cagaggccauauuucuucacuc

SEQ ID NO: 453987 - RNA, 22 nt, Human
gagcuguccgccccugggccga

SEQ ID NO: 453988 - RNA, 22 nt, Human
agguggagacccagagaaggcg

SEQ ID NO: 453989 - RNA, 22 nt, Human
ugaguaauaaacugucuugcuc

SEQ ID NO: 453990 - RNA, 22 nt, Human
aggguggccaugagggagagau

SEQ ID NO: 453991 - RNA, 22 nt, Human
uggcuccaucauccaugcaaga

SEQ ID NO: 453992 - RNA, 22 nt, Human
cuggggugugcucagagcaggg

SEQ ID NO: 453993 - RNA, 22 nt, Human
agcagggcagcugaugcgcacg

SEQ ID NO: 453994 - RNA, 22 nt, Human
cugcugugcacccaggaaggcu

SEQ ID NO: 453995 - RNA, 22 nt, Human
ugccugaugcaggaguaucaga

SEQ ID NO: 453996 - RNA, 22 nt, Human
gcagugcuuuagucuguccuuu

SEQ ID NO: 453997 - RNA, 22 nt, Human
cccagguggguuggccucuguc

SEQ ID NO: 453998 - RNA, 22 nt, Human
cuggcagcuucaggacacucgg

SEQ ID NO: 453999 - RNA, 22 nt, Human
cacuuaagcaguuaauuuaucu

SEQ ID NO: 454000 - RNA, 22 nt, Human
aaaggucaagcuggacucaggu

SEQ ID NO: 454001 - RNA, 22 nt, Human
ugaaggaaugaguauacuguuu

SEQ ID NO: 454002 - RNA, 22 nt, Human
caggcagagugagguggucuaa

SEQ ID NO: 454003 - RNA, 22 nt, Human
uguaugcaccauuguauuaccu

SEQ ID NO: 454004 - RNA, 22 nt, Human
ugacaggcagugcugggcaugu

SEQ ID NO: 454005 - RNA, 22 nt, Human
gagcucaggagcaucagaagaa

SEQ ID NO: 454006 - RNA, 22 nt, Human
aaaugcauugguuucuacuugu

SEQ ID NO: 454007 - RNA, 22 nt, Human
agcagcugagaugguaagauuc

SEQ ID NO: 454008 - RNA, 22 nt, Human
gcaggcugugaggcucagaugg

SEQ ID NO: 454009 - RNA, 22 nt, Human
gcagaagcccggucagcgcacg

SEQ ID NO: 454010 - RNA, 22 nt, Human
cagccagugguugaagaugcag

SEQ ID NO: 454011 - RNA, 22 nt, Human
aagggcuguaagccaaguaaag

SEQ ID NO: 454012 - RNA, 21 nt, Human
gccaaggggguagcuauuccu

SEQ ID NO: 454013 - RNA, 22 nt, Human
ucagaagcaggagugugcacaa

SEQ ID NO: 454014 - RNA, 22 nt, Human
agcugcagucaagcugggccac

SEQ ID NO: 454015 - RNA, 22 nt, Human
uagcuaucuguguccagaucca

SEQ ID NO: 454016 - RNA, 22 nt, Human
uuuugagauggugucucgcucc

SEQ ID NO: 454017 - RNA, 22 nt, Human
ugacauuuaucuucuacaauga

SEQ ID NO: 454018 - RNA, 22 nt, Human
aggauccuuuuucugcuguuug

SEQ ID NO: 454019 - RNA, 19 nt, Human
uccugcagguggcuugcag

SEQ ID NO: 454020 - RNA, 22 nt, Human
ugucagaggcucagggucucag

SEQ ID NO: 454021 - RNA, 22 nt, Human
ugagagugaaaugucacauguc

SEQ ID NO: 454022 - RNA, 22 nt, Human
agcugcagcguucauuuuucca

SEQ ID NO: 454023 - RNA, 22 nt, Human
gaaauguguuguucauuucuaa

SEQ ID NO: 454024 - RNA, 22 nt, Human
acaaagcuagagaagagaauug

SEQ ID NO: 454025 - RNA, 22 nt, Human
agacuguaauuuguggccuccu

SEQ ID NO: 454026 - RNA, 22 nt, Human
ugcagggcuccuggcuccaauc

SEQ ID NO: 454027 - RNA, 22 nt, Human
ccaggcuuucccagccucucca

SEQ ID NO: 454028 - RNA, 22 nt, Human
gagauguacaauguguauuaau

SEQ ID NO: 454029 - RNA, 22 nt, Human
agaggggcucaagcaguggucu

SEQ ID NO: 454030 - RNA, 22 nt, Human
aggggcagccucacaauccucu

SEQ ID NO: 454031 - RNA, 22 nt, Human
ggagaccagaaggaagcuucga

SEQ ID NO: 454032 - RNA, 22 nt, Human
gcacggcuaauuuuuguauuuu

SEQ ID NO: 454033 - RNA, 22 nt, Human
agcagcuggugagcaagcucag

SEQ ID NO: 454034 - RNA, 22 nt, Human
gcagcuguggguuccaagucua

SEQ ID NO: 454035 - RNA, 22 nt, Human
gagaaagggauaauuugaagag

SEQ ID NO: 454036 - RNA, 22 nt, Human
cagccagugugaccgaggagga

SEQ ID NO: 454037 - RNA, 22 nt, Human
aaguggagccagggaaacugaa

SEQ ID NO: 454038 - RNA, 22 nt, Human
acaaagucacaauaauuaaccu

SEQ ID NO: 454039 - RNA, 22 nt, Human
uccuuugguuguagacaggaau

SEQ ID NO: 454040 - RNA, 22 nt, Human
aagugacaccucuucccuuucc

SEQ ID NO: 454041 - RNA, 22 nt, Human
uaugcacagaaguuugcugaau

SEQ ID NO: 454042 - RNA, 22 nt, Human
agucucugugagcucccaaugg

SEQ ID NO: 454043 - RNA, 21 nt, Human
uggcugccuacaugcugcagg

SEQ ID NO: 454044 - RNA, 18 nt, Human
ccagagcuggcuccucgc

SEQ ID NO: 454045 - RNA, 22 nt, Human
ucacuuuugaucccuaugcagu

SEQ ID NO: 454046 - RNA, 22 nt, Human
aggcucagugauguaaaauaua

SEQ ID NO: 454047 - RNA, 22 nt, Human
aaucaguuaaauauugaguaca

SEQ ID NO: 454048 - RNA, 22 nt, Human
agauuucacaugcugcucuauu

SEQ ID NO: 454049 - RNA, 22 nt, Human
cauuuauugaguggccacagug

SEQ ID NO: 454050 - RNA, 22 nt, Human
aaaggccacacugcucuuucuc

SEQ ID NO: 454051 - RNA, 22 nt, Human
gccaccagccccaugcgcugug

SEQ ID NO: 454052 - RNA, 22 nt, Human
uccuggcccuguggccugcagu

SEQ ID NO: 454053 - RNA, 22 nt, Human
gcucuccaaacccuguggcuuu

SEQ ID NO: 454054 - RNA, 20 nt, Human
gcugaagauucccaugcaag

SEQ ID NO: 454055 - RNA, 22 nt, Human
gggggucccaagcugggcugcu

SEQ ID NO: 454056 - RNA, 22 nt, Human
gugggcugcccuugaggucagc

SEQ ID NO: 454057 - RNA, 22 nt, Human
agugugaccuuauuuggaaaca

SEQ ID NO: 454058 - RNA, 22 nt, Human
cuguauuuaguuaaaaugcuaa

SEQ ID NO: 454059 - RNA, 22 nt, Human
gcugccaguguggcaugaugca

SEQ ID NO: 454060 - RNA, 22 nt, Human
aucuggcucaccuggguaaaua

SEQ ID NO: 454061 - RNA, 22 nt, Human
guacucucuugaaggccuuucu

SEQ ID NO: 454062 - RNA, 17 nt, Human
uggacccuugggccucc

SEQ ID NO: 454063 - RNA, 22 nt, Human
ugucuuuagccagcagucuucu

SEQ ID NO: 454064 - RNA, 22 nt, Human
cccagcacaggcaauuccauac

SEQ ID NO: 454065 - RNA, 22 nt, Human
aaggcacugagccagccgucuc

SEQ ID NO: 454066 - RNA, 22 nt, Human
aaaagacauaugugggcauucu

SEQ ID NO: 454067 - RNA, 22 nt, Human
gagguacaugaggauacacagg

SEQ ID NO: 454068 - RNA, 22 nt, Human
ugagaguauuuuggcauuauca

SEQ ID NO: 454069 - RNA, 22 nt, Human
agugaaaugauucugagcaaga

SEQ ID NO: 454070 - RNA, 19 nt, Human
uuuacucuccaaggugagu

SEQ ID NO: 454071 - RNA, 22 nt, Human
ggccaggccaagaggguuggaa

SEQ ID NO: 454072 - RNA, 22 nt, Human
cugagggcccugaagcuuggca

SEQ ID NO: 454073 - RNA, 22 nt, Human
agcagcuguggaaaaguaacua

SEQ ID NO: 454074 - RNA, 22 nt, Human
uaccugcagcgggaauccauua

SEQ ID NO: 454075 - RNA, 22 nt, Human
aagaugauagaucugucaaugu

SEQ ID NO: 454076 - RNA, 22 nt, Human
cagagcuggcggugagaagaca

SEQ ID NO: 454077 - RNA, 22 nt, Human
ucacaucucccuggaggacaca

SEQ ID NO: 454078 - RNA, 22 nt, Human
ugaaugauacagaauuauguag

SEQ ID NO: 454079 - RNA, 22 nt, Human
uccagcagguuggucaggugca

SEQ ID NO: 454080 - RNA, 22 nt, Human
acacaugcugauaagaauauaa

SEQ ID NO: 454081 - RNA, 20 nt, Human
gaagccagaggggaaaggag

SEQ ID NO: 454082 - RNA, 23 nt, Human
cagcuuucagggcuuuagggaag

SEQ ID NO: 454083 - RNA, 22 nt, Human
gggcucagacaucccuccugga

SEQ ID NO: 454084 - RNA, 22 nt, Human
auacauacauguacacauaaau

SEQ ID NO: 454085 - RNA, 22 nt, Human
uucuggagagaaaccuuacaaa

SEQ ID NO: 454086 - RNA, 22 nt, Human
aguauguagugcaaucagucag

SEQ ID NO: 454087 - RNA, 22 nt, Human
aagcugccugggaggaagggcu

SEQ ID NO: 454088 - RNA, 22 nt, Human
cugugcuggagaugggccagag

SEQ ID NO: 454089 - RNA, 22 nt, Human
cuggcugguuacuauuucuggu

SEQ ID NO: 454090 - RNA, 22 nt, Human
ugaucagucccaugaucuucca

SEQ ID NO: 454091 - RNA, 22 nt, Human
ugggaccucucuugagagagca

SEQ ID NO: 454092 - RNA, 22 nt, Human
aguaaugucccuuaaauguggu

SEQ ID NO: 454093 - RNA, 22 nt, Human
acauuucuuuucaucucuauau

SEQ ID NO: 454094 - RNA, 22 nt, Human
auggauaauggugauaguugca

SEQ ID NO: 454095 - RNA, 22 nt, Human
cagaccuggaaaacaggcuugc

SEQ ID NO: 454096 - RNA, 22 nt, Human
uagauuucucauucauagauug

SEQ ID NO: 454097 - RNA, 22 nt, Human
acacaggggcucggcugggugc

SEQ ID NO: 454098 - RNA, 22 nt, Human
uucuuugcccuuaaugaaauaa

SEQ ID NO: 454099 - RNA, 22 nt, Human
gcugcccucccagggcaagcuu

SEQ ID NO: 454100 - RNA, 22 nt, Human
gucuucuguaagaugagguccc

SEQ ID NO: 454101 - RNA, 22 nt, Human
uucuucaauuauuggaaagaaa

SEQ ID NO: 454102 - RNA, 20 nt, Human
gaggcucugggcauggcgcc

SEQ ID NO: 454103 - RNA, 22 nt, Human
cagaauuuagcacaauguaugg

SEQ ID NO: 454104 - RNA, 22 nt, Human
aauuucuucagcucuaaaaugg

SEQ ID NO: 454105 - RNA, 22 nt, Human
cugcacagagcagggcagacac

SEQ ID NO: 454106 - RNA, 22 nt, Human
aacucagcauccugcacagaga

SEQ ID NO: 454107 - RNA, 22 nt, Human
cagcacugcuucgcagccaggg

SEQ ID NO: 454108 - RNA, 22 nt, Human
gcagagccugacgggauuuuuc

SEQ ID NO: 454109 - RNA, 22 nt, Human
gcuccagguauuugcccuuuua

SEQ ID NO: 454110 - RNA, 22 nt, Human
uuuuuaaugcagucugagacau

SEQ ID NO: 454111 - RNA, 22 nt, Human
aagcuggacucugccauuuacu

SEQ ID NO: 454112 - RNA, 22 nt, Human
ugguggcagcugagugucaggu

SEQ ID NO: 454113 - RNA, 22 nt, Human
cagggcuccccagagagccucu

SEQ ID NO: 454114 - RNA, 22 nt, Human
gcuuccuggagggagagagcug

SEQ ID NO: 454115 - RNA, 22 nt, Human
ucucauucauacccuacaugcu

SEQ ID NO: 454116 - RNA, 22 nt, Human
ccugggcuugcaucugugcugg

SEQ ID NO: 454117 - RNA, 22 nt, Human
agccaggccagacucacacccu

SEQ ID NO: 454118 - RNA, 22 nt, Human
gcugccugcucggcuccuggga

SEQ ID NO: 454119 - RNA, 22 nt, Human
cugccugggccggccacccucu

SEQ ID NO: 454120 - RNA, 22 nt, Human
gcaggcucuucuuucugcccag

SEQ ID NO: 454121 - RNA, 17 nt, Human
agcagaagucagaggga

SEQ ID NO: 454122 - RNA, 22 nt, Human
cuggcugcuuguagacucgacu

SEQ ID NO: 454123 - RNA, 22 nt, Human
uaaagguaugucuuaaucaaac

SEQ ID NO: 454124 - RNA, 22 nt, Human
ggcacugauaauguccucucuc

SEQ ID NO: 454125 - RNA, 18 nt, Human
cagagcagagguggagcg

SEQ ID NO: 454126 - RNA, 22 nt, Human
cagggguguuuuuggccaggag

SEQ ID NO: 454127 - RNA, 19 nt, Human
uggcucugucgaaggcaca

SEQ ID NO: 454128 - RNA, 22 nt, Human
ucucagagaagugaugagcaau

SEQ ID NO: 454129 - RNA, 22 nt, Human
uuauccaacaugacuuaugucc

SEQ ID NO: 454130 - RNA, 22 nt, Human
uccugcaguuacaucccagcca

SEQ ID NO: 454131 - RNA, 22 nt, Human
agaagccauguuuaguaggaug

SEQ ID NO: 454132 - RNA, 22 nt, Human
uagaugaccuuguguuaggcaa

SEQ ID NO: 454133 - RNA, 22 nt, Human
agcagggcagguaaggaucaga

SEQ ID NO: 454134 - RNA, 22 nt, Human
cccucuggcucuucucaggccg

SEQ ID NO: 454135 - RNA, 22 nt, Human
uaaaugcaagugcuccugggag

SEQ ID NO: 454136 - RNA, 22 nt, Human
auugaaagauuuugggcucaug

SEQ ID NO: 454137 - RNA, 22 nt, Human
ccaggagccugggccaggcugg

SEQ ID NO: 454138 - RNA, 22 nt, Human
ugaaggugaaugucuaugggga

SEQ ID NO: 454139 - RNA, 22 nt, Human
agcuuuaccugccuuggggcac

SEQ ID NO: 454140 - RNA, 18 nt, Human
uggcucugcagccagaug

SEQ ID NO: 454141 - RNA, 22 nt, Human
gcagaggggaagcugaggaauu

SEQ ID NO: 454142 - RNA, 22 nt, Human
auauuauucuaguaacagugau

SEQ ID NO: 454143 - RNA, 22 nt, Human
guuagaaacacauucuuauuga

SEQ ID NO: 454144 - RNA, 22 nt, Human
cugggcagugguggcccuuccc

SEQ ID NO: 454145 - RNA, 22 nt, Human
cugucccaggagcuguaagaca

SEQ ID NO: 454146 - RNA, 22 nt, Human
uccugccuuagagcaaggaaaa

SEQ ID NO: 454147 - RNA, 22 nt, Human
cugagagguaagcagcgcagug

SEQ ID NO: 454148 - RNA, 22 nt, Human
cucuggacagcaggugcugugg

SEQ ID NO: 454149 - RNA, 23 nt, Human
ucugcucugaaguucggcugagc

SEQ ID NO: 454150 - RNA, 22 nt, Human
auacaagaucacuccagaaaau

SEQ ID NO: 454151 - RNA, 22 nt, Human
gagugguaggcaguguuaggaa

SEQ ID NO: 454152 - RNA, 22 nt, Human
ugucucugcuuuccuugcaggg

SEQ ID NO: 454153 - RNA, 22 nt, Human
ugcagggcuauaacuccauucu

SEQ ID NO: 454154 - RNA, 22 nt, Human
gcagggccagggcucaggcugu

SEQ ID NO: 454155 - RNA, 22 nt, Human
aagggugggcaccgccagguca

SEQ ID NO: 454156 - RNA, 22 nt, Human
uucuuucccaguagaugugaaa

SEQ ID NO: 454157 - RNA, 22 nt, Human
gggccagagcuuggcagcuggg

SEQ ID NO: 454158 - RNA, 22 nt, Human
aaaugcacugaacacauguugu

SEQ ID NO: 454159 - RNA, 22 nt, Human
uuugaaagcuacuuucggguca

SEQ ID NO: 454160 - RNA, 22 nt, Human
ugagcccaggaguaugaggcug

SEQ ID NO: 454161 - RNA, 22 nt, Human
gcuccaggagagggaagcagau

SEQ ID NO: 454162 - RNA, 22 nt, Human
aagggcucgguagcaguccuga

SEQ ID NO: 454163 - RNA, 22 nt, Human
ggcccagaauacuuuguaaaau

SEQ ID NO: 454164 - RNA, 22 nt, Human
ucuggcucagggcucugaggga

SEQ ID NO: 454165 - RNA, 22 nt, Human
aguuuaugaaacacagauuuga

SEQ ID NO: 454166 - RNA, 22 nt, Human
gaauucugguuuugaaaugaau

SEQ ID NO: 454167 - RNA, 22 nt, Human
gcucccugcacucugcagcccu

SEQ ID NO: 454168 - RNA, 18 nt, Human
cucucuggucuggauccc

SEQ ID NO: 454169 - RNA, 22 nt, Human
aaaggucaaaaucgugacauug

SEQ ID NO: 454170 - RNA, 22 nt, Human
auucuguauggaaaagcacuau

SEQ ID NO: 454171 - RNA, 22 nt, Human
ugagcugggcugggcugagcug

SEQ ID NO: 454172 - RNA, 22 nt, Human
aggcacaguggcucacaccugu

SEQ ID NO: 454173 - RNA, 22 nt, Human
aguucacauuccgagguacugg

SEQ ID NO: 454174 - RNA, 18 nt, Human
ugacagaaccuggagccu

SEQ ID NO: 454175 - RNA, 22 nt, Human
agaagggccagcuggacaccug

SEQ ID NO: 454176 - RNA, 21 nt, Human
uaaaucucuguauucuucagu

SEQ ID NO: 454177 - RNA, 22 nt, Human
ugugacaugugucaucuuuucu

SEQ ID NO: 454178 - RNA, 22 nt, Human
aacaaccaaaaagaugaaugua

SEQ ID NO: 454179 - RNA, 22 nt, Human
ugaaaucuuauacuuugguagu

SEQ ID NO: 454180 - RNA, 22 nt, Human
aggcagagcuaggaagaauugu

SEQ ID NO: 454181 - RNA, 22 nt, Human
ucagcaguuuuauaugcagcuu

SEQ ID NO: 454182 - RNA, 22 nt, Human
gaaggccaguuuugagauaggu

SEQ ID NO: 454183 - RNA, 17 nt, Human
gcugcagcgguaggcag

SEQ ID NO: 454184 - RNA, 22 nt, Human
gaaccucagugaaacuggaggu

SEQ ID NO: 454185 - RNA, 22 nt, Human
uggagccagcccaggccccucu

SEQ ID NO: 454186 - RNA, 22 nt, Human
cagagccacuuggagaugagaa

SEQ ID NO: 454187 - RNA, 23 nt, Human
ucaguuuuggcuguucaguguug

SEQ ID NO: 454188 - RNA, 22 nt, Human
gagugcaguaugagaggcugcu

SEQ ID NO: 454189 - RNA, 22 nt, Human
acccugccgugggcugcuugug

SEQ ID NO: 454190 - RNA, 22 nt, Human
ccaggaagcggugagggcugcc

SEQ ID NO: 454191 - RNA, 22 nt, Human
aagauuuccuucaguagagcua

SEQ ID NO: 454192 - RNA, 23 nt, Human
ugggaguguugggaucucugcuc

SEQ ID NO: 454193 - RNA, 19 nt, Human
gaucuuugccaauuuaagc

SEQ ID NO: 454194 - RNA, 22 nt, Human
agggcagaaauauugauacugu

SEQ ID NO: 454195 - RNA, 22 nt, Human
acaggcuggugguccuggccau

SEQ ID NO: 454196 - RNA, 22 nt, Human
gugcauguuaaugguguacaaa

SEQ ID NO: 454197 - RNA, 22 nt, Human
gggcagguuggcaucccgggca

SEQ ID NO: 454198 - RNA, 22 nt, Human
ccuuccaggagucucugcaggu

SEQ ID NO: 454199 - RNA, 22 nt, Human
agaaauguacgauguuaugcag

SEQ ID NO: 454200 - RNA, 21 nt, Human
aauaaaacaguuggugucaau

SEQ ID NO: 454201 - RNA, 22 nt, Human
uccugccuguuuaccuguacuu

SEQ ID NO: 454202 - RNA, 22 nt, Human
ccagcccugccagagagagcug

SEQ ID NO: 454203 - RNA, 22 nt, Human
cagguccccuccccuaccaggc

SEQ ID NO: 454204 - RNA, 22 nt, Human
cagagccugccucuggcugugg

SEQ ID NO: 454205 - RNA, 22 nt, Human
gacccuguuucuacaaauaauu

SEQ ID NO: 454206 - RNA, 22 nt, Human
auguagcaugaggcacugugcc

SEQ ID NO: 454207 - RNA, 22 nt, Human
acccagccuacaaagcucaccu

SEQ ID NO: 454208 - RNA, 21 nt, Human
ucaggggcuguguuuuccauc

SEQ ID NO: 454209 - RNA, 22 nt, Human
uggugugggcguggcaggcaag

SEQ ID NO: 454210 - RNA, 22 nt, Human
caugcuuugggucagaaaugcc

SEQ ID NO: 454211 - RNA, 22 nt, Human
uacauaaugagcuaguuaaguu

SEQ ID NO: 454212 - RNA, 22 nt, Human
gcucugucaacagcuagcugug

SEQ ID NO: 454213 - RNA, 22 nt, Human
uuucauaauacuguacaugaaa

SEQ ID NO: 454214 - RNA, 22 nt, Human
augaugguaaauucaguauccg

SEQ ID NO: 454215 - RNA, 22 nt, Human
cagcuccuauuagacacugaau

SEQ ID NO: 454216 - RNA, 22 nt, Human
agcaggugaauuccuggaugug

SEQ ID NO: 454217 - RNA, 22 nt, Human
acccaggagguggaggcugcag

SEQ ID NO: 454218 - RNA, 22 nt, Human
agcucccagaagccagagucgg

SEQ ID NO: 454219 - RNA, 18 nt, Human
gggcaagcggcugucacc

SEQ ID NO: 454220 - RNA, 22 nt, Human
gcaaagucucaagacccaagug

SEQ ID NO: 454221 - RNA, 22 nt, Human
aggagcugaagucucugcacuc

SEQ ID NO: 454222 - RNA, 22 nt, Human
guguaaggugaaaucaacaaau

SEQ ID NO: 454223 - RNA, 22 nt, Human
ugucucugaacagcuuacuaaa

SEQ ID NO: 454224 - RNA, 22 nt, Human
gcgaaaaauguguaaauauguu

SEQ ID NO: 454225 - RNA, 22 nt, Human
uggcagagcccagaacugagca

SEQ ID NO: 454226 - RNA, 22 nt, Human
agcagggcucacauuaguggau

SEQ ID NO: 454227 - RNA, 22 nt, Human
auguaacaggugaagcucugag

SEQ ID NO: 454228 - RNA, 22 nt, Human
gcccucagaggacagcugacuu

SEQ ID NO: 454229 - RNA, 22 nt, Human
aguuacaaccaugacacaagca

SEQ ID NO: 454230 - RNA, 22 nt, Human
agagugggugaucucuguuguc

SEQ ID NO: 454231 - RNA, 22 nt, Human
aucacugucgucaucugagauu

SEQ ID NO: 454232 - RNA, 22 nt, Human
cagccucuaagcacagccucuc

SEQ ID NO: 454233 - RNA, 20 nt, Human
gccagcacagggagcaguuc

SEQ ID NO: 454234 - RNA, 22 nt, Human
agucaguggcuccgagccuggu

SEQ ID NO: 454235 - RNA, 22 nt, Human
gaagaagcaggaguguguagca

SEQ ID NO: 454236 - RNA, 22 nt, Human
ggcuguccuuggccaaggcacu

SEQ ID NO: 454237 - RNA, 22 nt, Human
aggcaucugaguuugcaagcuu

SEQ ID NO: 454238 - RNA, 22 nt, Human
caggaaauaucuccuggcagag

SEQ ID NO: 454239 - RNA, 22 nt, Human
ccacccuggacaggccucugag

SEQ ID NO: 454240 - RNA, 22 nt, Human
cagcaugguggagcugcucuuu

SEQ ID NO: 454241 - RNA, 22 nt, Human
uuucucaaggugucauguauuu

SEQ ID NO: 454242 - RNA, 22 nt, Human
aagggagacaguugugugagga

SEQ ID NO: 454243 - RNA, 22 nt, Human
ggcucuggugcccuggcuccca

SEQ ID NO: 454244 - RNA, 22 nt, Human
acauguguauagccuguauaga

SEQ ID NO: 454245 - RNA, 21 nt, Human
acagauuuuauaucucugcug

SEQ ID NO: 454246 - RNA, 22 nt, Human
gcuuccugucccucagccauga

SEQ ID NO: 454247 - RNA, 23 nt, Human
agccagggcacugguggagauug

SEQ ID NO: 454248 - RNA, 22 nt, Human
ccaccagcagugugcaaggauu

SEQ ID NO: 454249 - RNA, 22 nt, Human
aauguguauacuggcaauuaag

SEQ ID NO: 454250 - RNA, 22 nt, Human
acugauacaucuguggaagugg

SEQ ID NO: 454251 - RNA, 22 nt, Human
uagaaagcuugggguguuuaaa

SEQ ID NO: 454252 - RNA, 22 nt, Human
cccaggaccgcgcggcugagcg

SEQ ID NO: 454253 - RNA, 22 nt, Human
uaagacaugguugaucuagugu

SEQ ID NO: 454254 - RNA, 22 nt, Human
uagagcuauuuagagcauuuua

SEQ ID NO: 454255 - RNA, 22 nt, Human
gcagggcaucccugagcgggug

SEQ ID NO: 454256 - RNA, 22 nt, Human
aggcugugcaauuaggguaaga

SEQ ID NO: 454257 - RNA, 22 nt, Human
uaugaagauauaucugaucucu

SEQ ID NO: 454258 - RNA, 22 nt, Human
caggaaugacccaacaguuuca

SEQ ID NO: 454259 - RNA, 22 nt, Human
uucugucugauggugccagaac

SEQ ID NO: 454260 - RNA, 22 nt, Human
uuuccucuucuggcaggcaggg

SEQ ID NO: 454261 - RNA, 20 nt, Human
acaggagaucugaggaaagg

SEQ ID NO: 454262 - RNA, 22 nt, Human
auucccaucgucaacuucacug

SEQ ID NO: 454263 - RNA, 22 nt, Human
gcucugcuggaaguucucugga

SEQ ID NO: 454264 - RNA, 22 nt, Human
gugccagggaguggaggagcuu

SEQ ID NO: 454265 - RNA, 22 nt, Human
caaggccugccucuggcagaaa

SEQ ID NO: 454266 - RNA, 22 nt, Human
cugugcuucgcaacuccaaggu

SEQ ID NO: 454267 - RNA, 17 nt, Human
agugacuuggaaagagc

SEQ ID NO: 454268 - RNA, 22 nt, Human
ucagagaguuggaaagaauuaa

SEQ ID NO: 454269 - RNA, 22 nt, Human
gcugccucccccauggcuggaa

SEQ ID NO: 454270 - RNA, 22 nt, Human
ggccucugccccagccacaccu

SEQ ID NO: 454271 - RNA, 20 nt, Human
ugaagcagccuugauucugu

SEQ ID NO: 454272 - RNA, 22 nt, Human
aucaggaagaagaauguguugg

SEQ ID NO: 454273 - RNA, 22 nt, Human
agaauccugaugaaaaggagag

SEQ ID NO: 454274 - RNA, 22 nt, Human
aaggcacuguacuaguuaguua

SEQ ID NO: 454275 - RNA, 22 nt, Human
agagcuguuuggacaucugagu

SEQ ID NO: 454276 - RNA, 22 nt, Human
gugucccaaagauuagaaauca

SEQ ID NO: 454277 - RNA, 22 nt, Human
uuacaguauuguuaaacucuuu

SEQ ID NO: 454278 - RNA, 22 nt, Human
ucugccuggauuccauucucca

SEQ ID NO: 454279 - RNA, 22 nt, Human
ucucagagaacaguuggugcuu

SEQ ID NO: 454280 - RNA, 22 nt, Human
uugugucugggggagugacauc

SEQ ID NO: 454281 - RNA, 22 nt, Human
accugccuauggagccacaugg

SEQ ID NO: 454282 - RNA, 22 nt, Human
ccacacagucaguuuccaagaa

SEQ ID NO: 454283 - RNA, 22 nt, Human
uacaaagagguaauugcauaua

SEQ ID NO: 454284 - RNA, 22 nt, Human
ccaggacuucgaggcuacagug

SEQ ID NO: 454285 - RNA, 22 nt, Human
gagaggagucccuaucacaguu

SEQ ID NO: 454286 - RNA, 22 nt, Human
ugagccugcugucgcuggaccc

SEQ ID NO: 454287 - RNA, 22 nt, Human
aggucaaggccaaaagaguggu

SEQ ID NO: 454288 - RNA, 22 nt, Human
gccugggugaauuugauccuaa

SEQ ID NO: 454289 - RNA, 22 nt, Human
ucccagaguuuccuguguccca

SEQ ID NO: 454290 - RNA, 22 nt, Human
acugccuugucucuugccuguu

SEQ ID NO: 454291 - RNA, 23 nt, Human
agggcugaugccauugcagcucu

SEQ ID NO: 454292 - RNA, 22 nt, Human
uugggacagaaaaggagaagau

SEQ ID NO: 454293 - RNA, 22 nt, Human
gaaaucugcuucuugcauagua

SEQ ID NO: 454294 - RNA, 22 nt, Human
cugcagagcauaaaucugaaua

SEQ ID NO: 454295 - RNA, 22 nt, Human
cccaggcugaguuagagguguc

SEQ ID NO: 454296 - RNA, 22 nt, Human
gcuggccaggugcuuugguucu

SEQ ID NO: 454297 - RNA, 22 nt, Human
ucccaggaucugagggcagaga

SEQ ID NO: 454298 - RNA, 22 nt, Human
agucugucagucauucuaacaa

SEQ ID NO: 454299 - RNA, 22 nt, Human
gugagggcagcuuggucagugu

SEQ ID NO: 454300 - RNA, 22 nt, Human
ucagaacagaagaaggaacacg

SEQ ID NO: 454301 - RNA, 22 nt, Human
aggaggccccuccuggguugcu

SEQ ID NO: 454302 - RNA, 22 nt, Human
cugggaggcccacguugggaag

SEQ ID NO: 454303 - RNA, 22 nt, Human
gaugaagccugacuucucggug

SEQ ID NO: 454304 - RNA, 22 nt, Human
uggaggcauaggccugggcccu

SEQ ID NO: 454305 - RNA, 22 nt, Human
gcagauggaaagugcuugaggg

SEQ ID NO: 454306 - RNA, 23 nt, Human
uggccugcagaguuucugcuggg

SEQ ID NO: 454307 - RNA, 22 nt, Human
gaggcagcaucuauggugggaa

SEQ ID NO: 454308 - RNA, 22 nt, Human
agcaggaguguccccuggcugu

SEQ ID NO: 454309 - RNA, 22 nt, Human
gaaaucugaacaacagcuguca

SEQ ID NO: 454310 - RNA, 22 nt, Human
ccugccugcagaaaguaucucc

SEQ ID NO: 454311 - RNA, 22 nt, Human
gccaggcagagccccgugcagc

SEQ ID NO: 454312 - RNA, 22 nt, Human
ugggcaaguaucggacucugag

SEQ ID NO: 454313 - RNA, 22 nt, Human
cccugcagaucagugagaacuu

SEQ ID NO: 454314 - RNA, 22 nt, Human
ucacaugcuugaggaaagaaaa

SEQ ID NO: 454315 - RNA, 22 nt, Human
gccagcaguauguccuggcagu

SEQ ID NO: 454316 - RNA, 22 nt, Human
cuuggcagagggcugggcucag

SEQ ID NO: 454317 - RNA, 22 nt, Human
agcuucuggaaggcaaggcuug

SEQ ID NO: 454318 - RNA, 22 nt, Human
cuuacagagaagaaaauguagu

SEQ ID NO: 454319 - RNA, 22 nt, Human
gagggcugaagauuguggcccc

SEQ ID NO: 454320 - RNA, 22 nt, Human
ggaagccaugagggacaguucu

SEQ ID NO: 454321 - RNA, 22 nt, Human
uacauuuauaaggcuucucugu

SEQ ID NO: 454322 - RNA, 22 nt, Human
auacagaagaacuauagccacu

SEQ ID NO: 454323 - RNA, 22 nt, Human
agccaggcgcaguggcuuaugc

SEQ ID NO: 454324 - RNA, 22 nt, Human
ggaggccaaggagggcggauca

SEQ ID NO: 454325 - RNA, 22 nt, Human
gcauugucaaaagugguaugac

SEQ ID NO: 454326 - RNA, 22 nt, Human
agguauauauucugguccuuau

SEQ ID NO: 454327 - RNA, 22 nt, Human
cugcuguggguuaagacacugu

SEQ ID NO: 454328 - RNA, 22 nt, Human
ugugcauguauugauuuguacc

SEQ ID NO: 454329 - RNA, 21 nt, Human
ggccugaguauaggacaggcc

SEQ ID NO: 454330 - RNA, 22 nt, Human
uccaggcacgaggcccugugca

SEQ ID NO: 454331 - RNA, 22 nt, Human
gcuggugcauuagcugcaguuc

SEQ ID NO: 454332 - RNA, 22 nt, Human
ccacagggucagccacucugca

SEQ ID NO: 454333 - RNA, 22 nt, Human
ccuggugccacuagagaauguc

SEQ ID NO: 454334 - RNA, 22 nt, Human
ucuuuacacaagacaagaauaa

SEQ ID NO: 454335 - RNA, 22 nt, Human
ucucagagggaaaggccaauuu

SEQ ID NO: 454336 - RNA, 22 nt, Human
ucacaagacagaaaacauuuag

SEQ ID NO: 454337 - RNA, 21 nt, Human
gagugcaggucugaugccauc

SEQ ID NO: 454338 - RNA, 22 nt, Human
aggggugugcauccuggaggau

SEQ ID NO: 454339 - RNA, 22 nt, Human
ccagacccugcucuggggcucu

SEQ ID NO: 454340 - RNA, 22 nt, Human
acaguggagaaggcaugaggcu

SEQ ID NO: 454341 - RNA, 22 nt, Human
agcagcauagaagcugggagga

SEQ ID NO: 454342 - RNA, 22 nt, Human
ugccaggcccugugcuggaugc

SEQ ID NO: 454343 - RNA, 22 nt, Human
ggcugcagaaguacuuccggau

SEQ ID NO: 454344 - RNA, 22 nt, Human
uucaagguaugguagcugguca

SEQ ID NO: 454345 - RNA, 22 nt, Human
uuugacaaaggaaaaaugcaca

SEQ ID NO: 454346 - RNA, 22 nt, Human
ccugggugaugugcugcccucg

SEQ ID NO: 454347 - RNA, 22 nt, Human
ugucuagggagcugcucaggcu

SEQ ID NO: 454348 - RNA, 23 nt, Human
uuguuuuuagagguggcaugaga

SEQ ID NO: 454349 - RNA, 22 nt, Human
gaggcagcuuggggcugugggu

SEQ ID NO: 454350 - RNA, 22 nt, Human
uagaaacugauagucuugugcu

SEQ ID NO: 454351 - RNA, 22 nt, Human
ucauuuguugcuguuaccugag

SEQ ID NO: 454352 - RNA, 21 nt, Human
ugaaaguuggagucaaaugua

SEQ ID NO: 454353 - RNA, 22 nt, Human
cacagggcagguacucucagag

SEQ ID NO: 454354 - RNA, 22 nt, Human
uguaugugcuugagaagguggg

SEQ ID NO: 454355 - RNA, 22 nt, Human
ugggcugcuguuacaggggcug

SEQ ID NO: 454356 - RNA, 22 nt, Human
ucauuuauaaggaugcaauuaa

SEQ ID NO: 454357 - RNA, 22 nt, Human
uccucugcuccaucuuuacugu

SEQ ID NO: 454358 - RNA, 23 nt, Human
uauuacaauuggucuuauuaaga

SEQ ID NO: 454359 - RNA, 22 nt, Human
gagccuggauugaagugggugg

SEQ ID NO: 454360 - RNA, 18 nt, Human
ggcugagguugacuagaa

SEQ ID NO: 454361 - RNA, 22 nt, Human
cagggccacuguagaugaggag

SEQ ID NO: 454362 - RNA, 22 nt, Human
auggaagguccuacagagcgca

SEQ ID NO: 454363 - RNA, 22 nt, Human
acacagccaggguaguaaggcu

SEQ ID NO: 454364 - RNA, 22 nt, Human
auaccuuuuagacauguaguug

SEQ ID NO: 454365 - RNA, 22 nt, Human
agagauaugaguaguugugaca

SEQ ID NO: 454366 - RNA, 22 nt, Human
ugcagaagcugcaggucagugg

SEQ ID NO: 454367 - RNA, 22 nt, Human
ccaggccuuucuucuuggucug

SEQ ID NO: 454368 - RNA, 22 nt, Human
ccaaaguccuuucuccaccugc

SEQ ID NO: 454369 - RNA, 22 nt, Human
cacagcuggggaagcugaggcc

SEQ ID NO: 454370 - RNA, 22 nt, Human
gaggcauaaaucacaguguuca

SEQ ID NO: 454371 - RNA, 22 nt, Human
cucucuggaagggggagcugau

SEQ ID NO: 454372 - RNA, 22 nt, Human
guuggccugaauggucaagagg

SEQ ID NO: 454373 - RNA, 22 nt, Human
agggcucugagcuggaccaccu

SEQ ID NO: 454374 - RNA, 22 nt, Human
uaguggagguggucugugaacu

SEQ ID NO: 454375 - RNA, 22 nt, Human
augaggcaaggcuggccguguu

SEQ ID NO: 454376 - RNA, 22 nt, Human
aagccagccagugccagucuua

SEQ ID NO: 454377 - RNA, 22 nt, Human
ugggaccaagucauuucuuuag

SEQ ID NO: 454378 - RNA, 22 nt, Human
cagccacguagcccuuggccgu

SEQ ID NO: 454379 - RNA, 22 nt, Human
ucugucacccagagugcagugg

SEQ ID NO: 454380 - RNA, 22 nt, Human
uggacagcgaaagugccuggga

SEQ ID NO: 454381 - RNA, 22 nt, Human
aauuugcaugaugagaacaaua

SEQ ID NO: 454382 - RNA, 22 nt, Human
agccuggauucgugcauccaca

SEQ ID NO: 454383 - RNA, 22 nt, Human
uggaugcuguaggacacgcucu

SEQ ID NO: 454384 - RNA, 22 nt, Human
agaauuguugggguaauaaaag

SEQ ID NO: 454385 - RNA, 22 nt, Human
aggugccagaugcacagcugaa

SEQ ID NO: 454386 - RNA, 22 nt, Human
aagaacagauucagccugaacu

SEQ ID NO: 454387 - RNA, 22 nt, Human
gggcaugguggugcacaccugu

SEQ ID NO: 454388 - RNA, 22 nt, Human
uugauuucuuacucuuccaagg

SEQ ID NO: 454389 - RNA, 22 nt, Human
gaaggagagagacaucgucccu

SEQ ID NO: 454390 - RNA, 20 nt, Human
uccagggcuagggagcucau

SEQ ID NO: 454391 - RNA, 22 nt, Human
acagcagccuuguugguuucga

SEQ ID NO: 454392 - RNA, 22 nt, Human
uagccgcuuaauuauuugguga

SEQ ID NO: 454393 - RNA, 20 nt, Human
ggcucuggaaucuggugggc

SEQ ID NO: 454394 - RNA, 22 nt, Human
auuccaaacagugcugcagacu

SEQ ID NO: 454395 - RNA, 22 nt, Human
acuaagugauucuaagcaucuu

SEQ ID NO: 454396 - RNA, 22 nt, Human
uuagugucuucuucauccucug

SEQ ID NO: 454397 - RNA, 22 nt, Human
uauguguacaucugguugagca

SEQ ID NO: 454398 - RNA, 22 nt, Human
augucuuucuuauggucuguug

SEQ ID NO: 454399 - RNA, 22 nt, Human
auccaaagcccuaaguuaacug

SEQ ID NO: 454400 - RNA, 22 nt, Human
aggacucaucccugcuugucag

SEQ ID NO: 454401 - RNA, 22 nt, Human
ccagggcauguccaagacuuag

SEQ ID NO: 454402 - RNA, 22 nt, Human
uggagaagauuggucaccauuc

SEQ ID NO: 454403 - RNA, 22 nt, Human
auccugggcagugugucacucu

SEQ ID NO: 454404 - RNA, 22 nt, Human
agaggugacauaggagaggcuc

SEQ ID NO: 454405 - RNA, 22 nt, Human
ucugaggcuaagagacagaggc

SEQ ID NO: 454406 - RNA, 20 nt, Human
ucucccaggcucagggaaga

SEQ ID NO: 454407 - RNA, 22 nt, Human
ugguuugcccacucgagugauu

SEQ ID NO: 454408 - RNA, 22 nt, Human
ugccaggcgauugcuaucagca

SEQ ID NO: 454409 - RNA, 22 nt, Human
cagagcugagucuucaagguug

SEQ ID NO: 454410 - RNA, 22 nt, Human
ugcuuuauguuaucagaagggu

SEQ ID NO: 454411 - RNA, 23 nt, Human
uuugaaaguaucaacucgccuga

SEQ ID NO: 454412 - RNA, 22 nt, Human
ugccucugaggaagauuguguu

SEQ ID NO: 454413 - RNA, 22 nt, Human
caagggcucacggucugcuggg

SEQ ID NO: 454414 - RNA, 22 nt, Human
uggaggaauaacagcaaccuua

SEQ ID NO: 454415 - RNA, 20 nt, Human
cagucccaauccagggccag

SEQ ID NO: 454416 - RNA, 22 nt, Human
cugaggaguuuggguuguucaa

SEQ ID NO: 454417 - RNA, 22 nt, Human
guaaucucagcuacuugggagg

SEQ ID NO: 454418 - RNA, 22 nt, Human
acugugugcccugacgccaggg

SEQ ID NO: 454419 - RNA, 22 nt, Human
ggagcugcuccuucagccaagu

SEQ ID NO: 454420 - RNA, 22 nt, Human
ggggcuggcucacuaagagacu

SEQ ID NO: 454421 - RNA, 22 nt, Human
acagaguacauucagagacuau

SEQ ID NO: 454422 - RNA, 22 nt, Human
cagagacagggcagggagugug

SEQ ID NO: 454423 - RNA, 19 nt, Human
ggcucucuuaaagcuguuu

SEQ ID NO: 454424 - RNA, 22 nt, Human
uccugguggcuuucccugccuu

SEQ ID NO: 454425 - RNA, 22 nt, Human
gcucugcugucuucuugcaggc

SEQ ID NO: 454426 - RNA, 22 nt, Human
ugggccuccaauuccagcggga

SEQ ID NO: 454427 - RNA, 22 nt, Human
acagauuuuaaaugacacuccc

SEQ ID NO: 454428 - RNA, 22 nt, Human
cagaggcucaccagccuuucac

SEQ ID NO: 454429 - RNA, 22 nt, Human
uuuagggaaauugaggguuaag

SEQ ID NO: 454430 - RNA, 22 nt, Human
cccaagggagugccuggucaac

SEQ ID NO: 454431 - RNA, 22 nt, Human
gacaagacauugguaaagauau

SEQ ID NO: 454432 - RNA, 20 nt, Human
gcaaauggaucccacaagcc

SEQ ID NO: 454433 - RNA, 22 nt, Human
uacccaggaggaaacugaggcu

SEQ ID NO: 454434 - RNA, 22 nt, Human
gaaugcuaagcaugugggaguu

SEQ ID NO: 454435 - RNA, 22 nt, Human
cagcuugcuaauuuugacuuca

SEQ ID NO: 454436 - RNA, 22 nt, Human
cagagcuguccaaacccugaca

SEQ ID NO: 454437 - RNA, 22 nt, Human
uucuaguucauauucucaaaga

SEQ ID NO: 454438 - RNA, 22 nt, Human
uuuccuuccuugcuagccugag

SEQ ID NO: 454439 - RNA, 22 nt, Human
cugccacuuucacccagugcuc

SEQ ID NO: 454440 - RNA, 22 nt, Human
cugccuggaaggagcaagggga

SEQ ID NO: 454441 - RNA, 22 nt, Human
gcucucugucguuaugcuucau

SEQ ID NO: 454442 - RNA, 22 nt, Human
gugucccacucuggaggugaag

SEQ ID NO: 454443 - RNA, 22 nt, Human
aggcucugcagaccccagcugu

SEQ ID NO: 454444 - RNA, 22 nt, Human
agcagcaggcuguguggacuga

SEQ ID NO: 454445 - RNA, 22 nt, Human
auaccuguguauccacaagcgu

SEQ ID NO: 454446 - RNA, 22 nt, Human
uuugaaaggagcuuuauccaga

SEQ ID NO: 454447 - RNA, 22 nt, Human
auuugucuuugagugcccugcu

SEQ ID NO: 454448 - RNA, 21 nt, Human
agcugcuccagggagcucagg

SEQ ID NO: 454449 - RNA, 22 nt, Human
uggcagcuugaaugcagucuuu

SEQ ID NO: 454450 - RNA, 22 nt, Human
cccuggagcaucucugcugucu

SEQ ID NO: 454451 - RNA, 22 nt, Human
uaguggaggggaugcaaagcuu

SEQ ID NO: 454452 - RNA, 20 nt, Human
uuucauugucagaaucuuau

SEQ ID NO: 454453 - RNA, 22 nt, Human
ugugaagcuggauccuggagcu

SEQ ID NO: 454454 - RNA, 22 nt, Human
gugcuuccaucuagagggucac

SEQ ID NO: 454455 - RNA, 22 nt, Human
gcagagcaguacucucuugacu

SEQ ID NO: 454456 - RNA, 22 nt, Human
ccuccagguguuacauaugacu

SEQ ID NO: 454457 - RNA, 22 nt, Human
ugucuuuucuacuguaagcaua

SEQ ID NO: 454458 - RNA, 22 nt, Human
gaggagggagcuggaagcucuu

SEQ ID NO: 454459 - RNA, 22 nt, Human
caguuuauagcucuagcagcuu

SEQ ID NO: 454460 - RNA, 21 nt, Human
aaggaaaagcuuggucucuga

SEQ ID NO: 454461 - RNA, 22 nt, Human
ugucucugugagaucugacgau

SEQ ID NO: 454462 - RNA, 22 nt, Human
ucaggccacggcucacugagac

SEQ ID NO: 454463 - RNA, 22 nt, Human
uaacagaagaugaaacuucuuu

SEQ ID NO: 454464 - RNA, 22 nt, Human
cagcucccagagugaccagcag

SEQ ID NO: 454465 - RNA, 21 nt, Human
aggaaguggccagauugggaa

SEQ ID NO: 454466 - RNA, 22 nt, Human
uucauucaucucuaaaaugccu

SEQ ID NO: 454467 - RNA, 22 nt, Human
uuucauaauagugcaguuuguu

SEQ ID NO: 454468 - RNA, 22 nt, Human
uggcugagaaguucugguggga

SEQ ID NO: 454469 - RNA, 22 nt, Human
ccagccagccuugaucugagua

SEQ ID NO: 454470 - RNA, 22 nt, Human
gccugcagcaugcuaggucuug

SEQ ID NO: 454471 - RNA, 22 nt, Human
aggcugagacugugcauuagug

SEQ ID NO: 454472 - RNA, 22 nt, Human
gcagaggcucuuuaaugcuuag

SEQ ID NO: 454473 - RNA, 22 nt, Human
agcuggagaugcccagcaccgg

SEQ ID NO: 454474 - RNA, 22 nt, Human
uuguuuucacagcuuugcccgg

SEQ ID NO: 454475 - RNA, 22 nt, Human
uuagagaaauucugguaaugua

SEQ ID NO: 454476 - RNA, 22 nt, Human
gcugagucuugagcacugagca

SEQ ID NO: 454477 - RNA, 19 nt, Human
ggcugucucggcccagcca

SEQ ID NO: 454478 - RNA, 22 nt, Human
aaaugcagauuuugaugcagca

SEQ ID NO: 454479 - RNA, 20 nt, Human
cccucugcuacacugggagc

SEQ ID NO: 454480 - RNA, 22 nt, Human
cugccucuauucacugaggcag

SEQ ID NO: 454481 - RNA, 22 nt, Human
gucaccagugcuaagaggugga

SEQ ID NO: 454482 - RNA, 22 nt, Human
ccagagccuggcaucugcauaa

SEQ ID NO: 454483 - RNA, 22 nt, Human
uccugcagagccgcccucaggu

SEQ ID NO: 454484 - RNA, 22 nt, Human
gcugaaggucucuggagagguc

SEQ ID NO: 454485 - RNA, 22 nt, Human
ccagcuggcacuguggcugccc

SEQ ID NO: 454486 - RNA, 22 nt, Human
gaggagaaagcagugauuugug

SEQ ID NO: 454487 - RNA, 22 nt, Human
ucagggcaggacaguguaggcc

SEQ ID NO: 454488 - RNA, 22 nt, Human
caaggccacguucugcaugcgg

SEQ ID NO: 454489 - RNA, 22 nt, Human
uggcagaguuggagguggaaga

SEQ ID NO: 454490 - RNA, 22 nt, Human
uggggugccgacagggagggca

SEQ ID NO: 454491 - RNA, 22 nt, Human
ugccuggguccaggccaagccu

SEQ ID NO: 454492 - RNA, 22 nt, Human
guggagacgggacagaagcuaa

SEQ ID NO: 454493 - RNA, 19 nt, Human
ugugaaagcuaguguucuu

SEQ ID NO: 454494 - RNA, 22 nt, Human
cucuggaauuaaggaagccugu

SEQ ID NO: 454495 - RNA, 22 nt, Human
cucuggccgcagcucagcucug

SEQ ID NO: 454496 - RNA, 22 nt, Human
aggcugagauagguggaucauu

SEQ ID NO: 454497 - RNA, 22 nt, Human
uuucuauuuacagugcuaggua

SEQ ID NO: 454498 - RNA, 22 nt, Human
ggccucucuccuuggcuugcag

SEQ ID NO: 454499 - RNA, 22 nt, Human
ccucuguccuggggaguggagc

SEQ ID NO: 454500 - RNA, 22 nt, Human
aaguccaguuuuuccagguggu

SEQ ID NO: 454501 - RNA, 22 nt, Human
ccugacucuggccaggccagcu

SEQ ID NO: 454502 - RNA, 22 nt, Human
gccuuccuuuuaccaccagcca

SEQ ID NO: 454503 - RNA, 22 nt, Human
ccugagugccaugagagcaccc

SEQ ID NO: 454504 - RNA, 21 nt, Human
gugucaugguugacuuuggca

SEQ ID NO: 454505 - RNA, 22 nt, Human
ugaggccugucauugucuuguu

SEQ ID NO: 454506 - RNA, 22 nt, Human
gcacagaaguaaaauacaaguc

SEQ ID NO: 454507 - RNA, 22 nt, Human
cugcugcauuccucuuuaugag

SEQ ID NO: 454508 - RNA, 22 nt, Human
agaagccaaaugccagugaccu

SEQ ID NO: 454509 - RNA, 22 nt, Human
guccacauaggaacccagcuuc

SEQ ID NO: 454510 - RNA, 22 nt, Human
uccucuggcucuuucccuagga

SEQ ID NO: 454511 - RNA, 22 nt, Human
gaaugcacacgugugugcaugc

SEQ ID NO: 454512 - RNA, 22 nt, Human
uuuguaaagucuguucugaguu

SEQ ID NO: 454513 - RNA, 22 nt, Human
ccuggagcaggagcugcagagg

SEQ ID NO: 454514 - RNA, 22 nt, Human
uuugcauugcagugguuuacag

SEQ ID NO: 454515 - RNA, 22 nt, Human
cuuccugaacaaugccaucaau

SEQ ID NO: 454516 - RNA, 22 nt, Human
uugaaagaagaagcugcgaugu

SEQ ID NO: 454517 - RNA, 22 nt, Human
cagaaggcuggcagauugagau

SEQ ID NO: 454518 - RNA, 22 nt, Human
uuugacagcuuguuacaaaguu

SEQ ID NO: 454519 - RNA, 22 nt, Human
agcuguucccucacugcaguca

SEQ ID NO: 454520 - RNA, 22 nt, Human
ccugucuggccaccagggcgau

SEQ ID NO: 454521 - RNA, 22 nt, Human
uagggacacugcucaugaguuc

SEQ ID NO: 454522 - RNA, 22 nt, Human
agaagcagcuuucaaggugauu

SEQ ID NO: 454523 - RNA, 22 nt, Human
uggccugcuuucauuugaugcu

SEQ ID NO: 454524 - RNA, 22 nt, Human
ucuacugugguccuuguaacca

SEQ ID NO: 454525 - RNA, 22 nt, Human
uccugagaugagacagugcugc

SEQ ID NO: 454526 - RNA, 22 nt, Human
cagugcagccaaggacaggcac

SEQ ID NO: 454527 - RNA, 22 nt, Human
aggaagcucggagagggcaaau

SEQ ID NO: 454528 - RNA, 22 nt, Human
gcugccagcucacucuccugag

SEQ ID NO: 454529 - RNA, 20 nt, Human
gcucccugguagaaauguuu

SEQ ID NO: 454530 - RNA, 22 nt, Human
ucuuagcauuucauaacaacug

SEQ ID NO: 454531 - RNA, 22 nt, Human
acugccaaugguaguuugaugg

SEQ ID NO: 454532 - RNA, 16 nt, Human
ccuuucucugccuucc

SEQ ID NO: 454533 - RNA, 22 nt, Human
agacaggcuuugcuguauauca

SEQ ID NO: 454534 - RNA, 22 nt, Human
guucuuaagaccacaauaaaaa

SEQ ID NO: 454535 - RNA, 22 nt, Human
auucagugugagguuuucaagu

SEQ ID NO: 454536 - RNA, 22 nt, Human
agucccuucucaaagugugcgg

SEQ ID NO: 454537 - RNA, 18 nt, Human
gacccagcagaugggcuu

SEQ ID NO: 454538 - RNA, 22 nt, Human
uuucccaaguguaaacauggca

SEQ ID NO: 454539 - RNA, 21 nt, Human
uucuuuccccagaggacuaaa

SEQ ID NO: 454540 - RNA, 22 nt, Human
uuuauugacccaaagcgagagu

SEQ ID NO: 454541 - RNA, 22 nt, Human
cuucuccucugaguccugggag

SEQ ID NO: 454542 - RNA, 22 nt, Human
gcacccaggccggcgacugcag

SEQ ID NO: 454543 - RNA, 21 nt, Human
acucaggagacuaacuauguc

SEQ ID NO: 454544 - RNA, 22 nt, Human
aucugaaagcuaggaguucuca

SEQ ID NO: 454545 - RNA, 22 nt, Human
ugcagccuugccuccucccagc

SEQ ID NO: 454546 - RNA, 20 nt, Human
ugcuuccuggccacugcggg

SEQ ID NO: 454547 - RNA, 22 nt, Human
cugcagagaauuguggggcuuc

SEQ ID NO: 454548 - RNA, 21 nt, Human
ugcagagauaucugaagcaga

SEQ ID NO: 454549 - RNA, 22 nt, Human
cugggggcaauggucagagugu

SEQ ID NO: 454550 - RNA, 22 nt, Human
ucauugcagaaauaaaggugaa

SEQ ID NO: 454551 - RNA, 22 nt, Human
ugcauuguugaugaguugaaua

SEQ ID NO: 454552 - RNA, 23 nt, Human
agaccugcaucugauaggcccug

SEQ ID NO: 454553 - RNA, 22 nt, Human
gggagccaaggagagaggccuu

SEQ ID NO: 454554 - RNA, 22 nt, Human
gaaggaaaggucucaugccuuu

SEQ ID NO: 454555 - RNA, 22 nt, Human
cuguggagcuuguggcaguggg

SEQ ID NO: 454556 - RNA, 22 nt, Human
cagccaucaguaaagacagcuu

SEQ ID NO: 454557 - RNA, 22 nt, Human
gaagccaacauuccaaguagaa

SEQ ID NO: 454558 - RNA, 22 nt, Human
ccaggacucaguggggaaaggg

SEQ ID NO: 454559 - RNA, 22 nt, Human
cuccaggccagggaaguggaca

SEQ ID NO: 454560 - RNA, 22 nt, Human
uaacagaaacagauaaguguaa

SEQ ID NO: 454561 - RNA, 22 nt, Human
cagaaguaagauuacugugagu

SEQ ID NO: 454562 - RNA, 22 nt, Human
cccagcaucccagugggcagca

SEQ ID NO: 454563 - RNA, 22 nt, Human
agccuggacagcuacggagaac

SEQ ID NO: 454564 - RNA, 22 nt, Human
ccaguuuuuccagugcuuucug

SEQ ID NO: 454565 - RNA, 22 nt, Human
aaacuguaagagaauaaacuac

SEQ ID NO: 454566 - RNA, 22 nt, Human
agcugguuagcaaucuaaguga

SEQ ID NO: 454567 - RNA, 22 nt, Human
ggguggcacaggugcagagggu

SEQ ID NO: 454568 - RNA, 22 nt, Human
uuucauguuuucuuaaauggca

SEQ ID NO: 454569 - RNA, 22 nt, Human
gcucagagauguucaguagcuu

SEQ ID NO: 454570 - RNA, 17 nt, Human
auuucacuuagcaugag

SEQ ID NO: 454571 - RNA, 22 nt, Human
cuguagcaaguuauucaauaaa

SEQ ID NO: 454572 - RNA, 22 nt, Human
caguuaaaggcccaauaucugg

SEQ ID NO: 454573 - RNA, 21 nt, Human
cucaggauggcggccuggugg

SEQ ID NO: 454574 - RNA, 22 nt, Human
augccacugacauggacaauuu

SEQ ID NO: 454575 - RNA, 22 nt, Human
cagggccaccguguuugcugcu

SEQ ID NO: 454576 - RNA, 22 nt, Human
ugccucugugugcaggugagca

SEQ ID NO: 454577 - RNA, 22 nt, Human
gagagcugcaagguagggcggg

SEQ ID NO: 454578 - RNA, 22 nt, Human
gccuggaggaauguagcugagg

SEQ ID NO: 454579 - RNA, 22 nt, Human
agacaaguucugugggucaccu

SEQ ID NO: 454580 - RNA, 22 nt, Human
auguuuaaaggguugagaaaua

SEQ ID NO: 454581 - RNA, 22 nt, Human
guguccuuuuaugugacugguu

SEQ ID NO: 454582 - RNA, 22 nt, Human
ggagaaagcuguaguggaaugu

SEQ ID NO: 454583 - RNA, 22 nt, Human
ugccagcacuucuggcugucug

SEQ ID NO: 454584 - RNA, 20 nt, Human
aggagaugauccagagucag

SEQ ID NO: 454585 - RNA, 22 nt, Human
aacauuuaugguagucauugca

SEQ ID NO: 454586 - RNA, 22 nt, Human
agggaggagaauggacuccuuc

SEQ ID NO: 454587 - RNA, 22 nt, Human
agcagggccugagugaccuaac

SEQ ID NO: 454588 - RNA, 23 nt, Human
ucacaggggccagcgcucugugg

SEQ ID NO: 454589 - RNA, 22 nt, Human
auaguggugagcugcauuuaug

SEQ ID NO: 454590 - RNA, 22 nt, Human
guggcccugucccaggccuccu

SEQ ID NO: 454591 - RNA, 22 nt, Human
gaaaaaugcuccaaaucugugg

SEQ ID NO: 454592 - RNA, 22 nt, Human
aagaauuuuccagcaugucagu

SEQ ID NO: 454593 - RNA, 22 nt, Human
ggcagcuggguuggccagaaac

SEQ ID NO: 454594 - RNA, 20 nt, Human
acaauagauuugagcaaagu

SEQ ID NO: 454595 - RNA, 22 nt, Human
cauugcuguuaauugucucuag

SEQ ID NO: 454596 - RNA, 22 nt, Human
ucucuucuugauuuucacugga

SEQ ID NO: 454597 - RNA, 22 nt, Human
ucccagagugugggcaucaagg

SEQ ID NO: 454598 - RNA, 22 nt, Human
ucccuggguccugcuugcucuc

SEQ ID NO: 454599 - RNA, 22 nt, Human
uggcagcacuagguacugagcu

SEQ ID NO: 454600 - RNA, 22 nt, Human
cacagcuggugacagagcccag

SEQ ID NO: 454601 - RNA, 20 nt, Human
cccaggagugagcagcuuua

SEQ ID NO: 454602 - RNA, 22 nt, Human
cccuggaggucagaggccuggg

SEQ ID NO: 454603 - RNA, 22 nt, Human
gcaggagcccuggcauguucuu

SEQ ID NO: 454604 - RNA, 22 nt, Human
agggaagugaaugacagauauc

SEQ ID NO: 454605 - RNA, 22 nt, Human
ugagacaguucugcagcugggu

SEQ ID NO: 454606 - RNA, 22 nt, Human
ggggcugggauuugaacccagg

SEQ ID NO: 454607 - RNA, 20 nt, Human
ugaaggccauuuguuccaga

SEQ ID NO: 454608 - RNA, 22 nt, Human
aaguuuaagguggaaguggugg

SEQ ID NO: 454609 - RNA, 22 nt, Human
guguguccucaguaguggcaug

SEQ ID NO: 454610 - RNA, 22 nt, Human
cugggcugcaguuccugguccu

SEQ ID NO: 454611 - RNA, 22 nt, Human
gcagagugggagcccagggcug

SEQ ID NO: 454612 - RNA, 22 nt, Human
agggcagcccuucugggagggc

SEQ ID NO: 454613 - RNA, 22 nt, Human
acuuggagagcauugcugggga

SEQ ID NO: 454614 - RNA, 22 nt, Human
agcugagcugcagaugacugua

SEQ ID NO: 454615 - RNA, 20 nt, Human
gcauugaguauagacagaug

SEQ ID NO: 454616 - RNA, 22 nt, Human
cuggcugcuggccugaggaugc

SEQ ID NO: 454617 - RNA, 22 nt, Human
guagggacuuguuuuacuagua

SEQ ID NO: 454618 - RNA, 22 nt, Human
cucucugcuguauccuuaggcu

SEQ ID NO: 454619 - RNA, 22 nt, Human
cagucacacaaguggacuuggg

SEQ ID NO: 454620 - RNA, 22 nt, Human
ugccagagaagacccagucacu

SEQ ID NO: 454621 - RNA, 23 nt, Human
aguuccagaaaaaugcucaagca

SEQ ID NO: 454622 - RNA, 22 nt, Human
guauuugauacaugaaauggug

SEQ ID NO: 454623 - RNA, 22 nt, Human
uugcaucuaccauaucaaagau

SEQ ID NO: 454624 - RNA, 22 nt, Human
aaacugaauucccaagggcaug

SEQ ID NO: 454625 - RNA, 22 nt, Human
uuuacagucucuauagucaaaa

SEQ ID NO: 454626 - RNA, 22 nt, Human
uauugaaaugaaugacagugau

SEQ ID NO: 454627 - RNA, 22 nt, Human
aaugcacaugucuuggccucac

SEQ ID NO: 454628 - RNA, 21 nt, Human
uagggcaggcauuggaagaga

SEQ ID NO: 454629 - RNA, 20 nt, Human
ucaggaugugcugagugaag

SEQ ID NO: 454630 - RNA, 22 nt, Human
gggcuggcucugucuagaaagg

SEQ ID NO: 454631 - RNA, 22 nt, Human
cuaguccacuguccugccucca

SEQ ID NO: 454632 - RNA, 22 nt, Human
gugugcagggaugagugcaggu

SEQ ID NO: 454633 - RNA, 22 nt, Human
uuuucuuauggugaagcacaaa

SEQ ID NO: 454634 - RNA, 22 nt, Human
uugcagggaccugcagaaagcu

SEQ ID NO: 454635 - RNA, 22 nt, Human
ugugaaggagcaugcagagggg

SEQ ID NO: 454636 - RNA, 22 nt, Human
agucucuuuugcgaagaguguu

SEQ ID NO: 454637 - RNA, 22 nt, Human
uaaguggaagguuauaugcuaa

SEQ ID NO: 454638 - RNA, 22 nt, Human
ggcagcaacucggagagaagag

SEQ ID NO: 454639 - RNA, 22 nt, Human
gaggcagcagaacauggaagag

SEQ ID NO: 454640 - RNA, 22 nt, Human
agggcagcacaaggcauggacu

SEQ ID NO: 454641 - RNA, 22 nt, Human
uccagcuuugagauuuuaugga

SEQ ID NO: 454642 - RNA, 22 nt, Human
ugcagggccgcuggaggucaug

SEQ ID NO: 454643 - RNA, 22 nt, Human
uuuauccauaucauuaaaaucu

SEQ ID NO: 454644 - RNA, 22 nt, Human
cauuuacuguugaaucccuagc

SEQ ID NO: 454645 - RNA, 23 nt, Human
ucagagagcuguugagagcugcc

SEQ ID NO: 454646 - RNA, 22 nt, Human
agagccugcuguguaagucaca

SEQ ID NO: 454647 - RNA, 22 nt, Human
ucagaggaauuugcuuuucaug

SEQ ID NO: 454648 - RNA, 22 nt, Human
ucaaagucauggcaggcucaga

SEQ ID NO: 454649 - RNA, 22 nt, Human
uauuucugaggcccaggaagug

SEQ ID NO: 454650 - RNA, 22 nt, Human
aggccuggcuuugguuugcuga

SEQ ID NO: 454651 - RNA, 22 nt, Human
auacauguucguguacauguuc

SEQ ID NO: 454652 - RNA, 22 nt, Human
ucagggacauuuagacacugau

SEQ ID NO: 454653 - RNA, 22 nt, Human
aaggccauuauucugauauauu

SEQ ID NO: 454654 - RNA, 22 nt, Human
cuggcucaccuccgcuccagca

SEQ ID NO: 454655 - RNA, 22 nt, Human
agcuuccuuggcgcugaggccu

SEQ ID NO: 454656 - RNA, 18 nt, Human
uccauuguucuacuguga

SEQ ID NO: 454657 - RNA, 22 nt, Human
augauggugggagaugacccag

SEQ ID NO: 454658 - RNA, 22 nt, Human
uggccacccagcugacgccuuc

SEQ ID NO: 454659 - RNA, 22 nt, Human
aacagcagggggaccugcuggu

SEQ ID NO: 454660 - RNA, 22 nt, Human
gauuauauaauggaagcucuug

SEQ ID NO: 454661 - RNA, 22 nt, Human
uggcugaguaaguugugauaug

SEQ ID NO: 454662 - RNA, 23 nt, Human
ucuuuccucagcacacaccaaga

SEQ ID NO: 454663 - RNA, 22 nt, Human
gcagggucgcucuaggagauca

SEQ ID NO: 454664 - RNA, 22 nt, Human
auuugucuagugguauucacgu

SEQ ID NO: 454665 - RNA, 22 nt, Human
cacucugagaaguacaagcucc

SEQ ID NO: 454666 - RNA, 22 nt, Human
uuccauaaucaccuuauucuuu

SEQ ID NO: 454667 - RNA, 22 nt, Human
gaggccacgguuuuccuugggg

SEQ ID NO: 454668 - RNA, 22 nt, Human
ucaucacucauuggacaacaga

SEQ ID NO: 454669 - RNA, 22 nt, Human
ugaggcucacaaaucugcauuu

SEQ ID NO: 454670 - RNA, 22 nt, Human
cauuuucagcacccaucugaaa

SEQ ID NO: 454671 - RNA, 22 nt, Human
caagggccuccaccuugcucgu

SEQ ID NO: 454672 - RNA, 22 nt, Human
aaugaugggaaggagaaaagca

SEQ ID NO: 454673 - RNA, 22 nt, Human
ugugcaguuucuauguugucca

SEQ ID NO: 454674 - RNA, 22 nt, Human
gaacagcccuguuaagucuguu

SEQ ID NO: 454675 - RNA, 22 nt, Human
aggcacugauucucagaguuac

SEQ ID NO: 454676 - RNA, 22 nt, Human
agcagcuggggccugugacgau

SEQ ID NO: 454677 - RNA, 22 nt, Human
uggagcaggugggaugucguga

SEQ ID NO: 454678 - RNA, 22 nt, Human
cugggaguugacgaggcuugua

SEQ ID NO: 454679 - RNA, 22 nt, Human
ugucucagaggcaggaagagcc

SEQ ID NO: 454680 - RNA, 22 nt, Human
aagauguaucaguuaagucuuc

SEQ ID NO: 454681 - RNA, 22 nt, Human
acagggcagaaauguugcaucu

SEQ ID NO: 454682 - RNA, 22 nt, Human
acuuaaaaagaaucuuuucacg

SEQ ID NO: 454683 - RNA, 22 nt, Human
gaggguccccaugcagagcuca

SEQ ID NO: 454684 - RNA, 22 nt, Human
ugcagggcccucauuccugucc

SEQ ID NO: 454685 - RNA, 22 nt, Human
ucacaguaaaagcauggaagag

SEQ ID NO: 454686 - RNA, 18 nt, Human
ggagagugagaucaaaca

SEQ ID NO: 454687 - RNA, 22 nt, Human
ucaggugguccuaagugccauc

SEQ ID NO: 454688 - RNA, 22 nt, Human
agcagggcugcagugugucuuu

SEQ ID NO: 454689 - RNA, 23 nt, Human
aggaggccugaaacugaggcuga

SEQ ID NO: 454690 - RNA, 22 nt, Human
agauggaguuaguaccagaguc

SEQ ID NO: 454691 - RNA, 22 nt, Human
ucagagcugcccaugcaagggg

SEQ ID NO: 454692 - RNA, 19 nt, Human
agccacagaacuugcagga

SEQ ID NO: 454693 - RNA, 22 nt, Human
aauuaggggaggacguaucaua

SEQ ID NO: 454694 - RNA, 22 nt, Human
gagcuuaggccagggacaggga

SEQ ID NO: 454695 - RNA, 22 nt, Human
ugucaccaguuccaggaaauaa

SEQ ID NO: 454696 - RNA, 22 nt, Human
uggggcaguuaauaaacauucu

SEQ ID NO: 454697 - RNA, 22 nt, Human
aaggccugggaguacugggaca

SEQ ID NO: 454698 - RNA, 22 nt, Human
ccugccugcuuucugcuuugca

SEQ ID NO: 454699 - RNA, 22 nt, Human
acagaacugggaaaugcacaua

SEQ ID NO: 454700 - RNA, 20 nt, Human
uccugguggauacugcuuaa

SEQ ID NO: 454701 - RNA, 22 nt, Human
acagguggaaacaugguguugg

SEQ ID NO: 454702 - RNA, 22 nt, Human
gcccucuggcagccuuggcugg

SEQ ID NO: 454703 - RNA, 20 nt, Human
aucuggcucagauccugcag

SEQ ID NO: 454704 - RNA, 22 nt, Human
uucugaaaggcagguuguuugc

SEQ ID NO: 454705 - RNA, 22 nt, Human
uggcugggggugcuauagcugc

SEQ ID NO: 454706 - RNA, 22 nt, Human
gagggcucuaccaaguaacucu

SEQ ID NO: 454707 - RNA, 22 nt, Human
uacaguagacaauguuaguaug

SEQ ID NO: 454708 - RNA, 22 nt, Human
ucugugucugcagaaguucagc

SEQ ID NO: 454709 - RNA, 22 nt, Human
ugggcugagcacugaggaagga

SEQ ID NO: 454710 - RNA, 22 nt, Human
caggagacuauggcccaaggcc

SEQ ID NO: 454711 - RNA, 18 nt, Human
agcagaauucuaggguuc

SEQ ID NO: 454712 - RNA, 22 nt, Human
caauaauauccugugcuguuug

SEQ ID NO: 454713 - RNA, 22 nt, Human
aagccagguguugugguaagag

SEQ ID NO: 454714 - RNA, 22 nt, Human
aggucagaagugccagggaauu

SEQ ID NO: 454715 - RNA, 19 nt, Human
ucaucucacagggccuggc

SEQ ID NO: 454716 - RNA, 22 nt, Human
uuguuaaaaauagauuuccagg

SEQ ID NO: 454717 - RNA, 22 nt, Human
gccuggcaggggccugggagug

SEQ ID NO: 454718 - RNA, 21 nt, Human
aaauuucugcaagccucaacu

SEQ ID NO: 454719 - RNA, 21 nt, Human
ucagaguggaagacaguuuga

SEQ ID NO: 454720 - RNA, 22 nt, Human
uggaggcagucaaaugacugac

SEQ ID NO: 454721 - RNA, 22 nt, Human
acccucaacaaauucacucuau

SEQ ID NO: 454722 - RNA, 20 nt, Human
gucaggauuaguaaacucug

SEQ ID NO: 454723 - RNA, 22 nt, Human
gagcaggccagcaauggaaggg

SEQ ID NO: 454724 - RNA, 22 nt, Human
cccucagcuucucccugcagcu

SEQ ID NO: 454725 - RNA, 23 nt, Human
agggaaaguaguaauggccuuug

SEQ ID NO: 454726 - RNA, 22 nt, Human
agccuucaguaaauccacugug

SEQ ID NO: 454727 - RNA, 22 nt, Human
ccucccacuucuugcugagguc

SEQ ID NO: 454728 - RNA, 22 nt, Human
cuguaaaacugcuuaaguaugc

SEQ ID NO: 454729 - RNA, 22 nt, Human
caucaucaaaacaaauggaguc

SEQ ID NO: 454730 - RNA, 19 nt, Human
uccucaggggcucacagac

SEQ ID NO: 454731 - RNA, 22 nt, Human
aggcuuccuggaggaagaggua

SEQ ID NO: 454732 - RNA, 22 nt, Human
gcuuuaaauggcuugcccaagu

SEQ ID NO: 454733 - RNA, 22 nt, Human
caugaguucaucugcuucucuu

SEQ ID NO: 454734 - RNA, 22 nt, Human
cagagcuggcucugcauguaca

SEQ ID NO: 454735 - RNA, 22 nt, Human
uugucugugaaauggaaauagu

SEQ ID NO: 454736 - RNA, 22 nt, Human
agagccuggucugagauaggac

SEQ ID NO: 454737 - RNA, 22 nt, Human
uaaaguauccaguuauucuucu

SEQ ID NO: 454738 - RNA, 22 nt, Human
ccucagcucuucccugugcaca

SEQ ID NO: 454739 - RNA, 20 nt, Human
uaaggcuguuuuguauuccu

SEQ ID NO: 454740 - RNA, 23 nt, Human
agagcaucaugaugcuaagucug

SEQ ID NO: 454741 - RNA, 22 nt, Human
ggaggccaaggcgggcggauca

SEQ ID NO: 454742 - RNA, 22 nt, Human
gcuggccugcugggcaccaccg

SEQ ID NO: 454743 - RNA, 22 nt, Human
cagcugagcaucacuagucugg

SEQ ID NO: 454744 - RNA, 22 nt, Human
guuauaaaugacugcaaaaguu

SEQ ID NO: 454745 - RNA, 22 nt, Human
ucucuucuagcuucuugugguu

SEQ ID NO: 454746 - RNA, 22 nt, Human
ccuggugcuuaccagagcuuuu

SEQ ID NO: 454747 - RNA, 22 nt, Human
uaaucacagaaacagacuguuu

SEQ ID NO: 454748 - RNA, 22 nt, Human
guaagggauuugaacauagguu

SEQ ID NO: 454749 - RNA, 22 nt, Human
aauuuagaauucgcuagcuaau

SEQ ID NO: 454750 - RNA, 22 nt, Human
gccucgaggcugagaaggcaca

SEQ ID NO: 454751 - RNA, 22 nt, Human
gggccugacugagagcuccuca

SEQ ID NO: 454752 - RNA, 22 nt, Human
gcagcuggagcaucuucucauc

SEQ ID NO: 454753 - RNA, 20 nt, Human
gagauggcuaagugcugaac

SEQ ID NO: 454754 - RNA, 21 nt, Human
ccuggccaaucugauaggguu

SEQ ID NO: 454755 - RNA, 22 nt, Human
accaggcagcugggggugaugu

SEQ ID NO: 454756 - RNA, 22 nt, Human
gggcuuggcacaugggcucagc

SEQ ID NO: 454757 - RNA, 22 nt, Human
uacaggcacugaaaugcuuauu

SEQ ID NO: 454758 - RNA, 17 nt, Human
uguuuucauucauugcu

SEQ ID NO: 454759 - RNA, 22 nt, Human
uuucccaagaaaaauaauugga

SEQ ID NO: 454760 - RNA, 17 nt, Human
gguggccugcaguggcu

SEQ ID NO: 454761 - RNA, 19 nt, Human
agcauccagucaugggauc

SEQ ID NO: 454762 - RNA, 22 nt, Human
ugcauguuaagaaaauauugag

SEQ ID NO: 454763 - RNA, 22 nt, Human
gaaauucaggacaaagacucuu

SEQ ID NO: 454764 - RNA, 22 nt, Human
gggcaggaggcuaauucugcau

SEQ ID NO: 454765 - RNA, 22 nt, Human
guggcuucugcggugugcgcag

SEQ ID NO: 454766 - RNA, 22 nt, Human
uuuguaaaggccugaauuucag

SEQ ID NO: 454767 - RNA, 23 nt, Human
uugaaggagaaagcuuucuuggu

SEQ ID NO: 454768 - RNA, 22 nt, Human
aguauacauauauuagccuucg

SEQ ID NO: 454769 - RNA, 22 nt, Human
agccucugcuuaugcaaaggua

SEQ ID NO: 454770 - RNA, 22 nt, Human
acaagauuuuaugacucuuuuu

SEQ ID NO: 454771 - RNA, 22 nt, Human
ucaguuuucucaucugugaaau

SEQ ID NO: 454772 - RNA, 22 nt, Human
gccugccacgcaugcagaguca

SEQ ID NO: 454773 - RNA, 22 nt, Human
uaucuuugcaaauaucucuaag

SEQ ID NO: 454774 - RNA, 22 nt, Human
ucccaggauguuggcggcaggu

SEQ ID NO: 454775 - RNA, 18 nt, Human
aaugcacacauuuacucc

SEQ ID NO: 454776 - RNA, 22 nt, Human
aagcuggcaauuaucaaaacug

SEQ ID NO: 454777 - RNA, 22 nt, Human
gcagcugcuguggcaucaagcu

SEQ ID NO: 454778 - RNA, 22 nt, Human
agucucugcugguugugccuau

SEQ ID NO: 454779 - RNA, 22 nt, Human
aaugucugaaaaucagacugca

SEQ ID NO: 454780 - RNA, 22 nt, Human
aggucccaggcauagcuggucu

SEQ ID NO: 454781 - RNA, 22 nt, Human
ucaggagggugacaggcccugg

SEQ ID NO: 454782 - RNA, 22 nt, Human
ugagccagccuugcagcugugc

SEQ ID NO: 454783 - RNA, 22 nt, Human
uaagcugugggagauuggcaua

SEQ ID NO: 454784 - RNA, 22 nt, Human
uccugggcuugcuccuccagcu

SEQ ID NO: 454785 - RNA, 22 nt, Human
gagccugaugaaacaggcagac

SEQ ID NO: 454786 - RNA, 22 nt, Human
agggagaaaauuggaugcacaa

SEQ ID NO: 454787 - RNA, 22 nt, Human
cauuaggguaauugaacacuua

SEQ ID NO: 454788 - RNA, 22 nt, Human
gcagggcucugcuguaguccua

SEQ ID NO: 454789 - RNA, 19 nt, Human
cacagggcaggucucaugu

SEQ ID NO: 454790 - RNA, 22 nt, Human
gguuuauuaaugugaacuguau

SEQ ID NO: 454791 - RNA, 22 nt, Human
cacagcuugggcucugacaaua

SEQ ID NO: 454792 - RNA, 22 nt, Human
ucuggcucacuucaggcuucac

SEQ ID NO: 454793 - RNA, 22 nt, Human
ccuuggaggacugcugcuucuu

SEQ ID NO: 454794 - RNA, 22 nt, Human
cagcagagcauuugguaggagg

SEQ ID NO: 454795 - RNA, 22 nt, Human
agauacaucuugaacuucuaga

SEQ ID NO: 454796 - RNA, 22 nt, Human
uguggcaggaagagcuucugag

SEQ ID NO: 454797 - RNA, 22 nt, Human
uggacucaaguccaaguucacg

SEQ ID NO: 454798 - RNA, 22 nt, Human
ccucaggauccgcaggugcagu

SEQ ID NO: 454799 - RNA, 22 nt, Human
ucccagagaaagucaaggucuu

SEQ ID NO: 454800 - RNA, 22 nt, Human
cugguccuugacgcgugggagg

SEQ ID NO: 454801 - RNA, 22 nt, Human
uggccugggcaugaagcaucgu

SEQ ID NO: 454802 - RNA, 22 nt, Human
agccauugaguuuuaugugcua

SEQ ID NO: 454803 - RNA, 22 nt, Human
acugggaggcaaagagcaagga

SEQ ID NO: 454804 - RNA, 22 nt, Human
uuucaauguaugucuuucugag

SEQ ID NO: 454805 - RNA, 20 nt, Human
ccagagcugauggcugcccg

SEQ ID NO: 454806 - RNA, 22 nt, Human
aggaccuggaucacagagaucu

SEQ ID NO: 454807 - RNA, 22 nt, Human
cuuagaaaucgaacucagguua

SEQ ID NO: 454808 - RNA, 22 nt, Human
ugcaggccggcccuaggccuca

SEQ ID NO: 454809 - RNA, 22 nt, Human
ggaggccuugaggccaggagcu

SEQ ID NO: 454810 - RNA, 22 nt, Human
caguguggagggagagagccug

SEQ ID NO: 454811 - RNA, 22 nt, Human
aauuaugagguagauaucacau

SEQ ID NO: 454812 - RNA, 22 nt, Human
agcugugguucugggcagcgac

SEQ ID NO: 454813 - RNA, 22 nt, Human
ccagcuggugggucuuucucug

SEQ ID NO: 454814 - RNA, 22 nt, Human
agggcugacacaccuuauccuc

SEQ ID NO: 454815 - RNA, 22 nt, Human
uuucacaacguuguggugagag

SEQ ID NO: 454816 - RNA, 22 nt, Human
gucacuggggccacaugcagaa

SEQ ID NO: 454817 - RNA, 22 nt, Human
cuggcagcuggaggcuagaggc

SEQ ID NO: 454818 - RNA, 22 nt, Human
uguguuccugccuggcucuggu

SEQ ID NO: 454819 - RNA, 22 nt, Human
cauguacaguuuuucuguccug

SEQ ID NO: 454820 - RNA, 22 nt, Human
caggacagguguucuagaucag

SEQ ID NO: 454821 - RNA, 22 nt, Human
gcuggaaggcuaggcucaguug

SEQ ID NO: 454822 - RNA, 22 nt, Human
cccuucccuucugggagaucca

SEQ ID NO: 454823 - RNA, 22 nt, Human
aacuguaauuuuuacauaguaa

SEQ ID NO: 454824 - RNA, 22 nt, Human
acagagcauauaaagugcuuug

SEQ ID NO: 454825 - RNA, 22 nt, Human
gcuggagauaguaggauccaua

SEQ ID NO: 454826 - RNA, 22 nt, Human
ggccagagaauaugccuuacgu

SEQ ID NO: 454827 - RNA, 22 nt, Human
agaacagaugugggcagaccug

SEQ ID NO: 454828 - RNA, 22 nt, Human
aggcugagagcaacgugucaga

SEQ ID NO: 454829 - RNA, 22 nt, Human
ggcuccuguggcaagacagcuu

SEQ ID NO: 454830 - RNA, 22 nt, Human
aggcacugaauauccaguaaaa

SEQ ID NO: 454831 - RNA, 22 nt, Human
gugggcaaggucccugccagcu

SEQ ID NO: 454832 - RNA, 22 nt, Human
cugggaggcagucucucuagaa

SEQ ID NO: 454833 - RNA, 22 nt, Human
acaacacagcaaaaccccaucu

SEQ ID NO: 454834 - RNA, 22 nt, Human
ucauuucuauugcuacugucug

SEQ ID NO: 454835 - RNA, 22 nt, Human
uacaguagaauuuuuaguaacu

SEQ ID NO: 454836 - RNA, 23 nt, Human
cauggcagcaagagcucauggcc

SEQ ID NO: 454837 - RNA, 22 nt, Human
cagcacugcugcuguacacaca

SEQ ID NO: 454838 - RNA, 22 nt, Human
uuccucucgcucuccggggccc

SEQ ID NO: 454839 - RNA, 22 nt, Human
agauacauuaguaguuacuugu

SEQ ID NO: 454840 - RNA, 18 nt, Human
aggcagcagcaucuucuc

SEQ ID NO: 454841 - RNA, 22 nt, Human
cacucaggguacaauggagggc

SEQ ID NO: 454842 - RNA, 22 nt, Human
ugaggcuugucucagauggggg

SEQ ID NO: 454843 - RNA, 22 nt, Human
cccugcagccggccagcucauu

SEQ ID NO: 454844 - RNA, 22 nt, Human
aaacagcugucauuguuuuaaa

SEQ ID NO: 454845 - RNA, 22 nt, Human
uucacuuauagggauguuauug

SEQ ID NO: 454846 - RNA, 20 nt, Human
guggccucucacauucugag

SEQ ID NO: 454847 - RNA, 18 nt, Human
aaaaugcaggcgacaugg

SEQ ID NO: 454848 - RNA, 22 nt, Human
guuucauucggcagcucauaag

SEQ ID NO: 454849 - RNA, 22 nt, Human
guuugaaaaaagcaguauguaa

SEQ ID NO: 454850 - RNA, 22 nt, Human
cuggaaggcucugcugccuguc

SEQ ID NO: 454851 - RNA, 22 nt, Human
cagcaucccucaggggccucug

SEQ ID NO: 454852 - RNA, 22 nt, Human
augggaugcauggcuguggcca

SEQ ID NO: 454853 - RNA, 22 nt, Human
cagaggccuuucuacagugaua

SEQ ID NO: 454854 - RNA, 22 nt, Human
gcugagguaggagguugcagug

SEQ ID NO: 454855 - RNA, 23 nt, Human
acugagccagggccugggucagc

SEQ ID NO: 454856 - RNA, 22 nt, Human
ugaaacaaauuuggaaaaucua

SEQ ID NO: 454857 - RNA, 22 nt, Human
cugccagcacugccuccugagg

SEQ ID NO: 454858 - RNA, 22 nt, Human
gccuucugaucgcuggacugac

SEQ ID NO: 454859 - RNA, 22 nt, Human
uggcugagaccuucccaaauuc

SEQ ID NO: 454860 - RNA, 22 nt, Human
gcugcagcagaaguucucagag

SEQ ID NO: 454861 - RNA, 22 nt, Human
agcacagaguugcagagagcgu

SEQ ID NO: 454862 - RNA, 22 nt, Human
acagaauuaucaggaaauguua

SEQ ID NO: 454863 - RNA, 22 nt, Human
uucucuagguuuuagaugaaga

SEQ ID NO: 454864 - RNA, 22 nt, Human
agggacagucuacuguucacug

SEQ ID NO: 454865 - RNA, 22 nt, Human
uuccaaaggaauggggagcuau

SEQ ID NO: 454866 - RNA, 22 nt, Human
cuggggugucucgucugccauu

SEQ ID NO: 454867 - RNA, 22 nt, Human
gaggggcuggcacgauggcugc

SEQ ID NO: 454868 - RNA, 23 nt, Human
ucugagagaacaaugccuccuau

SEQ ID NO: 454869 - RNA, 22 nt, Human
ucucagagcucacaccuccugg

SEQ ID NO: 454870 - RNA, 22 nt, Human
agaauucuggaguugggaggaa

SEQ ID NO: 454871 - RNA, 22 nt, Human
caaaugugguuucucagcauuc

SEQ ID NO: 454872 - RNA, 22 nt, Human
agccuggccaggccugcccagg

SEQ ID NO: 454873 - RNA, 22 nt, Human
uguucaauccccagguccugaa

SEQ ID NO: 454874 - RNA, 22 nt, Human
uauuucuauuccccaggcaagu

SEQ ID NO: 454875 - RNA, 22 nt, Human
uccagccacucagcagggauug

SEQ ID NO: 454876 - RNA, 22 nt, Human
ucacucagguucaugucuuugu

SEQ ID NO: 454877 - RNA, 22 nt, Human
ucagagagccucaggcacugcc

SEQ ID NO: 454878 - RNA, 22 nt, Human
aggccuguuccuuccugggcac

SEQ ID NO: 454879 - RNA, 22 nt, Human
gggcagauggggcacaggcuga

SEQ ID NO: 454880 - RNA, 22 nt, Human
gcuuuuauuucuucacaaaagu

SEQ ID NO: 454881 - RNA, 22 nt, Human
cagcuguguagaugcaggguca

SEQ ID NO: 454882 - RNA, 22 nt, Human
ggaagaagggucauuggcagcc

SEQ ID NO: 454883 - RNA, 22 nt, Human
gccuuccugcagcucugagcgu

SEQ ID NO: 454884 - RNA, 22 nt, Human
uucccaggcugugcuaccagag

SEQ ID NO: 454885 - RNA, 22 nt, Human
caguggcagagaacagagaccu

SEQ ID NO: 454886 - RNA, 22 nt, Human
ugguaauuuacgcauuucugua

SEQ ID NO: 454887 - RNA, 22 nt, Human
uccugggguccugacugcuucc

SEQ ID NO: 454888 - RNA, 22 nt, Human
agcagcagauccaaaaaaugug

SEQ ID NO: 454889 - RNA, 22 nt, Human
gccagguggucuggcuccagag

SEQ ID NO: 454890 - RNA, 18 nt, Human
caguuuuuauaucuggca

SEQ ID NO: 454891 - RNA, 22 nt, Human
agucacaguuccuacccaguaa

SEQ ID NO: 454892 - RNA, 22 nt, Human
acuuucauuuguaauaaacuuc

SEQ ID NO: 454893 - RNA, 22 nt, Human
aucuuugaagaggacuugaagu

SEQ ID NO: 454894 - RNA, 22 nt, Human
uuccucuccucacaugagucac

SEQ ID NO: 454895 - RNA, 22 nt, Human
cauuguuaccaucuuuuaccua

SEQ ID NO: 454896 - RNA, 22 nt, Human
ucucugauguauaucagagaac

SEQ ID NO: 454897 - RNA, 22 nt, Human
auuaauuuuaccuuuguaaaca

SEQ ID NO: 454898 - RNA, 22 nt, Human
aagggaggggauguaagccugg

SEQ ID NO: 454899 - RNA, 22 nt, Human
uucuuuaaaauagugagaaaga

SEQ ID NO: 454900 - RNA, 22 nt, Human
cugagccaaaaagcagagcuug

SEQ ID NO: 454901 - RNA, 22 nt, Human
uauuucuggcuuugagggugau

SEQ ID NO: 454902 - RNA, 22 nt, Human
ggaggagacccugugucaguuu

SEQ ID NO: 454903 - RNA, 22 nt, Human
guggugcaggccagcaggggcg

SEQ ID NO: 454904 - RNA, 22 nt, Human
agccagggauggcagugcccag

SEQ ID NO: 454905 - RNA, 22 nt, Human
cagacccugggccacagaggag

SEQ ID NO: 454906 - RNA, 22 nt, Human
ucacuucacacccacuaucaug

SEQ ID NO: 454907 - RNA, 22 nt, Human
ugaaguccuagaacuccuggua

SEQ ID NO: 454908 - RNA, 22 nt, Human
cagcuucccuuggcugagcaga

SEQ ID NO: 454909 - RNA, 22 nt, Human
uuucuauuggcgucacuguugu

SEQ ID NO: 454910 - RNA, 21 nt, Human
uggccaaacuggagcauuuga

SEQ ID NO: 454911 - RNA, 17 nt, Human
guccuacccauggucua

SEQ ID NO: 454912 - RNA, 19 nt, Human
aggucauugauagugcagg

SEQ ID NO: 454913 - RNA, 22 nt, Human
ucaggcagaaaaaucacuaauu

SEQ ID NO: 454914 - RNA, 22 nt, Human
aaugaacaucaaaugccuacca

SEQ ID NO: 454915 - RNA, 22 nt, Human
cugaagcacagcauauaaauaa

SEQ ID NO: 454916 - RNA, 22 nt, Human
ucaguuuuuguuugccagauag

SEQ ID NO: 454917 - RNA, 22 nt, Human
ggcugcaggcagaggcugucug

SEQ ID NO: 454918 - RNA, 22 nt, Human
gcaaaauuuacacuccuucuuc

SEQ ID NO: 454919 - RNA, 22 nt, Human
cuggcagguggauggggacucc

SEQ ID NO: 454920 - RNA, 22 nt, Human
ggugacugguuuaucuggcagu

SEQ ID NO: 454921 - RNA, 22 nt, Human
uucacagggcagcagcugagcc

SEQ ID NO: 454922 - RNA, 22 nt, Human
gauaugaaguggcauugugaag

SEQ ID NO: 454923 - RNA, 22 nt, Human
agcagccaaccuuacauucauc

SEQ ID NO: 454924 - RNA, 22 nt, Human
uaguuaggaauagcagcgacuc

SEQ ID NO: 454925 - RNA, 22 nt, Human
uaaagguacgaagugagggauu

SEQ ID NO: 454926 - RNA, 21 nt, Human
accaggcuugugggagggagc

SEQ ID NO: 454927 - RNA, 22 nt, Human
auguguacaaccaagcacuaaa

SEQ ID NO: 454928 - RNA, 22 nt, Human
cucugagagagcuggugagcac

SEQ ID NO: 454929 - RNA, 17 nt, Human
uggcaagaauggaaaug

SEQ ID NO: 454930 - RNA, 22 nt, Human
aaggccaugcacauccuaggca

SEQ ID NO: 454931 - RNA, 22 nt, Human
gaagaaggugccagaggcuuac

SEQ ID NO: 454932 - RNA, 22 nt, Human
cuggcagcguguuuaugaacau

SEQ ID NO: 454933 - RNA, 22 nt, Human
ggccuagggaguggccaugccu

SEQ ID NO: 454934 - RNA, 20 nt, Human
uucuuucaucuacacguugu

SEQ ID NO: 454935 - RNA, 22 nt, Human
caggaugggugucggccagcac

SEQ ID NO: 454936 - RNA, 22 nt, Human
ucucccaggucauacacagaga

SEQ ID NO: 454937 - RNA, 20 nt, Human
ccugucucacguuccgcccc

SEQ ID NO: 454938 - RNA, 22 nt, Human
gggaagggagggaccucagucu

SEQ ID NO: 454939 - RNA, 22 nt, Human
ccacugucagaggggcugugcc

SEQ ID NO: 454940 - RNA, 22 nt, Human
agcccagguugaggcugcagug

SEQ ID NO: 454941 - RNA, 22 nt, Human
gcacagggagacagccguggcc

SEQ ID NO: 454942 - RNA, 22 nt, Human
agggccuggaacuggagaccac

SEQ ID NO: 454943 - RNA, 22 nt, Human
agccaggcggggcagguuuccu

SEQ ID NO: 454944 - RNA, 18 nt, Human
gcagcuuuugauucaccc

SEQ ID NO: 454945 - RNA, 22 nt, Human
ggcacugacacuagcauggcac

SEQ ID NO: 454946 - RNA, 22 nt, Human
uagugcacacgcauguagcagu

SEQ ID NO: 454947 - RNA, 22 nt, Human
uuuaaauuuagaagaaacacug

SEQ ID NO: 454948 - RNA, 21 nt, Human
uauacaugugugcauacgugu

SEQ ID NO: 454949 - RNA, 22 nt, Human
aggagaguaccauugggccgca

SEQ ID NO: 454950 - RNA, 18 nt, Human
gggcucacacaggucauc

SEQ ID NO: 454951 - RNA, 22 nt, Human
ccagggcaggagaaagacucac

SEQ ID NO: 454952 - RNA, 22 nt, Human
ccuggcuccugccucugcaggg

SEQ ID NO: 454953 - RNA, 22 nt, Human
cuuuccaacucuagugaaauuu

SEQ ID NO: 454954 - RNA, 22 nt, Human
uuucaaagguggaagagugaau

SEQ ID NO: 454955 - RNA, 22 nt, Human
aaaaguaauugaugcaaucgua

SEQ ID NO: 454956 - RNA, 22 nt, Human
aggcucagucuguucaugcacu

SEQ ID NO: 454957 - RNA, 22 nt, Human
uuuguucauuuugagcucauca

SEQ ID NO: 454958 - RNA, 22 nt, Human
agugcaauguguacagaaaaau

SEQ ID NO: 454959 - RNA, 22 nt, Human
ggggcagaaguagugccccuga

SEQ ID NO: 454960 - RNA, 22 nt, Human
ucaggaguccugccugcagccu

SEQ ID NO: 454961 - RNA, 22 nt, Human
ucacaacuugaagcugauuuaa

SEQ ID NO: 454962 - RNA, 22 nt, Human
aggcuguccucucuugcucagu

SEQ ID NO: 454963 - RNA, 22 nt, Human
gcucagagauggggaaugaaaa

SEQ ID NO: 454964 - RNA, 22 nt, Human
uuuauuauucucuggagaaugu

SEQ ID NO: 454965 - RNA, 22 nt, Human
gguguccaucaggcugugcuuc

SEQ ID NO: 454966 - RNA, 22 nt, Human
gucaggaugcuauuguuauuaa

SEQ ID NO: 454967 - RNA, 22 nt, Human
agugucugccaacugcaugguc

SEQ ID NO: 454968 - RNA, 22 nt, Human
gcucagagcuugaaguuccacu

SEQ ID NO: 454969 - RNA, 20 nt, Human
uucugcuugcaaauaucaag

SEQ ID NO: 454970 - RNA, 22 nt, Human
ggacagagcccugguggccuaa

SEQ ID NO: 454971 - RNA, 22 nt, Human
agcucccagcagagcuggccac

SEQ ID NO: 454972 - RNA, 21 nt, Human
ugggagagggcucagcuaccc

SEQ ID NO: 454973 - RNA, 22 nt, Human
ugcagaaggaggaggaaaucca

SEQ ID NO: 454974 - RNA, 22 nt, Human
agcagcugaucaaagcacuuau

SEQ ID NO: 454975 - RNA, 22 nt, Human
cagaggcauauaauugcugggg

SEQ ID NO: 454976 - RNA, 20 nt, Human
ugcagagcuggcuggcuccu

SEQ ID NO: 454977 - RNA, 22 nt, Human
gaacccaggcuuuugaggcugu

SEQ ID NO: 454978 - RNA, 22 nt, Human
aggcucaguauagcuggcaagu

SEQ ID NO: 454979 - RNA, 22 nt, Human
ggggacugccuuccacagacac

SEQ ID NO: 454980 - RNA, 22 nt, Human
aggagcugagucagcccgacag

SEQ ID NO: 454981 - RNA, 18 nt, Human
gggaagccgggaagccgg

SEQ ID NO: 454982 - RNA, 22 nt, Human
cuggcuccaucacugggugaug

SEQ ID NO: 454983 - RNA, 22 nt, Human
ugcagagguuuccaggcaaguu

SEQ ID NO: 454984 - RNA, 22 nt, Human
ucucuucugaaaccugucuuua

SEQ ID NO: 454985 - RNA, 22 nt, Human
guagcccaccuggggagggcga

SEQ ID NO: 454986 - RNA, 22 nt, Human
ucucauugguauauacaugugu

SEQ ID NO: 454987 - RNA, 22 nt, Human
ugagccaguggaagauggcagu

SEQ ID NO: 454988 - RNA, 22 nt, Human
caagaugccccugguagggauc

SEQ ID NO: 454989 - RNA, 22 nt, Human
cugggcagaauuuuaggauggc

SEQ ID NO: 454990 - RNA, 22 nt, Human
agccugucugucuccaaagcug

SEQ ID NO: 454991 - RNA, 22 nt, Human
cucagcagagaccagggaggaa

SEQ ID NO: 454992 - RNA, 22 nt, Human
ucuuuauuucugaaucccccau

SEQ ID NO: 454993 - RNA, 22 nt, Human
uccuucagucuucugagccaua

SEQ ID NO: 454994 - RNA, 22 nt, Human
uaccacuacauuugcuaauggc

SEQ ID NO: 454995 - RNA, 22 nt, Human
cagaggcugccagccaugugca

SEQ ID NO: 454996 - RNA, 22 nt, Human
ugaaagcuguccacuaggcugu

SEQ ID NO: 454997 - RNA, 22 nt, Human
gaggcucagagugguuaaauaa

SEQ ID NO: 454998 - RNA, 22 nt, Human
agcaugaaaggcgugccaacuu

SEQ ID NO: 454999 - RNA, 21 nt, Human
gauuucacuuaccuucauuua

SEQ ID NO: 455000 - RNA, 22 nt, Human
uuugagaaaugggcucugugcu

SEQ ID NO: 455001 - RNA, 22 nt, Human
agcaauaugacauugcuacauc

SEQ ID NO: 455002 - RNA, 22 nt, Human
aacaaaugauaccaguucucaa

SEQ ID NO: 455003 - RNA, 22 nt, Human
ugcuagaaaucugaaacuagca

SEQ ID NO: 455004 - RNA, 22 nt, Human
caguuuuugccauuaagaguaa

SEQ ID NO: 455005 - RNA, 22 nt, Human
gcagaaggauccgcaggugcaa

SEQ ID NO: 455006 - RNA, 22 nt, Human
gcucugagaggugcagcaguaa

SEQ ID NO: 455007 - RNA, 22 nt, Human
uguaugcagcaaaacaauuagu

SEQ ID NO: 455008 - RNA, 22 nt, Human
uccagcagaaaagagguaggga

SEQ ID NO: 455009 - RNA, 22 nt, Human
ucaugcacaugugucaccauca

SEQ ID NO: 455010 - RNA, 22 nt, Human
auauuaggaguuaaauguauua

SEQ ID NO: 455011 - RNA, 22 nt, Human
ucccagccacagguguagcccu

SEQ ID NO: 455012 - RNA, 20 nt, Human
agucugucaauuuacagugg

SEQ ID NO: 455013 - RNA, 22 nt, Human
gcugcaggggggucuggacuug

SEQ ID NO: 455014 - RNA, 21 nt, Human
uccuccuucaaguccuggccu

SEQ ID NO: 455015 - RNA, 22 nt, Human
cauggcagaaaccugagcugcu

SEQ ID NO: 455016 - RNA, 22 nt, Human
aaaguuuuagaacuaggaagca

SEQ ID NO: 455017 - RNA, 22 nt, Human
caggcuggaguuaccuuuaggg

SEQ ID NO: 455018 - RNA, 22 nt, Human
uuguauauauucuuaaagaugu

SEQ ID NO: 455019 - RNA, 22 nt, Human
aagagcuggagcugcuacagga

SEQ ID NO: 455020 - RNA, 21 nt, Human
uuuagggaggauauuuaacuu

SEQ ID NO: 455021 - RNA, 22 nt, Human
uuagccaugugggaaaaacagc

SEQ ID NO: 455022 - RNA, 22 nt, Human
aggcacugcuucuaaguaggaa

SEQ ID NO: 455023 - RNA, 22 nt, Human
cucuggagcauuucaccuacau

SEQ ID NO: 455024 - RNA, 15 nt, Human
uucaggauaugacuc

SEQ ID NO: 455025 - RNA, 22 nt, Human
gugcugcagagucucgugccgc

SEQ ID NO: 455026 - RNA, 22 nt, Human
ugacuccaaacagaaaacgaau

SEQ ID NO: 455027 - RNA, 22 nt, Human
cagggcccauggcucagguagg

SEQ ID NO: 455028 - RNA, 22 nt, Human
aacaaauggaacacaaaucuuu

SEQ ID NO: 455029 - RNA, 22 nt, Human
cacagggcaccaguuggccauc

SEQ ID NO: 455030 - RNA, 22 nt, Human
cuguccuguggaccugaggacg

SEQ ID NO: 455031 - RNA, 22 nt, Human
gcucugucauuuugcagacacu

SEQ ID NO: 455032 - RNA, 22 nt, Human
cagagcuggacuuaaauauauu

SEQ ID NO: 455033 - RNA, 22 nt, Human
aaggagcucccggcagaccagg

SEQ ID NO: 455034 - RNA, 22 nt, Human
uucaggaugacaccauguccag

SEQ ID NO: 455035 - RNA, 22 nt, Human
ucauugcacuccagccugggca

SEQ ID NO: 455036 - RNA, 22 nt, Human
ggaggaugagcuacgaggagcu

SEQ ID NO: 455037 - RNA, 20 nt, Human
acuggagccaucucagccua

SEQ ID NO: 455038 - RNA, 22 nt, Human
cuguacauaaaggaauaggugu

SEQ ID NO: 455039 - RNA, 22 nt, Human
cucacugcccugaaguuggguu

SEQ ID NO: 455040 - RNA, 22 nt, Human
uaauuuauuucaacugccaagg

SEQ ID NO: 455041 - RNA, 22 nt, Human
uggagcaggaagucuauggcug

SEQ ID NO: 455042 - RNA, 22 nt, Human
augaggcaugugaggagaaggg

SEQ ID NO: 455043 - RNA, 22 nt, Human
gcagggucuugagaggcagcca

SEQ ID NO: 455044 - RNA, 22 nt, Human
agguuuauguuuggugcaggag

SEQ ID NO: 455045 - RNA, 22 nt, Human
cagcuggacuuuugauagaagu

SEQ ID NO: 455046 - RNA, 22 nt, Human
gggcagagagcuggaacuccuu

SEQ ID NO: 455047 - RNA, 22 nt, Human
ucagaaauguaagcugaugacu

SEQ ID NO: 455048 - RNA, 22 nt, Human
ucucugagcccagugucccccu

SEQ ID NO: 455049 - RNA, 22 nt, Human
aguggcaguggcugggcagagc

SEQ ID NO: 455050 - RNA, 22 nt, Human
uuucacauuuaggcgugaauug

SEQ ID NO: 455051 - RNA, 22 nt, Human
ugcauuccuccaccuccugcac

SEQ ID NO: 455052 - RNA, 22 nt, Human
cuguacaggucaaugauaagau

SEQ ID NO: 455053 - RNA, 22 nt, Human
uauucacauguacauaugcuca

SEQ ID NO: 455054 - RNA, 22 nt, Human
guauuagggccaaaggcaggaa

SEQ ID NO: 455055 - RNA, 17 nt, Human
aagauuucauuagcuga

SEQ ID NO: 455056 - RNA, 23 nt, Human
ucaggauauugugugccaaggug

SEQ ID NO: 455057 - RNA, 22 nt, Human
aggccugggucucgugccuacc

SEQ ID NO: 455058 - RNA, 22 nt, Human
ggcuccucucuggccgcucccg

SEQ ID NO: 455059 - RNA, 22 nt, Human
aucuggcucgcuaggcucuggg

SEQ ID NO: 455060 - RNA, 22 nt, Human
gggugggguguaucggauccua

SEQ ID NO: 455061 - RNA, 22 nt, Human
agagaauuuuaaaagccuugaa

SEQ ID NO: 455062 - RNA, 22 nt, Human
cuguuuaucccuuuggucagca

SEQ ID NO: 455063 - RNA, 22 nt, Human
accauuuuggguauuuucagag

SEQ ID NO: 455064 - RNA, 22 nt, Human
uagcagugccaggauuuugcug

SEQ ID NO: 455065 - RNA, 18 nt, Human
gcagcugacacuggaguu

SEQ ID NO: 455066 - RNA, 22 nt, Human
gggaccugccaaggccacccag

SEQ ID NO: 455067 - RNA, 22 nt, Human
cugggcugucaauggcccucug

SEQ ID NO: 455068 - RNA, 21 nt, Human
ucuggagcccuaagcugagaa

SEQ ID NO: 455069 - RNA, 22 nt, Human
gaggcagugaacaauuccugug

SEQ ID NO: 455070 - RNA, 22 nt, Human
guucccauacaguaucagugcu

SEQ ID NO: 455071 - RNA, 22 nt, Human
ucaaaagucugcauucuucaca

SEQ ID NO: 455072 - RNA, 22 nt, Human
aagauacugaugauguaggcua

SEQ ID NO: 455073 - RNA, 22 nt, Human
uaauuuacuugcaaauaacaau

SEQ ID NO: 455074 - RNA, 22 nt, Human
auucucugaagucaauggaaau

SEQ ID NO: 455075 - RNA, 22 nt, Human
augucuaaaagauaaaguuuaa

SEQ ID NO: 455076 - RNA, 22 nt, Human
ucauuuucaaguuugaacagga

SEQ ID NO: 455077 - RNA, 22 nt, Human
cagggcugcuggccgugcccuc

SEQ ID NO: 455078 - RNA, 22 nt, Human
gcuggagccuucugcucuguug

SEQ ID NO: 455079 - RNA, 21 nt, Human
accucaagcaacaaccaaggu

SEQ ID NO: 455080 - RNA, 22 nt, Human
aaaugcacaggagaaccaauuc

SEQ ID NO: 455081 - RNA, 22 nt, Human
ucccaaagcuacucuucugacu

SEQ ID NO: 455082 - RNA, 22 nt, Human
gcucaggaucccaggggugugc

SEQ ID NO: 455083 - RNA, 22 nt, Human
ggagccugugcccaagcccaga

SEQ ID NO: 455084 - RNA, 22 nt, Human
gacaaaacacauuaguuuaaaa

SEQ ID NO: 455085 - RNA, 22 nt, Human
aguggcagagugcacucaggca

SEQ ID NO: 455086 - RNA, 19 nt, Human
cuuuucaucaacagccaau

SEQ ID NO: 455087 - RNA, 22 nt, Human
cagagcugggaucccaugggcg

SEQ ID NO: 455088 - RNA, 22 nt, Human
uaagaauuguguugaauagagu

SEQ ID NO: 455089 - RNA, 22 nt, Human
ucagaggacuaccuucuccagu

SEQ ID NO: 455090 - RNA, 22 nt, Human
cagagugaaaacugagcucaaa

SEQ ID NO: 455091 - RNA, 23 nt, Human
aaauauucuuuuuuaguaagugc

SEQ ID NO: 455092 - RNA, 22 nt, Human
acagaggaagcauauagcacaa

SEQ ID NO: 455093 - RNA, 22 nt, Human
uucacauuaucaggauuguuuc

SEQ ID NO: 455094 - RNA, 22 nt, Human
caggccucuauggucagcugag

SEQ ID NO: 455095 - RNA, 22 nt, Human
ucuagggaacaugggucaagcu

SEQ ID NO: 455096 - RNA, 22 nt, Human
caggagaagucucuagggggug

SEQ ID NO: 455097 - RNA, 22 nt, Human
ugagcaguaacagcucacaggg

SEQ ID NO: 455098 - RNA, 22 nt, Human
gcuggccauauauuuugcuguu

SEQ ID NO: 455099 - RNA, 22 nt, Human
agggaaggaaaagcugucgcuu

SEQ ID NO: 455100 - RNA, 22 nt, Human
ggugaaggaggaagcugaugga

SEQ ID NO: 455101 - RNA, 22 nt, Human
guuugcauauuugcacaggaau

SEQ ID NO: 455102 - RNA, 23 nt, Human
caggcaggaugaggacuacacuc

SEQ ID NO: 455103 - RNA, 22 nt, Human
agaggcaggagguugacuugag

SEQ ID NO: 455104 - RNA, 22 nt, Human
caggccucagagaguggcgggg

SEQ ID NO: 455105 - RNA, 22 nt, Human
auugaaagcauggauuuggauu

SEQ ID NO: 455106 - RNA, 22 nt, Human
cugagccauaagggaggcuggg

SEQ ID NO: 455107 - RNA, 22 nt, Human
uggaaugacagagagucugaau

SEQ ID NO: 455108 - RNA, 22 nt, Human
gcagaaggucuggcacuucagg

SEQ ID NO: 455109 - RNA, 22 nt, Human
aggagcugacuuguaaagcauu

SEQ ID NO: 455110 - RNA, 22 nt, Human
aauuaaaagauaacccaugagu

SEQ ID NO: 455111 - RNA, 22 nt, Human
acagaauuaaaguguuugugga

SEQ ID NO: 455112 - RNA, 22 nt, Human
aagguuaaauagguauuuucca

SEQ ID NO: 455113 - RNA, 22 nt, Human
gacagaagaggaacuuggacag

SEQ ID NO: 455114 - RNA, 22 nt, Human
ggucucagcccucgccagcagc

SEQ ID NO: 455115 - RNA, 22 nt, Human
ugggacuugccucgagggcugc

SEQ ID NO: 455116 - RNA, 22 nt, Human
cagagagcuuagugugcugcau

SEQ ID NO: 455117 - RNA, 22 nt, Human
cugcugcugcuaucuacccagg

SEQ ID NO: 455118 - RNA, 22 nt, Human
guacauuuuacuuuguuugaau

SEQ ID NO: 455119 - RNA, 22 nt, Human
gagaaguuucugguuugcauag

SEQ ID NO: 455120 - RNA, 22 nt, Human
ccaaagucugcauuuuaacaug

SEQ ID NO: 455121 - RNA, 22 nt, Human
uucuccgcuaaguucucugcag

SEQ ID NO: 455122 - RNA, 22 nt, Human
aacaaacaaacauuuugucauc

SEQ ID NO: 455123 - RNA, 22 nt, Human
uuugcauugcauuaaguauucu

SEQ ID NO: 455124 - RNA, 22 nt, Human
gccagagcugagugagguucuu

SEQ ID NO: 455125 - RNA, 22 nt, Human
cuuuucauuguuuguacaugca

SEQ ID NO: 455126 - RNA, 22 nt, Human
ugagccuguggggugacaacca

SEQ ID NO: 455127 - RNA, 22 nt, Human
ccaggagccacucaggcccaca

SEQ ID NO: 455128 - RNA, 22 nt, Human
caggccuccacuccacgcagac

SEQ ID NO: 455129 - RNA, 22 nt, Human
acuuccuggcugggugaccugg

SEQ ID NO: 455130 - RNA, 20 nt, Human
ucugucucugagcuagacuu

SEQ ID NO: 455131 - RNA, 22 nt, Human
ccaggcagagggaauagcaagu

SEQ ID NO: 455132 - RNA, 22 nt, Human
cagauggaacacagaaaggaga

SEQ ID NO: 455133 - RNA, 22 nt, Human
agcagaaccacagcacuguuga

SEQ ID NO: 455134 - RNA, 22 nt, Human
aaugagcuagaccugcuuccuc

SEQ ID NO: 455135 - RNA, 22 nt, Human
ggucaggggcugcucuacagag

SEQ ID NO: 455136 - RNA, 22 nt, Human
ucugccugagcagagggaggcc

SEQ ID NO: 455137 - RNA, 22 nt, Human
aacauacagugagcaguggacu

SEQ ID NO: 455138 - RNA, 22 nt, Human
guuugcauguguacuuaauugg

SEQ ID NO: 455139 - RNA, 22 nt, Human
uccaggcauaagccuugagugu

SEQ ID NO: 455140 - RNA, 20 nt, Human
ugugcccaauguccagguuc

SEQ ID NO: 455141 - RNA, 21 nt, Human
acagaacuguauagugauaaa

SEQ ID NO: 455142 - RNA, 22 nt, Human
aaugagcugcugcuguuccacc

SEQ ID NO: 455143 - RNA, 18 nt, Human
agugugugcccuuucagg

SEQ ID NO: 455144 - RNA, 22 nt, Human
ggcagcugggucacaccgaucu

SEQ ID NO: 455145 - RNA, 22 nt, Human
uggaagccaggcccgcuccuaa

SEQ ID NO: 455146 - RNA, 22 nt, Human
cuucuuuacuuucuagaaauaa

SEQ ID NO: 455147 - RNA, 19 nt, Human
cugaagucuuuucagcugg

SEQ ID NO: 455148 - RNA, 21 nt, Human
ucccagagugcuugggacugc

SEQ ID NO: 455149 - RNA, 23 nt, Human
ggccauggagacuuagaaugggc

SEQ ID NO: 455150 - RNA, 23 nt, Human
agaagcagcuucuggaguaucgg

SEQ ID NO: 455151 - RNA, 22 nt, Human
gcagcccagagcgcaggacccc

SEQ ID NO: 455152 - RNA, 22 nt, Human
ggcuuccuggagaaggucugag

SEQ ID NO: 455153 - RNA, 22 nt, Human
caguacuuugaagauauuuuag

SEQ ID NO: 455154 - RNA, 22 nt, Human
aaaugucuuucaauagagaaau

SEQ ID NO: 455155 - RNA, 22 nt, Human
acaagaauuauuucuaguuaac

SEQ ID NO: 455156 - RNA, 19 nt, Human
cccagagcauccugaacuu

SEQ ID NO: 455157 - RNA, 22 nt, Human
acugcagggcauccuggccaag

SEQ ID NO: 455158 - RNA, 22 nt, Human
ugcuuuggccacuagaauucag

SEQ ID NO: 455159 - RNA, 20 nt, Human
uccuugaaagugggguauau

SEQ ID NO: 455160 - RNA, 23 nt, Human
aguacauucgaaaaauucuguga

SEQ ID NO: 455161 - RNA, 22 nt, Human
cccaggaggccaagguugcagu

SEQ ID NO: 455162 - RNA, 22 nt, Human
acuguacuguguauuguagaau

SEQ ID NO: 455163 - RNA, 22 nt, Human
caagaaggcuauaugggccagg

SEQ ID NO: 455164 - RNA, 22 nt, Human
ccuggcacgaagggcugagguu

SEQ ID NO: 455165 - RNA, 22 nt, Human
gaugccucuuuuggcugaauua

SEQ ID NO: 455166 - RNA, 22 nt, Human
cagagguauugcaaaagccuag

SEQ ID NO: 455167 - RNA, 22 nt, Human
acacuuuguuguggcauauacg

SEQ ID NO: 455168 - RNA, 22 nt, Human
augggagugacagggccacugg

SEQ ID NO: 455169 - RNA, 22 nt, Human
gggcugcugcugccagcgacac

SEQ ID NO: 455170 - RNA, 22 nt, Human
gguggcagcgucuaucugacau

SEQ ID NO: 455171 - RNA, 22 nt, Human
gccuucagcggccgcucgcugc

SEQ ID NO: 455172 - RNA, 22 nt, Human
aaaagcucuuucugcuguagau

SEQ ID NO: 455173 - RNA, 22 nt, Human
ugcuggccgugagcucucggga

SEQ ID NO: 455174 - RNA, 22 nt, Human
gcagggcauagaggcacggagg

SEQ ID NO: 455175 - RNA, 22 nt, Human
augugcauuaaaugucaauguu

SEQ ID NO: 455176 - RNA, 22 nt, Human
cccccaggcucugacacaggag

SEQ ID NO: 455177 - RNA, 22 nt, Human
uuugcauuguaauauuuaguuc

SEQ ID NO: 455178 - RNA, 22 nt, Human
aucaguuugagugcugugucaa

SEQ ID NO: 455179 - RNA, 22 nt, Human
agcagcugucccuuaacaucag

SEQ ID NO: 455180 - RNA, 22 nt, Human
agggggaggcugugcugcgucu

SEQ ID NO: 455181 - RNA, 22 nt, Human
ccaggcaggcgauggugcagug

SEQ ID NO: 455182 - RNA, 21 nt, Human
gcugccaccgcgugcuccagg

SEQ ID NO: 455183 - RNA, 22 nt, Human
guauuaggaaauaugaagaaag

SEQ ID NO: 455184 - RNA, 22 nt, Human
aagaugcgguugaccauggugu

SEQ ID NO: 455185 - RNA, 22 nt, Human
uuugugaagggaacagaagugu

SEQ ID NO: 455186 - RNA, 22 nt, Human
cugggccuggcguuccaggcug

SEQ ID NO: 455187 - RNA, 22 nt, Human
aaagaacagauguguggugcau

SEQ ID NO: 455188 - RNA, 22 nt, Human
uauccaaaggaacaaucacagc

SEQ ID NO: 455189 - RNA, 22 nt, Human
ccaggccugugcaaggagggag

SEQ ID NO: 455190 - RNA, 22 nt, Human
ucugagaggcagaccuuccuaa

SEQ ID NO: 455191 - RNA, 22 nt, Human
gccugcaguucugugcuaggca

SEQ ID NO: 455192 - RNA, 22 nt, Human
cucuccucagaacaggcccucu

SEQ ID NO: 455193 - RNA, 22 nt, Human
gcugccaugccacagcacucac

SEQ ID NO: 455194 - RNA, 18 nt, Human
cugagggcagccccuggg

SEQ ID NO: 455195 - RNA, 20 nt, Human
aagagcauaguacaggaaga

SEQ ID NO: 455196 - RNA, 22 nt, Human
cucugagaaagcugugagcuaa

SEQ ID NO: 455197 - RNA, 22 nt, Human
ccuggagccccucuggccagcc

SEQ ID NO: 455198 - RNA, 22 nt, Human
gcauuuauuucuuuacugcauc

SEQ ID NO: 455199 - RNA, 22 nt, Human
gagggccaauggauuucaacug

SEQ ID NO: 455200 - RNA, 22 nt, Human
agcagcucuuaacaaagcaugg

SEQ ID NO: 455201 - RNA, 22 nt, Human
ggccugcucugcagccucuaca

SEQ ID NO: 455202 - RNA, 22 nt, Human
aagccucaccuuuuagaagcua

SEQ ID NO: 455203 - RNA, 22 nt, Human
aaggccaggacaccaggggacu

SEQ ID NO: 455204 - RNA, 22 nt, Human
aaagauuucagaagccugugcc

SEQ ID NO: 455205 - RNA, 22 nt, Human
aagaaaacguuuugaggaguuu

SEQ ID NO: 455206 - RNA, 21 nt, Human
ugaggcaggggugcuuuuguc

SEQ ID NO: 455207 - RNA, 22 nt, Human
caguggugaagagcaggggcuc

SEQ ID NO: 455208 - RNA, 22 nt, Human
ccagaggucuccugcacgggau

SEQ ID NO: 455209 - RNA, 22 nt, Human
gagucugagaacugggcucagu

SEQ ID NO: 455210 - RNA, 22 nt, Human
uugauacaggccuucuagauga

SEQ ID NO: 455211 - RNA, 22 nt, Human
cucccacuccuggcucaccaca

SEQ ID NO: 455212 - RNA, 22 nt, Human
ucuggagauaagacagacagau

SEQ ID NO: 455213 - RNA, 22 nt, Human
aaaugaacaguugcauucucug

SEQ ID NO: 455214 - RNA, 22 nt, Human
cugccucugcgucccacagagu

SEQ ID NO: 455215 - RNA, 22 nt, Human
cauuuauugguuaggccagcag

SEQ ID NO: 455216 - RNA, 22 nt, Human
uucauguaauuccauaagguaa

SEQ ID NO: 455217 - RNA, 22 nt, Human
gccugggaacucugaucuccug

SEQ ID NO: 455218 - RNA, 22 nt, Human
ggugaggaauuggggacugacc

SEQ ID NO: 455219 - RNA, 18 nt, Human
gaggccugagaaccaggu

SEQ ID NO: 455220 - RNA, 22 nt, Human
gcagccugaggcccuuucuggc

SEQ ID NO: 455221 - RNA, 22 nt, Human
cagaggaaaugggaaggagaua

SEQ ID NO: 455222 - RNA, 22 nt, Human
ucacagacauggugagguaaca

SEQ ID NO: 455223 - RNA, 22 nt, Human
uaggccauucuuggagcuuacu

SEQ ID NO: 455224 - RNA, 22 nt, Human
aaaagggacuacucucagcucc

SEQ ID NO: 455225 - RNA, 22 nt, Human
ucuuuuggaaaugaugugcagg

SEQ ID NO: 455226 - RNA, 22 nt, Human
cuguagccagaagcagaaggcc

SEQ ID NO: 455227 - RNA, 22 nt, Human
ccucagggacuccaugcugcag

SEQ ID NO: 455228 - RNA, 22 nt, Human
gcuccagaugaaaggccagagg

SEQ ID NO: 455229 - RNA, 23 nt, Human
cauguacagaguuugauaaagug

SEQ ID NO: 455230 - RNA, 22 nt, Human
gaccucagugaauggucaugua

SEQ ID NO: 455231 - RNA, 22 nt, Human
aaggagagagcuuugcuggaac

SEQ ID NO: 455232 - RNA, 22 nt, Human
augcagcuucaggauuaugaug

SEQ ID NO: 455233 - RNA, 22 nt, Human
uuuccuaugauauucuaugugu

SEQ ID NO: 455234 - RNA, 22 nt, Human
ugugucaauuuucauuccuacu

SEQ ID NO: 455235 - RNA, 22 nt, Human
caggccuggagugcaauggcac

SEQ ID NO: 455236 - RNA, 22 nt, Human
ucccacugcuuugcucugcuca

SEQ ID NO: 455237 - RNA, 22 nt, Human
agccagagagccccagguucua

SEQ ID NO: 455238 - RNA, 22 nt, Human
gcagcuggggccacacuuaggc

SEQ ID NO: 455239 - RNA, 22 nt, Human
gucaggaugggcagccaaacua

SEQ ID NO: 455240 - RNA, 22 nt, Human
aggaggccgggauucuggagau

SEQ ID NO: 455241 - RNA, 22 nt, Human
cagagcauaauugacaugaggu

SEQ ID NO: 455242 - RNA, 22 nt, Human
gcagggcugcagagggcacugu

SEQ ID NO: 455243 - RNA, 22 nt, Human
aucucagucagguugaauuugg

SEQ ID NO: 455244 - RNA, 22 nt, Human
ugccuggcaagaggggcuggcu

SEQ ID NO: 455245 - RNA, 22 nt, Human
gcugcccuaauaucacauguua

SEQ ID NO: 455246 - RNA, 22 nt, Human
guggcgcagaggguggcagaga

SEQ ID NO: 455247 - RNA, 22 nt, Human
gagagggcugccuggugugagg

SEQ ID NO: 455248 - RNA, 22 nt, Human
ugaggcucagagcaccugcucc

SEQ ID NO: 455249 - RNA, 22 nt, Human
agguagaggccuccaggcagca

SEQ ID NO: 455250 - RNA, 22 nt, Human
gccuggagugcaguggcgugau

SEQ ID NO: 455251 - RNA, 22 nt, Human
agccuguccagaggacagggcu

SEQ ID NO: 455252 - RNA, 17 nt, Human
gagccacccugugcgag

SEQ ID NO: 455253 - RNA, 18 nt, Human
ccuggcuuccaucuuggu

SEQ ID NO: 455254 - RNA, 22 nt, Human
ggucccaggauugguugcgcag

SEQ ID NO: 455255 - RNA, 22 nt, Human
ccugucucccuggcauggcuca

SEQ ID NO: 455256 - RNA, 22 nt, Human
acauuucuuucuauucaguagc

SEQ ID NO: 455257 - RNA, 22 nt, Human
accaggcaaaaccacaggagca

SEQ ID NO: 455258 - RNA, 21 nt, Human
gcagaugggagucaucaggcu

SEQ ID NO: 455259 - RNA, 22 nt, Human
gcucaggacccaggugugaccu

SEQ ID NO: 455260 - RNA, 22 nt, Human
uuaugcuaaaugaaucaaguca

SEQ ID NO: 455261 - RNA, 18 nt, Human
cugaaggauccaggugua

SEQ ID NO: 455262 - RNA, 22 nt, Human
aaguuuuaacaaguacuuacua

SEQ ID NO: 455263 - RNA, 22 nt, Human
uuauguaccugaauuaguaaag

SEQ ID NO: 455264 - RNA, 21 nt, Human
ccuucuccacagggucuccgg

SEQ ID NO: 455265 - RNA, 22 nt, Human
gggcucugcgcucagcuccagc

SEQ ID NO: 455266 - RNA, 22 nt, Human
ccugggaguggcacucacagca

SEQ ID NO: 455267 - RNA, 22 nt, Human
cucaggauucucgacacucaca

SEQ ID NO: 455268 - RNA, 22 nt, Human
ggcucagaaacuaaaggcgcug

SEQ ID NO: 455269 - RNA, 22 nt, Human
acagaggaaggcugagcugccc

SEQ ID NO: 455270 - RNA, 22 nt, Human
cccagggaaugacucuggccuu

SEQ ID NO: 455271 - RNA, 22 nt, Human
gacccaggguggucaccugaaa

SEQ ID NO: 455272 - RNA, 22 nt, Human
gggcagcugcagggauggugac

SEQ ID NO: 455273 - RNA, 22 nt, Human
auuucagcccaguaugagcccc

SEQ ID NO: 455274 - RNA, 22 nt, Human
ucauuuguucucauucucuacu

SEQ ID NO: 455275 - RNA, 22 nt, Human
agguggcucugacagcucuggu

SEQ ID NO: 455276 - RNA, 18 nt, Human
ugcccagaaaagcaggga

SEQ ID NO: 455277 - RNA, 19 nt, Human
ggagccuggagcacgugcc

SEQ ID NO: 455278 - RNA, 22 nt, Human
gcugugugaaaacugggccugg

SEQ ID NO: 455279 - RNA, 22 nt, Human
augaggcaucuaacauugcaaa

SEQ ID NO: 455280 - RNA, 22 nt, Human
cagcugccuucugcgggaaguc

SEQ ID NO: 455281 - RNA, 22 nt, Human
agcaguggaccucagugcuauu

SEQ ID NO: 455282 - RNA, 22 nt, Human
aagcccagaugggagcauuuca

SEQ ID NO: 455283 - RNA, 22 nt, Human
guauuaggaggaacacaggccu

SEQ ID NO: 455284 - RNA, 22 nt, Human
ugugccaugaggcucugauaug

SEQ ID NO: 455285 - RNA, 22 nt, Human
guggcuucacauggcauuuggc

SEQ ID NO: 455286 - RNA, 22 nt, Human
cugcuggggucagagcacuggg

SEQ ID NO: 455287 - RNA, 22 nt, Human
cugggaggugcagcaaaaauca

SEQ ID NO: 455288 - RNA, 22 nt, Human
aauuaacagagggcuuauuacu

SEQ ID NO: 455289 - RNA, 19 nt, Human
ggcucucccuugagagagc

SEQ ID NO: 455290 - RNA, 22 nt, Human
gcugcagcagcugcaggguugu

SEQ ID NO: 455291 - RNA, 22 nt, Human
ggcagcugugaagugccucaca

SEQ ID NO: 455292 - RNA, 22 nt, Human
acacagggggcauucuaggagu

SEQ ID NO: 455293 - RNA, 22 nt, Human
aucaggauagucuguaaauugu

SEQ ID NO: 455294 - RNA, 22 nt, Human
acauaugcucaucugcauuccc

SEQ ID NO: 455295 - RNA, 19 nt, Human
ugcagaggguaggaaggcc

SEQ ID NO: 455296 - RNA, 19 nt, Human
uggaccugugcccauggcu

SEQ ID NO: 455297 - RNA, 22 nt, Human
guacauuucucuuguucuuauu

SEQ ID NO: 455298 - RNA, 22 nt, Human
agaagccagaauauucauggau

SEQ ID NO: 455299 - RNA, 22 nt, Human
agcugccaaguuggaguagcaa

SEQ ID NO: 455300 - RNA, 22 nt, Human
auucuucauguugaagcuguca

SEQ ID NO: 455301 - RNA, 22 nt, Human
auugaaaguccuaucuaaggga

SEQ ID NO: 455302 - RNA, 22 nt, Human
ggccugcacagagguggcucua

SEQ ID NO: 455303 - RNA, 22 nt, Human
uuagaaagcuuuccauagucaa

SEQ ID NO: 455304 - RNA, 22 nt, Human
cacacaggaugaagcagcagaa

SEQ ID NO: 455305 - RNA, 22 nt, Human
gcugagagaucaaggcaggauu

SEQ ID NO: 455306 - RNA, 22 nt, Human
gcugcucuccauggccgugagu

SEQ ID NO: 455307 - RNA, 22 nt, Human
uuuauuccaugugucuaugacc

SEQ ID NO: 455308 - RNA, 22 nt, Human
ggaagccagagugcugggcagg

SEQ ID NO: 455309 - RNA, 22 nt, Human
ggaggccaaagugugggcggcu

SEQ ID NO: 455310 - RNA, 22 nt, Human
acuuucucaggaauucacagac

SEQ ID NO: 455311 - RNA, 22 nt, Human
uugucccaggacuugcauagau

SEQ ID NO: 455312 - RNA, 22 nt, Human
uauuuguauguguguacauaua

SEQ ID NO: 455313 - RNA, 22 nt, Human
acccaggccugagagacaggag

SEQ ID NO: 455314 - RNA, 22 nt, Human
gcuuucuugguucugcaggggc

SEQ ID NO: 455315 - RNA, 19 nt, Human
gugauuucuuuccacaagc

SEQ ID NO: 455316 - RNA, 22 nt, Human
augggcuguccuaguccagccc

SEQ ID NO: 455317 - RNA, 18 nt, Human
cucucugggugaggacaa

SEQ ID NO: 455318 - RNA, 21 nt, Human
cacaggugggucagugaggcc

SEQ ID NO: 455319 - RNA, 22 nt, Human
cacacaugucucuccaugcucu

SEQ ID NO: 455320 - RNA, 21 nt, Human
ugcaggaaagugcugcgaccc

SEQ ID NO: 455321 - RNA, 22 nt, Human
ugcugcucuucaccauggccuc

SEQ ID NO: 455322 - RNA, 21 nt, Human
ugggggagaauugguugcuuu

SEQ ID NO: 455323 - RNA, 22 nt, Human
ugggcagagaguagaggcaacg

SEQ ID NO: 455324 - RNA, 22 nt, Human
uguaacaaaauaccuuggauug

SEQ ID NO: 455325 - RNA, 22 nt, Human
ccagccucacuggcaucaccua

SEQ ID NO: 455326 - RNA, 22 nt, Human
auguguaaaaagugcuuaauau

SEQ ID NO: 455327 - RNA, 22 nt, Human
uuauguaauuuguuugcucuuc

SEQ ID NO: 455328 - RNA, 22 nt, Human
gcacacccucucaccagcacug

SEQ ID NO: 455329 - RNA, 22 nt, Human
cagggccauaucuugugcacca

SEQ ID NO: 455330 - RNA, 22 nt, Human
uaaggcacccgugagcugccag

SEQ ID NO: 455331 - RNA, 22 nt, Human
uuccagcaggcagacaggagau

SEQ ID NO: 455332 - RNA, 22 nt, Human
agccaggcagggcucucgcucu

SEQ ID NO: 455333 - RNA, 22 nt, Human
acugggaggcaucuggagcuga

SEQ ID NO: 455334 - RNA, 22 nt, Human
uccuggagccacggagcuuuca

SEQ ID NO: 455335 - RNA, 22 nt, Human
aaaguuugaaugauauauuagu

SEQ ID NO: 455336 - RNA, 22 nt, Human
acagugugugcuuucccuuacg

SEQ ID NO: 455337 - RNA, 22 nt, Human
gcacugaaaauguuggauucca

SEQ ID NO: 455338 - RNA, 22 nt, Human
cucagaauuacaucccauuuua

SEQ ID NO: 455339 - RNA, 22 nt, Human
ggccagggccuggggacugucc

SEQ ID NO: 455340 - RNA, 22 nt, Human
accgaaggaaacuggaaccguu

SEQ ID NO: 455341 - RNA, 22 nt, Human
gggcauggaggucugucugcag

SEQ ID NO: 455342 - RNA, 22 nt, Human
aagcuuccugaaugcucauuua

SEQ ID NO: 455343 - RNA, 22 nt, Human
ccugagggaggguauaggcugu

SEQ ID NO: 455344 - RNA, 22 nt, Human
cacucugacuggcccugcagga

SEQ ID NO: 455345 - RNA, 23 nt, Human
uggcucagggucucuuaugaagu

SEQ ID NO: 455346 - RNA, 22 nt, Human
agaaacugaauuauuucugagg

SEQ ID NO: 455347 - RNA, 19 nt, Human
agucccaggcccgaaagag

SEQ ID NO: 455348 - RNA, 22 nt, Human
uuuauuauguacaggcacuaua

SEQ ID NO: 455349 - RNA, 22 nt, Human
acaguguguucugggaccucca

SEQ ID NO: 455350 - RNA, 20 nt, Human
uuaagaaaagcacauccugc

SEQ ID NO: 455351 - RNA, 22 nt, Human
cacaaugcguacauauaucaaa

SEQ ID NO: 455352 - RNA, 22 nt, Human
uuuaugagcaaugcugagggga

SEQ ID NO: 455353 - RNA, 22 nt, Human
caggaaggcccaccuguccugu

SEQ ID NO: 455354 - RNA, 23 nt, Human
aucagucuugguagcugugccca

SEQ ID NO: 455355 - RNA, 22 nt, Human
agcauggggcaaugcaugugcu

SEQ ID NO: 455356 - RNA, 22 nt, Human
ccagaagacaagaauguucuua

SEQ ID NO: 455357 - RNA, 22 nt, Human
gaucaaaagcuggguucuaaaa

SEQ ID NO: 455358 - RNA, 17 nt, Human
agcagcugaagcagcca

SEQ ID NO: 455359 - RNA, 22 nt, Human
aagcugccacacggugaguacu

SEQ ID NO: 455360 - RNA, 20 nt, Human
ucuuacaaucguuacaucca

SEQ ID NO: 455361 - RNA, 22 nt, Human
gugugcagucugcuaggcaggg

SEQ ID NO: 455362 - RNA, 23 nt, Human
uggcagagacccagaaucuacau

SEQ ID NO: 455363 - RNA, 22 nt, Human
aggcacuguggaagacaugguu

SEQ ID NO: 455364 - RNA, 22 nt, Human
cugccuggagcauucugaaggu

SEQ ID NO: 455365 - RNA, 22 nt, Human
gccaaaucuggauuuagcaaga

SEQ ID NO: 455366 - RNA, 22 nt, Human
agggcagcuagcuguagaaaga

SEQ ID NO: 455367 - RNA, 21 nt, Human
aggugccaaggagaagcaggc

SEQ ID NO: 455368 - RNA, 21 nt, Human
ucacaucuauguuaagcaaac

SEQ ID NO: 455369 - RNA, 22 nt, Human
aggaccuguaccucagcaucua

SEQ ID NO: 455370 - RNA, 22 nt, Human
cacuggggaaaacaggcuucuu

SEQ ID NO: 455371 - RNA, 22 nt, Human
ccugggcagggcuggacucuca

SEQ ID NO: 455372 - RNA, 22 nt, Human
aggcacaguuucauccccgggc

SEQ ID NO: 455373 - RNA, 22 nt, Human
agcagggggaguuagacuagau

SEQ ID NO: 455374 - RNA, 22 nt, Human
ugaggccugcccuggggaaguu

SEQ ID NO: 455375 - RNA, 22 nt, Human
uauggaaaguguuuucuucugu

SEQ ID NO: 455376 - RNA, 22 nt, Human
gcuuugcauuguuuaaucagga

SEQ ID NO: 455377 - RNA, 22 nt, Human
acagcaaaggacgaacacucug

SEQ ID NO: 455378 - RNA, 22 nt, Human
auccucagaccucagcaaagcc

SEQ ID NO: 455379 - RNA, 22 nt, Human
gccuggagcccaguguggggcu

SEQ ID NO: 455380 - RNA, 22 nt, Human
ugcugcacaauuggaaaguauc

SEQ ID NO: 455381 - RNA, 22 nt, Human
uuacuuugaugaucaaugagcg

SEQ ID NO: 455382 - RNA, 22 nt, Human
ugcagggaacuuggacagcuag

SEQ ID NO: 455383 - RNA, 22 nt, Human
uauagaagagacaugugcauag

SEQ ID NO: 455384 - RNA, 22 nt, Human
agcaccugcuaugugucaggga

SEQ ID NO: 455385 - RNA, 22 nt, Human
aaguggugguaugaaccgaggg

SEQ ID NO: 455386 - RNA, 22 nt, Human
cuaucuuuuguucauuuugagu

SEQ ID NO: 455387 - RNA, 22 nt, Human
cugaggcuuggaggggucuggu

SEQ ID NO: 455388 - RNA, 22 nt, Human
auugucgcuuauuuaggugcuu

SEQ ID NO: 455389 - RNA, 22 nt, Human
ucagagcuaaggggagagcaaa

SEQ ID NO: 455390 - RNA, 21 nt, Human
gcccucaggggaggauggccu

SEQ ID NO: 455391 - RNA, 22 nt, Human
ucagcagaggggaaggcaucug

SEQ ID NO: 455392 - RNA, 22 nt, Human
acacugaauauacaaugaauau

SEQ ID NO: 455393 - RNA, 22 nt, Human
aggccuguuccaggccccuuuu

SEQ ID NO: 455394 - RNA, 22 nt, Human
aggugccaauuuucagugaaca

SEQ ID NO: 455395 - RNA, 22 nt, Human
agucacccuccaacucuccacu

SEQ ID NO: 455396 - RNA, 22 nt, Human
gaggcucacgacgggacgaacu

SEQ ID NO: 455397 - RNA, 22 nt, Human
guaaaauugcaauuacuuuugc

SEQ ID NO: 455398 - RNA, 22 nt, Human
aggauccuccuuagaaaagacc

SEQ ID NO: 455399 - RNA, 22 nt, Human
guuuuccuucucagccauugcc

SEQ ID NO: 455400 - RNA, 22 nt, Human
cacagcuucugagugaggauuu

SEQ ID NO: 455401 - RNA, 22 nt, Human
cugguccuccuugccuucagau

SEQ ID NO: 455402 - RNA, 22 nt, Human
ccaguugguuucaaugggacag

SEQ ID NO: 455403 - RNA, 22 nt, Human
agucuucagagaaauuaacucu

SEQ ID NO: 455404 - RNA, 19 nt, Human
ggcuggcaagugacagugu

SEQ ID NO: 455405 - RNA, 22 nt, Human
aaaugguauuuacucuguauua

SEQ ID NO: 455406 - RNA, 22 nt, Human
cagcuggcgggcagagccgcca

SEQ ID NO: 455407 - RNA, 22 nt, Human
acugccauuggucaaaugagug

SEQ ID NO: 455408 - RNA, 22 nt, Human
gccagucugcucccacaaguuc

SEQ ID NO: 455409 - RNA, 22 nt, Human
uauguacauaacaugaaaugca

SEQ ID NO: 455410 - RNA, 22 nt, Human
uucaaucauuuuuacauagucc

SEQ ID NO: 455411 - RNA, 22 nt, Human
gcccagugguaaaagcaggccu

SEQ ID NO: 455412 - RNA, 22 nt, Human
ugguggacaccgcagccaugaa

SEQ ID NO: 455413 - RNA, 22 nt, Human
gacuguacuugagagaggaacu

SEQ ID NO: 455414 - RNA, 22 nt, Human
agccacagcaacaagugcaauu

SEQ ID NO: 455415 - RNA, 22 nt, Human
auuuauguaucuguguagauca

SEQ ID NO: 455416 - RNA, 22 nt, Human
acagagcaauaacagggagagg

SEQ ID NO: 455417 - RNA, 22 nt, Human
guuauuuuaacuucucaguaau

SEQ ID NO: 455418 - RNA, 22 nt, Human
uuacugaaaauucuucaggauu

SEQ ID NO: 455419 - RNA, 22 nt, Human
gucccuggggaaucagcuggag

SEQ ID NO: 455420 - RNA, 22 nt, Human
uugcauuguaggauguuagaag

SEQ ID NO: 455421 - RNA, 22 nt, Human
agcagcugggcucagagcuggg

SEQ ID NO: 455422 - RNA, 22 nt, Human
augugaaacugaagcauccaua

SEQ ID NO: 455423 - RNA, 22 nt, Human
cuucaggauuuaggaagaugaa

SEQ ID NO: 455424 - RNA, 22 nt, Human
uggacaacauagugagaccuca

SEQ ID NO: 455425 - RNA, 22 nt, Human
gcugucugggaugucacugcug

SEQ ID NO: 455426 - RNA, 22 nt, Human
aggucacacaacugucagaggc

SEQ ID NO: 455427 - RNA, 22 nt, Human
agcaggcuccuuccuucucugg

SEQ ID NO: 455428 - RNA, 22 nt, Human
uccauucuaugcuuacauuuau

SEQ ID NO: 455429 - RNA, 22 nt, Human
auguaagguucagaguauguga

SEQ ID NO: 455430 - RNA, 22 nt, Human
ucccaaggauaagagagucuga

SEQ ID NO: 455431 - RNA, 22 nt, Human
agauuuccaucuuuuucaugug

SEQ ID NO: 455432 - RNA, 22 nt, Human
aggacccagaggcagaggacgu

SEQ ID NO: 455433 - RNA, 22 nt, Human
aggaggcuguggagcacuccau

SEQ ID NO: 455434 - RNA, 22 nt, Human
aagccaggaagagagccuucac

SEQ ID NO: 455435 - RNA, 22 nt, Human
cagggcacaguuauggaggugg

SEQ ID NO: 455436 - RNA, 22 nt, Human
ccuggccuggcacucccucugc

SEQ ID NO: 455437 - RNA, 19 nt, Human
gcuguacaguaaggagaca

SEQ ID NO: 455438 - RNA, 22 nt, Human
gaggcagagguuguugcaguga

SEQ ID NO: 455439 - RNA, 22 nt, Human
acucaggaaaugagaggcucuc

SEQ ID NO: 455440 - RNA, 22 nt, Human
guaaaauucuagcaucugaaag

SEQ ID NO: 455441 - RNA, 22 nt, Human
guagggacaauauguuauuaga

SEQ ID NO: 455442 - RNA, 22 nt, Human
cagggcucaggaaaucagacgu

SEQ ID NO: 455443 - RNA, 22 nt, Human
gauuucaagcccccagagauuc

SEQ ID NO: 455444 - RNA, 22 nt, Human
uguguccauucaggcacugacc

SEQ ID NO: 455445 - RNA, 22 nt, Human
uacagauacagaucuagauaca

SEQ ID NO: 455446 - RNA, 22 nt, Human
agcugcugugugcucaggcagg

SEQ ID NO: 455447 - RNA, 22 nt, Human
gugcauuugacgaauacucacu

SEQ ID NO: 455448 - RNA, 22 nt, Human
agagaugucgccuugcccaggg

SEQ ID NO: 455449 - RNA, 22 nt, Human
agccacagagcaggagaccuuu

SEQ ID NO: 455450 - RNA, 18 nt, Human
uccucucuuuccccaggg

SEQ ID NO: 455451 - RNA, 22 nt, Human
aucacauuguuagcauagacug

SEQ ID NO: 455452 - RNA, 22 nt, Human
aaagguaguacuucuagaaggg

SEQ ID NO: 455453 - RNA, 22 nt, Human
acuguacuuuucuuggcuagau

SEQ ID NO: 455454 - RNA, 22 nt, Human
uguuuuaugagccauauaaccu

SEQ ID NO: 455455 - RNA, 22 nt, Human
aggagggcaggcuggcugccua

SEQ ID NO: 455456 - RNA, 22 nt, Human
cagggcugaacugagcuuguga

SEQ ID NO: 455457 - RNA, 22 nt, Human
accacuguaucuccagcacauu

SEQ ID NO: 455458 - RNA, 22 nt, Human
aagccagauagaagaacucauu

SEQ ID NO: 455459 - RNA, 22 nt, Human
uggaagaauaggauagaagaac

SEQ ID NO: 455460 - RNA, 22 nt, Human
cagguggguacaucacagagac

SEQ ID NO: 455461 - RNA, 22 nt, Human
ugcuuuauuuuaaauaugccau

SEQ ID NO: 455462 - RNA, 22 nt, Human
uuauacuaaaacgcauugaauu

SEQ ID NO: 455463 - RNA, 22 nt, Human
acagaaggcggggacaaggcgg

SEQ ID NO: 455464 - RNA, 23 nt, Human
ugaagugaaauuucacaagggac

SEQ ID NO: 455465 - RNA, 22 nt, Human
caggacagagcccagacugugu

SEQ ID NO: 455466 - RNA, 22 nt, Human
cuuccugcauugugccagaguu

SEQ ID NO: 455467 - RNA, 22 nt, Human
cagcugaagagaggugcugagu

SEQ ID NO: 455468 - RNA, 22 nt, Human
gggagcugagggaccucugugg

SEQ ID NO: 455469 - RNA, 22 nt, Human
ggaccugcauuuuaacaagauc

SEQ ID NO: 455470 - RNA, 22 nt, Human
cccauuuagauaacaguucaaa

SEQ ID NO: 455471 - RNA, 22 nt, Human
cugggccaucagaggggcugga

SEQ ID NO: 455472 - RNA, 22 nt, Human
aggaccugacuggcuccugcuu

SEQ ID NO: 455473 - RNA, 22 nt, Human
cagaggcaaaagagguggaggu

SEQ ID NO: 455474 - RNA, 22 nt, Human
ggcaggugcucugugggccugg

SEQ ID NO: 455475 - RNA, 22 nt, Human
aacuagaaaacaagaugcugau

SEQ ID NO: 455476 - RNA, 22 nt, Human
agaacuuaggaacaacagcuua

SEQ ID NO: 455477 - RNA, 22 nt, Human
ucagggcaucucuuaaguggug

SEQ ID NO: 455478 - RNA, 22 nt, Human
gaagccacccuccuuccagccc

SEQ ID NO: 455479 - RNA, 22 nt, Human
caucacugacgcugagauucca

SEQ ID NO: 455480 - RNA, 22 nt, Human
cuggccugagaaugcuacccuu

SEQ ID NO: 455481 - RNA, 22 nt, Human
cagucccaucucccagguggcu

SEQ ID NO: 455482 - RNA, 23 nt, Human
ggcagcucucaucugaugacuga

SEQ ID NO: 455483 - RNA, 22 nt, Human
gcacaugguaggcauuugaugu

SEQ ID NO: 455484 - RNA, 22 nt, Human
gugccuggcacacagaaggcaa

SEQ ID NO: 455485 - RNA, 22 nt, Human
uaaauguauaggcacuaaaccu

SEQ ID NO: 455486 - RNA, 22 nt, Human
aucacauugccagugauuaccc

SEQ ID NO: 455487 - RNA, 20 nt, Human
ucagggcaugggacagcccc

SEQ ID NO: 455488 - RNA, 22 nt, Human
cuggccuagcucucugcuugaa

SEQ ID NO: 455489 - RNA, 22 nt, Human
ugcagcccuuccuuccucuggg

SEQ ID NO: 455490 - RNA, 22 nt, Human
caguuucuacgaaggucaaccc

SEQ ID NO: 455491 - RNA, 22 nt, Human
guuauguauugggaaauccaag

SEQ ID NO: 455492 - RNA, 18 nt, Human
ugucucugaauuccagug

SEQ ID NO: 455493 - RNA, 22 nt, Human
ugcagcuguuacggacccuguc

SEQ ID NO: 455494 - RNA, 22 nt, Human
gugguaaucggauucuuaccgg

SEQ ID NO: 455495 - RNA, 21 nt, Human
ggcaggauggcaguggacccc

SEQ ID NO: 455496 - RNA, 22 nt, Human
aagagcaucgguggagccccca

SEQ ID NO: 455497 - RNA, 22 nt, Human
agcagcuuacauguggccuauc

SEQ ID NO: 455498 - RNA, 22 nt, Human
uugcagcuucgagucuaucugu

SEQ ID NO: 455499 - RNA, 22 nt, Human
gcagagugaagcaguauggaaa

SEQ ID NO: 455500 - RNA, 22 nt, Human
aacuagaaccacuuguauuucc

SEQ ID NO: 455501 - RNA, 22 nt, Human
ugcaccauguaaguggccacgu

SEQ ID NO: 455502 - RNA, 22 nt, Human
uagauuuccucuuccucauucc

SEQ ID NO: 455503 - RNA, 22 nt, Human
cugcagcuccccugagaucaag

SEQ ID NO: 455504 - RNA, 22 nt, Human
uuacaaaguucugaguucaaac

SEQ ID NO: 455505 - RNA, 22 nt, Human
ccugggucuugguucaugcucu

SEQ ID NO: 455506 - RNA, 22 nt, Human
ucacuccucauugcugcccauu

SEQ ID NO: 455507 - RNA, 21 nt, Human
uuuagggaccaggucauaggc

SEQ ID NO: 455508 - RNA, 22 nt, Human
ccugucaguugcugucagggau

SEQ ID NO: 455509 - RNA, 22 nt, Human
aagcagaauuuaauagaaaggu

SEQ ID NO: 455510 - RNA, 22 nt, Human
uuccaugugaguacacugugau

SEQ ID NO: 455511 - RNA, 22 nt, Human
guggccugaugccagcccugug

SEQ ID NO: 455512 - RNA, 22 nt, Human
uaauacaauggaguugggcccc

SEQ ID NO: 455513 - RNA, 22 nt, Human
uccauccauguaggaagauggu

SEQ ID NO: 455514 - RNA, 22 nt, Human
ucacaggcuccagggccuggau

SEQ ID NO: 455515 - RNA, 22 nt, Human
gccugccuucggugcgcagcgg

SEQ ID NO: 455516 - RNA, 22 nt, Human
ugccagaagauucucuaucaga

SEQ ID NO: 455517 - RNA, 22 nt, Human
ggugcucaagagggcauccucu

SEQ ID NO: 455518 - RNA, 22 nt, Human
aagggcaggcacccacccucac

SEQ ID NO: 455519 - RNA, 22 nt, Human
ccagcugaggcagccacacagg

SEQ ID NO: 455520 - RNA, 22 nt, Human
acugcagcaaagcccgugucuu

SEQ ID NO: 455521 - RNA, 22 nt, Human
agggccagccaggcccuacaaa

SEQ ID NO: 455522 - RNA, 22 nt, Human
aaaaauagcuucucuugucccu

SEQ ID NO: 455523 - RNA, 22 nt, Human
ugggggacugcacuggcgucag

SEQ ID NO: 455524 - RNA, 22 nt, Human
uaguccaguaaaacagcuaacg

SEQ ID NO: 455525 - RNA, 18 nt, Human
gcuccuggaccaggucac

SEQ ID NO: 455526 - RNA, 22 nt, Human
cacugucuuuugugaagacaau

SEQ ID NO: 455527 - RNA, 22 nt, Human
ugucccagaucacaggagggga

SEQ ID NO: 455528 - RNA, 23 nt, Human
uccuucagagccucccuccaagc

SEQ ID NO: 455529 - RNA, 22 nt, Human
agcucccagucuccucuccaug

SEQ ID NO: 455530 - RNA, 19 nt, Human
guuucauuaagauaggaaa

SEQ ID NO: 455531 - RNA, 22 nt, Human
uaaaggcucguauuguugugug

SEQ ID NO: 455532 - RNA, 22 nt, Human
ggagugacucacagcugggaca

SEQ ID NO: 455533 - RNA, 22 nt, Human
ugcagagggacagccacagcuc

SEQ ID NO: 455534 - RNA, 23 nt, Human
aggagacagggaagugccuggcu

SEQ ID NO: 455535 - RNA, 22 nt, Human
gcagcuggcucagagagguggg

SEQ ID NO: 455536 - RNA, 20 nt, Human
ucagauuuuucuaacuuuga

SEQ ID NO: 455537 - RNA, 22 nt, Human
ugagaugaauaacuccugcuaa

SEQ ID NO: 455538 - RNA, 22 nt, Human
uuauuagguuauucucuguacu

SEQ ID NO: 455539 - RNA, 22 nt, Human
ucucagggccccaaaggcuagu

SEQ ID NO: 455540 - RNA, 22 nt, Human
uguccugggaaugggaugcagu

SEQ ID NO: 455541 - RNA, 22 nt, Human
cccaggcagagagcuggugagc

SEQ ID NO: 455542 - RNA, 22 nt, Human
cccuggcagaaugucucugggc

SEQ ID NO: 455543 - RNA, 22 nt, Human
augggugugaaaauggucaucu

SEQ ID NO: 455544 - RNA, 22 nt, Human
gcagggacugugaucucacaga

SEQ ID NO: 455545 - RNA, 22 nt, Human
uggcucugucaaacugcacaca

SEQ ID NO: 455546 - RNA, 22 nt, Human
gcuugggauaugcugauguaaa

SEQ ID NO: 455547 - RNA, 22 nt, Human
acagguggcuuauuggcugauu

SEQ ID NO: 455548 - RNA, 22 nt, Human
ugaggcagucacccccuccugc

SEQ ID NO: 455549 - RNA, 23 nt, Human
uuacaguaggaguuggaaaacca

SEQ ID NO: 455550 - RNA, 22 nt, Human
cuuuggaauaauuuccuggagu

SEQ ID NO: 455551 - RNA, 22 nt, Human
aagcagcauaauugcuauuuua

SEQ ID NO: 455552 - RNA, 22 nt, Human
gagguggguguaucacagguca

SEQ ID NO: 455553 - RNA, 22 nt, Human
uguuacacagcagaauagcaag

SEQ ID NO: 455554 - RNA, 22 nt, Human
caguggcaaugggacagagcac

SEQ ID NO: 455555 - RNA, 22 nt, Human
aggaaccagagguugagcaacu

SEQ ID NO: 455556 - RNA, 22 nt, Human
agauguaguagugggucuuuua

SEQ ID NO: 455557 - RNA, 20 nt, Human
gcugucuggauuagaagccu

SEQ ID NO: 455558 - RNA, 22 nt, Human
ccagagaggggaagggcuugcc

SEQ ID NO: 455559 - RNA, 22 nt, Human
auuuucugguugagguuuaaca

SEQ ID NO: 455560 - RNA, 22 nt, Human
ccucccaccguaucucaguggc

SEQ ID NO: 455561 - RNA, 22 nt, Human
auggcaggcccagguguucauu

SEQ ID NO: 455562 - RNA, 22 nt, Human
auuucacaucuaucucagauuu

SEQ ID NO: 455563 - RNA, 22 nt, Human
ugucaacacaccuaucucaauu

SEQ ID NO: 455564 - RNA, 22 nt, Human
aauguacaucucaguguaguac

SEQ ID NO: 455565 - RNA, 22 nt, Human
agacagaacagaauaauuguug

SEQ ID NO: 455566 - RNA, 22 nt, Human
uccugaaaauaauuucacaaga

SEQ ID NO: 455567 - RNA, 22 nt, Human
guuguacaaaauaucagugagg

SEQ ID NO: 455568 - RNA, 22 nt, Human
ugaggcaggacauggacaacug

SEQ ID NO: 455569 - RNA, 22 nt, Human
cuggugguucaggagaauggcu

SEQ ID NO: 455570 - RNA, 22 nt, Human
cacuguacuggguugaaggacg

SEQ ID NO: 455571 - RNA, 22 nt, Human
ccugugcauccgguggucauug

SEQ ID NO: 455572 - RNA, 22 nt, Human
caguccuggggaccaggcugag

SEQ ID NO: 455573 - RNA, 22 nt, Human
gcugccugggcaggaggcgcug

SEQ ID NO: 455574 - RNA, 22 nt, Human
cauacuuugggauaagagugga

SEQ ID NO: 455575 - RNA, 22 nt, Human
gcagaggauagcauaugaaccu

SEQ ID NO: 455576 - RNA, 22 nt, Human
cugauuccaaagccaaagcuau

SEQ ID NO: 455577 - RNA, 22 nt, Human
aaaaauguuaucuacuguccga

SEQ ID NO: 455578 - RNA, 22 nt, Human
auuugucucugcacuuuacuca

SEQ ID NO: 455579 - RNA, 22 nt, Human
gggagggauuaguucugccugg

SEQ ID NO: 455580 - RNA, 22 nt, Human
aggcuggcuggcaggggacaca

SEQ ID NO: 455581 - RNA, 22 nt, Human
gccugcuguuaacugcaggaau

SEQ ID NO: 455582 - RNA, 22 nt, Human
acagaaauugggcaaauggaag

SEQ ID NO: 455583 - RNA, 22 nt, Human
ucacuguaucauguugcacuua

SEQ ID NO: 455584 - RNA, 22 nt, Human
ggccacuccgcugcuacuggaa

SEQ ID NO: 455585 - RNA, 22 nt, Human
auguaucaugcaggguccauga

SEQ ID NO: 455586 - RNA, 22 nt, Human
agagcugggacuuggacucaau

SEQ ID NO: 455587 - RNA, 22 nt, Human
uuguauuugauugucauaucgu

SEQ ID NO: 455588 - RNA, 22 nt, Human
auagauauuugaguuguuucca

SEQ ID NO: 455589 - RNA, 22 nt, Human
cccccaaggccaggcugagacc

SEQ ID NO: 455590 - RNA, 22 nt, Human
gcaggcuggucugaccaucccu

SEQ ID NO: 455591 - RNA, 22 nt, Human
uccugcagccauuagaggucaa

SEQ ID NO: 455592 - RNA, 22 nt, Human
ugcuggagaggaaggugggguc

SEQ ID NO: 455593 - RNA, 22 nt, Human
ugggccugauucuugaauccug

SEQ ID NO: 455594 - RNA, 22 nt, Human
acaaacuucccagacaagcucc

SEQ ID NO: 455595 - RNA, 21 nt, Human
acaggcucuggggaugcuggg

SEQ ID NO: 455596 - RNA, 22 nt, Human
aaguccuuggagaauagaaagg

SEQ ID NO: 455597 - RNA, 22 nt, Human
uggccuggccacauccagcagg

SEQ ID NO: 455598 - RNA, 22 nt, Human
uccugagaaggcacagcuugca

SEQ ID NO: 455599 - RNA, 22 nt, Human
agccucaguuucaggccuccuc

SEQ ID NO: 455600 - RNA, 22 nt, Human
ugccaggcauauggccucuuug

SEQ ID NO: 455601 - RNA, 22 nt, Human
gccuugcuuugcuucuggacag

SEQ ID NO: 455602 - RNA, 17 nt, Human
ucaggcugugccuggua

SEQ ID NO: 455603 - RNA, 22 nt, Human
agcuguguguuuccacugagcu

SEQ ID NO: 455604 - RNA, 22 nt, Human
gccuucccacccugcgaggcug

SEQ ID NO: 455605 - RNA, 22 nt, Human
agaaaucaauaucuauauguug

SEQ ID NO: 455606 - RNA, 22 nt, Human
augugaggaagaaagagguaag

SEQ ID NO: 455607 - RNA, 22 nt, Human
ggagacagugacuuagagacug

SEQ ID NO: 455608 - RNA, 22 nt, Human
caaggcaggaagccugucuuau

SEQ ID NO: 455609 - RNA, 22 nt, Human
gaagagcuauguccagggagca

SEQ ID NO: 455610 - RNA, 22 nt, Human
uguaaucauuacaguacaugga

SEQ ID NO: 455611 - RNA, 18 nt, Human
gcagugaagaaagagcuu

SEQ ID NO: 455612 - RNA, 22 nt, Human
guaacagaggguuugcagauau

SEQ ID NO: 455613 - RNA, 17 nt, Human
ccagagcuacugagacu

SEQ ID NO: 455614 - RNA, 22 nt, Human
ugaguacucggagugcuuugga

SEQ ID NO: 455615 - RNA, 16 nt, Human
ucagggcagaauggca

SEQ ID NO: 455616 - RNA, 22 nt, Human
gcugccacuuggucaugucaug

SEQ ID NO: 455617 - RNA, 22 nt, Human
ugcagggaaugcuugcagcaug

SEQ ID NO: 455618 - RNA, 22 nt, Human
cugcugcauuacucuucucaag

SEQ ID NO: 455619 - RNA, 21 nt, Human
ggccugagcaccuguccaccu

SEQ ID NO: 455620 - RNA, 22 nt, Human
accaggcugugaagugagacua

SEQ ID NO: 455621 - RNA, 22 nt, Human
uggacucagaaguguucuuuua

SEQ ID NO: 455622 - RNA, 22 nt, Human
ucuaggagcaugaagggaaggc

SEQ ID NO: 455623 - RNA, 22 nt, Human
ccucugcaccauagccuucagc

SEQ ID NO: 455624 - RNA, 22 nt, Human
agugaaauaaagcugccuaugg

SEQ ID NO: 455625 - RNA, 22 nt, Human
gcagggucugaggccacagagg

SEQ ID NO: 455626 - RNA, 22 nt, Human
caaagaugcugauguuggauca

SEQ ID NO: 455627 - RNA, 22 nt, Human
uggggagugaugccucggauaa

SEQ ID NO: 455628 - RNA, 22 nt, Human
cacugaguucccugacauuuca

SEQ ID NO: 455629 - RNA, 22 nt, Human
ugucacaaacauacauuauaga

SEQ ID NO: 455630 - RNA, 22 nt, Human
acagagcuguacuacuuacuga

SEQ ID NO: 455631 - RNA, 22 nt, Human
cugggacacccaaggaaagagc

SEQ ID NO: 455632 - RNA, 22 nt, Human
ugaagcaguucucagaaguggg

SEQ ID NO: 455633 - RNA, 22 nt, Human
aucuucaacuugaucauuugaa

SEQ ID NO: 455634 - RNA, 22 nt, Human
ugaaacaagggaccguccuuuc

SEQ ID NO: 455635 - RNA, 20 nt, Human
cccugagacaaaggaggggc

SEQ ID NO: 455636 - RNA, 22 nt, Human
ggccucugggguccugagccca

SEQ ID NO: 455637 - RNA, 22 nt, Human
cagcuuggaggaggaucuaaga

SEQ ID NO: 455638 - RNA, 22 nt, Human
uacuuccuguuuccaugucugu

SEQ ID NO: 455639 - RNA, 22 nt, Human
uuuguggcaggagcggagaccg

SEQ ID NO: 455640 - RNA, 22 nt, Human
gcuguacauuuguguacacuug

SEQ ID NO: 455641 - RNA, 22 nt, Human
ucugcgcugccuugauccuugg

SEQ ID NO: 455642 - RNA, 19 nt, Human
gaggaggcuucagcuuucu

SEQ ID NO: 455643 - RNA, 22 nt, Human
cagguggagcugacugagggca

SEQ ID NO: 455644 - RNA, 23 nt, Human
uggggccaagugaggaagggucu

SEQ ID NO: 455645 - RNA, 22 nt, Human
gggucagcugcugggggcugac

SEQ ID NO: 455646 - RNA, 22 nt, Human
ggcugcuguacugaugucaguu

SEQ ID NO: 455647 - RNA, 22 nt, Human
ggaggaagcacacggcuuguau

SEQ ID NO: 455648 - RNA, 22 nt, Human
uggcucagccagcccuaggaac

SEQ ID NO: 455649 - RNA, 21 nt, Human
gagagggcauuauaggaagug

SEQ ID NO: 455650 - RNA, 22 nt, Human
auaaacugaagggaacacugag

SEQ ID NO: 455651 - RNA, 22 nt, Human
ucuugggauugcccugcaguuc

SEQ ID NO: 455652 - RNA, 22 nt, Human
ccuggccagccagggcuggggu

SEQ ID NO: 455653 - RNA, 22 nt, Human
ccucugaguccucccugguugc

SEQ ID NO: 455654 - RNA, 18 nt, Human
agcagcugugccacacug

SEQ ID NO: 455655 - RNA, 22 nt, Human
uuuuuauaugaaggauagugcg

SEQ ID NO: 455656 - RNA, 18 nt, Human
ugaauagggguuugcaga

SEQ ID NO: 455657 - RNA, 22 nt, Human
caaaugcaaaauauaacccugu

SEQ ID NO: 455658 - RNA, 22 nt, Human
uuuuucugccauucaaagagga

SEQ ID NO: 455659 - RNA, 22 nt, Human
uuucacauuuguuuuaagaagu

SEQ ID NO: 455660 - RNA, 22 nt, Human
cugaggccucucuccugggcuu

SEQ ID NO: 455661 - RNA, 21 nt, Human
ccacaggggcuccccugucag

SEQ ID NO: 455662 - RNA, 22 nt, Human
gaaaugugugacaaguuucaau

SEQ ID NO: 455663 - RNA, 22 nt, Human
uagccucuggaauccuuucucu

SEQ ID NO: 455664 - RNA, 21 nt, Human
cccaagggaggcaggauaagg

SEQ ID NO: 455665 - RNA, 22 nt, Human
aaacugaaacaucaucauguug

SEQ ID NO: 455666 - RNA, 22 nt, Human
ugaaauauuuagagaguaaguu

SEQ ID NO: 455667 - RNA, 22 nt, Human
ucaggcugccuaucagacugug

SEQ ID NO: 455668 - RNA, 22 nt, Human
uggagcccagggugagaaggag

SEQ ID NO: 455669 - RNA, 22 nt, Human
aagugagugguaaggagcaugg

SEQ ID NO: 455670 - RNA, 22 nt, Human
uuaugcuaguauaguccuuaga

SEQ ID NO: 455671 - RNA, 22 nt, Human
ggcuuuauuuugcaugaaugcu

SEQ ID NO: 455672 - RNA, 22 nt, Human
caaggcaggcaguucacuugag

SEQ ID NO: 455673 - RNA, 23 nt, Human
gagagcugacugucaagacuguu

SEQ ID NO: 455674 - RNA, 17 nt, Human
ggugagaccucccacuc

SEQ ID NO: 455675 - RNA, 22 nt, Human
auggcagggcagccucucagag

SEQ ID NO: 455676 - RNA, 22 nt, Human
uggucgaccaguuggaaaguaa

SEQ ID NO: 455677 - RNA, 22 nt, Human
uguuuauaccuugguauaacca

SEQ ID NO: 455678 - RNA, 22 nt, Human
uccaauaacaucuaaaaacuua

SEQ ID NO: 455679 - RNA, 22 nt, Human
cugggccugggaggccaggucu

SEQ ID NO: 455680 - RNA, 22 nt, Human
cagcugaagaaagagugguuag

SEQ ID NO: 455681 - RNA, 22 nt, Human
agcucccagaaggcccugcgcc

SEQ ID NO: 455682 - RNA, 22 nt, Human
auaaaaaugagggcgguagcua

SEQ ID NO: 455683 - RNA, 22 nt, Human
cuggagccugcaguuuucacuu

SEQ ID NO: 455684 - RNA, 22 nt, Human
ucagagguaguagcagaguuga

SEQ ID NO: 455685 - RNA, 22 nt, Human
cagguggguguaugaaugcaaa

SEQ ID NO: 455686 - RNA, 22 nt, Human
ugugccaggcacuugcccaggc

SEQ ID NO: 455687 - RNA, 22 nt, Human
guggcucuaggugagcauggag

SEQ ID NO: 455688 - RNA, 22 nt, Human
ccuggaaguuggagguugcagu

SEQ ID NO: 455689 - RNA, 22 nt, Human
ccagaggcauguucaaagcaau

SEQ ID NO: 455690 - RNA, 22 nt, Human
cuggcucaguucuugguuuuca

SEQ ID NO: 455691 - RNA, 22 nt, Human
aagacccacaaggcugaauguu

SEQ ID NO: 455692 - RNA, 21 nt, Human
ugaggcucuguugugccugca

SEQ ID NO: 455693 - RNA, 22 nt, Human
ggccaggcacugugugagauau

SEQ ID NO: 455694 - RNA, 22 nt, Human
ccagcucugccaagcgucagcu

SEQ ID NO: 455695 - RNA, 22 nt, Human
uuaaacagucccagaggcugac

SEQ ID NO: 455696 - RNA, 20 nt, Human
cauuaugguugggcacagug

SEQ ID NO: 455697 - RNA, 22 nt, Human
gagccagguuugaaucucaguc

SEQ ID NO: 455698 - RNA, 22 nt, Human
gucuggggaagucagggcauca

SEQ ID NO: 455699 - RNA, 22 nt, Human
gcucagagaugucugcugccuu

SEQ ID NO: 455700 - RNA, 22 nt, Human
ucugucugcucauuuaccucag

SEQ ID NO: 455701 - RNA, 22 nt, Human
gccuggagaaaggaagguggga

SEQ ID NO: 455702 - RNA, 22 nt, Human
uccugagauaaaucucauguga

SEQ ID NO: 455703 - RNA, 22 nt, Human
cuuccugcaggacagccaucug

SEQ ID NO: 455704 - RNA, 22 nt, Human
uggcccugaggggcugugcccc

SEQ ID NO: 455705 - RNA, 22 nt, Human
agagccaggcaggcaauguuga

SEQ ID NO: 455706 - RNA, 21 nt, Human
gcugcucgagauccagugcuu

SEQ ID NO: 455707 - RNA, 18 nt, Human
ucagcuggggcugcagcc

SEQ ID NO: 455708 - RNA, 22 nt, Human
auuuccaaaaccacuuauugcc

SEQ ID NO: 455709 - RNA, 22 nt, Human
aagcgccacgagaagcuggacc

SEQ ID NO: 455710 - RNA, 22 nt, Human
caucugccuaaguggcccuguu

SEQ ID NO: 455711 - RNA, 22 nt, Human
aggcacugacaauucuggacug

SEQ ID NO: 455712 - RNA, 22 nt, Human
ucaaguguaguggugucagguc

SEQ ID NO: 455713 - RNA, 22 nt, Human
cugcagcugucucuacugggca

SEQ ID NO: 455714 - RNA, 22 nt, Human
cuggagcuaggaaguccaagau

SEQ ID NO: 455715 - RNA, 22 nt, Human
ucucuucuuguguuuuccugcc

SEQ ID NO: 455716 - RNA, 19 nt, Human
augauggucccauucaccu

SEQ ID NO: 455717 - RNA, 22 nt, Human
acagggccaggugagaggugcu

SEQ ID NO: 455718 - RNA, 20 nt, Human
agggcagcuugaggagccgg

SEQ ID NO: 455719 - RNA, 22 nt, Human
cugagcugggacucaguagcaa

SEQ ID NO: 455720 - RNA, 22 nt, Human
guggccaggacauugccaggca

SEQ ID NO: 455721 - RNA, 22 nt, Human
acagggucauuuuaugaucugu

SEQ ID NO: 455722 - RNA, 22 nt, Human
ggaaaaggccacagggacacau

SEQ ID NO: 455723 - RNA, 22 nt, Human
auugaggcagcauaguucaggg

SEQ ID NO: 455724 - RNA, 22 nt, Human
ugaaggccucugguacaugcca

SEQ ID NO: 455725 - RNA, 22 nt, Human
caaagacugcauaacacaugaa

SEQ ID NO: 455726 - RNA, 22 nt, Human
uuuaagaugguauuuuauaaag

SEQ ID NO: 455727 - RNA, 22 nt, Human
agucccagcccaguccuguaag

SEQ ID NO: 455728 - RNA, 22 nt, Human
gcagaagcugggcagcgaggug

SEQ ID NO: 455729 - RNA, 22 nt, Human
gccagcagguugucaaggagcu

SEQ ID NO: 455730 - RNA, 22 nt, Human
ugcuuuauggauuuguguccug

SEQ ID NO: 455731 - RNA, 22 nt, Human
ggcuggcaagugucugcucaug

SEQ ID NO: 455732 - RNA, 22 nt, Human
cuuacauuuaaucaugugucau

SEQ ID NO: 455733 - RNA, 22 nt, Human
ugcugaggucaccuugcugcua

SEQ ID NO: 455734 - RNA, 22 nt, Human
aacagacagaaaaaugugaucu

SEQ ID NO: 455735 - RNA, 22 nt, Human
gaggccugaggcugccuggagc

SEQ ID NO: 455736 - RNA, 22 nt, Human
ucucaagagggaggcaaucaug

SEQ ID NO: 455737 - RNA, 22 nt, Human
ucuggccaggauggcaagacca

SEQ ID NO: 455738 - RNA, 22 nt, Human
ugcagggaaaacccaggaugcu

SEQ ID NO: 455739 - RNA, 22 nt, Human
agaggccuccgaaaggugggcu

SEQ ID NO: 455740 - RNA, 19 nt, Human
ucauaaggagagaggaaau

SEQ ID NO: 455741 - RNA, 20 nt, Human
ugugugcacacaugacauuc

SEQ ID NO: 455742 - RNA, 22 nt, Human
auuguuaugaaaauaagauguu

SEQ ID NO: 455743 - RNA, 22 nt, Human
acaaaaauuagcugggcauggu

SEQ ID NO: 455744 - RNA, 22 nt, Human
gcagcuuuguggagaggcccau

SEQ ID NO: 455745 - RNA, 22 nt, Human
cuggugugauugagcccaggug

SEQ ID NO: 455746 - RNA, 21 nt, Human
ucagcagcuuuugcagucccu

SEQ ID NO: 455747 - RNA, 22 nt, Human
cagaggaggcgguauacacugc

SEQ ID NO: 455748 - RNA, 23 nt, Human
agcuggguggccugcgugaagcu

SEQ ID NO: 455749 - RNA, 22 nt, Human
cuguggcaggaagggacuagca

SEQ ID NO: 455750 - RNA, 22 nt, Human
cuguacagaguucugaguguac

SEQ ID NO: 455751 - RNA, 22 nt, Human
ucaugccacuuacaaaauaaug

SEQ ID NO: 455752 - RNA, 22 nt, Human
cugagauggaguuuugcucuug

SEQ ID NO: 455753 - RNA, 22 nt, Human
auguuucaugacugagcaaaau

SEQ ID NO: 455754 - RNA, 22 nt, Human
uaaucacaucaggguaaauggg

SEQ ID NO: 455755 - RNA, 19 nt, Human
gcagccaggugcucuaccu

SEQ ID NO: 455756 - RNA, 23 nt, Human
ggccuguguuuugucugaaguac

SEQ ID NO: 455757 - RNA, 22 nt, Human
uuuugcuuuuguaacacagugu

SEQ ID NO: 455758 - RNA, 22 nt, Human
ugaaaguuacaggaaaacagau

SEQ ID NO: 455759 - RNA, 22 nt, Human
cugcccagaaucacucacucga

SEQ ID NO: 455760 - RNA, 22 nt, Human
cuggagugaggucugggagccu

SEQ ID NO: 455761 - RNA, 22 nt, Human
caaggccaguccauuuuggaag

SEQ ID NO: 455762 - RNA, 22 nt, Human
ccuccuggcccugggccuggaa

SEQ ID NO: 455763 - RNA, 22 nt, Human
uucuaguucccucuggaaugua

SEQ ID NO: 455764 - RNA, 22 nt, Human
gcuuccugauauucauacuguu

SEQ ID NO: 455765 - RNA, 22 nt, Human
ccagcugacgaugccuggucuc

SEQ ID NO: 455766 - RNA, 22 nt, Human
cuuccaguaguaucauucucau

SEQ ID NO: 455767 - RNA, 22 nt, Human
ugaugcugagccugggacugac

SEQ ID NO: 455768 - RNA, 22 nt, Human
agcugucuaccugcagaguccu

SEQ ID NO: 455769 - RNA, 21 nt, Human
ccuucucuugcuucagcuuca

SEQ ID NO: 455770 - RNA, 22 nt, Human
gacauucacaguuuccgauggu

SEQ ID NO: 455771 - RNA, 22 nt, Human
uucaggagaauuccaagaagua

SEQ ID NO: 455772 - RNA, 18 nt, Human
cccucuccugcuaguggg

SEQ ID NO: 455773 - RNA, 22 nt, Human
uggggacaggagacuuacagcu

SEQ ID NO: 455774 - RNA, 22 nt, Human
gcaggagcaaacugcagugugg

SEQ ID NO: 455775 - RNA, 22 nt, Human
ucagagugcagggaguagcagc

SEQ ID NO: 455776 - RNA, 22 nt, Human
uggcaggaggaugaggcggcua

SEQ ID NO: 455777 - RNA, 22 nt, Human
ucccaggguuacagccagggca

SEQ ID NO: 455778 - RNA, 22 nt, Human
ucugagaguacgggcugcgcgc

SEQ ID NO: 455779 - RNA, 22 nt, Human
cauuaucugccauugacaccau

SEQ ID NO: 455780 - RNA, 21 nt, Human
aggugcagagccagggaccag

SEQ ID NO: 455781 - RNA, 22 nt, Human
cagaaguggccucagagggagu

SEQ ID NO: 455782 - RNA, 22 nt, Human
ucccugggccuccugcuaugca

SEQ ID NO: 455783 - RNA, 22 nt, Human
ugggcucugugccagguuggug

SEQ ID NO: 455784 - RNA, 22 nt, Human
ucuggcucucucaucacccaau

SEQ ID NO: 455785 - RNA, 22 nt, Human
uuuuaauacugcuauuguagga

SEQ ID NO: 455786 - RNA, 22 nt, Human
gguugccggggcaggacuggaa

SEQ ID NO: 455787 - RNA, 22 nt, Human
agaagccauucccuguaggcuc

SEQ ID NO: 455788 - RNA, 22 nt, Human
aauuugauucccugcaccuguu

SEQ ID NO: 455789 - RNA, 22 nt, Human
ggaguucacugugcaggcucug

SEQ ID NO: 455790 - RNA, 22 nt, Human
gcagcagaugcuuucauggaca

SEQ ID NO: 455791 - RNA, 22 nt, Human
auguguauacuugugcuuacuc

SEQ ID NO: 455792 - RNA, 22 nt, Human
cagaggaagagauacaagcccu

SEQ ID NO: 455793 - RNA, 22 nt, Human
acaugcauacaagcacauguag

SEQ ID NO: 455794 - RNA, 22 nt, Human
ucacagggauggaauagaaaua

SEQ ID NO: 455795 - RNA, 21 nt, Human
ccagacuggccuaugugguag

SEQ ID NO: 455796 - RNA, 20 nt, Human
ucauuucuugggguuccaag

SEQ ID NO: 455797 - RNA, 22 nt, Human
ucaaagcuuagauaauuucuuu

SEQ ID NO: 455798 - RNA, 22 nt, Human
gcugucugucucugugacuuaa

SEQ ID NO: 455799 - RNA, 18 nt, Human
uucaccagugugaugggu

SEQ ID NO: 455800 - RNA, 22 nt, Human
aagaacugugcuccaggcucca

SEQ ID NO: 455801 - RNA, 22 nt, Human
acagagguguuccagaccuagg

SEQ ID NO: 455802 - RNA, 22 nt, Human
uacaagacgagggaaguucuuu

SEQ ID NO: 455803 - RNA, 22 nt, Human
ccugaggcccuggcugugcuga

SEQ ID NO: 455804 - RNA, 22 nt, Human
ucuguuccauguuuuguuccau

SEQ ID NO: 455805 - RNA, 22 nt, Human
gugucccaggagaggagacaau

SEQ ID NO: 455806 - RNA, 21 nt, Human
ucccagggccaggugccauca

SEQ ID NO: 455807 - RNA, 22 nt, Human
ccuaagaauuaaugaauacacc

SEQ ID NO: 455808 - RNA, 22 nt, Human
cagaggaagcagacacaucuug

SEQ ID NO: 455809 - RNA, 22 nt, Human
aaagucuuuauuuuguaucuuu

SEQ ID NO: 455810 - RNA, 21 nt, Human
ugcagcugacacugguaugcc

SEQ ID NO: 455811 - RNA, 22 nt, Human
augcccgauaccuaguuaacuc

SEQ ID NO: 455812 - RNA, 22 nt, Human
uccagaggcuccaaagggagau

SEQ ID NO: 455813 - RNA, 22 nt, Human
gugugcaggugucagugcagcu

SEQ ID NO: 455814 - RNA, 22 nt, Human
uuucugcugugcuuucuugcgu

SEQ ID NO: 455815 - RNA, 22 nt, Human
auuuauuaugggauuuggcaca

SEQ ID NO: 455816 - RNA, 22 nt, Human
gcagcagaguuugggagauggu

SEQ ID NO: 455817 - RNA, 22 nt, Human
ugagcuggaaucuucuugacug

SEQ ID NO: 455818 - RNA, 22 nt, Human
ccucauggccuugagcugaggg

SEQ ID NO: 455819 - RNA, 22 nt, Human
ucaccaggauugggcuguaggc

SEQ ID NO: 455820 - RNA, 21 nt, Human
gccugccugcgugacccucuu

SEQ ID NO: 455821 - RNA, 22 nt, Human
uaggcagauguuaacaggaaaa

SEQ ID NO: 455822 - RNA, 22 nt, Human
cugcccugggauggucugugcg

SEQ ID NO: 455823 - RNA, 22 nt, Human
augcaguauaaaucauuucugg

SEQ ID NO: 455824 - RNA, 22 nt, Human
ugguccuggggaucugcaguga

SEQ ID NO: 455825 - RNA, 19 nt, Human
gcagccaccgcggcggccg

SEQ ID NO: 455826 - RNA, 21 nt, Human
ucagggcagcugcucuucaga

SEQ ID NO: 455827 - RNA, 22 nt, Human
aggcuccuuguucaucauccau

SEQ ID NO: 455828 - RNA, 22 nt, Human
ugcagugguugagagcccagac

SEQ ID NO: 455829 - RNA, 22 nt, Human
aggccugggcaagaaggggcgu

SEQ ID NO: 455830 - RNA, 22 nt, Human
aggcagugagugugacuucaca

SEQ ID NO: 455831 - RNA, 20 nt, Human
cucugcugcccgccggcugc

SEQ ID NO: 455832 - RNA, 22 nt, Human
uuagccauauagaaaaagagcu

SEQ ID NO: 455833 - RNA, 22 nt, Human
gcuggcucccauugguccuucc

SEQ ID NO: 455834 - RNA, 22 nt, Human
acaaggaggucuggggggcccu

SEQ ID NO: 455835 - RNA, 22 nt, Human
uagggcagauucgguggaguuu

SEQ ID NO: 455836 - RNA, 22 nt, Human
aagagcaucuauuucacagugg

SEQ ID NO: 455837 - RNA, 22 nt, Human
cacauguuuggcaugucaccaa

SEQ ID NO: 455838 - RNA, 22 nt, Human
cauuucugauuacagaauacua

SEQ ID NO: 455839 - RNA, 22 nt, Human
cagagcuggguuugggaaaccu

SEQ ID NO: 455840 - RNA, 18 nt, Human
ucaaagucuggcuccacu

SEQ ID NO: 455841 - RNA, 22 nt, Human
agccuauuccaggaugagcuca

SEQ ID NO: 455842 - RNA, 22 nt, Human
guguccacggcugagaaugauu

SEQ ID NO: 455843 - RNA, 18 nt, Human
aucucccauuggccaagg

SEQ ID NO: 455844 - RNA, 22 nt, Human
ugcugugagguugagaaggaag

SEQ ID NO: 455845 - RNA, 22 nt, Human
cagcuugggaguuugguuuuau

SEQ ID NO: 455846 - RNA, 22 nt, Human
aucagagauggcuccagugcuc

SEQ ID NO: 455847 - RNA, 22 nt, Human
ccugcccagcuucaccucaggc

SEQ ID NO: 455848 - RNA, 21 nt, Human
cagugagguccccagccuagg

SEQ ID NO: 455849 - RNA, 22 nt, Human
cauucugcauuuggaaggggca

SEQ ID NO: 455850 - RNA, 20 nt, Human
acuggacacugaggugagcu

SEQ ID NO: 455851 - RNA, 22 nt, Human
ccagagucuuuauauuccugaa

SEQ ID NO: 455852 - RNA, 22 nt, Human
agaagccaauccuugucucucu

SEQ ID NO: 455853 - RNA, 22 nt, Human
augugacaauauuuggucuuau

SEQ ID NO: 455854 - RNA, 22 nt, Human
ccagcugcugugaggaccacag

SEQ ID NO: 455855 - RNA, 22 nt, Human
gaaauucugugucccagagugc

SEQ ID NO: 455856 - RNA, 22 nt, Human
aguguugucaaacggcucagca

SEQ ID NO: 455857 - RNA, 22 nt, Human
cuguacaaguccuucaucaggg

SEQ ID NO: 455858 - RNA, 18 nt, Human
aguggucuguuauaucau

SEQ ID NO: 455859 - RNA, 22 nt, Human
aaggcugaauucaaggguaggc

SEQ ID NO: 455860 - RNA, 22 nt, Human
auaugaagucagacaaacuggg

SEQ ID NO: 455861 - RNA, 22 nt, Human
cagacuggccacaucugcacug

SEQ ID NO: 455862 - RNA, 18 nt, Human
caggagcaggaguugaac

SEQ ID NO: 455863 - RNA, 22 nt, Human
ugcaagagguaaaaugaaagga

SEQ ID NO: 455864 - RNA, 22 nt, Human
aaguguagauuauggagugucu

SEQ ID NO: 455865 - RNA, 19 nt, Human
ucugcuggcagaauucccu

SEQ ID NO: 455866 - RNA, 22 nt, Human
ggcugcagggcagcuggugugg

SEQ ID NO: 455867 - RNA, 22 nt, Human
guuacacaggaaaacauuagca

SEQ ID NO: 455868 - RNA, 22 nt, Human
ugaacagauggcccagcagagg

SEQ ID NO: 455869 - RNA, 22 nt, Human
agcacagguacggagaugcuac

SEQ ID NO: 455870 - RNA, 22 nt, Human
cagcagugaugugugaggguuc

SEQ ID NO: 455871 - RNA, 22 nt, Human
agugcagagagcaauacucuac

SEQ ID NO: 455872 - RNA, 22 nt, Human
ucuuacagaaaauagauaacau

SEQ ID NO: 455873 - RNA, 22 nt, Human
caggagcaaggagcagugggau

SEQ ID NO: 455874 - RNA, 22 nt, Human
cuggagcugcuguccuugggug

SEQ ID NO: 455875 - RNA, 21 nt, Human
ggcuguggagccaugacucac

SEQ ID NO: 455876 - RNA, 22 nt, Human
gccuuugcaccaucagugcaau

SEQ ID NO: 455877 - RNA, 22 nt, Human
ucugucugacaggguaugaacu

SEQ ID NO: 455878 - RNA, 22 nt, Human
cuccugggcucaagugauccuc

SEQ ID NO: 455879 - RNA, 22 nt, Human
ucucagaguuuagagcugagcc

SEQ ID NO: 455880 - RNA, 22 nt, Human
ucuuuugagggccagaggaaga

SEQ ID NO: 455881 - RNA, 21 nt, Human
gcaggaugcaucuuggugucu

SEQ ID NO: 455882 - RNA, 22 nt, Human
ucugucaggagauuggcagcug

SEQ ID NO: 455883 - RNA, 20 nt, Human
accccagccccucuaucuga

SEQ ID NO: 455884 - RNA, 22 nt, Human
uucagagccacuucaagucuaa

SEQ ID NO: 455885 - RNA, 22 nt, Human
caggccugucugcacaugaggc

SEQ ID NO: 455886 - RNA, 22 nt, Human
gcaccuggcugcccagguggag

SEQ ID NO: 455887 - RNA, 22 nt, Human
agaggccaguggcugugcuguc

SEQ ID NO: 455888 - RNA, 17 nt, Human
gcuuccucaugcaguuc

SEQ ID NO: 455889 - RNA, 22 nt, Human
ugguaaauauguccauucucuu

SEQ ID NO: 455890 - RNA, 19 nt, Human
gaguuauugccagggcaug

SEQ ID NO: 455891 - RNA, 22 nt, Human
gcaggaagccuuaccaagccca

SEQ ID NO: 455892 - RNA, 21 nt, Human
ccugucuuggacugaggcacc

SEQ ID NO: 455893 - RNA, 22 nt, Human
gcuggccugggcagccugucgg

SEQ ID NO: 455894 - RNA, 19 nt, Human
gagcugccuuuugaagacc

SEQ ID NO: 455895 - RNA, 22 nt, Human
agaagccauaguaucucagggu

SEQ ID NO: 455896 - RNA, 22 nt, Human
ccagagcccagcacacggugcu

SEQ ID NO: 455897 - RNA, 19 nt, Human
ucaggacugacuugaaguc

SEQ ID NO: 455898 - RNA, 22 nt, Human
gagaagcaauuuccaacugugc

SEQ ID NO: 455899 - RNA, 22 nt, Human
cuguccagaaagggggcaacaa

SEQ ID NO: 455900 - RNA, 22 nt, Human
agccuggcacugaggcagggcg

SEQ ID NO: 455901 - RNA, 22 nt, Human
auucuccacacauccagaccuu

SEQ ID NO: 455902 - RNA, 22 nt, Human
agccccaggcccggacgccucu

SEQ ID NO: 455903 - RNA, 22 nt, Human
cuuauguaugcuacuuuguggu

SEQ ID NO: 455904 - RNA, 22 nt, Human
gaaaagagaacaucugaggauc

SEQ ID NO: 455905 - RNA, 22 nt, Human
cuuaauuuaagccuagaaugca

SEQ ID NO: 455906 - RNA, 22 nt, Human
uguuuaagcugaugagguaucg

SEQ ID NO: 455907 - RNA, 22 nt, Human
aggaaacuccccuacaucucaa

SEQ ID NO: 455908 - RNA, 22 nt, Human
gggcugacaguuuccccugaaa

SEQ ID NO: 455909 - RNA, 22 nt, Human
gcucugcucuugacuuaccagg

SEQ ID NO: 455910 - RNA, 22 nt, Human
aucuggaagccagauacucagu

SEQ ID NO: 455911 - RNA, 22 nt, Human
aggcucagccugggccuagagc

SEQ ID NO: 455912 - RNA, 22 nt, Human
cagaggguugucaggcgccuug

SEQ ID NO: 455913 - RNA, 22 nt, Human
cauguuauuuauccauuaaaca

SEQ ID NO: 455914 - RNA, 22 nt, Human
uuacaguaugaucaacuuuuca

SEQ ID NO: 455915 - RNA, 22 nt, Human
acugaaaaugaauuagaaacag

SEQ ID NO: 455916 - RNA, 22 nt, Human
auuuaaauuuucugauggagag

SEQ ID NO: 455917 - RNA, 22 nt, Human
cugccuggcauggagaagagaa

SEQ ID NO: 455918 - RNA, 19 nt, Human
gggaaauucacuugcuucc

SEQ ID NO: 455919 - RNA, 22 nt, Human
caggaacacaaguucagggaug

SEQ ID NO: 455920 - RNA, 18 nt, Human
ccugcagcccaggaggcc

SEQ ID NO: 455921 - RNA, 22 nt, Human
cagagccaugguaugggcuugu

SEQ ID NO: 455922 - RNA, 22 nt, Human
aaacuagagcaugugaguggga

SEQ ID NO: 455923 - RNA, 22 nt, Human
ggcagccuccagggcacuggug

SEQ ID NO: 455924 - RNA, 22 nt, Human
cugagggcaugaacauuccaua

SEQ ID NO: 455925 - RNA, 22 nt, Human
acugaaggaagcgggcaggggu

SEQ ID NO: 455926 - RNA, 22 nt, Human
gcaggaugaaggcagaggcuga

SEQ ID NO: 455927 - RNA, 22 nt, Human
agguuuucagcuguauccugag

SEQ ID NO: 455928 - RNA, 22 nt, Human
aaggcugagggcuguaccuggc

SEQ ID NO: 455929 - RNA, 22 nt, Human
ucagggcaucaucaugaauaua

SEQ ID NO: 455930 - RNA, 22 nt, Human
aucagagauuguaguaugugca

SEQ ID NO: 455931 - RNA, 22 nt, Human
agcugagcucaggcugauguaa

SEQ ID NO: 455932 - RNA, 21 nt, Human
cacaagacacauaggguguuu

SEQ ID NO: 455933 - RNA, 22 nt, Human
uauuuuaucugccagaguggag

SEQ ID NO: 455934 - RNA, 22 nt, Human
ucauugcaagcucauuuaucug

SEQ ID NO: 455935 - RNA, 22 nt, Human
ugaaggccagggauuugcagcc

SEQ ID NO: 455936 - RNA, 22 nt, Human
uugcucugaacccagggcacca

SEQ ID NO: 455937 - RNA, 21 nt, Human
cugcaucucauagaacauguc

SEQ ID NO: 455938 - RNA, 22 nt, Human
ucagccuggcaggauggccugg

SEQ ID NO: 455939 - RNA, 17 nt, Human
gaaagguccuagaaauc

SEQ ID NO: 455940 - RNA, 22 nt, Human
augucccagcugagagacaacu

SEQ ID NO: 455941 - RNA, 22 nt, Human
ugucagaacucuauugaugucc

SEQ ID NO: 455942 - RNA, 22 nt, Human
ugcaggggcuugucugggccug

SEQ ID NO: 455943 - RNA, 22 nt, Human
ugccuguccugaggaugagggu

SEQ ID NO: 455944 - RNA, 22 nt, Human
ucaggagucugugcaguuccac

SEQ ID NO: 455945 - RNA, 22 nt, Human
cccucugaccuccugccacagu

SEQ ID NO: 455946 - RNA, 22 nt, Human
acagcugggugcugcucagagc

SEQ ID NO: 455947 - RNA, 22 nt, Human
ugcugucuuccaggauggugaa

SEQ ID NO: 455948 - RNA, 22 nt, Human
gccagcucagaugcaggaagga

SEQ ID NO: 455949 - RNA, 22 nt, Human
aguuuuaugcaguguucugaua

SEQ ID NO: 455950 - RNA, 22 nt, Human
ccugagcuggaagagcuugugc

SEQ ID NO: 455951 - RNA, 22 nt, Human
uaagaacauuuucggaaagaua

SEQ ID NO: 455952 - RNA, 22 nt, Human
cagucacauggaugauggauag

SEQ ID NO: 455953 - RNA, 22 nt, Human
acuggaagccaguugacaauca

SEQ ID NO: 455954 - RNA, 22 nt, Human
gcagggcaggauuugaacccag

SEQ ID NO: 455955 - RNA, 18 nt, Human
ugaggccucugcugggcc

SEQ ID NO: 455956 - RNA, 22 nt, Human
ggcaggguggcccuccagugag

SEQ ID NO: 455957 - RNA, 22 nt, Human
cagcuuuaccuuuaggaguaac

SEQ ID NO: 455958 - RNA, 22 nt, Human
cccaggcugauguucagcgggu

SEQ ID NO: 455959 - RNA, 22 nt, Human
cagggccagccauccugcuggg

SEQ ID NO: 455960 - RNA, 21 nt, Human
gcacagggacagaucaucaca

SEQ ID NO: 455961 - RNA, 22 nt, Human
augaaaacuuuagccucauuag

SEQ ID NO: 455962 - RNA, 22 nt, Human
cucugggcuuguugaccugcac

SEQ ID NO: 455963 - RNA, 22 nt, Human
cagaggccccagaacuagcucu

SEQ ID NO: 455964 - RNA, 22 nt, Human
gggauggggucaacauguaccu

SEQ ID NO: 455965 - RNA, 22 nt, Human
cguggccuuugagugagcuccc

SEQ ID NO: 455966 - RNA, 22 nt, Human
ugggaaauguguuucuggacca

SEQ ID NO: 455967 - RNA, 22 nt, Human
ucuggaaguuagaggaggaaag

SEQ ID NO: 455968 - RNA, 22 nt, Human
cuccagugcacccagaggauuu

SEQ ID NO: 455969 - RNA, 22 nt, Human
aggagcagcccacuccuguccu

SEQ ID NO: 455970 - RNA, 22 nt, Human
agagccagcauuugggcccugc

SEQ ID NO: 455971 - RNA, 19 nt, Human
ggagaagcccaggaauccu

SEQ ID NO: 455972 - RNA, 23 nt, Human
uugucugugcuuuuccaguugcu

SEQ ID NO: 455973 - RNA, 22 nt, Human
gaggcacaguguuuggucagug

SEQ ID NO: 455974 - RNA, 22 nt, Human
aaguucaaggugauaguggcag

SEQ ID NO: 455975 - RNA, 22 nt, Human
uucacagaugccugaugugugg

SEQ ID NO: 455976 - RNA, 22 nt, Human
ccuucauugcaucuuuaagaga

SEQ ID NO: 455977 - RNA, 22 nt, Human
cugaggcucaagggcagguggg

SEQ ID NO: 455978 - RNA, 22 nt, Human
uggcucugcugaaccuagugca

SEQ ID NO: 455979 - RNA, 22 nt, Human
gccuggagagcacugugcgcuu

SEQ ID NO: 455980 - RNA, 22 nt, Human
acauuugagaugccuuuuaggu

SEQ ID NO: 455981 - RNA, 22 nt, Human
gucacuguuuccuauuauauuu

SEQ ID NO: 455982 - RNA, 22 nt, Human
ucagcagucacauguuguccca

SEQ ID NO: 455983 - RNA, 22 nt, Human
cugccuggucucaggcaugggg

SEQ ID NO: 455984 - RNA, 22 nt, Human
ugaggaagggugugacggcacc

SEQ ID NO: 455985 - RNA, 22 nt, Human
ccaggccagcaggcacaccugc

SEQ ID NO: 455986 - RNA, 22 nt, Human
ugcauuaugcuacccagaagcu

SEQ ID NO: 455987 - RNA, 18 nt, Human
gagagcugcuaccuagcu

SEQ ID NO: 455988 - RNA, 22 nt, Human
gaccauuucuaggaaucagacu

SEQ ID NO: 455989 - RNA, 22 nt, Human
ccuggagcaaaaaucuaaggag

SEQ ID NO: 455990 - RNA, 22 nt, Human
ugggaaugugagcauucauuca

SEQ ID NO: 455991 - RNA, 22 nt, Human
gguggccucucaugcaagguag

SEQ ID NO: 455992 - RNA, 22 nt, Human
aaugcuuuagcagugauuagug

SEQ ID NO: 455993 - RNA, 22 nt, Human
uuugacagauccuuaacucagc

SEQ ID NO: 455994 - RNA, 22 nt, Human
aggcucuggcaacagcuggugu

SEQ ID NO: 455995 - RNA, 22 nt, Human
ugaggccugaagccugaaguga

SEQ ID NO: 455996 - RNA, 23 nt, Human
acucagagaccccgggaagugac

SEQ ID NO: 455997 - RNA, 22 nt, Human
aguaaacauuuucauauuuucu

SEQ ID NO: 455998 - RNA, 21 nt, Human
uuuauuuauauaggacacaug

SEQ ID NO: 455999 - RNA, 22 nt, Human
auaugcacauacauacauaggu

SEQ ID NO: 456000 - RNA, 22 nt, Human
acuaaaaacuacugccaauagc

SEQ ID NO: 456001 - RNA, 22 nt, Human
caaaugcaugagaaauaagagg

SEQ ID NO: 456002 - RNA, 22 nt, Human
ccaggugugauuuggcaguguc

SEQ ID NO: 456003 - RNA, 22 nt, Human
gccagaagggguggauccaggc

SEQ ID NO: 456004 - RNA, 19 nt, Human
uggggcuguguuuugaccc

SEQ ID NO: 456005 - RNA, 22 nt, Human
aaaugucuuucuucugcuacgu

SEQ ID NO: 456006 - RNA, 22 nt, Human
ggcagugguuagaaacaugagc

SEQ ID NO: 456007 - RNA, 22 nt, Human
ugugggcacuaaugacaugcag

SEQ ID NO: 456008 - RNA, 22 nt, Human
gugagcaggauuucauggugua

SEQ ID NO: 456009 - RNA, 22 nt, Human
accugcagcugagaaaaugacu

SEQ ID NO: 456010 - RNA, 22 nt, Human
agcaggguuuggggauuggcac

SEQ ID NO: 456011 - RNA, 22 nt, Human
uagagcaguuggcagcuguauu

SEQ ID NO: 456012 - RNA, 22 nt, Human
cugugucccuugucccagagcc

SEQ ID NO: 456013 - RNA, 22 nt, Human
ccucacuuuccuuucuccuggg

SEQ ID NO: 456014 - RNA, 22 nt, Human
uuuucauuuuuguagaugcaag

SEQ ID NO: 456015 - RNA, 22 nt, Human
cucucccccacagcagccuucu

SEQ ID NO: 456016 - RNA, 22 nt, Human
gcugagagaaaagugagguucu

SEQ ID NO: 456017 - RNA, 22 nt, Human
gugcccaggcccaaggcaccac

SEQ ID NO: 456018 - RNA, 20 nt, Human
gucucagaauggauuugcau

SEQ ID NO: 456019 - RNA, 22 nt, Human
ggcagcuggccuccucgcccac

SEQ ID NO: 456020 - RNA, 20 nt, Human
uaagaacaagacuaggaagc

SEQ ID NO: 456021 - RNA, 22 nt, Human
uaaugcacaugacugaacuauu

SEQ ID NO: 456022 - RNA, 22 nt, Human
cugagcuuccaguuccuccagg

SEQ ID NO: 456023 - RNA, 22 nt, Human
aaguucaagaucaagguuccag

SEQ ID NO: 456024 - RNA, 22 nt, Human
agucuucucauuucacaugcuu

SEQ ID NO: 456025 - RNA, 22 nt, Human
aaguuaugaaauuuggacagcu

SEQ ID NO: 456026 - RNA, 22 nt, Human
guccucugaaguugugcaaugc

SEQ ID NO: 456027 - RNA, 22 nt, Human
gcaggagcagucaggggcagcu

SEQ ID NO: 456028 - RNA, 20 nt, Human
gcagggcaagggauaugaaa

SEQ ID NO: 456029 - RNA, 22 nt, Human
cuggcaggcagacuucugcaag

SEQ ID NO: 456030 - RNA, 22 nt, Human
uagagugguuaacaguuuagaa

SEQ ID NO: 456031 - RNA, 22 nt, Human
gcugccaccguggagaugagug

SEQ ID NO: 456032 - RNA, 22 nt, Human
auguccuucuccucuuaccugc

SEQ ID NO: 456033 - RNA, 22 nt, Human
ggcagugaaugaaacagaggcu

SEQ ID NO: 456034 - RNA, 22 nt, Human
ucagaaauagucuuuaaaauga

SEQ ID NO: 456035 - RNA, 22 nt, Human
ggaggaggggugacugaaugcu

SEQ ID NO: 456036 - RNA, 22 nt, Human
uucuaacucuguuauguguuuc

SEQ ID NO: 456037 - RNA, 22 nt, Human
gagaggcugaaaucacaggagc

SEQ ID NO: 456038 - RNA, 22 nt, Human
ccagcuccaggacugggagcug

SEQ ID NO: 456039 - RNA, 22 nt, Human
ugcauuauacuuuuagaaauuu

SEQ ID NO: 456040 - RNA, 22 nt, Human
acagaaaugauguuuggcaaua

SEQ ID NO: 456041 - RNA, 22 nt, Human
cccucagcuccacccucagcag

SEQ ID NO: 456042 - RNA, 22 nt, Human
aagacaugcaauuagcaaggaa

SEQ ID NO: 456043 - RNA, 22 nt, Human
cagacuugacggcagcugcuuu

SEQ ID NO: 456044 - RNA, 22 nt, Human
agccuucacugggaccuuggau

SEQ ID NO: 456045 - RNA, 22 nt, Human
ggcagccagagggcagcuggau

SEQ ID NO: 456046 - RNA, 22 nt, Human
gagugugucggucagcguggcg

SEQ ID NO: 456047 - RNA, 21 nt, Human
ugagagccuccaaccggcuac

SEQ ID NO: 456048 - RNA, 21 nt, Human
ggggcagagcuaggcccugca

SEQ ID NO: 456049 - RNA, 22 nt, Human
acacaaacagucuauagcacca

SEQ ID NO: 456050 - RNA, 21 nt, Human
acagccugucaucucaugguc

SEQ ID NO: 456051 - RNA, 22 nt, Human
gcaccaggaggcccuucucauc

SEQ ID NO: 456052 - RNA, 22 nt, Human
cuuucacaguccugacugagcg

SEQ ID NO: 456053 - RNA, 22 nt, Human
ucucagugcagagaggcuaucu

SEQ ID NO: 456054 - RNA, 22 nt, Human
agggccugggauguccuccuag

SEQ ID NO: 456055 - RNA, 22 nt, Human
gggcugaggaacauauuuuguu

SEQ ID NO: 456056 - RNA, 22 nt, Human
gcucugagauugagccuuuggu

SEQ ID NO: 456057 - RNA, 22 nt, Human
uauuugauagagauaaaugaua

SEQ ID NO: 456058 - RNA, 22 nt, Human
augaaggcaguuaaacgucauc

SEQ ID NO: 456059 - RNA, 22 nt, Human
ggaggcugagaaguccaagauc

SEQ ID NO: 456060 - RNA, 18 nt, Human
aaaugcuaggcuacauga

SEQ ID NO: 456061 - RNA, 22 nt, Human
cuaucuuucgauucuagcuuaa

SEQ ID NO: 456062 - RNA, 22 nt, Human
ucuggccugaaaguccaugcuu

SEQ ID NO: 456063 - RNA, 22 nt, Human
caggaggcccaaagggcgcaga

SEQ ID NO: 456064 - RNA, 22 nt, Human
ccaggagcuggagggugcagug

SEQ ID NO: 456065 - RNA, 22 nt, Human
ucaggagauggucuuuauaggc

SEQ ID NO: 456066 - RNA, 18 nt, Human
cuuucagauggauaugcu

SEQ ID NO: 456067 - RNA, 22 nt, Human
aaagccuuggucaucugguucc

SEQ ID NO: 456068 - RNA, 22 nt, Human
agagucugaaugcucagaguug

SEQ ID NO: 456069 - RNA, 22 nt, Human
agugacagcugggaaggugaaa

SEQ ID NO: 456070 - RNA, 22 nt, Human
agucccagccuaggcugugcug

SEQ ID NO: 456071 - RNA, 22 nt, Human
gccuucugauaucucuuggcau

SEQ ID NO: 456072 - RNA, 22 nt, Human
gggccacacagaaccuccuggu

SEQ ID NO: 456073 - RNA, 22 nt, Human
cugccaggccuccgcugucccc

SEQ ID NO: 456074 - RNA, 17 nt, Human
cucuccuuccucugagg

SEQ ID NO: 456075 - RNA, 21 nt, Human
ugccagcauguaggcuaguug

SEQ ID NO: 456076 - RNA, 22 nt, Human
ucaguuuucucauuuaugagau

SEQ ID NO: 456077 - RNA, 22 nt, Human
gccugugcuuaacugacgugag

SEQ ID NO: 456078 - RNA, 22 nt, Human
uuacaucuaaacugugaacaau

SEQ ID NO: 456079 - RNA, 19 nt, Human
agucucaguguacagaggc

SEQ ID NO: 456080 - RNA, 22 nt, Human
aaugauuggcacuagauacaca

SEQ ID NO: 456081 - RNA, 22 nt, Human
augguguagcaugugauaugac

SEQ ID NO: 456082 - RNA, 22 nt, Human
auguguuuguaccuuuaaauau

SEQ ID NO: 456083 - RNA, 22 nt, Human
ccagaggugcugggagaggucu

SEQ ID NO: 456084 - RNA, 21 nt, Human
gccugcagaccccaccaggcu

SEQ ID NO: 456085 - RNA, 22 nt, Human
ucucagagugguggucccucug

SEQ ID NO: 456086 - RNA, 22 nt, Human
cccaggcacagauuaucccaau

SEQ ID NO: 456087 - RNA, 22 nt, Human
ggagcagagcugggcuuggcug

SEQ ID NO: 456088 - RNA, 21 nt, Human
cucuugucuuugcucaguagc

SEQ ID NO: 456089 - RNA, 21 nt, Human
uagggcucucugugucaggug

SEQ ID NO: 456090 - RNA, 22 nt, Human
cgaggcagaggcugaaacggcu

SEQ ID NO: 456091 - RNA, 22 nt, Human
ugcuaucucuauauccauuuau

SEQ ID NO: 456092 - RNA, 22 nt, Human
caggccagguggcaggcaaaac

SEQ ID NO: 456093 - RNA, 22 nt, Human
cugagauggccacugggucuca

SEQ ID NO: 456094 - RNA, 22 nt, Human
aguauuuccuggcuuaucugcu

SEQ ID NO: 456095 - RNA, 22 nt, Human
guucaagguuuuacagagugua

SEQ ID NO: 456096 - RNA, 21 nt, Human
auacuuugaauuacagccuug

SEQ ID NO: 456097 - RNA, 21 nt, Human
gcucucugcaugguggcucag

SEQ ID NO: 456098 - RNA, 22 nt, Human
uguuaaauguuccuuuacugga

SEQ ID NO: 456099 - RNA, 22 nt, Human
guagggacccacagucuauauu

SEQ ID NO: 456100 - RNA, 22 nt, Human
agcauccaacaggagggaaggg

SEQ ID NO: 456101 - RNA, 20 nt, Human
ucagagucaucaaagauggu

SEQ ID NO: 456102 - RNA, 22 nt, Human
aaaggcaggcuuucacaucuca

SEQ ID NO: 456103 - RNA, 22 nt, Human
ucccaggcaaaggcagcucauu

SEQ ID NO: 456104 - RNA, 22 nt, Human
cuguauuucccacauucucuau

SEQ ID NO: 456105 - RNA, 19 nt, Human
uaaaaacugaaggaagcag

SEQ ID NO: 456106 - RNA, 23 nt, Human
guggagccacaucacaggcuccu

SEQ ID NO: 456107 - RNA, 20 nt, Human
uaugaagauaugugaacagc

SEQ ID NO: 456108 - RNA, 22 nt, Human
cccuccagagcuugaccugcug

SEQ ID NO: 456109 - RNA, 22 nt, Human
gggacuggaacuacuggugcag

SEQ ID NO: 456110 - RNA, 22 nt, Human
ucagaagcugguguccuuugaa

SEQ ID NO: 456111 - RNA, 22 nt, Human
uguuugugcugccuggugggca

SEQ ID NO: 456112 - RNA, 22 nt, Human
caaaggcugccacuguggcugu

SEQ ID NO: 456113 - RNA, 22 nt, Human
cccagcaucuccaggcauggcc

SEQ ID NO: 456114 - RNA, 22 nt, Human
uaacagaaauagaaaugagagu

SEQ ID NO: 456115 - RNA, 22 nt, Human
gggcugagauuggugcccuguc

SEQ ID NO: 456116 - RNA, 18 nt, Human
gccugcaggcacgggggu

SEQ ID NO: 456117 - RNA, 22 nt, Human
uucuaugccauguucagcuacu

SEQ ID NO: 456118 - RNA, 22 nt, Human
guaacagaaagucaugcucauu

SEQ ID NO: 456119 - RNA, 22 nt, Human
uucuuccucagcagggcugccu

SEQ ID NO: 456120 - RNA, 22 nt, Human
uuuuccuauaugcaaagaaugc

SEQ ID NO: 456121 - RNA, 19 nt, Human
ccugugugggguagagauc

SEQ ID NO: 456122 - RNA, 22 nt, Human
ugcaguggaagagguggagauc

SEQ ID NO: 456123 - RNA, 22 nt, Human
gagugggcaccgugggcacacu

SEQ ID NO: 456124 - RNA, 22 nt, Human
acagccagggcauugucgccga

SEQ ID NO: 456125 - RNA, 22 nt, Human
ucauaauacaaagaguucugca

SEQ ID NO: 456126 - RNA, 22 nt, Human
ugccucuguugagccuuggcug

SEQ ID NO: 456127 - RNA, 22 nt, Human
agcagccacacgccuccuucuc

SEQ ID NO: 456128 - RNA, 22 nt, Human
cugggcacaaguggcccuggau

SEQ ID NO: 456129 - RNA, 22 nt, Human
caaaguccauaguuuacaauag

SEQ ID NO: 456130 - RNA, 22 nt, Human
agcuuccuacaaccaucucaga

SEQ ID NO: 456131 - RNA, 22 nt, Human
gcugucuuccuugcuccaaggg

SEQ ID NO: 456132 - RNA, 22 nt, Human
aggcagccuauggggagcucag

SEQ ID NO: 456133 - RNA, 22 nt, Human
ccagcagcuguggcuuugccuc

SEQ ID NO: 456134 - RNA, 22 nt, Human
ugcaggcuuuagccccauggcu

SEQ ID NO: 456135 - RNA, 22 nt, Human
agaggcuguuacacucccagau

SEQ ID NO: 456136 - RNA, 23 nt, Human
gggggcugguugacucucugcag

SEQ ID NO: 456137 - RNA, 22 nt, Human
ugcugccacaaauucagcugcc

SEQ ID NO: 456138 - RNA, 22 nt, Human
ccaggagucaauaaaggaagcu

SEQ ID NO: 456139 - RNA, 22 nt, Human
gcaggggaguccacucuaugca

SEQ ID NO: 456140 - RNA, 22 nt, Human
aaaacuguaucuucuugggacu

SEQ ID NO: 456141 - RNA, 22 nt, Human
auuaaauuggaucugcauaguu

SEQ ID NO: 456142 - RNA, 22 nt, Human
aauauguucaaaauagaucacu

SEQ ID NO: 456143 - RNA, 22 nt, Human
uggcagcugucuguggggucuc

SEQ ID NO: 456144 - RNA, 22 nt, Human
uggcagaggaaaaagucacugg

SEQ ID NO: 456145 - RNA, 22 nt, Human
gggcaggucugggucagccuga

SEQ ID NO: 456146 - RNA, 22 nt, Human
ccaguggguaggccauggugag

SEQ ID NO: 456147 - RNA, 22 nt, Human
cgaggcagggaagcugcaaaag

SEQ ID NO: 456148 - RNA, 22 nt, Human
augaggcaaucaugguccaguu

SEQ ID NO: 456149 - RNA, 19 nt, Human
cugugcaggccgggcugag

SEQ ID NO: 456150 - RNA, 22 nt, Human
aagcaaagaguuuaguggguga

SEQ ID NO: 456151 - RNA, 22 nt, Human
agcagugaugcaugacagccua

SEQ ID NO: 456152 - RNA, 22 nt, Human
guggcagcaaaauccugcauuc

SEQ ID NO: 456153 - RNA, 22 nt, Human
ccaggccugcaucugcugcgca

SEQ ID NO: 456154 - RNA, 22 nt, Human
uugaagcaugguacuuguucaa

SEQ ID NO: 456155 - RNA, 21 nt, Human
uuugaaagcccuauguuuuca

SEQ ID NO: 456156 - RNA, 22 nt, Human
aacagacaacuccuguggcuca

SEQ ID NO: 456157 - RNA, 22 nt, Human
ucagcaaugugauacugugcaa

SEQ ID NO: 456158 - RNA, 22 nt, Human
ugacaaaacugcaauuacuuuu

SEQ ID NO: 456159 - RNA, 22 nt, Human
ugaggcaguugagcuuccugag

SEQ ID NO: 456160 - RNA, 22 nt, Human
cuggagccggcgagccccagcc

SEQ ID NO: 456161 - RNA, 21 nt, Human
uccugcagaaugccuuccuac

SEQ ID NO: 456162 - RNA, 22 nt, Human
ccagcgcuucccaucagggagg

SEQ ID NO: 456163 - RNA, 22 nt, Human
gcccauggacacccaagugcca

SEQ ID NO: 456164 - RNA, 20 nt, Human
agggucaguagcacagagcu

SEQ ID NO: 456165 - RNA, 23 nt, Human
uuacuuuugcaccaaccuaauau

SEQ ID NO: 456166 - RNA, 22 nt, Human
acuuaguauuuuucagcuuuga

SEQ ID NO: 456167 - RNA, 22 nt, Human
ugugucccuuggaaccucagcu

SEQ ID NO: 456168 - RNA, 22 nt, Human
gagcaugguuccauagguuggu

SEQ ID NO: 456169 - RNA, 22 nt, Human
ccacccagccagaugcaggaag

SEQ ID NO: 456170 - RNA, 22 nt, Human
uggccaggcagguagaacggcc

SEQ ID NO: 456171 - RNA, 22 nt, Human
gcucugugccacaugcaguguu

SEQ ID NO: 456172 - RNA, 22 nt, Human
uguuucagucccuguguucaau

SEQ ID NO: 456173 - RNA, 22 nt, Human
uccagggcugacuugggagagg

SEQ ID NO: 456174 - RNA, 22 nt, Human
uucaagaugccagggacgcggc

SEQ ID NO: 456175 - RNA, 22 nt, Human
agccuccuggaguuucugggau

SEQ ID NO: 456176 - RNA, 22 nt, Human
gggcugaccaaugccuugcuuu

SEQ ID NO: 456177 - RNA, 22 nt, Human
cggggcaggagucccuguagag

SEQ ID NO: 456178 - RNA, 22 nt, Human
gggccacauugaagggugggua

SEQ ID NO: 456179 - RNA, 22 nt, Human
agaauuguaagcaauuugauua

SEQ ID NO: 456180 - RNA, 22 nt, Human
aguguuucucagaagggccuau

SEQ ID NO: 456181 - RNA, 22 nt, Human
aggcagcagucaugaggaaaga

SEQ ID NO: 456182 - RNA, 22 nt, Human
aucuuucagagcuccaucaggg

SEQ ID NO: 456183 - RNA, 22 nt, Human
ucccagaguauuagcaauugcu

SEQ ID NO: 456184 - RNA, 22 nt, Human
ccccuuccuuccucagacagcc

SEQ ID NO: 456185 - RNA, 22 nt, Human
uccaggcuagaagucacaggcc

SEQ ID NO: 456186 - RNA, 22 nt, Human
gcaguggauccaaugguaucuu

SEQ ID NO: 456187 - RNA, 22 nt, Human
ccccuuccacagugcuuccuaa

SEQ ID NO: 456188 - RNA, 22 nt, Human
aggcugggaagguaaaguugua

SEQ ID NO: 456189 - RNA, 22 nt, Human
ucugcugcugagcacacuccua

SEQ ID NO: 456190 - RNA, 22 nt, Human
guuuuguugcugcagagcucaa

SEQ ID NO: 456191 - RNA, 22 nt, Human
cuggccugaucucaugcugucc

SEQ ID NO: 456192 - RNA, 22 nt, Human
aaaauguaaagcuugaguguag

SEQ ID NO: 456193 - RNA, 22 nt, Human
ggaggaugccaagcugugcaca

SEQ ID NO: 456194 - RNA, 22 nt, Human
gcuuccuucuaccacaucaugc

SEQ ID NO: 456195 - RNA, 22 nt, Human
aacuuuaaggcuauaaauuaug

SEQ ID NO: 456196 - RNA, 22 nt, Human
agggcuggagccacagcuggga

SEQ ID NO: 456197 - RNA, 22 nt, Human
ccuggcucucugcagauccugg

SEQ ID NO: 456198 - RNA, 22 nt, Human
gugggugauguacuggaggcca

SEQ ID NO: 456199 - RNA, 22 nt, Human
auguaauuugcccucaaguuaa

SEQ ID NO: 456200 - RNA, 22 nt, Human
acacuguaaauugagugcguga

SEQ ID NO: 456201 - RNA, 22 nt, Human
gccagacacuccccugggcagg

SEQ ID NO: 456202 - RNA, 22 nt, Human
agcugcaggccucuccugggga

SEQ ID NO: 456203 - RNA, 22 nt, Human
uucuaguugagggagacaaaua

SEQ ID NO: 456204 - RNA, 22 nt, Human
gccaaagcagucuugccucugc

SEQ ID NO: 456205 - RNA, 22 nt, Human
caggcagcagaggaguguggga

SEQ ID NO: 456206 - RNA, 22 nt, Human
ugcagggcaguggagguugagu

SEQ ID NO: 456207 - RNA, 22 nt, Human
agagcugaauuuggguggugga

SEQ ID NO: 456208 - RNA, 22 nt, Human
gacagggcaagacucugucuaa

SEQ ID NO: 456209 - RNA, 22 nt, Human
aggcaggugggucacuugaguc

SEQ ID NO: 456210 - RNA, 22 nt, Human
cccugcagagccagcccugacc

SEQ ID NO: 456211 - RNA, 22 nt, Human
uuggcuuccaggaucucagcag

SEQ ID NO: 456212 - RNA, 22 nt, Human
agccacagagguugaugugguu

SEQ ID NO: 456213 - RNA, 22 nt, Human
auagacuugguuaguaaauuug

SEQ ID NO: 456214 - RNA, 22 nt, Human
ucagguggcuucggggaguggc

SEQ ID NO: 456215 - RNA, 22 nt, Human
aaacaguauuaucaauauauuu

SEQ ID NO: 456216 - RNA, 22 nt, Human
uucaauucugcucugaucuuag

SEQ ID NO: 456217 - RNA, 19 nt, Human
gguaaaagugagcuucagg

SEQ ID NO: 456218 - RNA, 22 nt, Human
cuguggaccugcucuuagagac

SEQ ID NO: 456219 - RNA, 22 nt, Human
gaggccuggguuggaggugcau

SEQ ID NO: 456220 - RNA, 18 nt, Human
cauuguacaaugcuuuau

SEQ ID NO: 456221 - RNA, 22 nt, Human
gucaggauuugaacucaggucu

SEQ ID NO: 456222 - RNA, 22 nt, Human
gguuucaacuuuugugaggaau

SEQ ID NO: 456223 - RNA, 22 nt, Human
acagcuuuuaugggaccagcca

SEQ ID NO: 456224 - RNA, 22 nt, Human
aagaagaugguuaacuuucagu

SEQ ID NO: 456225 - RNA, 22 nt, Human
ucagaagguggagguugcagug

SEQ ID NO: 456226 - RNA, 22 nt, Human
agaaacauuuagauuauauguc

SEQ ID NO: 456227 - RNA, 22 nt, Human
aaauucuuucauggcuaauaag

SEQ ID NO: 456228 - RNA, 22 nt, Human
gcuggggucugugaggagggcu

SEQ ID NO: 456229 - RNA, 22 nt, Human
ggcuggccucaggguccucgcu

SEQ ID NO: 456230 - RNA, 22 nt, Human
gcaguggauggccagcaggggc

SEQ ID NO: 456231 - RNA, 21 nt, Human
ggcagcccgcccucuccuggc

SEQ ID NO: 456232 - RNA, 18 nt, Human
agaaggagcuaugggcag

SEQ ID NO: 456233 - RNA, 22 nt, Human
cagucucuaaaucaaucugaau

SEQ ID NO: 456234 - RNA, 22 nt, Human
cagaacugggcagggagcagag

SEQ ID NO: 456235 - RNA, 22 nt, Human
cacagugcaugaugggcagaag

SEQ ID NO: 456236 - RNA, 22 nt, Human
gggcaguugauggaggucugga

SEQ ID NO: 456237 - RNA, 22 nt, Human
gcaaaucaccaccuagcuggau

SEQ ID NO: 456238 - RNA, 21 nt, Human
ucucugguuggaguugugcca

SEQ ID NO: 456239 - RNA, 23 nt, Human
uggcagcuguguaagagaaagca

SEQ ID NO: 456240 - RNA, 22 nt, Human
ccugagguggcugcagcacugc

SEQ ID NO: 456241 - RNA, 20 nt, Human
cguaaggcaagugcugcauc

SEQ ID NO: 456242 - RNA, 22 nt, Human
caagccucagaaucuucuccau

SEQ ID NO: 456243 - RNA, 22 nt, Human
agggacacaugugauuauuuau

SEQ ID NO: 456244 - RNA, 22 nt, Human
gcagugcuaaguagcuggccca

SEQ ID NO: 456245 - RNA, 22 nt, Human
cccagagcugagucugauauau

SEQ ID NO: 456246 - RNA, 22 nt, Human
ugggaggcagguaggugaugau

SEQ ID NO: 456247 - RNA, 22 nt, Human
uaaugaauaaacuugagaguca

SEQ ID NO: 456248 - RNA, 20 nt, Human
ccuccuggucaggugugcag

SEQ ID NO: 456249 - RNA, 22 nt, Human
cugagcugggaguagagacucu

SEQ ID NO: 456250 - RNA, 22 nt, Human
gagcagugacuggagcaugaga

SEQ ID NO: 456251 - RNA, 22 nt, Human
ggccuggaagaggacagagaaa

SEQ ID NO: 456252 - RNA, 22 nt, Human
cugugucccccucagccaggug

SEQ ID NO: 456253 - RNA, 22 nt, Human
ucucaggaucuaauacauggua

SEQ ID NO: 456254 - RNA, 22 nt, Human
aaaugcuguguuuuaacauaga

SEQ ID NO: 456255 - RNA, 22 nt, Human
uggaguuccuuugaaaggcucu

SEQ ID NO: 456256 - RNA, 22 nt, Human
agggcccuaaggaaggcacaca

SEQ ID NO: 456257 - RNA, 22 nt, Human
ggauggagguucucagaugcuc

SEQ ID NO: 456258 - RNA, 20 nt, Human
uggcuccugcgguggaacca

SEQ ID NO: 456259 - RNA, 21 nt, Human
uccauuguuuucccaggguuu

SEQ ID NO: 456260 - RNA, 22 nt, Human
gcagagcucaagguguucagcu

SEQ ID NO: 456261 - RNA, 22 nt, Human
ccaggcugggcggggaaccugg

SEQ ID NO: 456262 - RNA, 21 nt, Human
uccagggaacuucucaggaau

SEQ ID NO: 456263 - RNA, 22 nt, Human
gggccuggugcuucugacuccu

SEQ ID NO: 456264 - RNA, 22 nt, Human
gcugcuuccuuuccugcugacc

SEQ ID NO: 456265 - RNA, 18 nt, Human
aagccagagaccacugcc

SEQ ID NO: 456266 - RNA, 22 nt, Human
gccugccugaaggcuguaccag

SEQ ID NO: 456267 - RNA, 22 nt, Human
uuucuuauacuauauugucauc

SEQ ID NO: 456268 - RNA, 22 nt, Human
ccugccagcauggcuuaucucc

SEQ ID NO: 456269 - RNA, 22 nt, Human
ucugaaaauguugacuuuguuu

SEQ ID NO: 456270 - RNA, 22 nt, Human
auuucucagcacuuccuaucuc

SEQ ID NO: 456271 - RNA, 22 nt, Human
uguuucaggaccuaucuuuuag

SEQ ID NO: 456272 - RNA, 22 nt, Human
uagcugccauugcuccaggaag

SEQ ID NO: 456273 - RNA, 22 nt, Human
gggagaaguggaaaucucauua

SEQ ID NO: 456274 - RNA, 22 nt, Human
augaaauaucuugaagaaauuc

SEQ ID NO: 456275 - RNA, 22 nt, Human
uacaggcaugaaugaaaucugu

SEQ ID NO: 456276 - RNA, 18 nt, Human
gccagagggaagcaggug

SEQ ID NO: 456277 - RNA, 18 nt, Human
gagacacaagggccugga

SEQ ID NO: 456278 - RNA, 22 nt, Human
gaaucauuuagcucugcaugga

SEQ ID NO: 456279 - RNA, 19 nt, Human
ggcagaagguguaggggga

SEQ ID NO: 456280 - RNA, 22 nt, Human
auggcagagggauugaacagcu

SEQ ID NO: 456281 - RNA, 22 nt, Human
accagagcuggcagaguaucaa

SEQ ID NO: 456282 - RNA, 22 nt, Human
gagcuggcaggaggcuccccga

SEQ ID NO: 456283 - RNA, 22 nt, Human
cauuuguuggucagauuguagu

SEQ ID NO: 456284 - RNA, 22 nt, Human
cacaggggcaaacuguagggga

SEQ ID NO: 456285 - RNA, 22 nt, Human
gcucccagucugauggaggaga

SEQ ID NO: 456286 - RNA, 22 nt, Human
cccacucccugcacgccugccg

SEQ ID NO: 456287 - RNA, 22 nt, Human
uccugcaggggcugaggaacca

SEQ ID NO: 456288 - RNA, 22 nt, Human
ccuggcagcgugccgagcugcg

SEQ ID NO: 456289 - RNA, 22 nt, Human
aacuguacgauaauaaauuugu

SEQ ID NO: 456290 - RNA, 22 nt, Human
caccaggcugcccaggacaggg

SEQ ID NO: 456291 - RNA, 22 nt, Human
guacccaggcacgccuugcuga

SEQ ID NO: 456292 - RNA, 20 nt, Human
acagaauaugcugguugugg

SEQ ID NO: 456293 - RNA, 22 nt, Human
cagcacuggggggauucggagc

SEQ ID NO: 456294 - RNA, 22 nt, Human
acgcagaagggccuggcgugcc

SEQ ID NO: 456295 - RNA, 22 nt, Human
ugaugcuucacgcugaauaugc

SEQ ID NO: 456296 - RNA, 22 nt, Human
uuggauccaucucaggcauagg

SEQ ID NO: 456297 - RNA, 22 nt, Human
cagccucucuguaucucaggau

SEQ ID NO: 456298 - RNA, 22 nt, Human
ccagcuuuuccucucauugcuu

SEQ ID NO: 456299 - RNA, 22 nt, Human
agaguccagaaaacagugugcu

SEQ ID NO: 456300 - RNA, 22 nt, Human
augcagagacagauguggcaug

SEQ ID NO: 456301 - RNA, 22 nt, Human
agagccagcaagugaauaguga

SEQ ID NO: 456302 - RNA, 22 nt, Human
aacccgggaggcagagguugug

SEQ ID NO: 456303 - RNA, 22 nt, Human
uuacaugguuguuggaaaugcu

SEQ ID NO: 456304 - RNA, 22 nt, Human
cagggcuccaugcagggacucc

SEQ ID NO: 456305 - RNA, 22 nt, Human
uggcugagugaacauguccauu

SEQ ID NO: 456306 - RNA, 22 nt, Human
uggagggcaugcuguccauggg

SEQ ID NO: 456307 - RNA, 22 nt, Human
aauucugugcaggcagagcuau

SEQ ID NO: 456308 - RNA, 22 nt, Human
ucaggggaaaucucucagcgaa

SEQ ID NO: 456309 - RNA, 22 nt, Human
auccuucagcugcccuguuacc

SEQ ID NO: 456310 - RNA, 22 nt, Human
gacagcaggagaucaugauaga

SEQ ID NO: 456311 - RNA, 22 nt, Human
augaaggcuguguggagccccc

SEQ ID NO: 456312 - RNA, 22 nt, Human
caccugggcuaaacuaugcagg

SEQ ID NO: 456313 - RNA, 22 nt, Human
gcaccugggguacacagcuaca

SEQ ID NO: 456314 - RNA, 22 nt, Human
ccaucccuccuccaccagcuag

SEQ ID NO: 456315 - RNA, 22 nt, Human
auguacaguggaaacuaacaaa

SEQ ID NO: 456316 - RNA, 22 nt, Human
uguccuuuaugaaaugguguuu

SEQ ID NO: 456317 - RNA, 22 nt, Human
gcagggaagacccggagcagcg

SEQ ID NO: 456318 - RNA, 22 nt, Human
aaggcugccucugccagaggag

SEQ ID NO: 456319 - RNA, 22 nt, Human
cucagccccaauucuccccauu

SEQ ID NO: 456320 - RNA, 22 nt, Human
ucugguuagccaauaaugccaa

SEQ ID NO: 456321 - RNA, 22 nt, Human
aucuggcuuuuacugaauugcu

SEQ ID NO: 456322 - RNA, 22 nt, Human
uauugaaauccauuacguucuu

SEQ ID NO: 456323 - RNA, 22 nt, Human
uaugcacacauuagcacagggu

SEQ ID NO: 456324 - RNA, 22 nt, Human
cauguuaauaugcauugaguac

SEQ ID NO: 456325 - RNA, 18 nt, Human
cuccagggaacucaguca

SEQ ID NO: 456326 - RNA, 22 nt, Human
agcugccaggccccugagaacc

SEQ ID NO: 456327 - RNA, 22 nt, Human
ucuuuccuacuuuauugugaac

SEQ ID NO: 456328 - RNA, 22 nt, Human
ccagcuuuuggggugacaauuu

SEQ ID NO: 456329 - RNA, 22 nt, Human
ccaggcagcaaauuuucugaau

SEQ ID NO: 456330 - RNA, 17 nt, Human
ucaggauccaggguucu

SEQ ID NO: 456331 - RNA, 19 nt, Human
acuuugcaugugugucuaa

SEQ ID NO: 456332 - RNA, 19 nt, Human
agugcagggagcacccuca

SEQ ID NO: 456333 - RNA, 22 nt, Human
cuuuggcaaugaaacacaagaa

SEQ ID NO: 456334 - RNA, 22 nt, Human
aggcagguguuaccucugguuu

SEQ ID NO: 456335 - RNA, 22 nt, Human
gcugugagcugccugugucaca

SEQ ID NO: 456336 - RNA, 22 nt, Human
aucaguuuguauaugaaacacu

SEQ ID NO: 456337 - RNA, 22 nt, Human
cauuuguuaaccaguguggauu

SEQ ID NO: 456338 - RNA, 20 nt, Human
gucagugucuucaguaguga

SEQ ID NO: 456339 - RNA, 22 nt, Human
gcagaggccaggccaccagcaa

SEQ ID NO: 456340 - RNA, 22 nt, Human
aauugugcuaugauuaugaaag

SEQ ID NO: 456341 - RNA, 22 nt, Human
uccagagguauguagagaguau

SEQ ID NO: 456342 - RNA, 22 nt, Human
aggccugcagcaggagcaaacc

SEQ ID NO: 456343 - RNA, 22 nt, Human
uacagaguggugagaucuuuug

SEQ ID NO: 456344 - RNA, 21 nt, Human
uacaagaccggauucgggccc

SEQ ID NO: 456345 - RNA, 20 nt, Human
gcugccuuguccugcuuggu

SEQ ID NO: 456346 - RNA, 22 nt, Human
ugcagucuggauguccucagau

SEQ ID NO: 456347 - RNA, 22 nt, Human
acuccuggggauccauuccuuu

SEQ ID NO: 456348 - RNA, 22 nt, Human
ugcauuguuugauaggugaauu

SEQ ID NO: 456349 - RNA, 17 nt, Human
guuugcaugguguuaac

SEQ ID NO: 456350 - RNA, 22 nt, Human
gugucccagcagcacauuggcu

SEQ ID NO: 456351 - RNA, 22 nt, Human
ugaggcagggagaguggauaug

SEQ ID NO: 456352 - RNA, 22 nt, Human
gggaggaaggcuugggugagua

SEQ ID NO: 456353 - RNA, 22 nt, Human
uuguuacacauaauaacauuuu

SEQ ID NO: 456354 - RNA, 22 nt, Human
agaaaucugacugcugugcaca

SEQ ID NO: 456355 - RNA, 22 nt, Human
uguggcaguauaagagcuagaa

SEQ ID NO: 456356 - RNA, 22 nt, Human
caugcuuuaccaaagcagugau

SEQ ID NO: 456357 - RNA, 22 nt, Human
ugggacagugugccuugcuccu

SEQ ID NO: 456358 - RNA, 22 nt, Human
ccuggaggagcgcugaccagcu

SEQ ID NO: 456359 - RNA, 22 nt, Human
gaggugggagggcagucccuaa

SEQ ID NO: 456360 - RNA, 22 nt, Human
aagaauucacugguagagucaa

SEQ ID NO: 456361 - RNA, 22 nt, Human
caucacuguccucagcauucca

SEQ ID NO: 456362 - RNA, 22 nt, Human
ggagcagggaauuacagcgcag

SEQ ID NO: 456363 - RNA, 22 nt, Human
cacacaugaaucccuaguaccu

SEQ ID NO: 456364 - RNA, 20 nt, Human
guucucacugaucugcaggg

SEQ ID NO: 456365 - RNA, 22 nt, Human
agggaaagguagugaggucaca

SEQ ID NO: 456366 - RNA, 22 nt, Human
ucuuccaguguagacaucugcc

SEQ ID NO: 456367 - RNA, 22 nt, Human
cagaggaaggcucugggaaugu

SEQ ID NO: 456368 - RNA, 22 nt, Human
agggcuacugccugccuucagg

SEQ ID NO: 456369 - RNA, 22 nt, Human
ccugggagguggagguugcagu

SEQ ID NO: 456370 - RNA, 22 nt, Human
agaagccaauucugugugaguc

SEQ ID NO: 456371 - RNA, 22 nt, Human
uuucugaagggcagcagacucu

SEQ ID NO: 456372 - RNA, 22 nt, Human
uugcaggggaaggagcagagcu

SEQ ID NO: 456373 - RNA, 22 nt, Human
uccaggcacuauauauacuuuu

SEQ ID NO: 456374 - RNA, 22 nt, Human
uuuaaauucugucugccgcuua

SEQ ID NO: 456375 - RNA, 23 nt, Human
aguguuccaguugguugagagug

SEQ ID NO: 456376 - RNA, 22 nt, Human
cacagcuucccaaaguggaccu

SEQ ID NO: 456377 - RNA, 22 nt, Human
agagccacggcaggccuaggaa

SEQ ID NO: 456378 - RNA, 22 nt, Human
gaagccucaacaucucugcguc

SEQ ID NO: 456379 - RNA, 22 nt, Human
aagcugccagauucagucugcu

SEQ ID NO: 456380 - RNA, 22 nt, Human
ccuuuuucccuggagggacagc

SEQ ID NO: 456381 - RNA, 20 nt, Human
caaugcacacagcugcuucu

SEQ ID NO: 456382 - RNA, 22 nt, Human
ccaaggaguagagcaggaagcu

SEQ ID NO: 456383 - RNA, 22 nt, Human
ugcuuucaaaggcuuucuagau

SEQ ID NO: 456384 - RNA, 22 nt, Human
ucauuucuaucuaugcagcuuc

SEQ ID NO: 456385 - RNA, 22 nt, Human
agggcuccuccccggccuccac

SEQ ID NO: 456386 - RNA, 22 nt, Human
agugcacagcgugauguauugg

SEQ ID NO: 456387 - RNA, 22 nt, Human
auaaacaguaaaugugagcagu

SEQ ID NO: 456388 - RNA, 22 nt, Human
acaacaggguaaggcaggccau

SEQ ID NO: 456389 - RNA, 22 nt, Human
guauuuuauggccuggggccua

SEQ ID NO: 456390 - RNA, 22 nt, Human
auacuaagcucauuacauuuug

SEQ ID NO: 456391 - RNA, 22 nt, Human
auaacagagagcuacugaacug

SEQ ID NO: 456392 - RNA, 23 nt, Human
cagagcuggcucagagcugccug

SEQ ID NO: 456393 - RNA, 22 nt, Human
cugcuucugggaugauggagua

SEQ ID NO: 456394 - RNA, 22 nt, Human
ugaggcucugcuucuguggcuc

SEQ ID NO: 456395 - RNA, 22 nt, Human
gcugucuccauagcuguguguc

SEQ ID NO: 456396 - RNA, 22 nt, Human
agcccaagcuaugaggugaccu

SEQ ID NO: 456397 - RNA, 22 nt, Human
aggaaaaauaaggcagcagggc

SEQ ID NO: 456398 - RNA, 18 nt, Human
uugagggaggggcagagu

SEQ ID NO: 456399 - RNA, 22 nt, Human
auuagggaaggauuuggccuga

SEQ ID NO: 456400 - RNA, 22 nt, Human
acagaguaucuaucaggaguau

SEQ ID NO: 456401 - RNA, 22 nt, Human
auucaguuucauggcacagcua

SEQ ID NO: 456402 - RNA, 22 nt, Human
caggagcuacucagguuggguu

SEQ ID NO: 456403 - RNA, 22 nt, Human
cuccaggggccagaagccuggc

SEQ ID NO: 456404 - RNA, 22 nt, Human
cuggagccgcauggagcaggga

SEQ ID NO: 456405 - RNA, 19 nt, Human
gcccugcaggagguggggc

SEQ ID NO: 456406 - RNA, 22 nt, Human
gugggacucuucuuuggcagug

SEQ ID NO: 456407 - RNA, 23 nt, Human
ccucagcauggcaggagcccagc

SEQ ID NO: 456408 - RNA, 22 nt, Human
cccuggagcuagucugagcaga

SEQ ID NO: 456409 - RNA, 22 nt, Human
uaauuuaauccaaguguuacau

SEQ ID NO: 456410 - RNA, 22 nt, Human
gagcuggcuccgccaugcugcu

SEQ ID NO: 456411 - RNA, 22 nt, Human
ucaggaaagaguguauccauca

SEQ ID NO: 456412 - RNA, 22 nt, Human
aacuguaaagguugagugguaa

SEQ ID NO: 456413 - RNA, 22 nt, Human
caugggcucuucuggacugcac

SEQ ID NO: 456414 - RNA, 22 nt, Human
ucaguggauauuucuguggcug

SEQ ID NO: 456415 - RNA, 22 nt, Human
ugcguugcgcuccugcagcagg

SEQ ID NO: 456416 - RNA, 22 nt, Human
gcagacaauuuauuagcagauu

SEQ ID NO: 456417 - RNA, 22 nt, Human
uaaaucccuacaucuguguuuu

SEQ ID NO: 456418 - RNA, 22 nt, Human
ggugcagaggagccagcugggg

SEQ ID NO: 456419 - RNA, 22 nt, Human
ggcucuggugaggguaggagau

SEQ ID NO: 456420 - RNA, 19 nt, Human
ugagugggccccugcagac

SEQ ID NO: 456421 - RNA, 22 nt, Human
gcagcuguguaaugagcccaca

SEQ ID NO: 456422 - RNA, 22 nt, Human
uuuccacuguagagauguugaa

SEQ ID NO: 456423 - RNA, 22 nt, Human
cuggagagauccuccugaaaaa

SEQ ID NO: 456424 - RNA, 21 nt, Human
ucugucucuccacugcccugc

SEQ ID NO: 456425 - RNA, 22 nt, Human
gucccugcaucaccacgggacu

SEQ ID NO: 456426 - RNA, 22 nt, Human
agagccaggcggcugggcaccu

SEQ ID NO: 456427 - RNA, 22 nt, Human
cauuuucaugaguuucuguuca

SEQ ID NO: 456428 - RNA, 22 nt, Human
cugggagucaccaggagcaagg

SEQ ID NO: 456429 - RNA, 22 nt, Human
ugaggugaagaguggagcucag

SEQ ID NO: 456430 - RNA, 22 nt, Human
caagggaccugagauggucucu

SEQ ID NO: 456431 - RNA, 22 nt, Human
gggagggaaagcuugaucuguc

SEQ ID NO: 456432 - RNA, 22 nt, Human
agggcugacagugaggagucaa

SEQ ID NO: 456433 - RNA, 22 nt, Human
cagggcucuuccggagcaggga

SEQ ID NO: 456434 - RNA, 22 nt, Human
aaaguucaugguguuauagaaa

SEQ ID NO: 456435 - RNA, 22 nt, Human
ccuuuccuuuuuagugugggag

SEQ ID NO: 456436 - RNA, 22 nt, Human
uagcagcugugaguaaaagcca

SEQ ID NO: 456437 - RNA, 22 nt, Human
cuuauguauaauguuccacaua

SEQ ID NO: 456438 - RNA, 22 nt, Human
uggagccaugccuggccuuucc

SEQ ID NO: 456439 - RNA, 22 nt, Human
cuggcuucugggccagggcaga

SEQ ID NO: 456440 - RNA, 22 nt, Human
aagagggaggugcgggugcaga

SEQ ID NO: 456441 - RNA, 22 nt, Human
gaagagcuccaaaaacagugag

SEQ ID NO: 456442 - RNA, 22 nt, Human
agagaugaaaaguggagacugg

SEQ ID NO: 456443 - RNA, 23 nt, Human
ggcagagagcauggcuggggccc

SEQ ID NO: 456444 - RNA, 22 nt, Human
gcuggcagagacaagaagacua

SEQ ID NO: 456445 - RNA, 22 nt, Human
ugaagccagucaauguuaaguu

SEQ ID NO: 456446 - RNA, 22 nt, Human
uuuucuuacugucugugauccu

SEQ ID NO: 456447 - RNA, 22 nt, Human
ccugggugucaugggcagcugg

SEQ ID NO: 456448 - RNA, 22 nt, Human
cagcagagguuggaacaguucu

SEQ ID NO: 456449 - RNA, 22 nt, Human
cagagcauuuggaagccacgug

SEQ ID NO: 456450 - RNA, 22 nt, Human
ucuguggauuuuaguguucaug

SEQ ID NO: 456451 - RNA, 22 nt, Human
ugcuuuauaacuuaguuuaugg

SEQ ID NO: 456452 - RNA, 22 nt, Human
cagucuucuaaccuagcagccu

SEQ ID NO: 456453 - RNA, 22 nt, Human
cuuagggaaucuuagagcugga

SEQ ID NO: 456454 - RNA, 22 nt, Human
gauccuugcaacucugugaggu

SEQ ID NO: 456455 - RNA, 22 nt, Human
ccacuugugaaauaaucaaaua

SEQ ID NO: 456456 - RNA, 22 nt, Human
caggaaaaaugccaggagucag

SEQ ID NO: 456457 - RNA, 22 nt, Human
gcuggccuucugcagaguucug

SEQ ID NO: 456458 - RNA, 22 nt, Human
agaggaugauuuuaaggacacu

SEQ ID NO: 456459 - RNA, 22 nt, Human
cauuugcauaugaagaaguaag

SEQ ID NO: 456460 - RNA, 22 nt, Human
cauuuagaaacuguuuuuaaca

SEQ ID NO: 456461 - RNA, 22 nt, Human
uuauuuaaaagugguaagauuc

SEQ ID NO: 456462 - RNA, 22 nt, Human
uucagagauggaaggcagaaug

SEQ ID NO: 456463 - RNA, 22 nt, Human
ggucugagcuugagcccaugcu

SEQ ID NO: 456464 - RNA, 22 nt, Human
cagcuuggcuuccgcuuuacug

SEQ ID NO: 456465 - RNA, 22 nt, Human
acuguaaauuuugguugcaggu

SEQ ID NO: 456466 - RNA, 22 nt, Human
cucagggucugguccuuagauu

SEQ ID NO: 456467 - RNA, 22 nt, Human
aggugucuggauggguguccuu

SEQ ID NO: 456468 - RNA, 22 nt, Human
uggguacuccuauuaguucagu

SEQ ID NO: 456469 - RNA, 20 nt, Human
cucuccucacccgugucagg

SEQ ID NO: 456470 - RNA, 22 nt, Human
cauaacuagagugaaauguuga

SEQ ID NO: 456471 - RNA, 22 nt, Human
ggaucauuaacacauccaucac

SEQ ID NO: 456472 - RNA, 22 nt, Human
uuuuaucaaucauuaagacauu

SEQ ID NO: 456473 - RNA, 22 nt, Human
ugagcaguaggucugaauagug

SEQ ID NO: 456474 - RNA, 22 nt, Human
uuucauaaacaguagaagacua

SEQ ID NO: 456475 - RNA, 22 nt, Human
gagccagguuggaggcugcagu

SEQ ID NO: 456476 - RNA, 22 nt, Human
agcuggccuguuagagcugagu

SEQ ID NO: 456477 - RNA, 22 nt, Human
cccaggacucuucacugcagcc

SEQ ID NO: 456478 - RNA, 22 nt, Human
ccacagggacuguuaaaacccu

SEQ ID NO: 456479 - RNA, 22 nt, Human
augggcaguaacaguggcaguc

SEQ ID NO: 456480 - RNA, 22 nt, Human
caauaguaaauuacggaggaga

SEQ ID NO: 456481 - RNA, 22 nt, Human
agaauucuuggugguuagaaua

SEQ ID NO: 456482 - RNA, 22 nt, Human
ugcugggcuagaagcugaggcc

SEQ ID NO: 456483 - RNA, 22 nt, Human
gagagcugggaaagccguggag

SEQ ID NO: 456484 - RNA, 22 nt, Human
ucacacguccuugcuacuccuc

SEQ ID NO: 456485 - RNA, 22 nt, Human
aguuuccaaauauuguuuuagc

SEQ ID NO: 456486 - RNA, 22 nt, Human
acaguaauaaguguuggugagg

SEQ ID NO: 456487 - RNA, 21 nt, Human
ugauuuccagaaaauuggccc

SEQ ID NO: 456488 - RNA, 22 nt, Human
uggcagagucucuccuuuccag

SEQ ID NO: 456489 - RNA, 22 nt, Human
uugggugcugucauggggcacg

SEQ ID NO: 456490 - RNA, 22 nt, Human
aucagagacaaaaccagcacuu

SEQ ID NO: 456491 - RNA, 22 nt, Human
agggcugaugcaccauguagcc

SEQ ID NO: 456492 - RNA, 22 nt, Human
agggccagaggcaccuugcagc

SEQ ID NO: 456493 - RNA, 22 nt, Human
ucaggagcugcacugggcccac

SEQ ID NO: 456494 - RNA, 22 nt, Human
gccagagccacuuuugggugau

SEQ ID NO: 456495 - RNA, 22 nt, Human
ggcuucauggaggaggugaguc

SEQ ID NO: 456496 - RNA, 22 nt, Human
uuuccucugcugccauugcccc

SEQ ID NO: 456497 - RNA, 22 nt, Human
aagggcucccaacucaucuuuu

SEQ ID NO: 456498 - RNA, 22 nt, Human
gcuuuauuuugugagggauuac

SEQ ID NO: 456499 - RNA, 22 nt, Human
cugcugucuuuauuucacugcu

SEQ ID NO: 456500 - RNA, 22 nt, Human
augaugguuguccuaggugcau

SEQ ID NO: 456501 - RNA, 22 nt, Human
cugggcuguaauguggcacuga

SEQ ID NO: 456502 - RNA, 22 nt, Human
aucuggaacaaagcuuaggaau

SEQ ID NO: 456503 - RNA, 22 nt, Human
caaugauggcuaggcagcugcu

SEQ ID NO: 456504 - RNA, 22 nt, Human
ccucagagguuuucauucugua

SEQ ID NO: 456505 - RNA, 22 nt, Human
uccugggccuguacuccauccg

SEQ ID NO: 456506 - RNA, 22 nt, Human
ccauggaguuccucuggucuau

SEQ ID NO: 456507 - RNA, 22 nt, Human
aagcaguguucccagcuggccc

SEQ ID NO: 456508 - RNA, 22 nt, Human
uggcucagaaggcugccuucac

SEQ ID NO: 456509 - RNA, 22 nt, Human
aggcacugacagauucuguguc

SEQ ID NO: 456510 - RNA, 22 nt, Human
cagccucuuuccacaucaggca

SEQ ID NO: 456511 - RNA, 22 nt, Human
aggccuggccuuuauguucaag

SEQ ID NO: 456512 - RNA, 19 nt, Human
cagucccaaauucuuguca

SEQ ID NO: 456513 - RNA, 22 nt, Human
aggcucagagaugaguaagcac

SEQ ID NO: 456514 - RNA, 20 nt, Human
uacagucagggcacaggcag

SEQ ID NO: 456515 - RNA, 22 nt, Human
gcuugcuggugccugcaggcuc

SEQ ID NO: 456516 - RNA, 20 nt, Human
ggccugagcauggcuggcag

SEQ ID NO: 456517 - RNA, 22 nt, Human
cccaggcuggagugcaauggca

SEQ ID NO: 456518 - RNA, 22 nt, Human
cuccagcuuuuucccaguuggc

SEQ ID NO: 456519 - RNA, 22 nt, Human
ggccagaaguuggaaaagagcc

SEQ ID NO: 456520 - RNA, 22 nt, Human
agcuggggcugcagagaacagg

SEQ ID NO: 456521 - RNA, 22 nt, Human
ugugcuucagguugucgccacg

SEQ ID NO: 456522 - RNA, 22 nt, Human
uucauugugauucuuggcuagc

SEQ ID NO: 456523 - RNA, 22 nt, Human
caggcagaaggaaguaccaggc

SEQ ID NO: 456524 - RNA, 22 nt, Human
uuuaccaagcuuuaauuacaua

SEQ ID NO: 456525 - RNA, 22 nt, Human
ugcuuuaucugugagaaccuga

SEQ ID NO: 456526 - RNA, 22 nt, Human
cugcuguguaucauuuuagaug

SEQ ID NO: 456527 - RNA, 22 nt, Human
uugaauaguguuuucaguauac

SEQ ID NO: 456528 - RNA, 22 nt, Human
aggccagagaggggaccagccu

SEQ ID NO: 456529 - RNA, 22 nt, Human
uagggcaguuucauguuaucuu

SEQ ID NO: 456530 - RNA, 22 nt, Human
ccuccagcgcgauccacuccgg

SEQ ID NO: 456531 - RNA, 22 nt, Human
cucaggauccaucuccugcccu

SEQ ID NO: 456532 - RNA, 22 nt, Human
gcagcccaauggacugagacag

SEQ ID NO: 456533 - RNA, 22 nt, Human
agggccugcaucaggagcuugg

SEQ ID NO: 456534 - RNA, 22 nt, Human
ucaaaugcaggucuggucuugg

SEQ ID NO: 456535 - RNA, 22 nt, Human
ucucaccauggugcuugcuuau

SEQ ID NO: 456536 - RNA, 22 nt, Human
ugcagugugaccuguagcgagc

SEQ ID NO: 456537 - RNA, 22 nt, Human
aauauuucuccuucguuauagc

SEQ ID NO: 456538 - RNA, 22 nt, Human
aaguuguauauaccgcuuuaag

SEQ ID NO: 456539 - RNA, 22 nt, Human
agcauaaaggucaacguuuuag

SEQ ID NO: 456540 - RNA, 22 nt, Human
uaaauucuacaacuucaaagau

SEQ ID NO: 456541 - RNA, 22 nt, Human
ucucagagagcuguguuuuccu

SEQ ID NO: 456542 - RNA, 22 nt, Human
gacccuggaguuaguccugugu

SEQ ID NO: 456543 - RNA, 22 nt, Human
uugguuuaggaacuggcuugga

SEQ ID NO: 456544 - RNA, 22 nt, Human
uugaagcaaggcgaaucuugug

SEQ ID NO: 456545 - RNA, 22 nt, Human
ucugucacaauuugcuuacucu

SEQ ID NO: 456546 - RNA, 20 nt, Human
cccaggcagagcuagcggca

SEQ ID NO: 456547 - RNA, 22 nt, Human
aggagcugcaaauauuaguaau

SEQ ID NO: 456548 - RNA, 22 nt, Human
cugcuuccaugcaauggcaguc

SEQ ID NO: 456549 - RNA, 22 nt, Human
uggaaagacauucagccgcugg

SEQ ID NO: 456550 - RNA, 22 nt, Human
gagcuuccauggacgccaucug

SEQ ID NO: 456551 - RNA, 20 nt, Human
ucucagcauaagaacccuuc

SEQ ID NO: 456552 - RNA, 22 nt, Human
gggacuggaguagaggccggug

SEQ ID NO: 456553 - RNA, 22 nt, Human
aguuccagcugugaccagaaaa

SEQ ID NO: 456554 - RNA, 22 nt, Human
uggcagggucuugcuguguugc

SEQ ID NO: 456555 - RNA, 22 nt, Human
ucuuuccuuagaauaauucuuu

SEQ ID NO: 456556 - RNA, 22 nt, Human
ggcgugggaaguggggcuucug

SEQ ID NO: 456557 - RNA, 22 nt, Human
caugggcaccuuaaaaugaggc

SEQ ID NO: 456558 - RNA, 22 nt, Human
caccagcuuugcccacugccca

SEQ ID NO: 456559 - RNA, 22 nt, Human
gaggacagcuuagggcuuccug

SEQ ID NO: 456560 - RNA, 22 nt, Human
aggcacagagaaugcccuccau

SEQ ID NO: 456561 - RNA, 22 nt, Human
uuuaaugugagucccuuucaag

SEQ ID NO: 456562 - RNA, 22 nt, Human
accaugaugggaagcucagggc

SEQ ID NO: 456563 - RNA, 22 nt, Human
guccagugacaaguagcuggcc

SEQ ID NO: 456564 - RNA, 22 nt, Human
ucagagagguuggugauaagaa

SEQ ID NO: 456565 - RNA, 23 nt, Human
ccugcucaggcgugugcccugcu

SEQ ID NO: 456566 - RNA, 17 nt, Human
agagagagcaugccacc

SEQ ID NO: 456567 - RNA, 22 nt, Human
gcuguacaggguuauccuuucc

SEQ ID NO: 456568 - RNA, 21 nt, Human
cauuagggcagaagcaggaag

SEQ ID NO: 456569 - RNA, 20 nt, Human
uccucagaagacauuugggg

SEQ ID NO: 456570 - RNA, 22 nt, Human
ugccugucuccucugcagggug

SEQ ID NO: 456571 - RNA, 22 nt, Human
uggcucagagccuugagagcug

SEQ ID NO: 456572 - RNA, 22 nt, Human
auuguacuuuuauuacauguag

SEQ ID NO: 456573 - RNA, 22 nt, Human
ugagagugauugguucgaaugu

SEQ ID NO: 456574 - RNA, 22 nt, Human
cagcccuggaacagcugacuca

SEQ ID NO: 456575 - RNA, 22 nt, Human
cucagagaaccuaagcggagga

SEQ ID NO: 456576 - RNA, 22 nt, Human
gcuggucacucugggagcugcu

SEQ ID NO: 456577 - RNA, 22 nt, Human
ugccaggcuaaguggaggacuu

SEQ ID NO: 456578 - RNA, 22 nt, Human
ggcaccugcucaucuggacuca

SEQ ID NO: 456579 - RNA, 22 nt, Human
uuuccucugacugcuccccugc

SEQ ID NO: 456580 - RNA, 22 nt, Human
agguuuaugccuuggagcuggg

SEQ ID NO: 456581 - RNA, 22 nt, Human
cucuggcuucuaccuugcaguu

SEQ ID NO: 456582 - RNA, 22 nt, Human
uugaagcauuguggcuuguauu

SEQ ID NO: 456583 - RNA, 22 nt, Human
agccuucagcaguucaggugcc

SEQ ID NO: 456584 - RNA, 22 nt, Human
uaugcacacauguaugcaugug

SEQ ID NO: 456585 - RNA, 22 nt, Human
accagagcuuacaugcuagaaa

SEQ ID NO: 456586 - RNA, 22 nt, Human
ggaggcuccuaagcugacuuga

SEQ ID NO: 456587 - RNA, 22 nt, Human
ugacagaaagaauaugucaauc

SEQ ID NO: 456588 - RNA, 22 nt, Human
ucugaggcuucagacuguacug

SEQ ID NO: 456589 - RNA, 22 nt, Human
cuucucuucccagggacacagg

SEQ ID NO: 456590 - RNA, 23 nt, Human
aaacaugcagcacaugaaugcua

SEQ ID NO: 456591 - RNA, 22 nt, Human
uucaggauuauacucucuuccc

SEQ ID NO: 456592 - RNA, 22 nt, Human
aggagugcaaauaguccagaga

SEQ ID NO: 456593 - RNA, 22 nt, Human
aggggagaguuaaugugaaugu

SEQ ID NO: 456594 - RNA, 22 nt, Human
aaugcugcaagaggugaaaaga

SEQ ID NO: 456595 - RNA, 23 nt, Human
ggcucugugcugggccugcagga

SEQ ID NO: 456596 - RNA, 22 nt, Human
acagaauauugguuacuguugc

SEQ ID NO: 456597 - RNA, 22 nt, Human
auauuaggcaaggagauuauuu

SEQ ID NO: 456598 - RNA, 22 nt, Human
aagugguaggaagagagcacug

SEQ ID NO: 456599 - RNA, 22 nt, Human
agggucagggagugaguauuua

SEQ ID NO: 456600 - RNA, 22 nt, Human
auuugagaugguaaauaacuuu

SEQ ID NO: 456601 - RNA, 22 nt, Human
aaaguucagauuagacucaaga

SEQ ID NO: 456602 - RNA, 22 nt, Human
uguuuauugagugccuacuaua

SEQ ID NO: 456603 - RNA, 22 nt, Human
aggcuggcccuacuggcugccu

SEQ ID NO: 456604 - RNA, 22 nt, Human
ucagaggauugccucagcgagc

SEQ ID NO: 456605 - RNA, 22 nt, Human
uagauaaauuagaaaguuuacu

SEQ ID NO: 456606 - RNA, 22 nt, Human
aagagcauggaauggagaucca

SEQ ID NO: 456607 - RNA, 20 nt, Human
ucugaggcugagcucuacuu

SEQ ID NO: 456608 - RNA, 22 nt, Human
caguuauuaugaggucauuagg

SEQ ID NO: 456609 - RNA, 22 nt, Human
uggcugaggagggucuucuggu

SEQ ID NO: 456610 - RNA, 18 nt, Human
uguggcaggggugggaga

SEQ ID NO: 456611 - RNA, 22 nt, Human
gccugcagggccugggccuacc

SEQ ID NO: 456612 - RNA, 22 nt, Human
cagcuggaucccugcagaacuu

SEQ ID NO: 456613 - RNA, 23 nt, Human
gccucugcagccuaguuaguguc

SEQ ID NO: 456614 - RNA, 22 nt, Human
aaaaaucacuuuuauaggcagc

SEQ ID NO: 456615 - RNA, 22 nt, Human
acagaaagaagguguauuugag

SEQ ID NO: 456616 - RNA, 22 nt, Human
cugaggccagcugcagagcucu

SEQ ID NO: 456617 - RNA, 21 nt, Human
cagaaguaaggguaacuucuc

SEQ ID NO: 456618 - RNA, 23 nt, Human
ggccucagcgcacagaaacugcu

SEQ ID NO: 456619 - RNA, 23 nt, Human
ucccagccucuucucuugcauac

SEQ ID NO: 456620 - RNA, 22 nt, Human
agggcagauggaacuuccccga

SEQ ID NO: 456621 - RNA, 19 nt, Human
cagauguuuucaguucauu

SEQ ID NO: 456622 - RNA, 22 nt, Human
agcagcucacaggauuccugaa

SEQ ID NO: 456623 - RNA, 22 nt, Human
ccaaggagaaugacaccaugga

SEQ ID NO: 456624 - RNA, 22 nt, Human
acagcagagugugagauagcca

SEQ ID NO: 456625 - RNA, 21 nt, Human
ugggaccuagcuuugcacagg

SEQ ID NO: 456626 - RNA, 20 nt, Human
ugcagaagaacguucugguu

SEQ ID NO: 456627 - RNA, 22 nt, Human
gaacuguauaggagcaguguuu

SEQ ID NO: 456628 - RNA, 22 nt, Human
cccaaggcugcagugagcauga

SEQ ID NO: 456629 - RNA, 22 nt, Human
uggcaugauaggaggugcagaa

SEQ ID NO: 456630 - RNA, 22 nt, Human
agaugcugugaggaagcuagga

SEQ ID NO: 456631 - RNA, 18 nt, Human
uggcagccagcugcuccu

SEQ ID NO: 456632 - RNA, 22 nt, Human
aggcuuuaauuaucuacaggag

SEQ ID NO: 456633 - RNA, 22 nt, Human
acaaaguuauucuuucagagga

SEQ ID NO: 456634 - RNA, 22 nt, Human
guggcauuaggccaggugcaua

SEQ ID NO: 456635 - RNA, 20 nt, Human
auguccagugacuggaccau

SEQ ID NO: 456636 - RNA, 22 nt, Human
uacauacacaaauauacuguuu

SEQ ID NO: 456637 - RNA, 22 nt, Human
ugcacaucuuucagcaucauac

SEQ ID NO: 456638 - RNA, 22 nt, Human
uggcucaggugugagcugaaga

SEQ ID NO: 456639 - RNA, 21 nt, Human
cugugcuuuuuaagugugaug

SEQ ID NO: 456640 - RNA, 22 nt, Human
gagcagaacuacucacauaucg

SEQ ID NO: 456641 - RNA, 21 nt, Human
cucacaggaugcaguguuacu

SEQ ID NO: 456642 - RNA, 20 nt, Human
uuugagaccagucugcccaa

SEQ ID NO: 456643 - RNA, 22 nt, Human
acuggagcccguggaggcgcag

SEQ ID NO: 456644 - RNA, 22 nt, Human
caaggccacugcucagguuucc

SEQ ID NO: 456645 - RNA, 23 nt, Human
aggaaagcauucauuuuuaccau

SEQ ID NO: 456646 - RNA, 22 nt, Human
agguggguccuggcucugccau

SEQ ID NO: 456647 - RNA, 22 nt, Human
aucaaaguggaaguuuacuagg

SEQ ID NO: 456648 - RNA, 22 nt, Human
ugccaggccaauucuauuugac

SEQ ID NO: 456649 - RNA, 22 nt, Human
guggcugcucgggcuccggccc

SEQ ID NO: 456650 - RNA, 22 nt, Human
guuauaaaggugauaaugguca

SEQ ID NO: 456651 - RNA, 22 nt, Human
uucauauauaugcacuacguac

SEQ ID NO: 456652 - RNA, 22 nt, Human
gagagaagaaagccaugguccu

SEQ ID NO: 456653 - RNA, 22 nt, Human
uccagggaccucccugagagcu

SEQ ID NO: 456654 - RNA, 22 nt, Human
acccagcucuuugauggucuug

SEQ ID NO: 456655 - RNA, 22 nt, Human
gccuucugcgcucgugucuccg

SEQ ID NO: 456656 - RNA, 20 nt, Human
ggggcaguggcucaugccug

SEQ ID NO: 456657 - RNA, 22 nt, Human
ccugccagauccccugagcuga

SEQ ID NO: 456658 - RNA, 22 nt, Human
agucucaggcagaggaaggcua

SEQ ID NO: 456659 - RNA, 22 nt, Human
gggcaugccugcgcagugcaug

SEQ ID NO: 456660 - RNA, 22 nt, Human
gcacccagagggcagggucucc

SEQ ID NO: 456661 - RNA, 22 nt, Human
cacagaaucugugacuccaaga

SEQ ID NO: 456662 - RNA, 22 nt, Human
ccucugccugcacaucauccug

SEQ ID NO: 456663 - RNA, 22 nt, Human
ggagcugaugacgucaccaugg

SEQ ID NO: 456664 - RNA, 22 nt, Human
ucagggcaggcgagcagcugcu

SEQ ID NO: 456665 - RNA, 22 nt, Human
gaaguucaggugggaauugagc

SEQ ID NO: 456666 - RNA, 20 nt, Human
uccugggguaagccaugguc

SEQ ID NO: 456667 - RNA, 22 nt, Human
uugggggaagaggauagacagu

SEQ ID NO: 456668 - RNA, 22 nt, Human
gagacugauggggcucccagaa

SEQ ID NO: 456669 - RNA, 22 nt, Human
ugggaauggaugcuaagugcua

SEQ ID NO: 456670 - RNA, 23 nt, Human
ucuugaaaagccuacagcaguuc

SEQ ID NO: 456671 - RNA, 22 nt, Human
uucaagauccagcacaacagug

SEQ ID NO: 456672 - RNA, 22 nt, Human
ucaggccacuucacaggugauu

SEQ ID NO: 456673 - RNA, 22 nt, Human
gccaggcaggugucggagcccu

SEQ ID NO: 456674 - RNA, 22 nt, Human
uucuuacuaguauguuucagca

SEQ ID NO: 456675 - RNA, 22 nt, Human
caaaugcuaacuucuuuccaaa

SEQ ID NO: 456676 - RNA, 22 nt, Human
uggacaggugagugacucaggg

SEQ ID NO: 456677 - RNA, 22 nt, Human
cucaggagguuuccugucuagg

SEQ ID NO: 456678 - RNA, 19 nt, Human
cagaguccuugaccagucc

SEQ ID NO: 456679 - RNA, 22 nt, Human
ucagaggacagcagcuaaauaa

SEQ ID NO: 456680 - RNA, 22 nt, Human
uggggugggcaugcgcuguccu

SEQ ID NO: 456681 - RNA, 22 nt, Human
cagcaggcccaggugcugguga

SEQ ID NO: 456682 - RNA, 22 nt, Human
acuucaaacaauuaacagagaa

SEQ ID NO: 456683 - RNA, 22 nt, Human
ucucacugggucacagcagagg

SEQ ID NO: 456684 - RNA, 22 nt, Human
uggcucugccacuaacuuggua

SEQ ID NO: 456685 - RNA, 21 nt, Human
agaagccuggguggagguggg

SEQ ID NO: 456686 - RNA, 22 nt, Human
aaaugcagauugucauucagga

SEQ ID NO: 456687 - RNA, 22 nt, Human
aacaucuuuuuguuugcugaaa

SEQ ID NO: 456688 - RNA, 22 nt, Human
cggggcuguagcacagcugagc

SEQ ID NO: 456689 - RNA, 16 nt, Human
gggagggaguuggugg

SEQ ID NO: 456690 - RNA, 22 nt, Human
ucccagcacgucugcuguuucu

SEQ ID NO: 456691 - RNA, 22 nt, Human
acacacuucacccuugagcuaa

SEQ ID NO: 456692 - RNA, 20 nt, Human
accuuucaaaugauucagca

SEQ ID NO: 456693 - RNA, 22 nt, Human
ugagccagucugucugggugaa

SEQ ID NO: 456694 - RNA, 22 nt, Human
ucucaggguuuccugggggcug

SEQ ID NO: 456695 - RNA, 23 nt, Human
auguuauuauuagcagucuugcc

SEQ ID NO: 456696 - RNA, 22 nt, Human
agccuucaaccuagcuagagca

SEQ ID NO: 456697 - RNA, 22 nt, Human
gggcaugagagggcagcuggca

SEQ ID NO: 456698 - RNA, 22 nt, Human
agcaccuggucuccuggcgcug

SEQ ID NO: 456699 - RNA, 23 nt, Human
cagaggguuccauggagcauggu

SEQ ID NO: 456700 - RNA, 22 nt, Human
ccucaggaaaugaauaaauggc

SEQ ID NO: 456701 - RNA, 22 nt, Human
aaagccuugggauuugugauca

SEQ ID NO: 456702 - RNA, 22 nt, Human
gggcugcugccaaucacagccu

SEQ ID NO: 456703 - RNA, 22 nt, Human
guaucuuucccaccaaucacaa

SEQ ID NO: 456704 - RNA, 22 nt, Human
gaggcccaguccugcaagcacg

SEQ ID NO: 456705 - RNA, 22 nt, Human
acacuguagcugagggcaugcg

SEQ ID NO: 456706 - RNA, 22 nt, Human
ugaggcaggaguuaaugugcuc

SEQ ID NO: 456707 - RNA, 22 nt, Human
ggugauuuucgaguuucauguu

SEQ ID NO: 456708 - RNA, 22 nt, Human
aaugauggucauggcaacuuuu

SEQ ID NO: 456709 - RNA, 23 nt, Human
acagggcauugcuggccucgagg

SEQ ID NO: 456710 - RNA, 22 nt, Human
cauuuguauagugcuuagacca

SEQ ID NO: 456711 - RNA, 22 nt, Human
cucgcaggacagugcuaggacu

SEQ ID NO: 456712 - RNA, 22 nt, Human
ccaggguaccccaagggcaggu

SEQ ID NO: 456713 - RNA, 22 nt, Human
cagacacaccaggcccauucug

SEQ ID NO: 456714 - RNA, 22 nt, Human
guggccucaugucuauaaagag

SEQ ID NO: 456715 - RNA, 22 nt, Human
aaagaggaaccaagagcacgug

SEQ ID NO: 456716 - RNA, 22 nt, Human
uggccaccccuuucucugcacu

SEQ ID NO: 456717 - RNA, 22 nt, Human
ggcagaggaagcuggaaguggg

SEQ ID NO: 456718 - RNA, 22 nt, Human
gaaacaugucugacaauuuacc

SEQ ID NO: 456719 - RNA, 22 nt, Human
agggucaguucugugagguguu

SEQ ID NO: 456720 - RNA, 23 nt, Human
gcccaugcuguugggcccgagca

SEQ ID NO: 456721 - RNA, 22 nt, Human
gcuccucucccagagcugcagg

SEQ ID NO: 456722 - RNA, 22 nt, Human
cuccagugagugagcaggcgac

SEQ ID NO: 456723 - RNA, 22 nt, Human
gagguucacaggcuaucacagu

SEQ ID NO: 456724 - RNA, 22 nt, Human
uuucuuguaagauguuuauuaa

SEQ ID NO: 456725 - RNA, 22 nt, Human
cccuggagugugacgaggcauu

SEQ ID NO: 456726 - RNA, 22 nt, Human
uaaauuguuuucuagaaguugu

SEQ ID NO: 456727 - RNA, 22 nt, Human
gccuggcaggccuguuggggcu

SEQ ID NO: 456728 - RNA, 22 nt, Human
ggcugccauaacagaguaccac

SEQ ID NO: 456729 - RNA, 22 nt, Human
agcuucucaggagucugaggca

SEQ ID NO: 456730 - RNA, 22 nt, Human
gauggcagucaaccaggugagg

SEQ ID NO: 456731 - RNA, 22 nt, Human
guggcucucgccagccugcggg

SEQ ID NO: 456732 - RNA, 21 nt, Human
uuugaaagugggugauucuuu

SEQ ID NO: 456733 - RNA, 22 nt, Human
uggcucugcaccucaguguacc

SEQ ID NO: 456734 - RNA, 22 nt, Human
cugcagaguggagccucggcug

SEQ ID NO: 456735 - RNA, 22 nt, Human
aucaggaucaugcuggguggga

SEQ ID NO: 456736 - RNA, 22 nt, Human
uccuuuguuaaggagguuuguu

SEQ ID NO: 456737 - RNA, 22 nt, Human
gagcucugggaaacaaagugua

SEQ ID NO: 456738 - RNA, 22 nt, Human
ucccaggcugggggccugaagu

SEQ ID NO: 456739 - RNA, 22 nt, Human
guggcugcagcccagcggcacg

SEQ ID NO: 456740 - RNA, 22 nt, Human
cagagcuggccugugauuuuug

SEQ ID NO: 456741 - RNA, 22 nt, Human
gcaaaaaccacaauuacuuuua

SEQ ID NO: 456742 - RNA, 22 nt, Human
agcaaggcagucagcuggcugg

SEQ ID NO: 456743 - RNA, 23 nt, Human
gggaccagcuagggcugugaccu

SEQ ID NO: 456744 - RNA, 22 nt, Human
augaggcaaggaucagguaagg

SEQ ID NO: 456745 - RNA, 18 nt, Human
agagaugguguagaguuu

SEQ ID NO: 456746 - RNA, 22 nt, Human
gaagccacuauagauauucuaa

SEQ ID NO: 456747 - RNA, 22 nt, Human
cuggagaggcugggaacagguu

SEQ ID NO: 456748 - RNA, 22 nt, Human
ggucaugcugugaaucagugcu

SEQ ID NO: 456749 - RNA, 22 nt, Human
cugaaacauugcaauaacaaag

SEQ ID NO: 456750 - RNA, 22 nt, Human
gggcaggugccagcucccuguc

SEQ ID NO: 456751 - RNA, 22 nt, Human
ccucuccaguuuuaacgugacc

SEQ ID NO: 456752 - RNA, 22 nt, Human
ucuucaaacugaaaauuuagaa

SEQ ID NO: 456753 - RNA, 20 nt, Human
gggguuggcuggcacaggga

SEQ ID NO: 456754 - RNA, 22 nt, Human
ggaugcugggagacagcaggca

SEQ ID NO: 456755 - RNA, 22 nt, Human
ugaaaaaccucaguccgcuuua

SEQ ID NO: 456756 - RNA, 22 nt, Human
caggggcagucugugugcgugg

SEQ ID NO: 456757 - RNA, 22 nt, Human
gaggaagaagggauuagaacuc

SEQ ID NO: 456758 - RNA, 22 nt, Human
ccucuucugagugagacucccu

SEQ ID NO: 456759 - RNA, 22 nt, Human
gcuggccugggcagaggcuaug

SEQ ID NO: 456760 - RNA, 22 nt, Human
gaaaugugcagaauguguuaga

SEQ ID NO: 456761 - RNA, 22 nt, Human
cuguaaaacacuguaguaucug

SEQ ID NO: 456762 - RNA, 22 nt, Human
ucccagggucaguggugaggcc

SEQ ID NO: 456763 - RNA, 22 nt, Human
uggagcaggugcucaggguaau

SEQ ID NO: 456764 - RNA, 22 nt, Human
ggucccaggagaauaggugcaa

SEQ ID NO: 456765 - RNA, 22 nt, Human
caguacuuuucaaccaguauga

SEQ ID NO: 456766 - RNA, 22 nt, Human
agggccugagcuggcugaccuc

SEQ ID NO: 456767 - RNA, 22 nt, Human
gccagggaacccaagggccuca

SEQ ID NO: 456768 - RNA, 22 nt, Human
gaggcugcuguuagcccugggc

SEQ ID NO: 456769 - RNA, 22 nt, Human
cugagcugggaguggauagugg

SEQ ID NO: 456770 - RNA, 22 nt, Human
aaagauuugaguucugcuuaua

SEQ ID NO: 456771 - RNA, 22 nt, Human
ugcugcacucaccaacagauaa

SEQ ID NO: 456772 - RNA, 22 nt, Human
agcaagcuaccuagauagucua

SEQ ID NO: 456773 - RNA, 22 nt, Human
aacauaauguggccaaagucac

SEQ ID NO: 456774 - RNA, 22 nt, Human
agagugggccucugagucccag

SEQ ID NO: 456775 - RNA, 22 nt, Human
cuggggcucucuggaaugcuug

SEQ ID NO: 456776 - RNA, 22 nt, Human
uugugaaacauucauggauuug

SEQ ID NO: 456777 - RNA, 19 nt, Human
ugccugucaguagaucuca

SEQ ID NO: 456778 - RNA, 22 nt, Human
uacaaagugugcccaugcugag

SEQ ID NO: 456779 - RNA, 23 nt, Human
ugcagccacucaggagcucagug

SEQ ID NO: 456780 - RNA, 22 nt, Human
auguacacaugcaugcaugugc

SEQ ID NO: 456781 - RNA, 22 nt, Human
agagccuggcucccagcuaccg

SEQ ID NO: 456782 - RNA, 22 nt, Human
uaaaugcagcaguuucuguucu

SEQ ID NO: 456783 - RNA, 22 nt, Human
cauuucuacagcuucuucagaa

SEQ ID NO: 456784 - RNA, 22 nt, Human
ucacaguuauagucuguagaau

SEQ ID NO: 456785 - RNA, 22 nt, Human
agagccugaggccaggaaaaug

SEQ ID NO: 456786 - RNA, 22 nt, Human
cagccagagaaagggcacugcc

SEQ ID NO: 456787 - RNA, 22 nt, Human
aaaaauaggucaaccguguaug

SEQ ID NO: 456788 - RNA, 22 nt, Human
ucauugaauuucacagcuuuau

SEQ ID NO: 456789 - RNA, 22 nt, Human
cugaggcagagggcagaccaga

SEQ ID NO: 456790 - RNA, 22 nt, Human
auuuaaaugcuuaagaggguuu

SEQ ID NO: 456791 - RNA, 22 nt, Human
uuuggaaaguguacaaauuuga

SEQ ID NO: 456792 - RNA, 22 nt, Human
aucauguuccagaaacagugau

SEQ ID NO: 456793 - RNA, 22 nt, Human
ugggcaggcaagugaauaccuu

SEQ ID NO: 456794 - RNA, 22 nt, Human
ucagaggugguaaaggacagca

SEQ ID NO: 456795 - RNA, 22 nt, Human
aggagcuggguuccuuuggugg

SEQ ID NO: 456796 - RNA, 22 nt, Human
ucacagcaaaagugugcagagc

SEQ ID NO: 456797 - RNA, 23 nt, Human
uccuuugucuuugcauagauggu

SEQ ID NO: 456798 - RNA, 22 nt, Human
ccagcacugcucucagacugag

SEQ ID NO: 456799 - RNA, 22 nt, Human
gccuaggaguggggauggcggu

SEQ ID NO: 456800 - RNA, 22 nt, Human
cucugagcagaggccguggcua

SEQ ID NO: 456801 - RNA, 22 nt, Human
agcagcuucuuucacuccugga

SEQ ID NO: 456802 - RNA, 18 nt, Human
ucagcuuuugaaaaccaa

SEQ ID NO: 456803 - RNA, 22 nt, Human
cagcugaggucaaagaagcagg

SEQ ID NO: 456804 - RNA, 19 nt, Human
ggaccagguccugggcagc

SEQ ID NO: 456805 - RNA, 19 nt, Human
acagagcucucugcuucug

SEQ ID NO: 456806 - RNA, 22 nt, Human
uccuugaaugaauguucucucc

SEQ ID NO: 456807 - RNA, 22 nt, Human
uucaaugagcccggggccauag

SEQ ID NO: 456808 - RNA, 20 nt, Human
ccuccaggcacacccaugug

SEQ ID NO: 456809 - RNA, 22 nt, Human
uggcugagagucauccugugug

SEQ ID NO: 456810 - RNA, 22 nt, Human
ccuguacacggucuaugccucc

SEQ ID NO: 456811 - RNA, 22 nt, Human
aucuuuaguagaggaauauauu

SEQ ID NO: 456812 - RNA, 22 nt, Human
gagggcaguagccucguacccu

SEQ ID NO: 456813 - RNA, 22 nt, Human
ugagaagcagcuuacagguguc

SEQ ID NO: 456814 - RNA, 22 nt, Human
aggcagcaagauuauuuaaucc

SEQ ID NO: 456815 - RNA, 22 nt, Human
acugcagccuugaacucugggc

SEQ ID NO: 456816 - RNA, 22 nt, Human
aaggaagguucauagucaaaga

SEQ ID NO: 456817 - RNA, 22 nt, Human
cagagcagcagagcuuccaugg

SEQ ID NO: 456818 - RNA, 22 nt, Human
ugggccaggcaugugaucagca

SEQ ID NO: 456819 - RNA, 19 nt, Human
caggaugaucccaugacac

SEQ ID NO: 456820 - RNA, 22 nt, Human
aagccaguguccagaaugggca

SEQ ID NO: 456821 - RNA, 22 nt, Human
gauggcagguaguggucucauc

SEQ ID NO: 456822 - RNA, 22 nt, Human
uuaaacagagucugaaauguaa

SEQ ID NO: 456823 - RNA, 22 nt, Human
gcugccaugguccaggcuccag

SEQ ID NO: 456824 - RNA, 22 nt, Human
gagagugauucccucccauaga

SEQ ID NO: 456825 - RNA, 19 nt, Human
ugaagcaauaccauuuuug

SEQ ID NO: 456826 - RNA, 22 nt, Human
acauuucuccuugcaggaguca

SEQ ID NO: 456827 - RNA, 22 nt, Human
aagggcagagggaaucccacau

SEQ ID NO: 456828 - RNA, 22 nt, Human
uaaaugugucuauggacccgcc

SEQ ID NO: 456829 - RNA, 22 nt, Human
guauuuuacugcucaaagcucu

SEQ ID NO: 456830 - RNA, 22 nt, Human
cagcccucagguccucagcagc

SEQ ID NO: 456831 - RNA, 22 nt, Human
gggaagcagcauugugcuggcu

SEQ ID NO: 456832 - RNA, 22 nt, Human
ucccagccuuucuuuucugcug

SEQ ID NO: 456833 - RNA, 22 nt, Human
cagaggcugcucuggguggcau

SEQ ID NO: 456834 - RNA, 22 nt, Human
cugucccucaucaccucugggu

SEQ ID NO: 456835 - RNA, 22 nt, Human
uaguccauuuucacacugcuga

SEQ ID NO: 456836 - RNA, 22 nt, Human
uagggcucuggugggcucuguu

SEQ ID NO: 456837 - RNA, 22 nt, Human
gagauucuguagucaggcaucu

SEQ ID NO: 456838 - RNA, 22 nt, Human
ucccagauucuucugugugggc

SEQ ID NO: 456839 - RNA, 20 nt, Human
gcuuccuucccagcccccac

SEQ ID NO: 456840 - RNA, 22 nt, Human
uggcucagucauggaugaguaa

SEQ ID NO: 456841 - RNA, 20 nt, Human
ugucauuguuucuaggaccu

SEQ ID NO: 456842 - RNA, 20 nt, Human
gcccaagguccagaaggggg

SEQ ID NO: 456843 - RNA, 22 nt, Human
uggcucaggccuacgacgccuu

SEQ ID NO: 456844 - RNA, 22 nt, Human
gcagagccaugggagguuuuug

SEQ ID NO: 456845 - RNA, 22 nt, Human
cuggagcccaggccuggugucu

SEQ ID NO: 456846 - RNA, 22 nt, Human
cacaggcucuucucacuugauu

SEQ ID NO: 456847 - RNA, 22 nt, Human
gggaguguugagcgcccugcca

SEQ ID NO: 456848 - RNA, 22 nt, Human
cuggccucaccucagacuuacu

SEQ ID NO: 456849 - RNA, 22 nt, Human
uuuucauugagcaccugaguaa

SEQ ID NO: 456850 - RNA, 22 nt, Human
aaauauaauuucugccucaaua

SEQ ID NO: 456851 - RNA, 22 nt, Human
ccugccugguguaagucuaagg

SEQ ID NO: 456852 - RNA, 22 nt, Human
auguccagccaaccacuggauu

SEQ ID NO: 456853 - RNA, 22 nt, Human
ugcagggccuugggucuuucuu

SEQ ID NO: 456854 - RNA, 17 nt, Human
cugcuuugugcaacgcu

SEQ ID NO: 456855 - RNA, 22 nt, Human
cuguuuucccuggaguucagca

SEQ ID NO: 456856 - RNA, 22 nt, Human
cacauacaaugguguuauuugg

SEQ ID NO: 456857 - RNA, 22 nt, Human
ugauuucccuguagccucugaa

SEQ ID NO: 456858 - RNA, 22 nt, Human
uggggccugagguggagcugca

SEQ ID NO: 456859 - RNA, 22 nt, Human
ggcagugaaaaaguauguuucc

SEQ ID NO: 456860 - RNA, 22 nt, Human
gaggggcugggguugacuccaa

SEQ ID NO: 456861 - RNA, 22 nt, Human
cagccagguucaaguccuuaua

SEQ ID NO: 456862 - RNA, 22 nt, Human
acacagggaggaggugcugugc

SEQ ID NO: 456863 - RNA, 22 nt, Human
gcuggccucuggagaagggcuu

SEQ ID NO: 456864 - RNA, 22 nt, Human
agagaagagcaaugauaaauuu

SEQ ID NO: 456865 - RNA, 22 nt, Human
acuguacacacuucucugucuu

SEQ ID NO: 456866 - RNA, 22 nt, Human
gagccuggacaucucaggccca

SEQ ID NO: 456867 - RNA, 22 nt, Human
gagaaggggugauguggguaau

SEQ ID NO: 456868 - RNA, 22 nt, Human
cccaggcagugcugaucccuca

SEQ ID NO: 456869 - RNA, 22 nt, Human
uccaggcuccccugcgugcucc

SEQ ID NO: 456870 - RNA, 22 nt, Human
uuauacauguguuuugagauga

SEQ ID NO: 456871 - RNA, 23 nt, Human
uugauacagaagaaucaguuugu

SEQ ID NO: 456872 - RNA, 20 nt, Human
gcacugaagguuccagggga

SEQ ID NO: 456873 - RNA, 22 nt, Human
caacagaaggaagcagggucag

SEQ ID NO: 456874 - RNA, 22 nt, Human
guuugcauuucuugaacuauau

SEQ ID NO: 456875 - RNA, 22 nt, Human
cuacauuuguucuauagcuuuu

SEQ ID NO: 456876 - RNA, 22 nt, Human
aaaaugaauaaguuaacccagg

SEQ ID NO: 456877 - RNA, 22 nt, Human
uacaaaguuugagaaugcuuuc

SEQ ID NO: 456878 - RNA, 20 nt, Human
aagcagaagcugcucucagc

SEQ ID NO: 456879 - RNA, 22 nt, Human
cugcagccuccugggguacaug

SEQ ID NO: 456880 - RNA, 19 nt, Human
agaggcagucuccaacagg

SEQ ID NO: 456881 - RNA, 22 nt, Human
cagucacauugcccugcauuua

SEQ ID NO: 456882 - RNA, 22 nt, Human
aggccuagaggaauggccaggg

SEQ ID NO: 456883 - RNA, 22 nt, Human
ggucauuguucuuuucugugau

SEQ ID NO: 456884 - RNA, 15 nt, Human
cagucccagggaccc

SEQ ID NO: 456885 - RNA, 22 nt, Human
ccaaaggcggaacugagucucu

SEQ ID NO: 456886 - RNA, 23 nt, Human
ugucauugugacuacagaaccag

SEQ ID NO: 456887 - RNA, 22 nt, Human
uuuaaaauuuagaccucuccac

SEQ ID NO: 456888 - RNA, 22 nt, Human
uggcagggaguugcaggauuuc

SEQ ID NO: 456889 - RNA, 22 nt, Human
auucaaguucuucugucuuugc

SEQ ID NO: 456890 - RNA, 22 nt, Human
gggaaauugugugagaucuuug

SEQ ID NO: 456891 - RNA, 22 nt, Human
ugacauuucgguguaugugaug

SEQ ID NO: 456892 - RNA, 19 nt, Human
ugagaaggcaguggggagc

SEQ ID NO: 456893 - RNA, 22 nt, Human
agugggaccggugcuauuccag

SEQ ID NO: 456894 - RNA, 22 nt, Human
cuggcagcgcagcaugaagucg

SEQ ID NO: 456895 - RNA, 22 nt, Human
gccuggagacagcagaggcggc

SEQ ID NO: 456896 - RNA, 22 nt, Human
uccauggguagcccugguugag

SEQ ID NO: 456897 - RNA, 22 nt, Human
uuugaaaggaauuaggaugaca

SEQ ID NO: 456898 - RNA, 22 nt, Human
aggaaaaagaguugcugccuuc

SEQ ID NO: 456899 - RNA, 22 nt, Human
acagcuuuugaaaaauuacugg

SEQ ID NO: 456900 - RNA, 22 nt, Human
agcagggcuugccgcuuguccu

SEQ ID NO: 456901 - RNA, 19 nt, Human
agaaucaggucaggugaca

SEQ ID NO: 456902 - RNA, 22 nt, Human
cauuugaugacucaacucauaa

SEQ ID NO: 456903 - RNA, 22 nt, Human
ggagaagcagcuucuugaugaa

SEQ ID NO: 456904 - RNA, 20 nt, Human
aggaagccaaaggcugucuu

SEQ ID NO: 456905 - RNA, 22 nt, Human
ggagauaguccaggugaaggga

SEQ ID NO: 456906 - RNA, 22 nt, Human
uaagaaauuuaguuauagaaug

SEQ ID NO: 456907 - RNA, 22 nt, Human
ggcagcagcaagguuggagcug

SEQ ID NO: 456908 - RNA, 22 nt, Human
ccagcccucacugaggccucuc

SEQ ID NO: 456909 - RNA, 22 nt, Human
guucacaagaguuacagacaga

SEQ ID NO: 456910 - RNA, 22 nt, Human
agcagcugaccagugaguccug

SEQ ID NO: 456911 - RNA, 22 nt, Human
cacauaaucaccaaguccuuuc

SEQ ID NO: 456912 - RNA, 22 nt, Human
gccugugguuugauuaagcauu

SEQ ID NO: 456913 - RNA, 22 nt, Human
guuugauucaagaacaaagagu

SEQ ID NO: 456914 - RNA, 19 nt, Human
ugagaggcuuaaggcagcu

SEQ ID NO: 456915 - RNA, 22 nt, Human
aaaugaccagaauacaggcuuc

SEQ ID NO: 456916 - RNA, 22 nt, Human
gcagauggcucagacacugggg

SEQ ID NO: 456917 - RNA, 22 nt, Human
uugggcaaaguguuucuggagc

SEQ ID NO: 456918 - RNA, 22 nt, Human
uuguuuuggagaugagcuaaaa

SEQ ID NO: 456919 - RNA, 22 nt, Human
ggagccuggccuggcucugugu

SEQ ID NO: 456920 - RNA, 22 nt, Human
accaaggaguuugguauuuuag

SEQ ID NO: 456921 - RNA, 17 nt, Human
ccagguggaaucgugga

SEQ ID NO: 456922 - RNA, 22 nt, Human
auaugcauuuaccuggcauaua

SEQ ID NO: 456923 - RNA, 22 nt, Human
uggagcagcacaagaaagggga

SEQ ID NO: 456924 - RNA, 22 nt, Human
cagggccuccuaaggcaucuaa

SEQ ID NO: 456925 - RNA, 22 nt, Human
gggcuggucuggcuuagucagg

SEQ ID NO: 456926 - RNA, 22 nt, Human
ugaaagcagcaccaauaccauu

SEQ ID NO: 456927 - RNA, 22 nt, Human
gcucccaggaugaggagccagg

SEQ ID NO: 456928 - RNA, 22 nt, Human
ugcaggcaggggaugagcagcc

SEQ ID NO: 456929 - RNA, 15 nt, Human
aggcacugugggacc

SEQ ID NO: 456930 - RNA, 22 nt, Human
agcaggagagcagugcgugguc

SEQ ID NO: 456931 - RNA, 22 nt, Human
gagcacaggcuuugguggacac

SEQ ID NO: 456932 - RNA, 22 nt, Human
gagcugccaagauuacaaucag

SEQ ID NO: 456933 - RNA, 20 nt, Human
cuguaucagguuacaaagua

SEQ ID NO: 456934 - RNA, 18 nt, Human
cagaggagagacauucag

SEQ ID NO: 456935 - RNA, 22 nt, Human
uccucuucugcccaucagaggc

SEQ ID NO: 456936 - RNA, 22 nt, Human
cagagcaguaaaucuggggcac

SEQ ID NO: 456937 - RNA, 22 nt, Human
gugcuuucugcaugguuccuac

SEQ ID NO: 456938 - RNA, 22 nt, Human
ggcagaguggagugcggccucc

SEQ ID NO: 456939 - RNA, 22 nt, Human
agggcugaguggugcagucaaa

SEQ ID NO: 456940 - RNA, 22 nt, Human
ugcauauuuuauaaagauggaa

SEQ ID NO: 456941 - RNA, 22 nt, Human
ggggcagaaagcccacagagug

SEQ ID NO: 456942 - RNA, 22 nt, Human
cuagcaucagaugagaagcugu

SEQ ID NO: 456943 - RNA, 22 nt, Human
aagcagcugauuucacagcuca

SEQ ID NO: 456944 - RNA, 22 nt, Human
ggagggcucaauugacuccuga

SEQ ID NO: 456945 - RNA, 22 nt, Human
agggcagcuaaggugcugacug

SEQ ID NO: 456946 - RNA, 22 nt, Human
uguccaggucagcagcagggac

SEQ ID NO: 456947 - RNA, 22 nt, Human
gaacagcugcuagagaucugug

SEQ ID NO: 456948 - RNA, 22 nt, Human
uugggcuggcagagguggucuu

SEQ ID NO: 456949 - RNA, 22 nt, Human
gaugggaggaaccugggucccu

SEQ ID NO: 456950 - RNA, 22 nt, Human
ccagucugugugccagccugcg

SEQ ID NO: 456951 - RNA, 22 nt, Human
cugcagggaugugaggcccguu

SEQ ID NO: 456952 - RNA, 22 nt, Human
uucauguguauggaacauuuuu

SEQ ID NO: 456953 - RNA, 22 nt, Human
uuuccaaaggaggaaccaguuu

SEQ ID NO: 456954 - RNA, 22 nt, Human
agcucauggugcuaucucaggg

SEQ ID NO: 456955 - RNA, 22 nt, Human
acagaguauuggaaaggcagug

SEQ ID NO: 456956 - RNA, 22 nt, Human
ggcugccugugcccaggcacac

SEQ ID NO: 456957 - RNA, 22 nt, Human
uuguuucagcuguaugcuaugu

SEQ ID NO: 456958 - RNA, 19 nt, Human
uggcuucuguuuucauguu

SEQ ID NO: 456959 - RNA, 20 nt, Human
gugcauuucaccuguacugu

SEQ ID NO: 456960 - RNA, 22 nt, Human
uuucauaaugucacagucaaaa

SEQ ID NO: 456961 - RNA, 22 nt, Human
agcucagggcgaucugucucgg

SEQ ID NO: 456962 - RNA, 22 nt, Human
cugcucuggcuguguacuucag

SEQ ID NO: 456963 - RNA, 22 nt, Human
cugccuugaggagguuguggga

SEQ ID NO: 456964 - RNA, 22 nt, Human
cuccagggaggucugcaggacu

SEQ ID NO: 456965 - RNA, 22 nt, Human
cagugcaggcugggggcccugc

SEQ ID NO: 456966 - RNA, 22 nt, Human
agguggcuccucccauggcugg

SEQ ID NO: 456967 - RNA, 22 nt, Human
cugcuuugaggggcucuguaua

SEQ ID NO: 456968 - RNA, 22 nt, Human
ggcacugaaguggguguugggu

SEQ ID NO: 456969 - RNA, 22 nt, Human
uaguggaguagaaaccaaagaa

SEQ ID NO: 456970 - RNA, 22 nt, Human
ugaggaaguuguuucucuucua

SEQ ID NO: 456971 - RNA, 22 nt, Human
uguggcucucaugcacucccag

SEQ ID NO: 456972 - RNA, 22 nt, Human
cucuugaagcaggggccaguuc

SEQ ID NO: 456973 - RNA, 22 nt, Human
ucacaaaagcuuuugaauuugg

SEQ ID NO: 456974 - RNA, 22 nt, Human
cccaggccagaacuugguugcu

SEQ ID NO: 456975 - RNA, 22 nt, Human
caggccacaaguuggguucaag

SEQ ID NO: 456976 - RNA, 22 nt, Human
aaucacaauuacuuuugcacca

SEQ ID NO: 456977 - RNA, 22 nt, Human
ucacaggguuuggaagccuccu

SEQ ID NO: 456978 - RNA, 22 nt, Human
guuaauaaagguauagaaucag

SEQ ID NO: 456979 - RNA, 17 nt, Human
ugaaggaaggaugaugu

SEQ ID NO: 456980 - RNA, 22 nt, Human
gccaggcuggcaaaaggaaacc

SEQ ID NO: 456981 - RNA, 21 nt, Human
aucacauuggcuguuauuauu

SEQ ID NO: 456982 - RNA, 19 nt, Human
ggccccucucacaggaguu

SEQ ID NO: 456983 - RNA, 17 nt, Human
gccuuccuuccuccaca

SEQ ID NO: 456984 - RNA, 22 nt, Human
agagggaaugugauugcaccau

SEQ ID NO: 456985 - RNA, 22 nt, Human
cuuucucaaugccggaaggcac

SEQ ID NO: 456986 - RNA, 21 nt, Human
uccuguaagcuuggguggcuc

SEQ ID NO: 456987 - RNA, 22 nt, Human
cagggguggcugcagcagaggu

SEQ ID NO: 456988 - RNA, 18 nt, Human
gguggcucagucaugggg

SEQ ID NO: 456989 - RNA, 22 nt, Human
gccauuuagggaggcaagguga

SEQ ID NO: 456990 - RNA, 22 nt, Human
uaaggccaggcuguggucggca

SEQ ID NO: 456991 - RNA, 22 nt, Human
cugaggccuaagacaugaauga

SEQ ID NO: 456992 - RNA, 22 nt, Human
ugcuuaaaaugaugauuauuuu

SEQ ID NO: 456993 - RNA, 22 nt, Human
aagaaacuguugcgugacagcg

SEQ ID NO: 456994 - RNA, 22 nt, Human
ugucuucaucuccaugcacaga

SEQ ID NO: 456995 - RNA, 22 nt, Human
gaaauucacuguauuucuuggg

SEQ ID NO: 456996 - RNA, 22 nt, Human
agaugaaaagauaagcagcaau

SEQ ID NO: 456997 - RNA, 21 nt, Human
cuggacugaggagacagucgc

SEQ ID NO: 456998 - RNA, 20 nt, Human
caagcccucuuuagccugcc

SEQ ID NO: 456999 - RNA, 22 nt, Human
aucuggcucacuuagucuagga

SEQ ID NO: 457000 - RNA, 22 nt, Human
uguuucuuuguagauauucuuu

SEQ ID NO: 457001 - RNA, 22 nt, Human
uggagcagagaugggagcccaa

SEQ ID NO: 457002 - RNA, 22 nt, Human
uacaaagucccauugccaugga

SEQ ID NO: 457003 - RNA, 22 nt, Human
aaggcagcagugcacgacugau

SEQ ID NO: 457004 - RNA, 22 nt, Human
ccaggacuuauuacaguauaac

SEQ ID NO: 457005 - RNA, 22 nt, Human
gcacugaaugcuuuuacuguaa

SEQ ID NO: 457006 - RNA, 22 nt, Human
acaggcacugucaagucaugaa

SEQ ID NO: 457007 - RNA, 22 nt, Human
cagcuugugcaaagguccuggg

SEQ ID NO: 457008 - RNA, 22 nt, Human
agcccucauggaacagcuccua

SEQ ID NO: 457009 - RNA, 22 nt, Human
gggacaggcugagacuugagcu

SEQ ID NO: 457010 - RNA, 17 nt, Human
gcacugaacaauccugu

SEQ ID NO: 457011 - RNA, 18 nt, Human
aggcacagagcauacaua

SEQ ID NO: 457012 - RNA, 18 nt, Human
agugucuggauauuuggg

SEQ ID NO: 457013 - RNA, 22 nt, Human
uaauuuaauuccauggauucua

SEQ ID NO: 457014 - RNA, 22 nt, Human
gggcuucucuuaugcuaacugg

SEQ ID NO: 457015 - RNA, 22 nt, Human
aacccuggggcagcugcuaggg

SEQ ID NO: 457016 - RNA, 22 nt, Human
uaggcuggaacuuaggcagagg

SEQ ID NO: 457017 - RNA, 22 nt, Human
agauaacuuuuggguauucaug

SEQ ID NO: 457018 - RNA, 22 nt, Human
auacaucucauguaagagauaa

SEQ ID NO: 457019 - RNA, 22 nt, Human
aaggcugauuagacugauagcu

SEQ ID NO: 457020 - RNA, 22 nt, Human
ccaggccuuccaguacgcagaa

SEQ ID NO: 457021 - RNA, 22 nt, Human
uggcucaggccacuucuuuuau

SEQ ID NO: 457022 - RNA, 21 nt, Human
uccucugcagugagguggccu

SEQ ID NO: 457023 - RNA, 22 nt, Human
cugaggugagcuucccugggcu

SEQ ID NO: 457024 - RNA, 22 nt, Human
agggcugcugcuccgggcccag

SEQ ID NO: 457025 - RNA, 22 nt, Human
ggcagccauggacacuggcuag

SEQ ID NO: 457026 - RNA, 22 nt, Human
uuuauacuccacucugcaagcg

SEQ ID NO: 457027 - RNA, 22 nt, Human
gcaucuucacacaaagccagug

SEQ ID NO: 457028 - RNA, 22 nt, Human
caacagagagaccagaaacagg

SEQ ID NO: 457029 - RNA, 22 nt, Human
cauuacaugguccaggauauau

SEQ ID NO: 457030 - RNA, 22 nt, Human
aacagaaaucauuuagggcucu

SEQ ID NO: 457031 - RNA, 22 nt, Human
aaguccagaacuccugugauag

SEQ ID NO: 457032 - RNA, 22 nt, Human
ccuguguggaaaccgcaugacg

SEQ ID NO: 457033 - RNA, 22 nt, Human
agugcagugguuaggagccagg

SEQ ID NO: 457034 - RNA, 22 nt, Human
cuguccccgcgaguccagagcu

SEQ ID NO: 457035 - RNA, 19 nt, Human
aggcugugagggaggacuc

SEQ ID NO: 457036 - RNA, 22 nt, Human
gcugagcugaggcagggcuggg

SEQ ID NO: 457037 - RNA, 19 nt, Human
uggccagguacugucugcu

SEQ ID NO: 457038 - RNA, 22 nt, Human
ccugggcaacauagggagaccc

SEQ ID NO: 457039 - RNA, 21 nt, Human
caggaaaagcggaagucuagc

SEQ ID NO: 457040 - RNA, 22 nt, Human
uggcucugucacugugagcuau

SEQ ID NO: 457041 - RNA, 22 nt, Human
cugugcaguggcagcguguggg

SEQ ID NO: 457042 - RNA, 22 nt, Human
ucccuggcuguguucaggugcg

SEQ ID NO: 457043 - RNA, 22 nt, Human
uuuauguaguuacggacuauca

SEQ ID NO: 457044 - RNA, 22 nt, Human
uggccuggugucugcgaggccu

SEQ ID NO: 457045 - RNA, 22 nt, Human
gggcucucaaggcagggcccca

SEQ ID NO: 457046 - RNA, 22 nt, Human
uccugagauguggagcuccaug

SEQ ID NO: 457047 - RNA, 22 nt, Human
gccuggccgcuccgagcuccgc

SEQ ID NO: 457048 - RNA, 22 nt, Human
augauugaaaaugacauugcca

SEQ ID NO: 457049 - RNA, 22 nt, Human
gcucugaggcugugaggugcug

SEQ ID NO: 457050 - RNA, 22 nt, Human
uguagcacagagcuuugacacu

SEQ ID NO: 457051 - RNA, 22 nt, Human
uuuccucuuccgagggggaggc

SEQ ID NO: 457052 - RNA, 22 nt, Human
gggucuggacggcugcaggaag

SEQ ID NO: 457053 - RNA, 23 nt, Human
gggagccauggguggucauggag

SEQ ID NO: 457054 - RNA, 22 nt, Human
ugucuguaagguguuuauguua

SEQ ID NO: 457055 - RNA, 22 nt, Human
gcagugugaccgagcuugcuuc

SEQ ID NO: 457056 - RNA, 22 nt, Human
aggcacuguggguguggccgga

SEQ ID NO: 457057 - RNA, 22 nt, Human
ccauaagguugaaaacuguaca

SEQ ID NO: 457058 - RNA, 22 nt, Human
uuggcuucucuuaacccuaaag

SEQ ID NO: 457059 - RNA, 22 nt, Human
aaggaguuuggguagucauaca

SEQ ID NO: 457060 - RNA, 22 nt, Human
cugcccuggucccauggcugau

SEQ ID NO: 457061 - RNA, 22 nt, Human
aggcugaggaucccuguguucu

SEQ ID NO: 457062 - RNA, 22 nt, Human
caguacuugggaaugcugggga

SEQ ID NO: 457063 - RNA, 22 nt, Human
caugggcuuuggaggcuggagg

SEQ ID NO: 457064 - RNA, 22 nt, Human
uagaggugucacuuugggaagu

SEQ ID NO: 457065 - RNA, 22 nt, Human
uggccugaauuauggcagaucu

SEQ ID NO: 457066 - RNA, 23 nt, Human
cccuggagcuagucugagcagag

SEQ ID NO: 457067 - RNA, 22 nt, Human
ggugaccucaccuggucccacc

SEQ ID NO: 457068 - RNA, 22 nt, Human
caauuucuuguuaauucucagg

SEQ ID NO: 457069 - RNA, 22 nt, Human
gagcacagggaauagacagaua

SEQ ID NO: 457070 - RNA, 22 nt, Human
augcaguggcagcuccuggugu

SEQ ID NO: 457071 - RNA, 22 nt, Human
cacagccugcugcacucaagaa

SEQ ID NO: 457072 - RNA, 22 nt, Human
acuccuggguugcaguccucaa

SEQ ID NO: 457073 - RNA, 22 nt, Human
caaaguuuggcucucaugacau

SEQ ID NO: 457074 - RNA, 23 nt, Human
ugaguucucaucuuggcuucuau

SEQ ID NO: 457075 - RNA, 22 nt, Human
caaggccaugagcagcgagugu

SEQ ID NO: 457076 - RNA, 22 nt, Human
uguauacauuuaacuagauaga

SEQ ID NO: 457077 - RNA, 22 nt, Human
gcugccacauuuucaggacuaa

SEQ ID NO: 457078 - RNA, 22 nt, Human
auuuccucaugaucauaaugca

SEQ ID NO: 457079 - RNA, 22 nt, Human
uguucuugagccuuuagaccua

SEQ ID NO: 457080 - RNA, 23 nt, Human
uggagcugacagucagagggagg

SEQ ID NO: 457081 - RNA, 22 nt, Human
ugaagcaggaaacuucuuguuu

SEQ ID NO: 457082 - RNA, 22 nt, Human
uuuaucuuuggaucuucagaaa

SEQ ID NO: 457083 - RNA, 22 nt, Human
aggcagagagcaguggccgucu

SEQ ID NO: 457084 - RNA, 22 nt, Human
uuugcauuccugccugcauuca

SEQ ID NO: 457085 - RNA, 22 nt, Human
ggcuguggggccggguacagug

SEQ ID NO: 457086 - RNA, 22 nt, Human
ucugcagcuuuuugguggggug

SEQ ID NO: 457087 - RNA, 20 nt, Human
gugggcagaugugugcaugg

SEQ ID NO: 457088 - RNA, 22 nt, Human
ucuggagagucacagugccaga

SEQ ID NO: 457089 - RNA, 22 nt, Human
aaggcaguaaaaucuaccuugc

SEQ ID NO: 457090 - RNA, 21 nt, Human
gggaaauuaggauugcucauc

SEQ ID NO: 457091 - RNA, 22 nt, Human
ccuccuuuccuguuuuccugag

SEQ ID NO: 457092 - RNA, 22 nt, Human
gggcaguuuauucuagaugguu

SEQ ID NO: 457093 - RNA, 22 nt, Human
ggcagggaaacagcugauccca

SEQ ID NO: 457094 - RNA, 22 nt, Human
acaccagggccuagccagggcg

SEQ ID NO: 457095 - RNA, 22 nt, Human
agggcaguucagccacaggcuc

SEQ ID NO: 457096 - RNA, 22 nt, Human
cugugacuagaccugcaggaga

SEQ ID NO: 457097 - RNA, 22 nt, Human
gaagcagcaaguauaggacagg

SEQ ID NO: 457098 - RNA, 22 nt, Human
gccuggcaaggcccuguugacu

SEQ ID NO: 457099 - RNA, 19 nt, Human
cagagcagugguuccugaa

SEQ ID NO: 457100 - RNA, 18 nt, Human
agacccucuaagggcagu

SEQ ID NO: 457101 - RNA, 22 nt, Human
uccuggcccggccgggccugcu

SEQ ID NO: 457102 - RNA, 22 nt, Human
auagugguuggauaugucagag

SEQ ID NO: 457103 - RNA, 22 nt, Human
ccaggguggggcaggcccacug

SEQ ID NO: 457104 - RNA, 22 nt, Human
aggcaguuguugcugagcagcu

SEQ ID NO: 457105 - RNA, 22 nt, Human
uacaacauaacgggcauucagu

SEQ ID NO: 457106 - RNA, 22 nt, Human
cccaggcagcggggucuccuug

SEQ ID NO: 457107 - RNA, 22 nt, Human
agaugcugugucuguucccuug

SEQ ID NO: 457108 - RNA, 22 nt, Human
agcagugagugggaggaccaug

SEQ ID NO: 457109 - RNA, 22 nt, Human
ggcuggagugggcuccagaguu

SEQ ID NO: 457110 - RNA, 22 nt, Human
agugaguggacccugcaaggaa

SEQ ID NO: 457111 - RNA, 22 nt, Human
cccuccccacaaagcuucacac

SEQ ID NO: 457112 - RNA, 20 nt, Human
uagaaaucuuauaaaagacu

SEQ ID NO: 457113 - RNA, 22 nt, Human
caugcagugacucagacacagg

SEQ ID NO: 457114 - RNA, 22 nt, Human
uggcugccuagucccucagccu

SEQ ID NO: 457115 - RNA, 18 nt, Human
cagggcuguggggucacu

SEQ ID NO: 457116 - RNA, 22 nt, Human
cuuucaaugugccugccuuggg

SEQ ID NO: 457117 - RNA, 22 nt, Human
ucuuugcuccacacucuagaga

SEQ ID NO: 457118 - RNA, 22 nt, Human
uugcuuuguggugguucuucca

SEQ ID NO: 457119 - RNA, 22 nt, Human
gucuccugagccuugacugcaa

SEQ ID NO: 457120 - RNA, 16 nt, Human
gggcugggggauucug

SEQ ID NO: 457121 - RNA, 18 nt, Human
guucaaggucaagagaga

SEQ ID NO: 457122 - RNA, 22 nt, Human
augugaaagagguguucagugg

SEQ ID NO: 457123 - RNA, 22 nt, Human
cauacauaugcauguguguaua

SEQ ID NO: 457124 - RNA, 20 nt, Human
cagcaggaaaagugccucag

SEQ ID NO: 457125 - RNA, 18 nt, Human
ugaggcagucagugaugg

SEQ ID NO: 457126 - RNA, 22 nt, Human
caauuucucuuuauaucucaca

SEQ ID NO: 457127 - RNA, 22 nt, Human
cagcagcugcgugcccaggccg

SEQ ID NO: 457128 - RNA, 22 nt, Human
aaggcaggaugggaaaagauuu

SEQ ID NO: 457129 - RNA, 22 nt, Human
ugcagcauuauucacaguagcc

SEQ ID NO: 457130 - RNA, 22 nt, Human
cccagccucugggcucacccaa

SEQ ID NO: 457131 - RNA, 22 nt, Human
uugcuuccaguccaagucuguu

SEQ ID NO: 457132 - RNA, 21 nt, Human
agaauucuuaaguauucuaau

SEQ ID NO: 457133 - RNA, 22 nt, Human
gaggcuggaggucaaagaugaa

SEQ ID NO: 457134 - RNA, 22 nt, Human
gcagguggcagaggugggaucu

SEQ ID NO: 457135 - RNA, 19 nt, Human
caaguucuggagauuaggg

SEQ ID NO: 457136 - RNA, 22 nt, Human
accaggggugucaacagcauuu

SEQ ID NO: 457137 - RNA, 22 nt, Human
aaauguauugcauaggauauuu

SEQ ID NO: 457138 - RNA, 22 nt, Human
aguggcagaucucuggucugga

SEQ ID NO: 457139 - RNA, 22 nt, Human
aagcugccugccacgcuagaua

SEQ ID NO: 457140 - RNA, 22 nt, Human
cagcccuuuccuucucagcuuu

SEQ ID NO: 457141 - RNA, 22 nt, Human
cccagcuaccucugcuaggaga

SEQ ID NO: 457142 - RNA, 22 nt, Human
caguguacuuggaauguaacag

SEQ ID NO: 457143 - RNA, 22 nt, Human
agauuucccacuccauguauug

SEQ ID NO: 457144 - RNA, 22 nt, Human
gggugcagggucuccagcagcu

SEQ ID NO: 457145 - RNA, 22 nt, Human
cagagcccagggccuacguccc

SEQ ID NO: 457146 - RNA, 22 nt, Human
acaggccugagauuuugcauuu

SEQ ID NO: 457147 - RNA, 22 nt, Human
guugggaagcagauggaugagc

SEQ ID NO: 457148 - RNA, 22 nt, Human
gagccaccuucaacucaggaau

SEQ ID NO: 457149 - RNA, 22 nt, Human
ggcuggaaguccaagaucaaga

SEQ ID NO: 457150 - RNA, 22 nt, Human
ugaagccaucaggaagccagca

SEQ ID NO: 457151 - RNA, 22 nt, Human
ugaaggaagaauaggcaguguu

SEQ ID NO: 457152 - RNA, 22 nt, Human
agggcugacaguaaaaguauga

SEQ ID NO: 457153 - RNA, 22 nt, Human
ccugucuguccucucaugagcc

SEQ ID NO: 457154 - RNA, 22 nt, Human
gcagagcuaucuucuggauuug

SEQ ID NO: 457155 - RNA, 22 nt, Human
ugcagcagcagggaggaggcuc

SEQ ID NO: 457156 - RNA, 22 nt, Human
gccauccucugagcacuaggca

SEQ ID NO: 457157 - RNA, 22 nt, Human
cggcagcuccgcgccguaggac

SEQ ID NO: 457158 - RNA, 22 nt, Human
ccucugggagacugcuacugag

SEQ ID NO: 457159 - RNA, 22 nt, Human
ggagcugggguuggcaucuucc

SEQ ID NO: 457160 - RNA, 22 nt, Human
ugcuguagcccugcacagugca

SEQ ID NO: 457161 - RNA, 22 nt, Human
gcucuggcuacuguggcuaccg

SEQ ID NO: 457162 - RNA, 22 nt, Human
uucauuccuucccuaagcaacu

SEQ ID NO: 457163 - RNA, 22 nt, Human
uccuggguccauggcagccgaa

SEQ ID NO: 457164 - RNA, 22 nt, Human
cugcagcuguagaggacagugg

SEQ ID NO: 457165 - RNA, 22 nt, Human
uggcugucagcugccuggugcg

SEQ ID NO: 457166 - RNA, 19 nt, Human
cccaaggcccugggcaggc

SEQ ID NO: 457167 - RNA, 22 nt, Human
uauuucugaauccaaaagguca

SEQ ID NO: 457168 - RNA, 22 nt, Human
agucccagcuucccccaugcag

SEQ ID NO: 457169 - RNA, 22 nt, Human
agcagagaagacacaggcuuca

SEQ ID NO: 457170 - RNA, 22 nt, Human
agcuuuauagaaaggaucagug

SEQ ID NO: 457171 - RNA, 22 nt, Human
agaaguuaccacauacuucucu

SEQ ID NO: 457172 - RNA, 23 nt, Human
cucccuggaguuucuggaagaug

SEQ ID NO: 457173 - RNA, 22 nt, Human
cacacacaguuuuguauucugu

SEQ ID NO: 457174 - RNA, 22 nt, Human
cucucugaggcaggccuguggg

SEQ ID NO: 457175 - RNA, 22 nt, Human
uguggccaccagagcugcuauu

SEQ ID NO: 457176 - RNA, 22 nt, Human
caaaauguucuggcaccuuuaa

SEQ ID NO: 457177 - RNA, 22 nt, Human
uccacagaauguaagauccaca

SEQ ID NO: 457178 - RNA, 22 nt, Human
augaggcacaucacagccaaug

SEQ ID NO: 457179 - RNA, 22 nt, Human
cagggagaggcaucauagggaa

SEQ ID NO: 457180 - RNA, 22 nt, Human
uccaggcacagaguuggucagu

SEQ ID NO: 457181 - RNA, 19 nt, Human
gggcagaauggcaucucag

SEQ ID NO: 457182 - RNA, 22 nt, Human
uccagggaucuuuagagucuuu

SEQ ID NO: 457183 - RNA, 22 nt, Human
accucugccacuuucuaacucu

SEQ ID NO: 457184 - RNA, 22 nt, Human
caucacagggggcuagaagucu

SEQ ID NO: 457185 - RNA, 22 nt, Human
cugagcgcaugguugcugggga

SEQ ID NO: 457186 - RNA, 22 nt, Human
guguaaggccccagguucuuua

SEQ ID NO: 457187 - RNA, 22 nt, Human
uuucauuauucaugcuaguuau

SEQ ID NO: 457188 - RNA, 20 nt, Human
aagagaagaagucuuugaaa

SEQ ID NO: 457189 - RNA, 21 nt, Human
ccccugggagcccugucagua

SEQ ID NO: 457190 - RNA, 22 nt, Human
uucuucaaaauccagcaugauu

SEQ ID NO: 457191 - RNA, 22 nt, Human
cccuggguucuggcugggcugc

SEQ ID NO: 457192 - RNA, 22 nt, Human
gcugagcuagcuaucucagucu

SEQ ID NO: 457193 - RNA, 22 nt, Human
gagggcuccauuccccgugccc

SEQ ID NO: 457194 - RNA, 22 nt, Human
ucugucaccgagggcauccaaa

SEQ ID NO: 457195 - RNA, 22 nt, Human
agccaagcacucaacuccugga

SEQ ID NO: 457196 - RNA, 22 nt, Human
ccauaagguuuggggccaugca

SEQ ID NO: 457197 - RNA, 20 nt, Human
aauaaaagaagccuucaccc

SEQ ID NO: 457198 - RNA, 20 nt, Human
cagagccaagagcagcaucu

SEQ ID NO: 457199 - RNA, 22 nt, Human
ugaagccaccgaaccagaagag

SEQ ID NO: 457200 - RNA, 22 nt, Human
uccuggccuugcuccugaugcc

SEQ ID NO: 457201 - RNA, 22 nt, Human
acugugugaaacaucaaugugu

SEQ ID NO: 457202 - RNA, 22 nt, Human
ucacaugcuacugagccagacc

SEQ ID NO: 457203 - RNA, 22 nt, Human
acagcuuuaguguggguggugc

SEQ ID NO: 457204 - RNA, 22 nt, Human
uacuuucuguccuucuguuaaa

SEQ ID NO: 457205 - RNA, 19 nt, Human
acccucucagugccugagg

SEQ ID NO: 457206 - RNA, 22 nt, Human
acaggcuuacaggcugcaagua

SEQ ID NO: 457207 - RNA, 22 nt, Human
ucuccucugcgcggcagugccc

SEQ ID NO: 457208 - RNA, 22 nt, Human
agucaaagcuacaggcauuuga

SEQ ID NO: 457209 - RNA, 22 nt, Human
uggccucugggaaagcagauuc

SEQ ID NO: 457210 - RNA, 22 nt, Human
cagcaguguacaaggugucaga

SEQ ID NO: 457211 - RNA, 22 nt, Human
uuucuacagguugauggguuug

SEQ ID NO: 457212 - RNA, 22 nt, Human
cugagcucuaaugucagccuug

SEQ ID NO: 457213 - RNA, 21 nt, Human
aggugggagaccauguagguc

SEQ ID NO: 457214 - RNA, 22 nt, Human
caggaggcuuugggauccaagu

SEQ ID NO: 457215 - RNA, 22 nt, Human
ggcuucaccaggugcaugcaug

SEQ ID NO: 457216 - RNA, 22 nt, Human
cucagaagaacccaggguccca

SEQ ID NO: 457217 - RNA, 22 nt, Human
gucaggauuuacaaacuucagu

SEQ ID NO: 457218 - RNA, 22 nt, Human
guuuauuaacugucaagugauu

SEQ ID NO: 457219 - RNA, 22 nt, Human
uacauauagacaguuacucuag

SEQ ID NO: 457220 - RNA, 19 nt, Human
ggcuggaguggccaucugu

SEQ ID NO: 457221 - RNA, 22 nt, Human
gaaggcuggaaggcaaguagga

SEQ ID NO: 457222 - RNA, 22 nt, Human
ccagccuucugagcugccugga

SEQ ID NO: 457223 - RNA, 22 nt, Human
uacauguaggugacauuuuaau

SEQ ID NO: 457224 - RNA, 22 nt, Human
caagcuccuuacauccacaggg

SEQ ID NO: 457225 - RNA, 22 nt, Human
acagagcugggaucugaaccca

SEQ ID NO: 457226 - RNA, 22 nt, Human
gucucagauaacauguauucua

SEQ ID NO: 457227 - RNA, 22 nt, Human
uucacauugguucuugauagcu

SEQ ID NO: 457228 - RNA, 22 nt, Human
ugggagcugggguuggacgucu

SEQ ID NO: 457229 - RNA, 22 nt, Human
ccacagaggacaacugccuggc

SEQ ID NO: 457230 - RNA, 21 nt, Human
ugccaggccugagcugggguc

SEQ ID NO: 457231 - RNA, 22 nt, Human
uucaggauucugugucugacaa

SEQ ID NO: 457232 - RNA, 22 nt, Human
aaggcaggagcuguaucuuauu

SEQ ID NO: 457233 - RNA, 22 nt, Human
uaaacauggauucugaucacag

SEQ ID NO: 457234 - RNA, 22 nt, Human
gccaggcauuuauugauugaau

SEQ ID NO: 457235 - RNA, 22 nt, Human
gaggagaagcuaagaaacacag

SEQ ID NO: 457236 - RNA, 22 nt, Human
caggagacaauggcuguggggc

SEQ ID NO: 457237 - RNA, 22 nt, Human
gcagggcagccacaggcccccu

SEQ ID NO: 457238 - RNA, 22 nt, Human
aaugguuuguaccuguccuugg

SEQ ID NO: 457239 - RNA, 22 nt, Human
ggccaggcugguuccuugaccu

SEQ ID NO: 457240 - RNA, 22 nt, Human
uucccaguauuaccuucaggaa

SEQ ID NO: 457241 - RNA, 22 nt, Human
cauucacucagcgaugccagua

SEQ ID NO: 457242 - RNA, 22 nt, Human
gcaugcugcaccagagccucuc

SEQ ID NO: 457243 - RNA, 22 nt, Human
agggugggcuagacucuucccc

SEQ ID NO: 457244 - RNA, 22 nt, Human
cauugaaaccuaacauaggcug

SEQ ID NO: 457245 - RNA, 22 nt, Human
cuuaaauuggaugaguuaaguu

SEQ ID NO: 457246 - RNA, 22 nt, Human
ugggcagacgggagcuugccuu

SEQ ID NO: 457247 - RNA, 22 nt, Human
caggggcucuaaugcaugauca

SEQ ID NO: 457248 - RNA, 22 nt, Human
accuuaaaacugacacauggag

SEQ ID NO: 457249 - RNA, 21 nt, Human
aagcuucccugcucuccaggg

SEQ ID NO: 457250 - RNA, 22 nt, Human
gggcucugggauucagagcaag

SEQ ID NO: 457251 - RNA, 19 nt, Human
gcugugccucucuccugcu

SEQ ID NO: 457252 - RNA, 22 nt, Human
gaagcagcugccagagaugucu

SEQ ID NO: 457253 - RNA, 22 nt, Human
agcugccuggagucauuuccug

SEQ ID NO: 457254 - RNA, 22 nt, Human
ucugccuucgcugcucccugaa

SEQ ID NO: 457255 - RNA, 22 nt, Human
uccauguggccagacacuggca

SEQ ID NO: 457256 - RNA, 22 nt, Human
ccugcacuaccuggggcugcug

SEQ ID NO: 457257 - RNA, 22 nt, Human
aaccccgcucaggcugggugag

SEQ ID NO: 457258 - RNA, 22 nt, Human
gugaaaucugaggcccaugaug

SEQ ID NO: 457259 - RNA, 23 nt, Human
aggagccaggugcagcccuugug

SEQ ID NO: 457260 - RNA, 22 nt, Human
auuguaauuuuagagaaagugg

SEQ ID NO: 457261 - RNA, 22 nt, Human
aaguguguauuguuuaugcugc

SEQ ID NO: 457262 - RNA, 22 nt, Human
cagaccucaguccucaguagga

SEQ ID NO: 457263 - RNA, 22 nt, Human
ugagggcugcuuccagagcuag

SEQ ID NO: 457264 - RNA, 22 nt, Human
ccagcucuuuuggcugagugag

SEQ ID NO: 457265 - RNA, 22 nt, Human
ggcuucugagugcucugcuguu

SEQ ID NO: 457266 - RNA, 22 nt, Human
agaagccagcuucagcugcccg

SEQ ID NO: 457267 - RNA, 20 nt, Human
cuuguacaugauaaagauuu

SEQ ID NO: 457268 - RNA, 22 nt, Human
ucugucuccucugaggugccag

SEQ ID NO: 457269 - RNA, 22 nt, Human
cucagagucugcauuucuguca

SEQ ID NO: 457270 - RNA, 22 nt, Human
gugcagggagcccagaaggucc

SEQ ID NO: 457271 - RNA, 23 nt, Human
acuuuagauaaauuaugugcaca

SEQ ID NO: 457272 - RNA, 22 nt, Human
aggagucacucagggcuucauc

SEQ ID NO: 457273 - RNA, 22 nt, Human
agggccugggucuguacuccuc

SEQ ID NO: 457274 - RNA, 18 nt, Human
uccagagcuacuguggug

SEQ ID NO: 457275 - RNA, 22 nt, Human
gcaggggcuacucugagcuucc

SEQ ID NO: 457276 - RNA, 22 nt, Human
gauuucaauccagcuuucuucu

SEQ ID NO: 457277 - RNA, 22 nt, Human
aauuagggagagguagcuaggu

SEQ ID NO: 457278 - RNA, 22 nt, Human
auuccaguucuccucucuaaag

SEQ ID NO: 457279 - RNA, 22 nt, Human
uugauacaggcucuauuucauc

SEQ ID NO: 457280 - RNA, 22 nt, Human
acuccagggcuccaucccuugu

SEQ ID NO: 457281 - RNA, 18 nt, Human
cugaggcccagagagggc

SEQ ID NO: 457282 - RNA, 22 nt, Human
uuagccauuuuauacaagugua

SEQ ID NO: 457283 - RNA, 22 nt, Human
gggcucugggaugcucuuagag

SEQ ID NO: 457284 - RNA, 22 nt, Human
auaucacaguaguuguuuaguu

SEQ ID NO: 457285 - RNA, 22 nt, Human
gaagcccacguuuggugaugua

SEQ ID NO: 457286 - RNA, 22 nt, Human
gaggcugcccaacuggagugga

SEQ ID NO: 457287 - RNA, 22 nt, Human
uguuccuaaauaugaauggaga

SEQ ID NO: 457288 - RNA, 21 nt, Human
ugcagccauucagcccuaugc

SEQ ID NO: 457289 - RNA, 22 nt, Human
ggcugcucuucuuggcgaccuc

SEQ ID NO: 457290 - RNA, 22 nt, Human
acuuggcaaguaucuauaaagu

SEQ ID NO: 457291 - RNA, 20 nt, Human
uguacacaguacuuuacaau

SEQ ID NO: 457292 - RNA, 21 nt, Human
ugcauaaagaaauacaaauac

SEQ ID NO: 457293 - RNA, 22 nt, Human
gagggacagcuaaagagaaauu

SEQ ID NO: 457294 - RNA, 22 nt, Human
aucacauucuuucaaagcaguc

SEQ ID NO: 457295 - RNA, 22 nt, Human
cacugcuuuuuuggcuauguac

SEQ ID NO: 457296 - RNA, 22 nt, Human
aaugaucuacucucauuaucuc

SEQ ID NO: 457297 - RNA, 22 nt, Human
ccacccugagccgcaagagcag

SEQ ID NO: 457298 - RNA, 22 nt, Human
auguaucaauuaucugucugca

SEQ ID NO: 457299 - RNA, 22 nt, Human
aaaguuacuaucacaaugaaau

SEQ ID NO: 457300 - RNA, 22 nt, Human
gaaaaguacacagcccaaacau

SEQ ID NO: 457301 - RNA, 22 nt, Human
cccuccagcucaaagcaaccgg

SEQ ID NO: 457302 - RNA, 21 nt, Human
ccuuuacaauuuugcauuccu

SEQ ID NO: 457303 - RNA, 22 nt, Human
agccauugaauuuagugccuuu

SEQ ID NO: 457304 - RNA, 22 nt, Human
uggucagacaaaggagaauguu

SEQ ID NO: 457305 - RNA, 22 nt, Human
ugggcuggagcuuguugcuucc

SEQ ID NO: 457306 - RNA, 22 nt, Human
cuugucugugucggauaaaacu

SEQ ID NO: 457307 - RNA, 22 nt, Human
ucccuggcugggggcugccuug

SEQ ID NO: 457308 - RNA, 22 nt, Human
ccuggcugcuuucacuauggag

SEQ ID NO: 457309 - RNA, 22 nt, Human
gcagccagggagagaaccaggg

SEQ ID NO: 457310 - RNA, 22 nt, Human
gccaggcagcuagcaaccccug

SEQ ID NO: 457311 - RNA, 22 nt, Human
aacuuucaggcaaugaauauuu

SEQ ID NO: 457312 - RNA, 22 nt, Human
guguacauagaauugugcuuug

SEQ ID NO: 457313 - RNA, 22 nt, Human
uucaaugaggauagaacuggau

SEQ ID NO: 457314 - RNA, 22 nt, Human
agccaaggcagcuagagcucug

SEQ ID NO: 457315 - RNA, 22 nt, Human
gagacguggccuuugccugagc

SEQ ID NO: 457316 - RNA, 22 nt, Human
ucaguguccggagccugagugc

SEQ ID NO: 457317 - RNA, 22 nt, Human
agagcuggguggacuuguaguu

SEQ ID NO: 457318 - RNA, 22 nt, Human
caagggcauugcuugggaccuu

SEQ ID NO: 457319 - RNA, 22 nt, Human
auaacagaugugaagugcuaau

SEQ ID NO: 457320 - RNA, 22 nt, Human
gucucccacuuucuggccucuu

SEQ ID NO: 457321 - RNA, 22 nt, Human
ugcaggcuguaaucugaggcua

SEQ ID NO: 457322 - RNA, 22 nt, Human
uccuggaggggacagcaugggc

SEQ ID NO: 457323 - RNA, 22 nt, Human
aaagcagguugcaauuacagug

SEQ ID NO: 457324 - RNA, 22 nt, Human
cuucccagacgggguggcagcc

SEQ ID NO: 457325 - RNA, 22 nt, Human
cugccuguuuucugauagauuu

SEQ ID NO: 457326 - RNA, 22 nt, Human
uauguuaaauguuugauguuua

SEQ ID NO: 457327 - RNA, 22 nt, Human
aggggcuggaguucgagguuac

SEQ ID NO: 457328 - RNA, 22 nt, Human
aucuggcugacuuugugggaca

SEQ ID NO: 457329 - RNA, 22 nt, Human
cugucugucaaguucaucucca

SEQ ID NO: 457330 - RNA, 22 nt, Human
ccagcuccucuucccaguguca

SEQ ID NO: 457331 - RNA, 22 nt, Human
aagaugcacaauguggcaauua

SEQ ID NO: 457332 - RNA, 22 nt, Human
guucauuuuacuguaaauagca

SEQ ID NO: 457333 - RNA, 22 nt, Human
guuuucaugucuauugggcaua

SEQ ID NO: 457334 - RNA, 22 nt, Human
aggcuuccucgugccuuagaua

SEQ ID NO: 457335 - RNA, 22 nt, Human
cacccacccacugcucauuggc

SEQ ID NO: 457336 - RNA, 22 nt, Human
uuuuucaugagacuagaaguca

SEQ ID NO: 457337 - RNA, 22 nt, Human
uccaggcaaagggacuagcagg

SEQ ID NO: 457338 - RNA, 22 nt, Human
ccagucccaggcagaaauccag

SEQ ID NO: 457339 - RNA, 22 nt, Human
gcagacagccagacugcacugg

SEQ ID NO: 457340 - RNA, 22 nt, Human
ucuggagcuuguuucagauggu

SEQ ID NO: 457341 - RNA, 22 nt, Human
aaacacuagcaggaagcacuga

SEQ ID NO: 457342 - RNA, 22 nt, Human
acugugcuuucucuggaggcau

SEQ ID NO: 457343 - RNA, 22 nt, Human
ggggauggaauguaguagugau

SEQ ID NO: 457344 - RNA, 22 nt, Human
ggccugagcuugggcagcguau

SEQ ID NO: 457345 - RNA, 23 nt, Human
gcugggcuuacucuuucagugag

SEQ ID NO: 457346 - RNA, 22 nt, Human
cuggcuccuccaaggccuggag

SEQ ID NO: 457347 - RNA, 22 nt, Human
cuccugaguaguagcauuguca

SEQ ID NO: 457348 - RNA, 22 nt, Human
gcugggagcaaagccaugcaua

SEQ ID NO: 457349 - RNA, 23 nt, Human
agaaaaguucauaccuuuuuaac

SEQ ID NO: 457350 - RNA, 22 nt, Human
ugccuacauuccuugcuuaugg

SEQ ID NO: 457351 - RNA, 22 nt, Human
auugacaagcaguaugucuuag

SEQ ID NO: 457352 - RNA, 22 nt, Human
guaugcaucgacucaagucuga

SEQ ID NO: 457353 - RNA, 21 nt, Human
ugcucaugcaaugcaugucca

SEQ ID NO: 457354 - RNA, 22 nt, Human
uccucagaugcucuuggacgcc

SEQ ID NO: 457355 - RNA, 22 nt, Human
gccagguguccucacagugagg

SEQ ID NO: 457356 - RNA, 22 nt, Human
aaaggugacacucugccagcug

SEQ ID NO: 457357 - RNA, 20 nt, Human
uguucacaguaguugcugcu

SEQ ID NO: 457358 - RNA, 22 nt, Human
caacaguguugcaaucugaaaa

SEQ ID NO: 457359 - RNA, 22 nt, Human
caauuucuggaacuaauucuga

SEQ ID NO: 457360 - RNA, 23 nt, Human
agagccugaaagacuucuggcac

SEQ ID NO: 457361 - RNA, 22 nt, Human
aagcugccaaugguaagcugcu

SEQ ID NO: 457362 - RNA, 22 nt, Human
ucugaggcuauguucaggcuaa

SEQ ID NO: 457363 - RNA, 22 nt, Human
accugccuucucaaggacauga

SEQ ID NO: 457364 - RNA, 22 nt, Human
acagcuggaggucugugagcac

SEQ ID NO: 457365 - RNA, 22 nt, Human
ugcuuuauaucucucuucuuag

SEQ ID NO: 457366 - RNA, 22 nt, Human
aagggcaggcagagaucauaua

SEQ ID NO: 457367 - RNA, 22 nt, Human
cuggaagaggaagccagcugga

SEQ ID NO: 457368 - RNA, 22 nt, Human
gcagccaggaaagcuggacccu

SEQ ID NO: 457369 - RNA, 22 nt, Human
aacaugaaaguugcuaagugca

SEQ ID NO: 457370 - RNA, 22 nt, Human
uguauuagagcaguagaauuau

SEQ ID NO: 457371 - RNA, 22 nt, Human
cccagccaaggugcugguguug

SEQ ID NO: 457372 - RNA, 22 nt, Human
acaggcauugggauggagguug

SEQ ID NO: 457373 - RNA, 22 nt, Human
caaagccaggcuuucuaaugua

SEQ ID NO: 457374 - RNA, 22 nt, Human
gcccagcagcugguggagaagg

SEQ ID NO: 457375 - RNA, 22 nt, Human
gccagaaagaggaggaccuggg

SEQ ID NO: 457376 - RNA, 22 nt, Human
ggccucugccucaucugggcac

SEQ ID NO: 457377 - RNA, 22 nt, Human
uggcagaguggaccauacucaa

SEQ ID NO: 457378 - RNA, 22 nt, Human
uggcagcauguuauguaaggaa

SEQ ID NO: 457379 - RNA, 22 nt, Human
gagagcugcauucucagacaca

SEQ ID NO: 457380 - RNA, 22 nt, Human
ugucagagcaaugagguucagc

SEQ ID NO: 457381 - RNA, 22 nt, Human
acuguucauuuguccuguaucu

SEQ ID NO: 457382 - RNA, 22 nt, Human
gcaggagucacugacuuggucc

SEQ ID NO: 457383 - RNA, 19 nt, Human
ucugucacuggggguauuc

SEQ ID NO: 457384 - RNA, 22 nt, Human
aggcacugaaagguggccagag

SEQ ID NO: 457385 - RNA, 18 nt, Human
cucaccauucugcccaau

SEQ ID NO: 457386 - RNA, 22 nt, Human
aaacagaaggguagguaaacau

SEQ ID NO: 457387 - RNA, 22 nt, Human
cagggcagggagcuuagaauga

SEQ ID NO: 457388 - RNA, 23 nt, Human
uggcucugugucacauacaggau

SEQ ID NO: 457389 - RNA, 22 nt, Human
aauaacaggcucaucagaugcu

SEQ ID NO: 457390 - RNA, 22 nt, Human
caggaggccaacugugggacuu

SEQ ID NO: 457391 - RNA, 22 nt, Human
agagcugugaaaaugagguuug

SEQ ID NO: 457392 - RNA, 22 nt, Human
cagcucugugggagcguaugug

SEQ ID NO: 457393 - RNA, 22 nt, Human
ucaccaggauuccuaucaguag

SEQ ID NO: 457394 - RNA, 22 nt, Human
agaggagcugggaggcccucgu

SEQ ID NO: 457395 - RNA, 22 nt, Human
ugacuuccugcacucaggugau

SEQ ID NO: 457396 - RNA, 22 nt, Human
uaaaggcucacuggcuuggggu

SEQ ID NO: 457397 - RNA, 22 nt, Human
cagagccaggccugcccucuuu

SEQ ID NO: 457398 - RNA, 22 nt, Human
auguacauuuagaucauuucug

SEQ ID NO: 457399 - RNA, 22 nt, Human
cugcagccuaggugcagcuggg

SEQ ID NO: 457400 - RNA, 22 nt, Human
gggagggaucugcuaggcaaug

SEQ ID NO: 457401 - RNA, 22 nt, Human
cuuccagagauagggccucaag

SEQ ID NO: 457402 - RNA, 20 nt, Human
cuuccacacaagaagcacag

SEQ ID NO: 457403 - RNA, 22 nt, Human
gccaggugcauggcugagucuc

SEQ ID NO: 457404 - RNA, 21 nt, Human
ugggcagauggcaguguggcu

SEQ ID NO: 457405 - RNA, 23 nt, Human
acacaaggguaacugccagccau

SEQ ID NO: 457406 - RNA, 22 nt, Human
ccuggcugggccugauuucuca

SEQ ID NO: 457407 - RNA, 22 nt, Human
cacugccuccccaggcuccaca

SEQ ID NO: 457408 - RNA, 22 nt, Human
ggagaggaaaugccagcacuuc

SEQ ID NO: 457409 - RNA, 22 nt, Human
aagggaggccagagguuuugca

SEQ ID NO: 457410 - RNA, 22 nt, Human
ucaggagcagcaugggugagag

SEQ ID NO: 457411 - RNA, 22 nt, Human
caaaguuaucaacugcaacauu

SEQ ID NO: 457412 - RNA, 22 nt, Human
gccugggaagacuaagugggag

SEQ ID NO: 457413 - RNA, 22 nt, Human
agucccagcuacucaagaggcu

SEQ ID NO: 457414 - RNA, 23 nt, Human
cuggcucauccugguugcagugg

SEQ ID NO: 457415 - RNA, 22 nt, Human
accagagcucuucagcacagga

SEQ ID NO: 457416 - RNA, 22 nt, Human
gcuaucuuucugcaccauaauu

SEQ ID NO: 457417 - RNA, 22 nt, Human
aauaguguuguucacucaggag

SEQ ID NO: 457418 - RNA, 22 nt, Human
uuauuuuaccuuccucugagcu

SEQ ID NO: 457419 - RNA, 22 nt, Human
uauguacagggauagaacuuga

SEQ ID NO: 457420 - RNA, 22 nt, Human
cuccugggaauuuaguugugag

SEQ ID NO: 457421 - RNA, 22 nt, Human
aaagcaaugggucuaagguaaa

SEQ ID NO: 457422 - RNA, 22 nt, Human
uuuauucugugcuacaugaaga

SEQ ID NO: 457423 - RNA, 22 nt, Human
gaaauccaguucccuacucuua

SEQ ID NO: 457424 - RNA, 22 nt, Human
uuuccacugggcacggggccag

SEQ ID NO: 457425 - RNA, 22 nt, Human
gagccagggcugugagcugagc

SEQ ID NO: 457426 - RNA, 22 nt, Human
gguggccuuucaguggaucagg

SEQ ID NO: 457427 - RNA, 22 nt, Human
gauuuccuagacauggggcaga

SEQ ID NO: 457428 - RNA, 21 nt, Human
ggcagcacuaccugaagcaua

SEQ ID NO: 457429 - RNA, 22 nt, Human
uccauuggucucugugcccagg

SEQ ID NO: 457430 - RNA, 22 nt, Human
acacugugcagauucccuguga

SEQ ID NO: 457431 - RNA, 22 nt, Human
agggccagcugaugagaaugag

SEQ ID NO: 457432 - RNA, 22 nt, Human
gacagggccgcagauggagacu

SEQ ID NO: 457433 - RNA, 22 nt, Human
aggccagaaauuuggaguaugu

SEQ ID NO: 457434 - RNA, 22 nt, Human
ucacugcagacaaccucaguca

SEQ ID NO: 457435 - RNA, 22 nt, Human
cccagcucucgcacuuacuagc

SEQ ID NO: 457436 - RNA, 22 nt, Human
gcaggaguguauuugcauguaa

SEQ ID NO: 457437 - RNA, 22 nt, Human
ugugugcagccucugucuuugg

SEQ ID NO: 457438 - RNA, 22 nt, Human
cugugaauuaaguauuguuauc

SEQ ID NO: 457439 - RNA, 20 nt, Human
aaggcacuaugucugcuagc

SEQ ID NO: 457440 - RNA, 22 nt, Human
cugaggcuggcguuugaggaag

SEQ ID NO: 457441 - RNA, 22 nt, Human
augcugcacaagccacauguag

SEQ ID NO: 457442 - RNA, 21 nt, Human
uggcugaguggaugcaugaau

SEQ ID NO: 457443 - RNA, 22 nt, Human
agucucagaaaauaugcuuuuu

SEQ ID NO: 457444 - RNA, 22 nt, Human
uucaggauucucucccauuuac

SEQ ID NO: 457445 - RNA, 22 nt, Human
ugaggcuccagccaggccagca

SEQ ID NO: 457446 - RNA, 22 nt, Human
gagggaccuuuacacagacauu

SEQ ID NO: 457447 - RNA, 22 nt, Human
uggaagcaucacuucuugccug

SEQ ID NO: 457448 - RNA, 22 nt, Human
caugagcugcugggagccuguc

SEQ ID NO: 457449 - RNA, 22 nt, Human
ucucaggccccugaguuucucu

SEQ ID NO: 457450 - RNA, 22 nt, Human
aaguccagcucuaaauaucuga

SEQ ID NO: 457451 - RNA, 22 nt, Human
aaggcccuggccccagcuucuu

SEQ ID NO: 457452 - RNA, 22 nt, Human
gugggcuucuguuagggaggcu

SEQ ID NO: 457453 - RNA, 22 nt, Human
cucucugagugagggacaagcu

SEQ ID NO: 457454 - RNA, 22 nt, Human
aaaguggucaccuucucauuuc

SEQ ID NO: 457455 - RNA, 22 nt, Human
aaaugcagguucuugagccaag

SEQ ID NO: 457456 - RNA, 22 nt, Human
uccuucaggguugaggccgacu

SEQ ID NO: 457457 - RNA, 22 nt, Human
aaagccacugcauguguaguau

SEQ ID NO: 457458 - RNA, 22 nt, Human
aaagggaggggcgauaagccgg

SEQ ID NO: 457459 - RNA, 22 nt, Human
gcacagggcaacaggucuguua

SEQ ID NO: 457460 - RNA, 22 nt, Human
cagucccaggguugguucagcu

SEQ ID NO: 457461 - RNA, 22 nt, Human
gcucugcugagauaucugggag

SEQ ID NO: 457462 - RNA, 22 nt, Human
ucugagagcuguagaagccuau

SEQ ID NO: 457463 - RNA, 22 nt, Human
agcaggugacccaagcaggcug

SEQ ID NO: 457464 - RNA, 22 nt, Human
uucacaggauauaugugcaggg

SEQ ID NO: 457465 - RNA, 22 nt, Human
ugcaggagacauaauagggacu

SEQ ID NO: 457466 - RNA, 22 nt, Human
agugaaauggaugcugcuacug

SEQ ID NO: 457467 - RNA, 22 nt, Human
cuguuuuugugcugugucuccc

SEQ ID NO: 457468 - RNA, 20 nt, Human
accuugaacccgccagccau

SEQ ID NO: 457469 - RNA, 22 nt, Human
gaggccuggugugucucccgcu

SEQ ID NO: 457470 - RNA, 22 nt, Human
ggcugugcgggcagccguggga

SEQ ID NO: 457471 - RNA, 22 nt, Human
ggcucaggagaggggcuaaaag

SEQ ID NO: 457472 - RNA, 18 nt, Human
acaggccucaguccugca

SEQ ID NO: 457473 - RNA, 21 nt, Human
gagcucucaggcaagaagcag

SEQ ID NO: 457474 - RNA, 22 nt, Human
gggcaagcacagcgagcgugcg

SEQ ID NO: 457475 - RNA, 22 nt, Human
ucugucuccugccagugccucu

SEQ ID NO: 457476 - RNA, 22 nt, Human
cagugcuguuguaagcucauug

SEQ ID NO: 457477 - RNA, 22 nt, Human
ucagccugcuccaagugcugcc

SEQ ID NO: 457478 - RNA, 22 nt, Human
ucagagcuuaucucuugcugga

SEQ ID NO: 457479 - RNA, 22 nt, Human
ugucaugcagguuuguuauaga

SEQ ID NO: 457480 - RNA, 22 nt, Human
agccucucuccagcuuggcaga

SEQ ID NO: 457481 - RNA, 22 nt, Human
uuugcuauuuuucugugcagcu

SEQ ID NO: 457482 - RNA, 22 nt, Human
ugcugucccuaagucucuucaa

SEQ ID NO: 457483 - RNA, 18 nt, Human
gggcccuggcguccgccc

SEQ ID NO: 457484 - RNA, 22 nt, Human
gcacccagcccagggcgugaug

SEQ ID NO: 457485 - RNA, 22 nt, Human
uuucuuauauucugucauuguu

SEQ ID NO: 457486 - RNA, 22 nt, Human
gcuguggaugcuauggaucauc

SEQ ID NO: 457487 - RNA, 22 nt, Human
cuccagggagcuuggaaagacc

SEQ ID NO: 457488 - RNA, 22 nt, Human
uccugcagaccucagucagguc

SEQ ID NO: 457489 - RNA, 22 nt, Human
uacuguuuuuuagacucauggu

SEQ ID NO: 457490 - RNA, 22 nt, Human
caggagcagaggguggucagca

SEQ ID NO: 457491 - RNA, 22 nt, Human
cccugcagaucuaggguccuuc

SEQ ID NO: 457492 - RNA, 22 nt, Human
uggcugagguuaugcugguugu

SEQ ID NO: 457493 - RNA, 22 nt, Human
gaagcagcagcuggggacaguu

SEQ ID NO: 457494 - RNA, 22 nt, Human
agcugcuccuuuccugcaggcg

SEQ ID NO: 457495 - RNA, 22 nt, Human
uucagucagugacuaagcaguu

SEQ ID NO: 457496 - RNA, 22 nt, Human
aauuuuauuagaaggcaagggg

SEQ ID NO: 457497 - RNA, 22 nt, Human
auuauguagguuaggugguugu

SEQ ID NO: 457498 - RNA, 22 nt, Human
aggcucugcagugcuggaggac

SEQ ID NO: 457499 - RNA, 16 nt, Human
aggcucagaggcugga

SEQ ID NO: 457500 - RNA, 21 nt, Human
uuugaaagcuacaucuauagc

SEQ ID NO: 457501 - RNA, 22 nt, Human
ugaagccacagagcaucugccu

SEQ ID NO: 457502 - RNA, 22 nt, Human
ggccugcugacccaaguccugu

SEQ ID NO: 457503 - RNA, 22 nt, Human
gucagcacuuuuccgaggcaga

SEQ ID NO: 457504 - RNA, 22 nt, Human
ggcagggcuugucucugugaug

SEQ ID NO: 457505 - RNA, 17 nt, Human
ucagagggaugagcagg

SEQ ID NO: 457506 - RNA, 22 nt, Human
ucaaugauaguacaaucagccu

SEQ ID NO: 457507 - RNA, 22 nt, Human
aggcacugggggaugagcaagg

SEQ ID NO: 457508 - RNA, 22 nt, Human
gaccagagaaaggcacuggaag

SEQ ID NO: 457509 - RNA, 22 nt, Human
cccagggauuauaaaggugaaa

SEQ ID NO: 457510 - RNA, 22 nt, Human
cucagaguccccacaucugggu

SEQ ID NO: 457511 - RNA, 22 nt, Human
gcucugcuugcaucaugacugc

SEQ ID NO: 457512 - RNA, 22 nt, Human
uaacagaaguuguucauugugg

SEQ ID NO: 457513 - RNA, 22 nt, Human
cugggguggugcaggccucaug

SEQ ID NO: 457514 - RNA, 22 nt, Human
ccugagacaugaaccaggcucc

SEQ ID NO: 457515 - RNA, 22 nt, Human
aaauccuaauaaugcacuagug

SEQ ID NO: 457516 - RNA, 22 nt, Human
gaaaccucuuagccucucuuug

SEQ ID NO: 457517 - RNA, 22 nt, Human
ggcucaggggccaggccugucc

SEQ ID NO: 457518 - RNA, 22 nt, Human
agaagauuuagguugacgcuau

SEQ ID NO: 457519 - RNA, 22 nt, Human
ggcucuggagacauguggagag

SEQ ID NO: 457520 - RNA, 22 nt, Human
caggaggaggguacaccaucag

SEQ ID NO: 457521 - RNA, 19 nt, Human
ggcugggucuggcagguuc

SEQ ID NO: 457522 - RNA, 22 nt, Human
cccuggaagguucucuggcuca

SEQ ID NO: 457523 - RNA, 22 nt, Human
ugaggcagcccacuuuccuuag

SEQ ID NO: 457524 - RNA, 22 nt, Human
agcagggcuccauuucacugcc

SEQ ID NO: 457525 - RNA, 22 nt, Human
gggauggggggaagcguccaug

SEQ ID NO: 457526 - RNA, 22 nt, Human
uggaagcagugauucuugucug

SEQ ID NO: 457527 - RNA, 22 nt, Human
augauacaucuucaugucagug

SEQ ID NO: 457528 - RNA, 22 nt, Human
uugcaacaucugaacauuuauc

SEQ ID NO: 457529 - RNA, 21 nt, Human
acaugcauagagagauuucug

SEQ ID NO: 457530 - RNA, 22 nt, Human
uguguacagcaggauuucucaa

SEQ ID NO: 457531 - RNA, 22 nt, Human
acagggcauuuccucuaugugu

SEQ ID NO: 457532 - RNA, 22 nt, Human
cuggggcccaucgagggcugag

SEQ ID NO: 457533 - RNA, 22 nt, Human
ggggggugcugaucaguggagc

SEQ ID NO: 457534 - RNA, 22 nt, Human
uuaaauuccagccucauaauag

SEQ ID NO: 457535 - RNA, 22 nt, Human
cggcagagcggcgagccccucc

SEQ ID NO: 457536 - RNA, 22 nt, Human
ucuggagcuggcagggcccugg

SEQ ID NO: 457537 - RNA, 22 nt, Human
aaacuguauauuuauggcaugu

SEQ ID NO: 457538 - RNA, 22 nt, Human
cagcauuggguuaccuuuguuu

SEQ ID NO: 457539 - RNA, 22 nt, Human
aauacagaggggucacaauuca

SEQ ID NO: 457540 - RNA, 22 nt, Human
agccucugauggcucccaagga

SEQ ID NO: 457541 - RNA, 22 nt, Human
uagcugccuaugugauaagaga

SEQ ID NO: 457542 - RNA, 22 nt, Human
augcaagauguauagaagacuu

SEQ ID NO: 457543 - RNA, 22 nt, Human
ccaggcagcucugauuuauguc

SEQ ID NO: 457544 - RNA, 22 nt, Human
ggggcggggcucugagaagcau

SEQ ID NO: 457545 - RNA, 22 nt, Human
gggagucugggcuagacuccuu

SEQ ID NO: 457546 - RNA, 22 nt, Human
cuagaaaugcucaagagaaagu

SEQ ID NO: 457547 - RNA, 22 nt, Human
acuggcugaaguuuacuuuuug

SEQ ID NO: 457548 - RNA, 22 nt, Human
agaaacuucagcuauucuuuug

SEQ ID NO: 457549 - RNA, 20 nt, Human
uggaccugucucuuuaggga

SEQ ID NO: 457550 - RNA, 22 nt, Human
cauuagggccaccauaacaaaa

SEQ ID NO: 457551 - RNA, 21 nt, Human
augggcagaggcagagaggcu

SEQ ID NO: 457552 - RNA, 22 nt, Human
ugagguaggugguaagagauac

SEQ ID NO: 457553 - RNA, 22 nt, Human
gaaggagacccugaagaugcug

SEQ ID NO: 457554 - RNA, 22 nt, Human
aggcagagcugauguucuguga

SEQ ID NO: 457555 - RNA, 22 nt, Human
agcugccugggcuuguacaccu

SEQ ID NO: 457556 - RNA, 22 nt, Human
ucucagucagccuugauguccc

SEQ ID NO: 457557 - RNA, 22 nt, Human
uuaaugcagaaaucaaacugac

SEQ ID NO: 457558 - RNA, 22 nt, Human
uuucaguguaagguuuccagga

SEQ ID NO: 457559 - RNA, 22 nt, Human
ugcagcaggcacaggacggaag

SEQ ID NO: 457560 - RNA, 22 nt, Human
cacauaauacauguuccacuua

SEQ ID NO: 457561 - RNA, 22 nt, Human
agauacaugucaagagacuuau

SEQ ID NO: 457562 - RNA, 22 nt, Human
ugggcagacuaaggucaaagcu

SEQ ID NO: 457563 - RNA, 22 nt, Human
cucaggguaaugaaagacgaau

SEQ ID NO: 457564 - RNA, 21 nt, Human
guguuuccuguuuauggcuug

SEQ ID NO: 457565 - RNA, 22 nt, Human
ccagggugaccagcuggccuag

SEQ ID NO: 457566 - RNA, 22 nt, Human
uggaauggaaacaaacugagga

SEQ ID NO: 457567 - RNA, 22 nt, Human
aucccugcccucauggagcuua

SEQ ID NO: 457568 - RNA, 22 nt, Human
ugcaggaauuuuuugcagaaag

SEQ ID NO: 457569 - RNA, 22 nt, Human
cauuuagagucuugcaauuuua

SEQ ID NO: 457570 - RNA, 22 nt, Human
cuggcuuucucugugguguuca

SEQ ID NO: 457571 - RNA, 22 nt, Human
ccagagagaguacugggcucug

SEQ ID NO: 457572 - RNA, 22 nt, Human
caggacccaaccucccugcucu

SEQ ID NO: 457573 - RNA, 22 nt, Human
uacauaauuaaucuuuaaguuc

SEQ ID NO: 457574 - RNA, 23 nt, Human
caugccaguuugugcaggcagau

SEQ ID NO: 457575 - RNA, 22 nt, Human
ucaaagcaucagucaauuuagg

SEQ ID NO: 457576 - RNA, 22 nt, Human
uuagaaagaacuuuagauauca

SEQ ID NO: 457577 - RNA, 22 nt, Human
ggagggcugccagguggagcgg

SEQ ID NO: 457578 - RNA, 22 nt, Human
aggcucccaagcacugacccca

SEQ ID NO: 457579 - RNA, 22 nt, Human
acaaaguuaacaguuggauagu

SEQ ID NO: 457580 - RNA, 22 nt, Human
caggugccgggaaugcagcaau

SEQ ID NO: 457581 - RNA, 22 nt, Human
uuagauaauguuauuguaauuu

SEQ ID NO: 457582 - RNA, 22 nt, Human
gcagcuuuguaaaguaugaagc

SEQ ID NO: 457583 - RNA, 23 nt, Human
ucucagugaaucucagaauucgc

SEQ ID NO: 457584 - RNA, 23 nt, Human
gcaguggaaugucucuguuugga

SEQ ID NO: 457585 - RNA, 22 nt, Human
ccaaaguccauaguuuacuuua

SEQ ID NO: 457586 - RNA, 22 nt, Human
acugucugcccugagaugccag

SEQ ID NO: 457587 - RNA, 22 nt, Human
acaggcugacuuccugccaugu

SEQ ID NO: 457588 - RNA, 22 nt, Human
cccucugcaggcuggaccugcc

SEQ ID NO: 457589 - RNA, 22 nt, Human
agccuccuguagcccucaccca

SEQ ID NO: 457590 - RNA, 21 nt, Human
aagagcugucaggaaggcugc

SEQ ID NO: 457591 - RNA, 22 nt, Human
gacauucacagguaaacauucc

SEQ ID NO: 457592 - RNA, 22 nt, Human
gaggcuggaauauuagaaaugu

SEQ ID NO: 457593 - RNA, 23 nt, Human
aguuuguaaagaaauauuugcac

SEQ ID NO: 457594 - RNA, 22 nt, Human
agugcacaccuuaguacaaagu

SEQ ID NO: 457595 - RNA, 22 nt, Human
ugggaggagcccucugggaagg

SEQ ID NO: 457596 - RNA, 22 nt, Human
cucugaagggagggccaagccc

SEQ ID NO: 457597 - RNA, 22 nt, Human
ucagcugccuuucccaugcuag

SEQ ID NO: 457598 - RNA, 22 nt, Human
uuugaaauaugaggcauuauga

SEQ ID NO: 457599 - RNA, 22 nt, Human
ccucaugguacuuacuguagcu

SEQ ID NO: 457600 - RNA, 22 nt, Human
cucuggaaaaccacuagcagga

SEQ ID NO: 457601 - RNA, 22 nt, Human
uuccauaacugaccgaaugcau

SEQ ID NO: 457602 - RNA, 22 nt, Human
ggcugccugcucaggugcggcg

SEQ ID NO: 457603 - RNA, 22 nt, Human
gcugccuggaauaacggcuggc

SEQ ID NO: 457604 - RNA, 22 nt, Human
ggcuugggagcaggcaugugac

SEQ ID NO: 457605 - RNA, 23 nt, Human
uccagcagccaagaaggguagaa

SEQ ID NO: 457606 - RNA, 22 nt, Human
aaaugugucauauucaaaguca

SEQ ID NO: 457607 - RNA, 22 nt, Human
ggaugcugacuuuggagcaugg

SEQ ID NO: 457608 - RNA, 22 nt, Human
ucuggagcgaggucccugucug

SEQ ID NO: 457609 - RNA, 22 nt, Human
uucuugauuucaugcaguuaag

SEQ ID NO: 457610 - RNA, 22 nt, Human
aagggcagccugacucacgguc

SEQ ID NO: 457611 - RNA, 22 nt, Human
ccucagcugcuucccuggagcc

SEQ ID NO: 457612 - RNA, 22 nt, Human
ugaaugauguauaauauugaga

SEQ ID NO: 457613 - RNA, 22 nt, Human
ugaagaugucagcagggguggu

SEQ ID NO: 457614 - RNA, 22 nt, Human
aauuuguuacacagcaauauaa

SEQ ID NO: 457615 - RNA, 22 nt, Human
accaggagccacaggaggagcc

SEQ ID NO: 457616 - RNA, 22 nt, Human
aggcugcucugcgaagucagcu

SEQ ID NO: 457617 - RNA, 22 nt, Human
cuacagcagagcuacacuaacu

SEQ ID NO: 457618 - RNA, 22 nt, Human
gagccuggggacccuccugagu

SEQ ID NO: 457619 - RNA, 22 nt, Human
agcucccagcuccuuugagaga

SEQ ID NO: 457620 - RNA, 22 nt, Human
aagggcugcaauccaaaacacu

SEQ ID NO: 457621 - RNA, 22 nt, Human
ccacaggcugcugcaggucccg

SEQ ID NO: 457622 - RNA, 22 nt, Human
auguaacuguuauauuuuguug

SEQ ID NO: 457623 - RNA, 22 nt, Human
aggcucagccccugggaggaga

SEQ ID NO: 457624 - RNA, 22 nt, Human
uaccucaugcuguacagcacgu

SEQ ID NO: 457625 - RNA, 22 nt, Human
uuagaaaacauaagugguaaag

SEQ ID NO: 457626 - RNA, 22 nt, Human
uucccaugccuggccccuaucc

SEQ ID NO: 457627 - RNA, 22 nt, Human
uggcugaguuccuggcacacgg

SEQ ID NO: 457628 - RNA, 22 nt, Human
ugccuggcaacuguggugggcu

SEQ ID NO: 457629 - RNA, 22 nt, Human
cuggccaacuugcuuguuggca

SEQ ID NO: 457630 - RNA, 22 nt, Human
caugaaugcuggguucauguaa

SEQ ID NO: 457631 - RNA, 22 nt, Human
auguauguuaguguauuaucua

SEQ ID NO: 457632 - RNA, 22 nt, Human
uucaggagaaaguucaguacuu

SEQ ID NO: 457633 - RNA, 22 nt, Human
uacuuguuaucaucuuuuccuu

SEQ ID NO: 457634 - RNA, 22 nt, Human
ucugggcugggagcguguggac

SEQ ID NO: 457635 - RNA, 22 nt, Human
ugagagggcccagagcacacca

SEQ ID NO: 457636 - RNA, 22 nt, Human
gggcacagcugcuacccagugc

SEQ ID NO: 457637 - RNA, 22 nt, Human
caugcacuuaccugaaauucaa

SEQ ID NO: 457638 - RNA, 22 nt, Human
uucacagauguauuggaacucc

SEQ ID NO: 457639 - RNA, 22 nt, Human
uaaugcacagaauugacauggg

SEQ ID NO: 457640 - RNA, 22 nt, Human
ccaggccuagccccugagggua

SEQ ID NO: 457641 - RNA, 22 nt, Human
accaggaggccuggagcacaaa

SEQ ID NO: 457642 - RNA, 22 nt, Human
aucuacagugcacaggacagcc

SEQ ID NO: 457643 - RNA, 22 nt, Human
gauuuccucacuaacauccauc

SEQ ID NO: 457644 - RNA, 22 nt, Human
acagggcagugucuugaaaaau

SEQ ID NO: 457645 - RNA, 22 nt, Human
ggaggaccugcuggcccugcaa

SEQ ID NO: 457646 - RNA, 21 nt, Human
caaagccaggcaacucucucc

SEQ ID NO: 457647 - RNA, 22 nt, Human
ucuggcuccugaguccaugcuc

SEQ ID NO: 457648 - RNA, 22 nt, Human
gagagcugggcuuugggugaag

SEQ ID NO: 457649 - RNA, 22 nt, Human
gccuggaguuguggugaagcca

SEQ ID NO: 457650 - RNA, 22 nt, Human
acaaagucucuaauaaucuucu

SEQ ID NO: 457651 - RNA, 21 nt, Human
agcuuccugcagugggagguc

SEQ ID NO: 457652 - RNA, 22 nt, Human
aagguacaccaaaguucaaguu

SEQ ID NO: 457653 - RNA, 22 nt, Human
gcagcacauauaaacaaagaga

SEQ ID NO: 457654 - RNA, 22 nt, Human
augcuuuuccuaaaaugaugcc

SEQ ID NO: 457655 - RNA, 22 nt, Human
ugcauuucagaagaaaauucgg

SEQ ID NO: 457656 - RNA, 22 nt, Human
aguaggaggcgggagcaugaag

SEQ ID NO: 457657 - RNA, 22 nt, Human
ggucagguuuuuaggagugacc

SEQ ID NO: 457658 - RNA, 22 nt, Human
gaaaggccauuucugaggguuu

SEQ ID NO: 457659 - RNA, 22 nt, Human
acacagccgugaaucugcuucu

SEQ ID NO: 457660 - RNA, 22 nt, Human
ggcuuuauuaacucauccguaa

SEQ ID NO: 457661 - RNA, 22 nt, Human
uauugaaauucuucauguccuc

SEQ ID NO: 457662 - RNA, 22 nt, Human
cugucacacugauaucaggcuu

SEQ ID NO: 457663 - RNA, 22 nt, Human
aggagugagcuuuggggucaga

SEQ ID NO: 457664 - RNA, 22 nt, Human
gcugucugggaggccuccacuu

SEQ ID NO: 457665 - RNA, 18 nt, Human
cacaggcaggugauaggu

SEQ ID NO: 457666 - RNA, 22 nt, Human
gaggcacaucacuuggugcauu

SEQ ID NO: 457667 - RNA, 22 nt, Human
uggaagggagugacagucagag

SEQ ID NO: 457668 - RNA, 22 nt, Human
aaaauggucucagcuggcacca

SEQ ID NO: 457669 - RNA, 22 nt, Human
ggcagcuggggcagugcccugu

SEQ ID NO: 457670 - RNA, 22 nt, Human
ccaaaguccauaguuuacauua

SEQ ID NO: 457671 - RNA, 23 nt, Human
aaguaacagggauaauagcaguu

SEQ ID NO: 457672 - RNA, 22 nt, Human
cuucaagaagacagcagagcau

SEQ ID NO: 457673 - RNA, 22 nt, Human
uccaggagaggccugaccaggu

SEQ ID NO: 457674 - RNA, 22 nt, Human
gcagagaggaaugaagccaucc

SEQ ID NO: 457675 - RNA, 22 nt, Human
agggagcucaguuggaagcggu

SEQ ID NO: 457676 - RNA, 22 nt, Human
ggcacugggagaggugagacgg

SEQ ID NO: 457677 - RNA, 22 nt, Human
caagagcucaccggagagcauu

SEQ ID NO: 457678 - RNA, 22 nt, Human
cuggccuguccugacccagccu

SEQ ID NO: 457679 - RNA, 19 nt, Human
ugaagcaggcagagaagau

SEQ ID NO: 457680 - RNA, 22 nt, Human
gaguuauuggguggaaagguag

SEQ ID NO: 457681 - RNA, 22 nt, Human
cugaagaggacgcagcagcaag

SEQ ID NO: 457682 - RNA, 22 nt, Human
ggagcugcuuugaucugaagaa

SEQ ID NO: 457683 - RNA, 21 nt, Human
cucuggagucaagagcuucca

SEQ ID NO: 457684 - RNA, 22 nt, Human
auuguacaugcagugagucauc

SEQ ID NO: 457685 - RNA, 22 nt, Human
cauugcccaguaggaucaccag

SEQ ID NO: 457686 - RNA, 22 nt, Human
augguacaaaauguauaaaguc

SEQ ID NO: 457687 - RNA, 22 nt, Human
uuggaugaagucuagcuuuagu

SEQ ID NO: 457688 - RNA, 22 nt, Human
cagauccacccuuguagugaca

SEQ ID NO: 457689 - RNA, 22 nt, Human
gcugccugguuucucagcugca

SEQ ID NO: 457690 - RNA, 22 nt, Human
gcugagagcaguguggccuuaa

SEQ ID NO: 457691 - RNA, 22 nt, Human
aagggcuggccacauucugggu

SEQ ID NO: 457692 - RNA, 19 nt, Human
gacucacaccuuccgcugu

SEQ ID NO: 457693 - RNA, 22 nt, Human
cgugagcaaaauggacacuccc

SEQ ID NO: 457694 - RNA, 22 nt, Human
acacugcucacuucuucccuug

SEQ ID NO: 457695 - RNA, 22 nt, Human
cuguacaucccgagagccagua

SEQ ID NO: 457696 - RNA, 22 nt, Human
ucagcuuugggggucucaggag

SEQ ID NO: 457697 - RNA, 22 nt, Human
ccuggcagacugugagggcagg

SEQ ID NO: 457698 - RNA, 22 nt, Human
ucccagagaagagcuggaugga

SEQ ID NO: 457699 - RNA, 22 nt, Human
uggcucagcugucacagccugg

SEQ ID NO: 457700 - RNA, 22 nt, Human
cccaggacucggcacucuccuu

SEQ ID NO: 457701 - RNA, 22 nt, Human
cugcagggaccacaagcagguu

SEQ ID NO: 457702 - RNA, 22 nt, Human
aggcucagauucacauuugguu

SEQ ID NO: 457703 - RNA, 22 nt, Human
aaaugcuagggagaaacucucc

SEQ ID NO: 457704 - RNA, 22 nt, Human
aggagcuguuuuguucagcaaa

SEQ ID NO: 457705 - RNA, 22 nt, Human
accaaggagaaggugcaagcuu

SEQ ID NO: 457706 - RNA, 22 nt, Human
gcucacugcaaccucugcuucc

SEQ ID NO: 457707 - RNA, 22 nt, Human
cagucucucugaaguauuaaga

SEQ ID NO: 457708 - RNA, 22 nt, Human
ucaguuuucauuucaugagcag

SEQ ID NO: 457709 - RNA, 22 nt, Human
uccuucagggcugaccacaggc

SEQ ID NO: 457710 - RNA, 22 nt, Human
aaaaguguucaggaagaauaau

SEQ ID NO: 457711 - RNA, 22 nt, Human
ccuuucucuggcagcaggacag

SEQ ID NO: 457712 - RNA, 22 nt, Human
agggccagcuagagcccucgcc

SEQ ID NO: 457713 - RNA, 22 nt, Human
cgccucagccguggucaucuuc

SEQ ID NO: 457714 - RNA, 22 nt, Human
accaugggucagccaccucagc

SEQ ID NO: 457715 - RNA, 22 nt, Human
aagagcuggaagugaagauaac

SEQ ID NO: 457716 - RNA, 22 nt, Human
gugcagauccugauugcaguuc

SEQ ID NO: 457717 - RNA, 17 nt, Human
gacaggcucagugacga

SEQ ID NO: 457718 - RNA, 22 nt, Human
acaaaugcaaguuuuaugucaa

SEQ ID NO: 457719 - RNA, 22 nt, Human
uguguccuucugggagucccag

SEQ ID NO: 457720 - RNA, 22 nt, Human
auuauuaggacuacugggguug

SEQ ID NO: 457721 - RNA, 22 nt, Human
ucccagggacaccaagcuguuu

SEQ ID NO: 457722 - RNA, 22 nt, Human
uguaggaguccaaucaggagac

SEQ ID NO: 457723 - RNA, 19 nt, Human
agcuccugggcucugggcc

SEQ ID NO: 457724 - RNA, 22 nt, Human
ggccucacccaucggugccuuu

SEQ ID NO: 457725 - RNA, 22 nt, Human
gagugcaucguggccauuuuaa

SEQ ID NO: 457726 - RNA, 22 nt, Human
ggccuugggcuggcugcaguau

SEQ ID NO: 457727 - RNA, 22 nt, Human
ggcagccaugcacgcugccugg

SEQ ID NO: 457728 - RNA, 22 nt, Human
ucuguggcacgauugcacugca

SEQ ID NO: 457729 - RNA, 22 nt, Human
ucuggcucucauacucgccagu

SEQ ID NO: 457730 - RNA, 22 nt, Human
ugcaggcuggaggagggacuaa

SEQ ID NO: 457731 - RNA, 22 nt, Human
cugaagaugucugagaugcuca

SEQ ID NO: 457732 - RNA, 22 nt, Human
cugggcugcaggaguggggcaa

SEQ ID NO: 457733 - RNA, 22 nt, Human
cauuucuagacaaguccuggag

SEQ ID NO: 457734 - RNA, 22 nt, Human
uuucuaguucucugccaaaaaa

SEQ ID NO: 457735 - RNA, 20 nt, Human
uauuugaaauggccaagugu

SEQ ID NO: 457736 - RNA, 22 nt, Human
gaaugugugacucuauugagca

SEQ ID NO: 457737 - RNA, 22 nt, Human
cugcugggcagaggcugcauga

SEQ ID NO: 457738 - RNA, 22 nt, Human
agggaccucauguaaguggauu

SEQ ID NO: 457739 - RNA, 23 nt, Human
agacccagagacuggcucugcuc

SEQ ID NO: 457740 - RNA, 22 nt, Human
augauggugagguugagcacag

SEQ ID NO: 457741 - RNA, 22 nt, Human
auagcagaaaccaagcuucuuc

SEQ ID NO: 457742 - RNA, 22 nt, Human
gucugaggaagaugcaggggga

SEQ ID NO: 457743 - RNA, 22 nt, Human
ugaaaaggaguccuuguuuuca

SEQ ID NO: 457744 - RNA, 22 nt, Human
ucucaaacuaacaaugauuaua

SEQ ID NO: 457745 - RNA, 22 nt, Human
uggcagagguauauugggagga

SEQ ID NO: 457746 - RNA, 22 nt, Human
ccaggcugggcuacaaguugag

SEQ ID NO: 457747 - RNA, 22 nt, Human
cugugaccuccaggaaggggug

SEQ ID NO: 457748 - RNA, 22 nt, Human
agcuggcccucgagagccaauu

SEQ ID NO: 457749 - RNA, 22 nt, Human
cuggcagcucugagucccuucu

SEQ ID NO: 457750 - RNA, 22 nt, Human
augaagcuaaacccugcagcca

SEQ ID NO: 457751 - RNA, 22 nt, Human
cccucugccugcgcccuggugu

SEQ ID NO: 457752 - RNA, 22 nt, Human
agaaauguuacaguuguuauuu

SEQ ID NO: 457753 - RNA, 22 nt, Human
uacauaguauucacauuguuuu

SEQ ID NO: 457754 - RNA, 22 nt, Human
gggcccuggacguggcggcaga

SEQ ID NO: 457755 - RNA, 22 nt, Human
uggcucagauaauucaaggggc

SEQ ID NO: 457756 - RNA, 22 nt, Human
ugggccugaaggagcugcgccc

SEQ ID NO: 457757 - RNA, 18 nt, Human
gucuggaggucaggagcu

SEQ ID NO: 457758 - RNA, 19 nt, Human
auagucuuuccaauuauac

SEQ ID NO: 457759 - RNA, 22 nt, Human
cuggccugaggucggcuguagg

SEQ ID NO: 457760 - RNA, 22 nt, Human
acagcuuugggcaaugcuauga

SEQ ID NO: 457761 - RNA, 20 nt, Human
aguggggagucaggagugcc

SEQ ID NO: 457762 - RNA, 22 nt, Human
aagugggaauagaaaugaaggu

SEQ ID NO: 457763 - RNA, 22 nt, Human
gccugagaaggauaggaagcga

SEQ ID NO: 457764 - RNA, 22 nt, Human
ggcugucugugguggagcguug

SEQ ID NO: 457765 - RNA, 22 nt, Human
ucaaaauuagugaccaaaggca

SEQ ID NO: 457766 - RNA, 22 nt, Human
uggcucugggcaccguguccac

SEQ ID NO: 457767 - RNA, 22 nt, Human
caguggagugggacuggucuga

SEQ ID NO: 457768 - RNA, 22 nt, Human
caaauguguuuuuucuucuaca

SEQ ID NO: 457769 - RNA, 22 nt, Human
acaguggaauuuguagaugugu

SEQ ID NO: 457770 - RNA, 22 nt, Human
acaugauuuuuaaagagauaau

SEQ ID NO: 457771 - RNA, 22 nt, Human
gcccggcagucacacacccagg

SEQ ID NO: 457772 - RNA, 22 nt, Human
ucucagagaccugaacucccug

SEQ ID NO: 457773 - RNA, 22 nt, Human
cuauuacaauucugcaaggagu

SEQ ID NO: 457774 - RNA, 22 nt, Human
ggcugggcaaacaagacucuuc

SEQ ID NO: 457775 - RNA, 22 nt, Human
gagcugccuacauugccaagag

SEQ ID NO: 457776 - RNA, 22 nt, Human
uuuuccuaguaggccuauuaga

SEQ ID NO: 457777 - RNA, 22 nt, Human
ggcucagguugggucacaugac

SEQ ID NO: 457778 - RNA, 22 nt, Human
cuugcugggguaagucugugcu

SEQ ID NO: 457779 - RNA, 22 nt, Human
guggccugucagaagccguggg

SEQ ID NO: 457780 - RNA, 22 nt, Human
aagccaguguuuuugagaguug

SEQ ID NO: 457781 - RNA, 22 nt, Human
auccuugagccuuaucuuuugu

SEQ ID NO: 457782 - RNA, 22 nt, Human
gaacaguaucaguagugccagu

SEQ ID NO: 457783 - RNA, 21 nt, Human
uuuauguacuucauagaguag

SEQ ID NO: 457784 - RNA, 22 nt, Human
agcuuuaugggagcuuagauaa

SEQ ID NO: 457785 - RNA, 22 nt, Human
acaaagguggaccauguggcuu

SEQ ID NO: 457786 - RNA, 22 nt, Human
ggcuccuguccuccuggagcuc

SEQ ID NO: 457787 - RNA, 22 nt, Human
uuccagagaaaagguuuauuuc

SEQ ID NO: 457788 - RNA, 22 nt, Human
gggaggcuggcucuggccacag

SEQ ID NO: 457789 - RNA, 22 nt, Human
aggcaggagugacccugacagg

SEQ ID NO: 457790 - RNA, 22 nt, Human
uggggcuggcuauugucucccu

SEQ ID NO: 457791 - RNA, 22 nt, Human
augguuuguaacccaauacucc

SEQ ID NO: 457792 - RNA, 22 nt, Human
caagccugucucaccagugcua

SEQ ID NO: 457793 - RNA, 17 nt, Human
aggcaggagauuggaga

SEQ ID NO: 457794 - RNA, 22 nt, Human
ugucccaggcugaaguacagug

SEQ ID NO: 457795 - RNA, 22 nt, Human
caaagguaaagaucugcugugg

SEQ ID NO: 457796 - RNA, 22 nt, Human
ugggcugcccugaugguccuca

SEQ ID NO: 457797 - RNA, 22 nt, Human
uucuaauuguguuugcauaucu

SEQ ID NO: 457798 - RNA, 22 nt, Human
cugggccauggaagucucugcc

SEQ ID NO: 457799 - RNA, 22 nt, Human
agaccugcagggccaggccugc

SEQ ID NO: 457800 - RNA, 22 nt, Human
gagcugccugugugccaugaug

SEQ ID NO: 457801 - RNA, 22 nt, Human
cccaggagguggagguugcagu

SEQ ID NO: 457802 - RNA, 22 nt, Human
ucaauucugguccucaggaacu

SEQ ID NO: 457803 - RNA, 22 nt, Human
gggagccacagugaggugcaug

SEQ ID NO: 457804 - RNA, 22 nt, Human
ugcagauucaaaugaaaugcaa

SEQ ID NO: 457805 - RNA, 22 nt, Human
ugcauuauuugcaugugccugu

SEQ ID NO: 457806 - RNA, 22 nt, Human
uugaccuauguuucuucaucug

SEQ ID NO: 457807 - RNA, 22 nt, Human
aacuuuauuguuaggggcuaaa

SEQ ID NO: 457808 - RNA, 22 nt, Human
ugcugcuccccagcacacagca

SEQ ID NO: 457809 - RNA, 22 nt, Human
gagcagcuggacaggccucccu

SEQ ID NO: 457810 - RNA, 22 nt, Human
uuugaguugcuuauuuaauagg

SEQ ID NO: 457811 - RNA, 22 nt, Human
cacugcuucuggaggaauuugg

SEQ ID NO: 457812 - RNA, 22 nt, Human
aggcaggugcuuaugacuugcu

SEQ ID NO: 457813 - RNA, 22 nt, Human
uggccucugcaauggauucacc

SEQ ID NO: 457814 - RNA, 22 nt, Human
acagagcuuaggaugacuccca

SEQ ID NO: 457815 - RNA, 22 nt, Human
gccagguggcugagugacugag

SEQ ID NO: 457816 - RNA, 22 nt, Human
uucaagaucuggguuuucagcu

SEQ ID NO: 457817 - RNA, 22 nt, Human
cccccuggcaggcuggccucuc

SEQ ID NO: 457818 - RNA, 22 nt, Human
aguguccccuccaagggccugg

SEQ ID NO: 457819 - RNA, 17 nt, Human
gcaagggaugggagauu

SEQ ID NO: 457820 - RNA, 22 nt, Human
gccuuccuuacaccugcucagc

SEQ ID NO: 457821 - RNA, 22 nt, Human
cauuuguaauacugacuugcag

SEQ ID NO: 457822 - RNA, 22 nt, Human
cucugcagaggcccaaggcuga

SEQ ID NO: 457823 - RNA, 22 nt, Human
aaacuguaaauacuaguaagug

SEQ ID NO: 457824 - RNA, 21 nt, Human
acacugugucauaaugcuuaa

SEQ ID NO: 457825 - RNA, 22 nt, Human
agggcugcccagugugagagcu

SEQ ID NO: 457826 - RNA, 21 nt, Human
ccagccucagaucagggagcu

SEQ ID NO: 457827 - RNA, 20 nt, Human
uccaguggccugaaucugga

SEQ ID NO: 457828 - RNA, 22 nt, Human
gggagaaggaggacugugcugu

SEQ ID NO: 457829 - RNA, 22 nt, Human
aaaggccauuacuugcuuuuag

SEQ ID NO: 457830 - RNA, 22 nt, Human
cauuugcagagggugacacucu

SEQ ID NO: 457831 - RNA, 22 nt, Human
uccagccaagccuugguagcug

SEQ ID NO: 457832 - RNA, 22 nt, Human
cagggcuguaaauuagugcuga

SEQ ID NO: 457833 - RNA, 22 nt, Human
guagccauuggcaaugaagccu

SEQ ID NO: 457834 - RNA, 22 nt, Human
uccucacagucaacacuuugag

SEQ ID NO: 457835 - RNA, 22 nt, Human
ccagcuuuaucaagucugagcu

SEQ ID NO: 457836 - RNA, 22 nt, Human
uuauucagucugucuagggagu

SEQ ID NO: 457837 - RNA, 22 nt, Human
gaaaauguuagcuucauaguca

SEQ ID NO: 457838 - RNA, 22 nt, Human
ugggccacacacagaagaauca

SEQ ID NO: 457839 - RNA, 22 nt, Human
gcugcccagcaggccccagggg

SEQ ID NO: 457840 - RNA, 22 nt, Human
agaguguuucagucuuccuaga

SEQ ID NO: 457841 - RNA, 22 nt, Human
ugcauuugucuugucucaugaa

SEQ ID NO: 457842 - RNA, 22 nt, Human
agcucccaggcagucaugagga

SEQ ID NO: 457843 - RNA, 22 nt, Human
ucacuuauugcucaucucaugc

SEQ ID NO: 457844 - RNA, 22 nt, Human
uggcucuggauuaaucuaggaa

SEQ ID NO: 457845 - RNA, 22 nt, Human
gggcuggcgggaaaggcaauuc

SEQ ID NO: 457846 - RNA, 22 nt, Human
accacugggcgggcagccugcu

SEQ ID NO: 457847 - RNA, 22 nt, Human
ggugggugagcccugggagcug

SEQ ID NO: 457848 - RNA, 22 nt, Human
aguccaguguguucuggcagca

SEQ ID NO: 457849 - RNA, 22 nt, Human
uauuucuugagacucgucuucc

SEQ ID NO: 457850 - RNA, 21 nt, Human
aucuggaagaacugguaagug

SEQ ID NO: 457851 - RNA, 22 nt, Human
augugucaauuuucaaaugcuu

SEQ ID NO: 457852 - RNA, 18 nt, Human
acagaggcagacauguau

SEQ ID NO: 457853 - RNA, 22 nt, Human
gccuggcccagggcucuuguug

SEQ ID NO: 457854 - RNA, 22 nt, Human
ucauuuccucaaauucaagguu

SEQ ID NO: 457855 - RNA, 22 nt, Human
auaaggcauauagucacuuuuu

SEQ ID NO: 457856 - RNA, 22 nt, Human
gccaggaguucagaugcauguu

SEQ ID NO: 457857 - RNA, 22 nt, Human
cucaggagacaguguccacaug

SEQ ID NO: 457858 - RNA, 22 nt, Human
ggcacugagcugccuuggggca

SEQ ID NO: 457859 - RNA, 22 nt, Human
agggcccaggacagcaucaggg

SEQ ID NO: 457860 - RNA, 23 nt, Human
ugcagggcaaguuagagacccca

SEQ ID NO: 457861 - RNA, 22 nt, Human
gaggaaccacucugagaagcca

SEQ ID NO: 457862 - RNA, 22 nt, Human
cacaggcugcccgcagcuggga

SEQ ID NO: 457863 - RNA, 22 nt, Human
acagaaauuagcagugaguuua

SEQ ID NO: 457864 - RNA, 22 nt, Human
cggagcugccugccaagccugc

SEQ ID NO: 457865 - RNA, 22 nt, Human
gaguggggcccacugcugggug

SEQ ID NO: 457866 - RNA, 21 nt, Human
cagaggcugagagggcaaucu

SEQ ID NO: 457867 - RNA, 22 nt, Human
uggccugccccgagauccuggc

SEQ ID NO: 457868 - RNA, 22 nt, Human
aggcugagccugggcguggugg

SEQ ID NO: 457869 - RNA, 22 nt, Human
accugcaguggccacuccuaau

SEQ ID NO: 457870 - RNA, 19 nt, Human
gccugccuggguuucugag

SEQ ID NO: 457871 - RNA, 22 nt, Human
ucacacacauaaucuaagauua

SEQ ID NO: 457872 - RNA, 22 nt, Human
uggaggaugccauccaggauac

SEQ ID NO: 457873 - RNA, 22 nt, Human
ugucacuucaggaaugcaggga

SEQ ID NO: 457874 - RNA, 19 nt, Human
ugggcuuccccagggcaga

SEQ ID NO: 457875 - RNA, 22 nt, Human
aagagcuguaugccauaugauu

SEQ ID NO: 457876 - RNA, 22 nt, Human
aaggcacuuaacgugggaggau

SEQ ID NO: 457877 - RNA, 21 nt, Human
aucucacagcccagagaagcc

SEQ ID NO: 457878 - RNA, 23 nt, Human
agcuuugugaaagcagacauggg

SEQ ID NO: 457879 - RNA, 22 nt, Human
ugucucaguacacuccgauguu

SEQ ID NO: 457880 - RNA, 22 nt, Human
auuucucaguguacauuauguu

SEQ ID NO: 457881 - RNA, 22 nt, Human
gcaaaugcucuccuuggucagg

SEQ ID NO: 457882 - RNA, 22 nt, Human
ugcaggagcagagauggcugga

SEQ ID NO: 457883 - RNA, 22 nt, Human
ucuggcagggguucugcacuug

SEQ ID NO: 457884 - RNA, 22 nt, Human
caagaugggcaccccagcaccu

SEQ ID NO: 457885 - RNA, 22 nt, Human
agcagccaguucucugugguag

SEQ ID NO: 457886 - RNA, 22 nt, Human
aaacucuuuccacgauuacuuu

SEQ ID NO: 457887 - RNA, 19 nt, Human
ugagagugaggaaggcuuc

SEQ ID NO: 457888 - RNA, 22 nt, Human
gucccuggaauggacucugcgc

SEQ ID NO: 457889 - RNA, 19 nt, Human
ggcauccacgaaugcagag

SEQ ID NO: 457890 - RNA, 22 nt, Human
ucacuguugaccuggaaguggg

SEQ ID NO: 457891 - RNA, 22 nt, Human
ugucccauggauaccaggcuau

SEQ ID NO: 457892 - RNA, 22 nt, Human
guccucuggaagaugaguucuu

SEQ ID NO: 457893 - RNA, 22 nt, Human
ugaaaaggagccuuagguaggu

SEQ ID NO: 457894 - RNA, 21 nt, Human
uggcucugagccucauggcug

SEQ ID NO: 457895 - RNA, 22 nt, Human
cuggccuuuaaaaugaccuuau

SEQ ID NO: 457896 - RNA, 22 nt, Human
acauuucuaauuuaauguaaca

SEQ ID NO: 457897 - RNA, 22 nt, Human
aggcagcauccagaggagaaug

SEQ ID NO: 457898 - RNA, 22 nt, Human
cagggcucaggcucugggauuc

SEQ ID NO: 457899 - RNA, 18 nt, Human
gagcugggagaaggaagg

SEQ ID NO: 457900 - RNA, 22 nt, Human
uccagucaggcugaauucaagg

SEQ ID NO: 457901 - RNA, 22 nt, Human
aauggacaggagagcauaguca

SEQ ID NO: 457902 - RNA, 22 nt, Human
agccaggaauuggacaacacau

SEQ ID NO: 457903 - RNA, 22 nt, Human
uggcugcugagaaggcagcugu

SEQ ID NO: 457904 - RNA, 22 nt, Human
ugagccagauaagggcucacgc

SEQ ID NO: 457905 - RNA, 22 nt, Human
augccaggaacaaacaguggug

SEQ ID NO: 457906 - RNA, 20 nt, Human
ggaagccagggugcagggga

SEQ ID NO: 457907 - RNA, 22 nt, Human
cagaggugcauacaggucauua

SEQ ID NO: 457908 - RNA, 22 nt, Human
cucucugaggaaggagcaucug

SEQ ID NO: 457909 - RNA, 22 nt, Human
cauguacaaaaggcaaaugccu

SEQ ID NO: 457910 - RNA, 19 nt, Human
ugcagccacgugagagacu

SEQ ID NO: 457911 - RNA, 22 nt, Human
guguggcugccagccaagaggc

SEQ ID NO: 457912 - RNA, 22 nt, Human
ucacugaagacugggcucuaaa

SEQ ID NO: 457913 - RNA, 20 nt, Human
ugcucaggauggagaggugu

SEQ ID NO: 457914 - RNA, 22 nt, Human
cuuauguauauuuggaacguac

SEQ ID NO: 457915 - RNA, 22 nt, Human
ccuggcuggcaagaucgugaag

SEQ ID NO: 457916 - RNA, 22 nt, Human
agaggagguggugaugcuuuaa

SEQ ID NO: 457917 - RNA, 22 nt, Human
uaguaacagauuuauacagucu

SEQ ID NO: 457918 - RNA, 22 nt, Human
agugagggaugaagaacugcgg

SEQ ID NO: 457919 - RNA, 20 nt, Human
ccagagaguagguuagugau

SEQ ID NO: 457920 - RNA, 22 nt, Human
aaauguguuugauaggaauauu

SEQ ID NO: 457921 - RNA, 22 nt, Human
uucuggagcuaaaguccacucu

SEQ ID NO: 457922 - RNA, 22 nt, Human
gcuuuauguaaguccaaaggca

SEQ ID NO: 457923 - RNA, 22 nt, Human
ugggcagaguagcucagaagaa

SEQ ID NO: 457924 - RNA, 22 nt, Human
ugccucugggugaccaaggagc

SEQ ID NO: 457925 - RNA, 22 nt, Human
ggcucaccauggccucccugcu

SEQ ID NO: 457926 - RNA, 22 nt, Human
cuguggugagcaacugacugaa

SEQ ID NO: 457927 - RNA, 22 nt, Human
ugaaauuccaggagaguuaaaa

SEQ ID NO: 457928 - RNA, 22 nt, Human
aggagucaggaccaaauggaaa

SEQ ID NO: 457929 - RNA, 22 nt, Human
ccugucuggaacauggccuguu

SEQ ID NO: 457930 - RNA, 22 nt, Human
auucucaaacaagugguuugau

SEQ ID NO: 457931 - RNA, 21 nt, Human
ugcccacagcaaaugcagagg

SEQ ID NO: 457932 - RNA, 22 nt, Human
uccucugcuguucugguucuuu

SEQ ID NO: 457933 - RNA, 20 nt, Human
cagagcugggauuugaacac

SEQ ID NO: 457934 - RNA, 22 nt, Human
gaccauuuuuacagagcauuca

SEQ ID NO: 457935 - RNA, 22 nt, Human
cagggcucugccuugagggaug

SEQ ID NO: 457936 - RNA, 22 nt, Human
cagaggcacagcuucuuuuaau

SEQ ID NO: 457937 - RNA, 22 nt, Human
uuggcuucuggcagucuggacg

SEQ ID NO: 457938 - RNA, 22 nt, Human
uggcccugacugauguggaggg

SEQ ID NO: 457939 - RNA, 22 nt, Human
uucacaauagcuggcaucaucu

SEQ ID NO: 457940 - RNA, 22 nt, Human
auaaggcagaaaugauucuagu

SEQ ID NO: 457941 - RNA, 22 nt, Human
cucuccucugaaguggugaccc

SEQ ID NO: 457942 - RNA, 22 nt, Human
cuagucacucagcacugacaaa

SEQ ID NO: 457943 - RNA, 22 nt, Human
uuugcauugccucugacuuaug

SEQ ID NO: 457944 - RNA, 19 nt, Human
uuucaauggcuuagagaaa

SEQ ID NO: 457945 - RNA, 22 nt, Human
gcuggccauggggagugaggag

SEQ ID NO: 457946 - RNA, 22 nt, Human
acagguggaggcuuuaggaggu

SEQ ID NO: 457947 - RNA, 22 nt, Human
ggagggugcauuuuacccugug

SEQ ID NO: 457948 - RNA, 22 nt, Human
ucauugcaguagggagagaccc

SEQ ID NO: 457949 - RNA, 22 nt, Human
cuucaguuuaucccaucaucca

SEQ ID NO: 457950 - RNA, 22 nt, Human
aagcuggagaguuaggugaaua

SEQ ID NO: 457951 - RNA, 22 nt, Human
cacaggagagcugggaggugcc

SEQ ID NO: 457952 - RNA, 22 nt, Human
aguaaaaucuuaagcacagugg

SEQ ID NO: 457953 - RNA, 22 nt, Human
uuuugcuugagugcacaaaaug

SEQ ID NO: 457954 - RNA, 22 nt, Human
ggcucuggugugaagcagccuc

SEQ ID NO: 457955 - RNA, 18 nt, Human
acaaaggucugcaagacc

SEQ ID NO: 457956 - RNA, 22 nt, Human
auuucacaaagaacagaugcag

SEQ ID NO: 457957 - RNA, 22 nt, Human
uuuguuaauucuuauguuagag

SEQ ID NO: 457958 - RNA, 22 nt, Human
ucacaggacccugaggguggcg

SEQ ID NO: 457959 - RNA, 22 nt, Human
ugccucagaguugucccuacca

SEQ ID NO: 457960 - RNA, 22 nt, Human
acuguauaaggcauagguaagc

SEQ ID NO: 457961 - RNA, 22 nt, Human
cuauuauuagauaaucuacuug

SEQ ID NO: 457962 - RNA, 22 nt, Human
ucaaagagcuauucaguugugg

SEQ ID NO: 457963 - RNA, 22 nt, Human
acagugucuccugguacccagu

SEQ ID NO: 457964 - RNA, 23 nt, Human
aaauuauugcucuucaauugccu

SEQ ID NO: 457965 - RNA, 22 nt, Human
ucucagagccuaacuaaccuaa

SEQ ID NO: 457966 - RNA, 22 nt, Human
gcaaagcugggugugaaugcac

SEQ ID NO: 457967 - RNA, 22 nt, Human
agcuguccuggcucaggcugug

SEQ ID NO: 457968 - RNA, 22 nt, Human
acugucacuccaacugagucgu

SEQ ID NO: 457969 - RNA, 22 nt, Human
ugcagaagaaugagcuuggagu

SEQ ID NO: 457970 - RNA, 22 nt, Human
gagggcagugaauuuugaagcu

SEQ ID NO: 457971 - RNA, 21 nt, Human
aggggacagaguagcuccagg

SEQ ID NO: 457972 - RNA, 22 nt, Human
augcugugucaccuuaggauuu

SEQ ID NO: 457973 - RNA, 22 nt, Human
uucuuucucaacaugaauguuu

SEQ ID NO: 457974 - RNA, 22 nt, Human
uggcagagagagugcagucgac

SEQ ID NO: 457975 - RNA, 22 nt, Human
agccaggcagacucucuuucuu

SEQ ID NO: 457976 - RNA, 22 nt, Human
agcccuggcccggcugugcuuu

SEQ ID NO: 457977 - RNA, 22 nt, Human
auagugggaauuacgauauacu

SEQ ID NO: 457978 - RNA, 20 nt, Human
caucaucacaugagccaauu

SEQ ID NO: 457979 - RNA, 22 nt, Human
cgaggcaggcaggcggaggaua

SEQ ID NO: 457980 - RNA, 22 nt, Human
acugucaccaucagagcgggaa

SEQ ID NO: 457981 - RNA, 23 nt, Human
aucaagauaauccagaugaccua

SEQ ID NO: 457982 - RNA, 22 nt, Human
ugaggggagaagcagcagccug

SEQ ID NO: 457983 - RNA, 21 nt, Human
ucuccaguauccuucucugag

SEQ ID NO: 457984 - RNA, 22 nt, Human
ccuggggagaagagcuuccccc

SEQ ID NO: 457985 - RNA, 20 nt, Human
ugggagcuggugaggucuca

SEQ ID NO: 457986 - RNA, 20 nt, Human
cacagcuugccuuuuaugac

SEQ ID NO: 457987 - RNA, 22 nt, Human
ugcaaacaggagaguaaguaua

SEQ ID NO: 457988 - RNA, 21 nt, Human
uggcucugaaagagugcugca

SEQ ID NO: 457989 - RNA, 22 nt, Human
uggcugagagaagacggggaag

SEQ ID NO: 457990 - RNA, 22 nt, Human
augggcagaguggggacaggaa

SEQ ID NO: 457991 - RNA, 20 nt, Human
aacacagauaccaaagguug

SEQ ID NO: 457992 - RNA, 22 nt, Human
cucagggcuggaaagccaggaa

SEQ ID NO: 457993 - RNA, 22 nt, Human
aguccaaggagagacagcauuu

SEQ ID NO: 457994 - RNA, 22 nt, Human
gcaaauacauguugagcaccua

SEQ ID NO: 457995 - RNA, 22 nt, Human
ggccucucauguccugggcuuc

SEQ ID NO: 457996 - RNA, 22 nt, Human
ucucucagaggccaggguccug

SEQ ID NO: 457997 - RNA, 22 nt, Human
ugcucagacaagcugaacagua

SEQ ID NO: 457998 - RNA, 17 nt, Human
ggcugcugugcuggugc

SEQ ID NO: 457999 - RNA, 22 nt, Human
uuuccuuugcccaauacauguc

SEQ ID NO: 458000 - RNA, 22 nt, Human
cagcccugccauggagccuccu

SEQ ID NO: 458001 - RNA, 22 nt, Human
cacauuucucuaccucacacaa

SEQ ID NO: 458002 - RNA, 22 nt, Human
ucagcaaugagaacuggcauuu

SEQ ID NO: 458003 - RNA, 22 nt, Human
guccucugcuucaugcccugau

SEQ ID NO: 458004 - RNA, 22 nt, Human
ggcaaaaaccacaauuacuuuu

SEQ ID NO: 458005 - RNA, 22 nt, Human
uaagaacagauaaaguuucccc

SEQ ID NO: 458006 - RNA, 22 nt, Human
agugcugucuccuucccccggg

SEQ ID NO: 458007 - RNA, 22 nt, Human
cugcucuguucccccaucaucu

SEQ ID NO: 458008 - RNA, 22 nt, Human
caguucaggccggcugacucag

SEQ ID NO: 458009 - RNA, 22 nt, Human
cagaggcaggauaagaacugcg

SEQ ID NO: 458010 - RNA, 22 nt, Human
caugugucaaaugauguagcug

SEQ ID NO: 458011 - RNA, 22 nt, Human
uaguggagaguuguuuugugca

SEQ ID NO: 458012 - RNA, 22 nt, Human
ccagcuuuagguugccugccag

SEQ ID NO: 458013 - RNA, 22 nt, Human
ugcagggcacacgcacgggugu

SEQ ID NO: 458014 - RNA, 22 nt, Human
caggagcccagaguccucagcu

SEQ ID NO: 458015 - RNA, 22 nt, Human
ucuucaaagaauuuuaguaauu

SEQ ID NO: 458016 - RNA, 22 nt, Human
cccaguccuaaagcagacgcca

SEQ ID NO: 458017 - RNA, 22 nt, Human
ugcuugagacacauaugaauuu

SEQ ID NO: 458018 - RNA, 19 nt, Human
gcuggggccugaccagaca

SEQ ID NO: 458019 - RNA, 22 nt, Human
aggcaagggggcgccaccuucc

SEQ ID NO: 458020 - RNA, 22 nt, Human
aaugcuuuaauugcauguagug

SEQ ID NO: 458021 - RNA, 19 nt, Human
caagugaagccugggaugg

SEQ ID NO: 458022 - RNA, 22 nt, Human
uugacaaaggaccuugcuauuu

SEQ ID NO: 458023 - RNA, 17 nt, Human
gagaguguauuggaugc

SEQ ID NO: 458024 - RNA, 22 nt, Human
aauuucaagucuugaagaagua

SEQ ID NO: 458025 - RNA, 22 nt, Human
cuggcaggagcauucacagagg

SEQ ID NO: 458026 - RNA, 22 nt, Human
uggcuuccgccgcgggccucgg

SEQ ID NO: 458027 - RNA, 22 nt, Human
aguggggacuuaugccagcauu

SEQ ID NO: 458028 - RNA, 22 nt, Human
ugaggugaccgcagaugggaag

SEQ ID NO: 458029 - RNA, 19 nt, Human
uuagccauccacagugaaa

SEQ ID NO: 458030 - RNA, 17 nt, Human
ugaaggccaugaccacg

SEQ ID NO: 458031 - RNA, 22 nt, Human
aagcaaaagguuacacuucugg

SEQ ID NO: 458032 - RNA, 22 nt, Human
uccugccucuccaugcuaacua

SEQ ID NO: 458033 - RNA, 22 nt, Human
augcaguacauacaaacacuga

SEQ ID NO: 458034 - RNA, 22 nt, Human
ucucaggggauucacuggcacc

SEQ ID NO: 458035 - RNA, 22 nt, Human
cugugugugucugcagcauacu

SEQ ID NO: 458036 - RNA, 22 nt, Human
agccugccuugggcugcuugag

SEQ ID NO: 458037 - RNA, 22 nt, Human
cagugccaugucugagccccua

SEQ ID NO: 458038 - RNA, 22 nt, Human
cucaggaucgcuugcccuaggg

SEQ ID NO: 458039 - RNA, 22 nt, Human
ugggcagggaucucuuuugcaa

SEQ ID NO: 458040 - RNA, 22 nt, Human
gauuuucauuauagcuaguuuc

SEQ ID NO: 458041 - RNA, 22 nt, Human
cagugcagguggcagaggacag

SEQ ID NO: 458042 - RNA, 22 nt, Human
ccaguccagugccaugcauggc

SEQ ID NO: 458043 - RNA, 22 nt, Human
ccuguggcucucuuuggagguc

SEQ ID NO: 458044 - RNA, 22 nt, Human
guuugucuuaauuaggcaucga

SEQ ID NO: 458045 - RNA, 22 nt, Human
cagcuugaaauauuaggagaug

SEQ ID NO: 458046 - RNA, 20 nt, Human
guguuucaugugauacaaug

SEQ ID NO: 458047 - RNA, 22 nt, Human
cagacagcugcuuucuugcugu

SEQ ID NO: 458048 - RNA, 22 nt, Human
uggcucagugaagagauaacuu

SEQ ID NO: 458049 - RNA, 22 nt, Human
agagugaaguucaucgugcagc

SEQ ID NO: 458050 - RNA, 22 nt, Human
ccaggcugagcaugauuggagc

SEQ ID NO: 458051 - RNA, 22 nt, Human
ggcuguggucauuaggagguug

SEQ ID NO: 458052 - RNA, 22 nt, Human
accaggcacuccugaggucuga

SEQ ID NO: 458053 - RNA, 22 nt, Human
gguggcagucuuaagagaucuu

SEQ ID NO: 458054 - RNA, 22 nt, Human
uagcugccagaccauucuuacu

SEQ ID NO: 458055 - RNA, 22 nt, Human
cagagggagcccuccaggagca

SEQ ID NO: 458056 - RNA, 22 nt, Human
ugacagaacagguugggagcaa

SEQ ID NO: 458057 - RNA, 22 nt, Human
ucuggcucaggucagacaggga

SEQ ID NO: 458058 - RNA, 20 nt, Human
ucccaagggcugagaggauc

SEQ ID NO: 458059 - RNA, 22 nt, Human
ccagagaguaaacauuuuccgg

SEQ ID NO: 458060 - RNA, 22 nt, Human
aggggcuguggaaaccaacucu

SEQ ID NO: 458061 - RNA, 22 nt, Human
aagaagaaguguuauuuuuaga

SEQ ID NO: 458062 - RNA, 22 nt, Human
gucucccaucguuugugaggaa

SEQ ID NO: 458063 - RNA, 22 nt, Human
ugaguucucacccauucuucuu

SEQ ID NO: 458064 - RNA, 21 nt, Human
uucaagauauuuaaaaggugg

SEQ ID NO: 458065 - RNA, 22 nt, Human
agcugugggauuugggugugcc

SEQ ID NO: 458066 - RNA, 22 nt, Human
ccaggacuuuaaguccagcacu

SEQ ID NO: 458067 - RNA, 22 nt, Human
ggcugcugaguuggccaggaga

SEQ ID NO: 458068 - RNA, 22 nt, Human
ucacauuugcaauugcauuguu

SEQ ID NO: 458069 - RNA, 22 nt, Human
ccagcugauucgguggugguug

SEQ ID NO: 458070 - RNA, 22 nt, Human
gaggcugauucggggaacagca

SEQ ID NO: 458071 - RNA, 22 nt, Human
cacugaaucucaaggggagggu

SEQ ID NO: 458072 - RNA, 22 nt, Human
uccuucagaggacggcagccag

SEQ ID NO: 458073 - RNA, 22 nt, Human
uccagggagauacuggcugcca

SEQ ID NO: 458074 - RNA, 22 nt, Human
gugacucacacaggccugggcu

SEQ ID NO: 458075 - RNA, 22 nt, Human
cuucucucccuggcacucagac

SEQ ID NO: 458076 - RNA, 22 nt, Human
agggcaguguggugggacugac

SEQ ID NO: 458077 - RNA, 22 nt, Human
cugaagagcucuccuguccccu

SEQ ID NO: 458078 - RNA, 22 nt, Human
auguccuuugcuucucuggucc

SEQ ID NO: 458079 - RNA, 22 nt, Human
ccacagaaaguugucuagagua

SEQ ID NO: 458080 - RNA, 22 nt, Human
agcagaagaaagccacaugacu

SEQ ID NO: 458081 - RNA, 20 nt, Human
aguaggggaaugcaagagca

SEQ ID NO: 458082 - RNA, 22 nt, Human
aggccuggugugccggaugcag

SEQ ID NO: 458083 - RNA, 22 nt, Human
ugggauggcauccugggccuug

SEQ ID NO: 458084 - RNA, 22 nt, Human
ucuguccauuuuccauuuuggc

SEQ ID NO: 458085 - RNA, 22 nt, Human
cagcagugucuccagcaucaca

SEQ ID NO: 458086 - RNA, 22 nt, Human
cccucugccucugaguaggaca

SEQ ID NO: 458087 - RNA, 22 nt, Human
guggcagugugaggauccugcu

SEQ ID NO: 458088 - RNA, 22 nt, Human
aaacaucaauugcaucucccaa

SEQ ID NO: 458089 - RNA, 22 nt, Human
uaucaacauuaauauuuucugg

SEQ ID NO: 458090 - RNA, 19 nt, Human
ccuuugaaucaggacacuu

SEQ ID NO: 458091 - RNA, 22 nt, Human
gggcuacagacaugcucuaagc

SEQ ID NO: 458092 - RNA, 22 nt, Human
acuguggcucaucaggcuggug

SEQ ID NO: 458093 - RNA, 22 nt, Human
agggaagaagcugguaguaggu

SEQ ID NO: 458094 - RNA, 22 nt, Human
aggcugccaaagcuucugucuc

SEQ ID NO: 458095 - RNA, 22 nt, Human
aaguuauugcagcaauccaagu

SEQ ID NO: 458096 - RNA, 22 nt, Human
aggcuggagggcaauggcaaga

SEQ ID NO: 458097 - RNA, 22 nt, Human
ugcugccaggucuugcugucca

SEQ ID NO: 458098 - RNA, 21 nt, Human
uggcucuggguaggagagugc

SEQ ID NO: 458099 - RNA, 22 nt, Human
gugccaaaagcuauaauuuggu

SEQ ID NO: 458100 - RNA, 22 nt, Human
gggcugagccauuugaaccuug

SEQ ID NO: 458101 - RNA, 22 nt, Human
cugagaauuacucugaugagua

SEQ ID NO: 458102 - RNA, 22 nt, Human
gcagggcuguucaggagggugg

SEQ ID NO: 458103 - RNA, 22 nt, Human
uccaggagguuuggaggaagca

SEQ ID NO: 458104 - RNA, 22 nt, Human
ucaguuuugaaaacauugaaug

SEQ ID NO: 458105 - RNA, 22 nt, Human
cagggugcgccacucagaugua

SEQ ID NO: 458106 - RNA, 22 nt, Human
agugaggcuaauaggcaauggu

SEQ ID NO: 458107 - RNA, 22 nt, Human
ggcugccuccucgagacaggau

SEQ ID NO: 458108 - RNA, 22 nt, Human
ugaaggcauugaugaaggaauc

SEQ ID NO: 458109 - RNA, 22 nt, Human
cugucugcuagaacaucuauac

SEQ ID NO: 458110 - RNA, 22 nt, Human
gggaguggguuuggccuaggcc

SEQ ID NO: 458111 - RNA, 22 nt, Human
agggcccucuggcaggccaggc

SEQ ID NO: 458112 - RNA, 22 nt, Human
gcccagcugucuggcagggaug

SEQ ID NO: 458113 - RNA, 22 nt, Human
uucugugcccauuuuaaaaugg

SEQ ID NO: 458114 - RNA, 22 nt, Human
agagaagggccuguauguaauc

SEQ ID NO: 458115 - RNA, 22 nt, Human
ccagccaggcuggcuguggagg

SEQ ID NO: 458116 - RNA, 22 nt, Human
uagaacacuugaccacugcucc

SEQ ID NO: 458117 - RNA, 22 nt, Human
cagcugcuguucaguuuuguuu

SEQ ID NO: 458118 - RNA, 22 nt, Human
uccauaagcagguucuuccuga

SEQ ID NO: 458119 - RNA, 17 nt, Human
acaagcaguggccaugg

SEQ ID NO: 458120 - RNA, 22 nt, Human
gaggcucagggaguauaugaau

SEQ ID NO: 458121 - RNA, 22 nt, Human
gaaggcugaguggguacggagg

SEQ ID NO: 458122 - RNA, 22 nt, Human
uuauuguuuacuaguuugcaga

SEQ ID NO: 458123 - RNA, 22 nt, Human
aaaggccaauaaagacaagcug

SEQ ID NO: 458124 - RNA, 22 nt, Human
aauaaacugcucaauugcauca

SEQ ID NO: 458125 - RNA, 22 nt, Human
cucaucugauaaaucacucuua

SEQ ID NO: 458126 - RNA, 22 nt, Human
auuucucaguuccuacuguuua

SEQ ID NO: 458127 - RNA, 23 nt, Human
cuggggcuuucaaaucugggcag

SEQ ID NO: 458128 - RNA, 22 nt, Human
cugcuucuaagaaccugcagcu

SEQ ID NO: 458129 - RNA, 22 nt, Human
cagcaucuaaucuucaugccgg

SEQ ID NO: 458130 - RNA, 22 nt, Human
acauaccauacauggugagaug

SEQ ID NO: 458131 - RNA, 22 nt, Human
auuuccaaucucugcauauggg

SEQ ID NO: 458132 - RNA, 20 nt, Human
gccuggcacccggggcuggc

SEQ ID NO: 458133 - RNA, 22 nt, Human
augcacagacccaaaggccauc

SEQ ID NO: 458134 - RNA, 22 nt, Human
ucugaggcauaaccuguucugc

SEQ ID NO: 458135 - RNA, 22 nt, Human
cugggagcggcugucacugguu

SEQ ID NO: 458136 - RNA, 22 nt, Human
agggcuccaggggaccaucagu

SEQ ID NO: 458137 - RNA, 22 nt, Human
ugcaguggcgccaucucagcuc

SEQ ID NO: 458138 - RNA, 22 nt, Human
uaacagcucuguguggcuguaa

SEQ ID NO: 458139 - RNA, 22 nt, Human
aucugaagggaaguggaaggca

SEQ ID NO: 458140 - RNA, 22 nt, Human
gaggcagugucgguggcaggau

SEQ ID NO: 458141 - RNA, 22 nt, Human
gauggcaggcaggugaguagag

SEQ ID NO: 458142 - RNA, 22 nt, Human
aggccacaguacuuugcagacc

SEQ ID NO: 458143 - RNA, 22 nt, Human
augccaggccccacgcugggca

SEQ ID NO: 458144 - RNA, 20 nt, Human
gccaacgcgcuggggcugcc

SEQ ID NO: 458145 - RNA, 22 nt, Human
aggcucagagagcuguguccau

SEQ ID NO: 458146 - RNA, 22 nt, Human
ugggcagcauccuccacaguca

SEQ ID NO: 458147 - RNA, 22 nt, Human
augccagucaaagaagaugaca

SEQ ID NO: 458148 - RNA, 22 nt, Human
acucugaaugugcauguaaauc

SEQ ID NO: 458149 - RNA, 22 nt, Human
guggcucuccauugacauggaa

SEQ ID NO: 458150 - RNA, 18 nt, Human
ucucuuuuccccucauug

SEQ ID NO: 458151 - RNA, 22 nt, Human
gagucugaugucccccaggcca

SEQ ID NO: 458152 - RNA, 22 nt, Human
uggccucuuacgacauagccuu

SEQ ID NO: 458153 - RNA, 22 nt, Human
auaaacagcuccauuuagugcc

SEQ ID NO: 458154 - RNA, 20 nt, Human
cugugccuaaaccuccgggu

SEQ ID NO: 458155 - RNA, 22 nt, Human
caagagcuggguggcaagcuag

SEQ ID NO: 458156 - RNA, 22 nt, Human
gaggaggcacuaguuagugaca

SEQ ID NO: 458157 - RNA, 22 nt, Human
uccauggggcccaggaugagag

SEQ ID NO: 458158 - RNA, 22 nt, Human
uuccucagacccucauugugag

SEQ ID NO: 458159 - RNA, 22 nt, Human
acaaaugcagcauaaagugaac

SEQ ID NO: 458160 - RNA, 22 nt, Human
cccagguguuuguggcagaggu

SEQ ID NO: 458161 - RNA, 22 nt, Human
gggggacuaacuggauccugga

SEQ ID NO: 458162 - RNA, 22 nt, Human
gcugucccgcugacuuccagcu

SEQ ID NO: 458163 - RNA, 22 nt, Human
gggggacuggaccguccugggu

SEQ ID NO: 458164 - RNA, 22 nt, Human
aggugagugugacugcaagaga

SEQ ID NO: 458165 - RNA, 22 nt, Human
aagcagggugucuugacccaug

SEQ ID NO: 458166 - RNA, 22 nt, Human
ucagaggagccaaaguucugag

SEQ ID NO: 458167 - RNA, 22 nt, Human
aggacugggugcagagggcauc

SEQ ID NO: 458168 - RNA, 22 nt, Human
cuggagccuagguugaccuggg

SEQ ID NO: 458169 - RNA, 22 nt, Human
ccaggcuggagugcaauggugc

SEQ ID NO: 458170 - RNA, 17 nt, Human
ggccuguguggcugcag

SEQ ID NO: 458171 - RNA, 22 nt, Human
cugaggcugggcauggggucca

SEQ ID NO: 458172 - RNA, 22 nt, Human
uuauucagauuggcuacaggau

SEQ ID NO: 458173 - RNA, 22 nt, Human
ugcagggccagacuggguugga

SEQ ID NO: 458174 - RNA, 20 nt, Human
uuccuguauacaaagaguuc

SEQ ID NO: 458175 - RNA, 22 nt, Human
agucagugaaaacuagaauguu

SEQ ID NO: 458176 - RNA, 22 nt, Human
cagagacaguuucacagggucu

SEQ ID NO: 458177 - RNA, 22 nt, Human
ucugccuggguguggagcagag

SEQ ID NO: 458178 - RNA, 17 nt, Human
ugccagccugucccagg

SEQ ID NO: 458179 - RNA, 18 nt, Human
guccugagcucugcugua

SEQ ID NO: 458180 - RNA, 22 nt, Human
agggucugacaaugugacuuag

SEQ ID NO: 458181 - RNA, 22 nt, Human
gaggcucacugggcaaagacuc

SEQ ID NO: 458182 - RNA, 19 nt, Human
ccagguggaacugagguag

SEQ ID NO: 458183 - RNA, 22 nt, Human
acauaauggacaauaaugcauc

SEQ ID NO: 458184 - RNA, 22 nt, Human
aggaccaguaugagagcaucug

SEQ ID NO: 458185 - RNA, 22 nt, Human
acugcaucugaaacauggguca

SEQ ID NO: 458186 - RNA, 22 nt, Human
agagucugaggcagcugcagcc

SEQ ID NO: 458187 - RNA, 22 nt, Human
caaagcucaugcucuuagccau

SEQ ID NO: 458188 - RNA, 22 nt, Human
cuuuuaaugggagcaguauuug

SEQ ID NO: 458189 - RNA, 16 nt, Human
cuacccagugagaagg

SEQ ID NO: 458190 - RNA, 22 nt, Human
aggcuuguggauuggagcgagu

SEQ ID NO: 458191 - RNA, 23 nt, Human
uggugccucagaagcagugggcu

SEQ ID NO: 458192 - RNA, 22 nt, Human
gcaaaugcuaaaguguagagac

SEQ ID NO: 458193 - RNA, 22 nt, Human
caguggaauacgagcagauguc

SEQ ID NO: 458194 - RNA, 22 nt, Human
ggcaggagggcggacaaugacc

SEQ ID NO: 458195 - RNA, 22 nt, Human
uugucugaaagaucauuacauu

SEQ ID NO: 458196 - RNA, 22 nt, Human
uccaguggcaccuuggcccuca

SEQ ID NO: 458197 - RNA, 22 nt, Human
ggccagagagcagccaggauuc

SEQ ID NO: 458198 - RNA, 22 nt, Human
cagaugaggcaaccucauugcu

SEQ ID NO: 458199 - RNA, 22 nt, Human
agucucugccagcuuguccucu

SEQ ID NO: 458200 - RNA, 22 nt, Human
caagaacaguuugccaaauugg

SEQ ID NO: 458201 - RNA, 22 nt, Human
uagcuuuagugaaaaauaucag

SEQ ID NO: 458202 - RNA, 22 nt, Human
ggaugcaggggcagcagagccu

SEQ ID NO: 458203 - RNA, 22 nt, Human
aggccugaggaccuucuggagg

SEQ ID NO: 458204 - RNA, 20 nt, Human
ucacaggggaccaggagcag

SEQ ID NO: 458205 - RNA, 22 nt, Human
cacauaauaaauguuccugaug

SEQ ID NO: 458206 - RNA, 18 nt, Human
ucagagagcagcuuuauu

SEQ ID NO: 458207 - RNA, 22 nt, Human
uccaugggaagauuuugagugg

SEQ ID NO: 458208 - RNA, 22 nt, Human
caugucuggguauaugcauaug

SEQ ID NO: 458209 - RNA, 22 nt, Human
gaggagcacaugaggcugaggg

SEQ ID NO: 458210 - RNA, 23 nt, Human
auauuagggagauuagcccucua

SEQ ID NO: 458211 - RNA, 17 nt, Human
ugguggcuggagucagg

SEQ ID NO: 458212 - RNA, 17 nt, Human
agcacuaaaaugcuucc

SEQ ID NO: 458213 - RNA, 22 nt, Human
guccucuggugaaagcauuccc

SEQ ID NO: 458214 - RNA, 22 nt, Human
acauuucuuccuaauuaucccu

SEQ ID NO: 458215 - RNA, 22 nt, Human
uaucuacuccucuuucagaugc

SEQ ID NO: 458216 - RNA, 22 nt, Human
acagcagcaauagcagugacau

SEQ ID NO: 458217 - RNA, 22 nt, Human
uagcugugagcacccaggcugu

SEQ ID NO: 458218 - RNA, 22 nt, Human
uuagucaauagugaauauagag

SEQ ID NO: 458219 - RNA, 22 nt, Human
agaggagguccuuuucugaugu

SEQ ID NO: 458220 - RNA, 22 nt, Human
ucccagagugagccaggggcag

SEQ ID NO: 458221 - RNA, 22 nt, Human
cagccugcccuggaagcccagc

SEQ ID NO: 458222 - RNA, 22 nt, Human
cugggcacuuuggggagccuac

SEQ ID NO: 458223 - RNA, 22 nt, Human
ucacauuuguuccucugcacuu

SEQ ID NO: 458224 - RNA, 22 nt, Human
ggagccagagggaugcaguuga

SEQ ID NO: 458225 - RNA, 22 nt, Human
ucugaaggucugagaaccagga

SEQ ID NO: 458226 - RNA, 22 nt, Human
auuuucauggcuucugcucagu

SEQ ID NO: 458227 - RNA, 22 nt, Human
uauugacagagggucagaagag

SEQ ID NO: 458228 - RNA, 21 nt, Human
agcugggccucagccugcagu

SEQ ID NO: 458229 - RNA, 20 nt, Human
gcccacucuaauccacuguc

SEQ ID NO: 458230 - RNA, 19 nt, Human
ucuggcuccugccaggcug

SEQ ID NO: 458231 - RNA, 22 nt, Human
gcucucugccuuucucaaugac

SEQ ID NO: 458232 - RNA, 22 nt, Human
uuauuauugugaccugagaaug

SEQ ID NO: 458233 - RNA, 22 nt, Human
aucugguuuggggauccuugug

SEQ ID NO: 458234 - RNA, 22 nt, Human
cggcugagcagugcugauggaa

SEQ ID NO: 458235 - RNA, 22 nt, Human
agcuggagaucaugcugauacu

SEQ ID NO: 458236 - RNA, 22 nt, Human
uggcugaguuucaugcaucaug

SEQ ID NO: 458237 - RNA, 22 nt, Human
augucuuucucacagccaguuc

SEQ ID NO: 458238 - RNA, 22 nt, Human
ugcuuccagcucucuguaaggu

SEQ ID NO: 458239 - RNA, 22 nt, Human
ugugcagggaagggcaugcuau

SEQ ID NO: 458240 - RNA, 22 nt, Human
aggggcugcuggguccgccccu

SEQ ID NO: 458241 - RNA, 22 nt, Human
guggccaggccgacugccaggc

SEQ ID NO: 458242 - RNA, 22 nt, Human
acugaaagauaaaucaguuagc

SEQ ID NO: 458243 - RNA, 22 nt, Human
gccagggaggcuguaggguccu

SEQ ID NO: 458244 - RNA, 22 nt, Human
aaaguguaaggaauuuaaguaa

SEQ ID NO: 458245 - RNA, 22 nt, Human
ucccagaguucaaugggaaggu

SEQ ID NO: 458246 - RNA, 22 nt, Human
agcaaagucaguggaaccaucc

SEQ ID NO: 458247 - RNA, 22 nt, Human
accucugcaaugcaaugucaug

SEQ ID NO: 458248 - RNA, 22 nt, Human
ccccagcucagugcagggacau

SEQ ID NO: 458249 - RNA, 22 nt, Human
uauuagguaaaggacuugcagg

SEQ ID NO: 458250 - RNA, 22 nt, Human
cuccuucccuucaaguguuccu

SEQ ID NO: 458251 - RNA, 22 nt, Human
accagggcccgggagagcucuc

SEQ ID NO: 458252 - RNA, 22 nt, Human
auaauauaauccuacuucccau

SEQ ID NO: 458253 - RNA, 22 nt, Human
aagugacaaaaggguauccaaa

SEQ ID NO: 458254 - RNA, 22 nt, Human
cagcagcaaaucuagaagagga

SEQ ID NO: 458255 - RNA, 22 nt, Human
aacucagucauaaagcgaaugc

SEQ ID NO: 458256 - RNA, 21 nt, Human
cacucaggguaugugccaggc

SEQ ID NO: 458257 - RNA, 22 nt, Human
gcucaagagagaugcaguucuu

SEQ ID NO: 458258 - RNA, 22 nt, Human
ggugggcaacauuuggccugag

SEQ ID NO: 458259 - RNA, 22 nt, Human
uuugcauuauauuuauagaaga

SEQ ID NO: 458260 - RNA, 23 nt, Human
ggcaccaggccauggagcgggag

SEQ ID NO: 458261 - RNA, 22 nt, Human
ccagcuggaagagugcagaacu

SEQ ID NO: 458262 - RNA, 22 nt, Human
gagcuuccacucuagaaggagu

SEQ ID NO: 458263 - RNA, 22 nt, Human
ccagucagccaagcugcagcgg

SEQ ID NO: 458264 - RNA, 22 nt, Human
uggaaagagguagaggaucugg

SEQ ID NO: 458265 - RNA, 22 nt, Human
cccaaggccuucaagccagcuc

SEQ ID NO: 458266 - RNA, 22 nt, Human
uccugcagccuugggcuggagc

SEQ ID NO: 458267 - RNA, 22 nt, Human
aggcucaguucuguggugagcc

SEQ ID NO: 458268 - RNA, 21 nt, Human
ccagcugucuguccuuaggca

SEQ ID NO: 458269 - RNA, 22 nt, Human
aaaugcacucugcuucugugac

SEQ ID NO: 458270 - RNA, 22 nt, Human
gcagccagaagacucagaacaa

SEQ ID NO: 458271 - RNA, 22 nt, Human
agccaggccagcugucuugagu

SEQ ID NO: 458272 - RNA, 22 nt, Human
gaugaggcucaugcacccugcg

SEQ ID NO: 458273 - RNA, 22 nt, Human
acugugcaugaaccgaaacaaa

SEQ ID NO: 458274 - RNA, 22 nt, Human
guuuacaaauauuuuaaauggu

SEQ ID NO: 458275 - RNA, 22 nt, Human
ucccagggugcgccugcccucg

SEQ ID NO: 458276 - RNA, 22 nt, Human
accugagggcccaaacuuggua

SEQ ID NO: 458277 - RNA, 22 nt, Human
ggccugagucccaccuggcugu

SEQ ID NO: 458278 - RNA, 22 nt, Human
aaacuugauuuagaacuaaggc

SEQ ID NO: 458279 - RNA, 22 nt, Human
gcucccaggaagagaagggcca

SEQ ID NO: 458280 - RNA, 22 nt, Human
uaucuuuagaggaagagaaucu

SEQ ID NO: 458281 - RNA, 22 nt, Human
cacuguacccauuuaaauaaau

SEQ ID NO: 458282 - RNA, 22 nt, Human
gacaagacaugugaugacauca

SEQ ID NO: 458283 - RNA, 22 nt, Human
aggagagucuugagucacuggu

SEQ ID NO: 458284 - RNA, 22 nt, Human
acagagcaguucuggagcuggc

SEQ ID NO: 458285 - RNA, 22 nt, Human
cacaggguuguucugaggauuc

SEQ ID NO: 458286 - RNA, 22 nt, Human
uacaguaacauguuguacaagc

SEQ ID NO: 458287 - RNA, 22 nt, Human
caaggcugcugcgggucgcacc

SEQ ID NO: 458288 - RNA, 22 nt, Human
aggggccugguuggccucuguu

SEQ ID NO: 458289 - RNA, 22 nt, Human
accccagcucugagccacacca

SEQ ID NO: 458290 - RNA, 22 nt, Human
auaugucgcuacaucauuagau

SEQ ID NO: 458291 - RNA, 22 nt, Human
gacagccucaugaggagcaaaa

SEQ ID NO: 458292 - RNA, 22 nt, Human
uaagaacaucuguccccagauu

SEQ ID NO: 458293 - RNA, 22 nt, Human
ucuuuccucugagcuccuguag

SEQ ID NO: 458294 - RNA, 22 nt, Human
ugacccugcuucuuggugcagg

SEQ ID NO: 458295 - RNA, 22 nt, Human
ugacagcauaacacuggucuug

SEQ ID NO: 458296 - RNA, 22 nt, Human
ggcagccaugucccagggcuuc

SEQ ID NO: 458297 - RNA, 22 nt, Human
ucucugaagauauuuauuauua

SEQ ID NO: 458298 - RNA, 22 nt, Human
uaagacauuugaaaugugaucc

SEQ ID NO: 458299 - RNA, 22 nt, Human
gcacacacaugugaguacaugc

SEQ ID NO: 458300 - RNA, 23 nt, Human
cuggcucuguagguggcauccuu

SEQ ID NO: 458301 - RNA, 23 nt, Human
uaagaacagacaagcauuuacau

SEQ ID NO: 458302 - RNA, 22 nt, Human
cugggccagcaacugcaaugga

SEQ ID NO: 458303 - RNA, 22 nt, Human
uggccuuccuggugacucauga

SEQ ID NO: 458304 - RNA, 22 nt, Human
cugagcuggucuauggacuugg

SEQ ID NO: 458305 - RNA, 21 nt, Human
uaaggccaagucuauuucugu

SEQ ID NO: 458306 - RNA, 21 nt, Human
agaugaggauacugaggccua

SEQ ID NO: 458307 - RNA, 22 nt, Human
gggcugagaauucagcuuuccu

SEQ ID NO: 458308 - RNA, 21 nt, Human
agccugcaauguagguaccgg

SEQ ID NO: 458309 - RNA, 22 nt, Human
ugagccuggccugcagagacca

SEQ ID NO: 458310 - RNA, 23 nt, Human
cagggcugggcuugguguuaggc

SEQ ID NO: 458311 - RNA, 22 nt, Human
agggacacugaugagaaauucu

SEQ ID NO: 458312 - RNA, 22 nt, Human
cuucauuaaugucuauaaguuu

SEQ ID NO: 458313 - RNA, 22 nt, Human
ggucucagcaguugcuuugacu

SEQ ID NO: 458314 - RNA, 22 nt, Human
gcugagaggcacuaucuccgga

SEQ ID NO: 458315 - RNA, 22 nt, Human
aaagacugcaaaaacgcacaga

SEQ ID NO: 458316 - RNA, 22 nt, Human
ugaggcucaaggucugguggag

SEQ ID NO: 458317 - RNA, 21 nt, Human
cucuggaggcaagggagagug

SEQ ID NO: 458318 - RNA, 22 nt, Human
ccagaaaaugcagaacauagaa

SEQ ID NO: 458319 - RNA, 22 nt, Human
ugcacacaaguuggagaaugaa

SEQ ID NO: 458320 - RNA, 22 nt, Human
gggcagagguucaacuucaaca

SEQ ID NO: 458321 - RNA, 22 nt, Human
auggauaagaacaaauaucuga

SEQ ID NO: 458322 - RNA, 22 nt, Human
uguccuuuuggcugucuauggu

SEQ ID NO: 458323 - RNA, 22 nt, Human
aaguugaaugcguacgugacau

SEQ ID NO: 458324 - RNA, 22 nt, Human
ucugucacucccugaugaugaa

SEQ ID NO: 458325 - RNA, 22 nt, Human
ugugccugucacccucagagag

SEQ ID NO: 458326 - RNA, 22 nt, Human
aaggaccuauauugucagagga

SEQ ID NO: 458327 - RNA, 22 nt, Human
uugcucagcacuggagccagcu

SEQ ID NO: 458328 - RNA, 22 nt, Human
uaggacaggugaggggcugugg

SEQ ID NO: 458329 - RNA, 20 nt, Human
ggagaugcagcccaggugcc

SEQ ID NO: 458330 - RNA, 22 nt, Human
aaaaagguugauccagauuagg

SEQ ID NO: 458331 - RNA, 22 nt, Human
aggcugaggggcgagggacccu

SEQ ID NO: 458332 - RNA, 22 nt, Human
cuuaaauuuucaucuacaagaa

SEQ ID NO: 458333 - RNA, 22 nt, Human
aaaauguguuuaugcauuucgu

SEQ ID NO: 458334 - RNA, 22 nt, Human
aaggcaguaggaucuuccacag

SEQ ID NO: 458335 - RNA, 22 nt, Human
aggauccugcgcuuugggggag

SEQ ID NO: 458336 - RNA, 22 nt, Human
ugaggcagugugagauaauaaa

SEQ ID NO: 458337 - RNA, 20 nt, Human
uucaggauucuagaccacac

SEQ ID NO: 458338 - RNA, 22 nt, Human
ugucuuuagaaagaagcagaca

SEQ ID NO: 458339 - RNA, 22 nt, Human
gauuuuucaguauaaaauauau

SEQ ID NO: 458340 - RNA, 22 nt, Human
ccuguguggccaggcuggaguc

SEQ ID NO: 458341 - RNA, 22 nt, Human
gacauaauccuccucaccuacu

SEQ ID NO: 458342 - RNA, 22 nt, Human
aagggcagaaagggacgcuuug

SEQ ID NO: 458343 - RNA, 22 nt, Human
aggccucacauugggcuucaag

SEQ ID NO: 458344 - RNA, 22 nt, Human
aucuuccuucacuuucucccac

SEQ ID NO: 458345 - RNA, 22 nt, Human
gggauuugugggauggccagug

SEQ ID NO: 458346 - RNA, 22 nt, Human
ucaggcugcccguucagggcuc

SEQ ID NO: 458347 - RNA, 19 nt, Human
ucugaaguccagggcauac

SEQ ID NO: 458348 - RNA, 22 nt, Human
uuuuugcaccaaccuaauagaa

SEQ ID NO: 458349 - RNA, 21 nt, Human
gacaggcaaggagucacuuag

SEQ ID NO: 458350 - RNA, 22 nt, Human
aucugccugagucuagguuuuc

SEQ ID NO: 458351 - RNA, 22 nt, Human
gcucucagguacaaagcugugu

SEQ ID NO: 458352 - RNA, 22 nt, Human
acugaaauacugcucuuggauu

SEQ ID NO: 458353 - RNA, 22 nt, Human
aaggccagcuuguagggcuggu

SEQ ID NO: 458354 - RNA, 22 nt, Human
uggcuggacagugggcagugga

SEQ ID NO: 458355 - RNA, 22 nt, Human
cccugcagcuuuugcauaguca

SEQ ID NO: 458356 - RNA, 22 nt, Human
gagaagguggaccugaaggagc

SEQ ID NO: 458357 - RNA, 22 nt, Human
acugcuuuucuaagauucugug

SEQ ID NO: 458358 - RNA, 23 nt, Human
agagcuuucuaaaauguaaaucu

SEQ ID NO: 458359 - RNA, 22 nt, Human
uggccugcagaggcuguggggc

SEQ ID NO: 458360 - RNA, 22 nt, Human
cauuuaaucuggcucaugagca

SEQ ID NO: 458361 - RNA, 22 nt, Human
cugcugcaggaugggcacucug

SEQ ID NO: 458362 - RNA, 22 nt, Human
caaagugcuaggauuacaggcc

SEQ ID NO: 458363 - RNA, 22 nt, Human
ugucaccaugccagcuucugcc

SEQ ID NO: 458364 - RNA, 22 nt, Human
aaacucuggagauguuuaugca

SEQ ID NO: 458365 - RNA, 22 nt, Human
gcaggaaagguugagacuuugc

SEQ ID NO: 458366 - RNA, 22 nt, Human
gcaaguacaaacgcaucggcug

SEQ ID NO: 458367 - RNA, 22 nt, Human
uaagccacuagucuguuaugaa

SEQ ID NO: 458368 - RNA, 22 nt, Human
ucucacuuuccagacuuuucaa

SEQ ID NO: 458369 - RNA, 22 nt, Human
gaauucuuuucuuucugaaagu

SEQ ID NO: 458370 - RNA, 22 nt, Human
uggagcagggcaucacugugcg

SEQ ID NO: 458371 - RNA, 22 nt, Human
caggcacuucugcugcuugucu

SEQ ID NO: 458372 - RNA, 22 nt, Human
uuucuuucaauucuccuaaugc

SEQ ID NO: 458373 - RNA, 22 nt, Human
cuggcagcgguuugcagccugg

SEQ ID NO: 458374 - RNA, 22 nt, Human
caggggcucugggugaugugag

SEQ ID NO: 458375 - RNA, 22 nt, Human
gaauuguagagggaacagaagc

SEQ ID NO: 458376 - RNA, 22 nt, Human
cagcuuucaucagugacacuca

SEQ ID NO: 458377 - RNA, 19 nt, Human
ucaaagucugagucacuuu

SEQ ID NO: 458378 - RNA, 22 nt, Human
auuucauugaaguuaauucuuc

SEQ ID NO: 458379 - RNA, 22 nt, Human
gccucugcgccucagccgaccu

SEQ ID NO: 458380 - RNA, 21 nt, Human
agugaaauugcaucagaggga

SEQ ID NO: 458381 - RNA, 22 nt, Human
ucuggcucaggagcuguguuca

SEQ ID NO: 458382 - RNA, 18 nt, Human
uguagagccagguuugcc

SEQ ID NO: 458383 - RNA, 22 nt, Human
agaaauuccuaagguacacaag

SEQ ID NO: 458384 - RNA, 22 nt, Human
ugcugucccccgugucugggcu

SEQ ID NO: 458385 - RNA, 22 nt, Human
acaguggaagcaugaugcuauc

SEQ ID NO: 458386 - RNA, 22 nt, Human
gaggaggcuaagugggcucugg

SEQ ID NO: 458387 - RNA, 22 nt, Human
uugggaaggcguggaagcagaa

SEQ ID NO: 458388 - RNA, 22 nt, Human
accagaguaauguguggaaauu

SEQ ID NO: 458389 - RNA, 22 nt, Human
acagggccagccugggaccugg

SEQ ID NO: 458390 - RNA, 20 nt, Human
cgcccaggagggcccaugug

SEQ ID NO: 458391 - RNA, 23 nt, Human
ccacagagcugccaauuccugug

SEQ ID NO: 458392 - RNA, 22 nt, Human
uucuaccauugggaaaacagcc

SEQ ID NO: 458393 - RNA, 22 nt, Human
gugccugccccacuccucagca

SEQ ID NO: 458394 - RNA, 22 nt, Human
cuguuauuuagaacauggaauc

SEQ ID NO: 458395 - RNA, 22 nt, Human
cugucauuuaagacauucugga

SEQ ID NO: 458396 - RNA, 22 nt, Human
cucaggaugcaauuccaucaag

SEQ ID NO: 458397 - RNA, 20 nt, Human
gucagaggacccuagagcga

SEQ ID NO: 458398 - RNA, 18 nt, Human
acauacauucugucugca

SEQ ID NO: 458399 - RNA, 22 nt, Human
accauuugacucucuaaggaua

SEQ ID NO: 458400 - RNA, 22 nt, Human
cccagacugcagagcgggcaga

SEQ ID NO: 458401 - RNA, 22 nt, Human
acacugugucuagcauuuuaca

SEQ ID NO: 458402 - RNA, 22 nt, Human
ggguaccaagcugcuugggggc

SEQ ID NO: 458403 - RNA, 22 nt, Human
ggcucccaggagggccuggagg

SEQ ID NO: 458404 - RNA, 22 nt, Human
ugacacagauuagagacauacc

SEQ ID NO: 458405 - RNA, 22 nt, Human
caucuuuguaacuuccacauaa

SEQ ID NO: 458406 - RNA, 22 nt, Human
ccagagagggcgccaccuggag

SEQ ID NO: 458407 - RNA, 22 nt, Human
agcagccaaaugaagauuuuac

SEQ ID NO: 458408 - RNA, 22 nt, Human
cagagccagcuguccuuggcau

SEQ ID NO: 458409 - RNA, 22 nt, Human
uugaagauggaucgccacucuc

SEQ ID NO: 458410 - RNA, 20 nt, Human
gucuccacuggggguuaacc

SEQ ID NO: 458411 - RNA, 22 nt, Human
gagcagagacaguacaacuggc

SEQ ID NO: 458412 - RNA, 22 nt, Human
cagagggcucggcggccgcucc

SEQ ID NO: 458413 - RNA, 22 nt, Human
ucucagagaggggccgggccuu

SEQ ID NO: 458414 - RNA, 22 nt, Human
gauuuauuggucuuucauuggu

SEQ ID NO: 458415 - RNA, 22 nt, Human
auuuucaucgcuagguuggccu

SEQ ID NO: 458416 - RNA, 22 nt, Human
aagagcugcccaaggugaacag

SEQ ID NO: 458417 - RNA, 22 nt, Human
ugccucagcugaggccgcucca

SEQ ID NO: 458418 - RNA, 22 nt, Human
uuugaaagcaccauuugaguag

SEQ ID NO: 458419 - RNA, 22 nt, Human
gaacagaagaggcuggugccac

SEQ ID NO: 458420 - RNA, 22 nt, Human
gcugucugacuccaaguuggag

SEQ ID NO: 458421 - RNA, 22 nt, Human
cuggagugauacucagaaugug

SEQ ID NO: 458422 - RNA, 22 nt, Human
uuucauaugggcauuggcaaua

SEQ ID NO: 458423 - RNA, 23 nt, Human
acuuaaaugguucuuuaucucag

SEQ ID NO: 458424 - RNA, 18 nt, Human
agucuucugauccauuuu

SEQ ID NO: 458425 - RNA, 22 nt, Human
uccauuuuagaagaaaauccac

SEQ ID NO: 458426 - RNA, 22 nt, Human
cugcugcucagugucaucaugu

SEQ ID NO: 458427 - RNA, 22 nt, Human
uggagcuggaauuucugggccu

SEQ ID NO: 458428 - RNA, 20 nt, Human
agaauucuuacccuuugaug

SEQ ID NO: 458429 - RNA, 22 nt, Human
ugcugugguucccagaguggau

SEQ ID NO: 458430 - RNA, 22 nt, Human
gcuggcagaauuucuucuugcu

SEQ ID NO: 458431 - RNA, 22 nt, Human
gagcucauucauucauugccug

SEQ ID NO: 458432 - RNA, 22 nt, Human
ccagaggugccacagaaagagc

SEQ ID NO: 458433 - RNA, 22 nt, Human
agcugagagguggcaagcugua

SEQ ID NO: 458434 - RNA, 22 nt, Human
ggcucagaccucccagcuccag

SEQ ID NO: 458435 - RNA, 22 nt, Human
guggugcauccuugaguaagcu

SEQ ID NO: 458436 - RNA, 22 nt, Human
caggauggucagaugcauuguc

SEQ ID NO: 458437 - RNA, 17 nt, Human
cagacagauauccuggg

SEQ ID NO: 458438 - RNA, 22 nt, Human
aaggaaagacauauaaaugacu

SEQ ID NO: 458439 - RNA, 22 nt, Human
ucugagaguagagcugccucuu

SEQ ID NO: 458440 - RNA, 22 nt, Human
ugggcaggauaauaucucaugu

SEQ ID NO: 458441 - RNA, 22 nt, Human
ggggauggauuccgggucccug

SEQ ID NO: 458442 - RNA, 22 nt, Human
uguucauuuggcccuuuuguau

SEQ ID NO: 458443 - RNA, 22 nt, Human
uuucauugucaauaaacuguau

SEQ ID NO: 458444 - RNA, 17 nt, Human
ggcaccagacggagagu

SEQ ID NO: 458445 - RNA, 21 nt, Human
gggcgaggccugauguggcuc

SEQ ID NO: 458446 - RNA, 22 nt, Human
uagaacagaguuccagugauca

SEQ ID NO: 458447 - RNA, 22 nt, Human
ccugucugcggaggaguggaag

SEQ ID NO: 458448 - RNA, 22 nt, Human
gcugucugcugugcacugagca

SEQ ID NO: 458449 - RNA, 22 nt, Human
caugagauaauuuuucuccagu

SEQ ID NO: 458450 - RNA, 22 nt, Human
augucccaagauacagcuagag

SEQ ID NO: 458451 - RNA, 22 nt, Human
aaggcucccucuucucgagugu

SEQ ID NO: 458452 - RNA, 21 nt, Human
guagggacagagaguugguga

SEQ ID NO: 458453 - RNA, 21 nt, Human
cugcucuggggaccggcugug

SEQ ID NO: 458454 - RNA, 22 nt, Human
uagcaggguccaaugugaggca

SEQ ID NO: 458455 - RNA, 22 nt, Human
gaagccagcaguggagaaagga

SEQ ID NO: 458456 - RNA, 22 nt, Human
aaugguuuaacauaugcuugag

SEQ ID NO: 458457 - RNA, 22 nt, Human
agaggcaguauacaauccgagc

SEQ ID NO: 458458 - RNA, 22 nt, Human
gccaggcagcaggaagccagug

SEQ ID NO: 458459 - RNA, 22 nt, Human
gggaucagcaagccacugcacc

SEQ ID NO: 458460 - RNA, 22 nt, Human
uaccuuggguugaguucauucu

SEQ ID NO: 458461 - RNA, 22 nt, Human
gucacacuagggccaaguggag

SEQ ID NO: 458462 - RNA, 22 nt, Human
uucaagaucuuccaaaggauac

SEQ ID NO: 458463 - RNA, 22 nt, Human
gugugcaguagagaaagagcag

SEQ ID NO: 458464 - RNA, 22 nt, Human
ucuaauccuugcuaccugggug

SEQ ID NO: 458465 - RNA, 22 nt, Human
agcagcucaaagccugcaagga

SEQ ID NO: 458466 - RNA, 22 nt, Human
agggcagagacaugcuuccuga

SEQ ID NO: 458467 - RNA, 19 nt, Human
cuggcagccugucuguguc

SEQ ID NO: 458468 - RNA, 22 nt, Human
gagcuguccuaccaggaguccu

SEQ ID NO: 458469 - RNA, 21 nt, Human
ugaagccugaggcauagcccc

SEQ ID NO: 458470 - RNA, 22 nt, Human
uccuggagcuuccuucauggua

SEQ ID NO: 458471 - RNA, 22 nt, Human
uccagccaugcaugacaaucac

SEQ ID NO: 458472 - RNA, 22 nt, Human
gaaaugcauaaucuuaguagau

SEQ ID NO: 458473 - RNA, 22 nt, Human
gagcuuuaagggcacuggucuu

SEQ ID NO: 458474 - RNA, 22 nt, Human
uggaagaaggcagagaggcauu

SEQ ID NO: 458475 - RNA, 20 nt, Human
uccaugaguuagagacuaua

SEQ ID NO: 458476 - RNA, 22 nt, Human
ccucugagaccagcucugcacc

SEQ ID NO: 458477 - RNA, 22 nt, Human
cuugcaggauuuugcugcugua

SEQ ID NO: 458478 - RNA, 22 nt, Human
uagauuucgcugcaucucaauc

SEQ ID NO: 458479 - RNA, 22 nt, Human
uccuccucuaucagacagugcc

SEQ ID NO: 458480 - RNA, 22 nt, Human
uuucauguuuauggaaaaugag

SEQ ID NO: 458481 - RNA, 22 nt, Human
aggcaguguauugcuagcggcu

SEQ ID NO: 458482 - RNA, 22 nt, Human
agcagggcaguuaaaggguccu

SEQ ID NO: 458483 - RNA, 22 nt, Human
gugcuaggauuacaggcauggg

SEQ ID NO: 458484 - RNA, 22 nt, Human
accccagaggcggaggcugcag

SEQ ID NO: 458485 - RNA, 22 nt, Human
gcucaggaaaacagucuaguaa

SEQ ID NO: 458486 - RNA, 22 nt, Human
gagcagugagugaauguugccu

SEQ ID NO: 458487 - RNA, 22 nt, Human
agggccagcccauaaugccaaa

SEQ ID NO: 458488 - RNA, 22 nt, Human
gccugcagccucagagaauuuu

SEQ ID NO: 458489 - RNA, 18 nt, Human
gagaggagccagaauuuu

SEQ ID NO: 458490 - RNA, 20 nt, Human
cucucuggaaggugggagcc

SEQ ID NO: 458491 - RNA, 22 nt, Human
cagggcuagugacaccccaguc

SEQ ID NO: 458492 - RNA, 22 nt, Human
ucccagagguugagucacuuau

SEQ ID NO: 458493 - RNA, 22 nt, Human
gcuggcagacugggggcagaac

SEQ ID NO: 458494 - RNA, 22 nt, Human
cuggcucaauaaauauuagcug

SEQ ID NO: 458495 - RNA, 22 nt, Human
gcagggagguuugcugaccugg

SEQ ID NO: 458496 - RNA, 21 nt, Human
aggcucagagaucaaacagua

SEQ ID NO: 458497 - RNA, 22 nt, Human
guauacauagaugaugaacaag

SEQ ID NO: 458498 - RNA, 22 nt, Human
cacagggccuugugugacugca

SEQ ID NO: 458499 - RNA, 22 nt, Human
ucugcaggaggcuggcugcagg

SEQ ID NO: 458500 - RNA, 22 nt, Human
aaaauaacuucuacuauuugca

SEQ ID NO: 458501 - RNA, 22 nt, Human
agaugcuucaguguuuaauuua

SEQ ID NO: 458502 - RNA, 22 nt, Human
ugggugggagcacccugucugg

SEQ ID NO: 458503 - RNA, 22 nt, Human
gccugcagugagugcagaaggu

SEQ ID NO: 458504 - RNA, 17 nt, Human
ccagagaguaguuagga

SEQ ID NO: 458505 - RNA, 18 nt, Human
uccagagguguuggagcc

SEQ ID NO: 458506 - RNA, 22 nt, Human
aaugcacacauuugguacugaa

SEQ ID NO: 458507 - RNA, 22 nt, Human
cauaauuucuguaucagcacca

SEQ ID NO: 458508 - RNA, 22 nt, Human
acagggccucagccagggcaga

SEQ ID NO: 458509 - RNA, 22 nt, Human
ugagaaagugggugccuagcaa

SEQ ID NO: 458510 - RNA, 22 nt, Human
aaaugcaaggccaugugaagga

SEQ ID NO: 458511 - RNA, 22 nt, Human
guggcugcuaagucuccuuccu

SEQ ID NO: 458512 - RNA, 20 nt, Human
gucucaaguaucucacaguc

SEQ ID NO: 458513 - RNA, 22 nt, Human
uucuaguuaaaguauguauuag

SEQ ID NO: 458514 - RNA, 22 nt, Human
ccuggagauuauuugguccaau

SEQ ID NO: 458515 - RNA, 22 nt, Human
gggaccuggcgagggucacaca

SEQ ID NO: 458516 - RNA, 22 nt, Human
ccagcuggugacauccccaacc

SEQ ID NO: 458517 - RNA, 22 nt, Human
aauauaaauuccugggcccagc

SEQ ID NO: 458518 - RNA, 22 nt, Human
cucuguccuccaccugcuuuca

SEQ ID NO: 458519 - RNA, 22 nt, Human
ccagccugaaaugccucauccu

SEQ ID NO: 458520 - RNA, 22 nt, Human
cccugccugugggcaucaacau

SEQ ID NO: 458521 - RNA, 22 nt, Human
agugcugacucugggcacagug

SEQ ID NO: 458522 - RNA, 22 nt, Human
ucagaacagaagcuggcuauaa

SEQ ID NO: 458523 - RNA, 22 nt, Human
ggccauggaccccgagcugacc

SEQ ID NO: 458524 - RNA, 20 nt, Human
gccuggaggcaaugggaaga

SEQ ID NO: 458525 - RNA, 22 nt, Human
gaugauggacaaagcauuggug

SEQ ID NO: 458526 - RNA, 22 nt, Human
acauuucucagguaagucauuu

SEQ ID NO: 458527 - RNA, 22 nt, Human
cagggcucuucaucacacagua

SEQ ID NO: 458528 - RNA, 22 nt, Human
ucuucacaccgggcagcaggaa

SEQ ID NO: 458529 - RNA, 22 nt, Human
ugggcugcuucuauuggugguc

SEQ ID NO: 458530 - RNA, 20 nt, Human
uucacagaggacucagguca

SEQ ID NO: 458531 - RNA, 22 nt, Human
ucucagagggaaacaugaguga

SEQ ID NO: 458532 - RNA, 22 nt, Human
uuugggcaauucagugggaccu

SEQ ID NO: 458533 - RNA, 22 nt, Human
cccagcuugcgggcggcaggag

SEQ ID NO: 458534 - RNA, 22 nt, Human
ccugggugacccgugagcgucc

SEQ ID NO: 458535 - RNA, 22 nt, Human
cagagcuggagggaacccuggc

SEQ ID NO: 458536 - RNA, 22 nt, Human
ccagagggccuuuggaguuauc

SEQ ID NO: 458537 - RNA, 22 nt, Human
uagggcuguuuaaaagugaggu

SEQ ID NO: 458538 - RNA, 22 nt, Human
gaugggcguggcgcguuuggug

SEQ ID NO: 458539 - RNA, 22 nt, Human
ucagggcagccuaaggcaccuc

SEQ ID NO: 458540 - RNA, 22 nt, Human
gcagagccugggggucugcgga

SEQ ID NO: 458541 - RNA, 22 nt, Human
cacccagccuucacacaggagu

SEQ ID NO: 458542 - RNA, 22 nt, Human
uuauuuucuccucagaaagugg

SEQ ID NO: 458543 - RNA, 22 nt, Human
aggcagccagauggcagccugc

SEQ ID NO: 458544 - RNA, 22 nt, Human
aggcacuguucccaguuauccu

SEQ ID NO: 458545 - RNA, 22 nt, Human
ccacagagacaggguccuugcu

SEQ ID NO: 458546 - RNA, 19 nt, Human
ucuaacagaagugucgucc

SEQ ID NO: 458547 - RNA, 22 nt, Human
gggcagcagaggaucccuuaau

SEQ ID NO: 458548 - RNA, 22 nt, Human
cucaacagcucugccauacucc

SEQ ID NO: 458549 - RNA, 18 nt, Human
gaugggagcaagagaaga

SEQ ID NO: 458550 - RNA, 22 nt, Human
cuucugggcauucagcugcaca

SEQ ID NO: 458551 - RNA, 22 nt, Human
gcuggagccauuggcuuggccu

SEQ ID NO: 458552 - RNA, 22 nt, Human
cugggcagccucacacaauguu

SEQ ID NO: 458553 - RNA, 22 nt, Human
cugggggcaagcagacagcugu

SEQ ID NO: 458554 - RNA, 20 nt, Human
gccugccucagcuagcugag

SEQ ID NO: 458555 - RNA, 22 nt, Human
ggaagccaggcugggggaucug

SEQ ID NO: 458556 - RNA, 17 nt, Human
aggcagcucagaacauc

SEQ ID NO: 458557 - RNA, 22 nt, Human
ugcagccaucgcagagucugua

SEQ ID NO: 458558 - RNA, 22 nt, Human
uucaagaugcacaguggcauuc

SEQ ID NO: 458559 - RNA, 22 nt, Human
acuuuuaugauaaucaauguuc

SEQ ID NO: 458560 - RNA, 22 nt, Human
gugccugggcaugagcuuguug

SEQ ID NO: 458561 - RNA, 22 nt, Human
gacaagacagcuugcagacaac

SEQ ID NO: 458562 - RNA, 22 nt, Human
uuauuugcccauguuuagcaga

SEQ ID NO: 458563 - RNA, 21 nt, Human
ccaggcuccugaggcugguca

SEQ ID NO: 458564 - RNA, 22 nt, Human
acauuuuaauaugcuuagugug

SEQ ID NO: 458565 - RNA, 22 nt, Human
aaacaucaccauuuuaccuaau

SEQ ID NO: 458566 - RNA, 22 nt, Human
ucugucauguuuccauuacaug

SEQ ID NO: 458567 - RNA, 22 nt, Human
uagcagaaccagcagucaauuu

SEQ ID NO: 458568 - RNA, 22 nt, Human
aagagguaaccauagcaaccac

SEQ ID NO: 458569 - RNA, 22 nt, Human
cuggaagguucuuugugugccu

SEQ ID NO: 458570 - RNA, 22 nt, Human
gagaggccauggcugugcagug

SEQ ID NO: 458571 - RNA, 22 nt, Human
ugggcuggcugaacuucaaccu

SEQ ID NO: 458572 - RNA, 22 nt, Human
gcacccagggacuuggcuggcc

SEQ ID NO: 458573 - RNA, 22 nt, Human
ccugccucaucaacuugucgug

SEQ ID NO: 458574 - RNA, 22 nt, Human
ccaggaggcagagguuacagug

SEQ ID NO: 458575 - RNA, 22 nt, Human
ccaguggaauuaaaaauaagug

SEQ ID NO: 458576 - RNA, 22 nt, Human
cuuguaauuauaauguacuguu

SEQ ID NO: 458577 - RNA, 22 nt, Human
gcugcucucagagcucaugcug

SEQ ID NO: 458578 - RNA, 22 nt, Human
uuugaaagccuggcuuuucucu

SEQ ID NO: 458579 - RNA, 22 nt, Human
acauuugucuucuuucagauua

SEQ ID NO: 458580 - RNA, 22 nt, Human
ucugggagagcugcugucagag

SEQ ID NO: 458581 - RNA, 22 nt, Human
cugcugggucuaugcaagugga

SEQ ID NO: 458582 - RNA, 22 nt, Human
cuggccacaacuagcccaggac

SEQ ID NO: 458583 - RNA, 22 nt, Human
caggcacuggccagucagcaca

SEQ ID NO: 458584 - RNA, 22 nt, Human
uauuuagaacagacaauagaaa

SEQ ID NO: 458585 - RNA, 22 nt, Human
gcagagcaccaaagugaaagau

SEQ ID NO: 458586 - RNA, 22 nt, Human
ccuaggccuuacuuuccugugc

SEQ ID NO: 458587 - RNA, 19 nt, Human
acagaagcauagaaaagga

SEQ ID NO: 458588 - RNA, 22 nt, Human
gccaccucuuugucucugccgc

SEQ ID NO: 458589 - RNA, 22 nt, Human
uuucuauucuggaucuguggca

SEQ ID NO: 458590 - RNA, 22 nt, Human
ugcugccuucuaggcgugcccu

SEQ ID NO: 458591 - RNA, 22 nt, Human
cacauuucugugagucaauauu

SEQ ID NO: 458592 - RNA, 22 nt, Human
gagcucagcccaaagagcagug

SEQ ID NO: 458593 - RNA, 22 nt, Human
gggagcaggagccugccugcca

SEQ ID NO: 458594 - RNA, 22 nt, Human
ggucagggcucuuccaguggcu

SEQ ID NO: 458595 - RNA, 22 nt, Human
cacugcagcaccaugcagggcu

SEQ ID NO: 458596 - RNA, 22 nt, Human
aaggcagcccuggcucagccug

SEQ ID NO: 458597 - RNA, 22 nt, Human
uggggugguaauacaccguucu

SEQ ID NO: 458598 - RNA, 22 nt, Human
cagggcagaacauauagauagu

SEQ ID NO: 458599 - RNA, 18 nt, Human
aggccagcccugcuacug

SEQ ID NO: 458600 - RNA, 22 nt, Human
acuuccaaauaccaucacauug

SEQ ID NO: 458601 - RNA, 22 nt, Human
agcugccacugagggugcacag

SEQ ID NO: 458602 - RNA, 22 nt, Human
ugucuucaguaaaauacacuau

SEQ ID NO: 458603 - RNA, 22 nt, Human
ugccugcugcuaagcucuuugu

SEQ ID NO: 458604 - RNA, 22 nt, Human
uccuugaagagugggcggucga

SEQ ID NO: 458605 - RNA, 22 nt, Human
aaauaauguuaggccuuugcuc

SEQ ID NO: 458606 - RNA, 22 nt, Human
uggaaguggcagaaaaugaaca

SEQ ID NO: 458607 - RNA, 22 nt, Human
ccucagggucugaggagaccgu

SEQ ID NO: 458608 - RNA, 22 nt, Human
aauaaauguuaagauugucuca

SEQ ID NO: 458609 - RNA, 22 nt, Human
gccugguggacacugggcauca

SEQ ID NO: 458610 - RNA, 22 nt, Human
aauuaguauugcgauucauuag

SEQ ID NO: 458611 - RNA, 18 nt, Human
aaagaaggauuggagagc

SEQ ID NO: 458612 - RNA, 19 nt, Human
ugguggcaaugucagcuaa

SEQ ID NO: 458613 - RNA, 22 nt, Human
gaaggaaaucugugauuuaugc

SEQ ID NO: 458614 - RNA, 22 nt, Human
gcccuggccuucaucucagaca

SEQ ID NO: 458615 - RNA, 19 nt, Human
uugaaagauuagcuuucua

SEQ ID NO: 458616 - RNA, 22 nt, Human
cucucuucccgugaguguugca

SEQ ID NO: 458617 - RNA, 22 nt, Human
agguggguaucaugagagauua

SEQ ID NO: 458618 - RNA, 19 nt, Human
ugacaggcuguugccuuga

SEQ ID NO: 458619 - RNA, 22 nt, Human
ugcaccauuaauuuaugugaga

SEQ ID NO: 458620 - RNA, 18 nt, Human
ucugucucuguccuugcu

SEQ ID NO: 458621 - RNA, 22 nt, Human
ugaggccuggacucugcaugga

SEQ ID NO: 458622 - RNA, 22 nt, Human
aauaagaauuuacuugucaaga

SEQ ID NO: 458623 - RNA, 22 nt, Human
gaugcacaugugaguauagaag

SEQ ID NO: 458624 - RNA, 22 nt, Human
uuucucaucuggaaacagugcu

SEQ ID NO: 458625 - RNA, 18 nt, Human
gguggcaggucagaugcc

SEQ ID NO: 458626 - RNA, 22 nt, Human
gucaggaugagggaugaggagu

SEQ ID NO: 458627 - RNA, 22 nt, Human
aggacuuagaacauuauguacu

SEQ ID NO: 458628 - RNA, 22 nt, Human
ucacauacacuaggauauuuuu

SEQ ID NO: 458629 - RNA, 23 nt, Human
uucauuugucuacuucacuuguu

SEQ ID NO: 458630 - RNA, 22 nt, Human
gauuucaaggauguuagaggug

SEQ ID NO: 458631 - RNA, 22 nt, Human
cagcaauaagccagguuagaca

SEQ ID NO: 458632 - RNA, 22 nt, Human
cuggggcucacuuuggucaggc

SEQ ID NO: 458633 - RNA, 22 nt, Human
uuuucauuuacauuagggaaga

SEQ ID NO: 458634 - RNA, 22 nt, Human
ggaggccagggacccagucagc

SEQ ID NO: 458635 - RNA, 22 nt, Human
aaaacauguccauacagaaacu

SEQ ID NO: 458636 - RNA, 23 nt, Human
aaaguguagccagguuaagaacc

SEQ ID NO: 458637 - RNA, 22 nt, Human
agugaaauuccuggucuuuguu

SEQ ID NO: 458638 - RNA, 22 nt, Human
cucccuggaggcccagaccugg

SEQ ID NO: 458639 - RNA, 22 nt, Human
caaggccauauugccuguaugu

SEQ ID NO: 458640 - RNA, 22 nt, Human
ccugggcuggaguacagcagug

SEQ ID NO: 458641 - RNA, 22 nt, Human
gaggccugguagccgagcccca

SEQ ID NO: 458642 - RNA, 22 nt, Human
gcagagcugggucuguauccaa

SEQ ID NO: 458643 - RNA, 22 nt, Human
auugucuguacuuuaaaaaugu

SEQ ID NO: 458644 - RNA, 22 nt, Human
ucacaggguguacaucaccuau

SEQ ID NO: 458645 - RNA, 22 nt, Human
agcccuagagcuggaggucagu

SEQ ID NO: 458646 - RNA, 22 nt, Human
gaaaugcaaauucucucucgcu

SEQ ID NO: 458647 - RNA, 22 nt, Human
agguggggaaaccagcgauccc

SEQ ID NO: 458648 - RNA, 22 nt, Human
uagggcagccacccaggcugcu

SEQ ID NO: 458649 - RNA, 22 nt, Human
ucagcuuuugucagaaauugua

SEQ ID NO: 458650 - RNA, 20 nt, Human
accauaauguuaauuacaaa

SEQ ID NO: 458651 - RNA, 22 nt, Human
cugagggagggacuuugagacu

SEQ ID NO: 458652 - RNA, 22 nt, Human
acagagagguaaaauauauagu

SEQ ID NO: 458653 - RNA, 22 nt, Human
uagaucugauacaauucaucug

SEQ ID NO: 458654 - RNA, 22 nt, Human
cuucuuuccuuccuccaguggc

SEQ ID NO: 458655 - RNA, 22 nt, Human
agggacagaugaaugacugagu

SEQ ID NO: 458656 - RNA, 22 nt, Human
acaaaaguguaggaauuccuua

SEQ ID NO: 458657 - RNA, 22 nt, Human
gauuucaaggaguuuucacagu

SEQ ID NO: 458658 - RNA, 22 nt, Human
ggguggggcccaggaaaucuau

SEQ ID NO: 458659 - RNA, 22 nt, Human
auaugauuccacuauuguaugg

SEQ ID NO: 458660 - RNA, 22 nt, Human
uucugucuucccacugaggagc

SEQ ID NO: 458661 - RNA, 22 nt, Human
aagcagcagaccugauuuugaa

SEQ ID NO: 458662 - RNA, 19 nt, Human
cugugcuuuaaacuccuau

SEQ ID NO: 458663 - RNA, 22 nt, Human
ccagagaguaggaggcauuauu

SEQ ID NO: 458664 - RNA, 22 nt, Human
uccugggcuguggccccgggca

SEQ ID NO: 458665 - RNA, 22 nt, Human
cuggccuuuagccccagugucu

SEQ ID NO: 458666 - RNA, 22 nt, Human
cucaggagagucuuauaucucc

SEQ ID NO: 458667 - RNA, 22 nt, Human
uggcagagaacacggcugaucu

SEQ ID NO: 458668 - RNA, 22 nt, Human
ucauuuguggaagugauugugg

SEQ ID NO: 458669 - RNA, 22 nt, Human
gucuccugagacugcagucacc

SEQ ID NO: 458670 - RNA, 22 nt, Human
uuugaaaguguuuacuugggaa

SEQ ID NO: 458671 - RNA, 22 nt, Human
gcagcagaggcccuacucuuug

SEQ ID NO: 458672 - RNA, 18 nt, Human
caggaugagugaugggga

SEQ ID NO: 458673 - RNA, 20 nt, Human
ucccaaggaugccugggugu

SEQ ID NO: 458674 - RNA, 22 nt, Human
gugagcaggauaggggcucccu

SEQ ID NO: 458675 - RNA, 22 nt, Human
cucugagaggugagaagcagca

SEQ ID NO: 458676 - RNA, 22 nt, Human
ugggaccugcccuggccccauc

SEQ ID NO: 458677 - RNA, 22 nt, Human
gccuggugugcgccgcgcagcu

SEQ ID NO: 458678 - RNA, 22 nt, Human
aggccugggacgggagccguga

SEQ ID NO: 458679 - RNA, 22 nt, Human
ggcuggcuuucucuccgcaccu

SEQ ID NO: 458680 - RNA, 22 nt, Human
cuggcuggccggagcgaggcgg

SEQ ID NO: 458681 - RNA, 22 nt, Human
ggagccagggaagcugcuuccu

SEQ ID NO: 458682 - RNA, 22 nt, Human
gcaggaugagugaguacauuua

SEQ ID NO: 458683 - RNA, 22 nt, Human
guguccagggccguguugucuu

SEQ ID NO: 458684 - RNA, 22 nt, Human
gcugcucuugaggggcucacug

SEQ ID NO: 458685 - RNA, 22 nt, Human
agguuacagugauuauagguuu

SEQ ID NO: 458686 - RNA, 22 nt, Human
cagcugugagcagccaguugcc

SEQ ID NO: 458687 - RNA, 22 nt, Human
uguguuccuucgucuucccuuc

SEQ ID NO: 458688 - RNA, 22 nt, Human
uuugggcaguagauguaucacu

SEQ ID NO: 458689 - RNA, 22 nt, Human
guuuauuauucaacuucauguu

SEQ ID NO: 458690 - RNA, 22 nt, Human
uagggcucagcucuagcuccug

SEQ ID NO: 458691 - RNA, 22 nt, Human
ugggaugggaucucgcuguguc

SEQ ID NO: 458692 - RNA, 22 nt, Human
gccaccagugggggccugggca

SEQ ID NO: 458693 - RNA, 22 nt, Human
aaagauuuaagaauaauuugug

SEQ ID NO: 458694 - RNA, 22 nt, Human
agcacccuccaacuucccugua

SEQ ID NO: 458695 - RNA, 22 nt, Human
ccugucauacuaacguaguggg

SEQ ID NO: 458696 - RNA, 22 nt, Human
aucaggaucagggcuagcagag

SEQ ID NO: 458697 - RNA, 22 nt, Human
cccugcagagagugcuuuugug

SEQ ID NO: 458698 - RNA, 22 nt, Human
gcugccuggcuuuaguccacuu

SEQ ID NO: 458699 - RNA, 22 nt, Human
ugcagggcuacaggacuacaac

SEQ ID NO: 458700 - RNA, 22 nt, Human
uggcugaguguuccaaggagca

SEQ ID NO: 458701 - RNA, 22 nt, Human
ggguacuuaauauuuacggggu

SEQ ID NO: 458702 - RNA, 19 nt, Human
ucauuguugguuugucggg

SEQ ID NO: 458703 - RNA, 22 nt, Human
ggacucagcagccaggaguggc

SEQ ID NO: 458704 - RNA, 22 nt, Human
ccauggagcgggugagugagug

SEQ ID NO: 458705 - RNA, 22 nt, Human
aggcccuggcacugccugggag

SEQ ID NO: 458706 - RNA, 22 nt, Human
ugaagccuuguguggccucucu

SEQ ID NO: 458707 - RNA, 22 nt, Human
agaauaaaucaaauguccugag

SEQ ID NO: 458708 - RNA, 20 nt, Human
gaggaaaagcugccaggccu

SEQ ID NO: 458709 - RNA, 22 nt, Human
aucaguuuuuauuaauguagcu

SEQ ID NO: 458710 - RNA, 22 nt, Human
aucagcugaaaaacaggcagca

SEQ ID NO: 458711 - RNA, 22 nt, Human
ucuuuggauaucgcuagaccgu

SEQ ID NO: 458712 - RNA, 22 nt, Human
aaugcacaaaaauuguauguaa

SEQ ID NO: 458713 - RNA, 22 nt, Human
ggaaacagagggcaccugagcc

SEQ ID NO: 458714 - RNA, 22 nt, Human
ccucucucuccugcacacacac

SEQ ID NO: 458715 - RNA, 22 nt, Human
caaaugcauaguuuauaagaag

SEQ ID NO: 458716 - RNA, 22 nt, Human
aauggccagcaacaggagugaa

SEQ ID NO: 458717 - RNA, 22 nt, Human
gccugagcuacuagggagucug

SEQ ID NO: 458718 - RNA, 22 nt, Human
uguaacaguaagccugugagcu

SEQ ID NO: 458719 - RNA, 22 nt, Human
gagggcagagacagugauucac

SEQ ID NO: 458720 - RNA, 22 nt, Human
ggucccagcugcucaagaggcu

SEQ ID NO: 458721 - RNA, 22 nt, Human
aggcuucagaaagaguaauugg

SEQ ID NO: 458722 - RNA, 22 nt, Human
ucuuuacaguccucugucaauc

SEQ ID NO: 458723 - RNA, 22 nt, Human
gagccuggccuccugccucagc

SEQ ID NO: 458724 - RNA, 22 nt, Human
agggccugggccagcacccuuu

SEQ ID NO: 458725 - RNA, 22 nt, Human
auuuuaauaagauucccaagua

SEQ ID NO: 458726 - RNA, 22 nt, Human
guaagagcacugucuccugcug

SEQ ID NO: 458727 - RNA, 22 nt, Human
cuuuauguccaccagacugcaa

SEQ ID NO: 458728 - RNA, 22 nt, Human
ccagggcugagcugugaccaug

SEQ ID NO: 458729 - RNA, 22 nt, Human
gcaggggcaggagaucucaggc

SEQ ID NO: 458730 - RNA, 22 nt, Human
ggcugccucaaagcucaagcuc

SEQ ID NO: 458731 - RNA, 22 nt, Human
uguugauuaguguuuagacuua

SEQ ID NO: 458732 - RNA, 22 nt, Human
ugccaggcaacugcccagccau

SEQ ID NO: 458733 - RNA, 22 nt, Human
aggugcagaaaaaaguccuuua

SEQ ID NO: 458734 - RNA, 22 nt, Human
uggcugagggggcaguucagga

SEQ ID NO: 458735 - RNA, 22 nt, Human
caugggcuacagaagcaugcug

SEQ ID NO: 458736 - RNA, 22 nt, Human
ggcucaggaugagccuucucau

SEQ ID NO: 458737 - RNA, 22 nt, Human
gggcuucuagaccagcagugag

SEQ ID NO: 458738 - RNA, 19 nt, Human
ugaaacaaacuuaaaagga

SEQ ID NO: 458739 - RNA, 22 nt, Human
agccagccgggggaccacagug

SEQ ID NO: 458740 - RNA, 22 nt, Human
gggccagugaacaaugagggaa

SEQ ID NO: 458741 - RNA, 22 nt, Human
uccuugaagcuuguaucuaaua

SEQ ID NO: 458742 - RNA, 22 nt, Human
ugccugucuuaauaucuggaaa

SEQ ID NO: 458743 - RNA, 22 nt, Human
ccaaggcuccucagcuggucuu

SEQ ID NO: 458744 - RNA, 22 nt, Human
ucagggcacaggccuguggguu

SEQ ID NO: 458745 - RNA, 22 nt, Human
agaggcugggaaggguccccgg

SEQ ID NO: 458746 - RNA, 22 nt, Human
ucagcagggccuccuugugcag

SEQ ID NO: 458747 - RNA, 22 nt, Human
cagucccagacauaguaaggga

SEQ ID NO: 458748 - RNA, 22 nt, Human
gguccagggaacuuugaaggau

SEQ ID NO: 458749 - RNA, 22 nt, Human
uuacaggggacauuggggacau

SEQ ID NO: 458750 - RNA, 22 nt, Human
augaguaagaccauaauuuuug

SEQ ID NO: 458751 - RNA, 22 nt, Human
ccuggcaguuuugcccaggauu

SEQ ID NO: 458752 - RNA, 20 nt, Human
caguccaaucagaggccacc

SEQ ID NO: 458753 - RNA, 22 nt, Human
uagccuucucaagacaaaguug

SEQ ID NO: 458754 - RNA, 22 nt, Human
aaagaagguagggcuggugacu

SEQ ID NO: 458755 - RNA, 22 nt, Human
cugcagggugacguugcccacc

SEQ ID NO: 458756 - RNA, 22 nt, Human
cucugcugcccaggccugcuag

SEQ ID NO: 458757 - RNA, 22 nt, Human
ucagcaauccucccacaggugg

SEQ ID NO: 458758 - RNA, 22 nt, Human
cuggcagccaagugggauacuc

SEQ ID NO: 458759 - RNA, 22 nt, Human
auauuagggucucuaaauucua

SEQ ID NO: 458760 - RNA, 22 nt, Human
gcaguccaaaguggcucucacc

SEQ ID NO: 458761 - RNA, 22 nt, Human
gccugcagccagggaguucucu

SEQ ID NO: 458762 - RNA, 19 nt, Human
gcucugagaggggcauggg

SEQ ID NO: 458763 - RNA, 22 nt, Human
ggcuucugccacgagagggaag

SEQ ID NO: 458764 - RNA, 22 nt, Human
gcagggaccucacuacccccag

SEQ ID NO: 458765 - RNA, 22 nt, Human
ucuucucaguuucucuaggaug

SEQ ID NO: 458766 - RNA, 22 nt, Human
auuauuaggugcucucugacaa

SEQ ID NO: 458767 - RNA, 22 nt, Human
gacccaggguauccagagcugc

SEQ ID NO: 458768 - RNA, 22 nt, Human
gauggcacacagacauccccgc

SEQ ID NO: 458769 - RNA, 22 nt, Human
ugaggcaggaguucaggcugcg

SEQ ID NO: 458770 - RNA, 22 nt, Human
ugaagccauuacuguguuaggg

SEQ ID NO: 458771 - RNA, 22 nt, Human
ucugggagauccaagcagaacu

SEQ ID NO: 458772 - RNA, 22 nt, Human
ugaggcucagagaagugcuguu

SEQ ID NO: 458773 - RNA, 22 nt, Human
ccagcuuucucagaggcuucua

SEQ ID NO: 458774 - RNA, 22 nt, Human
gcccugucggaacugcgaccuc

SEQ ID NO: 458775 - RNA, 22 nt, Human
gcaggugggggucggugcaucu

SEQ ID NO: 458776 - RNA, 22 nt, Human
cagaagagaugaaauaguauua

SEQ ID NO: 458777 - RNA, 22 nt, Human
caggagcccguugcuccggcgg

SEQ ID NO: 458778 - RNA, 22 nt, Human
aauguuuuagauuacugcuggg

SEQ ID NO: 458779 - RNA, 22 nt, Human
gggauggggagcuggaaagggg

SEQ ID NO: 458780 - RNA, 22 nt, Human
aacagugagaagguggacagga

SEQ ID NO: 458781 - RNA, 22 nt, Human
gcagggcacaaggacgcacagg

SEQ ID NO: 458782 - RNA, 22 nt, Human
ugaagcagagaauuugacaguc

SEQ ID NO: 458783 - RNA, 22 nt, Human
gagcugugagggacacauugcu

SEQ ID NO: 458784 - RNA, 22 nt, Human
uguggaaaauuggaacguuccu

SEQ ID NO: 458785 - RNA, 22 nt, Human
uuauuuauucauucugucuguc

SEQ ID NO: 458786 - RNA, 22 nt, Human
acagaauucucucugcagaggc

SEQ ID NO: 458787 - RNA, 22 nt, Human
cagaguucaaagccugcuggga

SEQ ID NO: 458788 - RNA, 22 nt, Human
cagcugaguuuccaagucugcc

SEQ ID NO: 458789 - RNA, 22 nt, Human
acaaaggugagcagaagacaca

SEQ ID NO: 458790 - RNA, 20 nt, Human
gggcuggcgcauggggaaag

SEQ ID NO: 458791 - RNA, 22 nt, Human
cacagagagcuacgugcagcgu

SEQ ID NO: 458792 - RNA, 22 nt, Human
uugagggucuggaucugcugcu

SEQ ID NO: 458793 - RNA, 22 nt, Human
augcuuuuccaggagaaauaua

SEQ ID NO: 458794 - RNA, 23 nt, Human
gguggcaggaguggaugcugagc

SEQ ID NO: 458795 - RNA, 22 nt, Human
ucugugcaggaagucauuauga

SEQ ID NO: 458796 - RNA, 22 nt, Human
agcuuuauauaaaagaguacau

SEQ ID NO: 458797 - RNA, 22 nt, Human
ugggcugcccaagguggccaug

SEQ ID NO: 458798 - RNA, 22 nt, Human
ggcucaagcagucugccugccu

SEQ ID NO: 458799 - RNA, 22 nt, Human
cauuguauugaggauacuuaag

SEQ ID NO: 458800 - RNA, 22 nt, Human
auacauuagaaucugguacuca

SEQ ID NO: 458801 - RNA, 22 nt, Human
ucuaaaaaagucuguucacuug

SEQ ID NO: 458802 - RNA, 22 nt, Human
auagaacagaaacagaugcaca

SEQ ID NO: 458803 - RNA, 22 nt, Human
ucuuuacaaucuaagcauaguu

SEQ ID NO: 458804 - RNA, 22 nt, Human
agagccccugguggagugagaa

SEQ ID NO: 458805 - RNA, 17 nt, Human
cagugcagagcccuuuc

SEQ ID NO: 458806 - RNA, 22 nt, Human
cagaccaucuugaagcaaacug

SEQ ID NO: 458807 - RNA, 22 nt, Human
agaagcugccuacaugaccagc

SEQ ID NO: 458808 - RNA, 22 nt, Human
gggucuggcaugcugagaugga

SEQ ID NO: 458809 - RNA, 22 nt, Human
ucaggaugagcucauaacuaug

SEQ ID NO: 458810 - RNA, 22 nt, Human
agcagcugccagagagaguucc

SEQ ID NO: 458811 - RNA, 22 nt, Human
agugccuggaccccaugacaua

SEQ ID NO: 458812 - RNA, 22 nt, Human
cuuguagaauugaaauggucuc

SEQ ID NO: 458813 - RNA, 22 nt, Human
cugccucaugcugccugcagcc

SEQ ID NO: 458814 - RNA, 22 nt, Human
gacaggaggcagagcucaggug

SEQ ID NO: 458815 - RNA, 22 nt, Human
uugcucugacuggagugcagug

SEQ ID NO: 458816 - RNA, 22 nt, Human
uuagccauuaauguccugugca

SEQ ID NO: 458817 - RNA, 22 nt, Human
ggucacugcucuaaacaaaagu

SEQ ID NO: 458818 - RNA, 22 nt, Human
uucucuugugccaaguuguugc

SEQ ID NO: 458819 - RNA, 22 nt, Human
auccuuggaugugucuuuuugu

SEQ ID NO: 458820 - RNA, 21 nt, Human
cugagggccgcagcugggcuc

SEQ ID NO: 458821 - RNA, 22 nt, Human
acaggcaggcuucggccagagc

SEQ ID NO: 458822 - RNA, 20 nt, Human
uguggcaggaugagggcgga

SEQ ID NO: 458823 - RNA, 22 nt, Human
aagagguugucugugaugaguu

SEQ ID NO: 458824 - RNA, 22 nt, Human
gguggcuggaggagcugaugga

SEQ ID NO: 458825 - RNA, 22 nt, Human
aaggacagaaacagauugcugg

SEQ ID NO: 458826 - RNA, 21 nt, Human
caugaagccgguucccuguuu

SEQ ID NO: 458827 - RNA, 22 nt, Human
ugaguccaauaggggccuggaa

SEQ ID NO: 458828 - RNA, 22 nt, Human
cagguaggauggaagggcucaa

SEQ ID NO: 458829 - RNA, 22 nt, Human
augugcaugcacuuacaugugu

SEQ ID NO: 458830 - RNA, 22 nt, Human
gaaggccuaggaaggaagccuu

SEQ ID NO: 458831 - RNA, 22 nt, Human
auuuauuaccucggaguuucug

SEQ ID NO: 458832 - RNA, 19 nt, Human
gaaaggcugcugcuaccug

SEQ ID NO: 458833 - RNA, 19 nt, Human
gcucagagggcccugugcu

SEQ ID NO: 458834 - RNA, 19 nt, Human
ugcagaagacacaguggug

SEQ ID NO: 458835 - RNA, 22 nt, Human
aggcugucucaccucaggaggg

SEQ ID NO: 458836 - RNA, 22 nt, Human
aaaguucucuaugguguaaaaa

SEQ ID NO: 458837 - RNA, 22 nt, Human
cugccucucaggucccugagau

SEQ ID NO: 458838 - RNA, 22 nt, Human
uggagccugagucagcggaggc

SEQ ID NO: 458839 - RNA, 22 nt, Human
uuccaggacaagauguuucagg

SEQ ID NO: 458840 - RNA, 20 nt, Human
agucccuuuggucagguauu

SEQ ID NO: 458841 - RNA, 22 nt, Human
caguggaauauauaggggauuu

SEQ ID NO: 458842 - RNA, 22 nt, Human
agcuguggaagacugucagggu

SEQ ID NO: 458843 - RNA, 22 nt, Human
cgcaccacugaauuccagccug

SEQ ID NO: 458844 - RNA, 22 nt, Human
ugaggccugacagaccaagccu

SEQ ID NO: 458845 - RNA, 22 nt, Human
ggcccuguccuggcugucuccg

SEQ ID NO: 458846 - RNA, 22 nt, Human
uauguacaaucagcaguucaua

SEQ ID NO: 458847 - RNA, 22 nt, Human
agucugucuaauauuauucagg

SEQ ID NO: 458848 - RNA, 22 nt, Human
cugcagagcuaggcugagugaa

SEQ ID NO: 458849 - RNA, 22 nt, Human
ugggcaggaugcguugauucuu

SEQ ID NO: 458850 - RNA, 22 nt, Human
uuccugagggacuuuugagauu

SEQ ID NO: 458851 - RNA, 22 nt, Human
gaagggagaagguugggugacg

SEQ ID NO: 458852 - RNA, 18 nt, Human
cugcugugucgucugggc

SEQ ID NO: 458853 - RNA, 22 nt, Human
ugucaugccaggaaauaguccc

SEQ ID NO: 458854 - RNA, 22 nt, Human
uucaagauaauaggaaugaaaa

SEQ ID NO: 458855 - RNA, 22 nt, Human
ugcccaaguccuccaccgaggu

SEQ ID NO: 458856 - RNA, 22 nt, Human
agugcugaagacuggcuaggga

SEQ ID NO: 458857 - RNA, 22 nt, Human
ucuucauuuuauagcaucugug

SEQ ID NO: 458858 - RNA, 22 nt, Human
ccugcucagagcgucuugugug

SEQ ID NO: 458859 - RNA, 22 nt, Human
cccugccucugaagcugcucag

SEQ ID NO: 458860 - RNA, 22 nt, Human
ccacagccauuccagggaggcu

SEQ ID NO: 458861 - RNA, 22 nt, Human
auuuucucucaaaccuuaaaau

SEQ ID NO: 458862 - RNA, 22 nt, Human
cccaggcacauccacucuguga

SEQ ID NO: 458863 - RNA, 22 nt, Human
uaaacaagcugucugauauucu

SEQ ID NO: 458864 - RNA, 21 nt, Human
uuacaaagcaagugcuguguc

SEQ ID NO: 458865 - RNA, 22 nt, Human
acucugaggcaggucagggcag

SEQ ID NO: 458866 - RNA, 22 nt, Human
uguggcucucagauccuccaau

SEQ ID NO: 458867 - RNA, 22 nt, Human
ggcacugaauuucuuggcaucu

SEQ ID NO: 458868 - RNA, 22 nt, Human
acaggcugccuaccaaguauca

SEQ ID NO: 458869 - RNA, 22 nt, Human
gacuuucucuccucccaggugu

SEQ ID NO: 458870 - RNA, 22 nt, Human
caggcagcugacugucagauau

SEQ ID NO: 458871 - RNA, 22 nt, Human
guggcccaggcuuggcgcuggc

SEQ ID NO: 458872 - RNA, 22 nt, Human
acaucacagagcccagauaaag

SEQ ID NO: 458873 - RNA, 22 nt, Human
aaaagucagucucuccuagcuc

SEQ ID NO: 458874 - RNA, 17 nt, Human
agguggcugcugcgccu

SEQ ID NO: 458875 - RNA, 22 nt, Human
ugaagcagauggucuggucauu

SEQ ID NO: 458876 - RNA, 22 nt, Human
gugaggcagcaggagccucugu

SEQ ID NO: 458877 - RNA, 22 nt, Human
cugggccagggaggugucugua

SEQ ID NO: 458878 - RNA, 22 nt, Human
aagggcucacccaacucacuuc

SEQ ID NO: 458879 - RNA, 22 nt, Human
acugcuuuuagaaaucuauaga

SEQ ID NO: 458880 - RNA, 22 nt, Human
gcaaaaaccacaauuacuuuug

SEQ ID NO: 458881 - RNA, 22 nt, Human
acagcuuuaucucagggaucag

SEQ ID NO: 458882 - RNA, 22 nt, Human
cugucucugucuuaacucccag

SEQ ID NO: 458883 - RNA, 22 nt, Human
ugcaaacuauugguagagaugg

SEQ ID NO: 458884 - RNA, 22 nt, Human
ccaaguacucucaccaaagcuu

SEQ ID NO: 458885 - RNA, 22 nt, Human
agccauccucccaccucagccu

SEQ ID NO: 458886 - RNA, 22 nt, Human
ccagaagggcuauugcagugac

SEQ ID NO: 458887 - RNA, 22 nt, Human
aggcugggaaaccugaaguugu

SEQ ID NO: 458888 - RNA, 22 nt, Human
agccaggccuuagggagaggca

SEQ ID NO: 458889 - RNA, 22 nt, Human
ccucccuggccagagcagcagc

SEQ ID NO: 458890 - RNA, 22 nt, Human
guggagaccuccuaggaugugu

SEQ ID NO: 458891 - RNA, 22 nt, Human
ucauccagccucaucaggagcu

SEQ ID NO: 458892 - RNA, 22 nt, Human
gcucagagcaucccagugaaug

SEQ ID NO: 458893 - RNA, 21 nt, Human
aaaguucaugcuuuaauauuc

SEQ ID NO: 458894 - RNA, 22 nt, Human
caggcagaaauuuuguuucauu

SEQ ID NO: 458895 - RNA, 19 nt, Human
agggucaggacaaggacuu

SEQ ID NO: 458896 - RNA, 22 nt, Human
cagaguguggcaucuuccaacu

SEQ ID NO: 458897 - RNA, 22 nt, Human
cagggccuucguaaguguccgg

SEQ ID NO: 458898 - RNA, 22 nt, Human
cugcugugcagacagacucucu

SEQ ID NO: 458899 - RNA, 18 nt, Human
aggggcagcuugugugga

SEQ ID NO: 458900 - RNA, 22 nt, Human
gauaccagacagggagggagaa

SEQ ID NO: 458901 - RNA, 22 nt, Human
uuacaagugucagguacuggca

SEQ ID NO: 458902 - RNA, 22 nt, Human
caaggccaguucaccaagggca

SEQ ID NO: 458903 - RNA, 22 nt, Human
gguggggcccuggcacugguau

SEQ ID NO: 458904 - RNA, 22 nt, Human
uccucuggggcgugguccugga

SEQ ID NO: 458905 - RNA, 22 nt, Human
ggucccaggcugcgggcuggug

SEQ ID NO: 458906 - RNA, 22 nt, Human
caggagugaguuggggucuaca

SEQ ID NO: 458907 - RNA, 22 nt, Human
ccuggccucuccgaguaaccug

SEQ ID NO: 458908 - RNA, 22 nt, Human
gcagcuuuagaaacaagggcug

SEQ ID NO: 458909 - RNA, 22 nt, Human
caguagccacuagacacaugua

SEQ ID NO: 458910 - RNA, 22 nt, Human
uccuucaguuaucacaguacug

SEQ ID NO: 458911 - RNA, 22 nt, Human
augcugagacuggagcagcugg

SEQ ID NO: 458912 - RNA, 22 nt, Human
uggaaagaugaagauguuuaag

SEQ ID NO: 458913 - RNA, 22 nt, Human
agccagcuggagaccacuguuu

SEQ ID NO: 458914 - RNA, 22 nt, Human
ggcaguggaggacccugugucu

SEQ ID NO: 458915 - RNA, 22 nt, Human
uuaguuuucccaucuuuauggu

SEQ ID NO: 458916 - RNA, 22 nt, Human
aggcugagcaaagggccuuacc

SEQ ID NO: 458917 - RNA, 21 nt, Human
gcagcuggucucagagcuugc

SEQ ID NO: 458918 - RNA, 23 nt, Human
ccagcucccaggucugaggacug

SEQ ID NO: 458919 - RNA, 22 nt, Human
ucccaggcuaggccucugcguu

SEQ ID NO: 458920 - RNA, 22 nt, Human
uaggggugaggccaggcaucag

SEQ ID NO: 458921 - RNA, 20 nt, Human
gcugcucuccacggucugca

SEQ ID NO: 458922 - RNA, 22 nt, Human
gccugcaggcuguaguuuguga

SEQ ID NO: 458923 - RNA, 22 nt, Human
uccuucagugucccgcucaggu

SEQ ID NO: 458924 - RNA, 22 nt, Human
uuagaaaaaggcuguggucuua

SEQ ID NO: 458925 - RNA, 22 nt, Human
uggaagagggagcuggguggcc

SEQ ID NO: 458926 - RNA, 23 nt, Human
ucugggcaccuuguugacaugau

SEQ ID NO: 458927 - RNA, 21 nt, Human
cagcuuugucugucuucgggg

SEQ ID NO: 458928 - RNA, 22 nt, Human
aauaauuauuugagagcagacc

SEQ ID NO: 458929 - RNA, 22 nt, Human
aagggcuggaucucucugagca

SEQ ID NO: 458930 - RNA, 22 nt, Human
aggagaaggaggccccucacac

SEQ ID NO: 458931 - RNA, 22 nt, Human
ggcucugcccagguggacagca

SEQ ID NO: 458932 - RNA, 22 nt, Human
uguggucucguuauguugccca

SEQ ID NO: 458933 - RNA, 22 nt, Human
uccaggaggguuuucugccuuc

SEQ ID NO: 458934 - RNA, 22 nt, Human
uccugcagucugcacucugccu

SEQ ID NO: 458935 - RNA, 22 nt, Human
ugggacagggaaucugaucccc

SEQ ID NO: 458936 - RNA, 22 nt, Human
aggcugagcugaccugguuugg

SEQ ID NO: 458937 - RNA, 22 nt, Human
cucagagaagucuuugcuaaac

SEQ ID NO: 458938 - RNA, 22 nt, Human
guuugcauguauuaagucaaua

SEQ ID NO: 458939 - RNA, 22 nt, Human
cgagaguggacagggcgcagcu

SEQ ID NO: 458940 - RNA, 22 nt, Human
cagugcagaacacauggaaaau

SEQ ID NO: 458941 - RNA, 20 nt, Human
cugcaggguuagaggcucca

SEQ ID NO: 458942 - RNA, 22 nt, Human
aggcuucacgaugggugaggug

SEQ ID NO: 458943 - RNA, 21 nt, Human
ugaggcuguuguaccagggag

SEQ ID NO: 458944 - RNA, 22 nt, Human
cugagcauggccgguccauggu

SEQ ID NO: 458945 - RNA, 22 nt, Human
acauuucuaguuguucaucucc

SEQ ID NO: 458946 - RNA, 22 nt, Human
ucaggcaggacaauuauuuagg

SEQ ID NO: 458947 - RNA, 22 nt, Human
gggugacauuucccaaugagcc

SEQ ID NO: 458948 - RNA, 22 nt, Human
cagggccagccgcagcauccac

SEQ ID NO: 458949 - RNA, 21 nt, Human
gcagcagaggcuugacagaca

SEQ ID NO: 458950 - RNA, 22 nt, Human
agcaggggcaggguuuugugcu

SEQ ID NO: 458951 - RNA, 22 nt, Human
cuggccagaguuggagggugug

SEQ ID NO: 458952 - RNA, 22 nt, Human
cagcuccccucuguggggcagu

SEQ ID NO: 458953 - RNA, 21 nt, Human
ugcuggccucaagggugacuu

SEQ ID NO: 458954 - RNA, 22 nt, Human
uccagucauuuccauuguuccc

SEQ ID NO: 458955 - RNA, 22 nt, Human
uggccucaagucugagggccuu

SEQ ID NO: 458956 - RNA, 22 nt, Human
cugcccuggcagccuaccaugg

SEQ ID NO: 458957 - RNA, 22 nt, Human
acagggccucagcugauucugg

SEQ ID NO: 458958 - RNA, 22 nt, Human
aaauguagaccuauagggaccu

SEQ ID NO: 458959 - RNA, 23 nt, Human
ccagcccuccaccagcucuaggc

SEQ ID NO: 458960 - RNA, 22 nt, Human
ugaauccagagcuauuucgucc

SEQ ID NO: 458961 - RNA, 22 nt, Human
uuaaagaugcagcuuuagagaa

SEQ ID NO: 458962 - RNA, 22 nt, Human
caggagcucucaucgucagggc

SEQ ID NO: 458963 - RNA, 22 nt, Human
gaggccuggcucugcccuccug

SEQ ID NO: 458964 - RNA, 22 nt, Human
ucacauuuuaucugagauugac

SEQ ID NO: 458965 - RNA, 22 nt, Human
uugcagagagguuaggaacuca

SEQ ID NO: 458966 - RNA, 22 nt, Human
caggcauggugagaacucagcc

SEQ ID NO: 458967 - RNA, 22 nt, Human
ggugggcaggucacucugccuc

SEQ ID NO: 458968 - RNA, 22 nt, Human
augaggcagaaaaaagucggag

SEQ ID NO: 458969 - RNA, 22 nt, Human
aggaggaggugggacacaguga

SEQ ID NO: 458970 - RNA, 22 nt, Human
ucacugcagagaccucuaguca

SEQ ID NO: 458971 - RNA, 20 nt, Human
ccuggcuuugcaucugugau

SEQ ID NO: 458972 - RNA, 22 nt, Human
gagagcuggguucaaguagcug

SEQ ID NO: 458973 - RNA, 22 nt, Human
uccucccacauaggacaauggg

SEQ ID NO: 458974 - RNA, 22 nt, Human
caggcacuagcagaaugaggcu

SEQ ID NO: 458975 - RNA, 22 nt, Human
augaagucugcacaugcaugug

SEQ ID NO: 458976 - RNA, 22 nt, Human
gguuugcacgauauuuccaugg

SEQ ID NO: 458977 - RNA, 22 nt, Human
aaugucugccagaacugaucau

SEQ ID NO: 458978 - RNA, 23 nt, Human
cccuggaguaaauucuuggaagg

SEQ ID NO: 458979 - RNA, 22 nt, Human
ccucucuguguggccucuccau

SEQ ID NO: 458980 - RNA, 22 nt, Human
cuuuguuuauauuucuccucga

SEQ ID NO: 458981 - RNA, 22 nt, Human
ugggccugccccaggcuucagc

SEQ ID NO: 458982 - RNA, 22 nt, Human
caggugcccagcuccugcugug

SEQ ID NO: 458983 - RNA, 19 nt, Human
cagcugccuuuucuuugca

SEQ ID NO: 458984 - RNA, 22 nt, Human
ugcccaaguguuuggcugaguc

SEQ ID NO: 458985 - RNA, 22 nt, Human
acccaggagcaggcugggcagu

SEQ ID NO: 458986 - RNA, 22 nt, Human
aagaugcaugcugaagcuggcu

SEQ ID NO: 458987 - RNA, 22 nt, Human
ccucgaccuccccaggcucagg

SEQ ID NO: 458988 - RNA, 22 nt, Human
cuggggggagcugcguccagca

SEQ ID NO: 458989 - RNA, 22 nt, Human
acaguggagaagcaaaugcagu

SEQ ID NO: 458990 - RNA, 22 nt, Human
auuucugugcaguaaaugguga

SEQ ID NO: 458991 - RNA, 22 nt, Human
aacaggagaguaaauauaugau

SEQ ID NO: 458992 - RNA, 22 nt, Human
gcccagcacauugcugaggacc

SEQ ID NO: 458993 - RNA, 22 nt, Human
acagagcauuugggacagagag

SEQ ID NO: 458994 - RNA, 22 nt, Human
ccugaggacacacgcugcagga

SEQ ID NO: 458995 - RNA, 22 nt, Human
uccuguaguugcuaaguuuguu

SEQ ID NO: 458996 - RNA, 22 nt, Human
uccauuuuagagaugaagaaac

SEQ ID NO: 458997 - RNA, 22 nt, Human
agugcccuggcccagcuggacc

SEQ ID NO: 458998 - RNA, 22 nt, Human
ugcuuuuaagaacaaugcugcu

SEQ ID NO: 458999 - RNA, 22 nt, Human
aauaugcauguauacaugugua

SEQ ID NO: 459000 - RNA, 22 nt, Human
cagaaaaccugacucuagaacu

SEQ ID NO: 459001 - RNA, 20 nt, Human
gcucccagccugcagucccc

SEQ ID NO: 459002 - RNA, 22 nt, Human
ugaaggccacuuccugugagcu

SEQ ID NO: 459003 - RNA, 22 nt, Human
caagaaauguuuacugagcauc

SEQ ID NO: 459004 - RNA, 22 nt, Human
ugucccagggaaggcccagcac

SEQ ID NO: 459005 - RNA, 22 nt, Human
aggcccaguuauccuacuuguu

SEQ ID NO: 459006 - RNA, 19 nt, Human
aauguaguguuaugucaac

SEQ ID NO: 459007 - RNA, 22 nt, Human
cugggcagcugugcaaacaaua

SEQ ID NO: 459008 - RNA, 23 nt, Human
gagugcagaauagacaugcagug

SEQ ID NO: 459009 - RNA, 22 nt, Human
cauuucauaguugucacaauaa

SEQ ID NO: 459010 - RNA, 22 nt, Human
ccugggcagggagaccaggcuc

SEQ ID NO: 459011 - RNA, 22 nt, Human
agagcugagaauguggcuuccu

SEQ ID NO: 459012 - RNA, 22 nt, Human
ugucccagacacaguaugcgcu

SEQ ID NO: 459013 - RNA, 22 nt, Human
ugaaggccuaacuuccagugcu

SEQ ID NO: 459014 - RNA, 22 nt, Human
gggagcuggagcuggaagacuc

SEQ ID NO: 459015 - RNA, 22 nt, Human
caagagcuagaaauugguuaga

SEQ ID NO: 459016 - RNA, 22 nt, Human
gggcuucucuuuagugagcuga

SEQ ID NO: 459017 - RNA, 22 nt, Human
caggcagcgcucguggccuggc

SEQ ID NO: 459018 - RNA, 22 nt, Human
aaacauuugcaacucgguuugg

SEQ ID NO: 459019 - RNA, 19 nt, Human
aggacccuuauccuggcuu

SEQ ID NO: 459020 - RNA, 22 nt, Human
gaagagcugugauucaggcuua

SEQ ID NO: 459021 - RNA, 22 nt, Human
ccuggcugguggcagcgacaag

SEQ ID NO: 459022 - RNA, 22 nt, Human
cauuguuauagcauuacacacc

SEQ ID NO: 459023 - RNA, 17 nt, Human
ucuguccagggagugug

SEQ ID NO: 459024 - RNA, 22 nt, Human
uacaaagccugguagauaucug

SEQ ID NO: 459025 - RNA, 22 nt, Human
uuagauaaauugcaacuugauu

SEQ ID NO: 459026 - RNA, 22 nt, Human
agcugguucagaaauuagaugg

SEQ ID NO: 459027 - RNA, 22 nt, Human
gguucacacuuucaugauuuca

SEQ ID NO: 459028 - RNA, 22 nt, Human
uaagaacaguagaacaguaggu

SEQ ID NO: 459029 - RNA, 22 nt, Human
aaccauuugcaguuacugagac

SEQ ID NO: 459030 - RNA, 22 nt, Human
cucuggaguucucaugaggaac

SEQ ID NO: 459031 - RNA, 22 nt, Human
ugaggcagcauucuucaagaca

SEQ ID NO: 459032 - RNA, 22 nt, Human
gcagugggcaacaagagcugga

SEQ ID NO: 459033 - RNA, 22 nt, Human
uguuuauucauggcuaaugaaa

SEQ ID NO: 459034 - RNA, 22 nt, Human
aaaggcuccuucucccaugacc

SEQ ID NO: 459035 - RNA, 20 nt, Human
gugaccagaagacagugggu

SEQ ID NO: 459036 - RNA, 22 nt, Human
cacagguguucuugcagugaaa

SEQ ID NO: 459037 - RNA, 22 nt, Human
gcugucagaaggugaaggguaa

SEQ ID NO: 459038 - RNA, 22 nt, Human
cagaccagcucuaugaacccaa

SEQ ID NO: 459039 - RNA, 22 nt, Human
ucuggagccuuggaugggaaag

SEQ ID NO: 459040 - RNA, 23 nt, Human
acaugggagggacauggaggcug

SEQ ID NO: 459041 - RNA, 23 nt, Human
cuccucguaacucuguggugggu

SEQ ID NO: 459042 - RNA, 22 nt, Human
caggaccccauauucacugaac

SEQ ID NO: 459043 - RNA, 17 nt, Human
cucacggaggaugaauc

SEQ ID NO: 459044 - RNA, 22 nt, Human
cuggcagcucuacucagagccu

SEQ ID NO: 459045 - RNA, 22 nt, Human
agaacagcaguuaugguucauu

SEQ ID NO: 459046 - RNA, 22 nt, Human
acacauuuacauguuuacguau

SEQ ID NO: 459047 - RNA, 22 nt, Human
agccccuuccaguucucagauc

SEQ ID NO: 459048 - RNA, 17 nt, Human
gccaaaggguuccaauc

SEQ ID NO: 459049 - RNA, 20 nt, Human
aggaaaaauggaaacuggag

SEQ ID NO: 459050 - RNA, 22 nt, Human
uuugcaauuugugcugcaaaug

SEQ ID NO: 459051 - RNA, 22 nt, Human
ggagccaggggaccuucacaga

SEQ ID NO: 459052 - RNA, 22 nt, Human
aagcaagacagaaguuacugcc

SEQ ID NO: 459053 - RNA, 22 nt, Human
ggggccagcaauguugaggaau

SEQ ID NO: 459054 - RNA, 22 nt, Human
uaaguucauuagacuacagaua

SEQ ID NO: 459055 - RNA, 22 nt, Human
ggugaggggagagugaaagaaa

SEQ ID NO: 459056 - RNA, 23 nt, Human
uccaggcacgcauuucuucuagc

SEQ ID NO: 459057 - RNA, 22 nt, Human
uaaauguggagacucaggaguc

SEQ ID NO: 459058 - RNA, 22 nt, Human
ugaggcaguucuuacuuguauu

SEQ ID NO: 459059 - RNA, 22 nt, Human
ugcacuggggucccagcgcacg

SEQ ID NO: 459060 - RNA, 22 nt, Human
cccaggagguagagguugcagu

SEQ ID NO: 459061 - RNA, 22 nt, Human
cacaucagggcugcuugggggu

SEQ ID NO: 459062 - RNA, 22 nt, Human
aaguucaagucuccugaguaua

SEQ ID NO: 459063 - RNA, 22 nt, Human
uuccauaauaggcuuaagugaa

SEQ ID NO: 459064 - RNA, 22 nt, Human
gccugucugcgucacgcuuauu

SEQ ID NO: 459065 - RNA, 22 nt, Human
acaaagugcacaagaugagaac

SEQ ID NO: 459066 - RNA, 22 nt, Human
uccugcagaucaaagccuuuga

SEQ ID NO: 459067 - RNA, 22 nt, Human
ccagggcagccaacccagaugc

SEQ ID NO: 459068 - RNA, 22 nt, Human
gaggcagcgggucaggaccgug

SEQ ID NO: 459069 - RNA, 22 nt, Human
gcugggaggaauuuggggaaua

SEQ ID NO: 459070 - RNA, 22 nt, Human
gggaccugcgccacucacuguc

SEQ ID NO: 459071 - RNA, 22 nt, Human
ugguggcuguugcagaacugag

SEQ ID NO: 459072 - RNA, 22 nt, Human
cugggcucagcccaugcugucc

SEQ ID NO: 459073 - RNA, 22 nt, Human
aaauggaucuguggaauacauu

SEQ ID NO: 459074 - RNA, 20 nt, Human
ugugaaagcaguagaaugac

SEQ ID NO: 459075 - RNA, 22 nt, Human
uggcagaggcucugugauguug

SEQ ID NO: 459076 - RNA, 22 nt, Human
gggccucugugcagaggggccu

SEQ ID NO: 459077 - RNA, 22 nt, Human
gcucagagggaacaaggggcug

SEQ ID NO: 459078 - RNA, 22 nt, Human
ucuuacaccauucaaauauuuu

SEQ ID NO: 459079 - RNA, 22 nt, Human
agucaacaaaaauguggagccu

SEQ ID NO: 459080 - RNA, 22 nt, Human
uuacaaagaguguucuuuucca

SEQ ID NO: 459081 - RNA, 19 nt, Human
cccuggcaggcaagccugg

SEQ ID NO: 459082 - RNA, 22 nt, Human
aggaagagcuggaccagaggac

SEQ ID NO: 459083 - RNA, 22 nt, Human
uccaggcaaaaggaacugcuug

SEQ ID NO: 459084 - RNA, 22 nt, Human
cagagccacugucugccaggca

SEQ ID NO: 459085 - RNA, 22 nt, Human
gcucaggacuggaggagcgggg

SEQ ID NO: 459086 - RNA, 20 nt, Human
ccuuuauuauuuguaugaug

SEQ ID NO: 459087 - RNA, 22 nt, Human
gaagccaguguuugaagaauuu

SEQ ID NO: 459088 - RNA, 22 nt, Human
cucuggccagagccugcgggaa

SEQ ID NO: 459089 - RNA, 22 nt, Human
ggaaccaguggaaugauaugcu

SEQ ID NO: 459090 - RNA, 22 nt, Human
ugcagcugcuugauucaucuug

SEQ ID NO: 459091 - RNA, 22 nt, Human
auccaaaucaugucagaagaac

SEQ ID NO: 459092 - RNA, 22 nt, Human
guauuaggagguggagccuuug

SEQ ID NO: 459093 - RNA, 22 nt, Human
aucuggcuauugacauguuaua

SEQ ID NO: 459094 - RNA, 22 nt, Human
caguaugucuacuggacaaagu

SEQ ID NO: 459095 - RNA, 22 nt, Human
uuuaaauuuguguuuagagggu

SEQ ID NO: 459096 - RNA, 22 nt, Human
uaaguuuucuggaauaacuugg

SEQ ID NO: 459097 - RNA, 23 nt, Human
caggacaugggaggaaguauggc

SEQ ID NO: 459098 - RNA, 22 nt, Human
caggggcaggugugagaucauc

SEQ ID NO: 459099 - RNA, 23 nt, Human
aaaugcagggucgcagguuacag

SEQ ID NO: 459100 - RNA, 22 nt, Human
ggguuggggcccagcagucugc

SEQ ID NO: 459101 - RNA, 23 nt, Human
cugcagccgcguggggacgugga

SEQ ID NO: 459102 - RNA, 22 nt, Human
cugcucugaguauuaacggagg

SEQ ID NO: 459103 - RNA, 22 nt, Human
aggcugaggaucguacuuucca

SEQ ID NO: 459104 - RNA, 22 nt, Human
ggcaaaaacagcaaugacuuuu

SEQ ID NO: 459105 - RNA, 22 nt, Human
agggucuguggaugcaucuggg

SEQ ID NO: 459106 - RNA, 22 nt, Human
acuguguguuugucuagcacag

SEQ ID NO: 459107 - RNA, 22 nt, Human
ccuggcuuuuguuuauaaauuc

SEQ ID NO: 459108 - RNA, 22 nt, Human
ggcuagaauaauugacuucauu

SEQ ID NO: 459109 - RNA, 22 nt, Human
agagcauccaucggccaggacc

SEQ ID NO: 459110 - RNA, 22 nt, Human
ggagcuguuggcagcuaucuug

SEQ ID NO: 459111 - RNA, 22 nt, Human
gucacuguauccagguuccagc

SEQ ID NO: 459112 - RNA, 22 nt, Human
cacuguacagcauuaacaaggc

SEQ ID NO: 459113 - RNA, 22 nt, Human
uauaauuuaucaugucacaguu

SEQ ID NO: 459114 - RNA, 22 nt, Human
cagagcaucgcgcagagagccu

SEQ ID NO: 459115 - RNA, 22 nt, Human
gcugucugucucugucccacca

SEQ ID NO: 459116 - RNA, 22 nt, Human
agggacugagcuaggaucuagu

SEQ ID NO: 459117 - RNA, 22 nt, Human
aggucauuuccuuagaggcaga

SEQ ID NO: 459118 - RNA, 22 nt, Human
ucagcagugcagggugaggcag

SEQ ID NO: 459119 - RNA, 22 nt, Human
uugucuuuggaaauuuaauguu

SEQ ID NO: 459120 - RNA, 20 nt, Human
cuguagggugcagcaggcuc

SEQ ID NO: 459121 - RNA, 22 nt, Human
cgcugccaggucaccaggggua

SEQ ID NO: 459122 - RNA, 22 nt, Human
aaggcuuuuaacuacuguuuua

SEQ ID NO: 459123 - RNA, 20 nt, Human
auacacauauucuugcaacu

SEQ ID NO: 459124 - RNA, 22 nt, Human
ccagcauggcaccugagaugag

SEQ ID NO: 459125 - RNA, 22 nt, Human
cacaggagauugaucuauuggu

SEQ ID NO: 459126 - RNA, 22 nt, Human
agaaaucucaguaucucaggga

SEQ ID NO: 459127 - RNA, 22 nt, Human
guauuauuggguaguaugguaa

SEQ ID NO: 459128 - RNA, 22 nt, Human
gcuggccugaccugaggcuggg

SEQ ID NO: 459129 - RNA, 19 nt, Human
ucaaugcaugaaaucagcc

SEQ ID NO: 459130 - RNA, 22 nt, Human
uugaaggaggcuccuuuuuaaa

SEQ ID NO: 459131 - RNA, 22 nt, Human
ucaccaggcuccuguuaagaug

SEQ ID NO: 459132 - RNA, 22 nt, Human
aauacaaucaaauucacuagca

SEQ ID NO: 459133 - RNA, 22 nt, Human
cugaaugaggaaaagagugagg

SEQ ID NO: 459134 - RNA, 22 nt, Human
agggaggucuuugaggggcuua

SEQ ID NO: 459135 - RNA, 22 nt, Human
accagagcagacuacuggaggu

SEQ ID NO: 459136 - RNA, 22 nt, Human
cuguauuuucaugccuacguac

SEQ ID NO: 459137 - RNA, 22 nt, Human
cucuccuugcagauggcugccu

SEQ ID NO: 459138 - RNA, 22 nt, Human
ccagagaggccaaggucguggu

SEQ ID NO: 459139 - RNA, 22 nt, Human
agcucugcaggcacagcugagg

SEQ ID NO: 459140 - RNA, 22 nt, Human
cagggcagugaagaacacacgu

SEQ ID NO: 459141 - RNA, 22 nt, Human
ggcaaaaaguucccaucagugu

SEQ ID NO: 459142 - RNA, 22 nt, Human
aagaaauguagagccuaguaaa

SEQ ID NO: 459143 - RNA, 22 nt, Human
uucuaguuuucaguccaccagg

SEQ ID NO: 459144 - RNA, 22 nt, Human
gagcugucucuauaugaaugcu

SEQ ID NO: 459145 - RNA, 19 nt, Human
gcagcugugggaagagcca

SEQ ID NO: 459146 - RNA, 22 nt, Human
uguauuuucuucuggaagcuua

SEQ ID NO: 459147 - RNA, 22 nt, Human
uccaucagauucccuccugaga

SEQ ID NO: 459148 - RNA, 23 nt, Human
ccucagggucuagcagagagaag

SEQ ID NO: 459149 - RNA, 20 nt, Human
caggccucugggggcccugg

SEQ ID NO: 459150 - RNA, 22 nt, Human
uauugaggaucuccugcuaauu

SEQ ID NO: 459151 - RNA, 22 nt, Human
ucagagugaccuuacauggucu

SEQ ID NO: 459152 - RNA, 22 nt, Human
ggcugcagcggauuggggauug

SEQ ID NO: 459153 - RNA, 22 nt, Human
auuucucucauuguuagcuagg

SEQ ID NO: 459154 - RNA, 22 nt, Human
aggaaggguucuuugugaaaga

SEQ ID NO: 459155 - RNA, 22 nt, Human
ucuuauuauuguuguaaaagca

SEQ ID NO: 459156 - RNA, 22 nt, Human
gcucccucugcucaggcacuug

SEQ ID NO: 459157 - RNA, 22 nt, Human
ccagagagagaggucaauggca

SEQ ID NO: 459158 - RNA, 22 nt, Human
ggcuccagggaguggagagaag

SEQ ID NO: 459159 - RNA, 21 nt, Human
agcagcagaucuggugagggc

SEQ ID NO: 459160 - RNA, 22 nt, Human
acuuuggaucugauguaaucag

SEQ ID NO: 459161 - RNA, 22 nt, Human
caucucaugggcaugccaagcu

SEQ ID NO: 459162 - RNA, 22 nt, Human
agaggcagaaguguucaaaccc

SEQ ID NO: 459163 - RNA, 22 nt, Human
ucaaugauuagaguuuagugug

SEQ ID NO: 459164 - RNA, 22 nt, Human
uugcauugcuuggucuucaaga

SEQ ID NO: 459165 - RNA, 22 nt, Human
ucacauuuuuuacuggacuuaa

SEQ ID NO: 459166 - RNA, 22 nt, Human
cuggccagcauuuuugcuuuag

SEQ ID NO: 459167 - RNA, 22 nt, Human
cgggcagaucacacagggcuug

SEQ ID NO: 459168 - RNA, 22 nt, Human
cauuuguaguaucuguuuauau

SEQ ID NO: 459169 - RNA, 22 nt, Human
agucaguguucuccggagaggc

SEQ ID NO: 459170 - RNA, 22 nt, Human
auuuucauuuugcagggugaga

SEQ ID NO: 459171 - RNA, 22 nt, Human
gcugguuagaaaacagagcuca

SEQ ID NO: 459172 - RNA, 22 nt, Human
ucaggagacuuaugucacagug

SEQ ID NO: 459173 - RNA, 22 nt, Human
ccccagcugcauacuugccaag

SEQ ID NO: 459174 - RNA, 22 nt, Human
agccagagcugaugucauucuc

SEQ ID NO: 459175 - RNA, 21 nt, Human
aggagggcacaaggccaggaa

SEQ ID NO: 459176 - RNA, 22 nt, Human
cugccacuuacuaggcauggug

SEQ ID NO: 459177 - RNA, 22 nt, Human
aagaacaacugcuuuaaaagca

SEQ ID NO: 459178 - RNA, 22 nt, Human
cucucugggggccaugccaaga

SEQ ID NO: 459179 - RNA, 22 nt, Human
ccacugucugcaggccucagca

SEQ ID NO: 459180 - RNA, 22 nt, Human
gcaggcugauagaggauuccau

SEQ ID NO: 459181 - RNA, 22 nt, Human
gccaggcagcagcgaggauggu

SEQ ID NO: 459182 - RNA, 22 nt, Human
uggcucagaagaaaagguaaac

SEQ ID NO: 459183 - RNA, 22 nt, Human
ggccucuggucaagacaagcau

SEQ ID NO: 459184 - RNA, 22 nt, Human
uccagggauguccuguagcacu

SEQ ID NO: 459185 - RNA, 22 nt, Human
gcagcugccuauucagggcuug

SEQ ID NO: 459186 - RNA, 22 nt, Human
aaggcagaaauucaacuacugg

SEQ ID NO: 459187 - RNA, 22 nt, Human
uuguaacagguacuaaauaacu

SEQ ID NO: 459188 - RNA, 22 nt, Human
ugcacagagagaugagacacgu

SEQ ID NO: 459189 - RNA, 19 nt, Human
agcagcuggagguggagug

SEQ ID NO: 459190 - RNA, 23 nt, Human
gccuggagaaaagcugcaguuca

SEQ ID NO: 459191 - RNA, 22 nt, Human
cugaggcugggcugaggguaua

SEQ ID NO: 459192 - RNA, 22 nt, Human
ugaggcaggagguugagaacug

SEQ ID NO: 459193 - RNA, 22 nt, Human
ucuggcucauaggaaggccauu

SEQ ID NO: 459194 - RNA, 22 nt, Human
uucuaguguccuuggacuugcu

SEQ ID NO: 459195 - RNA, 22 nt, Human
ccccaggacacauggaccaagu

SEQ ID NO: 459196 - RNA, 22 nt, Human
uucagaaagugaaucuuguuau

SEQ ID NO: 459197 - RNA, 18 nt, Human
acucaggaaaugaugaca

SEQ ID NO: 459198 - RNA, 22 nt, Human
uuguuucauggggauguuuauu

SEQ ID NO: 459199 - RNA, 22 nt, Human
ggauggagaugaccauggugac

SEQ ID NO: 459200 - RNA, 22 nt, Human
cugugagcuggguggccaggac

SEQ ID NO: 459201 - RNA, 22 nt, Human
agagcuggcugguagcccugau

SEQ ID NO: 459202 - RNA, 22 nt, Human
gugauugcccagcaccauuguu

SEQ ID NO: 459203 - RNA, 22 nt, Human
agggaaauuaaugugagcaaug

SEQ ID NO: 459204 - RNA, 19 nt, Human
agacagagcucaguggguu

SEQ ID NO: 459205 - RNA, 22 nt, Human
ugucucagggcagcagcagggg

SEQ ID NO: 459206 - RNA, 22 nt, Human
augcuguguggucaaguuaauu

SEQ ID NO: 459207 - RNA, 22 nt, Human
agcaccuguggcucaugcucgu

SEQ ID NO: 459208 - RNA, 22 nt, Human
caggaagcugugaaggagacgg

SEQ ID NO: 459209 - RNA, 22 nt, Human
agcagggcuguguagguaauga

SEQ ID NO: 459210 - RNA, 22 nt, Human
cugccucugguuuuggucccug

SEQ ID NO: 459211 - RNA, 22 nt, Human
caaaagcaguucuaucugaguu

SEQ ID NO: 459212 - RNA, 22 nt, Human
ccuuccuggagcccaugcagau

SEQ ID NO: 459213 - RNA, 22 nt, Human
uagggacccucccugcucuaac

SEQ ID NO: 459214 - RNA, 22 nt, Human
cuacauuuggagaguauaggaa

SEQ ID NO: 459215 - RNA, 22 nt, Human
uggaggcaccacuggcugcccg

SEQ ID NO: 459216 - RNA, 22 nt, Human
cucccuggcuuuguccugaggc

SEQ ID NO: 459217 - RNA, 23 nt, Human
uuuauuuauuuaggcugagggau

SEQ ID NO: 459218 - RNA, 20 nt, Human
gggcuagaccagggcagagg

SEQ ID NO: 459219 - RNA, 22 nt, Human
gucacacucagaaugacuagag

SEQ ID NO: 459220 - RNA, 22 nt, Human
ccagagccagagaggugccugc

SEQ ID NO: 459221 - RNA, 22 nt, Human
uucaaauuaccacauuugcuua

SEQ ID NO: 459222 - RNA, 23 nt, Human
uggcuucugccccauucucucca

SEQ ID NO: 459223 - RNA, 18 nt, Human
cgaggcaggcggaucacg

SEQ ID NO: 459224 - RNA, 20 nt, Human
agucucuguagugccugaga

SEQ ID NO: 459225 - RNA, 22 nt, Human
agggccacaguggggccugaga

SEQ ID NO: 459226 - RNA, 22 nt, Human
gcugccuggagcucagccugcc

SEQ ID NO: 459227 - RNA, 22 nt, Human
aggcacugggaauaugcugagg

SEQ ID NO: 459228 - RNA, 22 nt, Human
aacagaacccgagugugaaucu

SEQ ID NO: 459229 - RNA, 22 nt, Human
agagccagcaacucuagcccug

SEQ ID NO: 459230 - RNA, 22 nt, Human
ugcagggacacgaagacaaaua

SEQ ID NO: 459231 - RNA, 19 nt, Human
acagaaauguaagugagac

SEQ ID NO: 459232 - RNA, 22 nt, Human
uccugccugcaaucccagcacu

SEQ ID NO: 459233 - RNA, 22 nt, Human
ucaucaaagucaaagaaugacu

SEQ ID NO: 459234 - RNA, 21 nt, Human
uuaagagcuuagcaguaggcc

SEQ ID NO: 459235 - RNA, 22 nt, Human
gagcacagcuggagguagcauu

SEQ ID NO: 459236 - RNA, 22 nt, Human
uuguccuuaccucaaucuggaa

SEQ ID NO: 459237 - RNA, 22 nt, Human
uugaaagggauauaucuuucug

SEQ ID NO: 459238 - RNA, 22 nt, Human
ucucagaggucuucagccucug

SEQ ID NO: 459239 - RNA, 22 nt, Human
uggcucagaugcucuuccagug

SEQ ID NO: 459240 - RNA, 22 nt, Human
uuugcagcaaggagagagcauu

SEQ ID NO: 459241 - RNA, 22 nt, Human
aaaugcaccuugcugugagacu

SEQ ID NO: 459242 - RNA, 20 nt, Human
ugcagggccuaaaaagggaa

SEQ ID NO: 459243 - RNA, 22 nt, Human
uuggcagggccaggcucucucu

SEQ ID NO: 459244 - RNA, 22 nt, Human
ccaaaguccacaguuuacauua

SEQ ID NO: 459245 - RNA, 22 nt, Human
aauguguagauguugcauuccu

SEQ ID NO: 459246 - RNA, 22 nt, Human
uggcagagaacacacaugauuc

SEQ ID NO: 459247 - RNA, 22 nt, Human
uguccucaaggagcuucagucu

SEQ ID NO: 459248 - RNA, 22 nt, Human
agcuuuauuaacucuccaggug

SEQ ID NO: 459249 - RNA, 22 nt, Human
gccaguuccuguggagucagag

SEQ ID NO: 459250 - RNA, 22 nt, Human
gcaggcagaucaccugucagga

SEQ ID NO: 459251 - RNA, 22 nt, Human
uggcucagauuuuuguaggcuu

SEQ ID NO: 459252 - RNA, 22 nt, Human
gcauggcaaauaucgagggcag

SEQ ID NO: 459253 - RNA, 22 nt, Human
augcagguugggcaaguguggg

SEQ ID NO: 459254 - RNA, 20 nt, Human
cugagcgucuaagaggugag

SEQ ID NO: 459255 - RNA, 22 nt, Human
gcagcguggggacaggagcuca

SEQ ID NO: 459256 - RNA, 22 nt, Human
aaaugcuugcucuugauuauuu

SEQ ID NO: 459257 - RNA, 22 nt, Human
cucaggaugucggugacuauug

SEQ ID NO: 459258 - RNA, 20 nt, Human
ggggcccaagcccucuugcc

SEQ ID NO: 459259 - RNA, 22 nt, Human
uagggaccuuagaauuguaugu

SEQ ID NO: 459260 - RNA, 22 nt, Human
ucaggcugguggucagauggcu

SEQ ID NO: 459261 - RNA, 22 nt, Human
gaacauuuaugaugcaauaccu

SEQ ID NO: 459262 - RNA, 22 nt, Human
cuauuucugccuaaugaccugu

SEQ ID NO: 459263 - RNA, 22 nt, Human
ggcagaagaaaggcuaagucuc

SEQ ID NO: 459264 - RNA, 22 nt, Human
gagcugcuucugugugccgggu

SEQ ID NO: 459265 - RNA, 22 nt, Human
ggagcugugcugggugaucagg

SEQ ID NO: 459266 - RNA, 22 nt, Human
gcugccucugcacagcucacuc

SEQ ID NO: 459267 - RNA, 22 nt, Human
agcagggcagcuuuuuucagaa

SEQ ID NO: 459268 - RNA, 22 nt, Human
uucaguuucagucuugcaaaaa

SEQ ID NO: 459269 - RNA, 22 nt, Human
uuucuacauuuguaaccagauu

SEQ ID NO: 459270 - RNA, 22 nt, Human
cugguucauccccuuccaggaa

SEQ ID NO: 459271 - RNA, 22 nt, Human
aguggagaauaugcagaaagcc

SEQ ID NO: 459272 - RNA, 22 nt, Human
cagaguguaucuguguaagcau

SEQ ID NO: 459273 - RNA, 22 nt, Human
augaaggauggcuggcugcccu

SEQ ID NO: 459274 - RNA, 22 nt, Human
ccugggcaggaugggcccggug

SEQ ID NO: 459275 - RNA, 22 nt, Human
ccaggcuggauuuugcaguuca

SEQ ID NO: 459276 - RNA, 22 nt, Human
uacauucaacaugucacuaugu

SEQ ID NO: 459277 - RNA, 22 nt, Human
agaagcagacucugaggcaagg

SEQ ID NO: 459278 - RNA, 20 nt, Human
gugggcagcaggcauacugg

SEQ ID NO: 459279 - RNA, 22 nt, Human
cuggguggcagagccugcagug

SEQ ID NO: 459280 - RNA, 22 nt, Human
ccagagcuccagggcuacagaa

SEQ ID NO: 459281 - RNA, 20 nt, Human
agaagccaagugacauguuu

SEQ ID NO: 459282 - RNA, 22 nt, Human
agaagugagugugacucagcag

SEQ ID NO: 459283 - RNA, 22 nt, Human
aagggaaaucauauggugcagu

SEQ ID NO: 459284 - RNA, 19 nt, Human
augagcuggcauuucaggu

SEQ ID NO: 459285 - RNA, 22 nt, Human
agguagagcuccaguagaaaau

SEQ ID NO: 459286 - RNA, 21 nt, Human
aguucauacugaguaacaaaa

SEQ ID NO: 459287 - RNA, 22 nt, Human
gcucugagcacugugcggcugg

SEQ ID NO: 459288 - RNA, 22 nt, Human
ucugccugccagucugguccuc

SEQ ID NO: 459289 - RNA, 22 nt, Human
gcaaaggcuagagacacaggga

SEQ ID NO: 459290 - RNA, 21 nt, Human
gauugaaaccauggcagugag

SEQ ID NO: 459291 - RNA, 22 nt, Human
auuacaaaagaagggagaaggu

SEQ ID NO: 459292 - RNA, 22 nt, Human
gagggaggcaucaugaauccag

SEQ ID NO: 459293 - RNA, 22 nt, Human
ugcuugggaauguggagucaga

SEQ ID NO: 459294 - RNA, 22 nt, Human
ccagggugggguccaggaacca

SEQ ID NO: 459295 - RNA, 22 nt, Human
ccagucccgcaugguccagaau

SEQ ID NO: 459296 - RNA, 22 nt, Human
uuuugaaagggugauuuggcuu

SEQ ID NO: 459297 - RNA, 22 nt, Human
ugggagcaccuugagggcagaa

SEQ ID NO: 459298 - RNA, 22 nt, Human
aaauccuaaaaguuugacuuaa

SEQ ID NO: 459299 - RNA, 22 nt, Human
auguggaaugaacaaaggaggc

SEQ ID NO: 459300 - RNA, 22 nt, Human
cuggcuccacucccugccugac

SEQ ID NO: 459301 - RNA, 22 nt, Human
cucccaggggaacuaucaagua

SEQ ID NO: 459302 - RNA, 22 nt, Human
cuggagcccugaaugggcagga

SEQ ID NO: 459303 - RNA, 22 nt, Human
agagaagacuuacagccacagu

SEQ ID NO: 459304 - RNA, 22 nt, Human
aagauuucucuccuggaaagca

SEQ ID NO: 459305 - RNA, 22 nt, Human
aggagugaguguccucagcaga

SEQ ID NO: 459306 - RNA, 22 nt, Human
uaaggcacacaguugcugcaug

SEQ ID NO: 459307 - RNA, 22 nt, Human
ucuggcaggcaaucggcucugg

SEQ ID NO: 459308 - RNA, 22 nt, Human
uucaggaugaaagugugcaaca

SEQ ID NO: 459309 - RNA, 22 nt, Human
gcucugagagugggugauucug

SEQ ID NO: 459310 - RNA, 22 nt, Human
uggugcaagucucugaggaggg

SEQ ID NO: 459311 - RNA, 22 nt, Human
caggucccgccccgggcugacc

SEQ ID NO: 459312 - RNA, 22 nt, Human
uccagaguacggaagagucauc

SEQ ID NO: 459313 - RNA, 22 nt, Human
aaaaaugucauuauggaacuga

SEQ ID NO: 459314 - RNA, 22 nt, Human
uuagaucuuaggcaaauguguu

SEQ ID NO: 459315 - RNA, 22 nt, Human
uccuugaauugugccacuuacc

SEQ ID NO: 459316 - RNA, 22 nt, Human
gguggguuuggaagagcaggcu

SEQ ID NO: 459317 - RNA, 22 nt, Human
cacagcuggugcacuagcucug

SEQ ID NO: 459318 - RNA, 22 nt, Human
aggugaaguugaggaggcagaa

SEQ ID NO: 459319 - RNA, 22 nt, Human
uuauuuuuaaaaguucacacag

SEQ ID NO: 459320 - RNA, 22 nt, Human
gacaauuucucaauauagaaac

SEQ ID NO: 459321 - RNA, 22 nt, Human
ggggagugacgcagggccauag

SEQ ID NO: 459322 - RNA, 22 nt, Human
gcugagagugggugcagugcuu

SEQ ID NO: 459323 - RNA, 22 nt, Human
gagcugggcacacgccacuuga

SEQ ID NO: 459324 - RNA, 23 nt, Human
gccucuggagccccagugcucag

SEQ ID NO: 459325 - RNA, 22 nt, Human
gcugucuguucgagcguguguu

SEQ ID NO: 459326 - RNA, 22 nt, Human
aggcucuguuauucuagagggc

SEQ ID NO: 459327 - RNA, 22 nt, Human
ugucucaguauacgaaacacuu

SEQ ID NO: 459328 - RNA, 22 nt, Human
ugggccugggagggcagacgcu

SEQ ID NO: 459329 - RNA, 22 nt, Human
cugcccugcuugaugacagcga

SEQ ID NO: 459330 - RNA, 22 nt, Human
uugugcaauuuaaaaucuuccu

SEQ ID NO: 459331 - RNA, 17 nt, Human
aauagcugcucagagag

SEQ ID NO: 459332 - RNA, 16 nt, Human
ggagagugucugcaaa

SEQ ID NO: 459333 - RNA, 22 nt, Human
uacugugacagaguacuuaaac

SEQ ID NO: 459334 - RNA, 18 nt, Human
gggaagaggaucuggccc

SEQ ID NO: 459335 - RNA, 22 nt, Human
ggggaccuaggcucugucucuu

SEQ ID NO: 459336 - RNA, 22 nt, Human
ggagacagugguagggccuaag

SEQ ID NO: 459337 - RNA, 22 nt, Human
gaagcagcuagcccacuaguca

SEQ ID NO: 459338 - RNA, 23 nt, Human
ucagcugcuuccuccugccugcc

SEQ ID NO: 459339 - RNA, 18 nt, Human
ccauuucaugauuauuac

SEQ ID NO: 459340 - RNA, 22 nt, Human
cugaggcugaagagggccuacg

SEQ ID NO: 459341 - RNA, 22 nt, Human
auacaaaguauuaauccuggau

SEQ ID NO: 459342 - RNA, 22 nt, Human
uucacauuauaaucaguucugc

SEQ ID NO: 459343 - RNA, 22 nt, Human
cagcccugcacgcugccuccgc

SEQ ID NO: 459344 - RNA, 22 nt, Human
gcagggcagagggagaaucucu

SEQ ID NO: 459345 - RNA, 22 nt, Human
aaggcacuuuucuaaagaccuu

SEQ ID NO: 459346 - RNA, 22 nt, Human
aaaguuugcaauuuauguuaau

SEQ ID NO: 459347 - RNA, 22 nt, Human
gucuggagccacccuaagcauu

SEQ ID NO: 459348 - RNA, 22 nt, Human
agcugcccuucucuugcccuug

SEQ ID NO: 459349 - RNA, 22 nt, Human
ggcagagacuggguuggcagag

SEQ ID NO: 459350 - RNA, 22 nt, Human
gcccuggaaucucuccauggga

SEQ ID NO: 459351 - RNA, 22 nt, Human
uauuuccugcauggugauguaa

SEQ ID NO: 459352 - RNA, 22 nt, Human
cgcagggccgcgagcgggacca

SEQ ID NO: 459353 - RNA, 22 nt, Human
uuuauuaugauggacaccuucg

SEQ ID NO: 459354 - RNA, 20 nt, Human
cagggcucugggccuggccu

SEQ ID NO: 459355 - RNA, 22 nt, Human
cuauuuaucuauuucugaauga

SEQ ID NO: 459356 - RNA, 22 nt, Human
cgaggcagacaaaaguuggaag

SEQ ID NO: 459357 - RNA, 22 nt, Human
aaguucaaguguaaucuuuauu

SEQ ID NO: 459358 - RNA, 22 nt, Human
uugugaguagugccgcaauaaa

SEQ ID NO: 459359 - RNA, 22 nt, Human
ucugucacuauuggccagaaca

SEQ ID NO: 459360 - RNA, 21 nt, Human
cucaggaucuuauauauuagu

SEQ ID NO: 459361 - RNA, 22 nt, Human
aaaguuucaauagaggaagugg

SEQ ID NO: 459362 - RNA, 22 nt, Human
ggagccaguuuagaccucaguu

SEQ ID NO: 459363 - RNA, 22 nt, Human
aguggggagguccaggccaccc

SEQ ID NO: 459364 - RNA, 22 nt, Human
ggucucaggagacuggagagca

SEQ ID NO: 459365 - RNA, 22 nt, Human
uuuuuguagucauuagaagagg

SEQ ID NO: 459366 - RNA, 22 nt, Human
gucccugggaugcccuucuggg

SEQ ID NO: 459367 - RNA, 22 nt, Human
agccacgucccugucaggguca

SEQ ID NO: 459368 - RNA, 22 nt, Human
ccagguguggggaggacucaca

SEQ ID NO: 459369 - RNA, 22 nt, Human
ucagggacuuacaaaccagaag

SEQ ID NO: 459370 - RNA, 22 nt, Human
gugugcaugcauagacaccaca

SEQ ID NO: 459371 - RNA, 22 nt, Human
cagagccauuauggagacuugc

SEQ ID NO: 459372 - RNA, 22 nt, Human
auggaguucugccagcgcugcu

SEQ ID NO: 459373 - RNA, 22 nt, Human
ucccagaggaaauggcagcuga

SEQ ID NO: 459374 - RNA, 22 nt, Human
gagcagcuuaugucaagccaga

SEQ ID NO: 459375 - RNA, 22 nt, Human
uuucuacagcuggugcaacuuu

SEQ ID NO: 459376 - RNA, 22 nt, Human
gacccagcuuaagucacauguu

SEQ ID NO: 459377 - RNA, 22 nt, Human
cccugcagaccaaugccauaga

SEQ ID NO: 459378 - RNA, 22 nt, Human
uggcucugaucagauguccagu

SEQ ID NO: 459379 - RNA, 22 nt, Human
uuugaaagaaaccagugaguga

SEQ ID NO: 459380 - RNA, 22 nt, Human
gggaaauugucaacacucucaa

SEQ ID NO: 459381 - RNA, 22 nt, Human
ucagaguguggugagaugugca

SEQ ID NO: 459382 - RNA, 21 nt, Human
gcaugccugcaucuuaguguu

SEQ ID NO: 459383 - RNA, 22 nt, Human
aagagcaucaaugacucgcagu

SEQ ID NO: 459384 - RNA, 22 nt, Human
auuuaacaagacagagaacugg

SEQ ID NO: 459385 - RNA, 22 nt, Human
gccaccuguuucgcuugcccag

SEQ ID NO: 459386 - RNA, 22 nt, Human
ggcagggugccuggcuccuguu

SEQ ID NO: 459387 - RNA, 22 nt, Human
uauuugaagggagaaagugcca

SEQ ID NO: 459388 - RNA, 22 nt, Human
guacuuccagccaagugagaca

SEQ ID NO: 459389 - RNA, 22 nt, Human
uguggcagaaccagaauucaaa

SEQ ID NO: 459390 - RNA, 22 nt, Human
cucacuguuuaauagcuggauc

SEQ ID NO: 459391 - RNA, 22 nt, Human
acagccugagaguggagcuggc

SEQ ID NO: 459392 - RNA, 22 nt, Human
cagggccagagagggcuggcug

SEQ ID NO: 459393 - RNA, 22 nt, Human
gaguccaggcucagaaacccgu

SEQ ID NO: 459394 - RNA, 22 nt, Human
gugccagcucuccccacaucug

SEQ ID NO: 459395 - RNA, 22 nt, Human
accugggagucacaccugagaa

SEQ ID NO: 459396 - RNA, 17 nt, Human
caggcagacauguaagc

SEQ ID NO: 459397 - RNA, 22 nt, Human
gagcuggugugugcccgagcac

SEQ ID NO: 459398 - RNA, 22 nt, Human
gccugguggugugcucaagugg

SEQ ID NO: 459399 - RNA, 22 nt, Human
guggccuggaugagcuucgaca

SEQ ID NO: 459400 - RNA, 22 nt, Human
ccagcagagucuaggaaggagg

SEQ ID NO: 459401 - RNA, 22 nt, Human
ccagcccuucccaacuggccag

SEQ ID NO: 459402 - RNA, 22 nt, Human
ugcuggggauccguaccaaccc

SEQ ID NO: 459403 - RNA, 22 nt, Human
ccuggccacucagguguggggc

SEQ ID NO: 459404 - RNA, 22 nt, Human
agcugcucaggagagccagguc

SEQ ID NO: 459405 - RNA, 22 nt, Human
ucagaacaauugggaaccauua

SEQ ID NO: 459406 - RNA, 22 nt, Human
ucugucacuuauuaagauggau

SEQ ID NO: 459407 - RNA, 22 nt, Human
acuguacacgugucauuuacag

SEQ ID NO: 459408 - RNA, 22 nt, Human
aagggcagaauagagaagaugg

SEQ ID NO: 459409 - RNA, 22 nt, Human
agcucccagaguccucugccca

SEQ ID NO: 459410 - RNA, 22 nt, Human
ugcugggggugucucaccaggc

SEQ ID NO: 459411 - RNA, 22 nt, Human
ggcauggcuggguucuggugag

SEQ ID NO: 459412 - RNA, 22 nt, Human
ugaaagggguugaguuacagcu

SEQ ID NO: 459413 - RNA, 22 nt, Human
uccagacccaugacccugggga

SEQ ID NO: 459414 - RNA, 22 nt, Human
cacagcuuaugccacugauugg

SEQ ID NO: 459415 - RNA, 22 nt, Human
uaccuugggcuauuaucuuuga

SEQ ID NO: 459416 - RNA, 22 nt, Human
ucauaaaacacaccagguaguu

SEQ ID NO: 459417 - RNA, 22 nt, Human
uucucagauccaucagaagucc

SEQ ID NO: 459418 - RNA, 22 nt, Human
gcccugugccagucacgcugug

SEQ ID NO: 459419 - RNA, 22 nt, Human
auugacaauuagcccuuaggug

SEQ ID NO: 459420 - RNA, 22 nt, Human
ucaaaguuuuugagaauuacau

SEQ ID NO: 459421 - RNA, 22 nt, Human
aggagguggcugaacuugaggg

SEQ ID NO: 459422 - RNA, 22 nt, Human
aagagcuggcucuugcagcagc

SEQ ID NO: 459423 - RNA, 22 nt, Human
uuugacaguaauaaagcacaag

SEQ ID NO: 459424 - RNA, 22 nt, Human
aguuauauuccauagauucaga

SEQ ID NO: 459425 - RNA, 22 nt, Human
cauuaagauuuuuuucuacugg

SEQ ID NO: 459426 - RNA, 22 nt, Human
cucaggauuuacuaauuucaag

SEQ ID NO: 459427 - RNA, 22 nt, Human
ccucugugugugcaugcaugcg

SEQ ID NO: 459428 - RNA, 22 nt, Human
uggcagagugcagaagaggcau

SEQ ID NO: 459429 - RNA, 22 nt, Human
ggguacaaagauuucauaagau

SEQ ID NO: 459430 - RNA, 22 nt, Human
cagcagggggcagcgcagauca

SEQ ID NO: 459431 - RNA, 22 nt, Human
caggccugugacaccgugucug

SEQ ID NO: 459432 - RNA, 22 nt, Human
ccaggagcaacuugaaggcaag

SEQ ID NO: 459433 - RNA, 22 nt, Human
gcccagaguucaaggcugcagu

SEQ ID NO: 459434 - RNA, 22 nt, Human
uggcaggaaaguaacagagcac

SEQ ID NO: 459435 - RNA, 22 nt, Human
cacugcaggucugagauggggg

SEQ ID NO: 459436 - RNA, 22 nt, Human
cagugucuuauuuguagcucag

SEQ ID NO: 459437 - RNA, 22 nt, Human
ggagaugcuauguaguuugguu

SEQ ID NO: 459438 - RNA, 22 nt, Human
agcugguaugaacaggauagga

SEQ ID NO: 459439 - RNA, 22 nt, Human
cuccagucuaguagagccugcu

SEQ ID NO: 459440 - RNA, 22 nt, Human
gccuggagcuacuggacacuga

SEQ ID NO: 459441 - RNA, 22 nt, Human
gcagcugguuaaugggagaauu

SEQ ID NO: 459442 - RNA, 22 nt, Human
cagaggcagaauggagauuugg

SEQ ID NO: 459443 - RNA, 22 nt, Human
gaggaggcuggcgccgccugcc

SEQ ID NO: 459444 - RNA, 22 nt, Human
gcucugggaacugacugccuuc

SEQ ID NO: 459445 - RNA, 22 nt, Human
caaaaugugagucccaccucaa

SEQ ID NO: 459446 - RNA, 22 nt, Human
ugagcccagagcccuuguaggg

SEQ ID NO: 459447 - RNA, 21 nt, Human
uggcugcuggcccucucucca

SEQ ID NO: 459448 - RNA, 22 nt, Human
gcagcugccccgacugugaguc

SEQ ID NO: 459449 - RNA, 17 nt, Human
cauguguaugugggagu

SEQ ID NO: 459450 - RNA, 21 nt, Human
ugauuuccaucuuaaaauaaa

SEQ ID NO: 459451 - RNA, 22 nt, Human
cuggugccuccucccugugcuu

SEQ ID NO: 459452 - RNA, 22 nt, Human
aggccugaaggaagaugagcug

SEQ ID NO: 459453 - RNA, 22 nt, Human
ccaaggaggccccaggucagcu

SEQ ID NO: 459454 - RNA, 22 nt, Human
cugugaggcccugggugcugga

SEQ ID NO: 459455 - RNA, 22 nt, Human
uaaaguucuggugagagguaag

SEQ ID NO: 459456 - RNA, 22 nt, Human
cucugugauuuugugagccaga

SEQ ID NO: 459457 - RNA, 22 nt, Human
gccugccugcugugugcaaguu

SEQ ID NO: 459458 - RNA, 22 nt, Human
caggaacacaaugagucucaaa

SEQ ID NO: 459459 - RNA, 22 nt, Human
uuucacauaugguuguugauug

SEQ ID NO: 459460 - RNA, 22 nt, Human
cagcagugcuucagugugagau

SEQ ID NO: 459461 - RNA, 22 nt, Human
ugcagggcuaagucagagccug

SEQ ID NO: 459462 - RNA, 22 nt, Human
acagagagaauuggguuuacag

SEQ ID NO: 459463 - RNA, 22 nt, Human
gcagggugccgacuucagggau

SEQ ID NO: 459464 - RNA, 22 nt, Human
ugcaggagcugugcggugaggg

SEQ ID NO: 459465 - RNA, 22 nt, Human
guuugcauaucugugaaaugga

SEQ ID NO: 459466 - RNA, 22 nt, Human
gaggcugaauggccagaagcca

SEQ ID NO: 459467 - RNA, 22 nt, Human
auuucucaucaagugccaacuc

SEQ ID NO: 459468 - RNA, 22 nt, Human
uacccagcuccucagaagacca

SEQ ID NO: 459469 - RNA, 22 nt, Human
uccaggcaaagccuuguagacg

SEQ ID NO: 459470 - RNA, 22 nt, Human
guucuugccagcauccucaggu

SEQ ID NO: 459471 - RNA, 22 nt, Human
augcagcaguuuacaaagcaau

SEQ ID NO: 459472 - RNA, 22 nt, Human
augacagaggagugcaggugau

SEQ ID NO: 459473 - RNA, 22 nt, Human
ucagcaggcgguuccuuguggg

SEQ ID NO: 459474 - RNA, 22 nt, Human
ugcagcauucuuggccacuacu

SEQ ID NO: 459475 - RNA, 22 nt, Human
ucagcuuucucaaagaagcugg

SEQ ID NO: 459476 - RNA, 22 nt, Human
auaugcauguacgugugcacaa

SEQ ID NO: 459477 - RNA, 22 nt, Human
ccagcagcucccucaggguccg

SEQ ID NO: 459478 - RNA, 22 nt, Human
ugccagcacaaguuaagagauc

SEQ ID NO: 459479 - RNA, 22 nt, Human
uagggcaggugaagaaaagcua

SEQ ID NO: 459480 - RNA, 22 nt, Human
ucacaggaaccaucagagaaau

SEQ ID NO: 459481 - RNA, 22 nt, Human
uccaggcucucaggugucagca

SEQ ID NO: 459482 - RNA, 22 nt, Human
cugagcaggauauucacagcag

SEQ ID NO: 459483 - RNA, 21 nt, Human
cagacccucuagaggccaccu

SEQ ID NO: 459484 - RNA, 22 nt, Human
ccaucagcaugggagcaugggc

SEQ ID NO: 459485 - RNA, 22 nt, Human
uagaaaugauuuugaugcuuca

SEQ ID NO: 459486 - RNA, 22 nt, Human
uggccucuggcugaggacuaac

SEQ ID NO: 459487 - RNA, 23 nt, Human
auuugagaaaguauuuuuaagac

SEQ ID NO: 459488 - RNA, 22 nt, Human
uagggcucagagaaguggggcc

SEQ ID NO: 459489 - RNA, 22 nt, Human
aggaagccuggggcugcccucg

SEQ ID NO: 459490 - RNA, 22 nt, Human
ugaaacaaaccaguaauuuugu

SEQ ID NO: 459491 - RNA, 23 nt, Human
cagggcccugcucaauuucucca

SEQ ID NO: 459492 - RNA, 17 nt, Human
aggaagggcaaguuucu

SEQ ID NO: 459493 - RNA, 22 nt, Human
aaggccuggauuuagguuguga

SEQ ID NO: 459494 - RNA, 20 nt, Human
ggcagcucacuacuuucugu

SEQ ID NO: 459495 - RNA, 22 nt, Human
cucuguccuugcacaguuccua

SEQ ID NO: 459496 - RNA, 22 nt, Human
ucucugcucugugccucaguuu

SEQ ID NO: 459497 - RNA, 22 nt, Human
ugugccuacugauagagccaag

SEQ ID NO: 459498 - RNA, 22 nt, Human
aucagugcuaaagcaaaugccc

SEQ ID NO: 459499 - RNA, 22 nt, Human
caagcugguaucagcuagagcg

SEQ ID NO: 459500 - RNA, 22 nt, Human
aaaugcacacaccaggaaacua

SEQ ID NO: 459501 - RNA, 22 nt, Human
ucagcugccccaguggccccag

SEQ ID NO: 459502 - RNA, 22 nt, Human
uggcagggugccaguugcgagu

SEQ ID NO: 459503 - RNA, 22 nt, Human
cucccugggcagauguggcucu

SEQ ID NO: 459504 - RNA, 22 nt, Human
cucucugguacauagaguuugg

SEQ ID NO: 459505 - RNA, 22 nt, Human
agugucugccagcugccaggug

SEQ ID NO: 459506 - RNA, 22 nt, Human
acagcagcgucaacuuaaaauu

SEQ ID NO: 459507 - RNA, 22 nt, Human
agcaggcuuucaagagucuucu

SEQ ID NO: 459508 - RNA, 22 nt, Human
gccuccugagaagccacaggcu

SEQ ID NO: 459509 - RNA, 23 nt, Human
aggauccugguacaggagcagag

SEQ ID NO: 459510 - RNA, 22 nt, Human
ccagggcaauuauuuggagggu

SEQ ID NO: 459511 - RNA, 18 nt, Human
uggugaaggguggaggag

SEQ ID NO: 459512 - RNA, 19 nt, Human
cucuggccucuggaugcug

SEQ ID NO: 459513 - RNA, 23 nt, Human
gccuucagcucgggaaggcuccc

SEQ ID NO: 459514 - RNA, 22 nt, Human
uaugagcuuccaguguugcaug

SEQ ID NO: 459515 - RNA, 22 nt, Human
uuaaacaguguuucaugugggg

SEQ ID NO: 459516 - RNA, 22 nt, Human
ugauuuccacagucaggggugc

SEQ ID NO: 459517 - RNA, 19 nt, Human
ccucugcgcuguccugcuc

SEQ ID NO: 459518 - RNA, 22 nt, Human
gaccauuuguugaaaagauuau

SEQ ID NO: 459519 - RNA, 22 nt, Human
cccagcauuucugggcugcacu

SEQ ID NO: 459520 - RNA, 22 nt, Human
aggcugagucaaguuaggguga

SEQ ID NO: 459521 - RNA, 22 nt, Human
auacagaaaaugaugcagaguu

SEQ ID NO: 459522 - RNA, 21 nt, Human
acagcagggcuggcaugacag

SEQ ID NO: 459523 - RNA, 22 nt, Human
acccuggggguggccagugcca

SEQ ID NO: 459524 - RNA, 22 nt, Human
uauuucugucagccagauaugg

SEQ ID NO: 459525 - RNA, 22 nt, Human
gaguguucccacaccccaguug

SEQ ID NO: 459526 - RNA, 22 nt, Human
cagaggacaauagaauggaaag

SEQ ID NO: 459527 - RNA, 22 nt, Human
caggccugacccugagcuucac

SEQ ID NO: 459528 - RNA, 22 nt, Human
gcugccacucugagcuugcuuc

SEQ ID NO: 459529 - RNA, 22 nt, Human
gaccauuugcuaguaaauugca

SEQ ID NO: 459530 - RNA, 22 nt, Human
aggagcccugcgggaggcagag

SEQ ID NO: 459531 - RNA, 22 nt, Human
cuggccucauagccaagcugug

SEQ ID NO: 459532 - RNA, 22 nt, Human
cagcuggcaaguggagcagggu

SEQ ID NO: 459533 - RNA, 22 nt, Human
caaauguguagagcuuuugggg

SEQ ID NO: 459534 - RNA, 22 nt, Human
gcaaggcuuugugaauuuuaaa

SEQ ID NO: 459535 - RNA, 22 nt, Human
gcucccaccuuugcuaucagua

SEQ ID NO: 459536 - RNA, 22 nt, Human
ccugggucacucaggcaggcgg

SEQ ID NO: 459537 - RNA, 22 nt, Human
agcuccugaaaagcgcuugcuu

SEQ ID NO: 459538 - RNA, 22 nt, Human
cagcaggcguugggagaaagac

SEQ ID NO: 459539 - RNA, 22 nt, Human
gcccagcagaucucagugucuc

SEQ ID NO: 459540 - RNA, 22 nt, Human
acucugaggagugacuagaggu

SEQ ID NO: 459541 - RNA, 22 nt, Human
gcuucucucucagacugcaagc

SEQ ID NO: 459542 - RNA, 22 nt, Human
agccaggcugcaguuggcuggc

SEQ ID NO: 459543 - RNA, 22 nt, Human
gaggccuggcugucagucccca

SEQ ID NO: 459544 - RNA, 22 nt, Human
cacccaggcagguggcugagaa

SEQ ID NO: 459545 - RNA, 22 nt, Human
auaaguucagguaaagaaauca

SEQ ID NO: 459546 - RNA, 22 nt, Human
cagccugcuagggcaaugccuu

SEQ ID NO: 459547 - RNA, 21 nt, Human
gggcuggacaugguggcucau

SEQ ID NO: 459548 - RNA, 22 nt, Human
ucaccagggagcuuguccucug

SEQ ID NO: 459549 - RNA, 22 nt, Human
aaguccagguccucauuccauc

SEQ ID NO: 459550 - RNA, 22 nt, Human
agagugauucuaguuagggaau

SEQ ID NO: 459551 - RNA, 22 nt, Human
cuuuccuagauggccaucuuuc

SEQ ID NO: 459552 - RNA, 22 nt, Human
ugcccugucuaagcugucagua

SEQ ID NO: 459553 - RNA, 22 nt, Human
auugcagcuggucaggguaauu

SEQ ID NO: 459554 - RNA, 22 nt, Human
cacaggagugcugcuauuguug

SEQ ID NO: 459555 - RNA, 22 nt, Human
uagaaagugaagguuaauuaau

SEQ ID NO: 459556 - RNA, 22 nt, Human
aggcuucuacguggucccaggg

SEQ ID NO: 459557 - RNA, 22 nt, Human
ucuggccaacaaaaacuaaguc

SEQ ID NO: 459558 - RNA, 22 nt, Human
acaggagugaaucuggcacuua

SEQ ID NO: 459559 - RNA, 22 nt, Human
acaguggaaagaaacgaauuag

SEQ ID NO: 459560 - RNA, 22 nt, Human
uuaauaaaguaugaauuggaaa

SEQ ID NO: 459561 - RNA, 22 nt, Human
cugggaggcacuauucaggagg

SEQ ID NO: 459562 - RNA, 22 nt, Human
auuuucaucauggguuuaacau

SEQ ID NO: 459563 - RNA, 23 nt, Human
aucaagucaucagcaaaauacau

SEQ ID NO: 459564 - RNA, 22 nt, Human
auaaaaacugacccauccuuug

SEQ ID NO: 459565 - RNA, 22 nt, Human
uuagaaauacaagugagguuga

SEQ ID NO: 459566 - RNA, 22 nt, Human
aagccaguccucuacugggcac

SEQ ID NO: 459567 - RNA, 22 nt, Human
uccaggcugauccaugaagaau

SEQ ID NO: 459568 - RNA, 22 nt, Human
auugacaaggaaacuauaccag

SEQ ID NO: 459569 - RNA, 22 nt, Human
caggggcuguggcacauggugu

SEQ ID NO: 459570 - RNA, 22 nt, Human
cagggacccgcacagguagcau

SEQ ID NO: 459571 - RNA, 19 nt, Human
uccaggcauccuucaggcu

SEQ ID NO: 459572 - RNA, 22 nt, Human
uggcucaguuccaucaucugga

SEQ ID NO: 459573 - RNA, 22 nt, Human
cacaagucuguggucuccaaca

SEQ ID NO: 459574 - RNA, 19 nt, Human
cucugccucccuccugggu

SEQ ID NO: 459575 - RNA, 22 nt, Human
cuggccgguauuugccucuggg

SEQ ID NO: 459576 - RNA, 22 nt, Human
gccuguccacuaaacagccaag

SEQ ID NO: 459577 - RNA, 20 nt, Human
cuccaggggaagagccuucc

SEQ ID NO: 459578 - RNA, 22 nt, Human
cuggguggcuguccagccagcc

SEQ ID NO: 459579 - RNA, 19 nt, Human
auaaggcaauuggauuugg

SEQ ID NO: 459580 - RNA, 22 nt, Human
agugggggccaacgagggcagc

SEQ ID NO: 459581 - RNA, 22 nt, Human
agccugguguggggcugcagag

SEQ ID NO: 459582 - RNA, 22 nt, Human
uguaagauauucagcuuauuga

SEQ ID NO: 459583 - RNA, 21 nt, Human
ugucagcaacaauacuuucuc

SEQ ID NO: 459584 - RNA, 22 nt, Human
ccaggagucuggaugagguguc

SEQ ID NO: 459585 - RNA, 22 nt, Human
cagaagcauuccagcaaauagu

SEQ ID NO: 459586 - RNA, 22 nt, Human
agccucuggcccuagacugcuu

SEQ ID NO: 459587 - RNA, 22 nt, Human
uagaggcagaagaaauugacaa

SEQ ID NO: 459588 - RNA, 22 nt, Human
agcagggcccacuaggggagau

SEQ ID NO: 459589 - RNA, 22 nt, Human
ucccacugugaauccaaggccu

SEQ ID NO: 459590 - RNA, 22 nt, Human
ucugcaggccucgacaaggcca

SEQ ID NO: 459591 - RNA, 22 nt, Human
auagauacauuagguaacuugu

SEQ ID NO: 459592 - RNA, 22 nt, Human
ggcugcagguugguuggcagcu

SEQ ID NO: 459593 - RNA, 22 nt, Human
aaguucaagcucugccuaaaau

SEQ ID NO: 459594 - RNA, 22 nt, Human
ggagcugggaauuggaucaucu

SEQ ID NO: 459595 - RNA, 22 nt, Human
ucccagagucuucuccuguaau

SEQ ID NO: 459596 - RNA, 22 nt, Human
uccuuggcagcagggagcauga

SEQ ID NO: 459597 - RNA, 22 nt, Human
gugccagggggcacugaacaga

SEQ ID NO: 459598 - RNA, 20 nt, Human
ucaggcaguggggaaaggca

SEQ ID NO: 459599 - RNA, 22 nt, Human
ggccccugcggacugccuagag

SEQ ID NO: 459600 - RNA, 22 nt, Human
aggcagccuuuagacagucugc

SEQ ID NO: 459601 - RNA, 21 nt, Human
ccuccaggagcagagcccuga

SEQ ID NO: 459602 - RNA, 22 nt, Human
ucucuuuuauguacacccugac

SEQ ID NO: 459603 - RNA, 22 nt, Human
caggggcugugggcggagccuc

SEQ ID NO: 459604 - RNA, 22 nt, Human
uaccauuucauucuuuccucau

SEQ ID NO: 459605 - RNA, 20 nt, Human
agcugguuaucuuaauucuu

SEQ ID NO: 459606 - RNA, 22 nt, Human
gggaagggagggccuccaguca

SEQ ID NO: 459607 - RNA, 22 nt, Human
ucaguggaguauggaugaaguc

SEQ ID NO: 459608 - RNA, 22 nt, Human
caaggccaagguuuugugaacu

SEQ ID NO: 459609 - RNA, 22 nt, Human
acccaggguagaaccucagagc

SEQ ID NO: 459610 - RNA, 22 nt, Human
ggcaggucagguccaugaccaa

SEQ ID NO: 459611 - RNA, 22 nt, Human
ccuggcugucguuuugugaaau

SEQ ID NO: 459612 - RNA, 22 nt, Human
agcagccacagcagaucugagu

SEQ ID NO: 459613 - RNA, 22 nt, Human
cauuucugucacguucuuuuau

SEQ ID NO: 459614 - RNA, 23 nt, Human
uugcauguagcccaugaguaacu

SEQ ID NO: 459615 - RNA, 22 nt, Human
ucucaggaaauaggauuugagu

SEQ ID NO: 459616 - RNA, 22 nt, Human
ccuggccucagacagagggugg

SEQ ID NO: 459617 - RNA, 22 nt, Human
gcccucagaguuccccacagug

SEQ ID NO: 459618 - RNA, 22 nt, Human
uaauuauuaugacaacaauugc

SEQ ID NO: 459619 - RNA, 22 nt, Human
ugcucugguccucccucggcgc

SEQ ID NO: 459620 - RNA, 22 nt, Human
acauucuguuuccccaaagaga

SEQ ID NO: 459621 - RNA, 22 nt, Human
gaaggcugaugacagauucugc

SEQ ID NO: 459622 - RNA, 22 nt, Human
cagcaauaagguaagcuucucc

SEQ ID NO: 459623 - RNA, 22 nt, Human
auaaagauuucuuuuucucuac

SEQ ID NO: 459624 - RNA, 22 nt, Human
cagagagagucaaaucuuugcu

SEQ ID NO: 459625 - RNA, 22 nt, Human
uagggacaaagagcugaggccu

SEQ ID NO: 459626 - RNA, 22 nt, Human
gcuggcauuacaggagagaacc

SEQ ID NO: 459627 - RNA, 19 nt, Human
aggcugcaagguggugggc

SEQ ID NO: 459628 - RNA, 20 nt, Human
cuuuggcaaugagaacaggg

SEQ ID NO: 459629 - RNA, 22 nt, Human
auuauguaacugugguucagca

SEQ ID NO: 459630 - RNA, 22 nt, Human
cuggguggaucgcagccccagg

SEQ ID NO: 459631 - RNA, 22 nt, Human
gcuggagcugcagccugggccu

SEQ ID NO: 459632 - RNA, 22 nt, Human
cccuuccuccucgccugucaga

SEQ ID NO: 459633 - RNA, 22 nt, Human
ucagagugggagaaugugccaa

SEQ ID NO: 459634 - RNA, 22 nt, Human
agggagaacaguugcagcagac

SEQ ID NO: 459635 - RNA, 22 nt, Human
guggaaguagauuugagaaggu

SEQ ID NO: 459636 - RNA, 22 nt, Human
aaaccaucagauaauucauacu

SEQ ID NO: 459637 - RNA, 22 nt, Human
augucuuuggcuuugacauggc

SEQ ID NO: 459638 - RNA, 23 nt, Human
acagccaguucaccucuccuugg

SEQ ID NO: 459639 - RNA, 22 nt, Human
ggggacccucaggacugcgucu

SEQ ID NO: 459640 - RNA, 22 nt, Human
ugaagccacuuuccagaaucac

SEQ ID NO: 459641 - RNA, 22 nt, Human
cugaaggaagcagaagcgaggu

SEQ ID NO: 459642 - RNA, 17 nt, Human
agcagcuggcacaggag

SEQ ID NO: 459643 - RNA, 22 nt, Human
ugagcuuacgugggaacagacu

SEQ ID NO: 459644 - RNA, 22 nt, Human
agagcugcaggguggacccagg

SEQ ID NO: 459645 - RNA, 22 nt, Human
cugggaguguucuaggucacau

SEQ ID NO: 459646 - RNA, 22 nt, Human
uacuuuuagccuauuugauucu

SEQ ID NO: 459647 - RNA, 20 nt, Human
ugcagcuucaccugugucau

SEQ ID NO: 459648 - RNA, 22 nt, Human
agggcagagauuaauuaagaca

SEQ ID NO: 459649 - RNA, 22 nt, Human
caaggaaacaugaaaugcauug

SEQ ID NO: 459650 - RNA, 22 nt, Human
cagugcagucaaggaagaacca

SEQ ID NO: 459651 - RNA, 22 nt, Human
gcagggcugggugggagacaga

SEQ ID NO: 459652 - RNA, 19 nt, Human
gagggcucauuugaacaau

SEQ ID NO: 459653 - RNA, 22 nt, Human
agggcugacaguggcguggcgu

SEQ ID NO: 459654 - RNA, 22 nt, Human
ucagcuuugaucucaggcaauc

SEQ ID NO: 459655 - RNA, 22 nt, Human
uucauaaugagguccuagaggc

SEQ ID NO: 459656 - RNA, 22 nt, Human
ccagcuggagccaagguggacu

SEQ ID NO: 459657 - RNA, 22 nt, Human
uuucacaauuuuaaggagcaaa

SEQ ID NO: 459658 - RNA, 18 nt, Human
ccugccagucuggagcag

SEQ ID NO: 459659 - RNA, 22 nt, Human
caccaucagcagcaggugucaa

SEQ ID NO: 459660 - RNA, 22 nt, Human
gagccaggcaccuucuguguug

SEQ ID NO: 459661 - RNA, 22 nt, Human
guuaauuugcagcuuucgagcu

SEQ ID NO: 459662 - RNA, 22 nt, Human
uggcugagaaugggaugaugcc

SEQ ID NO: 459663 - RNA, 22 nt, Human
ucagggcacauucugcaguggc

SEQ ID NO: 459664 - RNA, 22 nt, Human
gguggcagaauaauugaagguc

SEQ ID NO: 459665 - RNA, 22 nt, Human
gacccaggcccaaggcugccag

SEQ ID NO: 459666 - RNA, 22 nt, Human
gaggccuggucuaugagauguu

SEQ ID NO: 459667 - RNA, 22 nt, Human
cugugcuggcagaccuggaguu

SEQ ID NO: 459668 - RNA, 22 nt, Human
aaaaugugaucuacaaaugcaa

SEQ ID NO: 459669 - RNA, 22 nt, Human
cccaggcuggauuucgguggca

SEQ ID NO: 459670 - RNA, 19 nt, Human
ucaaaggcuuuuaggagac

SEQ ID NO: 459671 - RNA, 22 nt, Human
cccaggcuggagugcaauggug

SEQ ID NO: 459672 - RNA, 22 nt, Human
acuuaaaaacagauccagcagg

SEQ ID NO: 459673 - RNA, 21 nt, Human
uagcacuucgcuguaauuggg

SEQ ID NO: 459674 - RNA, 22 nt, Human
aaauugugcucacacugauauu

SEQ ID NO: 459675 - RNA, 19 nt, Human
caggaaugagguaauggcu

SEQ ID NO: 459676 - RNA, 21 nt, Human
aaaggccauaaucacggagca

SEQ ID NO: 459677 - RNA, 22 nt, Human
gggagcugagcuggaagagaau

SEQ ID NO: 459678 - RNA, 22 nt, Human
acaggccacaguggagucucug

SEQ ID NO: 459679 - RNA, 22 nt, Human
uaacacugguauuucauuuagu

SEQ ID NO: 459680 - RNA, 22 nt, Human
guccuggggauacagaagugaa

SEQ ID NO: 459681 - RNA, 22 nt, Human
ccaggugggaggaaagcagaga

SEQ ID NO: 459682 - RNA, 22 nt, Human
cauaauaucuccgauuacuugc

SEQ ID NO: 459683 - RNA, 19 nt, Human
guaagggcuaauggacuau

SEQ ID NO: 459684 - RNA, 22 nt, Human
cuggacagaaagggcugcugug

SEQ ID NO: 459685 - RNA, 22 nt, Human
aauuuuaucucuaagcaggcuu

SEQ ID NO: 459686 - RNA, 22 nt, Human
gcuugcucaacccccgucucuc

SEQ ID NO: 459687 - RNA, 19 nt, Human
caugagcugcucacuuccc

SEQ ID NO: 459688 - RNA, 19 nt, Human
cugguccugacugaggggu

SEQ ID NO: 459689 - RNA, 22 nt, Human
cagagcagaagcgguccucaca

SEQ ID NO: 459690 - RNA, 22 nt, Human
gccuguccuggaugcucugcaa

SEQ ID NO: 459691 - RNA, 22 nt, Human
ccugggcucaagugauccuccu

SEQ ID NO: 459692 - RNA, 22 nt, Human
acaggccugacacacagagggc

SEQ ID NO: 459693 - RNA, 22 nt, Human
ugccugugucacagugauguuu

SEQ ID NO: 459694 - RNA, 22 nt, Human
gcugagaguguaggauguuuac

SEQ ID NO: 459695 - RNA, 22 nt, Human
aggcaguuuauccccagagccu

SEQ ID NO: 459696 - RNA, 22 nt, Human
ucagagugguagccuauuuucu

SEQ ID NO: 459697 - RNA, 22 nt, Human
ucugagagccucuagccuaagu

SEQ ID NO: 459698 - RNA, 22 nt, Human
guuguauagagggcaugaaucu

SEQ ID NO: 459699 - RNA, 22 nt, Human
ugcuuccuugagcucuccaauc

SEQ ID NO: 459700 - RNA, 22 nt, Human
aauagguagccagauauauaaa

SEQ ID NO: 459701 - RNA, 22 nt, Human
acugccuuauaugcugugugug

SEQ ID NO: 459702 - RNA, 22 nt, Human
gccuggccugaacuaggaggug

SEQ ID NO: 459703 - RNA, 22 nt, Human
ugcugccaagcccgugcuccug

SEQ ID NO: 459704 - RNA, 23 nt, Human
gcugucaguuguuuuugucucua

SEQ ID NO: 459705 - RNA, 22 nt, Human
cuuggucauuucuuguccuguu

SEQ ID NO: 459706 - RNA, 22 nt, Human
aggagccuccuucucaugugca

SEQ ID NO: 459707 - RNA, 22 nt, Human
uuguuacagcagugauuucaga

SEQ ID NO: 459708 - RNA, 22 nt, Human
gccaggcugaggcucuggaaga

SEQ ID NO: 459709 - RNA, 22 nt, Human
ugaggcagcuuuuucugugugu

SEQ ID NO: 459710 - RNA, 22 nt, Human
aaggggaauagaguggguugug

SEQ ID NO: 459711 - RNA, 22 nt, Human
uacaggcauguagcauggugau

SEQ ID NO: 459712 - RNA, 22 nt, Human
ccugccugcggcccgcggggag

SEQ ID NO: 459713 - RNA, 22 nt, Human
ugcucacugaacucuugcuguc

SEQ ID NO: 459714 - RNA, 22 nt, Human
acaguguuuuagaaaagcuuga

SEQ ID NO: 459715 - RNA, 22 nt, Human
cagccagggagcaaagaguuga

SEQ ID NO: 459716 - RNA, 22 nt, Human
ugcacagcgggugucugucagg

SEQ ID NO: 459717 - RNA, 22 nt, Human
cauucauuuaugaaauaucuau

SEQ ID NO: 459718 - RNA, 22 nt, Human
gagcugaaauaugaagccaauu

SEQ ID NO: 459719 - RNA, 22 nt, Human
uuuuaccugaaccacacaguau

SEQ ID NO: 459720 - RNA, 19 nt, Human
ccugucugucuucagcuag

SEQ ID NO: 459721 - RNA, 22 nt, Human
agccagcugccuuucacaucug

SEQ ID NO: 459722 - RNA, 22 nt, Human
gcugucacacauggccccagcu

SEQ ID NO: 459723 - RNA, 22 nt, Human
gggcacuguacacugugcaugg

SEQ ID NO: 459724 - RNA, 22 nt, Human
cucacagguaccagcacccucc

SEQ ID NO: 459725 - RNA, 22 nt, Human
agugaaauugcuguaagaggaa

SEQ ID NO: 459726 - RNA, 22 nt, Human
cggagccugcuuguugcagcug

SEQ ID NO: 459727 - RNA, 22 nt, Human
aaguuugacagaaguuucuaau

SEQ ID NO: 459728 - RNA, 22 nt, Human
gccuucccaagacgccugaguu

SEQ ID NO: 459729 - RNA, 23 nt, Human
uggcuggcagaaacugaagcaug

SEQ ID NO: 459730 - RNA, 22 nt, Human
ccugagugcuuccagagucaug

SEQ ID NO: 459731 - RNA, 22 nt, Human
ggcugcagagcugggugggccu

SEQ ID NO: 459732 - RNA, 18 nt, Human
uggagccauugccaccau

SEQ ID NO: 459733 - RNA, 22 nt, Human
gcucagaggagcaucauaagga

SEQ ID NO: 459734 - RNA, 22 nt, Human
gggcugcacagaucuucaaggg

SEQ ID NO: 459735 - RNA, 22 nt, Human
auacuaaaguauagaacuuagu

SEQ ID NO: 459736 - RNA, 22 nt, Human
gcuccucuccucggagucgggg

SEQ ID NO: 459737 - RNA, 22 nt, Human
uaauguguccugaaagcuucug

SEQ ID NO: 459738 - RNA, 19 nt, Human
gcacugaagaguuggucac

SEQ ID NO: 459739 - RNA, 22 nt, Human
ugacucuguaccugucugccuu

SEQ ID NO: 459740 - RNA, 22 nt, Human
cgcagaagagguugucuagucc

SEQ ID NO: 459741 - RNA, 22 nt, Human
uuaaauuagucaagcuucucug

SEQ ID NO: 459742 - RNA, 22 nt, Human
aggcacugguccauuuucugca

SEQ ID NO: 459743 - RNA, 22 nt, Human
uggcagcugaggggaggcuuug

SEQ ID NO: 459744 - RNA, 22 nt, Human
ccaggggcuggugcugagcugg

SEQ ID NO: 459745 - RNA, 22 nt, Human
auuauuaaagcuuaggucuuau

SEQ ID NO: 459746 - RNA, 22 nt, Human
cuguacucaagguaaaccagga

SEQ ID NO: 459747 - RNA, 22 nt, Human
uggcucaguuucugcccagcug

SEQ ID NO: 459748 - RNA, 22 nt, Human
agggcagccucucagccuaggu

SEQ ID NO: 459749 - RNA, 22 nt, Human
uggcacuggcgcaggauggcgg

SEQ ID NO: 459750 - RNA, 22 nt, Human
uacaugcaugucacagaaugaa

SEQ ID NO: 459751 - RNA, 22 nt, Human
cuuuauuccuacaagauuuucu

SEQ ID NO: 459752 - RNA, 19 nt, Human
gcuggcagauguggccgug

SEQ ID NO: 459753 - RNA, 22 nt, Human
ugcccaagcagaggagugauuc

SEQ ID NO: 459754 - RNA, 22 nt, Human
agagacaggauaucugcucaug

SEQ ID NO: 459755 - RNA, 22 nt, Human
uugcagagccaugaggcuggcu

SEQ ID NO: 459756 - RNA, 22 nt, Human
agggcagugggaaagccugcuc

SEQ ID NO: 459757 - RNA, 22 nt, Human
uugauuuauagaauguucaagc

SEQ ID NO: 459758 - RNA, 22 nt, Human
gaagccaguacugugcucugca

SEQ ID NO: 459759 - RNA, 17 nt, Human
ggagagugggaauggcc

SEQ ID NO: 459760 - RNA, 22 nt, Human
acagauuuuauuauucagguau

SEQ ID NO: 459761 - RNA, 22 nt, Human
uugaauaggacucagcagugau

SEQ ID NO: 459762 - RNA, 22 nt, Human
acuugguuggucucacccuguu

SEQ ID NO: 459763 - RNA, 21 nt, Human
aggcugcuggcucaggguccu

SEQ ID NO: 459764 - RNA, 22 nt, Human
aaugaacaaaauaugcuuugca

SEQ ID NO: 459765 - RNA, 22 nt, Human
uugcagggcaggaccauggaca

SEQ ID NO: 459766 - RNA, 19 nt, Human
uccaggaggcugccauuga

SEQ ID NO: 459767 - RNA, 22 nt, Human
uggcucuguugagguauggauu

SEQ ID NO: 459768 - RNA, 22 nt, Human
ucccagcgcggggggaggaucc

SEQ ID NO: 459769 - RNA, 22 nt, Human
auucuccaucaccacuggcacu

SEQ ID NO: 459770 - RNA, 22 nt, Human
gaaagaggaaggagauguauua

SEQ ID NO: 459771 - RNA, 22 nt, Human
gccaggcagccacccucugcga

SEQ ID NO: 459772 - RNA, 22 nt, Human
uguauuccaaaaugcugaggau

SEQ ID NO: 459773 - RNA, 22 nt, Human
gccuggaggguugagguuuugu

SEQ ID NO: 459774 - RNA, 22 nt, Human
uccucacauggugagccacaca

SEQ ID NO: 459775 - RNA, 22 nt, Human
ccagggugggaggcugaaggcg

SEQ ID NO: 459776 - RNA, 22 nt, Human
gcucacagccggcuggcagggg

SEQ ID NO: 459777 - RNA, 19 nt, Human
gccugggaugggcagaacu

SEQ ID NO: 459778 - RNA, 22 nt, Human
ggcugcucugccuuccagcugg

SEQ ID NO: 459779 - RNA, 22 nt, Human
guuucauuaccugacccaugag

SEQ ID NO: 459780 - RNA, 21 nt, Human
gcaaggcuuuuguguuuccca

SEQ ID NO: 459781 - RNA, 23 nt, Human
ucucaagaggaagcagggcucau

SEQ ID NO: 459782 - RNA, 22 nt, Human
augggaggcaggcucagaaccg

SEQ ID NO: 459783 - RNA, 20 nt, Human
uugcauuggaugugcaggug

SEQ ID NO: 459784 - RNA, 22 nt, Human
gggcagggguagcauuccaagu

SEQ ID NO: 459785 - RNA, 22 nt, Human
gcucccagguucuugggccuug

SEQ ID NO: 459786 - RNA, 22 nt, Human
uuccuaaaagaauacacuggau

SEQ ID NO: 459787 - RNA, 22 nt, Human
ggcugagcccccucugcguagg

SEQ ID NO: 459788 - RNA, 22 nt, Human
ucucagaguuuuuuuccaggac

SEQ ID NO: 459789 - RNA, 22 nt, Human
gcagcugggacacugaggccag

SEQ ID NO: 459790 - RNA, 22 nt, Human
gcagaagggaauaaggagcuuu

SEQ ID NO: 459791 - RNA, 22 nt, Human
acacugaauaauugagaguuga

SEQ ID NO: 459792 - RNA, 20 nt, Human
ugccaggcugcacgccugcc

SEQ ID NO: 459793 - RNA, 22 nt, Human
gggcaguggguggcugcagccu

SEQ ID NO: 459794 - RNA, 22 nt, Human
aggcaggcucaggcccaugcuu

SEQ ID NO: 459795 - RNA, 17 nt, Human
gcauccaguaacaugcc

SEQ ID NO: 459796 - RNA, 22 nt, Human
uacuuuggauccuuacaauagc

SEQ ID NO: 459797 - RNA, 22 nt, Human
ccagugcccagcugcccaggca

SEQ ID NO: 459798 - RNA, 22 nt, Human
acauuucuucccuuuagcagaa

SEQ ID NO: 459799 - RNA, 22 nt, Human
agcuccugcacccagccuugag

SEQ ID NO: 459800 - RNA, 22 nt, Human
cagugagggcccccuuccaggu

SEQ ID NO: 459801 - RNA, 22 nt, Human
gagugucugaauuagagcacaa

SEQ ID NO: 459802 - RNA, 22 nt, Human
cacaggcuugucagcaugaggc

SEQ ID NO: 459803 - RNA, 22 nt, Human
cugggcacacagugacucugca

SEQ ID NO: 459804 - RNA, 22 nt, Human
gcugagagugagcacuggauau

SEQ ID NO: 459805 - RNA, 22 nt, Human
ccagcuuuugcacuggacuggg

SEQ ID NO: 459806 - RNA, 22 nt, Human
ugcucuccggcuuccguggccu

SEQ ID NO: 459807 - RNA, 22 nt, Human
gagaaacuaacaucugaaggug

SEQ ID NO: 459808 - RNA, 18 nt, Human
cugaggcuuagagagguu

SEQ ID NO: 459809 - RNA, 20 nt, Human
aggcagagcgcacuuuuaga

SEQ ID NO: 459810 - RNA, 22 nt, Human
ccuggcaguggugaagaagagg

SEQ ID NO: 459811 - RNA, 23 nt, Human
caguacuuaguguagcguuaauu

SEQ ID NO: 459812 - RNA, 22 nt, Human
cugggcaguuuauucaguucug

SEQ ID NO: 459813 - RNA, 22 nt, Human
cauugcacgggcgucugucugu

SEQ ID NO: 459814 - RNA, 22 nt, Human
gaguggagcaaaagagguagau

SEQ ID NO: 459815 - RNA, 22 nt, Human
accagacacugugaagacaggc

SEQ ID NO: 459816 - RNA, 22 nt, Human
uacacacaugcauuugccuuau

SEQ ID NO: 459817 - RNA, 22 nt, Human
uuacauuuggcuauguccucua

SEQ ID NO: 459818 - RNA, 22 nt, Human
gacgccucuucccugcugcacu

SEQ ID NO: 459819 - RNA, 20 nt, Human
gcuguugccaguacagaugg

SEQ ID NO: 459820 - RNA, 22 nt, Human
ucaggcaguagaauugcuugaa

SEQ ID NO: 459821 - RNA, 22 nt, Human
aggcucauucuugccucugagc

SEQ ID NO: 459822 - RNA, 22 nt, Human
cuacagguaugugcaugacauc

SEQ ID NO: 459823 - RNA, 22 nt, Human
ucaugacaucuguuuaucucaa

SEQ ID NO: 459824 - RNA, 22 nt, Human
cacagggcagugauuguccaca

SEQ ID NO: 459825 - RNA, 22 nt, Human
cagagcugagaauguugaugcu

SEQ ID NO: 459826 - RNA, 19 nt, Human
uagagcugcuuccuggcag

SEQ ID NO: 459827 - RNA, 22 nt, Human
ccugcagagccacgugccagcg

SEQ ID NO: 459828 - RNA, 22 nt, Human
caaggcugugcaggguccauau

SEQ ID NO: 459829 - RNA, 22 nt, Human
ggaggcagaacuucccgucagu

SEQ ID NO: 459830 - RNA, 22 nt, Human
gcagcuuugaagacuuauuugc

SEQ ID NO: 459831 - RNA, 22 nt, Human
gcucuguguugucagaggcacc

SEQ ID NO: 459832 - RNA, 17 nt, Human
cugagcauccgugcucu

SEQ ID NO: 459833 - RNA, 22 nt, Human
accauguguuuuacacauggua

SEQ ID NO: 459834 - RNA, 22 nt, Human
aucaccaggcaaaaugucagag

SEQ ID NO: 459835 - RNA, 22 nt, Human
augcaccugaacuccaucagcu

SEQ ID NO: 459836 - RNA, 20 nt, Human
acaugaaaggaaacaggaaa

SEQ ID NO: 459837 - RNA, 22 nt, Human
gcuggccugcgagggcaggcug

SEQ ID NO: 459838 - RNA, 22 nt, Human
gcuguauuuaacaacuggcuca

SEQ ID NO: 459839 - RNA, 22 nt, Human
acuguccauaauauuggugaac

SEQ ID NO: 459840 - RNA, 22 nt, Human
ccucagagaaagguauggcuga

SEQ ID NO: 459841 - RNA, 22 nt, Human
uguguuuuacaaauucucuuaa

SEQ ID NO: 459842 - RNA, 22 nt, Human
guugaaugaaucauucuaugua

SEQ ID NO: 459843 - RNA, 22 nt, Human
uccaggagagguguggggacug

SEQ ID NO: 459844 - RNA, 22 nt, Human
gcccagccuccaagcuccaagg

SEQ ID NO: 459845 - RNA, 22 nt, Human
uaaaaguggauaagcuguagga

SEQ ID NO: 459846 - RNA, 22 nt, Human
agggcagcugugagccacugug

SEQ ID NO: 459847 - RNA, 22 nt, Human
ccugagagcagcuuccugcuua

SEQ ID NO: 459848 - RNA, 22 nt, Human
ucauggcacuuagcacaguccu

SEQ ID NO: 459849 - RNA, 22 nt, Human
agcaccuucacaggcucucagg

SEQ ID NO: 459850 - RNA, 22 nt, Human
ggcugccugggagcccuccucu

SEQ ID NO: 459851 - RNA, 22 nt, Human
uugaacagcuguuacauuguua

SEQ ID NO: 459852 - RNA, 22 nt, Human
cauuuacauuuaagguuaauau

SEQ ID NO: 459853 - RNA, 21 nt, Human
agcuggcagauauggugucug

SEQ ID NO: 459854 - RNA, 22 nt, Human
gcauggaauucccuuaugggcc

SEQ ID NO: 459855 - RNA, 22 nt, Human
ggggcagauggaacagagcaca

SEQ ID NO: 459856 - RNA, 22 nt, Human
cagaguggcagucccaggccca

SEQ ID NO: 459857 - RNA, 22 nt, Human
agcagggcacuggaaggcacug

SEQ ID NO: 459858 - RNA, 21 nt, Human
aggcucagcagguguauaaag

SEQ ID NO: 459859 - RNA, 22 nt, Human
cagagcuggagcuugaauggag

SEQ ID NO: 459860 - RNA, 22 nt, Human
cuacuucuaaguacauggugau

SEQ ID NO: 459861 - RNA, 22 nt, Human
acagggccauuaucuguucuag

SEQ ID NO: 459862 - RNA, 22 nt, Human
gcaggcagagguggaggagaca

SEQ ID NO: 459863 - RNA, 22 nt, Human
ccagggugagaaaaggcuggau

SEQ ID NO: 459864 - RNA, 22 nt, Human
ccugcuucagggaugauggcac

SEQ ID NO: 459865 - RNA, 22 nt, Human
gucuuucuuaauucaagugcuu

SEQ ID NO: 459866 - RNA, 22 nt, Human
gcaaggacucccugggucauuc

SEQ ID NO: 459867 - RNA, 22 nt, Human
ggcacagggaggcccuggugug

SEQ ID NO: 459868 - RNA, 22 nt, Human
uaauccaggguauucuaguuuc

SEQ ID NO: 459869 - RNA, 22 nt, Human
auaaggcagugacuucaucuau

SEQ ID NO: 459870 - RNA, 22 nt, Human
aggaagcccaagucucaucuuc

SEQ ID NO: 459871 - RNA, 22 nt, Human
guagggacaugccauuaucuca

SEQ ID NO: 459872 - RNA, 22 nt, Human
uaggccagcccuuaguccuguc

SEQ ID NO: 459873 - RNA, 21 nt, Human
uuucccagcugaaaauaaaug

SEQ ID NO: 459874 - RNA, 22 nt, Human
auugacaagugagcugggcugc

SEQ ID NO: 459875 - RNA, 22 nt, Human
ccagucccagcucugccaugcu

SEQ ID NO: 459876 - RNA, 22 nt, Human
acaaaggcagccaaucaucugc

SEQ ID NO: 459877 - RNA, 22 nt, Human
gcccaggcuggagugcaguagc

SEQ ID NO: 459878 - RNA, 22 nt, Human
gagacaaaaguuggagugcaag

SEQ ID NO: 459879 - RNA, 22 nt, Human
ugugcccaucccucuggagugu

SEQ ID NO: 459880 - RNA, 17 nt, Human
cagugaggccuuuccuc

SEQ ID NO: 459881 - RNA, 22 nt, Human
cagaguccuggacacagagaca

SEQ ID NO: 459882 - RNA, 22 nt, Human
uggguagagacacagucugggg

SEQ ID NO: 459883 - RNA, 23 nt, Human
ugcuguccaacagacuggccaug

SEQ ID NO: 459884 - RNA, 22 nt, Human
cucaaggaaagucuggagaaga

SEQ ID NO: 459885 - RNA, 17 nt, Human
ccugucuuguuucugcc

SEQ ID NO: 459886 - RNA, 22 nt, Human
aauggcugccagggcaggaggu

SEQ ID NO: 459887 - RNA, 22 nt, Human
auguuauuaaaguacagauucu

SEQ ID NO: 459888 - RNA, 22 nt, Human
cauggcugcgagaagagugggu

SEQ ID NO: 459889 - RNA, 22 nt, Human
agaggcugagaaacccucuucu

SEQ ID NO: 459890 - RNA, 22 nt, Human
uagauuucaggcuggcuugcgg

SEQ ID NO: 459891 - RNA, 22 nt, Human
acuggcagagguuggacaccau

SEQ ID NO: 459892 - RNA, 22 nt, Human
gccuccugguugcuucuccaac

SEQ ID NO: 459893 - RNA, 22 nt, Human
cuggcucaauuuguacugcugu

SEQ ID NO: 459894 - RNA, 21 nt, Human
uggcucuguucaauauaugga

SEQ ID NO: 459895 - RNA, 22 nt, Human
guggggggacguuggucacuuu

SEQ ID NO: 459896 - RNA, 20 nt, Human
agugugcauuuagagucugc

SEQ ID NO: 459897 - RNA, 22 nt, Human
agagugguacuucuuuuucuuc

SEQ ID NO: 459898 - RNA, 22 nt, Human
aaacauugcuaaauaaugcugc

SEQ ID NO: 459899 - RNA, 22 nt, Human
gccucugcggagcuguacauca

SEQ ID NO: 459900 - RNA, 22 nt, Human
cuaaaauuaccuaccaguuuag

SEQ ID NO: 459901 - RNA, 22 nt, Human
gagagugucgggggccccagga

SEQ ID NO: 459902 - RNA, 22 nt, Human
ucagcccugggacccagggaug

SEQ ID NO: 459903 - RNA, 22 nt, Human
gcugugcuauaucucugagugu

SEQ ID NO: 459904 - RNA, 22 nt, Human
ugccuggcaaugccagaagcca

SEQ ID NO: 459905 - RNA, 22 nt, Human
auugaaagauaggcuacugugg

SEQ ID NO: 459906 - RNA, 22 nt, Human
gcaggcaguuugcuuuucccuc

SEQ ID NO: 459907 - RNA, 22 nt, Human
gagguauguaugcuacauucuu

SEQ ID NO: 459908 - RNA, 22 nt, Human
ggugaaggucuacugugugcca

SEQ ID NO: 459909 - RNA, 22 nt, Human
uauuucccagggagcaacaagc

SEQ ID NO: 459910 - RNA, 22 nt, Human
agggcagagcacugaauuggga

SEQ ID NO: 459911 - RNA, 22 nt, Human
agcuguggaguaggggguugga

SEQ ID NO: 459912 - RNA, 23 nt, Human
cauguacacacagcuguacagug

SEQ ID NO: 459913 - RNA, 22 nt, Human
uggaagugcucuucugaccaac

SEQ ID NO: 459914 - RNA, 22 nt, Human
gcagacaggcccaguggaggga

SEQ ID NO: 459915 - RNA, 20 nt, Human
cugcucugcuuugcaggugg

SEQ ID NO: 459916 - RNA, 22 nt, Human
uuagauauguuuuugcuaaugc

SEQ ID NO: 459917 - RNA, 22 nt, Human
uaaaugcagauuccugagccua

SEQ ID NO: 459918 - RNA, 22 nt, Human
ccaggccucaccugcccaccua

SEQ ID NO: 459919 - RNA, 22 nt, Human
accaggagccauagagucaggc

SEQ ID NO: 459920 - RNA, 22 nt, Human
gagcagcugguaggugaaccca

SEQ ID NO: 459921 - RNA, 17 nt, Human
acaggcagaucaccuga

SEQ ID NO: 459922 - RNA, 22 nt, Human
cugguacaaaaugcugauauca

SEQ ID NO: 459923 - RNA, 22 nt, Human
cuggacagaaaccaguccuggg

SEQ ID NO: 459924 - RNA, 22 nt, Human
cauggccucaaaggacugcaga

SEQ ID NO: 459925 - RNA, 22 nt, Human
cuggccuggggccucagcugcu

SEQ ID NO: 459926 - RNA, 22 nt, Human
acaguuugcccugacauucucc

SEQ ID NO: 459927 - RNA, 22 nt, Human
ugcacccucaucagucaaaugg

SEQ ID NO: 459928 - RNA, 22 nt, Human
uauccuuguacuauaguauuua

SEQ ID NO: 459929 - RNA, 22 nt, Human
ggccugugucugugccuguccu

SEQ ID NO: 459930 - RNA, 22 nt, Human
aaggcacucauucaaggagaua

SEQ ID NO: 459931 - RNA, 22 nt, Human
cugggcugagccugggcugugu

SEQ ID NO: 459932 - RNA, 22 nt, Human
uugaaaguuuauggagucugca

SEQ ID NO: 459933 - RNA, 22 nt, Human
ggucccagcuggucacugucag

SEQ ID NO: 459934 - RNA, 22 nt, Human
ggcaguggguuccccaaggcac

SEQ ID NO: 459935 - RNA, 22 nt, Human
gaaagguugggugaauggugga

SEQ ID NO: 459936 - RNA, 22 nt, Human
gcugucuggaggcucugaggga

SEQ ID NO: 459937 - RNA, 22 nt, Human
aggccuggccugggcggcauug

SEQ ID NO: 459938 - RNA, 22 nt, Human
uaguuauuauuguuacuaucag

SEQ ID NO: 459939 - RNA, 22 nt, Human
caguggauuagccagagcugga

SEQ ID NO: 459940 - RNA, 21 nt, Human
guggccugauuaugaaugggu

SEQ ID NO: 459941 - RNA, 22 nt, Human
accaggcagucaccguccagga

SEQ ID NO: 459942 - RNA, 22 nt, Human
cacagaggcaaccuucuggggu

SEQ ID NO: 459943 - RNA, 22 nt, Human
gagaagcagguuuagcagacaa

SEQ ID NO: 459944 - RNA, 22 nt, Human
uuuagaaauucaucuauggccu

SEQ ID NO: 459945 - RNA, 21 nt, Human
acagcagagaucaagacuaag

SEQ ID NO: 459946 - RNA, 22 nt, Human
uuuuuccaccguacuuccugag

SEQ ID NO: 459947 - RNA, 22 nt, Human
ucaaaggcaccaaggucacugc

SEQ ID NO: 459948 - RNA, 22 nt, Human
aaagauuuaugaaguucaauua

SEQ ID NO: 459949 - RNA, 22 nt, Human
gacagaguuguugauguaugcu

SEQ ID NO: 459950 - RNA, 22 nt, Human
uagucucuggagacucuagggg

SEQ ID NO: 459951 - RNA, 22 nt, Human
cagcucccuauggugaggcgac

SEQ ID NO: 459952 - RNA, 22 nt, Human
agaaauacuuuguaaaucucac

SEQ ID NO: 459953 - RNA, 22 nt, Human
ggcagcucugaugaugcucugg

SEQ ID NO: 459954 - RNA, 22 nt, Human
agggcugcuuugcuaaauaugg

SEQ ID NO: 459955 - RNA, 22 nt, Human
caguccugugucccuugguggg

SEQ ID NO: 459956 - RNA, 22 nt, Human
ugggcagaucuuugguggcuag

SEQ ID NO: 459957 - RNA, 22 nt, Human
gccucugcucucagguagccuc

SEQ ID NO: 459958 - RNA, 22 nt, Human
gguggggucacgacagagggaa

SEQ ID NO: 459959 - RNA, 22 nt, Human
uugcaccaaaugaguuaaaauu

SEQ ID NO: 459960 - RNA, 20 nt, Human
acauguacuaaugaauacag

SEQ ID NO: 459961 - RNA, 22 nt, Human
ugccaggcugucaauucaccca

SEQ ID NO: 459962 - RNA, 22 nt, Human
uccuugaagaaugauucuugga

SEQ ID NO: 459963 - RNA, 22 nt, Human
cuuauuagaaagaaaagacaug

SEQ ID NO: 459964 - RNA, 22 nt, Human
guguugaugacauuuuagaaac

SEQ ID NO: 459965 - RNA, 22 nt, Human
uagagcugggcagugcucugag

SEQ ID NO: 459966 - RNA, 22 nt, Human
gggaccugggccagaggacagu

SEQ ID NO: 459967 - RNA, 22 nt, Human
ugcaauaacuacuuuaauguug

SEQ ID NO: 459968 - RNA, 20 nt, Human
ugcagcugcaggaggguggg

SEQ ID NO: 459969 - RNA, 22 nt, Human
aggcucaggucucaggucuggc

SEQ ID NO: 459970 - RNA, 22 nt, Human
cccuguccuuggcugugaggcu

SEQ ID NO: 459971 - RNA, 22 nt, Human
aaugcugcucucauaauuauag

SEQ ID NO: 459972 - RNA, 22 nt, Human
gcauccagagguagccacugug

SEQ ID NO: 459973 - RNA, 22 nt, Human
gcaggaugggagcuucacuuug

SEQ ID NO: 459974 - RNA, 21 nt, Human
auccuugaucagaagagugcu

SEQ ID NO: 459975 - RNA, 22 nt, Human
aucaguuuuguucacuacuaua

SEQ ID NO: 459976 - RNA, 22 nt, Human
auucauucugaccucaagagaa

SEQ ID NO: 459977 - RNA, 22 nt, Human
guggggcaguggccugggagca

SEQ ID NO: 459978 - RNA, 18 nt, Human
gcucugcccaggcugccc

SEQ ID NO: 459979 - RNA, 22 nt, Human
guggauggauuuugaggaaugg

SEQ ID NO: 459980 - RNA, 22 nt, Human
gcugucacauuuggagcacugg

SEQ ID NO: 459981 - RNA, 22 nt, Human
agcugcccuggcggagcugcuc

SEQ ID NO: 459982 - RNA, 22 nt, Human
ucuauaaauuaugcagucucag

SEQ ID NO: 459983 - RNA, 22 nt, Human
ugugcuucugcagagacuauuu

SEQ ID NO: 459984 - RNA, 22 nt, Human
gcaggaguguggugggacaucc

SEQ ID NO: 459985 - RNA, 22 nt, Human
aaaagacaucuauuucaggcag

SEQ ID NO: 459986 - RNA, 21 nt, Human
ccagcuuucccaagucccuuu

SEQ ID NO: 459987 - RNA, 22 nt, Human
cuccuuccccuacucagcaucc

SEQ ID NO: 459988 - RNA, 22 nt, Human
gagagucuaggaaccucauaua

SEQ ID NO: 459989 - RNA, 22 nt, Human
gcaguggaagccucuuuaagca

SEQ ID NO: 459990 - RNA, 22 nt, Human
gcccaugcucucaggcgggccu

SEQ ID NO: 459991 - RNA, 22 nt, Human
agauaauuugaguaaauuaauu

SEQ ID NO: 459992 - RNA, 22 nt, Human
gaggacagugugaucugccagc

SEQ ID NO: 459993 - RNA, 22 nt, Human
ggcccacacugacagcugagcu

SEQ ID NO: 459994 - RNA, 22 nt, Human
ggagccagcagggugacacuga

SEQ ID NO: 459995 - RNA, 21 nt, Human
uugcaccaugauaaauucaga

SEQ ID NO: 459996 - RNA, 21 nt, Human
gcagccacagccaccaagcua

SEQ ID NO: 459997 - RNA, 22 nt, Human
uugauuaaacaggcauauucaa

SEQ ID NO: 459998 - RNA, 22 nt, Human
cuuauauuugucaacuuuacaa

SEQ ID NO: 459999 - RNA, 22 nt, Human
uccuuugguucucuaagaugcu

SEQ ID NO: 460000 - RNA, 22 nt, Human
augucacagucugacucaguga

SEQ ID NO: 460001 - RNA, 22 nt, Human
aaguggagcuauaggcucagau

SEQ ID NO: 460002 - RNA, 22 nt, Human
caggccucccggugcacacuga

SEQ ID NO: 460003 - RNA, 22 nt, Human
cuuucacagcugugcuuaugau

SEQ ID NO: 460004 - RNA, 22 nt, Human
uuuauguaauuucauaggugug

SEQ ID NO: 460005 - RNA, 22 nt, Human
gaaggagagggucaaggauaau

SEQ ID NO: 460006 - RNA, 22 nt, Human
gcauuccuacaggcugcuauga

SEQ ID NO: 460007 - RNA, 22 nt, Human
gucccaggcagagucaggaggg

SEQ ID NO: 460008 - RNA, 22 nt, Human
ccagcuggucugugcucauguu

SEQ ID NO: 460009 - RNA, 22 nt, Human
agcagggcuuugcagacuuggg

SEQ ID NO: 460010 - RNA, 22 nt, Human
cccuguacagucucuguggcac

SEQ ID NO: 460011 - RNA, 22 nt, Human
agucucugggcaugguugugac

SEQ ID NO: 460012 - RNA, 22 nt, Human
gcuuggaaguaggauugggaga

SEQ ID NO: 460013 - RNA, 22 nt, Human
agcugaagaaaugggaagcauu

SEQ ID NO: 460014 - RNA, 22 nt, Human
ugauugacuuuagaauagcacu

SEQ ID NO: 460015 - RNA, 22 nt, Human
gcuggcuccucuguccucacgg

SEQ ID NO: 460016 - RNA, 22 nt, Human
gccuggagaggaagccggugga

SEQ ID NO: 460017 - RNA, 22 nt, Human
uagcaguggaaucuuuugucca

SEQ ID NO: 460018 - RNA, 22 nt, Human
uucuuguauauaaaaaucauuu

SEQ ID NO: 460019 - RNA, 23 nt, Human
ugcagcugccucuggcgggccgg

SEQ ID NO: 460020 - RNA, 22 nt, Human
cucaggauagauuguccucuca

SEQ ID NO: 460021 - RNA, 22 nt, Human
auggacagugugucuguuucca

SEQ ID NO: 460022 - RNA, 23 nt, Human
aucaaaguggaaaucaauuaucu

SEQ ID NO: 460023 - RNA, 22 nt, Human
ucagagaguuuucacuagggug

SEQ ID NO: 460024 - RNA, 21 nt, Human
agcuuguguguaucacagugu

SEQ ID NO: 460025 - RNA, 22 nt, Human
ucagugcagaauagugaugcau

SEQ ID NO: 460026 - RNA, 22 nt, Human
ggcucacgcaauuaucccggcc

SEQ ID NO: 460027 - RNA, 22 nt, Human
aaugaaugaaccacauauaaca

SEQ ID NO: 460028 - RNA, 22 nt, Human
auccugggaagcugacauugaa

SEQ ID NO: 460029 - RNA, 20 nt, Human
cccuggagagaagcuccacg

SEQ ID NO: 460030 - RNA, 22 nt, Human
agaagccaugguaugcaacuac

SEQ ID NO: 460031 - RNA, 22 nt, Human
aaggcuuuuguuccuauuuagu

SEQ ID NO: 460032 - RNA, 22 nt, Human
gucaccagcaccaaugccacau

SEQ ID NO: 460033 - RNA, 22 nt, Human
gagaaagauguaggcugggagg

SEQ ID NO: 460034 - RNA, 22 nt, Human
gaaaguauuuaaguccauauuu

SEQ ID NO: 460035 - RNA, 19 nt, Human
ccuggcccugcugcgcggg

SEQ ID NO: 460036 - RNA, 22 nt, Human
agggccaguaccaggugggugg

SEQ ID NO: 460037 - RNA, 22 nt, Human
aggcuggguaccugucauaugc

SEQ ID NO: 460038 - RNA, 22 nt, Human
ugaaagguguccaauauuucuc

SEQ ID NO: 460039 - RNA, 22 nt, Human
cuccuuccugguuagcaccuua

SEQ ID NO: 460040 - RNA, 22 nt, Human
augaguaaaaccacuauuuaca

SEQ ID NO: 460041 - RNA, 17 nt, Human
uugggagagaaagguau

SEQ ID NO: 460042 - RNA, 22 nt, Human
auuccaaaaggauguuagaaug

SEQ ID NO: 460043 - RNA, 23 nt, Human
ccagggccccuacaccacugucc

SEQ ID NO: 460044 - RNA, 22 nt, Human
ggcugcugguagggguaggaag

SEQ ID NO: 460045 - RNA, 19 nt, Human
aggacucuggaggcaugag

SEQ ID NO: 460046 - RNA, 15 nt, Human
ugggcagaucacuug

SEQ ID NO: 460047 - RNA, 22 nt, Human
acuguccaagcaugccuggcuu

SEQ ID NO: 460048 - RNA, 22 nt, Human
agcucacaguguccuuccucaa

SEQ ID NO: 460049 - RNA, 21 nt, Human
agggagcuauuuauaguaagc

SEQ ID NO: 460050 - RNA, 22 nt, Human
ugccagccagguucugaggcua

SEQ ID NO: 460051 - RNA, 22 nt, Human
caguguggugugcacagcuuag

SEQ ID NO: 460052 - RNA, 22 nt, Human
aaagccagggacagugugcaug

SEQ ID NO: 460053 - RNA, 20 nt, Human
uauuuguauuugggaaaguu

SEQ ID NO: 460054 - RNA, 22 nt, Human
uggaggcaacugaagauguagu

SEQ ID NO: 460055 - RNA, 21 nt, Human
agagcugggacuugccugaga

SEQ ID NO: 460056 - RNA, 22 nt, Human
uagaaaguaaaucaguuuuauu

SEQ ID NO: 460057 - RNA, 22 nt, Human
aggcccaguccucugccgucug

SEQ ID NO: 460058 - RNA, 22 nt, Human
cagggccagcgucucgggcuau

SEQ ID NO: 460059 - RNA, 22 nt, Human
uccuuuuuauaguuagagaaac

SEQ ID NO: 460060 - RNA, 22 nt, Human
uccaggaggugaggggaccaaa

SEQ ID NO: 460061 - RNA, 22 nt, Human
cagggcugaaaucaagguguag

SEQ ID NO: 460062 - RNA, 22 nt, Human
caagaugaaacuacagggagga

SEQ ID NO: 460063 - RNA, 22 nt, Human
ucacacagguuugcaaugauuu

SEQ ID NO: 460064 - RNA, 22 nt, Human
gagagcuggauucuggauaggu

SEQ ID NO: 460065 - RNA, 22 nt, Human
ucacaggcuugugaacauugca

SEQ ID NO: 460066 - RNA, 16 nt, Human
agcagccagcacugga

SEQ ID NO: 460067 - RNA, 22 nt, Human
ccuccacaggagcugcagugcu

SEQ ID NO: 460068 - RNA, 19 nt, Human
aguagcagaaagugcagug

SEQ ID NO: 460069 - RNA, 20 nt, Human
acaggggcagcacaauaaug

SEQ ID NO: 460070 - RNA, 19 nt, Human
ugcauaaauuauauacuuu

SEQ ID NO: 460071 - RNA, 18 nt, Human
ggagagugacagagucgu

SEQ ID NO: 460072 - RNA, 22 nt, Human
caguggcgugaucucugcucac

SEQ ID NO: 460073 - RNA, 22 nt, Human
caagggaguuacugagggcggg

SEQ ID NO: 460074 - RNA, 22 nt, Human
gccaguggcaugcggcagggac

SEQ ID NO: 460075 - RNA, 22 nt, Human
ccugggcagugcuggaguugaa

SEQ ID NO: 460076 - RNA, 22 nt, Human
ucaagagacaggacguguuuca

SEQ ID NO: 460077 - RNA, 22 nt, Human
agaagccacaggccucgucugg

SEQ ID NO: 460078 - RNA, 22 nt, Human
uuuaaucaggcaaagcauaaua

SEQ ID NO: 460079 - RNA, 22 nt, Human
gccuuggcugaugugcgaauga

SEQ ID NO: 460080 - RNA, 23 nt, Human
uggcagugaucaaaagcuuacau

SEQ ID NO: 460081 - RNA, 22 nt, Human
uagaaacucaggauacucuucc

SEQ ID NO: 460082 - RNA, 22 nt, Human
ccaaagagcuagaauuauaggc

SEQ ID NO: 460083 - RNA, 22 nt, Human
gugugccagacaugaugcuaug

SEQ ID NO: 460084 - RNA, 22 nt, Human
uuaugggagcaauuggggaggu

SEQ ID NO: 460085 - RNA, 22 nt, Human
acugucucucuagcaguucagg

SEQ ID NO: 460086 - RNA, 22 nt, Human
cuggccagguuuugaacaguug

SEQ ID NO: 460087 - RNA, 22 nt, Human
ggggcucaguucggacagccug

SEQ ID NO: 460088 - RNA, 21 nt, Human
aggcagccagucaugcucccu

SEQ ID NO: 460089 - RNA, 21 nt, Human
cuccugggcuaagauauagug

SEQ ID NO: 460090 - RNA, 22 nt, Human
gaaggccacggaauggagcugg

SEQ ID NO: 460091 - RNA, 22 nt, Human
uuacucagucucccauacauug

SEQ ID NO: 460092 - RNA, 22 nt, Human
ugcugucugauucagggugauu

SEQ ID NO: 460093 - RNA, 22 nt, Human
ugguacuuggaggcagaaaaau

SEQ ID NO: 460094 - RNA, 22 nt, Human
agccucugugacucacagguca

SEQ ID NO: 460095 - RNA, 22 nt, Human
agaagcaguuauuuuuugcaca

SEQ ID NO: 460096 - RNA, 22 nt, Human
acccaggcugcuucucaguggc

SEQ ID NO: 460097 - RNA, 22 nt, Human
agcuggccuccgggugccuggg

SEQ ID NO: 460098 - RNA, 19 nt, Human
aggcagcaggccagggaug

SEQ ID NO: 460099 - RNA, 22 nt, Human
accacugcccauggugaaaacu

SEQ ID NO: 460100 - RNA, 22 nt, Human
ggcucaggacacagugguuuag

SEQ ID NO: 460101 - RNA, 22 nt, Human
ggagaagccacacauugggugu

SEQ ID NO: 460102 - RNA, 22 nt, Human
ugaaaugcuguagagacuguau

SEQ ID NO: 460103 - RNA, 22 nt, Human
ugcucugucaagaaaagaugcc

SEQ ID NO: 460104 - RNA, 18 nt, Human
ugagaggcuauuuuuugc

SEQ ID NO: 460105 - RNA, 22 nt, Human
ggaggcccagagaggugaagug

SEQ ID NO: 460106 - RNA, 22 nt, Human
ugcaauaaagugcuauaaaucc

SEQ ID NO: 460107 - RNA, 22 nt, Human
cagggcucacucggcuggcguc

SEQ ID NO: 460108 - RNA, 22 nt, Human
cacagcugcacagaggaggugc

SEQ ID NO: 460109 - RNA, 22 nt, Human
ugugcccauuccacuugaguac

SEQ ID NO: 460110 - RNA, 22 nt, Human
gcagaggaggacccaggaauua

SEQ ID NO: 460111 - RNA, 22 nt, Human
uuccagggcuaauuccugugga

SEQ ID NO: 460112 - RNA, 22 nt, Human
aagauuuaccacuuuauucaag

SEQ ID NO: 460113 - RNA, 22 nt, Human
ggcugcagcagagggacucacg

SEQ ID NO: 460114 - RNA, 20 nt, Human
augugagggguugaaguggg

SEQ ID NO: 460115 - RNA, 22 nt, Human
acaggcagggaccuuggcuaag

SEQ ID NO: 460116 - RNA, 22 nt, Human
uuuccuaagguagugauaauuu

SEQ ID NO: 460117 - RNA, 21 nt, Human
gugguuauuuucauuagcauc

SEQ ID NO: 460118 - RNA, 22 nt, Human
gugccugugccaggggugugcu

SEQ ID NO: 460119 - RNA, 22 nt, Human
cuggagccacugggucuuguau

SEQ ID NO: 460120 - RNA, 22 nt, Human
aggggagccccugguccuggug

SEQ ID NO: 460121 - RNA, 22 nt, Human
gcagcccaaaaaagagguagau

SEQ ID NO: 460122 - RNA, 22 nt, Human
gcugagcugggacaguccuggg

SEQ ID NO: 460123 - RNA, 22 nt, Human
aucagucuguguuagaaaagag

SEQ ID NO: 460124 - RNA, 22 nt, Human
caggaggaggugagguagaacu

SEQ ID NO: 460125 - RNA, 22 nt, Human
agcuggagcuucaagcagguaa

SEQ ID NO: 460126 - RNA, 22 nt, Human
ccucacugcuauguguuugcuc

SEQ ID NO: 460127 - RNA, 22 nt, Human
ucugccagugguuuggcccuga

SEQ ID NO: 460128 - RNA, 22 nt, Human
uuucagauuaucucaacuuugg

SEQ ID NO: 460129 - RNA, 22 nt, Human
cagcaguggccaucuguguggu

SEQ ID NO: 460130 - RNA, 22 nt, Human
guccucugacucagccuuggga

SEQ ID NO: 460131 - RNA, 22 nt, Human
guuugcauuccaauuuagggga

SEQ ID NO: 460132 - RNA, 22 nt, Human
cagccaggcccccgagucguug

SEQ ID NO: 460133 - RNA, 22 nt, Human
acccagcuaacccuacccugga

SEQ ID NO: 460134 - RNA, 19 nt, Human
acaagggcaggcaagguga

SEQ ID NO: 460135 - RNA, 22 nt, Human
agggcuggaggguacuaguuua

SEQ ID NO: 460136 - RNA, 22 nt, Human
uggcagggccugaaucuuauac

SEQ ID NO: 460137 - RNA, 22 nt, Human
ugggcucugcaucagugcccau

SEQ ID NO: 460138 - RNA, 22 nt, Human
caggaggcaguuucagaaguca

SEQ ID NO: 460139 - RNA, 22 nt, Human
ccagccacagcuuccagcuccu

SEQ ID NO: 460140 - RNA, 22 nt, Human
aggcugaggugugcugugaucg

SEQ ID NO: 460141 - RNA, 22 nt, Human
cugugcaguaggucagggcugg

SEQ ID NO: 460142 - RNA, 22 nt, Human
gugcagcugugugagagcucca

SEQ ID NO: 460143 - RNA, 22 nt, Human
ccaggcagggcucaaggaaccu

SEQ ID NO: 460144 - RNA, 17 nt, Human
cuggagccaagagggcc

SEQ ID NO: 460145 - RNA, 22 nt, Human
aagggcuccauccuuauaaaug

SEQ ID NO: 460146 - RNA, 22 nt, Human
ucuacuuuucccuauacaguuu

SEQ ID NO: 460147 - RNA, 21 nt, Human
guuuuaagggagaaaaccuag

SEQ ID NO: 460148 - RNA, 21 nt, Human
acaugucucuaaucucaguga

SEQ ID NO: 460149 - RNA, 22 nt, Human
uggagagcgugcuuagcacucu

SEQ ID NO: 460150 - RNA, 22 nt, Human
ccugagagcgaguggccucaug

SEQ ID NO: 460151 - RNA, 22 nt, Human
ggcauauguagcguguguucug

SEQ ID NO: 460152 - RNA, 22 nt, Human
auccaaagauggaaagaacuuu

SEQ ID NO: 460153 - RNA, 22 nt, Human
gcuguucucuguaacaugcauu

SEQ ID NO: 460154 - RNA, 22 nt, Human
ugcaucuguucagagcugucga

SEQ ID NO: 460155 - RNA, 22 nt, Human
gcagggcacacaagaaugauaa

SEQ ID NO: 460156 - RNA, 21 nt, Human
gcagccagccgagaccaugcc

SEQ ID NO: 460157 - RNA, 22 nt, Human
guccagagauggacgagcagau

SEQ ID NO: 460158 - RNA, 22 nt, Human
ucugagggcuugaggggaagua

SEQ ID NO: 460159 - RNA, 22 nt, Human
gugggggcaggcagugcuagga

SEQ ID NO: 460160 - RNA, 22 nt, Human
ggaugcaggaguugaagaagga

SEQ ID NO: 460161 - RNA, 22 nt, Human
gcagaggacagggauuuagauu

SEQ ID NO: 460162 - RNA, 22 nt, Human
ucccagggacucucugccuucc

SEQ ID NO: 460163 - RNA, 22 nt, Human
uccuguggaagacaguguuggg

SEQ ID NO: 460164 - RNA, 22 nt, Human
ucucaggacuuugggaagcuca

SEQ ID NO: 460165 - RNA, 22 nt, Human
gcucucuggaggccauggacag

SEQ ID NO: 460166 - RNA, 22 nt, Human
gcucccugccuacacggaccuu

SEQ ID NO: 460167 - RNA, 19 nt, Human
ccagucccauacaggagau

SEQ ID NO: 460168 - RNA, 22 nt, Human
uggacagguuugggugccuguu

SEQ ID NO: 460169 - RNA, 22 nt, Human
ugccacagaggugaagcccacu

SEQ ID NO: 460170 - RNA, 22 nt, Human
auguuuauguugggcuauauuu

SEQ ID NO: 460171 - RNA, 22 nt, Human
ugggguggauagaaagugaugu

SEQ ID NO: 460172 - RNA, 22 nt, Human
aggcacugagaggcuguguugc

SEQ ID NO: 460173 - RNA, 22 nt, Human
agggaaaguaagcauuucauua

SEQ ID NO: 460174 - RNA, 22 nt, Human
uggaggcauuuuagguugucac

SEQ ID NO: 460175 - RNA, 22 nt, Human
ugccagcaguagcaguaggcca

SEQ ID NO: 460176 - RNA, 22 nt, Human
ucuuccucuagaucugaggccc

SEQ ID NO: 460177 - RNA, 22 nt, Human
gcucucugggugugucuagaua

SEQ ID NO: 460178 - RNA, 22 nt, Human
gaauacaagccugccaccugga

SEQ ID NO: 460179 - RNA, 22 nt, Human
ggacagaggguugacagaguau

SEQ ID NO: 460180 - RNA, 19 nt, Human
cugggagguguucagagaa

SEQ ID NO: 460181 - RNA, 22 nt, Human
agccuguggaucccugcacugg

SEQ ID NO: 460182 - RNA, 22 nt, Human
ugcauuguugaauauuucauag

SEQ ID NO: 460183 - RNA, 22 nt, Human
gcagcaaucuucacagugucau

SEQ ID NO: 460184 - RNA, 19 nt, Human
cagugcccgacgcaggucu

SEQ ID NO: 460185 - RNA, 21 nt, Human
cuguuucuugugaagugacac

SEQ ID NO: 460186 - RNA, 22 nt, Human
agcagccacccagcugcucauu

SEQ ID NO: 460187 - RNA, 22 nt, Human
aagugaguggccuggagaggug

SEQ ID NO: 460188 - RNA, 22 nt, Human
gagcucuggcagggcaggucug

SEQ ID NO: 460189 - RNA, 22 nt, Human
cgugucaucugagccuugggcg

SEQ ID NO: 460190 - RNA, 22 nt, Human
aggcagcagggccacuggcuga

SEQ ID NO: 460191 - RNA, 22 nt, Human
gaaaucugaaucuucuguuggu

SEQ ID NO: 460192 - RNA, 23 nt, Human
agcccagcagagaaccuaggucc

SEQ ID NO: 460193 - RNA, 22 nt, Human
gcuggccagggcugcucgcgga

SEQ ID NO: 460194 - RNA, 22 nt, Human
uuguacaaguauuaugugaaca

SEQ ID NO: 460195 - RNA, 22 nt, Human
uguguauuaccauuuuacagcu

SEQ ID NO: 460196 - RNA, 21 nt, Human
ucagggcagugggagguuccu

SEQ ID NO: 460197 - RNA, 23 nt, Human
cccagaccuugugcugcccuugg

SEQ ID NO: 460198 - RNA, 19 nt, Human
ugggccugcaucugggucu

SEQ ID NO: 460199 - RNA, 22 nt, Human
cuggcuggccggaggcaucccu

SEQ ID NO: 460200 - RNA, 22 nt, Human
gacccaggguuucugcacaggg

SEQ ID NO: 460201 - RNA, 22 nt, Human
agcugccacagagccuggccag

SEQ ID NO: 460202 - RNA, 22 nt, Human
acaaggcugaacagugaagccg

SEQ ID NO: 460203 - RNA, 22 nt, Human
cugacucuccucaagcauaaau

SEQ ID NO: 460204 - RNA, 22 nt, Human
ugauuucuuccuugucauuaga

SEQ ID NO: 460205 - RNA, 22 nt, Human
aaggccagaguacuagaggcug

SEQ ID NO: 460206 - RNA, 22 nt, Human
agacagagauacuauguuguca

SEQ ID NO: 460207 - RNA, 22 nt, Human
ccugguguugugaaguagccgu

SEQ ID NO: 460208 - RNA, 22 nt, Human
agcgugaaggcgggcagucggc

SEQ ID NO: 460209 - RNA, 22 nt, Human
caguuucugggcguucacaggu

SEQ ID NO: 460210 - RNA, 19 nt, Human
guugaaaguaggugagggu

SEQ ID NO: 460211 - RNA, 22 nt, Human
uucaggauggcggauguugggg

SEQ ID NO: 460212 - RNA, 22 nt, Human
uggcaagagggaugcaagguuu

SEQ ID NO: 460213 - RNA, 22 nt, Human
uagaaauccccagucucauagu

SEQ ID NO: 460214 - RNA, 22 nt, Human
ugaggcaggacuugcauaaagu

SEQ ID NO: 460215 - RNA, 22 nt, Human
ugccaggcucaggaugucccug

SEQ ID NO: 460216 - RNA, 16 nt, Human
gagggcagaggcggaa

SEQ ID NO: 460217 - RNA, 22 nt, Human
cggcuggguucggcugcaggcc

SEQ ID NO: 460218 - RNA, 22 nt, Human
cauguuuucuaggcuuucacaa

SEQ ID NO: 460219 - RNA, 22 nt, Human
uccuuucaccaaaaaguguugu

SEQ ID NO: 460220 - RNA, 22 nt, Human
cuggggcuggugaggcaggcuc

SEQ ID NO: 460221 - RNA, 22 nt, Human
gccugagauucugcauuucuaa

SEQ ID NO: 460222 - RNA, 22 nt, Human
uuuuaucugcuucauuaguuga

SEQ ID NO: 460223 - RNA, 22 nt, Human
gcugggcaccggagagacccca

SEQ ID NO: 460224 - RNA, 22 nt, Human
ucacacacauuugcugucugau

SEQ ID NO: 460225 - RNA, 22 nt, Human
ugcuuuauagacaaggaaguag

SEQ ID NO: 460226 - RNA, 22 nt, Human
aggcacugaccugcuuccuuga

SEQ ID NO: 460227 - RNA, 22 nt, Human
uacaguaaccagucuacuuaga

SEQ ID NO: 460228 - RNA, 22 nt, Human
agugcuccuauggaucaguugu

SEQ ID NO: 460229 - RNA, 22 nt, Human
aggcacuguacuagguacaggg

SEQ ID NO: 460230 - RNA, 22 nt, Human
uuauguacaauguuaauguaaa

SEQ ID NO: 460231 - RNA, 19 nt, Human
uaaggccaaaaguaagugu

SEQ ID NO: 460232 - RNA, 22 nt, Human
caccagguuccgggcagagcug

SEQ ID NO: 460233 - RNA, 22 nt, Human
uaaguaaauuuauaaugugauu

SEQ ID NO: 460234 - RNA, 20 nt, Human
gcagcugcccccagucccug

SEQ ID NO: 460235 - RNA, 20 nt, Human
aggcagacaaggagucuguu

SEQ ID NO: 460236 - RNA, 23 nt, Human
ugucacauuuaguuggcauuguu

SEQ ID NO: 460237 - RNA, 22 nt, Human
cugcuggagguuggagcaugca

SEQ ID NO: 460238 - RNA, 22 nt, Human
gucuggaguggggccugagaau

SEQ ID NO: 460239 - RNA, 22 nt, Human
uguuuaaucuauaaaauggaga

SEQ ID NO: 460240 - RNA, 22 nt, Human
cucuggagguggagguugcagu

SEQ ID NO: 460241 - RNA, 22 nt, Human
uucaggaucaaguugccaguag

SEQ ID NO: 460242 - RNA, 22 nt, Human
cauugaaauauggaaacugaug

SEQ ID NO: 460243 - RNA, 22 nt, Human
ucaagaaagggcuucaccagga

SEQ ID NO: 460244 - RNA, 17 nt, Human
ucugggcuucagugguc

SEQ ID NO: 460245 - RNA, 21 nt, Human
ccaaaggcuauguaucuucug

SEQ ID NO: 460246 - RNA, 22 nt, Human
uucuaccuacccucugcauaca

SEQ ID NO: 460247 - RNA, 22 nt, Human
gaggcaggcacuguuaucagca

SEQ ID NO: 460248 - RNA, 22 nt, Human
gaggaggcacuugagcagaugu

SEQ ID NO: 460249 - RNA, 22 nt, Human
cuuacaaaggagaggagauagg

SEQ ID NO: 460250 - RNA, 22 nt, Human
acagauauaaacuauaguagug

SEQ ID NO: 460251 - RNA, 22 nt, Human
guguuuggucagacguccgggg

SEQ ID NO: 460252 - RNA, 22 nt, Human
agagccagccuucucagcuuac

SEQ ID NO: 460253 - RNA, 22 nt, Human
uaauaucuacuucauagaguuu

SEQ ID NO: 460254 - RNA, 22 nt, Human
aaaaugcaugagaaugugcucg

SEQ ID NO: 460255 - RNA, 22 nt, Human
auacaucuugucagauucaugu

SEQ ID NO: 460256 - RNA, 22 nt, Human
aaugaacaggugaaugucagau

SEQ ID NO: 460257 - RNA, 22 nt, Human
cugugcaagacuuacuuuaaua

SEQ ID NO: 460258 - RNA, 22 nt, Human
ucaaaggcccauugucccguug

SEQ ID NO: 460259 - RNA, 22 nt, Human
cugggcugcagcgggagcgacg

SEQ ID NO: 460260 - RNA, 22 nt, Human
ccaggaagccucagaugcugag

SEQ ID NO: 460261 - RNA, 22 nt, Human
gcucccacugcagcccugagcc

SEQ ID NO: 460262 - RNA, 22 nt, Human
ugaggcucaagaaucugcauuu

SEQ ID NO: 460263 - RNA, 22 nt, Human
ugcugccuccaacuccugggcu

SEQ ID NO: 460264 - RNA, 20 nt, Human
uccuuuggccuuagagcugu

SEQ ID NO: 460265 - RNA, 17 nt, Human
gaauuucuuggucaaaa

SEQ ID NO: 460266 - RNA, 22 nt, Human
ucuggcucugacacuacuguua

SEQ ID NO: 460267 - RNA, 16 nt, Human
agccaggcugccucgg

SEQ ID NO: 460268 - RNA, 22 nt, Human
gcagugggaagguuggcacaug

SEQ ID NO: 460269 - RNA, 22 nt, Human
aacugcauuugcauaaguccau

SEQ ID NO: 460270 - RNA, 22 nt, Human
cagcucccaguggcagcuccuu

SEQ ID NO: 460271 - RNA, 22 nt, Human
ucagaaauuuucucaguaguuc

SEQ ID NO: 460272 - RNA, 22 nt, Human
gugaggcagagaugccaaaacu

SEQ ID NO: 460273 - RNA, 22 nt, Human
uaaggccaaguucauauacaac

SEQ ID NO: 460274 - RNA, 22 nt, Human
aaaucaaaagacauguguuuua

SEQ ID NO: 460275 - RNA, 22 nt, Human
uuauucuucuucucuugccagg

SEQ ID NO: 460276 - RNA, 18 nt, Human
gcugcugguggagggagc

SEQ ID NO: 460277 - RNA, 22 nt, Human
gggcugagucugcugccuguca

SEQ ID NO: 460278 - RNA, 22 nt, Human
agcagcaggagccgugggguga

SEQ ID NO: 460279 - RNA, 22 nt, Human
aaauuauuaugccccucuauaa

SEQ ID NO: 460280 - RNA, 22 nt, Human
gggcucuggauggagccugcag

SEQ ID NO: 460281 - RNA, 22 nt, Human
ucucccacuggccuuguaugau

SEQ ID NO: 460282 - RNA, 22 nt, Human
ccuccugguccagcaucucuuu

SEQ ID NO: 460283 - RNA, 22 nt, Human
cagugggaagggcagaggcuuu

SEQ ID NO: 460284 - RNA, 22 nt, Human
aggcacugauucuguuuuccau

SEQ ID NO: 460285 - RNA, 22 nt, Human
ggcagaggagcuggaaacaugg

SEQ ID NO: 460286 - RNA, 21 nt, Human
agcagaggcagaauguaugca

SEQ ID NO: 460287 - RNA, 18 nt, Human
cagaugagaugcaaucuc

SEQ ID NO: 460288 - RNA, 22 nt, Human
uccuggccgccgcguggggccg

SEQ ID NO: 460289 - RNA, 22 nt, Human
auccacccugugguggcuuucu

SEQ ID NO: 460290 - RNA, 22 nt, Human
guuuggggucugcagagcggcg

SEQ ID NO: 460291 - RNA, 22 nt, Human
aagcugccuugcugaggagaaa

SEQ ID NO: 460292 - RNA, 22 nt, Human
gggagcugaauggcaauggaga

SEQ ID NO: 460293 - RNA, 22 nt, Human
cugagccagcuggcaugugcua

SEQ ID NO: 460294 - RNA, 19 nt, Human
agggagaauuccaagagga

SEQ ID NO: 460295 - RNA, 20 nt, Human
aggaaaaggguggugguaga

SEQ ID NO: 460296 - RNA, 22 nt, Human
auacaaguugugauaauguaaa

SEQ ID NO: 460297 - RNA, 22 nt, Human
cucccagggccaucgagucacu

SEQ ID NO: 460298 - RNA, 22 nt, Human
agauuugcggcuuuacuuugca

SEQ ID NO: 460299 - RNA, 22 nt, Human
ucuuucucucuaaucaagcaca

SEQ ID NO: 460300 - RNA, 22 nt, Human
acugcuuuagaccuagagcucu

SEQ ID NO: 460301 - RNA, 22 nt, Human
ugaggcagugauguuuaagcac

SEQ ID NO: 460302 - RNA, 22 nt, Human
cuguagcagugugcucuuuuuc

SEQ ID NO: 460303 - RNA, 22 nt, Human
aagcugccauagaacgagaggu

SEQ ID NO: 460304 - RNA, 22 nt, Human
gcuaggagauugagcucugaag

SEQ ID NO: 460305 - RNA, 21 nt, Human
uauuucuuugacucucucccu

SEQ ID NO: 460306 - RNA, 21 nt, Human
aacaaagggaugcucaucuuu

SEQ ID NO: 460307 - RNA, 22 nt, Human
ugaggcucaagaaagauuuguu

SEQ ID NO: 460308 - RNA, 22 nt, Human
caggcaggucagugaagaagga

SEQ ID NO: 460309 - RNA, 23 nt, Human
cgcccagccucagugaccugggc

SEQ ID NO: 460310 - RNA, 22 nt, Human
auuugcagagcucugaauuuug

SEQ ID NO: 460311 - RNA, 22 nt, Human
gagucugagucuaauggcccca

SEQ ID NO: 460312 - RNA, 22 nt, Human
uugcugaaaacaguggguauug

SEQ ID NO: 460313 - RNA, 18 nt, Human
ucagaggagauaccuaaa

SEQ ID NO: 460314 - RNA, 22 nt, Human
ggcacugagaacaggcugacuu

SEQ ID NO: 460315 - RNA, 22 nt, Human
gggaagggacuuguuuaagguc

SEQ ID NO: 460316 - RNA, 22 nt, Human
cagccccucacagagcuguccu

SEQ ID NO: 460317 - RNA, 19 nt, Human
acaaacugaguacacuugu

SEQ ID NO: 460318 - RNA, 22 nt, Human
ggaggccaaggcagguggaucg

SEQ ID NO: 460319 - RNA, 22 nt, Human
gucaggauuauuuuauuaaaag

SEQ ID NO: 460320 - RNA, 23 nt, Human
uugugggcagauuccauggggag

SEQ ID NO: 460321 - RNA, 22 nt, Human
ugaggcaggaggauugcaggau

SEQ ID NO: 460322 - RNA, 22 nt, Human
agaugaagacucaggagcaggu

SEQ ID NO: 460323 - RNA, 22 nt, Human
ugagaagcugcugacuuagccu

SEQ ID NO: 460324 - RNA, 22 nt, Human
gaaaugugggucaugacccauu

SEQ ID NO: 460325 - RNA, 22 nt, Human
gaagggugcauggagggaaguc

SEQ ID NO: 460326 - RNA, 22 nt, Human
aaggcacugcuuugcugcgccc

SEQ ID NO: 460327 - RNA, 22 nt, Human
gcagcuggacccacacggcuua

SEQ ID NO: 460328 - RNA, 22 nt, Human
gaggcugggaaguccaagauca

SEQ ID NO: 460329 - RNA, 22 nt, Human
gagcagcugagcuggaaugaga

SEQ ID NO: 460330 - RNA, 21 nt, Human
uucaaugaaaacaaagugagg

SEQ ID NO: 460331 - RNA, 22 nt, Human
ugaggcagauauuuauuggguu

SEQ ID NO: 460332 - RNA, 22 nt, Human
ggcagaggaggggugaauuugc

SEQ ID NO: 460333 - RNA, 22 nt, Human
caccagcagaagacugagggug

SEQ ID NO: 460334 - RNA, 22 nt, Human
agaaagcuuaugaaugggcaag

SEQ ID NO: 460335 - RNA, 22 nt, Human
ccagggucucugcugccugaga

SEQ ID NO: 460336 - RNA, 22 nt, Human
gcucugcugaagccccuugcau

SEQ ID NO: 460337 - RNA, 22 nt, Human
uuuccuuccagguuccuaaggc

SEQ ID NO: 460338 - RNA, 22 nt, Human
agagccaggacugugucucacu

SEQ ID NO: 460339 - RNA, 22 nt, Human
gcccucugcacagcucugagca

SEQ ID NO: 460340 - RNA, 22 nt, Human
gagccaggcccguacuugcugu

SEQ ID NO: 460341 - RNA, 20 nt, Human
caccaggcgcucugagaaca

SEQ ID NO: 460342 - RNA, 22 nt, Human
gccugcagccccucugcaguag

SEQ ID NO: 460343 - RNA, 22 nt, Human
aaaaccaggcguuuccuauuau

SEQ ID NO: 460344 - RNA, 22 nt, Human
acuuucuccagaaaaccaagga

SEQ ID NO: 460345 - RNA, 22 nt, Human
uccuccaggucuaggguggcuu

SEQ ID NO: 460346 - RNA, 22 nt, Human
cuuagaaaugcagauucucagg

SEQ ID NO: 460347 - RNA, 22 nt, Human
accaucuuaguggccagcucuc

SEQ ID NO: 460348 - RNA, 22 nt, Human
cagggagaaaucuccaggaggu

SEQ ID NO: 460349 - RNA, 22 nt, Human
gacagcagacagaacuaccugc

SEQ ID NO: 460350 - RNA, 22 nt, Human
ugcuccagugagcuggccaucc

SEQ ID NO: 460351 - RNA, 17 nt, Human
ggugaguguccaggugg

SEQ ID NO: 460352 - RNA, 22 nt, Human
gaagagcuuagacagaaucaaa

SEQ ID NO: 460353 - RNA, 22 nt, Human
guccucaggaaagcagauaaca

SEQ ID NO: 460354 - RNA, 22 nt, Human
ucuguaaucaagauauuugaga

SEQ ID NO: 460355 - RNA, 22 nt, Human
agagccaggaucuguuuugggg

SEQ ID NO: 460356 - RNA, 22 nt, Human
gcugggagcaaguacucaucuu

SEQ ID NO: 460357 - RNA, 16 nt, Human
ccacagggcaaggggc

SEQ ID NO: 460358 - RNA, 21 nt, Human
agggccugugcucuccagguc

SEQ ID NO: 460359 - RNA, 22 nt, Human
uuacauuuugggguaaggauaa

SEQ ID NO: 460360 - RNA, 22 nt, Human
ggcagaagauaggacagggaau

SEQ ID NO: 460361 - RNA, 22 nt, Human
cugugcuugcggguguggagcc

SEQ ID NO: 460362 - RNA, 22 nt, Human
aggcugaggcaagaggaucacu

SEQ ID NO: 460363 - RNA, 22 nt, Human
uccuggugucgccuggucaguu

SEQ ID NO: 460364 - RNA, 22 nt, Human
aagcuuuaugaucucucagcua

SEQ ID NO: 460365 - RNA, 22 nt, Human
uccagccaacugccuagggagc

SEQ ID NO: 460366 - RNA, 21 nt, Human
ggcagccugacccccagagag

SEQ ID NO: 460367 - RNA, 22 nt, Human
ugaagcaggcauugacugauga

SEQ ID NO: 460368 - RNA, 22 nt, Human
ugaggaagaacaagaauuuaga

SEQ ID NO: 460369 - RNA, 22 nt, Human
ugccaaauugcccuauaaauga

SEQ ID NO: 460370 - RNA, 22 nt, Human
uucuccucuguuggccuucccu

SEQ ID NO: 460371 - RNA, 22 nt, Human
aaaggccacuugaaggauuuuu

SEQ ID NO: 460372 - RNA, 22 nt, Human
agaacuguccuuggaggagagu

SEQ ID NO: 460373 - RNA, 22 nt, Human
cuccaggguuccccgauccacu

SEQ ID NO: 460374 - RNA, 22 nt, Human
acaggcucuggggcaggauggc

SEQ ID NO: 460375 - RNA, 22 nt, Human
ucuucacagaugcauauacuuc

SEQ ID NO: 460376 - RNA, 23 nt, Human
ggggaaguggcagugagugaggc

SEQ ID NO: 460377 - RNA, 22 nt, Human
uccagagcagguggucagaagg

SEQ ID NO: 460378 - RNA, 22 nt, Human
ccugccugggcucacuugccag

SEQ ID NO: 460379 - RNA, 22 nt, Human
caggcagccuucucgucucaca

SEQ ID NO: 460380 - RNA, 22 nt, Human
uuugaaaggguuaugagacuga

SEQ ID NO: 460381 - RNA, 22 nt, Human
agcagagucugugugcacuuua

SEQ ID NO: 460382 - RNA, 22 nt, Human
gagggcugccacguugggcgag

SEQ ID NO: 460383 - RNA, 22 nt, Human
guuuuccacuggauuguuugga

SEQ ID NO: 460384 - RNA, 22 nt, Human
ggcugcuuuaucggcugcugaa

SEQ ID NO: 460385 - RNA, 22 nt, Human
gcagggccagguacaagaagca

SEQ ID NO: 460386 - RNA, 22 nt, Human
cagaagaggacuggguagcuca

SEQ ID NO: 460387 - RNA, 22 nt, Human
uggcucaggauaauuuucccaa

SEQ ID NO: 460388 - RNA, 22 nt, Human
gaaggccacaagagaaguuaag

SEQ ID NO: 460389 - RNA, 22 nt, Human
uggaaagaauuccuaugguuca

SEQ ID NO: 460390 - RNA, 22 nt, Human
uugcugaagugaagguauguuu

SEQ ID NO: 460391 - RNA, 22 nt, Human
aucagcaagauugugucuugua

SEQ ID NO: 460392 - RNA, 22 nt, Human
cagcucucacacccuccuccca

SEQ ID NO: 460393 - RNA, 17 nt, Human
gcagugaaaagagauca

SEQ ID NO: 460394 - RNA, 22 nt, Human
gaccugccugagcugccucugc

SEQ ID NO: 460395 - RNA, 22 nt, Human
agagcugagcaccaagcauggu

SEQ ID NO: 460396 - RNA, 22 nt, Human
cugcccugagucaugccagaug

SEQ ID NO: 460397 - RNA, 22 nt, Human
caaagucccagcugcuuagaga

SEQ ID NO: 460398 - RNA, 22 nt, Human
uacuuuuuagcacagugugugc

SEQ ID NO: 460399 - RNA, 22 nt, Human
cagcaauauacacagucuaugg

SEQ ID NO: 460400 - RNA, 22 nt, Human
ccuggccagaggcgugccugug

SEQ ID NO: 460401 - RNA, 22 nt, Human
cugacucagcagcugaugaucc

SEQ ID NO: 460402 - RNA, 22 nt, Human
ggccuugggcagacacgucaca

SEQ ID NO: 460403 - RNA, 22 nt, Human
uggcuagcccuuguggggagag

SEQ ID NO: 460404 - RNA, 19 nt, Human
cagaccuguccagccugug

SEQ ID NO: 460405 - RNA, 22 nt, Human
cuauuaaacacuacugugcacu

SEQ ID NO: 460406 - RNA, 22 nt, Human
gagauauguuagaaagcuauug

SEQ ID NO: 460407 - RNA, 22 nt, Human
gggagccaugcuggucuucuuu

SEQ ID NO: 460408 - RNA, 22 nt, Human
uggcucagugacauuccuccca

SEQ ID NO: 460409 - RNA, 22 nt, Human
cuugggagacacaagaagacau

SEQ ID NO: 460410 - RNA, 22 nt, Human
cagagcugcgcuuuuuccuggu

SEQ ID NO: 460411 - RNA, 22 nt, Human
guuagggagucagguggcucuu

SEQ ID NO: 460412 - RNA, 20 nt, Human
ggcagggcaucaacagcucu

SEQ ID NO: 460413 - RNA, 22 nt, Human
gcuucuggaggagcugggcuga

SEQ ID NO: 460414 - RNA, 22 nt, Human
gguggcagaggugcaucagccc

SEQ ID NO: 460415 - RNA, 22 nt, Human
cuugaaagcuuugcgucuucua

SEQ ID NO: 460416 - RNA, 22 nt, Human
aggccaggcaacauucugaagu

SEQ ID NO: 460417 - RNA, 22 nt, Human
aaagacuuggcuuaugauuugc

SEQ ID NO: 460418 - RNA, 22 nt, Human
aaggaagacuugagaagguucc

SEQ ID NO: 460419 - RNA, 22 nt, Human
agggcuccgggcaggcgaugga

SEQ ID NO: 460420 - RNA, 22 nt, Human
aaaggaagauugagcuuuucca

SEQ ID NO: 460421 - RNA, 22 nt, Human
cacagcagaaaguguaggagga

SEQ ID NO: 460422 - RNA, 22 nt, Human
ggcagccagcaaugagaaguuu

SEQ ID NO: 460423 - RNA, 22 nt, Human
uaauccacaauagagauuaucu

SEQ ID NO: 460424 - RNA, 22 nt, Human
cuggcucacuagcccugcccug

SEQ ID NO: 460425 - RNA, 22 nt, Human
gccacagggcagaugcgcagag

SEQ ID NO: 460426 - RNA, 22 nt, Human
ucuggcuccuggcuccacugcc

SEQ ID NO: 460427 - RNA, 20 nt, Human
auauguguacguguauacau

SEQ ID NO: 460428 - RNA, 22 nt, Human
ggcugcuggaagacugaacaag

SEQ ID NO: 460429 - RNA, 22 nt, Human
ucugagcuggagcccaucaccu

SEQ ID NO: 460430 - RNA, 22 nt, Human
gugacagaguuuuagaucucau

SEQ ID NO: 460431 - RNA, 22 nt, Human
gcaggggcugcugggaacucgg

SEQ ID NO: 460432 - RNA, 22 nt, Human
ucagagaacacagaggugaugu

SEQ ID NO: 460433 - RNA, 21 nt, Human
agaggcaggcauuaaguacac

SEQ ID NO: 460434 - RNA, 22 nt, Human
cacagaaguuucauagucucga

SEQ ID NO: 460435 - RNA, 22 nt, Human
cagguccugcagggagaguaaa

SEQ ID NO: 460436 - RNA, 19 nt, Human
gcaggguguugacuguccc

SEQ ID NO: 460437 - RNA, 18 nt, Human
uagggcucuagggaguga

SEQ ID NO: 460438 - RNA, 22 nt, Human
caggaggcuccuagggcucugu

SEQ ID NO: 460439 - RNA, 18 nt, Human
gcccagaggucugggccc

SEQ ID NO: 460440 - RNA, 22 nt, Human
uagugaaacaguuaucaaucug

SEQ ID NO: 460441 - RNA, 22 nt, Human
agcugucucugguauuauguga

SEQ ID NO: 460442 - RNA, 22 nt, Human
cagcuuuuuagaaucuagggca

SEQ ID NO: 460443 - RNA, 22 nt, Human
ccugucugaggaggugcucuuu

SEQ ID NO: 460444 - RNA, 17 nt, Human
accaggcaacacgccca

SEQ ID NO: 460445 - RNA, 22 nt, Human
ggacacagcugcagccacaccc

SEQ ID NO: 460446 - RNA, 22 nt, Human
ggagcuguucaggacugcuuca

SEQ ID NO: 460447 - RNA, 22 nt, Human
ccuggcagacagcacugaagcu

SEQ ID NO: 460448 - RNA, 21 nt, Human
augacagaugcugcagaucgu

SEQ ID NO: 460449 - RNA, 20 nt, Human
aggcacuguugucuguaucc

SEQ ID NO: 460450 - RNA, 22 nt, Human
aagauuuccauuucuagcucau

SEQ ID NO: 460451 - RNA, 22 nt, Human
ugggcucuccuggaggacaaca

SEQ ID NO: 460452 - RNA, 22 nt, Human
ugugaccucaucuuaacuggaa

SEQ ID NO: 460453 - RNA, 22 nt, Human
augggcagcagcugccauucau

SEQ ID NO: 460454 - RNA, 22 nt, Human
ucuccuucgaggcccagcuccc

SEQ ID NO: 460455 - RNA, 22 nt, Human
ggcuggcuugccaagcucaggg

SEQ ID NO: 460456 - RNA, 18 nt, Human
ggcagcaagaagggaggg

SEQ ID NO: 460457 - RNA, 22 nt, Human
agcucucaagauaagaaagaac

SEQ ID NO: 460458 - RNA, 22 nt, Human
ucaggagaaucagggcuguccu

SEQ ID NO: 460459 - RNA, 19 nt, Human
uggagacugagagugagca

SEQ ID NO: 460460 - RNA, 22 nt, Human
gggggcaguaaccucaaagugu

SEQ ID NO: 460461 - RNA, 22 nt, Human
ucaucuaagagucuuacauuua

SEQ ID NO: 460462 - RNA, 22 nt, Human
gcagagccgugaauggauuuca

SEQ ID NO: 460463 - RNA, 20 nt, Human
uguuccaugacuauuuggau

SEQ ID NO: 460464 - RNA, 22 nt, Human
uuuuucaagacaaccugcaugu

SEQ ID NO: 460465 - RNA, 21 nt, Human
uaagccaccaugugaaaccag

SEQ ID NO: 460466 - RNA, 23 nt, Human
ugagcaucacaggagaaccaggc

SEQ ID NO: 460467 - RNA, 22 nt, Human
gguucacacuaagcuuaagugg

SEQ ID NO: 460468 - RNA, 22 nt, Human
ggagagaaauugagguagcaag

SEQ ID NO: 460469 - RNA, 23 nt, Human
cugucuccugggcuagguggaau

SEQ ID NO: 460470 - RNA, 22 nt, Human
ucucaggaagauuagggcuaag

SEQ ID NO: 460471 - RNA, 22 nt, Human
gcagagugagccgaggcugcuc

SEQ ID NO: 460472 - RNA, 22 nt, Human
ggcgcaggccuuggauccuggu

SEQ ID NO: 460473 - RNA, 20 nt, Human
gucaucgccggcagcaaaga

SEQ ID NO: 460474 - RNA, 22 nt, Human
aggcucagugcaaaucauucug

SEQ ID NO: 460475 - RNA, 22 nt, Human
caggaacaauguaagucucauu

SEQ ID NO: 460476 - RNA, 22 nt, Human
ugacaauacagagagagcaaaa

SEQ ID NO: 460477 - RNA, 22 nt, Human
auaauguagguauguguauuua

SEQ ID NO: 460478 - RNA, 23 nt, Human
gccucagagaaacagcugcacac

SEQ ID NO: 460479 - RNA, 22 nt, Human
cagggccagcgcccaggcccag

SEQ ID NO: 460480 - RNA, 17 nt, Human
agauggcaggaggcaga

SEQ ID NO: 460481 - RNA, 22 nt, Human
aggcagcagagguugaggaaag

SEQ ID NO: 460482 - RNA, 22 nt, Human
uagcuuuacaaagugcugcacc

SEQ ID NO: 460483 - RNA, 19 nt, Human
gccaggagggcucuggcug

SEQ ID NO: 460484 - RNA, 20 nt, Human
cagagaccaggccagguguc

SEQ ID NO: 460485 - RNA, 22 nt, Human
ccaaggagaaaugcugugcuuu

SEQ ID NO: 460486 - RNA, 22 nt, Human
aggugcaguggcucaugccugu

SEQ ID NO: 460487 - RNA, 22 nt, Human
gagaaagacguaggcugggagg

SEQ ID NO: 460488 - RNA, 22 nt, Human
uggccuggaaaaaugcagaugg

SEQ ID NO: 460489 - RNA, 22 nt, Human
aggaaucccgcaccagcugcug

SEQ ID NO: 460490 - RNA, 22 nt, Human
uacauguuugguaaaugauggc

SEQ ID NO: 460491 - RNA, 22 nt, Human
aagauggaguaguguaaugguu

SEQ ID NO: 460492 - RNA, 22 nt, Human
uggcugaauaauauucuguugu

SEQ ID NO: 460493 - RNA, 23 nt, Human
cagcugaagcagccugggcugga

SEQ ID NO: 460494 - RNA, 22 nt, Human
gcagagugagauaugaacccag

SEQ ID NO: 460495 - RNA, 22 nt, Human
cccagcuccuuacagggccgaa

SEQ ID NO: 460496 - RNA, 22 nt, Human
ugucagggcaugcgguccagcc

SEQ ID NO: 460497 - RNA, 22 nt, Human
gcaguggcaugaugugggcuca

SEQ ID NO: 460498 - RNA, 22 nt, Human
ggccuguguccuccuugcccug

SEQ ID NO: 460499 - RNA, 22 nt, Human
uuuguguuuuagcuggugaggc

SEQ ID NO: 460500 - RNA, 22 nt, Human
cccagacucaucccugggagcu

SEQ ID NO: 460501 - RNA, 22 nt, Human
cugaaggauuuaguucuuugcu

SEQ ID NO: 460502 - RNA, 20 nt, Human
gugugaagcccucaggagga

SEQ ID NO: 460503 - RNA, 22 nt, Human
uggcauuuccucagugcucaga

SEQ ID NO: 460504 - RNA, 22 nt, Human
agaggaaaaugaguuccagaau

SEQ ID NO: 460505 - RNA, 22 nt, Human
ccacuggcauccagcugccauc

SEQ ID NO: 460506 - RNA, 22 nt, Human
ggagcagagcucuucaucugca

SEQ ID NO: 460507 - RNA, 22 nt, Human
uggaaggcaacggagugagcug

SEQ ID NO: 460508 - RNA, 22 nt, Human
gggccuggggugacguaccccu

SEQ ID NO: 460509 - RNA, 22 nt, Human
cugggagauugcuagagaugca

SEQ ID NO: 460510 - RNA, 22 nt, Human
uaaagguagugugacauauugu

SEQ ID NO: 460511 - RNA, 22 nt, Human
uagcuuuaagacauggugaaug

SEQ ID NO: 460512 - RNA, 22 nt, Human
uccagggaugguaaugagcagu

SEQ ID NO: 460513 - RNA, 22 nt, Human
ucuggcucccagccugcucuca

SEQ ID NO: 460514 - RNA, 22 nt, Human
cucugcuuggaacuggacagaa

SEQ ID NO: 460515 - RNA, 22 nt, Human
agaaauguggaucguuuuaaaa

SEQ ID NO: 460516 - RNA, 22 nt, Human
gaaggcugcgaggggagugccg

SEQ ID NO: 460517 - RNA, 22 nt, Human
auucucaguucacuaguuucuu

SEQ ID NO: 460518 - RNA, 20 nt, Human
cugggaggucuuccaaauca

SEQ ID NO: 460519 - RNA, 22 nt, Human
gccuggagaccugcuccucuac

SEQ ID NO: 460520 - RNA, 22 nt, Human
aucacaaaggcugcuucaugau

SEQ ID NO: 460521 - RNA, 22 nt, Human
gugccuggcaugcgccggugcu

SEQ ID NO: 460522 - RNA, 22 nt, Human
ugucuacuugggcucuacagca

SEQ ID NO: 460523 - RNA, 22 nt, Human
gaggaaugucagcacaggccuc

SEQ ID NO: 460524 - RNA, 20 nt, Human
acugagcugcauggagagga

SEQ ID NO: 460525 - RNA, 22 nt, Human
ucuagaaauuuugccuuguauu

SEQ ID NO: 460526 - RNA, 22 nt, Human
ucugucucuuuguucugugagu

SEQ ID NO: 460527 - RNA, 22 nt, Human
ucaggaucaggggccuuuccuu

SEQ ID NO: 460528 - RNA, 22 nt, Human
cuguccagcuuggcuccugggg

SEQ ID NO: 460529 - RNA, 20 nt, Human
gcugccagugccugaugcuu

SEQ ID NO: 460530 - RNA, 22 nt, Human
cugaagccaugugcucacuggu

SEQ ID NO: 460531 - RNA, 22 nt, Human
cccaggagguggagguugcagc

SEQ ID NO: 460532 - RNA, 22 nt, Human
aagggcuggaauaucucuuaga

SEQ ID NO: 460533 - RNA, 22 nt, Human
ucccaggcuggggccaggugac

SEQ ID NO: 460534 - RNA, 22 nt, Human
acauuuaaccaaacuguuuaau

SEQ ID NO: 460535 - RNA, 22 nt, Human
gucauuguguggacauggagaa

SEQ ID NO: 460536 - RNA, 22 nt, Human
ccacugggcguuucuguccaau

SEQ ID NO: 460537 - RNA, 22 nt, Human
cuuuggaaaaauaccuggcaua

SEQ ID NO: 460538 - RNA, 22 nt, Human
gcuucucuggccugcagggcau

SEQ ID NO: 460539 - RNA, 22 nt, Human
gaugggggccagggccugcuuu

SEQ ID NO: 460540 - RNA, 22 nt, Human
uggcucaggguccccaaauggu

SEQ ID NO: 460541 - RNA, 22 nt, Human
agagggaucacccuguuucugg

SEQ ID NO: 460542 - RNA, 18 nt, Human
cugugcagcaaacugagc

SEQ ID NO: 460543 - RNA, 22 nt, Human
uggcugaguuacgaacagagca

SEQ ID NO: 460544 - RNA, 22 nt, Human
uacauguuauuucacuauuggu

SEQ ID NO: 460545 - RNA, 19 nt, Human
ggccuggauuuagggcucc

SEQ ID NO: 460546 - RNA, 22 nt, Human
ggagcugugcagugacuacaga

SEQ ID NO: 460547 - RNA, 22 nt, Human
aggcaguggcugagaccagggg

SEQ ID NO: 460548 - RNA, 22 nt, Human
acucagaguuugcguuccauac

SEQ ID NO: 460549 - RNA, 22 nt, Human
cagggcuguuagcugcugcucu

SEQ ID NO: 460550 - RNA, 22 nt, Human
ucccugcucagcucaccuggca

SEQ ID NO: 460551 - RNA, 22 nt, Human
agcaggaggguuuuguagaguc

SEQ ID NO: 460552 - RNA, 22 nt, Human
aaaaguauuggccaccauuucu

SEQ ID NO: 460553 - RNA, 22 nt, Human
gccuuuuuuguugcucugucac

SEQ ID NO: 460554 - RNA, 22 nt, Human
gcaugggcaagaggacuggggg

SEQ ID NO: 460555 - RNA, 22 nt, Human
cuagggacugggaccuuaguua

SEQ ID NO: 460556 - RNA, 21 nt, Human
cccuguguuccacagcagaca

SEQ ID NO: 460557 - RNA, 22 nt, Human
ccagcuugaagaugugcugguu

SEQ ID NO: 460558 - RNA, 22 nt, Human
gcagggcagugugucugugggg

SEQ ID NO: 460559 - RNA, 22 nt, Human
ccagggcaucacauccaguguu

SEQ ID NO: 460560 - RNA, 22 nt, Human
cauuaugugggaaaauguucuu

SEQ ID NO: 460561 - RNA, 22 nt, Human
agcuuaggaggaugaugaacau

SEQ ID NO: 460562 - RNA, 23 nt, Human
ucagagaggcccccugcagagau

SEQ ID NO: 460563 - RNA, 22 nt, Human
aaggcacuacgcugcuggggcg

SEQ ID NO: 460564 - RNA, 22 nt, Human
ugaggcaggagaaucacaugaa

SEQ ID NO: 460565 - RNA, 22 nt, Human
cuucuugcugggggccucagug

SEQ ID NO: 460566 - RNA, 22 nt, Human
caccagcuacagacuacugugu

SEQ ID NO: 460567 - RNA, 22 nt, Human
cugaaugucgaucagcuugggu

SEQ ID NO: 460568 - RNA, 19 nt, Human
ugcaggaggacugagcaga

SEQ ID NO: 460569 - RNA, 22 nt, Human
ggacuggacucucaggcucaca

SEQ ID NO: 460570 - RNA, 22 nt, Human
agcagccagugggagugauaca

SEQ ID NO: 460571 - RNA, 22 nt, Human
ugggcugaguggcagccagagu

SEQ ID NO: 460572 - RNA, 22 nt, Human
uuccugaugcacacagucauuu

SEQ ID NO: 460573 - RNA, 22 nt, Human
ccuggcucuucagagguuccua

SEQ ID NO: 460574 - RNA, 22 nt, Human
auauauuugagaauauucauga

SEQ ID NO: 460575 - RNA, 22 nt, Human
uucagcagugcagacacccagu

SEQ ID NO: 460576 - RNA, 22 nt, Human
ucagaggaacuggacuaaagcc

SEQ ID NO: 460577 - RNA, 22 nt, Human
caugcuccaaaaacaagagaau

SEQ ID NO: 460578 - RNA, 22 nt, Human
ucauccuuuugcaugggaaggc

SEQ ID NO: 460579 - RNA, 22 nt, Human
gcagggcuguggacacuuuggu

SEQ ID NO: 460580 - RNA, 22 nt, Human
uugcauugaaugcacauuuuua

SEQ ID NO: 460581 - RNA, 22 nt, Human
acaaaugccauauauaaauucu

SEQ ID NO: 460582 - RNA, 22 nt, Human
aagccagggucaggggccuccu

SEQ ID NO: 460583 - RNA, 22 nt, Human
ccuggcagcagcacaugccuuc

SEQ ID NO: 460584 - RNA, 22 nt, Human
cagcaauaguguguuuguuuca

SEQ ID NO: 460585 - RNA, 22 nt, Human
aaggagugcaugacucagagua

SEQ ID NO: 460586 - RNA, 22 nt, Human
uggagcugguaaacagugacau

SEQ ID NO: 460587 - RNA, 22 nt, Human
aguuucuaccgguacauucagg

SEQ ID NO: 460588 - RNA, 22 nt, Human
uuucaaauaccauaaaccuaau

SEQ ID NO: 460589 - RNA, 22 nt, Human
gaaaccagcuagaggcagaggg

SEQ ID NO: 460590 - RNA, 22 nt, Human
gcguccagggaaggcccagcug

SEQ ID NO: 460591 - RNA, 22 nt, Human
agggagcaugggugaagcaggc

SEQ ID NO: 460592 - RNA, 22 nt, Human
ggaaagagcuaaaagggugaga

SEQ ID NO: 460593 - RNA, 22 nt, Human
uaaaaaguagugagaauggcgc

SEQ ID NO: 460594 - RNA, 22 nt, Human
ucucccacagucucccauggcu

SEQ ID NO: 460595 - RNA, 22 nt, Human
guugggaaggcaagaaguagaa

SEQ ID NO: 460596 - RNA, 22 nt, Human
ucagagagguuaaauaucuugu

SEQ ID NO: 460597 - RNA, 23 nt, Human
uccaagggcuacaaacacagacc

SEQ ID NO: 460598 - RNA, 22 nt, Human
gaaggcuguuucugguagugau

SEQ ID NO: 460599 - RNA, 22 nt, Human
gcuggccucuacaggccggcca

SEQ ID NO: 460600 - RNA, 22 nt, Human
acguuuucagugacugugcuuc

SEQ ID NO: 460601 - RNA, 22 nt, Human
aggucauuguuaagucaccaua

SEQ ID NO: 460602 - RNA, 22 nt, Human
ugggagcacccugaggagcuuc

SEQ ID NO: 460603 - RNA, 22 nt, Human
uccaguggguugcugagggagg

SEQ ID NO: 460604 - RNA, 22 nt, Human
gcagcuuggauuucuguaguuu

SEQ ID NO: 460605 - RNA, 22 nt, Human
ccuuuguucacuggagagugga

SEQ ID NO: 460606 - RNA, 22 nt, Human
acagagagaaacaaucagcagc

SEQ ID NO: 460607 - RNA, 22 nt, Human
ugcaggugaaaauuaugaggau

SEQ ID NO: 460608 - RNA, 22 nt, Human
gagcccaggcagagguugcagu

SEQ ID NO: 460609 - RNA, 22 nt, Human
gccagagcugagacacgagucc

SEQ ID NO: 460610 - RNA, 22 nt, Human
gcagggcagcuuagucccuguc

SEQ ID NO: 460611 - RNA, 22 nt, Human
cauuuauucaugaucuguagcu

SEQ ID NO: 460612 - RNA, 22 nt, Human
ggcugaaggaugaaagcugcag

SEQ ID NO: 460613 - RNA, 22 nt, Human
gagaggcauggaacagauucuu

SEQ ID NO: 460614 - RNA, 22 nt, Human
aucaggauucaccccagagcug

SEQ ID NO: 460615 - RNA, 22 nt, Human
ccagagagaaaauggagggcca

SEQ ID NO: 460616 - RNA, 22 nt, Human
cagggcuguggaaaacuggugc

SEQ ID NO: 460617 - RNA, 22 nt, Human
aaggcagauauaaagacuagag

SEQ ID NO: 460618 - RNA, 22 nt, Human
auaugccauuagcuagaaauaa

SEQ ID NO: 460619 - RNA, 22 nt, Human
gagagcugugguuugaccaggc

SEQ ID NO: 460620 - RNA, 22 nt, Human
aguacuucagaggcugcccagg

SEQ ID NO: 460621 - RNA, 22 nt, Human
uaggaaaagucuagauugauga

SEQ ID NO: 460622 - RNA, 19 nt, Human
agccagggugagaaggagc

SEQ ID NO: 460623 - RNA, 22 nt, Human
ucuggccuuaucuguccaagcc

SEQ ID NO: 460624 - RNA, 18 nt, Human
aggcuucccaggcaggcc

SEQ ID NO: 460625 - RNA, 23 nt, Human
ggccuccuggucuaggcuagacu

SEQ ID NO: 460626 - RNA, 22 nt, Human
caucaaauggcaagugaaagcu

SEQ ID NO: 460627 - RNA, 22 nt, Human
ucacaugcccuguauuuaccag

SEQ ID NO: 460628 - RNA, 22 nt, Human
acuuuguuuggcuauuagaguc

SEQ ID NO: 460629 - RNA, 22 nt, Human
ugggcaagucacuucugucuuu

SEQ ID NO: 460630 - RNA, 20 nt, Human
gcugaccccugcugucaugc

SEQ ID NO: 460631 - RNA, 22 nt, Human
auuucuacugugagaaacauga

SEQ ID NO: 460632 - RNA, 22 nt, Human
ucaguuuuuaagaguuaugcga

SEQ ID NO: 460633 - RNA, 22 nt, Human
uuauuaggaacucaggauuuuu

SEQ ID NO: 460634 - RNA, 22 nt, Human
ggaggaagugcaguucuacuac

SEQ ID NO: 460635 - RNA, 20 nt, Human
uggagcuccagcguccaugu

SEQ ID NO: 460636 - RNA, 22 nt, Human
cagggugcagugucgcugcuag

SEQ ID NO: 460637 - RNA, 22 nt, Human
uuucaaaguggagaauuagaca

SEQ ID NO: 460638 - RNA, 22 nt, Human
gggcuggcaucgguugcugaga

SEQ ID NO: 460639 - RNA, 22 nt, Human
uauuucuuucagguauguguug

SEQ ID NO: 460640 - RNA, 22 nt, Human
uaaaacugcuugguauggucua

SEQ ID NO: 460641 - RNA, 22 nt, Human
cacugaaggaaggacuacugca

SEQ ID NO: 460642 - RNA, 23 nt, Human
ucuguacaauugagaagagaaca

SEQ ID NO: 460643 - RNA, 22 nt, Human
ucagcagggaggcucugugccc

SEQ ID NO: 460644 - RNA, 22 nt, Human
cuccagggcagcauggcagugg

SEQ ID NO: 460645 - RNA, 19 nt, Human
uagaaugcccacuuaaaaa

SEQ ID NO: 460646 - RNA, 20 nt, Human
ggcugcugugggcagagagg

SEQ ID NO: 460647 - RNA, 22 nt, Human
cagggccaagcugcagcaucug

SEQ ID NO: 460648 - RNA, 18 nt, Human
auggucucauacugggag

SEQ ID NO: 460649 - RNA, 22 nt, Human
ugucccauggacacaacuucuu

SEQ ID NO: 460650 - RNA, 22 nt, Human
ggagggagcauccccuugcuga

SEQ ID NO: 460651 - RNA, 22 nt, Human
acugugcacaauucuaaguccu

SEQ ID NO: 460652 - RNA, 22 nt, Human
caggcagcugaggacuuugcua

SEQ ID NO: 460653 - RNA, 22 nt, Human
cucugugggggagaggcagcug

SEQ ID NO: 460654 - RNA, 22 nt, Human
cuggccuggagccucugggugg

SEQ ID NO: 460655 - RNA, 22 nt, Human
ggugccaggcuguagucagggu

SEQ ID NO: 460656 - RNA, 22 nt, Human
uggaggagggcuggugucugua

SEQ ID NO: 460657 - RNA, 22 nt, Human
agagccuguuuugugggagaug

SEQ ID NO: 460658 - RNA, 22 nt, Human
ucaaaggcauugccaauaagua

SEQ ID NO: 460659 - RNA, 22 nt, Human
cuuauguacacacauauauugu

SEQ ID NO: 460660 - RNA, 22 nt, Human
aaggcugugucagaagcucccu

SEQ ID NO: 460661 - RNA, 22 nt, Human
ugggaggacuugugggcuucau

SEQ ID NO: 460662 - RNA, 22 nt, Human
gggauggcuuuguggcugacuc

SEQ ID NO: 460663 - RNA, 23 nt, Human
aaucuggcugauguuuuuucucu

SEQ ID NO: 460664 - RNA, 18 nt, Human
uggcaggaaaugcacuuu

SEQ ID NO: 460665 - RNA, 22 nt, Human
uccucagacacccugcuggcuu

SEQ ID NO: 460666 - RNA, 22 nt, Human
gagugaaaaaggaagggccaua

SEQ ID NO: 460667 - RNA, 22 nt, Human
cuucccuuggugaacagagcau

SEQ ID NO: 460668 - RNA, 22 nt, Human
ugcuggagaucauuaauguuca

SEQ ID NO: 460669 - RNA, 22 nt, Human
cucuucagauaaaagggauauu

SEQ ID NO: 460670 - RNA, 22 nt, Human
uguguacuugaaagggcagguc

SEQ ID NO: 460671 - RNA, 22 nt, Human
augcugaagagugcacaggcua

SEQ ID NO: 460672 - RNA, 22 nt, Human
uuucauuacguguuugacuugu

SEQ ID NO: 460673 - RNA, 22 nt, Human
gcuuccuagaucugugguacuc

SEQ ID NO: 460674 - RNA, 22 nt, Human
caguacuuauuucuauuuaggg

SEQ ID NO: 460675 - RNA, 22 nt, Human
aaaugucuuuaucucauguaac

SEQ ID NO: 460676 - RNA, 22 nt, Human
ucacagcuaagcuuggucacug

SEQ ID NO: 460677 - RNA, 22 nt, Human
acaaaggcauagugaauguuuu

SEQ ID NO: 460678 - RNA, 22 nt, Human
cacagaauaaauugguaucaga

SEQ ID NO: 460679 - RNA, 22 nt, Human
cuacauuucccagcugccuucc

SEQ ID NO: 460680 - RNA, 22 nt, Human
gagagugagauaauuucacaua

SEQ ID NO: 460681 - RNA, 22 nt, Human
cucuuccucucaugcggucaua

SEQ ID NO: 460682 - RNA, 22 nt, Human
aaggcauauauucuaaacagga

SEQ ID NO: 460683 - RNA, 22 nt, Human
uccucugcuccaggcuggacuu

SEQ ID NO: 460684 - RNA, 22 nt, Human
cucaggaguaguucagcagcug

SEQ ID NO: 460685 - RNA, 22 nt, Human
gccuggaguagcauggcaagcc

SEQ ID NO: 460686 - RNA, 22 nt, Human
agggcuggcaucucuaaugcug

SEQ ID NO: 460687 - RNA, 22 nt, Human
uuuuucauauuccccucucugg

SEQ ID NO: 460688 - RNA, 22 nt, Human
aggcugggcaccguuuugaucc

SEQ ID NO: 460689 - RNA, 22 nt, Human
gcucucugccauaugaggauac

SEQ ID NO: 460690 - RNA, 22 nt, Human
ggccaggcugcccugggagcag

SEQ ID NO: 460691 - RNA, 22 nt, Human
gcucagagcacucagacucagc

SEQ ID NO: 460692 - RNA, 22 nt, Human
agggguggccugccuuacuccc

SEQ ID NO: 460693 - RNA, 22 nt, Human
agucugucucugcuaaucacua

SEQ ID NO: 460694 - RNA, 22 nt, Human
gccuggugcuaugagggccagc

SEQ ID NO: 460695 - RNA, 22 nt, Human
accuuucacgguaucagacauc

SEQ ID NO: 460696 - RNA, 22 nt, Human
cauucucaauaguagaugagua

SEQ ID NO: 460697 - RNA, 22 nt, Human
cuggcuggucaucagcaguacg

SEQ ID NO: 460698 - RNA, 18 nt, Human
ggcuguggacaagauuag

SEQ ID NO: 460699 - RNA, 22 nt, Human
uacuuccagcaaucugcauauu

SEQ ID NO: 460700 - RNA, 22 nt, Human
aauuaguaaccuaauuccaucu

SEQ ID NO: 460701 - RNA, 22 nt, Human
uuggccuuguuaaggaggcccu

SEQ ID NO: 460702 - RNA, 22 nt, Human
gugccaggugcuaagcugugcu

SEQ ID NO: 460703 - RNA, 22 nt, Human
ugccuucaaucaggauggucuc

SEQ ID NO: 460704 - RNA, 19 nt, Human
gcgaggaagucacuguggc

SEQ ID NO: 460705 - RNA, 22 nt, Human
uauuucuguaacucagggucug

SEQ ID NO: 460706 - RNA, 22 nt, Human
aggagccaguuccaccccagga

SEQ ID NO: 460707 - RNA, 20 nt, Human
acaauauguagaugaauagc

SEQ ID NO: 460708 - RNA, 22 nt, Human
ugcucauuggcgaucugaggga

SEQ ID NO: 460709 - RNA, 22 nt, Human
gagguagccacagauagagacu

SEQ ID NO: 460710 - RNA, 22 nt, Human
ugcaggccucacaccuggcacc

SEQ ID NO: 460711 - RNA, 22 nt, Human
ucuggcucucaacaaauauuua

SEQ ID NO: 460712 - RNA, 22 nt, Human
ggcugcaguuugucuuuugcuu

SEQ ID NO: 460713 - RNA, 22 nt, Human
agaccaagaaaggaugaggauc

SEQ ID NO: 460714 - RNA, 22 nt, Human
cuauugaauagcccaaaucauu

SEQ ID NO: 460715 - RNA, 22 nt, Human
gaugugagugguagcugggauu

SEQ ID NO: 460716 - RNA, 22 nt, Human
gggcugagucaucuggggccuc

SEQ ID NO: 460717 - RNA, 17 nt, Human
gagauggguggaucacc

SEQ ID NO: 460718 - RNA, 22 nt, Human
aucaguuucuaccauguggaau

SEQ ID NO: 460719 - RNA, 22 nt, Human
cagggccaagccccuuuggcug

SEQ ID NO: 460720 - RNA, 22 nt, Human
gagaccaggaaguacagcagcc

SEQ ID NO: 460721 - RNA, 22 nt, Human
ucuuuuggguucuuaugauuua

SEQ ID NO: 460722 - RNA, 22 nt, Human
uggcagccacaucucguggauu

SEQ ID NO: 460723 - RNA, 21 nt, Human
ucaggcaggcgcagagggaag

SEQ ID NO: 460724 - RNA, 22 nt, Human
caagagcuuuagaaaugcucau

SEQ ID NO: 460725 - RNA, 22 nt, Human
ucccuggaacagagagacaacg

SEQ ID NO: 460726 - RNA, 22 nt, Human
uuagggcaggcaugagagaacu

SEQ ID NO: 460727 - RNA, 22 nt, Human
acccuguaugcuauaucccuaa

SEQ ID NO: 460728 - RNA, 22 nt, Human
gggcugagggccaauuccuacu

SEQ ID NO: 460729 - RNA, 22 nt, Human
agugugagccuacaggccaaag

SEQ ID NO: 460730 - RNA, 22 nt, Human
gagagugaaggcuucccagcaa

SEQ ID NO: 460731 - RNA, 22 nt, Human
ucuccuuugaaaguuaggacug

SEQ ID NO: 460732 - RNA, 22 nt, Human
uaugaagaaguucugugaaaug

SEQ ID NO: 460733 - RNA, 21 nt, Human
ugguggagugugcugagcaug

SEQ ID NO: 460734 - RNA, 22 nt, Human
uguucuuucaguuagacacagu

SEQ ID NO: 460735 - RNA, 22 nt, Human
aaaauacacauacuaggggaaa

SEQ ID NO: 460736 - RNA, 22 nt, Human
acaggugguaaaauggacuguc

SEQ ID NO: 460737 - RNA, 22 nt, Human
gguggccaggccagcucuggcc

SEQ ID NO: 460738 - RNA, 22 nt, Human
uggcuucaucugcagcacugcc

SEQ ID NO: 460739 - RNA, 22 nt, Human
ucuacugcacuggugucucauc

SEQ ID NO: 460740 - RNA, 22 nt, Human
aaauuucuggaagugucagagu

SEQ ID NO: 460741 - RNA, 22 nt, Human
uggcucuggggacaguaagucc

SEQ ID NO: 460742 - RNA, 22 nt, Human
gggcugagugggccucuuacuu

SEQ ID NO: 460743 - RNA, 22 nt, Human
cucccagguuacaucugagccu

SEQ ID NO: 460744 - RNA, 22 nt, Human
gagcucauccccaugguccguc

SEQ ID NO: 460745 - RNA, 22 nt, Human
cucuggacacuggcaugggguc

SEQ ID NO: 460746 - RNA, 22 nt, Human
cuccucuuuacccgcauggucu

SEQ ID NO: 460747 - RNA, 22 nt, Human
uaagaacaagauguuccuguuu

SEQ ID NO: 460748 - RNA, 22 nt, Human
agcagaggaggauuuaguuagg

SEQ ID NO: 460749 - RNA, 22 nt, Human
gaggcucagggaaacagcgcag

SEQ ID NO: 460750 - RNA, 22 nt, Human
uaaacagaaagcagauguacuu

SEQ ID NO: 460751 - RNA, 22 nt, Human
ggccaggcuggucucagacuuc

SEQ ID NO: 460752 - RNA, 22 nt, Human
ucucaggaagugauauugagac

SEQ ID NO: 460753 - RNA, 22 nt, Human
aaucagaauuuauugaaucuuu

SEQ ID NO: 460754 - RNA, 22 nt, Human
aucagcaagacuaggggaauac

SEQ ID NO: 460755 - RNA, 22 nt, Human
gaggcaugucuggccuguccca

SEQ ID NO: 460756 - RNA, 22 nt, Human
uuaggaaauuaugguuucagau

SEQ ID NO: 460757 - RNA, 22 nt, Human
gggcagagaaauggacaguugg

SEQ ID NO: 460758 - RNA, 22 nt, Human
acuguacacauucgucaagacu

SEQ ID NO: 460759 - RNA, 22 nt, Human
ucauauuuaggccuuuaauuca

SEQ ID NO: 460760 - RNA, 22 nt, Human
ggagccuggcaaugcugcgucc

SEQ ID NO: 460761 - RNA, 19 nt, Human
aagggcugggcaccucacu

SEQ ID NO: 460762 - RNA, 22 nt, Human
agggagcuuccgaacuacagcu

SEQ ID NO: 460763 - RNA, 20 nt, Human
ccugggguacacuggcaugu

SEQ ID NO: 460764 - RNA, 22 nt, Human
agagcuguagcuuccuagagcc

SEQ ID NO: 460765 - RNA, 22 nt, Human
ccuguacaagagccaucuggau

SEQ ID NO: 460766 - RNA, 22 nt, Human
gcugggcagccccuacagagag

SEQ ID NO: 460767 - RNA, 20 nt, Human
cauauauaccuagaagugga

SEQ ID NO: 460768 - RNA, 22 nt, Human
ugagcuguagcagaugcuguug

SEQ ID NO: 460769 - RNA, 22 nt, Human
gcagaugaggaagcuaaugcug

SEQ ID NO: 460770 - RNA, 21 nt, Human
guccucagcugaugggagcug

SEQ ID NO: 460771 - RNA, 22 nt, Human
cagaauggcuuuuauggcucag

SEQ ID NO: 460772 - RNA, 22 nt, Human
agaagaaaugaggccguucugc

SEQ ID NO: 460773 - RNA, 22 nt, Human
agagacaggguuuugucguguu

SEQ ID NO: 460774 - RNA, 22 nt, Human
uccucuggggucagggcacuac

SEQ ID NO: 460775 - RNA, 22 nt, Human
ccucgcggcacucgggccggau

SEQ ID NO: 460776 - RNA, 22 nt, Human
ccaggccucccuuuuccagcca

SEQ ID NO: 460777 - RNA, 22 nt, Human
ggaggguuagcaaaggcacaga

SEQ ID NO: 460778 - RNA, 22 nt, Human
ucaaaguagggguaagccaggc

SEQ ID NO: 460779 - RNA, 19 nt, Human
uccuccuuacuuccucuug

SEQ ID NO: 460780 - RNA, 22 nt, Human
ccagggcagggaccacgugucu

SEQ ID NO: 460781 - RNA, 22 nt, Human
cagacagaccugcaagggcaca

SEQ ID NO: 460782 - RNA, 22 nt, Human
cuucaagagaaugcagggaugu

SEQ ID NO: 460783 - RNA, 22 nt, Human
auaaggcacacauagauagggu

SEQ ID NO: 460784 - RNA, 22 nt, Human
ccugggagagccaucuguggcc

SEQ ID NO: 460785 - RNA, 22 nt, Human
ucucaggaauagaguggcagca

SEQ ID NO: 460786 - RNA, 22 nt, Human
aagcagaugggacuccaaggca

SEQ ID NO: 460787 - RNA, 22 nt, Human
cagugguggaaugaggaauugu

SEQ ID NO: 460788 - RNA, 22 nt, Human
ugcaggcucacccuggagcuga

SEQ ID NO: 460789 - RNA, 22 nt, Human
ggugaagggugucauggcauuu

SEQ ID NO: 460790 - RNA, 22 nt, Human
ccaguggacaauuucugaggaa

SEQ ID NO: 460791 - RNA, 22 nt, Human
cagcccagcagucuuagccugc

SEQ ID NO: 460792 - RNA, 22 nt, Human
ucucagggcgcagugaggcagu

SEQ ID NO: 460793 - RNA, 22 nt, Human
ugugucagaaggcaauggggau

SEQ ID NO: 460794 - RNA, 20 nt, Human
aaagucuguuuaucucugga

SEQ ID NO: 460795 - RNA, 22 nt, Human
cugucauugagccugucagggc

SEQ ID NO: 460796 - RNA, 22 nt, Human
ggcuccugauaggagaaugcgg

SEQ ID NO: 460797 - RNA, 22 nt, Human
gcuguacaucacaauuugcugu

SEQ ID NO: 460798 - RNA, 22 nt, Human
guaaaguucuacuagaaucaac

SEQ ID NO: 460799 - RNA, 22 nt, Human
caguuucuacgacuuaagcaca

SEQ ID NO: 460800 - RNA, 22 nt, Human
ugaauaaucuuggguauuaaua

SEQ ID NO: 460801 - RNA, 22 nt, Human
aguccccucuaacccaacuuua

SEQ ID NO: 460802 - RNA, 22 nt, Human
cagcugugcuguauuaagcucu

SEQ ID NO: 460803 - RNA, 20 nt, Human
gucugaggagcagugggaaa

SEQ ID NO: 460804 - RNA, 22 nt, Human
auuuuuccaauuaggauaaaga

SEQ ID NO: 460805 - RNA, 22 nt, Human
uuucuuaggcucuaaaaugacu

SEQ ID NO: 460806 - RNA, 22 nt, Human
uagaaacauauaggauggcagg

SEQ ID NO: 460807 - RNA, 22 nt, Human
gcaccaggcuuagagccccagg

SEQ ID NO: 460808 - RNA, 22 nt, Human
caggcugggcuccggagauaaa

SEQ ID NO: 460809 - RNA, 22 nt, Human
aggccugagcagaggaguggac

SEQ ID NO: 460810 - RNA, 22 nt, Human
caugggagguuggcuuggcaug

SEQ ID NO: 460811 - RNA, 22 nt, Human
gguggggccugcuccagcggcc

SEQ ID NO: 460812 - RNA, 22 nt, Human
uuuuagauugggaaauguaaag

SEQ ID NO: 460813 - RNA, 22 nt, Human
gccugugacucgucuugggcca

SEQ ID NO: 460814 - RNA, 18 nt, Human
ccucaggggaccuggcag

SEQ ID NO: 460815 - RNA, 22 nt, Human
uacauuccacuagugacuggcg

SEQ ID NO: 460816 - RNA, 22 nt, Human
gagggcucaacuacuacuaggc

SEQ ID NO: 460817 - RNA, 22 nt, Human
aagacuguacauuuuccagucu

SEQ ID NO: 460818 - RNA, 22 nt, Human
uaucuguuccaggcacucagcu

SEQ ID NO: 460819 - RNA, 22 nt, Human
gaggcugaggguuagagaguca

SEQ ID NO: 460820 - RNA, 22 nt, Human
agggccaggaacaccugaaggg

SEQ ID NO: 460821 - RNA, 22 nt, Human
acuuccuggcguagcugacauu

SEQ ID NO: 460822 - RNA, 22 nt, Human
uguuccauaaguggugcuuugu

SEQ ID NO: 460823 - RNA, 22 nt, Human
cagcucugaggaacacuccuuu

SEQ ID NO: 460824 - RNA, 22 nt, Human
gggagggaaggaggcgccgugu

SEQ ID NO: 460825 - RNA, 22 nt, Human
cauuuguaggaugcuucuuguu

SEQ ID NO: 460826 - RNA, 22 nt, Human
ccucugggugggaggccgggcg

SEQ ID NO: 460827 - RNA, 22 nt, Human
gcaggggcuaaggacacagaga

SEQ ID NO: 460828 - RNA, 22 nt, Human
ccugcagguccccggaugcgca

SEQ ID NO: 460829 - RNA, 20 nt, Human
uuggucagugguucaguuug

SEQ ID NO: 460830 - RNA, 22 nt, Human
gcagugacagggcugcugccuu

SEQ ID NO: 460831 - RNA, 22 nt, Human
aaagaacaucggagugggcggg

SEQ ID NO: 460832 - RNA, 22 nt, Human
ugggcugcacccucagccucug

SEQ ID NO: 460833 - RNA, 22 nt, Human
gaagagcuuaguuguccuagaa

SEQ ID NO: 460834 - RNA, 22 nt, Human
uauguguaggaggaggacaggg

SEQ ID NO: 460835 - RNA, 22 nt, Human
cucuggagcgcugcuucccgcg

SEQ ID NO: 460836 - RNA, 22 nt, Human
cucccugggccucaguuucucu

SEQ ID NO: 460837 - RNA, 19 nt, Human
accugcaguaauaauuccu

SEQ ID NO: 460838 - RNA, 22 nt, Human
agguaaagacugcaaggagaau

SEQ ID NO: 460839 - RNA, 22 nt, Human
aguuaaagucugaaauagagaa

SEQ ID NO: 460840 - RNA, 22 nt, Human
ugagugccugaacauagaguag

SEQ ID NO: 460841 - RNA, 22 nt, Human
ugcucugugguccaagauggcu

SEQ ID NO: 460842 - RNA, 22 nt, Human
ugaagggcaaccccaggcccag

SEQ ID NO: 460843 - RNA, 22 nt, Human
agaucaaagccaugagagauuu

SEQ ID NO: 460844 - RNA, 22 nt, Human
uccuguguuacugccuggagcg

SEQ ID NO: 460845 - RNA, 22 nt, Human
aagguacaguuuuaagaauaag

SEQ ID NO: 460846 - RNA, 21 nt, Human
aacauuucaggauccaaauug

SEQ ID NO: 460847 - RNA, 22 nt, Human
gguuucaacucagcuaguaagg

SEQ ID NO: 460848 - RNA, 22 nt, Human
ccccaggcagggccuaacagag

SEQ ID NO: 460849 - RNA, 22 nt, Human
cacagaauuaagggagaaauau

SEQ ID NO: 460850 - RNA, 22 nt, Human
gcagggcugcugaaacuuguuu

SEQ ID NO: 460851 - RNA, 22 nt, Human
uggccugggugcugcugacauc

SEQ ID NO: 460852 - RNA, 22 nt, Human
ucuggccagugaaaugcagaau

SEQ ID NO: 460853 - RNA, 22 nt, Human
cagggcaggaugcugugauuau

SEQ ID NO: 460854 - RNA, 22 nt, Human
ggcaggaggaagaguuagcacc

SEQ ID NO: 460855 - RNA, 22 nt, Human
gguggagcuguggacaggaagg

SEQ ID NO: 460856 - RNA, 22 nt, Human
ucuucauuccguagauauuuau

SEQ ID NO: 460857 - RNA, 22 nt, Human
ggagauggcucugcaaggucua

SEQ ID NO: 460858 - RNA, 22 nt, Human
uacagggguaacaguggggaau

SEQ ID NO: 460859 - RNA, 22 nt, Human
cuggccuuuuguuucuggagaa

SEQ ID NO: 460860 - RNA, 22 nt, Human
cccaagcagggugcagaggcau

SEQ ID NO: 460861 - RNA, 22 nt, Human
ccaggagcagauauggacauaa

SEQ ID NO: 460862 - RNA, 22 nt, Human
gagcucagcacuaaaaucaugu

SEQ ID NO: 460863 - RNA, 22 nt, Human
ggaagggcaaaagagaugaacu

SEQ ID NO: 460864 - RNA, 22 nt, Human
gcugucacaaauauuucucagc

SEQ ID NO: 460865 - RNA, 22 nt, Human
gagggcugaugcuuacuuauuu

SEQ ID NO: 460866 - RNA, 22 nt, Human
ggccagaggugguacauagcuu

SEQ ID NO: 460867 - RNA, 22 nt, Human
agcugcucccuauccuuuccuu

SEQ ID NO: 460868 - RNA, 22 nt, Human
ugcugaaggcaggggagguggc

SEQ ID NO: 460869 - RNA, 22 nt, Human
cuguuauuucugccaggugagu

SEQ ID NO: 460870 - RNA, 22 nt, Human
uuccaguuaaggaagcuauucu

SEQ ID NO: 460871 - RNA, 22 nt, Human
ggugaggcccagugaucugugu

SEQ ID NO: 460872 - RNA, 22 nt, Human
agugaccaacaaugcugagaag

SEQ ID NO: 460873 - RNA, 22 nt, Human
caaugguggugucagaagagau

SEQ ID NO: 460874 - RNA, 22 nt, Human
guuauaaauaccuaauaggauu

SEQ ID NO: 460875 - RNA, 22 nt, Human
gcagagcuucuguccuucagga

SEQ ID NO: 460876 - RNA, 22 nt, Human
caggaaaauggaaucaccugua

SEQ ID NO: 460877 - RNA, 22 nt, Human
uacauucuacuuuuucacuccc

SEQ ID NO: 460878 - RNA, 22 nt, Human
gaagaacaagcagugcuuuccu

SEQ ID NO: 460879 - RNA, 22 nt, Human
aacauguagcagaaacgacuaa

SEQ ID NO: 460880 - RNA, 22 nt, Human
ugaggcaguauuuuagugacuu

SEQ ID NO: 460881 - RNA, 22 nt, Human
gcagugggagcuuaggcagugc

SEQ ID NO: 460882 - RNA, 22 nt, Human
auugaaaauauaauucuaggag

SEQ ID NO: 460883 - RNA, 21 nt, Human
ccaggcagagcugugaguucu

SEQ ID NO: 460884 - RNA, 22 nt, Human
auuuauuauugugguuacuucu

SEQ ID NO: 460885 - RNA, 22 nt, Human
ggcccagccggcgagucucgcg

SEQ ID NO: 460886 - RNA, 22 nt, Human
caucugcuguuccuuggacuca

SEQ ID NO: 460887 - RNA, 22 nt, Human
gcuuccugagaaacaaucugau

SEQ ID NO: 460888 - RNA, 22 nt, Human
gagaggucaucucccaucagca

SEQ ID NO: 460889 - RNA, 22 nt, Human
ugggaccugaagcagguuggca

SEQ ID NO: 460890 - RNA, 21 nt, Human
gaggccacuaauaggggcaga

SEQ ID NO: 460891 - RNA, 22 nt, Human
cugcucugcagcuuggacuccc

SEQ ID NO: 460892 - RNA, 22 nt, Human
guggcugguuuccugcaugcaa

SEQ ID NO: 460893 - RNA, 22 nt, Human
ucacagugagccaugucagaga

SEQ ID NO: 460894 - RNA, 22 nt, Human
uccaggcaucccccaggacaga

SEQ ID NO: 460895 - RNA, 22 nt, Human
guccagggcuaaaucagguucc

SEQ ID NO: 460896 - RNA, 22 nt, Human
uacuguacugcaguucugcaaa

SEQ ID NO: 460897 - RNA, 22 nt, Human
cuuagggaauugggaggaugcc

SEQ ID NO: 460898 - RNA, 20 nt, Human
aagagcugacucacaguggu

SEQ ID NO: 460899 - RNA, 22 nt, Human
aagauuucagaguuugggggaa

SEQ ID NO: 460900 - RNA, 22 nt, Human
agaaggccuaacuugggggcaa

SEQ ID NO: 460901 - RNA, 22 nt, Human
ccacauuuuugauacucucacu

SEQ ID NO: 460902 - RNA, 22 nt, Human
ucacugggagaugugggaaggg

SEQ ID NO: 460903 - RNA, 21 nt, Human
agaaauguaucauucuuuucc

SEQ ID NO: 460904 - RNA, 22 nt, Human
gccagggaaacugcagaccagc

SEQ ID NO: 460905 - RNA, 22 nt, Human
uucaggauaguggugaguggca

SEQ ID NO: 460906 - RNA, 20 nt, Human
agacccuguguccuguggcc

SEQ ID NO: 460907 - RNA, 22 nt, Human
cucccucugucuuguccagaaa

SEQ ID NO: 460908 - RNA, 22 nt, Human
ggaggggccggcugccugccac

SEQ ID NO: 460909 - RNA, 22 nt, Human
cugacucccaaagaggacgcgu

SEQ ID NO: 460910 - RNA, 22 nt, Human
agaauaguggcaaugacugcac

SEQ ID NO: 460911 - RNA, 21 nt, Human
ccuauugaauauaggaagauu

SEQ ID NO: 460912 - RNA, 22 nt, Human
uuggaggcaaugggaaggaggc

SEQ ID NO: 460913 - RNA, 22 nt, Human
agugggcaggcagggugcgcag

SEQ ID NO: 460914 - RNA, 22 nt, Human
cgcugggcgccgaccugcuggc

SEQ ID NO: 460915 - RNA, 22 nt, Human
ggcaggcaggucuucauggccc

SEQ ID NO: 460916 - RNA, 18 nt, Human
agaguguucucagugaaa

SEQ ID NO: 460917 - RNA, 22 nt, Human
gcaggggaguggcaggcccgga

SEQ ID NO: 460918 - RNA, 22 nt, Human
auuuguaauuucuuaucugugu

SEQ ID NO: 460919 - RNA, 22 nt, Human
ucuuucagccacuuaccugucu

SEQ ID NO: 460920 - RNA, 22 nt, Human
acaagagauuaucuacagauga

SEQ ID NO: 460921 - RNA, 22 nt, Human
cucugguguccuuuagaauuua

SEQ ID NO: 460922 - RNA, 22 nt, Human
uuugggaacucuaucauggaaa

SEQ ID NO: 460923 - RNA, 22 nt, Human
caggcaggagccagggauucca

SEQ ID NO: 460924 - RNA, 22 nt, Human
cuggaaugccucccugucagag

SEQ ID NO: 460925 - RNA, 22 nt, Human
caaaugcuggcccugcuacuua

SEQ ID NO: 460926 - RNA, 23 nt, Human
aaggucacagaacuuagcaagcc

SEQ ID NO: 460927 - RNA, 22 nt, Human
uccuugaaaagaaugucuccau

SEQ ID NO: 460928 - RNA, 22 nt, Human
uuguaacagcuguuuauauagu

SEQ ID NO: 460929 - RNA, 22 nt, Human
uggcuggggccacaguuuuccu

SEQ ID NO: 460930 - RNA, 22 nt, Human
gggcacuggaggccaaggagcu

SEQ ID NO: 460931 - RNA, 22 nt, Human
uucauuccuucuguaccuugcc

SEQ ID NO: 460932 - RNA, 22 nt, Human
ugggcagggagcuggaaccaca

SEQ ID NO: 460933 - RNA, 22 nt, Human
cuggagugaagcuuauuuuuca

SEQ ID NO: 460934 - RNA, 22 nt, Human
cuccucccucuuugccacacau

SEQ ID NO: 460935 - RNA, 22 nt, Human
ggagccugcgggagcucccauu

SEQ ID NO: 460936 - RNA, 22 nt, Human
ucaggaggccaccaggaccugu

SEQ ID NO: 460937 - RNA, 22 nt, Human
gucaugccuggcuucuuagaca

SEQ ID NO: 460938 - RNA, 22 nt, Human
ccagcucugcagggccuggggu

SEQ ID NO: 460939 - RNA, 22 nt, Human
agcuguggcagcacuuuggagu

SEQ ID NO: 460940 - RNA, 22 nt, Human
caggcacugugcaagggucucg

SEQ ID NO: 460941 - RNA, 22 nt, Human
uggcucugugucucccagcagc

SEQ ID NO: 460942 - RNA, 22 nt, Human
cuggccugugggcugucuccgg

SEQ ID NO: 460943 - RNA, 17 nt, Human
aaguccagaguugagca

SEQ ID NO: 460944 - RNA, 22 nt, Human
agagcugcaccuaugcagaccu

SEQ ID NO: 460945 - RNA, 22 nt, Human
ggaaggaggggcaaagcaguuc

SEQ ID NO: 460946 - RNA, 22 nt, Human
agagccugucaauuguaaagag

SEQ ID NO: 460947 - RNA, 22 nt, Human
cccagacauaacagcagagagg

SEQ ID NO: 460948 - RNA, 22 nt, Human
gacauuucaaucucauuauggg

SEQ ID NO: 460949 - RNA, 22 nt, Human
agcaauauaaauguuggguaga

SEQ ID NO: 460950 - RNA, 22 nt, Human
gggugaggagcugccagucaug

SEQ ID NO: 460951 - RNA, 22 nt, Human
ucauucagguugggcaaguguc

SEQ ID NO: 460952 - RNA, 22 nt, Human
uuuuaaguuaauauaauugagg

SEQ ID NO: 460953 - RNA, 22 nt, Human
gcagccucaaacuccccagcuc

SEQ ID NO: 460954 - RNA, 20 nt, Human
uggcaggaauagggccagag

SEQ ID NO: 460955 - RNA, 22 nt, Human
uuggcucaggaccccugugacu

SEQ ID NO: 460956 - RNA, 22 nt, Human
cugccagguuggcgcucgcucu

SEQ ID NO: 460957 - RNA, 22 nt, Human
ugucacauguguggcauuuuuc

SEQ ID NO: 460958 - RNA, 22 nt, Human
ccagcccugccucucagggccc

SEQ ID NO: 460959 - RNA, 22 nt, Human
gcuccucuucucccacugaaug

SEQ ID NO: 460960 - RNA, 22 nt, Human
acccagagccagggucaggagc

SEQ ID NO: 460961 - RNA, 18 nt, Human
uggacaggguggagaaaa

SEQ ID NO: 460962 - RNA, 22 nt, Human
cagcauggggaucacuguaggc

SEQ ID NO: 460963 - RNA, 22 nt, Human
uaugcacauauaaccugcacug

SEQ ID NO: 460964 - RNA, 22 nt, Human
ucaguggagagcuuccaggauu

SEQ ID NO: 460965 - RNA, 22 nt, Human
ugggcagagucauacaggagac

SEQ ID NO: 460966 - RNA, 22 nt, Human
caguguggugagauuccaggug

SEQ ID NO: 460967 - RNA, 22 nt, Human
agggucaggagacacuggcaac

SEQ ID NO: 460968 - RNA, 22 nt, Human
auggccuggggagcaugggaag

SEQ ID NO: 460969 - RNA, 22 nt, Human
ccagagagcuacaaggcauaaa

SEQ ID NO: 460970 - RNA, 22 nt, Human
aaagacuagcauuuauauguac

SEQ ID NO: 460971 - RNA, 22 nt, Human
gcagccacagaggagggaugca

SEQ ID NO: 460972 - RNA, 22 nt, Human
cuacccagcaccuaggcugccu

SEQ ID NO: 460973 - RNA, 22 nt, Human
ucauacaucuuguauaucuauc

SEQ ID NO: 460974 - RNA, 22 nt, Human
aaagccagaguguguuagagac

SEQ ID NO: 460975 - RNA, 22 nt, Human
agacaaaggauuaaugaugaug

SEQ ID NO: 460976 - RNA, 22 nt, Human
aguccagugucaaggugccauu

SEQ ID NO: 460977 - RNA, 22 nt, Human
uagaaauguugguauuaacauu

SEQ ID NO: 460978 - RNA, 22 nt, Human
cccagggacagaugggcagcua

SEQ ID NO: 460979 - RNA, 22 nt, Human
gcucaggagcugacagccucaa

SEQ ID NO: 460980 - RNA, 23 nt, Human
uggagcugggcucagacccuggg

SEQ ID NO: 460981 - RNA, 22 nt, Human
uaguaugggaagaacuuuguag

SEQ ID NO: 460982 - RNA, 22 nt, Human
guuuucauuacugcugugauuu

SEQ ID NO: 460983 - RNA, 22 nt, Human
uuguacaaaggauuuggaagag

SEQ ID NO: 460984 - RNA, 22 nt, Human
uucagagagaccaaguggcgug

SEQ ID NO: 460985 - RNA, 22 nt, Human
gcaguguuuacauauuagaaac

SEQ ID NO: 460986 - RNA, 22 nt, Human
cagggcagcuuccuuuguuagg

SEQ ID NO: 460987 - RNA, 22 nt, Human
uuccucucaacaugccugccgg

SEQ ID NO: 460988 - RNA, 22 nt, Human
guaucuuuccacaucuucagua

SEQ ID NO: 460989 - RNA, 22 nt, Human
ccucuggcaacuucacagccca

SEQ ID NO: 460990 - RNA, 22 nt, Human
uagccaggcgaggucagugucg

SEQ ID NO: 460991 - RNA, 22 nt, Human
uccugucugcucacagagcugg

SEQ ID NO: 460992 - RNA, 22 nt, Human
acauugaucagccucccaugca

SEQ ID NO: 460993 - RNA, 22 nt, Human
uagggcuccacucccagagauu

SEQ ID NO: 460994 - RNA, 22 nt, Human
cagcaggcagccauuucacugu

SEQ ID NO: 460995 - RNA, 22 nt, Human
gggaggugauggcaagcagcgg

SEQ ID NO: 460996 - RNA, 22 nt, Human
gcugcagcuuuaggauccagug

SEQ ID NO: 460997 - RNA, 19 nt, Human
acucaagucuaaugaaauc

SEQ ID NO: 460998 - RNA, 22 nt, Human
uauuuauaaucugccaaagaga

SEQ ID NO: 460999 - RNA, 22 nt, Human
ugucucugauaaguaguucagu

SEQ ID NO: 461000 - RNA, 22 nt, Human
uuauugccugauugaggucauu

SEQ ID NO: 461001 - RNA, 20 nt, Human
uugcagcagugaggugaagg

SEQ ID NO: 461002 - RNA, 22 nt, Human
ggcagagguagcuggaaccagg

SEQ ID NO: 461003 - RNA, 22 nt, Human
cuguggcuaggaagcuguggga

SEQ ID NO: 461004 - RNA, 22 nt, Human
auguagagcaguguuguccaau

SEQ ID NO: 461005 - RNA, 22 nt, Human
gacacauagaucuaucucacuc

SEQ ID NO: 461006 - RNA, 22 nt, Human
uuuaguaaguucacugcaaagc

SEQ ID NO: 461007 - RNA, 22 nt, Human
uuccauauuuguguggcaaaag

SEQ ID NO: 461008 - RNA, 22 nt, Human
auccccagaaaauaggugccua

SEQ ID NO: 461009 - RNA, 22 nt, Human
augagcugggccauccagugau

SEQ ID NO: 461010 - RNA, 22 nt, Human
uguggccuccccacuucugggg

SEQ ID NO: 461011 - RNA, 22 nt, Human
auucauuuagguauucacuuac

SEQ ID NO: 461012 - RNA, 17 nt, Human
acacagccagguucucc

SEQ ID NO: 461013 - RNA, 18 nt, Human
cugcugcaggcacucagg

SEQ ID NO: 461014 - RNA, 22 nt, Human
aggccuccugcagggaugagug

SEQ ID NO: 461015 - RNA, 18 nt, Human
gcugucugaggucugagg

SEQ ID NO: 461016 - RNA, 22 nt, Human
aggccaaguagcuagcauugaa

SEQ ID NO: 461017 - RNA, 17 nt, Human
ccucacagggaccagac

SEQ ID NO: 461018 - RNA, 22 nt, Human
gugauuucagguuuuucauacu

SEQ ID NO: 461019 - RNA, 22 nt, Human
caguauguuugggagacaugac

SEQ ID NO: 461020 - RNA, 22 nt, Human
uagcugccuagacagcuauagc

SEQ ID NO: 461021 - RNA, 22 nt, Human
accuggagucauuugaggagua

SEQ ID NO: 461022 - RNA, 22 nt, Human
ugagaggccccagcucuuggcc

SEQ ID NO: 461023 - RNA, 22 nt, Human
cugcucuggucucuucauguuu

SEQ ID NO: 461024 - RNA, 22 nt, Human
aagugauuucugccugcauguu

SEQ ID NO: 461025 - RNA, 22 nt, Human
acaguggaauggugggccugca

SEQ ID NO: 461026 - RNA, 22 nt, Human
uuaacagacauauauauuugua

SEQ ID NO: 461027 - RNA, 22 nt, Human
ugaagcagcuucuuucugucaa

SEQ ID NO: 461028 - RNA, 22 nt, Human
caucaguguggcaguucacugu

SEQ ID NO: 461029 - RNA, 22 nt, Human
agaaauguauagugaauuuuuc

SEQ ID NO: 461030 - RNA, 22 nt, Human
gaaggccacaaaaaaugucaua

SEQ ID NO: 461031 - RNA, 22 nt, Human
agaggcugcacuugcucaugau

SEQ ID NO: 461032 - RNA, 23 nt, Human
ugggucagcugccuccaggacaa

SEQ ID NO: 461033 - RNA, 19 nt, Human
ggccaggcugacugugguc

SEQ ID NO: 461034 - RNA, 19 nt, Human
gcuguauuaaagauacaug

SEQ ID NO: 461035 - RNA, 22 nt, Human
ccagguguaggacaccaaggga

SEQ ID NO: 461036 - RNA, 22 nt, Human
uggcagcacuugaacuugagcc

SEQ ID NO: 461037 - RNA, 22 nt, Human
ggcugcuugcuguuucuuggau

SEQ ID NO: 461038 - RNA, 22 nt, Human
uggcugggcccccaccugccuc

SEQ ID NO: 461039 - RNA, 22 nt, Human
ugaaggccagcagagugaaggc

SEQ ID NO: 461040 - RNA, 22 nt, Human
caggcagcccugcaccaagugu

SEQ ID NO: 461041 - RNA, 22 nt, Human
aggccugacuugaauuuagggc

SEQ ID NO: 461042 - RNA, 22 nt, Human
cuggccaguuguccuggcuugg

SEQ ID NO: 461043 - RNA, 22 nt, Human
gcaucuuucuguccauucagca

SEQ ID NO: 461044 - RNA, 22 nt, Human
augccuggacugacaugcacug

SEQ ID NO: 461045 - RNA, 19 nt, Human
ucaguggaugaacauguuu

SEQ ID NO: 461046 - RNA, 22 nt, Human
accuuucauuaaagucuguagu

SEQ ID NO: 461047 - RNA, 22 nt, Human
ucaggggcuugaggugcauguc

SEQ ID NO: 461048 - RNA, 22 nt, Human
agauacaucauuuauaccuuca

SEQ ID NO: 461049 - RNA, 22 nt, Human
cugugccuggggggcagagcug

SEQ ID NO: 461050 - RNA, 22 nt, Human
ggagaugccagaauugcaaauu

SEQ ID NO: 461051 - RNA, 22 nt, Human
cacugccuggaaggagagacau

SEQ ID NO: 461052 - RNA, 22 nt, Human
uuuauuuggcauccagggagaa

SEQ ID NO: 461053 - RNA, 22 nt, Human
uggcugaggcacagcugccgcc

SEQ ID NO: 461054 - RNA, 22 nt, Human
caaugugguggcagaugucagu

SEQ ID NO: 461055 - RNA, 22 nt, Human
uauuucuguaugcauaaaagga

SEQ ID NO: 461056 - RNA, 22 nt, Human
ucaucuucuauuaauagggaga

SEQ ID NO: 461057 - RNA, 22 nt, Human
ccagaccacccuggccaugcac

SEQ ID NO: 461058 - RNA, 22 nt, Human
ucaagauaccaccauuauaugu

SEQ ID NO: 461059 - RNA, 22 nt, Human
uccaaaaaacguuugaauaguu

SEQ ID NO: 461060 - RNA, 19 nt, Human
cuccucagucccagagguc

SEQ ID NO: 461061 - RNA, 22 nt, Human
cuggagccauguauagccuaug

SEQ ID NO: 461062 - RNA, 22 nt, Human
gggugaagcuccugcaggggcc

SEQ ID NO: 461063 - RNA, 18 nt, Human
gggcuguguucaugccca

SEQ ID NO: 461064 - RNA, 22 nt, Human
gcuucauuacugacagucugug

SEQ ID NO: 461065 - RNA, 22 nt, Human
cagggcuguggcuuugugcugu

SEQ ID NO: 461066 - RNA, 22 nt, Human
gaggaagccccauugaagccag

SEQ ID NO: 461067 - RNA, 22 nt, Human
aauuuggcagugucuugaagua

SEQ ID NO: 461068 - RNA, 18 nt, Human
gagcccugagucugcaca

SEQ ID NO: 461069 - RNA, 22 nt, Human
uucugcaggagcccuaguguau

SEQ ID NO: 461070 - RNA, 22 nt, Human
ccagcagagggucuuggccauu

SEQ ID NO: 461071 - RNA, 22 nt, Human
aggcaguuucugggacagcaua

SEQ ID NO: 461072 - RNA, 22 nt, Human
ugggcucugcugcguaccaguu

SEQ ID NO: 461073 - RNA, 22 nt, Human
uccguauuugacuauugcaccg

SEQ ID NO: 461074 - RNA, 22 nt, Human
gcagggacaccuuugugaagcu

SEQ ID NO: 461075 - RNA, 22 nt, Human
agguggccggugccagccgggc

SEQ ID NO: 461076 - RNA, 21 nt, Human
ugcagcagaguaagcagggga

SEQ ID NO: 461077 - RNA, 19 nt, Human
ucugccucuggucaggcuc

SEQ ID NO: 461078 - RNA, 22 nt, Human
caggugggagccacagcguaca

SEQ ID NO: 461079 - RNA, 22 nt, Human
acguguucaauuuccaucugac

SEQ ID NO: 461080 - RNA, 22 nt, Human
ugaaaucuuuaguuucuguccc

SEQ ID NO: 461081 - RNA, 22 nt, Human
uggggcagcagaccuuucuugg

SEQ ID NO: 461082 - RNA, 22 nt, Human
aucaggaaugaauacuuuugga

SEQ ID NO: 461083 - RNA, 22 nt, Human
uuuagggaauagaagaucugaa

SEQ ID NO: 461084 - RNA, 22 nt, Human
augggaggguggaaaggcucug

SEQ ID NO: 461085 - RNA, 22 nt, Human
caaaggcuuugcuaugaugcau

SEQ ID NO: 461086 - RNA, 22 nt, Human
gaggagaagcuauuggaaggac

SEQ ID NO: 461087 - RNA, 22 nt, Human
cuaaaauuaucaagauaauucc

SEQ ID NO: 461088 - RNA, 22 nt, Human
ccugucagaugaaguaauugug

SEQ ID NO: 461089 - RNA, 22 nt, Human
auuuucuauucugcugguuuag

SEQ ID NO: 461090 - RNA, 22 nt, Human
agagaggcugggcguagggcuu

SEQ ID NO: 461091 - RNA, 22 nt, Human
aggccagcaccagagucaagaa

SEQ ID NO: 461092 - RNA, 22 nt, Human
ucucaagaucucaagauggccc

SEQ ID NO: 461093 - RNA, 22 nt, Human
aggagagagcugagcuuugcug

SEQ ID NO: 461094 - RNA, 22 nt, Human
uccaggcauuggagagauaaug

SEQ ID NO: 461095 - RNA, 22 nt, Human
ucuugacauuguuguuagcagg

SEQ ID NO: 461096 - RNA, 22 nt, Human
cugggugaguugaugaaggaga

SEQ ID NO: 461097 - RNA, 21 nt, Human
agcagccauuucacagagacu

SEQ ID NO: 461098 - RNA, 22 nt, Human
uguuuuuccaugugcagaacaa

SEQ ID NO: 461099 - RNA, 20 nt, Human
uggggccuguuucugugguu

SEQ ID NO: 461100 - RNA, 22 nt, Human
aagggcuccacuugaaucacac

SEQ ID NO: 461101 - RNA, 22 nt, Human
uuccucaggcuucccuuugucc

SEQ ID NO: 461102 - RNA, 22 nt, Human
ucucccacugcaagcccaggcu

SEQ ID NO: 461103 - RNA, 22 nt, Human
ggcagcuccucucagcaaaaga

SEQ ID NO: 461104 - RNA, 22 nt, Human
ccucugcugcuguugagcaccg

SEQ ID NO: 461105 - RNA, 22 nt, Human
gccaggggacgcggagcgacga

SEQ ID NO: 461106 - RNA, 22 nt, Human
gccacaggcacuuaagggcugg

SEQ ID NO: 461107 - RNA, 22 nt, Human
uauuucaucuggaacaagguaa

SEQ ID NO: 461108 - RNA, 22 nt, Human
auuauuagacuuauaugguagu

SEQ ID NO: 461109 - RNA, 18 nt, Human
ugcuggcaacuacuauug

SEQ ID NO: 461110 - RNA, 22 nt, Human
aggagcugcagauucugccuug

SEQ ID NO: 461111 - RNA, 22 nt, Human
gugcaugucggggugcauguca

SEQ ID NO: 461112 - RNA, 22 nt, Human
gccugagaguugaaguucagug

SEQ ID NO: 461113 - RNA, 23 nt, Human
ugaugggaaggaacgacuaccac

SEQ ID NO: 461114 - RNA, 22 nt, Human
gaaaggagaggguuaaggagcu

SEQ ID NO: 461115 - RNA, 22 nt, Human
agagcuguucagcagccagguu

SEQ ID NO: 461116 - RNA, 22 nt, Human
ggccucaguuucuucaacugua

SEQ ID NO: 461117 - RNA, 23 nt, Human
ugcucugggaggcccuggagagc

SEQ ID NO: 461118 - RNA, 22 nt, Human
ucuuccucucuaauugaucaga

SEQ ID NO: 461119 - RNA, 22 nt, Human
gaaugcacucacccaucacuca

SEQ ID NO: 461120 - RNA, 22 nt, Human
ucuuuucuggacucugcaugga

SEQ ID NO: 461121 - RNA, 22 nt, Human
accaugaucugcucugguguuu

SEQ ID NO: 461122 - RNA, 22 nt, Human
ucagccagugccuugaucuugc

SEQ ID NO: 461123 - RNA, 22 nt, Human
acaugggaucaaugaggcaggc

SEQ ID NO: 461124 - RNA, 22 nt, Human
auuuguacaaauuuauguuagu

SEQ ID NO: 461125 - RNA, 22 nt, Human
ggccugagaaccauggggccaa

SEQ ID NO: 461126 - RNA, 22 nt, Human
ggaagagccuggggugucaggc

SEQ ID NO: 461127 - RNA, 22 nt, Human
aggcacugacucaagggagcca

SEQ ID NO: 461128 - RNA, 22 nt, Human
gugagcagaacagguggcuucu

SEQ ID NO: 461129 - RNA, 22 nt, Human
guggcagguuauaagcaucuca

SEQ ID NO: 461130 - RNA, 22 nt, Human
caggaggagcauuagcgucuca

SEQ ID NO: 461131 - RNA, 22 nt, Human
cacauguacagaagcaggcugg

SEQ ID NO: 461132 - RNA, 22 nt, Human
gagcugcagcggcugacgcaac

SEQ ID NO: 461133 - RNA, 22 nt, Human
aauuauauugaaguugaauguc

SEQ ID NO: 461134 - RNA, 22 nt, Human
ggaggccaccugaccugcuguu

SEQ ID NO: 461135 - RNA, 22 nt, Human
gcagccuguuguaccagccugu

SEQ ID NO: 461136 - RNA, 22 nt, Human
gucuugaucuccugaccuugug

SEQ ID NO: 461137 - RNA, 22 nt, Human
cacagaguggaggcuuggccug

SEQ ID NO: 461138 - RNA, 22 nt, Human
cagcuucuggcguggagccuga

SEQ ID NO: 461139 - RNA, 22 nt, Human
uaugcauauagaugcacacaca

SEQ ID NO: 461140 - RNA, 22 nt, Human
gaagaacugugacagaagcagu

SEQ ID NO: 461141 - RNA, 20 nt, Human
acaguggaaauugaugucug

SEQ ID NO: 461142 - RNA, 22 nt, Human
acagauugaucuugagaauuau

SEQ ID NO: 461143 - RNA, 22 nt, Human
acagaguuaauggauaggcagg

SEQ ID NO: 461144 - RNA, 22 nt, Human
cagucccuaguggagcucacag

SEQ ID NO: 461145 - RNA, 22 nt, Human
gaaggcugcugggaaguguggu

SEQ ID NO: 461146 - RNA, 22 nt, Human
cucaggaggccauucucaaggu

SEQ ID NO: 461147 - RNA, 22 nt, Human
gggcucucaugaguguguggua

SEQ ID NO: 461148 - RNA, 22 nt, Human
ccucagaggugaacaucagugc

SEQ ID NO: 461149 - RNA, 22 nt, Human
uccuugaauccuagcauccuau

SEQ ID NO: 461150 - RNA, 22 nt, Human
gaaggagaggauugugaggcug

SEQ ID NO: 461151 - RNA, 22 nt, Human
uguauacaggauuacucauagc

SEQ ID NO: 461152 - RNA, 19 nt, Human
ugucccagacuccgugucu

SEQ ID NO: 461153 - RNA, 22 nt, Human
ugaacauauucaccucuaaaua

SEQ ID NO: 461154 - RNA, 19 nt, Human
uggcuuccaucucucucau

SEQ ID NO: 461155 - RNA, 21 nt, Human
gcagaggaaugguauacauaa

SEQ ID NO: 461156 - RNA, 22 nt, Human
ggugucuguugccuccugguua

SEQ ID NO: 461157 - RNA, 22 nt, Human
gucucagaccacccucuuuggc

SEQ ID NO: 461158 - RNA, 22 nt, Human
gccuggagggauagaaugcaag

SEQ ID NO: 461159 - RNA, 22 nt, Human
uucuuuggggaauauucugguu

SEQ ID NO: 461160 - RNA, 22 nt, Human
cagcuuguuuuauuuggggacc

SEQ ID NO: 461161 - RNA, 22 nt, Human
uuacaaacaagaucuuauucuu

SEQ ID NO: 461162 - RNA, 22 nt, Human
ccagagaggcaaaacuccuucc

SEQ ID NO: 461163 - RNA, 22 nt, Human
uggcagggccuaccccaauauc

SEQ ID NO: 461164 - RNA, 22 nt, Human
aggcucagggacucccucccuc

SEQ ID NO: 461165 - RNA, 22 nt, Human
aauuagggaaguauuuaguagu

SEQ ID NO: 461166 - RNA, 22 nt, Human
cugggacuuuacccuguggccc

SEQ ID NO: 461167 - RNA, 22 nt, Human
ggcagcuccaaaaggaaacacu

SEQ ID NO: 461168 - RNA, 22 nt, Human
gcaggguaggugacagguaguc

SEQ ID NO: 461169 - RNA, 22 nt, Human
ccaggguuuaaauucugacuau

SEQ ID NO: 461170 - RNA, 22 nt, Human
caaagguauucucauuuuggaa

SEQ ID NO: 461171 - RNA, 22 nt, Human
uaauaaaugaaagugcuggcau

SEQ ID NO: 461172 - RNA, 22 nt, Human
ugagcccagagaucugagcuau

SEQ ID NO: 461173 - RNA, 17 nt, Human
gguucaguucugcauuc

SEQ ID NO: 461174 - RNA, 21 nt, Human
gaaggagaaagcaagugcugc

SEQ ID NO: 461175 - RNA, 22 nt, Human
caggaugguggcaugaucagaa

SEQ ID NO: 461176 - RNA, 19 nt, Human
ggcagacacaguugacaug

SEQ ID NO: 461177 - RNA, 22 nt, Human
uaucuauuccaaauaucagcgu

SEQ ID NO: 461178 - RNA, 22 nt, Human
gugcaggggccuccccuugcug

SEQ ID NO: 461179 - RNA, 22 nt, Human
aggagaguucacacuggucaga

SEQ ID NO: 461180 - RNA, 22 nt, Human
cagagugaaauaggggaucaag

SEQ ID NO: 461181 - RNA, 22 nt, Human
aaugggaaagagacuagaugcu

SEQ ID NO: 461182 - RNA, 22 nt, Human
gcugucuguggugucagcugac

SEQ ID NO: 461183 - RNA, 22 nt, Human
agccaggggauucaucagggac

SEQ ID NO: 461184 - RNA, 22 nt, Human
ugcugcacgauaaauaauuucu

SEQ ID NO: 461185 - RNA, 22 nt, Human
ggcagugagcuggagggaagga

SEQ ID NO: 461186 - RNA, 22 nt, Human
cauggcaggaggcugcuggcag

SEQ ID NO: 461187 - RNA, 22 nt, Human
ugggcugaaaugcuguggacua

SEQ ID NO: 461188 - RNA, 18 nt, Human
aaauguacuguccauggc

SEQ ID NO: 461189 - RNA, 19 nt, Human
uaaaaugucuguggucagu

SEQ ID NO: 461190 - RNA, 22 nt, Human
uuuaauuugaaaugaguaaccc

SEQ ID NO: 461191 - RNA, 22 nt, Human
cuucaagauccauagauauugc

SEQ ID NO: 461192 - RNA, 22 nt, Human
cauuuguuaauuacuauuaucu

SEQ ID NO: 461193 - RNA, 22 nt, Human
gccaggcuggccagcaccuucu

SEQ ID NO: 461194 - RNA, 22 nt, Human
uagcuuuaaaaaucaucaaagc

SEQ ID NO: 461195 - RNA, 22 nt, Human
uagaaaggauauugagaugaau

SEQ ID NO: 461196 - RNA, 22 nt, Human
caggcuugauuauucagacaau

SEQ ID NO: 461197 - RNA, 22 nt, Human
gaggccaaucaauagggcaaua

SEQ ID NO: 461198 - RNA, 22 nt, Human
uggcucaguggcagccgcagcu

SEQ ID NO: 461199 - RNA, 22 nt, Human
acuggcaguggcagcagaaaga

SEQ ID NO: 461200 - RNA, 22 nt, Human
uagcuuuaccauagaagaguau

SEQ ID NO: 461201 - RNA, 22 nt, Human
ugggaccuguuacauugaguua

SEQ ID NO: 461202 - RNA, 22 nt, Human
aacaaaugaccugauuucuucc

SEQ ID NO: 461203 - RNA, 22 nt, Human
agcccagcagaaaguccagccu

SEQ ID NO: 461204 - RNA, 22 nt, Human
auaugaagaauuccaauuugga

SEQ ID NO: 461205 - RNA, 22 nt, Human
gcaaggaccuuugagcgugcca

SEQ ID NO: 461206 - RNA, 19 nt, Human
aggcagcacccaguccuug

SEQ ID NO: 461207 - RNA, 22 nt, Human
aacauugccaugguuaauuuua

SEQ ID NO: 461208 - RNA, 22 nt, Human
uggcccugacacgugguacugg

SEQ ID NO: 461209 - RNA, 22 nt, Human
uggcaggagacacauggcauag

SEQ ID NO: 461210 - RNA, 22 nt, Human
agugggaggcggcugacgggcg

SEQ ID NO: 461211 - RNA, 22 nt, Human
agggauguaaauucuucuucuu

SEQ ID NO: 461212 - RNA, 22 nt, Human
gcugcuccgucugagcucuggu

SEQ ID NO: 461213 - RNA, 22 nt, Human
ugccaggcuuuggucaaaggcu

SEQ ID NO: 461214 - RNA, 22 nt, Human
agggcuguuuuuggcaccuggg

SEQ ID NO: 461215 - RNA, 22 nt, Human
ggagccagagucugcaguguaa

SEQ ID NO: 461216 - RNA, 22 nt, Human
agagcugaaaaagcugacccgg

SEQ ID NO: 461217 - RNA, 22 nt, Human
aaguggacuaauacaaggacua

SEQ ID NO: 461218 - RNA, 22 nt, Human
acagagcuaaauuucaauccca

SEQ ID NO: 461219 - RNA, 22 nt, Human
cuggcucuaucuccaaggcugg

SEQ ID NO: 461220 - RNA, 22 nt, Human
aguggcagagguugacugcagu

SEQ ID NO: 461221 - RNA, 22 nt, Human
uacagaagcugagacacugaga

SEQ ID NO: 461222 - RNA, 22 nt, Human
aaucuguucuacucuauucaga

SEQ ID NO: 461223 - RNA, 22 nt, Human
acacaggggaaaguggagcuga

SEQ ID NO: 461224 - RNA, 22 nt, Human
ggagugacucucggggccacua

SEQ ID NO: 461225 - RNA, 20 nt, Human
caggaggcaaggucaagguc

SEQ ID NO: 461226 - RNA, 22 nt, Human
uauuucuugaguggucaguuuc

SEQ ID NO: 461227 - RNA, 22 nt, Human
cagaagcauugacuccuugcuc

SEQ ID NO: 461228 - RNA, 22 nt, Human
cucucugguuucagcgaagggg

SEQ ID NO: 461229 - RNA, 22 nt, Human
guuuuuccuugcugaggacccg

SEQ ID NO: 461230 - RNA, 22 nt, Human
cuggcccagagagcagagcuua

SEQ ID NO: 461231 - RNA, 19 nt, Human
ggcauccagaacuaccagu

SEQ ID NO: 461232 - RNA, 18 nt, Human
uggcagagugucuguucu

SEQ ID NO: 461233 - RNA, 18 nt, Human
acugugguuuauguguag

SEQ ID NO: 461234 - RNA, 19 nt, Human
gagcugagaguagcacugg

SEQ ID NO: 461235 - RNA, 22 nt, Human
agcccaagcauaggagggaggc

SEQ ID NO: 461236 - RNA, 22 nt, Human
uaauuuuaacugugcuguuugg

SEQ ID NO: 461237 - RNA, 22 nt, Human
gugggccuugcagggugcaggg

SEQ ID NO: 461238 - RNA, 22 nt, Human
cuuauuuuaagucaguuugggu

SEQ ID NO: 461239 - RNA, 22 nt, Human
uauuuaaaaagaggccagcugg

SEQ ID NO: 461240 - RNA, 22 nt, Human
uuagaaaggaaucuucauuuca

SEQ ID NO: 461241 - RNA, 22 nt, Human
gcugagagcggccagcugggaa

SEQ ID NO: 461242 - RNA, 22 nt, Human
cagagcagggugcaccuugggc

SEQ ID NO: 461243 - RNA, 22 nt, Human
agucuccuuggccucaaugccu

SEQ ID NO: 461244 - RNA, 22 nt, Human
gaaugaauagguguccagaugg

SEQ ID NO: 461245 - RNA, 22 nt, Human
aucuggcuuucuuaaugacuua

SEQ ID NO: 461246 - RNA, 20 nt, Human
acagcagauaccacaacuau

SEQ ID NO: 461247 - RNA, 22 nt, Human
cagggcaguaccgcccucuggc

SEQ ID NO: 461248 - RNA, 22 nt, Human
agagugcaaccgaaacaagcag

SEQ ID NO: 461249 - RNA, 22 nt, Human
cugggcugucccaaccccaucc

SEQ ID NO: 461250 - RNA, 22 nt, Human
uggaggagaauuuauggucgaa

SEQ ID NO: 461251 - RNA, 22 nt, Human
caggcugggcagccuccccggc

SEQ ID NO: 461252 - RNA, 22 nt, Human
agggcagaaaccaccuugaugg

SEQ ID NO: 461253 - RNA, 22 nt, Human
ccacacugaaccucagugucuu

SEQ ID NO: 461254 - RNA, 22 nt, Human
cuggcucccagcuuucagggag

SEQ ID NO: 461255 - RNA, 22 nt, Human
ccagcuuuccaggguugacugg

SEQ ID NO: 461256 - RNA, 23 nt, Human
gacacaggagcacccagcugagc

SEQ ID NO: 461257 - RNA, 22 nt, Human
agcagugaaacagcugcauaug

SEQ ID NO: 461258 - RNA, 22 nt, Human
agggcugccauuucuggcccaa

SEQ ID NO: 461259 - RNA, 20 nt, Human
cacaggccuugugagcagac

SEQ ID NO: 461260 - RNA, 20 nt, Human
uuggcucugaucaguggagc

SEQ ID NO: 461261 - RNA, 22 nt, Human
gcugccucuguagcuuuggacc

SEQ ID NO: 461262 - RNA, 22 nt, Human
ugcagggaagcaaggguggcuc

SEQ ID NO: 461263 - RNA, 22 nt, Human
agagacaccgcgcaucauggcu

SEQ ID NO: 461264 - RNA, 22 nt, Human
gggaaggacauucugggcucag

SEQ ID NO: 461265 - RNA, 22 nt, Human
cuccccagguucaggagguggg

SEQ ID NO: 461266 - RNA, 22 nt, Human
uucuguuuacucagaaauacaa

SEQ ID NO: 461267 - RNA, 22 nt, Human
gccugagccgccugagcggcgg

SEQ ID NO: 461268 - RNA, 22 nt, Human
ucucagagaaaugugucaccau

SEQ ID NO: 461269 - RNA, 22 nt, Human
ugaaaucugucccacuuuagcu

SEQ ID NO: 461270 - RNA, 22 nt, Human
cugaggccuggugaggugguga

SEQ ID NO: 461271 - RNA, 22 nt, Human
cugccgagugggucaugaggca

SEQ ID NO: 461272 - RNA, 20 nt, Human
cugcuguguuauuguagaac

SEQ ID NO: 461273 - RNA, 22 nt, Human
gaaugugucacccugucccaug

SEQ ID NO: 461274 - RNA, 22 nt, Human
uccucagugcuagccaacugcc

SEQ ID NO: 461275 - RNA, 22 nt, Human
cacuguguaagaagaugggcuu

SEQ ID NO: 461276 - RNA, 22 nt, Human
cugugucggacgugggcagcag

SEQ ID NO: 461277 - RNA, 22 nt, Human
ucagucuucccuccagugcaac

SEQ ID NO: 461278 - RNA, 22 nt, Human
aggugauguccacagcuugcag

SEQ ID NO: 461279 - RNA, 22 nt, Human
agagacuggagaugggcagugu

SEQ ID NO: 461280 - RNA, 22 nt, Human
gggaucagaaacauagcccuga

SEQ ID NO: 461281 - RNA, 22 nt, Human
ggggaccugggcuucaaggguu

SEQ ID NO: 461282 - RNA, 22 nt, Human
aguggcaggaaaguggaagaga

SEQ ID NO: 461283 - RNA, 22 nt, Human
uccugaggaaaguucaugaaug

SEQ ID NO: 461284 - RNA, 22 nt, Human
uguguauuucuggaacagacua

SEQ ID NO: 461285 - RNA, 21 nt, Human
uggcagggguaguaguacagc

SEQ ID NO: 461286 - RNA, 22 nt, Human
uugacagcaaagauugugccua

SEQ ID NO: 461287 - RNA, 19 nt, Human
ccagagagcuagguacaga

SEQ ID NO: 461288 - RNA, 22 nt, Human
gcagcuggauuucaagagggag

SEQ ID NO: 461289 - RNA, 22 nt, Human
cuacaaaaguaauugugguuuu

SEQ ID NO: 461290 - RNA, 22 nt, Human
aaacuucauggauaauauaaag

SEQ ID NO: 461291 - RNA, 22 nt, Human
uuguaacacuuuucuauuaaua

SEQ ID NO: 461292 - RNA, 22 nt, Human
agagcagauggccagggggccu

SEQ ID NO: 461293 - RNA, 22 nt, Human
aagcuccccgaaacccaccucu

SEQ ID NO: 461294 - RNA, 22 nt, Human
ucccagcauaacaaacugcccg

SEQ ID NO: 461295 - RNA, 22 nt, Human
gccugcagaggugcugcuagcu

SEQ ID NO: 461296 - RNA, 22 nt, Human
uggagcaggacggggaguggua

SEQ ID NO: 461297 - RNA, 20 nt, Human
ucccaggcuccacccuagac

SEQ ID NO: 461298 - RNA, 22 nt, Human
ucugccuugagguccucagcuc

SEQ ID NO: 461299 - RNA, 22 nt, Human
ccaggcaggcuagaauguaaau

SEQ ID NO: 461300 - RNA, 22 nt, Human
ccauccuaucugaccuacuugu

SEQ ID NO: 461301 - RNA, 22 nt, Human
gcagagcagugcuugcccagcg

SEQ ID NO: 461302 - RNA, 22 nt, Human
aaggugucaccagauuggcagg

SEQ ID NO: 461303 - RNA, 22 nt, Human
uucacauaaugauacaaagcuu

SEQ ID NO: 461304 - RNA, 15 nt, Human
uccaggcauucauuc

SEQ ID NO: 461305 - RNA, 22 nt, Human
aaauuuucucucuaagacuuaa

SEQ ID NO: 461306 - RNA, 22 nt, Human
aaagaacaaaugauauaugguu

SEQ ID NO: 461307 - RNA, 19 nt, Human
aagcagcccuggcaagagc

SEQ ID NO: 461308 - RNA, 22 nt, Human
uccugcagcauccgucgucugu

SEQ ID NO: 461309 - RNA, 22 nt, Human
ugcucuggggagcuccucugcg

SEQ ID NO: 461310 - RNA, 22 nt, Human
ugccuuccuggagcugaaggcu

SEQ ID NO: 461311 - RNA, 22 nt, Human
aggggccucgcaggaccgcucc

SEQ ID NO: 461312 - RNA, 22 nt, Human
gcagauggugccaugucuugug

SEQ ID NO: 461313 - RNA, 22 nt, Human
ccaguggaguuuuuauacccag

SEQ ID NO: 461314 - RNA, 22 nt, Human
ucccagagauuuccucuccuuc

SEQ ID NO: 461315 - RNA, 22 nt, Human
agagggcuuugauucucaguuc

SEQ ID NO: 461316 - RNA, 22 nt, Human
uccagcagguccgagacaaguu

SEQ ID NO: 461317 - RNA, 22 nt, Human
uugaagcauuucuuugagcuuc

SEQ ID NO: 461318 - RNA, 22 nt, Human
gcaugagggggguuaggaaguu

SEQ ID NO: 461319 - RNA, 22 nt, Human
gcaggaugggagcuucacucug

SEQ ID NO: 461320 - RNA, 22 nt, Human
gggcucuggaaggugcaccaug

SEQ ID NO: 461321 - RNA, 19 nt, Human
auaaggcagugacuuuuuu

SEQ ID NO: 461322 - RNA, 22 nt, Human
ucccagagcucuggagguugga

SEQ ID NO: 461323 - RNA, 22 nt, Human
acauuugaggauguuaagaaug

SEQ ID NO: 461324 - RNA, 22 nt, Human
acuggcagccacaacuggcagg

SEQ ID NO: 461325 - RNA, 22 nt, Human
cuguccuaugaguacucacuag

SEQ ID NO: 461326 - RNA, 22 nt, Human
augcuguguccuagugaaagaa

SEQ ID NO: 461327 - RNA, 22 nt, Human
uacaagaugacaggugcaugau

SEQ ID NO: 461328 - RNA, 22 nt, Human
agcugcagauucuaucuagaag

SEQ ID NO: 461329 - RNA, 22 nt, Human
aaugggagagaacacaaagucc

SEQ ID NO: 461330 - RNA, 22 nt, Human
ucaggggcugugcauuucccag

SEQ ID NO: 461331 - RNA, 22 nt, Human
uugaauucauuucucauugagu

SEQ ID NO: 461332 - RNA, 20 nt, Human
gagauuuccaaucaugccca

SEQ ID NO: 461333 - RNA, 22 nt, Human
agauggggcucaguguggaggc

SEQ ID NO: 461334 - RNA, 22 nt, Human
aacaguaacgagauguccuaac

SEQ ID NO: 461335 - RNA, 22 nt, Human
ccagccuggagggcaguggugg

SEQ ID NO: 461336 - RNA, 22 nt, Human
auacaguauuaccuguucagga

SEQ ID NO: 461337 - RNA, 22 nt, Human
ugggggugugccagggaccucc

SEQ ID NO: 461338 - RNA, 22 nt, Human
guccaagagucaagaagggggc

SEQ ID NO: 461339 - RNA, 22 nt, Human
agcagggguaacagaaggaaag

SEQ ID NO: 461340 - RNA, 22 nt, Human
gccucugcaacuccgccuuggu

SEQ ID NO: 461341 - RNA, 22 nt, Human
cuccagugagcgcggggcaugg

SEQ ID NO: 461342 - RNA, 22 nt, Human
ucagggacagggugcugcugcg

SEQ ID NO: 461343 - RNA, 22 nt, Human
aggcugccucgugagcucgcug

SEQ ID NO: 461344 - RNA, 22 nt, Human
gcaggccuuggcaaugagccug

SEQ ID NO: 461345 - RNA, 22 nt, Human
ugccucagagugggcuugcuau

SEQ ID NO: 461346 - RNA, 22 nt, Human
aucaggauagugguuaccuggg

SEQ ID NO: 461347 - RNA, 22 nt, Human
ugacauuuaucaaagaaauggu

SEQ ID NO: 461348 - RNA, 22 nt, Human
uuugucagucaugucugcuuuu

SEQ ID NO: 461349 - RNA, 22 nt, Human
gagaaagcuucuuucccacagg

SEQ ID NO: 461350 - RNA, 22 nt, Human
uuaagucacuuaucuaaagaca

SEQ ID NO: 461351 - RNA, 22 nt, Human
ccuggcagcuguuuggcuuggc

SEQ ID NO: 461352 - RNA, 22 nt, Human
aguacuuugcacuuugcucaga

SEQ ID NO: 461353 - RNA, 22 nt, Human
accagugcuuccugcuggagcu

SEQ ID NO: 461354 - RNA, 22 nt, Human
aagauuuccuggauguaauucc

SEQ ID NO: 461355 - RNA, 22 nt, Human
agucucagggccacccggggaa

SEQ ID NO: 461356 - RNA, 22 nt, Human
acaugcuuucuagguccuucug

SEQ ID NO: 461357 - RNA, 22 nt, Human
ucucuggccgagagucccuggg

SEQ ID NO: 461358 - RNA, 19 nt, Human
gggcucuggccucaguggg

SEQ ID NO: 461359 - RNA, 20 nt, Human
gagccuuccccucaccacug

SEQ ID NO: 461360 - RNA, 22 nt, Human
ugccuaggaaaccucaugcuuc

SEQ ID NO: 461361 - RNA, 23 nt, Human
cugcagucgccggccugggugcc

SEQ ID NO: 461362 - RNA, 22 nt, Human
ucugccugagggagcugaggaa

SEQ ID NO: 461363 - RNA, 22 nt, Human
ugcucugguaacucacuuccau

SEQ ID NO: 461364 - RNA, 23 nt, Human
ugggcagcuucugcaugcccacc

SEQ ID NO: 461365 - RNA, 22 nt, Human
ucacugaauacuugucucaucc

SEQ ID NO: 461366 - RNA, 22 nt, Human
ucuccccaaaggacucacucuc

SEQ ID NO: 461367 - RNA, 22 nt, Human
uugcucugauuagguggaaaca

SEQ ID NO: 461368 - RNA, 22 nt, Human
aagaugcuuauugcuccugcag

SEQ ID NO: 461369 - RNA, 22 nt, Human
ucucaggguuuguacaagugua

SEQ ID NO: 461370 - RNA, 22 nt, Human
cuggcucaugugaugagggcaa

SEQ ID NO: 461371 - RNA, 22 nt, Human
ggccucucuccagucagugcag

SEQ ID NO: 461372 - RNA, 22 nt, Human
gcagcugcagguggucccaugc

SEQ ID NO: 461373 - RNA, 22 nt, Human
aaaggccaccaacaugaagcau

SEQ ID NO: 461374 - RNA, 22 nt, Human
ucagagagcuggugggcagagg

SEQ ID NO: 461375 - RNA, 22 nt, Human
gcugcccaguucugcugcugcc

SEQ ID NO: 461376 - RNA, 22 nt, Human
gccuggugaaaggcagagagcg

SEQ ID NO: 461377 - RNA, 22 nt, Human
agcagcucuggcacuguagcau

SEQ ID NO: 461378 - RNA, 22 nt, Human
ugcugccagagagacagggacu

SEQ ID NO: 461379 - RNA, 22 nt, Human
uggcagagagacucuccuugau

SEQ ID NO: 461380 - RNA, 22 nt, Human
uucuuuugggaauuacguaugc

SEQ ID NO: 461381 - RNA, 22 nt, Human
aagcccagaugugagaacugag

SEQ ID NO: 461382 - RNA, 22 nt, Human
gacagggcauggugcagaguuc

SEQ ID NO: 461383 - RNA, 22 nt, Human
uuaugacaggaaaaucacagaa

SEQ ID NO: 461384 - RNA, 22 nt, Human
caggcuugggagcagagccacu

SEQ ID NO: 461385 - RNA, 22 nt, Human
ugcugccauggucgcugguguc

SEQ ID NO: 461386 - RNA, 22 nt, Human
uccuucagggggccgccugcac

SEQ ID NO: 461387 - RNA, 22 nt, Human
agccucucuuucugguggcuaa

SEQ ID NO: 461388 - RNA, 22 nt, Human
uuauuagcugggcuucagggug

SEQ ID NO: 461389 - RNA, 22 nt, Human
gaaggcuugcagcucuguggca

SEQ ID NO: 461390 - RNA, 22 nt, Human
cagcaggguuaagugacucacc

SEQ ID NO: 461391 - RNA, 22 nt, Human
ugaaacagucuccagacuugga

SEQ ID NO: 461392 - RNA, 22 nt, Human
gccaggcaauguguuagaagcg

SEQ ID NO: 461393 - RNA, 22 nt, Human
ugggagaagcagcagccaagug

SEQ ID NO: 461394 - RNA, 19 nt, Human
gcuuuaguuuacucaucua

SEQ ID NO: 461395 - RNA, 22 nt, Human
ucugggagcacacgcagugauc

SEQ ID NO: 461396 - RNA, 22 nt, Human
cuggaaguauaggggagaugau

SEQ ID NO: 461397 - RNA, 22 nt, Human
gccuuggccuuccuaggccuga

SEQ ID NO: 461398 - RNA, 22 nt, Human
uccugcagcugauaaauacagu

SEQ ID NO: 461399 - RNA, 22 nt, Human
aggcccugggcaguucuguagc

SEQ ID NO: 461400 - RNA, 22 nt, Human
ccagggcuggguuugucggugu

SEQ ID NO: 461401 - RNA, 22 nt, Human
uuggcugaagguuaagugcugg

SEQ ID NO: 461402 - RNA, 22 nt, Human
agccauccuacuaccucagcau

SEQ ID NO: 461403 - RNA, 22 nt, Human
uccuucagcucucuauuuagau

SEQ ID NO: 461404 - RNA, 22 nt, Human
uaugcacaccuggguccuuguc

SEQ ID NO: 461405 - RNA, 22 nt, Human
uaggcucagggcugggugacgg

SEQ ID NO: 461406 - RNA, 22 nt, Human
ucuggcucuuugggugauugua

SEQ ID NO: 461407 - RNA, 22 nt, Human
aacuguucuucauuuucaguau

SEQ ID NO: 461408 - RNA, 22 nt, Human
uggcugaggagagggcggaagu

SEQ ID NO: 461409 - RNA, 22 nt, Human
ucuauuuuauacucaaaucuuc

SEQ ID NO: 461410 - RNA, 21 nt, Human
uccagaccucccucuccuagc

SEQ ID NO: 461411 - RNA, 22 nt, Human
gcugagcuagaaaaggaccaca

SEQ ID NO: 461412 - RNA, 22 nt, Human
ucaaugauaucagcaggaugug

SEQ ID NO: 461413 - RNA, 22 nt, Human
acacaggagauauguaauggcu

SEQ ID NO: 461414 - RNA, 22 nt, Human
cccugcagacgucuugaugccu

SEQ ID NO: 461415 - RNA, 22 nt, Human
gcugugcagccaagugccucug

SEQ ID NO: 461416 - RNA, 22 nt, Human
gcuguggcuguacagagaccau

SEQ ID NO: 461417 - RNA, 19 nt, Human
cuggaaugauagagaccuc

SEQ ID NO: 461418 - RNA, 22 nt, Human
aagugagauuauauguacggga

SEQ ID NO: 461419 - RNA, 19 nt, Human
acauuuagaauguacuugc

SEQ ID NO: 461420 - RNA, 22 nt, Human
uuuauauccaucuuugaaguaa

SEQ ID NO: 461421 - RNA, 16 nt, Human
aggcagagauuuaccc

SEQ ID NO: 461422 - RNA, 19 nt, Human
agggaaggauucugucauu

SEQ ID NO: 461423 - RNA, 22 nt, Human
cucaugauguagcgaaugagaa

SEQ ID NO: 461424 - RNA, 22 nt, Human
augcuuuuaugucacaugguca

SEQ ID NO: 461425 - RNA, 22 nt, Human
agcagcugagccccagcuguga

SEQ ID NO: 461426 - RNA, 22 nt, Human
agggggcaucagguccuggcuc

SEQ ID NO: 461427 - RNA, 20 nt, Human
uuuacauuuugaaacaguga

SEQ ID NO: 461428 - RNA, 22 nt, Human
cagcuuguuaccgagggagggu

SEQ ID NO: 461429 - RNA, 22 nt, Human
ugcucuggaguggcuugugcac

SEQ ID NO: 461430 - RNA, 22 nt, Human
cucugggcaggaccaguggacc

SEQ ID NO: 461431 - RNA, 22 nt, Human
uucagcagucguccaggaaaag

SEQ ID NO: 461432 - RNA, 22 nt, Human
ggucucagacuggcaggcagug

SEQ ID NO: 461433 - RNA, 22 nt, Human
ccaaaauuauuacauuuguagg

SEQ ID NO: 461434 - RNA, 22 nt, Human
aaauaauuauagcgagucuauc

SEQ ID NO: 461435 - RNA, 18 nt, Human
aggaaagaaaggcaggug

SEQ ID NO: 461436 - RNA, 21 nt, Human
gccaccucgucucggagcagc

SEQ ID NO: 461437 - RNA, 22 nt, Human
aggggcucaguuacuuuggcag

SEQ ID NO: 461438 - RNA, 20 nt, Human
uagauuucauacuucucuuu

SEQ ID NO: 461439 - RNA, 22 nt, Human
ugaagacacauacaagggaaug

SEQ ID NO: 461440 - RNA, 22 nt, Human
ccaguguucauaauuuuacacu

SEQ ID NO: 461441 - RNA, 22 nt, Human
ugcuuaaacccugaucaugugu

SEQ ID NO: 461442 - RNA, 22 nt, Human
ucagcugcucuguugagcugaa

SEQ ID NO: 461443 - RNA, 21 nt, Human
gcagacugcccugcugucccc

SEQ ID NO: 461444 - RNA, 20 nt, Human
uacauucaaaacaaacucug

SEQ ID NO: 461445 - RNA, 22 nt, Human
uacuuacagagcuuauaaguua

SEQ ID NO: 461446 - RNA, 22 nt, Human
gggacaggccccucgcuagcuu

SEQ ID NO: 461447 - RNA, 22 nt, Human
gaggugaguggaucacgagguc

SEQ ID NO: 461448 - RNA, 22 nt, Human
ugcagggccuugggaugugucc

SEQ ID NO: 461449 - RNA, 18 nt, Human
uccagcgugcuccagggc

SEQ ID NO: 461450 - RNA, 22 nt, Human
ccuggagcuuuuccauccugga

SEQ ID NO: 461451 - RNA, 22 nt, Human
uauuucuaagcuguaagucuga

SEQ ID NO: 461452 - RNA, 22 nt, Human
agcagcaacuuauuuuucuuau

SEQ ID NO: 461453 - RNA, 22 nt, Human
gagaggccaccugacgagcagu

SEQ ID NO: 461454 - RNA, 22 nt, Human
uugcauaaagauuuuauugcau

SEQ ID NO: 461455 - RNA, 22 nt, Human
cugccuuggaaaaugugguaau

SEQ ID NO: 461456 - RNA, 22 nt, Human
gcaggcagagaaggaacauuua

SEQ ID NO: 461457 - RNA, 22 nt, Human
ucaggggacuuaggagagaagu

SEQ ID NO: 461458 - RNA, 22 nt, Human
gccucugccaagggggcugcgg

SEQ ID NO: 461459 - RNA, 22 nt, Human
aaaaacugguaacuauucccca

SEQ ID NO: 461460 - RNA, 18 nt, Human
uccuccuuuggccuuuuc

SEQ ID NO: 461461 - RNA, 22 nt, Human
uguggcuuaagaaugccuuuaa

SEQ ID NO: 461462 - RNA, 23 nt, Human
ugccucugccucccuagucugca

SEQ ID NO: 461463 - RNA, 22 nt, Human
aagccacugagauuucacugca

SEQ ID NO: 461464 - RNA, 22 nt, Human
gcugcagcucgccuuccggccu

SEQ ID NO: 461465 - RNA, 22 nt, Human
ggcagaaggccucccagcuccu

SEQ ID NO: 461466 - RNA, 22 nt, Human
aggcagcagugauaagauagga

SEQ ID NO: 461467 - RNA, 22 nt, Human
cauggccuugagugacugcacu

SEQ ID NO: 461468 - RNA, 22 nt, Human
aagacauuacuggaaucugacu

SEQ ID NO: 461469 - RNA, 22 nt, Human
cuaggaggcgggggcugcagua

SEQ ID NO: 461470 - RNA, 22 nt, Human
agauguuccagccaaugggaau

SEQ ID NO: 461471 - RNA, 22 nt, Human
uuggccuuaaccucucugugcc

SEQ ID NO: 461472 - RNA, 22 nt, Human
ccaggcugcuuagccuuaucuu

SEQ ID NO: 461473 - RNA, 21 nt, Human
gggugcuguggucaugcagga

SEQ ID NO: 461474 - RNA, 22 nt, Human
ugggagcucagaaagggagguc

SEQ ID NO: 461475 - RNA, 22 nt, Human
ugucucaguucccuucucugga

SEQ ID NO: 461476 - RNA, 21 nt, Human
aguguccuugaucuugccuug

SEQ ID NO: 461477 - RNA, 22 nt, Human
uauucacaguugauuuacaguu

SEQ ID NO: 461478 - RNA, 22 nt, Human
gccagccugugcuuggccaggc

SEQ ID NO: 461479 - RNA, 22 nt, Human
aaggcagaaagggaugugagug

SEQ ID NO: 461480 - RNA, 22 nt, Human
uggcacugaccccaggccugug

SEQ ID NO: 461481 - RNA, 22 nt, Human
uuucuacaugucaauccaaacc

SEQ ID NO: 461482 - RNA, 22 nt, Human
ugccaaggagcuggaucagggc

SEQ ID NO: 461483 - RNA, 22 nt, Human
ugaugggaaaaugaggccuggg

SEQ ID NO: 461484 - RNA, 22 nt, Human
guggcugcuacagagcuggagg

SEQ ID NO: 461485 - RNA, 22 nt, Human
aagguacagaaauuaacaagga

SEQ ID NO: 461486 - RNA, 22 nt, Human
auacaaagacaaaucucaaucu

SEQ ID NO: 461487 - RNA, 22 nt, Human
gccugccuuuguaugacccuga

SEQ ID NO: 461488 - RNA, 22 nt, Human
ggaguuggugagcaccaggcuu

SEQ ID NO: 461489 - RNA, 22 nt, Human
aagagagagcauucuucuguua

SEQ ID NO: 461490 - RNA, 22 nt, Human
cgggcagcggcguggccauggu

SEQ ID NO: 461491 - RNA, 22 nt, Human
ugugacagaucuuuaaauaaug

SEQ ID NO: 461492 - RNA, 22 nt, Human
uggcuuccaaaggaaugggccu

SEQ ID NO: 461493 - RNA, 18 nt, Human
gggcaucauucacaaagu

SEQ ID NO: 461494 - RNA, 22 nt, Human
ucauugcagugauguuguaugu

SEQ ID NO: 461495 - RNA, 22 nt, Human
cacacuagucuauccauuagcu

SEQ ID NO: 461496 - RNA, 22 nt, Human
gcugaagcccacguggcuugua

SEQ ID NO: 461497 - RNA, 22 nt, Human
acagcuuuucaauucugcugag

SEQ ID NO: 461498 - RNA, 22 nt, Human
ucaggaaaauacugcuuaucca

SEQ ID NO: 461499 - RNA, 22 nt, Human
uccugccuaccuugcggaggug

SEQ ID NO: 461500 - RNA, 22 nt, Human
gauccuugcacuugacuuggca

SEQ ID NO: 461501 - RNA, 22 nt, Human
gauuuucugagccuucaaauuu

SEQ ID NO: 461502 - RNA, 22 nt, Human
agcagccauuuaaaaugaauug

SEQ ID NO: 461503 - RNA, 22 nt, Human
uaugugaauacagcaguggaug

SEQ ID NO: 461504 - RNA, 22 nt, Human
caucagcaggcaacacucuugg

SEQ ID NO: 461505 - RNA, 22 nt, Human
cugcagggagaggggacagccu

SEQ ID NO: 461506 - RNA, 22 nt, Human
uccuucagauuccugcuucugg

SEQ ID NO: 461507 - RNA, 22 nt, Human
uguacacugcaggaugcauugc

SEQ ID NO: 461508 - RNA, 22 nt, Human
ugugccagccucuggcuguguc

SEQ ID NO: 461509 - RNA, 22 nt, Human
agcugcugagccaggcugaugu

SEQ ID NO: 461510 - RNA, 22 nt, Human
acaggcagguugagaaacauuu

SEQ ID NO: 461511 - RNA, 22 nt, Human
gggcuccaacggugagcaugga

SEQ ID NO: 461512 - RNA, 22 nt, Human
guccucagggaauguggcgggu

SEQ ID NO: 461513 - RNA, 22 nt, Human
augguuuguguggcccagauga

SEQ ID NO: 461514 - RNA, 22 nt, Human
gggcugagccacagcuuuuguu

SEQ ID NO: 461515 - RNA, 22 nt, Human
aagcagaacugggaaguagugg

SEQ ID NO: 461516 - RNA, 22 nt, Human
agucaccaucuguggcagccug

SEQ ID NO: 461517 - RNA, 22 nt, Human
ggcaccuggagguuuacuggau

SEQ ID NO: 461518 - RNA, 22 nt, Human
cagacaugauguaagcagaggc

SEQ ID NO: 461519 - RNA, 22 nt, Human
ucccugcacagccgagccaugc

SEQ ID NO: 461520 - RNA, 22 nt, Human
ucaagagaaggggaaauagacu

SEQ ID NO: 461521 - RNA, 22 nt, Human
gcugccaguaguuggagcucca

SEQ ID NO: 461522 - RNA, 22 nt, Human
cagccaggagcucccccugcuc

SEQ ID NO: 461523 - RNA, 22 nt, Human
aagagcuggucacagguccauu

SEQ ID NO: 461524 - RNA, 22 nt, Human
uucucucauucaaauuaaagug

SEQ ID NO: 461525 - RNA, 22 nt, Human
gcugcccugucugcagcaggac

SEQ ID NO: 461526 - RNA, 22 nt, Human
gggaccuggucuagcacugagc

SEQ ID NO: 461527 - RNA, 22 nt, Human
aggcaggcaaccaccugggaag

SEQ ID NO: 461528 - RNA, 22 nt, Human
uggagaauucuauguugagggg

SEQ ID NO: 461529 - RNA, 21 nt, Human
uggcaggcagcuggaagcuug

SEQ ID NO: 461530 - RNA, 22 nt, Human
cuguuuucaaagagagagaaug

SEQ ID NO: 461531 - RNA, 23 nt, Human
agcuggaggcugucuacucccaa

SEQ ID NO: 461532 - RNA, 22 nt, Human
ucuucagauugcacugagcaag

SEQ ID NO: 461533 - RNA, 22 nt, Human
aagaugauaggacuugcuuaag

SEQ ID NO: 461534 - RNA, 22 nt, Human
uggcagagacaaggccgggccu

SEQ ID NO: 461535 - RNA, 22 nt, Human
ccagggcauccucacaucgcag

SEQ ID NO: 461536 - RNA, 22 nt, Human
ccuuuugcucucccauccagaa

SEQ ID NO: 461537 - RNA, 23 nt, Human
gugagcagcccacuaggaaugcc

SEQ ID NO: 461538 - RNA, 22 nt, Human
ccuggaguuuuuugguugacuc

SEQ ID NO: 461539 - RNA, 20 nt, Human
gcugaggucauuaugccuca

SEQ ID NO: 461540 - RNA, 22 nt, Human
ggccugcugcuaugacuuccug

SEQ ID NO: 461541 - RNA, 22 nt, Human
aaguuuaacuugaauucuuucu

SEQ ID NO: 461542 - RNA, 22 nt, Human
gcagcguggggcugagucagcu

SEQ ID NO: 461543 - RNA, 22 nt, Human
acaauucuggguauuuauauag

SEQ ID NO: 461544 - RNA, 22 nt, Human
uuaguuaguggggcugucaguc

SEQ ID NO: 461545 - RNA, 22 nt, Human
ggaccugcccuggcucagaugc

SEQ ID NO: 461546 - RNA, 22 nt, Human
uguuacaauauuaucaacugag

SEQ ID NO: 461547 - RNA, 22 nt, Human
gccuugccucagccauggaaac

SEQ ID NO: 461548 - RNA, 22 nt, Human
gagugugggcacgggggccuug

SEQ ID NO: 461549 - RNA, 23 nt, Human
agaguccacaagauuuuccagug

SEQ ID NO: 461550 - RNA, 22 nt, Human
uggcugagcugcagcguggcuu

SEQ ID NO: 461551 - RNA, 20 nt, Human
agugccagggcaggugagag

SEQ ID NO: 461552 - RNA, 22 nt, Human
ggcagugagucccggagaggcc

SEQ ID NO: 461553 - RNA, 22 nt, Human
gacacagcacuguacaaggaau

SEQ ID NO: 461554 - RNA, 22 nt, Human
cuccucacacccacugcaacca

SEQ ID NO: 461555 - RNA, 22 nt, Human
gcugugcuggaaggggaccugc

SEQ ID NO: 461556 - RNA, 22 nt, Human
ugccagcuccgaggagcugcag

SEQ ID NO: 461557 - RNA, 22 nt, Human
uccuugaacagagggccugggu

SEQ ID NO: 461558 - RNA, 22 nt, Human
agaggccagguccagaguuugu

SEQ ID NO: 461559 - RNA, 22 nt, Human
uccuuccucggggacccagauc

SEQ ID NO: 461560 - RNA, 22 nt, Human
ccugggcauucuuugaguucuc

SEQ ID NO: 461561 - RNA, 22 nt, Human
ggguuccuccaguuccuagagc

SEQ ID NO: 461562 - RNA, 22 nt, Human
acaaauuuauugaagggcauau

SEQ ID NO: 461563 - RNA, 22 nt, Human
guuacaaaggaagcuucacugc

SEQ ID NO: 461564 - RNA, 22 nt, Human
cagcuuugugcaaugcagucuc

SEQ ID NO: 461565 - RNA, 22 nt, Human
aggcagagcuggguuuugaaau

SEQ ID NO: 461566 - RNA, 22 nt, Human
cagagggcucuuggcugccugc

SEQ ID NO: 461567 - RNA, 22 nt, Human
ggcugcagaggcgaucugaggu

SEQ ID NO: 461568 - RNA, 18 nt, Human
caggucagccuggccuca

SEQ ID NO: 461569 - RNA, 22 nt, Human
gggcaguagcuucguaggcauc

SEQ ID NO: 461570 - RNA, 22 nt, Human
caugaaaaauuuacuguuaaca

SEQ ID NO: 461571 - RNA, 22 nt, Human
cacacaugagucuccccauugg

SEQ ID NO: 461572 - RNA, 19 nt, Human
uugcauuguaguuggacug

SEQ ID NO: 461573 - RNA, 22 nt, Human
ccagcagccaccuucucgaaau

SEQ ID NO: 461574 - RNA, 19 nt, Human
cauaauacaguggaucuga

SEQ ID NO: 461575 - RNA, 22 nt, Human
ucaggauaaaauguaauggcaa

SEQ ID NO: 461576 - RNA, 18 nt, Human
ccgggcuuuggugacaca

SEQ ID NO: 461577 - RNA, 22 nt, Human
aaggccugcucagcugucugug

SEQ ID NO: 461578 - RNA, 17 nt, Human
uucaagauauugaaaug

SEQ ID NO: 461579 - RNA, 22 nt, Human
uccaggcauguggccaguacuc

SEQ ID NO: 461580 - RNA, 22 nt, Human
ugucauuuaguccucugugugu

SEQ ID NO: 461581 - RNA, 22 nt, Human
uucaagaugucuucacaauagu

SEQ ID NO: 461582 - RNA, 23 nt, Human
ucagaaugcacugaauuuacccu

SEQ ID NO: 461583 - RNA, 22 nt, Human
cagggcucaucugugugaccag

SEQ ID NO: 461584 - RNA, 19 nt, Human
acaaagcugugagcagcuu

SEQ ID NO: 461585 - RNA, 22 nt, Human
gcacagcaauuucuauaagcuc

SEQ ID NO: 461586 - RNA, 22 nt, Human
agagcucaagacgcucacagua

SEQ ID NO: 461587 - RNA, 22 nt, Human
uugaagagugccuuccagacau

SEQ ID NO: 461588 - RNA, 22 nt, Human
ucugcucagugcuuaucucuaa

SEQ ID NO: 461589 - RNA, 22 nt, Human
ccuggcugccgagugugcagcg

SEQ ID NO: 461590 - RNA, 19 nt, Human
agcagagcagggccguggg

SEQ ID NO: 461591 - RNA, 22 nt, Human
aggcaggaacccugugugcgcc

SEQ ID NO: 461592 - RNA, 22 nt, Human
uaaaaguuuuaguuguacauaa

SEQ ID NO: 461593 - RNA, 19 nt, Human
cagaguacaccagauagga

SEQ ID NO: 461594 - RNA, 20 nt, Human
uccaggcagacagcuauggg

SEQ ID NO: 461595 - RNA, 22 nt, Human
aggcuggcuuggcucuccugug

SEQ ID NO: 461596 - RNA, 22 nt, Human
uacaguaucuucuggcaagcau

SEQ ID NO: 461597 - RNA, 22 nt, Human
caguagcaggcaggugcuuuug

SEQ ID NO: 461598 - RNA, 22 nt, Human
gcccuuccaacccagagggcaa

SEQ ID NO: 461599 - RNA, 22 nt, Human
acuccugggugcugaccagcgu

SEQ ID NO: 461600 - RNA, 22 nt, Human
agaggccggccgagcccauggg

SEQ ID NO: 461601 - RNA, 22 nt, Human
ugcagaagaccuuccagggcug

SEQ ID NO: 461602 - RNA, 19 nt, Human
agauggggaagagugugag

SEQ ID NO: 461603 - RNA, 22 nt, Human
uaaaucacuccuaauaaucagu

SEQ ID NO: 461604 - RNA, 22 nt, Human
uuucuucugagaucagggagaa

SEQ ID NO: 461605 - RNA, 22 nt, Human
aauuucaaacuaauaggaacca

SEQ ID NO: 461606 - RNA, 20 nt, Human
aaaguguaagcauauaauua

SEQ ID NO: 461607 - RNA, 22 nt, Human
ucagagaguccuggucauuugc

SEQ ID NO: 461608 - RNA, 22 nt, Human
ggucccugguucccucugagcu

SEQ ID NO: 461609 - RNA, 22 nt, Human
cugccagcagaggccagcgcug

SEQ ID NO: 461610 - RNA, 22 nt, Human
aaagcuuuucaguauguucaug

SEQ ID NO: 461611 - RNA, 22 nt, Human
gcccuuccuuagacagcaggau

SEQ ID NO: 461612 - RNA, 22 nt, Human
augcucugggcaggagcccugg

SEQ ID NO: 461613 - RNA, 21 nt, Human
ucucugggaggacuugugaga

SEQ ID NO: 461614 - RNA, 22 nt, Human
cugggacagcugagacaggaga

SEQ ID NO: 461615 - RNA, 22 nt, Human
agaccagcugccucccagggcc

SEQ ID NO: 461616 - RNA, 22 nt, Human
cuggagcaggcuugucccagcu

SEQ ID NO: 461617 - RNA, 21 nt, Human
aaaaugugagcgugaugcuua

SEQ ID NO: 461618 - RNA, 22 nt, Human
ugggcagaaaucaguaucagau

SEQ ID NO: 461619 - RNA, 23 nt, Human
ugagcccaggaggucaaggcugc

SEQ ID NO: 461620 - RNA, 22 nt, Human
gcagagcucaugccugcaccuc

SEQ ID NO: 461621 - RNA, 22 nt, Human
gcauggcagugaggauggugcu

SEQ ID NO: 461622 - RNA, 22 nt, Human
ggcagugacuguucagacgucc

SEQ ID NO: 461623 - RNA, 22 nt, Human
ggggccagguccagcuuccaaa

SEQ ID NO: 461624 - RNA, 22 nt, Human
augagacuaccuguaauguggc

SEQ ID NO: 461625 - RNA, 22 nt, Human
auggccugggcccgcuucagau

SEQ ID NO: 461626 - RNA, 22 nt, Human
gcugcaggagcuggagcugugg

SEQ ID NO: 461627 - RNA, 22 nt, Human
gucucaguuuuccaaacuguca

SEQ ID NO: 461628 - RNA, 22 nt, Human
gagcugcuggcuccucagguua

SEQ ID NO: 461629 - RNA, 22 nt, Human
gaaaucugucuuuguuugaaua

SEQ ID NO: 461630 - RNA, 23 nt, Human
aggugcagcccuggaccugcccc

SEQ ID NO: 461631 - RNA, 19 nt, Human
guuuuucccagacgaggca

SEQ ID NO: 461632 - RNA, 20 nt, Human
cagaggcauuuucagacucu

SEQ ID NO: 461633 - RNA, 22 nt, Human
aaggggaaaaaguguuaggagu

SEQ ID NO: 461634 - RNA, 22 nt, Human
gcucugucuucagcacacagua

SEQ ID NO: 461635 - RNA, 22 nt, Human
accugcagcuaaagauguaggg

SEQ ID NO: 461636 - RNA, 22 nt, Human
augaggcauucacagaaggcac

SEQ ID NO: 461637 - RNA, 22 nt, Human
gcagugaaaaagugcacccugu

SEQ ID NO: 461638 - RNA, 22 nt, Human
gcuggcagccaagugaagaggg

SEQ ID NO: 461639 - RNA, 22 nt, Human
uagagcuagcuucaaaaugcga

SEQ ID NO: 461640 - RNA, 22 nt, Human
uuucauugcagagucugugugc

SEQ ID NO: 461641 - RNA, 22 nt, Human
guaacacagaaaugaaauucca

SEQ ID NO: 461642 - RNA, 22 nt, Human
guauuuuacuuacgcaugacuu

SEQ ID NO: 461643 - RNA, 22 nt, Human
uuucucaaguucagauauuuga

SEQ ID NO: 461644 - RNA, 22 nt, Human
aggaugggccugggauaugcuu

SEQ ID NO: 461645 - RNA, 22 nt, Human
ucuuuccuguaacugcuguuca

SEQ ID NO: 461646 - RNA, 22 nt, Human
gcuuuguguagaaggaggaugg

SEQ ID NO: 461647 - RNA, 22 nt, Human
agggcucugagugggaaagagg

SEQ ID NO: 461648 - RNA, 22 nt, Human
cagcuggggcagccacgugcgg

SEQ ID NO: 461649 - RNA, 22 nt, Human
cauuuauuggcauguaguaggu

SEQ ID NO: 461650 - RNA, 22 nt, Human
aaaucacuaaguuauagugugg

SEQ ID NO: 461651 - RNA, 22 nt, Human
gggcuggaucuccugcaggcag

SEQ ID NO: 461652 - RNA, 22 nt, Human
ugaggcaguauucuccauucca

SEQ ID NO: 461653 - RNA, 17 nt, Human
ggaaaaggaugauacag

SEQ ID NO: 461654 - RNA, 22 nt, Human
agaaauguuuauggcugccuau

SEQ ID NO: 461655 - RNA, 22 nt, Human
cagcccugagaaggaggaucuc

SEQ ID NO: 461656 - RNA, 22 nt, Human
cggcuggguagaggugccgggu

SEQ ID NO: 461657 - RNA, 22 nt, Human
augcacuugcguguuugcaaau

SEQ ID NO: 461658 - RNA, 22 nt, Human
ugaaaaggguagaucccuaagu

SEQ ID NO: 461659 - RNA, 22 nt, Human
uuuaauuuucugggcccagcag

SEQ ID NO: 461660 - RNA, 22 nt, Human
auguuuaaucggcugccuuucc

SEQ ID NO: 461661 - RNA, 22 nt, Human
uuuacaaguuuacagaaugaug

SEQ ID NO: 461662 - RNA, 22 nt, Human
uuacauuagacccacuuucaug

SEQ ID NO: 461663 - RNA, 22 nt, Human
agcccuucaaccugccuacucc

SEQ ID NO: 461664 - RNA, 22 nt, Human
ggagcugcacgcucugaagccu

SEQ ID NO: 461665 - RNA, 22 nt, Human
gugccugguuuggggaguguuc

SEQ ID NO: 461666 - RNA, 22 nt, Human
agaugcugucacacacacuguu

SEQ ID NO: 461667 - RNA, 22 nt, Human
agucccagugagaugaaccagg

SEQ ID NO: 461668 - RNA, 22 nt, Human
ucucugguuauuaacuaacucc

SEQ ID NO: 461669 - RNA, 22 nt, Human
cagcagcuuugccaagucagcc

SEQ ID NO: 461670 - RNA, 22 nt, Human
caguacuuaguucucaugguuu

SEQ ID NO: 461671 - RNA, 22 nt, Human
cccagccucagcuuuacuucca

SEQ ID NO: 461672 - RNA, 22 nt, Human
gggcucagccccauugaaccag

SEQ ID NO: 461673 - RNA, 22 nt, Human
acacauuucuaaauuuuuaccg

SEQ ID NO: 461674 - RNA, 22 nt, Human
cuggcagcaguuaugaaacaau

SEQ ID NO: 461675 - RNA, 22 nt, Human
acagcagagacacucaggaggc

SEQ ID NO: 461676 - RNA, 22 nt, Human
ccauuuguucgcccagcuccaa

SEQ ID NO: 461677 - RNA, 22 nt, Human
ggcacugagcgggcucugagcg

SEQ ID NO: 461678 - RNA, 22 nt, Human
gugcucuccuggcugcccugac

SEQ ID NO: 461679 - RNA, 22 nt, Human
uugcugaauugaauccuuuggu

SEQ ID NO: 461680 - RNA, 22 nt, Human
uagcagcuuccagagagggcag

SEQ ID NO: 461681 - RNA, 22 nt, Human
acuuugcagggcuugauaucca

SEQ ID NO: 461682 - RNA, 22 nt, Human
aaacaugagcauuucuguuuaa

SEQ ID NO: 461683 - RNA, 22 nt, Human
gaggggcuggguagggcaaccc

SEQ ID NO: 461684 - RNA, 22 nt, Human
cugagaaggaagccuccacucu

SEQ ID NO: 461685 - RNA, 22 nt, Human
uguuuuauuucuccaagaggga

SEQ ID NO: 461686 - RNA, 22 nt, Human
gagccaggucgggccgcggcga

SEQ ID NO: 461687 - RNA, 22 nt, Human
aagcagccaccucaucuccacu

SEQ ID NO: 461688 - RNA, 22 nt, Human
ucucaguggcuuccucacuuuu

SEQ ID NO: 461689 - RNA, 22 nt, Human
uccaggcauagaaggcacgcac

SEQ ID NO: 461690 - RNA, 22 nt, Human
ugugccuuaugaauucuuucug

SEQ ID NO: 461691 - RNA, 22 nt, Human
gucccagggagguucagggcuu

SEQ ID NO: 461692 - RNA, 22 nt, Human
auugaaaggcaaaguaggaagc

SEQ ID NO: 461693 - RNA, 22 nt, Human
ggcccugugguuuugcaaaguc

SEQ ID NO: 461694 - RNA, 23 nt, Human
auaauaacgucugucuugucucu

SEQ ID NO: 461695 - RNA, 22 nt, Human
auccaguucucagugcuuacag

SEQ ID NO: 461696 - RNA, 22 nt, Human
cugcagagcagccaguccccca

SEQ ID NO: 461697 - RNA, 22 nt, Human
guccucugcccaggucaagguu

SEQ ID NO: 461698 - RNA, 22 nt, Human
uugaagcagcucaggaggcuua

SEQ ID NO: 461699 - RNA, 22 nt, Human
ccugucuguaucgguucagagu

SEQ ID NO: 461700 - RNA, 22 nt, Human
ccuggguggcagagguugcagu

SEQ ID NO: 461701 - RNA, 22 nt, Human
cagcucugcugggaggaugcag

SEQ ID NO: 461702 - RNA, 22 nt, Human
gcuggagccaagcugcucuugg

SEQ ID NO: 461703 - RNA, 22 nt, Human
aggcccagacucagcggggcgg

SEQ ID NO: 461704 - RNA, 22 nt, Human
cagucuggaggucagcuggcuu

SEQ ID NO: 461705 - RNA, 23 nt, Human
acagacaacacugaugagagaaa

SEQ ID NO: 461706 - RNA, 22 nt, Human
ugauuaacugucuauuaaucau

SEQ ID NO: 461707 - RNA, 22 nt, Human
acagggcaccugagguaggaag

SEQ ID NO: 461708 - RNA, 22 nt, Human
acagagcucccagccaucuccu

SEQ ID NO: 461709 - RNA, 22 nt, Human
ugccaggcaggacccuagaacc

SEQ ID NO: 461710 - RNA, 22 nt, Human
gcuuucucuucacugauguuca

SEQ ID NO: 461711 - RNA, 22 nt, Human
cuggccugaggccgccuucaga

SEQ ID NO: 461712 - RNA, 22 nt, Human
cugcccugucugcagccuggcu

SEQ ID NO: 461713 - RNA, 22 nt, Human
uauaacacucagaaagaaucau

SEQ ID NO: 461714 - RNA, 22 nt, Human
gagagucuagugcaccuaguuu

SEQ ID NO: 461715 - RNA, 22 nt, Human
ggaaagaccugagauaggaaua

SEQ ID NO: 461716 - RNA, 22 nt, Human
auugagaauccauuugagauga

SEQ ID NO: 461717 - RNA, 22 nt, Human
cuuccucccggcccaugcucug

SEQ ID NO: 461718 - RNA, 22 nt, Human
agguauuauuagcaucucuauu

SEQ ID NO: 461719 - RNA, 22 nt, Human
cacaaaaucuuucucgauuauu

SEQ ID NO: 461720 - RNA, 22 nt, Human
guccagggaaauagcgacaggg

SEQ ID NO: 461721 - RNA, 22 nt, Human
gcccucugcuggccucaccucg

SEQ ID NO: 461722 - RNA, 22 nt, Human
gcagagacuccacugucuugug

SEQ ID NO: 461723 - RNA, 22 nt, Human
uggagcagcuaagccucugaga

SEQ ID NO: 461724 - RNA, 22 nt, Human
ucuggagccacaaaccucagcu

SEQ ID NO: 461725 - RNA, 22 nt, Human
agggcagcagcccauggcucug

SEQ ID NO: 461726 - RNA, 21 nt, Human
uggcagagugcagucuauaca

SEQ ID NO: 461727 - RNA, 22 nt, Human
cccaucaggaacccaggagccc

SEQ ID NO: 461728 - RNA, 22 nt, Human
cuccaggagcugugucuuucuu

SEQ ID NO: 461729 - RNA, 22 nt, Human
cagcuggcguggagugauugca

SEQ ID NO: 461730 - RNA, 22 nt, Human
ggcuucuccagguacugagcau

SEQ ID NO: 461731 - RNA, 22 nt, Human
ccugaagaugcuguggccuggu

SEQ ID NO: 461732 - RNA, 22 nt, Human
gcugaaggcccggaggacaggg

SEQ ID NO: 461733 - RNA, 22 nt, Human
cucaggauagcugcgcagccug

SEQ ID NO: 461734 - RNA, 22 nt, Human
uccauuuuucaugacuccucaa

SEQ ID NO: 461735 - RNA, 22 nt, Human
uggcugggugcuauccaguacu

SEQ ID NO: 461736 - RNA, 22 nt, Human
ccuggaagauucaccacuacca

SEQ ID NO: 461737 - RNA, 22 nt, Human
ucuuagaaauuccccaguggcu

SEQ ID NO: 461738 - RNA, 22 nt, Human
ccucugagagaaggccuucagc

SEQ ID NO: 461739 - RNA, 22 nt, Human
aggcagcauuugaauccagguc

SEQ ID NO: 461740 - RNA, 23 nt, Human
agcaggaaaccgagggugauguu

SEQ ID NO: 461741 - RNA, 19 nt, Human
auuucaagagguuuauugg

SEQ ID NO: 461742 - RNA, 21 nt, Human
uggagcugccacuuguccucc

SEQ ID NO: 461743 - RNA, 22 nt, Human
ugcuuuauucagucucugccau

SEQ ID NO: 461744 - RNA, 22 nt, Human
gucccucugugucccugcaguc

SEQ ID NO: 461745 - RNA, 21 nt, Human
aaggagccuaggaggcucagg

SEQ ID NO: 461746 - RNA, 22 nt, Human
gagggcugcuggaaaaaugcag

SEQ ID NO: 461747 - RNA, 22 nt, Human
gagucaguaauggauaugucau

SEQ ID NO: 461748 - RNA, 22 nt, Human
ccuggccuuaagggcagggagc

SEQ ID NO: 461749 - RNA, 22 nt, Human
cacauggggcgcugcauuggcc

SEQ ID NO: 461750 - RNA, 20 nt, Human
aauguauauuuuaugccagg

SEQ ID NO: 461751 - RNA, 22 nt, Human
cauccugguuaccccauaguca

SEQ ID NO: 461752 - RNA, 22 nt, Human
ccuguggcacaugcagggauuc

SEQ ID NO: 461753 - RNA, 22 nt, Human
uuuuuggguccaggcuguaucu

SEQ ID NO: 461754 - RNA, 22 nt, Human
cagaacauuccaugugcccugc

SEQ ID NO: 461755 - RNA, 22 nt, Human
aaaguuagaaugauaucaacga

SEQ ID NO: 461756 - RNA, 22 nt, Human
cauuauggcagccaggauauug

SEQ ID NO: 461757 - RNA, 22 nt, Human
aacagcaugcuggguaacauug

SEQ ID NO: 461758 - RNA, 20 nt, Human
auacaaagagauugauguau

SEQ ID NO: 461759 - RNA, 22 nt, Human
aaaugcacagaaaggaugugga

SEQ ID NO: 461760 - RNA, 22 nt, Human
auuccaaagcacaucagaacua

SEQ ID NO: 461761 - RNA, 22 nt, Human
gggcugugcugaguaggaggug

SEQ ID NO: 461762 - RNA, 22 nt, Human
gcagguggauuaucagaagugc

SEQ ID NO: 461763 - RNA, 22 nt, Human
cugccucuggccucaggcccag

SEQ ID NO: 461764 - RNA, 22 nt, Human
aacagaaaagguagguggcuuu

SEQ ID NO: 461765 - RNA, 22 nt, Human
agcaaucaccaccucuauauuu

SEQ ID NO: 461766 - RNA, 21 nt, Human
ucacacacguuuccaagggca

SEQ ID NO: 461767 - RNA, 22 nt, Human
aggaagccaugguggacgucua

SEQ ID NO: 461768 - RNA, 16 nt, Human
gccuggaguggcaggg

SEQ ID NO: 461769 - RNA, 22 nt, Human
uuugaaaguucuucugacacua

SEQ ID NO: 461770 - RNA, 22 nt, Human
ugcugcauuuaucuucucaaac

SEQ ID NO: 461771 - RNA, 22 nt, Human
uccuguggucuggaaggaaugg

SEQ ID NO: 461772 - RNA, 22 nt, Human
gcuguggccaacaaaccacuuu

SEQ ID NO: 461773 - RNA, 22 nt, Human
uuccuuguuuguagcucuggga

SEQ ID NO: 461774 - RNA, 22 nt, Human
agaggaggcuggguccagauaa

SEQ ID NO: 461775 - RNA, 22 nt, Human
uuuagaaauugcagagugggug

SEQ ID NO: 461776 - RNA, 18 nt, Human
acagaaauagcugugccu

SEQ ID NO: 461777 - RNA, 22 nt, Human
uucaaagugcauguuccucaga

SEQ ID NO: 461778 - RNA, 22 nt, Human
accuuucaaaguggcuaucacu

SEQ ID NO: 461779 - RNA, 22 nt, Human
aaggcugagagucacaguccua

SEQ ID NO: 461780 - RNA, 22 nt, Human
gccaggcacaguucuaggugcu

SEQ ID NO: 461781 - RNA, 22 nt, Human
gccugcagacguguuuuccuca

SEQ ID NO: 461782 - RNA, 22 nt, Human
acugcccuguaacugccaggua

SEQ ID NO: 461783 - RNA, 22 nt, Human
agagccugcuaccucauuccag

SEQ ID NO: 461784 - RNA, 21 nt, Human
guggcccugguguggcugcac

SEQ ID NO: 461785 - RNA, 22 nt, Human
uuggaaggcccugccuagcagg

SEQ ID NO: 461786 - RNA, 22 nt, Human
ugccaggcucagccccuaucuu

SEQ ID NO: 461787 - RNA, 18 nt, Human
agucucagcggaggagua

SEQ ID NO: 461788 - RNA, 22 nt, Human
cugcucugacccuuucaccuuc

SEQ ID NO: 461789 - RNA, 22 nt, Human
caggagaagguuuggagugcag

SEQ ID NO: 461790 - RNA, 22 nt, Human
agcagggcucuguggagggugg

SEQ ID NO: 461791 - RNA, 22 nt, Human
cagagggcucaguccugcugga

SEQ ID NO: 461792 - RNA, 22 nt, Human
agcuguggggcaggcagcgagg

SEQ ID NO: 461793 - RNA, 22 nt, Human
ugucauugaggaaaacuaggug

SEQ ID NO: 461794 - RNA, 22 nt, Human
aauaccuuuccugccauucacu

SEQ ID NO: 461795 - RNA, 22 nt, Human
uuuucuaacaucuaguaauuug

SEQ ID NO: 461796 - RNA, 23 nt, Human
gugugccaagcacugugccagga

SEQ ID NO: 461797 - RNA, 22 nt, Human
uggagccuguguuucugcccag

SEQ ID NO: 461798 - RNA, 22 nt, Human
gcugucuggguugagggcccug

SEQ ID NO: 461799 - RNA, 22 nt, Human
gucaggauuaaugggaguaugc

SEQ ID NO: 461800 - RNA, 22 nt, Human
cugaggucucuuuccauaguga

SEQ ID NO: 461801 - RNA, 22 nt, Human
gcucagaaaagugaggcucagu

SEQ ID NO: 461802 - RNA, 18 nt, Human
aggcuucuuggcucaguc

SEQ ID NO: 461803 - RNA, 23 nt, Human
acuuuauugaccccaggucaguu

SEQ ID NO: 461804 - RNA, 22 nt, Human
agggaggaucugcuccuugucu

SEQ ID NO: 461805 - RNA, 20 nt, Human
aagcaauauagugcaaaugu

SEQ ID NO: 461806 - RNA, 22 nt, Human
uccagucucuacucugagauaa

SEQ ID NO: 461807 - RNA, 22 nt, Human
uaugcacaguuacaagaauauc

SEQ ID NO: 461808 - RNA, 22 nt, Human
ggcuucucgugccgaagcaaga

SEQ ID NO: 461809 - RNA, 22 nt, Human
gaucauuuugaugcccuuuuag

SEQ ID NO: 461810 - RNA, 22 nt, Human
aggcccuguccauggugcugaa

SEQ ID NO: 461811 - RNA, 22 nt, Human
gcaccugggacccagaggcacc

SEQ ID NO: 461812 - RNA, 22 nt, Human
accagccugucugagucguggg

SEQ ID NO: 461813 - RNA, 22 nt, Human
ugaggccagucucaucacaggc

SEQ ID NO: 461814 - RNA, 22 nt, Human
aauuucaauuacuuuugcacca

SEQ ID NO: 461815 - RNA, 23 nt, Human
uuaggcacuuaguagggccagag

SEQ ID NO: 461816 - RNA, 22 nt, Human
cauugacaguucuuuaaguugc

SEQ ID NO: 461817 - RNA, 22 nt, Human
cagcugaauucuucagacucca

SEQ ID NO: 461818 - RNA, 22 nt, Human
aggccagggucccacacucgca

SEQ ID NO: 461819 - RNA, 22 nt, Human
ccagagcccagggucaugcagg

SEQ ID NO: 461820 - RNA, 22 nt, Human
auacuguuuugugacuuaucuu

SEQ ID NO: 461821 - RNA, 22 nt, Human
aagccacuauggugauucucaa

SEQ ID NO: 461822 - RNA, 22 nt, Human
aggucaccauggcaugcuccac

SEQ ID NO: 461823 - RNA, 22 nt, Human
gaggcugcuuugaugacaggag

SEQ ID NO: 461824 - RNA, 22 nt, Human
gaggcugggaaguccaagacca

SEQ ID NO: 461825 - RNA, 22 nt, Human
aggucacccguuugacuaucca

SEQ ID NO: 461826 - RNA, 22 nt, Human
cagggcucagggacugcagaaa

SEQ ID NO: 461827 - RNA, 20 nt, Human
gagauggacagaugaagggg

SEQ ID NO: 461828 - RNA, 22 nt, Human
gagggucccugcucagggccag

SEQ ID NO: 461829 - RNA, 22 nt, Human
caggcagcugcgacaagagagc

SEQ ID NO: 461830 - RNA, 22 nt, Human
agccuccaucccaugcacaaag

SEQ ID NO: 461831 - RNA, 22 nt, Human
gcagugccuugcuucucugucu

SEQ ID NO: 461832 - RNA, 21 nt, Human
agcucagccgggcacaguggc

SEQ ID NO: 461833 - RNA, 20 nt, Human
aggccaggaaauguaguucu

SEQ ID NO: 461834 - RNA, 22 nt, Human
ggagcuggcuacagagaacucc

SEQ ID NO: 461835 - RNA, 22 nt, Human
agccagcuggugggucagcugg

SEQ ID NO: 461836 - RNA, 22 nt, Human
auucugucuuuuuaaaauaaua

SEQ ID NO: 461837 - RNA, 22 nt, Human
ucaaaguaaaaguauagaguuu

SEQ ID NO: 461838 - RNA, 22 nt, Human
gcagcugccgugagcucacgcc

SEQ ID NO: 461839 - RNA, 22 nt, Human
accauguuggccaagcuggucu

SEQ ID NO: 461840 - RNA, 22 nt, Human
ugcccaggcuccucgcagccuu

SEQ ID NO: 461841 - RNA, 22 nt, Human
cccaggaguaagugacauuguu

SEQ ID NO: 461842 - RNA, 19 nt, Human
caucuggaugauucuccug

SEQ ID NO: 461843 - RNA, 22 nt, Human
agggagcugcucugcuuccgug

SEQ ID NO: 461844 - RNA, 22 nt, Human
ugcagccaccaccucugcugaa

SEQ ID NO: 461845 - RNA, 22 nt, Human
uccaggcuaauuuugcauuguu

SEQ ID NO: 461846 - RNA, 22 nt, Human
gggcugcugcccaggaggcacc

SEQ ID NO: 461847 - RNA, 22 nt, Human
cugagaaaggaccucaaacagg

SEQ ID NO: 461848 - RNA, 22 nt, Human
caacagaagguguacuacugaa

SEQ ID NO: 461849 - RNA, 22 nt, Human
ccagcugguuaaaauagagaaa

SEQ ID NO: 461850 - RNA, 22 nt, Human
ugcuggaggcaguggaggugcc

SEQ ID NO: 461851 - RNA, 22 nt, Human
ucagagaguuagugucuuagcu

SEQ ID NO: 461852 - RNA, 22 nt, Human
acuugauuuugaaccuuucuac

SEQ ID NO: 461853 - RNA, 22 nt, Human
aucuggaauccuuguggacaau

SEQ ID NO: 461854 - RNA, 22 nt, Human
cuguacaucucugaggacagua

SEQ ID NO: 461855 - RNA, 22 nt, Human
gcucuggguagccacugccugg

SEQ ID NO: 461856 - RNA, 22 nt, Human
gccugccuggagcuugagguga

SEQ ID NO: 461857 - RNA, 22 nt, Human
acuugcauuauauuuaucacaa

SEQ ID NO: 461858 - RNA, 22 nt, Human
aguucaggcauaaggcaugaac

SEQ ID NO: 461859 - RNA, 22 nt, Human
cucccagguuccgacgccucuu

SEQ ID NO: 461860 - RNA, 22 nt, Human
uuccaaugacuaguggcauccu

SEQ ID NO: 461861 - RNA, 22 nt, Human
ggcagcuccuccuagucugccc

SEQ ID NO: 461862 - RNA, 22 nt, Human
ucacaugcucaccuaagccaca

SEQ ID NO: 461863 - RNA, 22 nt, Human
auuauguauuugguauaguuug

SEQ ID NO: 461864 - RNA, 21 nt, Human
cgcagagcgaacuugcggcgc

SEQ ID NO: 461865 - RNA, 22 nt, Human
ccugggcaauauagugaggccc

SEQ ID NO: 461866 - RNA, 17 nt, Human
acagggcagaaacagcu

SEQ ID NO: 461867 - RNA, 22 nt, Human
cuggcagcccaaccuagagucu

SEQ ID NO: 461868 - RNA, 22 nt, Human
agagccugaggaugucccagcu

SEQ ID NO: 461869 - RNA, 22 nt, Human
uuccuguauucuaaagggaaag

SEQ ID NO: 461870 - RNA, 22 nt, Human
ucucucagaggaagaggcagug

SEQ ID NO: 461871 - RNA, 22 nt, Human
acaaaauuuuuagacaaggcuu

SEQ ID NO: 461872 - RNA, 17 nt, Human
uagagcugguucaggag

SEQ ID NO: 461873 - RNA, 22 nt, Human
aaaguucagugccuucuauaca

SEQ ID NO: 461874 - RNA, 22 nt, Human
gaguucaguguuucuaguagug

SEQ ID NO: 461875 - RNA, 22 nt, Human
ugugccuucucaguccugcuca

SEQ ID NO: 461876 - RNA, 22 nt, Human
uuugcauuugcaaauaaugaaa

SEQ ID NO: 461877 - RNA, 22 nt, Human
cuccacagccccuccaguggca

SEQ ID NO: 461878 - RNA, 22 nt, Human
gaaagacauaguugcaagaugg

SEQ ID NO: 461879 - RNA, 23 nt, Human
uggcucucucagugcugcagagg

SEQ ID NO: 461880 - RNA, 22 nt, Human
acucuugucucaacuuuuguau

SEQ ID NO: 461881 - RNA, 22 nt, Human
uguucccauuuucugcauaauc

SEQ ID NO: 461882 - RNA, 22 nt, Human
uacaguaaccuuauuugucauu

SEQ ID NO: 461883 - RNA, 22 nt, Human
cccagcaguuguuggugcacau

SEQ ID NO: 461884 - RNA, 22 nt, Human
caggcuggagugcaguugugca

SEQ ID NO: 461885 - RNA, 22 nt, Human
agcaggagcccuuaucaccagg

SEQ ID NO: 461886 - RNA, 22 nt, Human
ggcuuuaugcagggauagaaau

SEQ ID NO: 461887 - RNA, 22 nt, Human
cuggauuuaauuaacuguugcu

SEQ ID NO: 461888 - RNA, 22 nt, Human
gucccaggugggcuccaccucu

SEQ ID NO: 461889 - RNA, 22 nt, Human
uuugaaagcaggugugggaggg

SEQ ID NO: 461890 - RNA, 22 nt, Human
caucccugcccucaugccuaua

SEQ ID NO: 461891 - RNA, 22 nt, Human
ugcagaagugagucaugaggaa

SEQ ID NO: 461892 - RNA, 22 nt, Human
agggcuccgggccaccggccug

SEQ ID NO: 461893 - RNA, 20 nt, Human
agcaggaaaagugccagucu

SEQ ID NO: 461894 - RNA, 22 nt, Human
cagccagcuucagauccaagcc

SEQ ID NO: 461895 - RNA, 22 nt, Human
auuuuacauaaggaagguuuaa

SEQ ID NO: 461896 - RNA, 22 nt, Human
ccagccuggacugggucuugug

SEQ ID NO: 461897 - RNA, 22 nt, Human
ugcacacacaugaaguagcaug

SEQ ID NO: 461898 - RNA, 22 nt, Human
ugcuggcugggcugcuggagac

SEQ ID NO: 461899 - RNA, 21 nt, Human
ugcuuuaugggaaaaauguca

SEQ ID NO: 461900 - RNA, 19 nt, Human
agcuggggcgguguguguu

SEQ ID NO: 461901 - RNA, 22 nt, Human
aggaguggaauuacuggguucu

SEQ ID NO: 461902 - RNA, 19 nt, Human
ucccagagucuagagguug

SEQ ID NO: 461903 - RNA, 22 nt, Human
gccugggagugcacagugaggu

SEQ ID NO: 461904 - RNA, 22 nt, Human
ugggccugggucuuugcugcca

SEQ ID NO: 461905 - RNA, 22 nt, Human
gcaaggcagcgcggaguagcua

SEQ ID NO: 461906 - RNA, 22 nt, Human
caaggagaaaacggcuucugaa

SEQ ID NO: 461907 - RNA, 22 nt, Human
ccuccagcugccucagucucuu

SEQ ID NO: 461908 - RNA, 22 nt, Human
uggagcaagcuggagagaacau

SEQ ID NO: 461909 - RNA, 22 nt, Human
ggcuguggacacugagcucaga

SEQ ID NO: 461910 - RNA, 22 nt, Human
ucauguuauugacucauaauau

SEQ ID NO: 461911 - RNA, 22 nt, Human
ggggauggaggcgugugguccu

SEQ ID NO: 461912 - RNA, 22 nt, Human
ugcaaaauaaugaacgauuuuu

SEQ ID NO: 461913 - RNA, 22 nt, Human
aaagguuaagguguucaagaaa

SEQ ID NO: 461914 - RNA, 22 nt, Human
accaggcaguauggugcugcaa

SEQ ID NO: 461915 - RNA, 22 nt, Human
gagcaggcucugccuguguguc

SEQ ID NO: 461916 - RNA, 22 nt, Human
uuuuccucugcagagcaguuag

SEQ ID NO: 461917 - RNA, 22 nt, Human
uucaacacaggaacaugauaua

SEQ ID NO: 461918 - RNA, 22 nt, Human
gaagaacaccugcugcccagug

SEQ ID NO: 461919 - RNA, 23 nt, Human
ccuggcagcaaacgaggagguua

SEQ ID NO: 461920 - RNA, 22 nt, Human
uuugugaaaugaagucacaacu

SEQ ID NO: 461921 - RNA, 23 nt, Human
cccauuuucauguuaacuccugg

SEQ ID NO: 461922 - RNA, 21 nt, Human
ugugucacuaacuagaggcua

SEQ ID NO: 461923 - RNA, 22 nt, Human
gccuggucucuuucaugucagu

SEQ ID NO: 461924 - RNA, 22 nt, Human
acaagaauguagauuaguuaag

SEQ ID NO: 461925 - RNA, 22 nt, Human
agagcagauggagcuggaagag

SEQ ID NO: 461926 - RNA, 22 nt, Human
ugcauuguaggauguuuagcag

SEQ ID NO: 461927 - RNA, 22 nt, Human
acagcugugagggucacuugua

SEQ ID NO: 461928 - RNA, 22 nt, Human
agacaucagcuugugugcaggg

SEQ ID NO: 461929 - RNA, 22 nt, Human
uguacaaugccagggaacacca

SEQ ID NO: 461930 - RNA, 22 nt, Human
ccuacacaucucaccucacagg

SEQ ID NO: 461931 - RNA, 22 nt, Human
ugcagccaucuuucuuggagga

SEQ ID NO: 461932 - RNA, 22 nt, Human
ccugccugucaucgccugcgcc

SEQ ID NO: 461933 - RNA, 22 nt, Human
cacaggccugucucuuucuaac

SEQ ID NO: 461934 - RNA, 22 nt, Human
gugucacaagagcccaggaaac

SEQ ID NO: 461935 - RNA, 22 nt, Human
auguacauuuuccuaauguuuu

SEQ ID NO: 461936 - RNA, 22 nt, Human
aauguguacuuuuucaugcuca

SEQ ID NO: 461937 - RNA, 22 nt, Human
uuauuuucagcuaggaaagcca

SEQ ID NO: 461938 - RNA, 22 nt, Human
aucaguuuggugcuuucaguga

SEQ ID NO: 461939 - RNA, 23 nt, Human
cccugcagucagggugagauggu

SEQ ID NO: 461940 - RNA, 18 nt, Human
ccugagcccugcuuacuu

SEQ ID NO: 461941 - RNA, 22 nt, Human
agguacagaugaaagucuaguu

SEQ ID NO: 461942 - RNA, 19 nt, Human
uccugggcugggccagguc

SEQ ID NO: 461943 - RNA, 22 nt, Human
cugagccaugagccugcgccca

SEQ ID NO: 461944 - RNA, 22 nt, Human
uugaaaggguuaaagugguaaa

SEQ ID NO: 461945 - RNA, 22 nt, Human
aucuuucaguuucauaccaauu

SEQ ID NO: 461946 - RNA, 22 nt, Human
gccccagccaaggugacacgaa

SEQ ID NO: 461947 - RNA, 21 nt, Human
ccugagccuguuuauccagaa

SEQ ID NO: 461948 - RNA, 23 nt, Human
ugggccuggccucccaguccagc

SEQ ID NO: 461949 - RNA, 22 nt, Human
cuggcucauuuuagcaucaggu

SEQ ID NO: 461950 - RNA, 22 nt, Human
accugaggcuguuagucuaggu

SEQ ID NO: 461951 - RNA, 22 nt, Human
uaaggcacuucaauguuuagaa

SEQ ID NO: 461952 - RNA, 22 nt, Human
gcagcuuuggagguggaacucu

SEQ ID NO: 461953 - RNA, 22 nt, Human
ccccagccagcaggaccucuga

SEQ ID NO: 461954 - RNA, 22 nt, Human
aguuauuucaguaacauaauag

SEQ ID NO: 461955 - RNA, 22 nt, Human
aggaaacuguccccucauccua

SEQ ID NO: 461956 - RNA, 22 nt, Human
cagugcaguugguggcaggggu

SEQ ID NO: 461957 - RNA, 22 nt, Human
cagcugggagcuccauuagaua

SEQ ID NO: 461958 - RNA, 22 nt, Human
cuucuuaaugcauaaacugugu

SEQ ID NO: 461959 - RNA, 22 nt, Human
aacagaauugcugcugccaaug

SEQ ID NO: 461960 - RNA, 22 nt, Human
agggcugguauguccaugaaag

SEQ ID NO: 461961 - RNA, 22 nt, Human
acugucuguccugcucuccgug

SEQ ID NO: 461962 - RNA, 22 nt, Human
gacccggcuccaggcccagcag

SEQ ID NO: 461963 - RNA, 22 nt, Human
guccucuuagccacuuaauuau

SEQ ID NO: 461964 - RNA, 19 nt, Human
ggcucagggcgcugccgcc

SEQ ID NO: 461965 - RNA, 22 nt, Human
aucagaagcuuguagucucucu

SEQ ID NO: 461966 - RNA, 22 nt, Human
gccugaaguuucaugccucuau

SEQ ID NO: 461967 - RNA, 22 nt, Human
agccauggcgccacuagaggga

SEQ ID NO: 461968 - RNA, 22 nt, Human
cccacacauuuuucacuuaccg

SEQ ID NO: 461969 - RNA, 22 nt, Human
caaagucagccagcuaguaggu

SEQ ID NO: 461970 - RNA, 22 nt, Human
agccucugcuggcccuggcacu

SEQ ID NO: 461971 - RNA, 23 nt, Human
ucagaggaucaucaaacguuuuc

SEQ ID NO: 461972 - RNA, 22 nt, Human
ggucagagggugggcugccugu

SEQ ID NO: 461973 - RNA, 22 nt, Human
aagggcuggagacugggucuuc

SEQ ID NO: 461974 - RNA, 22 nt, Human
agcugccagaugacagugcuau

SEQ ID NO: 461975 - RNA, 22 nt, Human
aaccaggacaauuugaauagaa

SEQ ID NO: 461976 - RNA, 17 nt, Human
cuggagccuccaacucc

SEQ ID NO: 461977 - RNA, 22 nt, Human
gaagagcugacagugucauccu

SEQ ID NO: 461978 - RNA, 22 nt, Human
cucaggauugugccuagggaga

SEQ ID NO: 461979 - RNA, 22 nt, Human
cugcuuuguguggucccuccag

SEQ ID NO: 461980 - RNA, 22 nt, Human
cuguguccucccgcugcaccca

SEQ ID NO: 461981 - RNA, 22 nt, Human
agggcucuguccccagaggccc

SEQ ID NO: 461982 - RNA, 22 nt, Human
ccaggagcaggagcuggacaga

SEQ ID NO: 461983 - RNA, 22 nt, Human
ccagggcugguggcugcagagg

SEQ ID NO: 461984 - RNA, 22 nt, Human
agccugugugcuuuggacaggg

SEQ ID NO: 461985 - RNA, 22 nt, Human
cuacauuuuaauaagcugcuua

SEQ ID NO: 461986 - RNA, 22 nt, Human
gcagcaggcacggucucgacau

SEQ ID NO: 461987 - RNA, 22 nt, Human
ccugggcuuucaaaaccagccu

SEQ ID NO: 461988 - RNA, 22 nt, Human
agcaggcuaagggaccuguuua

SEQ ID NO: 461989 - RNA, 22 nt, Human
gcacccaguuugucucaggguu

SEQ ID NO: 461990 - RNA, 22 nt, Human
uuuauucuugagagugagaaga

SEQ ID NO: 461991 - RNA, 22 nt, Human
uauguacaugauuucauuugcu

SEQ ID NO: 461992 - RNA, 21 nt, Human
uaaauaauaaguugcugagau

SEQ ID NO: 461993 - RNA, 22 nt, Human
uacagagacuuuauggcacaaa

SEQ ID NO: 461994 - RNA, 20 nt, Human
ggcaccaggcuaggauugga

SEQ ID NO: 461995 - RNA, 22 nt, Human
ccacugagaccuuuuggaggag

SEQ ID NO: 461996 - RNA, 22 nt, Human
uccagcuuauagguagauuuaa

SEQ ID NO: 461997 - RNA, 19 nt, Human
gcugcuggcucuggcugga

SEQ ID NO: 461998 - RNA, 22 nt, Human
aggucauuuuugccuucuauuu

SEQ ID NO: 461999 - RNA, 22 nt, Human
augcugaauugaugcgagggag

SEQ ID NO: 462000 - RNA, 22 nt, Human
ccucaggggcuuuucguuguug

SEQ ID NO: 462001 - RNA, 22 nt, Human
aaggcaguagguguuucaaacu

SEQ ID NO: 462002 - RNA, 22 nt, Human
agaaaugcucuuccugaccaga

SEQ ID NO: 462003 - RNA, 22 nt, Human
gcuggccacacugcugauggag

SEQ ID NO: 462004 - RNA, 22 nt, Human
gccagcagguggagagaucaag

SEQ ID NO: 462005 - RNA, 22 nt, Human
cagcuccugccugggcagcugu

SEQ ID NO: 462006 - RNA, 16 nt, Human
gagaagagcccggcag

SEQ ID NO: 462007 - RNA, 22 nt, Human
aucacuguguauguauaugcag

SEQ ID NO: 462008 - RNA, 21 nt, Human
gggcaggucucugaugucaac

SEQ ID NO: 462009 - RNA, 22 nt, Human
uggccugccucccggcuucuuu

SEQ ID NO: 462010 - RNA, 22 nt, Human
ccugggaggcggagguugcagu

SEQ ID NO: 462011 - RNA, 22 nt, Human
cagaauaugacaagauuuuccu

SEQ ID NO: 462012 - RNA, 22 nt, Human
agcaggaaguagucuguaagca

SEQ ID NO: 462013 - RNA, 22 nt, Human
uucucuuaucuggcauuauugg

SEQ ID NO: 462014 - RNA, 22 nt, Human
ggcuucucucccccagcuccac

SEQ ID NO: 462015 - RNA, 22 nt, Human
aggaccauccuaagguaggcaa

SEQ ID NO: 462016 - RNA, 22 nt, Human
aguuacaaacacuaucaguucu

SEQ ID NO: 462017 - RNA, 22 nt, Human
ugugggcaggcccgggucugag

SEQ ID NO: 462018 - RNA, 22 nt, Human
uucaaaacagcuagauauugga

SEQ ID NO: 462019 - RNA, 22 nt, Human
caguagcauguaauaaagacag

SEQ ID NO: 462020 - RNA, 22 nt, Human
gacuucuauuaauaccucuacu

SEQ ID NO: 462021 - RNA, 22 nt, Human
uaaacaucugucauguguuuau

SEQ ID NO: 462022 - RNA, 22 nt, Human
ggguccagcgacagcaggcuca

SEQ ID NO: 462023 - RNA, 22 nt, Human
aaaucugguucaguaaguccuc

SEQ ID NO: 462024 - RNA, 19 nt, Human
ccaggccucuggggccugu

SEQ ID NO: 462025 - RNA, 22 nt, Human
aaagacugguguguuacauaua

SEQ ID NO: 462026 - RNA, 22 nt, Human
uccuugaaaaucuugguuuaga

SEQ ID NO: 462027 - RNA, 22 nt, Human
gggggaagaaagaacauggcau

SEQ ID NO: 462028 - RNA, 22 nt, Human
cugaaggacacgugaggagcca

SEQ ID NO: 462029 - RNA, 22 nt, Human
aguccagggcucucugugggau

SEQ ID NO: 462030 - RNA, 19 nt, Human
cagaggcaccagguauaga

SEQ ID NO: 462031 - RNA, 22 nt, Human
uaugaguacaaggacucugucu

SEQ ID NO: 462032 - RNA, 22 nt, Human
cccagcucugcagaccugcccu

SEQ ID NO: 462033 - RNA, 20 nt, Human
aggaacuggaagggaggaaa

SEQ ID NO: 462034 - RNA, 22 nt, Human
ggaggugaggccguagggugug

SEQ ID NO: 462035 - RNA, 22 nt, Human
auuuaugauuagccuauuguug

SEQ ID NO: 462036 - RNA, 22 nt, Human
ggcuucuguccucuggaucugu

SEQ ID NO: 462037 - RNA, 22 nt, Human
ccugcagcuguaggagaaggcg

SEQ ID NO: 462038 - RNA, 22 nt, Human
cagagaccccgcugcccuucug

SEQ ID NO: 462039 - RNA, 22 nt, Human
uccagugguacauggagacacu

SEQ ID NO: 462040 - RNA, 22 nt, Human
gcuucgggguccaagcgcgugu

SEQ ID NO: 462041 - RNA, 22 nt, Human
ggccuugguaaagggaugcaug

SEQ ID NO: 462042 - RNA, 22 nt, Human
cugaggcauguuacaggacaua

SEQ ID NO: 462043 - RNA, 17 nt, Human
auacaguuuauuuuaca

SEQ ID NO: 462044 - RNA, 22 nt, Human
ggcaggcuggcuuuguuccagg

SEQ ID NO: 462045 - RNA, 22 nt, Human
ucugugcucuucucaguaucac

SEQ ID NO: 462046 - RNA, 22 nt, Human
cauuuacagugagaguuuuuac

SEQ ID NO: 462047 - RNA, 22 nt, Human
cagaguguauucugcaguugca

SEQ ID NO: 462048 - RNA, 22 nt, Human
aaguucaagagugacauauuag

SEQ ID NO: 462049 - RNA, 22 nt, Human
ugccuuggugcuucuucaugug

SEQ ID NO: 462050 - RNA, 22 nt, Human
uagcagggaaggugugcugagc

SEQ ID NO: 462051 - RNA, 22 nt, Human
agucucagccacacagaccuau

SEQ ID NO: 462052 - RNA, 22 nt, Human
agcugccauccuguucagcacc

SEQ ID NO: 462053 - RNA, 22 nt, Human
agaagccagauuguagugggac

SEQ ID NO: 462054 - RNA, 22 nt, Human
cucaggaggugguagaggcccu

SEQ ID NO: 462055 - RNA, 22 nt, Human
gucuggaggaggaagaaggcac

SEQ ID NO: 462056 - RNA, 22 nt, Human
uuauuagguuuacauaaagguu

SEQ ID NO: 462057 - RNA, 22 nt, Human
cagaaauguuuauauguggugu

SEQ ID NO: 462058 - RNA, 22 nt, Human
ugaggccucauaaugagauuuc

SEQ ID NO: 462059 - RNA, 22 nt, Human
ugcagcugcuggcccaggugcu

SEQ ID NO: 462060 - RNA, 22 nt, Human
agcagggcugugcuccuuccga

SEQ ID NO: 462061 - RNA, 22 nt, Human
uauuauguagaguaaggguuaa

SEQ ID NO: 462062 - RNA, 22 nt, Human
cuccugagcucugaggaagcuu

SEQ ID NO: 462063 - RNA, 22 nt, Human
ucaggcugagaaaaucuggacc

SEQ ID NO: 462064 - RNA, 22 nt, Human
aaggagagguuguccguguugu

SEQ ID NO: 462065 - RNA, 22 nt, Human
uuugaacaagagcuucacauua

SEQ ID NO: 462066 - RNA, 22 nt, Human
uggaguucucaggugagggcuu

SEQ ID NO: 462067 - RNA, 22 nt, Human
gccagcugcuggaacagcgcga

SEQ ID NO: 462068 - RNA, 22 nt, Human
aguguuucuggcaaaugaaagu

SEQ ID NO: 462069 - RNA, 22 nt, Human
ugccaggccucaggagucucca

SEQ ID NO: 462070 - RNA, 22 nt, Human
aaacauuguaauuuuagcaugg

SEQ ID NO: 462071 - RNA, 22 nt, Human
gggcuucucccuaaggacucug

SEQ ID NO: 462072 - RNA, 22 nt, Human
uacaaagcuguauagccugguc

SEQ ID NO: 462073 - RNA, 22 nt, Human
ugucacaguuuguacuuuauag

SEQ ID NO: 462074 - RNA, 22 nt, Human
ggccucugguucguggugaccu

SEQ ID NO: 462075 - RNA, 22 nt, Human
cugccaaggcuggggaggacaa

SEQ ID NO: 462076 - RNA, 22 nt, Human
cugagccuuauucaccagcccu

SEQ ID NO: 462077 - RNA, 20 nt, Human
ucacuaguaaccaucugcuu

SEQ ID NO: 462078 - RNA, 22 nt, Human
gacaaaggaucagagguuggga

SEQ ID NO: 462079 - RNA, 22 nt, Human
uguacauuuagagcucaauaga

SEQ ID NO: 462080 - RNA, 22 nt, Human
uagaaauguuagauguauugag

SEQ ID NO: 462081 - RNA, 22 nt, Human
agggaguuagaaauccaggaua

SEQ ID NO: 462082 - RNA, 19 nt, Human
auuuccaagaauuggagag

SEQ ID NO: 462083 - RNA, 22 nt, Human
caaggccaagucucugugaaga

SEQ ID NO: 462084 - RNA, 20 nt, Human
ucugugugccaucaccuaac

SEQ ID NO: 462085 - RNA, 22 nt, Human
agcugcugaaugacacugcaag

SEQ ID NO: 462086 - RNA, 22 nt, Human
ggaggccaucuggcuggaggcu

SEQ ID NO: 462087 - RNA, 22 nt, Human
gggcucuguccauuccuucaua

SEQ ID NO: 462088 - RNA, 22 nt, Human
uuaaacagguuuuugaauggcc

SEQ ID NO: 462089 - RNA, 22 nt, Human
uggccugggccugccggugcaa

SEQ ID NO: 462090 - RNA, 22 nt, Human
ucuggccugggccugccggugc

SEQ ID NO: 462091 - RNA, 22 nt, Human
agcagcaugaugacagagucuc

SEQ ID NO: 462092 - RNA, 22 nt, Human
ggaggcucugcuccguguguuc

SEQ ID NO: 462093 - RNA, 22 nt, Human
gcauacagagaggauguggcau

SEQ ID NO: 462094 - RNA, 22 nt, Human
caggaggcagagguugcagcga

SEQ ID NO: 462095 - RNA, 22 nt, Human
guauccuuugcggaaauuucua

SEQ ID NO: 462096 - RNA, 22 nt, Human
ugaguucuaguggcugcagauu

SEQ ID NO: 462097 - RNA, 23 nt, Human
gggagaauaugaggaugauggug

SEQ ID NO: 462098 - RNA, 22 nt, Human
gggcugcuuuuaagggucucag

SEQ ID NO: 462099 - RNA, 22 nt, Human
guauuugauagauuucaaagga

SEQ ID NO: 462100 - RNA, 22 nt, Human
gcugcagcuguaggacacaauu

SEQ ID NO: 462101 - RNA, 22 nt, Human
ucuggcccagccccugagguca

SEQ ID NO: 462102 - RNA, 22 nt, Human
caugucuuauauccugucuuca

SEQ ID NO: 462103 - RNA, 22 nt, Human
cuacagaaaaucagccacaggc

SEQ ID NO: 462104 - RNA, 22 nt, Human
aaagccagugguaugagagaaa

SEQ ID NO: 462105 - RNA, 22 nt, Human
agagcuuauaucuuggccaucc

SEQ ID NO: 462106 - RNA, 22 nt, Human
uguugaagauaaaguucucauu

SEQ ID NO: 462107 - RNA, 22 nt, Human
uaagcaaauagcuagaucagag

SEQ ID NO: 462108 - RNA, 22 nt, Human
gccugagagacccauggggcaa

SEQ ID NO: 462109 - RNA, 22 nt, Human
uguauuuuuagaccuuuagacc

SEQ ID NO: 462110 - RNA, 22 nt, Human
guuucuuuugugaucaccaacc

SEQ ID NO: 462111 - RNA, 22 nt, Human
cagcuccagcccaggcagcucc

SEQ ID NO: 462112 - RNA, 22 nt, Human
ugagcagggacuuugaguguag

SEQ ID NO: 462113 - RNA, 22 nt, Human
gccuuugccugcgacguggcug

SEQ ID NO: 462114 - RNA, 22 nt, Human
aaagcccauguggaaguacagg

SEQ ID NO: 462115 - RNA, 22 nt, Human
acagagcacugcccugugccgc

SEQ ID NO: 462116 - RNA, 22 nt, Human
uggccagaaccugcaguaggcc

SEQ ID NO: 462117 - RNA, 22 nt, Human
gcauguuuugcaacaagugacc

SEQ ID NO: 462118 - RNA, 22 nt, Human
uugauacauagcacaguuuagg

SEQ ID NO: 462119 - RNA, 22 nt, Human
ucauuuguaccauuuuuuaaga

SEQ ID NO: 462120 - RNA, 22 nt, Human
gggagagagaaaacguggcgca

SEQ ID NO: 462121 - RNA, 22 nt, Human
gcagcagagaacacaaugaugg

SEQ ID NO: 462122 - RNA, 22 nt, Human
gucccuggaucugggacagcug

SEQ ID NO: 462123 - RNA, 22 nt, Human
agccuggccugggcaggcacau

SEQ ID NO: 462124 - RNA, 19 nt, Human
ccuuccuccccagggccau

SEQ ID NO: 462125 - RNA, 22 nt, Human
augugugccccuuuuacucuuu

SEQ ID NO: 462126 - RNA, 22 nt, Human
uagaaaugcaguguacuguguc

SEQ ID NO: 462127 - RNA, 22 nt, Human
uguacaugugucuguauaucuu

SEQ ID NO: 462128 - RNA, 22 nt, Human
agcagggcuccugaaagccgcg

SEQ ID NO: 462129 - RNA, 20 nt, Human
gaggcugcggacugcuggac

SEQ ID NO: 462130 - RNA, 22 nt, Human
uggcagagucaucacaucugga

SEQ ID NO: 462131 - RNA, 22 nt, Human
gaggaccacagaugagccugca

SEQ ID NO: 462132 - RNA, 22 nt, Human
gggggcuggacuuucccacaca

SEQ ID NO: 462133 - RNA, 22 nt, Human
agccacagcauguguguaugua

SEQ ID NO: 462134 - RNA, 22 nt, Human
ugguaaagaaggcuagaucuga

SEQ ID NO: 462135 - RNA, 22 nt, Human
ucuccuggucaccucagaaguc

SEQ ID NO: 462136 - RNA, 22 nt, Human
gagugcaguaucuucugugucc

SEQ ID NO: 462137 - RNA, 22 nt, Human
gcacagccacugagugagaacc

SEQ ID NO: 462138 - RNA, 22 nt, Human
gacuucaaaggucaaacaucgc

SEQ ID NO: 462139 - RNA, 22 nt, Human
accugagaaugggggcaugugu

SEQ ID NO: 462140 - RNA, 22 nt, Human
caggagugucuccacacagcaa

SEQ ID NO: 462141 - RNA, 22 nt, Human
augggcagcugcagcaguggug

SEQ ID NO: 462142 - RNA, 22 nt, Human
aggcucaguuugguuuccauug

SEQ ID NO: 462143 - RNA, 21 nt, Human
gggcagaggggccuccugggu

SEQ ID NO: 462144 - RNA, 22 nt, Human
aaauguucccaauaugaagcug

SEQ ID NO: 462145 - RNA, 22 nt, Human
augccuguaaucccagugcuuu

SEQ ID NO: 462146 - RNA, 22 nt, Human
gcagccucagggcacucagaug

SEQ ID NO: 462147 - RNA, 22 nt, Human
guuuacaacaucuuguccuuca

SEQ ID NO: 462148 - RNA, 22 nt, Human
cagacagaaggcuccuugaggu

SEQ ID NO: 462149 - RNA, 22 nt, Human
cuucuaggcuucucagggggca

SEQ ID NO: 462150 - RNA, 22 nt, Human
acucugccaucccaggugcugu

SEQ ID NO: 462151 - RNA, 22 nt, Human
uuguugucauuguagaggauuu

SEQ ID NO: 462152 - RNA, 22 nt, Human
ucagcuuuuuggauugcccaag

SEQ ID NO: 462153 - RNA, 22 nt, Human
ugcagcuucuuguccugugauu

SEQ ID NO: 462154 - RNA, 18 nt, Human
uuaagagcugaaagggga

SEQ ID NO: 462155 - RNA, 22 nt, Human
uggagccauaacccuuucguac

SEQ ID NO: 462156 - RNA, 22 nt, Human
uccugaaaaauuacauguucag

SEQ ID NO: 462157 - RNA, 22 nt, Human
aucaguuuauacuuauaaaucu

SEQ ID NO: 462158 - RNA, 22 nt, Human
cugggcacagcguugggcucuu

SEQ ID NO: 462159 - RNA, 22 nt, Human
ugugaaagucaaauuaauugaa

SEQ ID NO: 462160 - RNA, 22 nt, Human
caggcagggagcuggaaaggau

SEQ ID NO: 462161 - RNA, 19 nt, Human
guagggacagugguucuga

SEQ ID NO: 462162 - RNA, 22 nt, Human
acauuucucagggaguuuugcu

SEQ ID NO: 462163 - RNA, 22 nt, Human
auugaaaaauucacaauucugg

SEQ ID NO: 462164 - RNA, 22 nt, Human
ugccugggguuggcaaacugcu

SEQ ID NO: 462165 - RNA, 22 nt, Human
agcugguucauucauucauggu

SEQ ID NO: 462166 - RNA, 22 nt, Human
gcaggaguuaggcgucguggau

SEQ ID NO: 462167 - RNA, 22 nt, Human
acaguggaguugggguagcccu

SEQ ID NO: 462168 - RNA, 22 nt, Human
aacacaaagaagcugcaggauc

SEQ ID NO: 462169 - RNA, 22 nt, Human
uggcccugacuuggaggccuga

SEQ ID NO: 462170 - RNA, 21 nt, Human
cugccuugaaugguacuggga

SEQ ID NO: 462171 - RNA, 22 nt, Human
caagagcucagaaacccuugcu

SEQ ID NO: 462172 - RNA, 22 nt, Human
acuggacagaggaaauauggag

SEQ ID NO: 462173 - RNA, 22 nt, Human
caggcugaucagggcugggaug

SEQ ID NO: 462174 - RNA, 22 nt, Human
uacuuugucauucuaaccuucc

SEQ ID NO: 462175 - RNA, 22 nt, Human
uuugacaggacuaacauauggc

SEQ ID NO: 462176 - RNA, 22 nt, Human
agggcaugugggagaggagccu

SEQ ID NO: 462177 - RNA, 22 nt, Human
auguccagagccggccugcuga

SEQ ID NO: 462178 - RNA, 22 nt, Human
aaaugcacagagccuuagagau

SEQ ID NO: 462179 - RNA, 22 nt, Human
agcugggccugagcuggaagcu

SEQ ID NO: 462180 - RNA, 22 nt, Human
uaacagaaauauuuccagguga

SEQ ID NO: 462181 - RNA, 22 nt, Human
uugccucccagcaugggcagcu

SEQ ID NO: 462182 - RNA, 22 nt, Human
cugucccagauguucucagcac

SEQ ID NO: 462183 - RNA, 22 nt, Human
gccuggugguauccuggcaaga

SEQ ID NO: 462184 - RNA, 22 nt, Human
agauacauauagaaaacaucaa

SEQ ID NO: 462185 - RNA, 19 nt, Human
agugaaauggaguauucaa

SEQ ID NO: 462186 - RNA, 22 nt, Human
agagugaaguaauuguuaggau

SEQ ID NO: 462187 - RNA, 22 nt, Human
ggagcugucuguagggcacagg

SEQ ID NO: 462188 - RNA, 22 nt, Human
acaggugugagaacaugccuug

SEQ ID NO: 462189 - RNA, 22 nt, Human
uguauuuuuaggaaugcgcuau

SEQ ID NO: 462190 - RNA, 22 nt, Human
ucuuggagaauggcagagaagc

SEQ ID NO: 462191 - RNA, 22 nt, Human
uucacaggaauguaggggucuu

SEQ ID NO: 462192 - RNA, 22 nt, Human
cccugcagugugaccucaccua

SEQ ID NO: 462193 - RNA, 22 nt, Human
ucuuacauauagcaugaguaca

SEQ ID NO: 462194 - RNA, 22 nt, Human
caugaagcuugaagcaguccac

SEQ ID NO: 462195 - RNA, 22 nt, Human
ccagucacagguguguuuauau

SEQ ID NO: 462196 - RNA, 22 nt, Human
cuggcugggagcgagcugcuca

SEQ ID NO: 462197 - RNA, 22 nt, Human
gcagagccaggagagacccuug

SEQ ID NO: 462198 - RNA, 22 nt, Human
acauacuuuuuaaaagauugcu

SEQ ID NO: 462199 - RNA, 22 nt, Human
uuucaguggguuuauuucaugu

SEQ ID NO: 462200 - RNA, 18 nt, Human
gcugagguggugucagag

SEQ ID NO: 462201 - RNA, 22 nt, Human
gggucccaggaaggagcagugu

SEQ ID NO: 462202 - RNA, 22 nt, Human
gcuggccuuugaggaagcugcg

SEQ ID NO: 462203 - RNA, 22 nt, Human
gccaggcucucagugacugccc

SEQ ID NO: 462204 - RNA, 22 nt, Human
gccugccugcugucaucugccu

SEQ ID NO: 462205 - RNA, 22 nt, Human
auggauaagucaaagaguaucc

SEQ ID NO: 462206 - RNA, 22 nt, Human
uauuaggguuuugaagguuugu

SEQ ID NO: 462207 - RNA, 22 nt, Human
uccagggcuuggcugggacggu

SEQ ID NO: 462208 - RNA, 22 nt, Human
auuuguagugaagugaaaauaa

SEQ ID NO: 462209 - RNA, 22 nt, Human
gaggcuggugguuaguuccauu

SEQ ID NO: 462210 - RNA, 22 nt, Human
cagccugacaccagcuuugggc

SEQ ID NO: 462211 - RNA, 17 nt, Human
uuccucucacauuuuuu

SEQ ID NO: 462212 - RNA, 22 nt, Human
ccuccaaguuugacucaggaca

SEQ ID NO: 462213 - RNA, 22 nt, Human
gugcugaguagaaugaaugccu

SEQ ID NO: 462214 - RNA, 22 nt, Human
agggagcuguggucagcucagu

SEQ ID NO: 462215 - RNA, 22 nt, Human
aggggcaguuccaaguuuugug

SEQ ID NO: 462216 - RNA, 22 nt, Human
gcagguggagcaguagucuggu

SEQ ID NO: 462217 - RNA, 17 nt, Human
gcuuuggaaggguagac

SEQ ID NO: 462218 - RNA, 22 nt, Human
uauaauuuggggaaaguggugu

SEQ ID NO: 462219 - RNA, 22 nt, Human
ugaagccacacuagcuuguccu

SEQ ID NO: 462220 - RNA, 22 nt, Human
gccaggugggagacagacagca

SEQ ID NO: 462221 - RNA, 21 nt, Human
uuugcauuuuacaugugggga

SEQ ID NO: 462222 - RNA, 22 nt, Human
cugucaccuguucacugcagca

SEQ ID NO: 462223 - RNA, 22 nt, Human
acaugucaauuuaguacucuua

SEQ ID NO: 462224 - RNA, 22 nt, Human
cagggagcuggugccagccgac

SEQ ID NO: 462225 - RNA, 22 nt, Human
uuuccuucaucaucugagagcu

SEQ ID NO: 462226 - RNA, 22 nt, Human
uccaggcuggccucgcgugaca

SEQ ID NO: 462227 - RNA, 22 nt, Human
acaugcauucucuaaaagcaaa

SEQ ID NO: 462228 - RNA, 22 nt, Human
aucuggcucccuuggaauccgu

SEQ ID NO: 462229 - RNA, 22 nt, Human
ucucuuaauaaguaaauacuga

SEQ ID NO: 462230 - RNA, 22 nt, Human
ugggauggagccugaguauagu

SEQ ID NO: 462231 - RNA, 22 nt, Human
gcugcccugugguccagcaggu

SEQ ID NO: 462232 - RNA, 22 nt, Human
agccacaggaaacagagacagc

SEQ ID NO: 462233 - RNA, 22 nt, Human
guuugcauggaagacagugagu

SEQ ID NO: 462234 - RNA, 22 nt, Human
ccucaggcuuacgggcaaugga

SEQ ID NO: 462235 - RNA, 22 nt, Human
guacucaguaauauaacauauu

SEQ ID NO: 462236 - RNA, 22 nt, Human
cagcucugugcaggccugggga

SEQ ID NO: 462237 - RNA, 22 nt, Human
ugaaagguuauuuaggucugcu

SEQ ID NO: 462238 - RNA, 22 nt, Human
ucagaggucacacagcaaguuu

SEQ ID NO: 462239 - RNA, 22 nt, Human
uuccucuuucucugugcuaugu

SEQ ID NO: 462240 - RNA, 22 nt, Human
aaugauauagcagacauagccu

SEQ ID NO: 462241 - RNA, 22 nt, Human
ucucagagggaggauuacugcc

SEQ ID NO: 462242 - RNA, 22 nt, Human
ugcagcuccucuggcugccuga

SEQ ID NO: 462243 - RNA, 22 nt, Human
uggcugagaaaaugguuuuagg

SEQ ID NO: 462244 - RNA, 23 nt, Human
agcagugaguaaacagauaggau

SEQ ID NO: 462245 - RNA, 22 nt, Human
aggcaguuuaggcagcgauuua

SEQ ID NO: 462246 - RNA, 23 nt, Human
cuugcagggcuggaggcuuagaa

SEQ ID NO: 462247 - RNA, 22 nt, Human
ugaagacagaccaaggagaaug

SEQ ID NO: 462248 - RNA, 22 nt, Human
uagacacaucaaguauaguuaa

SEQ ID NO: 462249 - RNA, 22 nt, Human
cuuagggagaaugccucugcag

SEQ ID NO: 462250 - RNA, 22 nt, Human
gcccagcugcacccuggugggu

SEQ ID NO: 462251 - RNA, 22 nt, Human
agcuuuaugaggagaccuuagu

SEQ ID NO: 462252 - RNA, 22 nt, Human
gcagggcagcucacugugguuc

SEQ ID NO: 462253 - RNA, 22 nt, Human
cucuggagguugagcccagcaa

SEQ ID NO: 462254 - RNA, 22 nt, Human
auauguguauuugguuagccua

SEQ ID NO: 462255 - RNA, 22 nt, Human
uuccauaauuaaguggagagaa

SEQ ID NO: 462256 - RNA, 22 nt, Human
agggccagggaagcuguauuuu

SEQ ID NO: 462257 - RNA, 22 nt, Human
uugaaggacaucuuguuucuag

SEQ ID NO: 462258 - RNA, 22 nt, Human
ccucaggguggcaucagaucuu

SEQ ID NO: 462259 - RNA, 22 nt, Human
uaauuuaauuucaugccagccu

SEQ ID NO: 462260 - RNA, 22 nt, Human
uccugggagagugggacuguau

SEQ ID NO: 462261 - RNA, 22 nt, Human
ucagguggcuuggagggggacg

SEQ ID NO: 462262 - RNA, 22 nt, Human
ugccacccagccaggaguggga

SEQ ID NO: 462263 - RNA, 22 nt, Human
aagcugccuuccaugugaggaa

SEQ ID NO: 462264 - RNA, 16 nt, Human
cagcuuuaugucagug

SEQ ID NO: 462265 - RNA, 22 nt, Human
ucagggcaccaaaaaagaugcc

SEQ ID NO: 462266 - RNA, 22 nt, Human
acuuccugcagcuucucagccc

SEQ ID NO: 462267 - RNA, 22 nt, Human
gucaggggccaugggccaagga

SEQ ID NO: 462268 - RNA, 22 nt, Human
gcuguucccauguggggcucag

SEQ ID NO: 462269 - RNA, 22 nt, Human
cccacucuggcucccuucuagu

SEQ ID NO: 462270 - RNA, 22 nt, Human
uggcucaguuugggggauugaa

SEQ ID NO: 462271 - RNA, 22 nt, Human
cuggagagaccgaaagaggcug

SEQ ID NO: 462272 - RNA, 22 nt, Human
cacugggcguguccugggugag

SEQ ID NO: 462273 - RNA, 22 nt, Human
cuggagcucuccagagccccgu

SEQ ID NO: 462274 - RNA, 22 nt, Human
cagggccaggcugauggccugg

SEQ ID NO: 462275 - RNA, 22 nt, Human
gcugggcuugguuucccugcuu

SEQ ID NO: 462276 - RNA, 22 nt, Human
gacccagaaggagugcccuaga

SEQ ID NO: 462277 - RNA, 22 nt, Human
ggaaggaggaugcucuggccuu

SEQ ID NO: 462278 - RNA, 22 nt, Human
ugcauauugugaaaauguagau

SEQ ID NO: 462279 - RNA, 22 nt, Human
ggguccagaguugaagagguua

SEQ ID NO: 462280 - RNA, 22 nt, Human
ugggcuggcccaccacaccucg

SEQ ID NO: 462281 - RNA, 22 nt, Human
ggcuuuauuaagcaggguaagu

SEQ ID NO: 462282 - RNA, 22 nt, Human
aagggccauaacuugcaguguu

SEQ ID NO: 462283 - RNA, 22 nt, Human
ugcccaggguggagugcagcgg

SEQ ID NO: 462284 - RNA, 22 nt, Human
ggcugccugaggcugaggcccg

SEQ ID NO: 462285 - RNA, 22 nt, Human
cuggcugccacuucagggucuu

SEQ ID NO: 462286 - RNA, 22 nt, Human
ucccagagucagagguggggcc

SEQ ID NO: 462287 - RNA, 22 nt, Human
acacuuuacagcuuccuuugca

SEQ ID NO: 462288 - RNA, 22 nt, Human
agaaaguucugugaguuguuca

SEQ ID NO: 462289 - RNA, 21 nt, Human
agcagcugggcaacauggagg

SEQ ID NO: 462290 - RNA, 22 nt, Human
aggaccugacauuguguuuucu

SEQ ID NO: 462291 - RNA, 20 nt, Human
gagggcaggcacccauuuca

SEQ ID NO: 462292 - RNA, 22 nt, Human
cccugaggggaguggugaggug

SEQ ID NO: 462293 - RNA, 22 nt, Human
caaagguaguauauauauuguu

SEQ ID NO: 462294 - RNA, 22 nt, Human
uccucagacuucccuuugugua

SEQ ID NO: 462295 - RNA, 22 nt, Human
ccagagcugcauccagcagguu

SEQ ID NO: 462296 - RNA, 22 nt, Human
guguccuuauaagaagagaugc

SEQ ID NO: 462297 - RNA, 22 nt, Human
uaggaaaaauacagaauuauau

SEQ ID NO: 462298 - RNA, 22 nt, Human
caaaggcaguuacugaaugaag

SEQ ID NO: 462299 - RNA, 22 nt, Human
ugauuucaaguagugacaugcu

SEQ ID NO: 462300 - RNA, 22 nt, Human
gguggaaggccuggaaggaggc

SEQ ID NO: 462301 - RNA, 22 nt, Human
aaggacuccaauucuuucaucu

SEQ ID NO: 462302 - RNA, 22 nt, Human
uccaagggcagccauagaacuu

SEQ ID NO: 462303 - RNA, 22 nt, Human
ccugccagucacuaugucaccu

SEQ ID NO: 462304 - RNA, 22 nt, Human
uccugagagcagaguccaggug

SEQ ID NO: 462305 - RNA, 22 nt, Human
uggcucagcauucacuggucuu

SEQ ID NO: 462306 - RNA, 18 nt, Human
gcaggagauggguggggu

SEQ ID NO: 462307 - RNA, 22 nt, Human
gcuggcagggacagcugcgugu

SEQ ID NO: 462308 - RNA, 22 nt, Human
ucugugacuugcgggaggagaa

SEQ ID NO: 462309 - RNA, 22 nt, Human
ugagccugguugcagugucugg

SEQ ID NO: 462310 - RNA, 22 nt, Human
ugacaccacaacuagccauuga

SEQ ID NO: 462311 - RNA, 22 nt, Human
ucaaauguucccuguacuggcc

SEQ ID NO: 462312 - RNA, 22 nt, Human
gccagagcagaauagaguggcc

SEQ ID NO: 462313 - RNA, 22 nt, Human
caguuuuuagauuaguuggugg

SEQ ID NO: 462314 - RNA, 22 nt, Human
aaaugcaauuguauguacucca

SEQ ID NO: 462315 - RNA, 22 nt, Human
aaaguguugggauuacaggugu

SEQ ID NO: 462316 - RNA, 22 nt, Human
gaggacaggagacucacuguuu

SEQ ID NO: 462317 - RNA, 22 nt, Human
gcucccagcauugcugcugaau

SEQ ID NO: 462318 - RNA, 22 nt, Human
gcucaggaaggcucaaccagga

SEQ ID NO: 462319 - RNA, 22 nt, Human
uacauaguuccauuuacaggaa

SEQ ID NO: 462320 - RNA, 22 nt, Human
gugccugggguugagcuaugaa

SEQ ID NO: 462321 - RNA, 22 nt, Human
ucagaagcauguggggagccug

SEQ ID NO: 462322 - RNA, 18 nt, Human
augggaggggccaagaga

SEQ ID NO: 462323 - RNA, 22 nt, Human
uaggugucugcucuuauuuaac

SEQ ID NO: 462324 - RNA, 22 nt, Human
augaggcaggagugcaguggca

SEQ ID NO: 462325 - RNA, 19 nt, Human
uccugcagaccagaccugu

SEQ ID NO: 462326 - RNA, 22 nt, Human
acagcagcacuauugacauuuu

SEQ ID NO: 462327 - RNA, 22 nt, Human
gcuguccagagcaugggagcaa

SEQ ID NO: 462328 - RNA, 22 nt, Human
cuuauaguaugauguugagaau

SEQ ID NO: 462329 - RNA, 22 nt, Human
aagggcugcauuugauguguca

SEQ ID NO: 462330 - RNA, 22 nt, Human
acagcagcuaaaggugucuccu

SEQ ID NO: 462331 - RNA, 22 nt, Human
ucuuugucugaacagggacauu

SEQ ID NO: 462332 - RNA, 22 nt, Human
ccugaagcaaggguaggcaggu

SEQ ID NO: 462333 - RNA, 22 nt, Human
ucaccagucuuucuuaccauug

SEQ ID NO: 462334 - RNA, 22 nt, Human
uaaaaucauucuggugucagua

SEQ ID NO: 462335 - RNA, 22 nt, Human
ugcagagguguugcugagauaa

SEQ ID NO: 462336 - RNA, 22 nt, Human
aggggaaggccagccuguagag

SEQ ID NO: 462337 - RNA, 22 nt, Human
cagggccauuggcguggcuguc

SEQ ID NO: 462338 - RNA, 22 nt, Human
ggcuggagauaugucuggaaca

SEQ ID NO: 462339 - RNA, 22 nt, Human
aggccucuucagggagcaugga

SEQ ID NO: 462340 - RNA, 22 nt, Human
uguuaacaucuuggacucguga

SEQ ID NO: 462341 - RNA, 22 nt, Human
cugcagggcagggccuccuggc

SEQ ID NO: 462342 - RNA, 22 nt, Human
ccagcugcaggggagcagugga

SEQ ID NO: 462343 - RNA, 22 nt, Human
uggcagaaagaaccaugugcaa

SEQ ID NO: 462344 - RNA, 22 nt, Human
cacugcccagcgucuuaggcac

SEQ ID NO: 462345 - RNA, 22 nt, Human
uggggacacagagccaaacuau

SEQ ID NO: 462346 - RNA, 22 nt, Human
acacauaugguugcugcaguga

SEQ ID NO: 462347 - RNA, 22 nt, Human
ugaggcaggaugcuugcacagg

SEQ ID NO: 462348 - RNA, 22 nt, Human
ugcagggaaagggcacugggcu

SEQ ID NO: 462349 - RNA, 22 nt, Human
gugccaggcccagggagcgggg

SEQ ID NO: 462350 - RNA, 22 nt, Human
ugaaggcccagccacagaaugg

SEQ ID NO: 462351 - RNA, 22 nt, Human
ucagagaaguaagguggggugc

SEQ ID NO: 462352 - RNA, 22 nt, Human
gccaggcauucuagaaguagug

SEQ ID NO: 462353 - RNA, 22 nt, Human
accaggcuggagugcaguggcg

SEQ ID NO: 462354 - RNA, 22 nt, Human
cagcuggaugggagaccauguu

SEQ ID NO: 462355 - RNA, 22 nt, Human
cugaaggaagcagguggccugu

SEQ ID NO: 462356 - RNA, 22 nt, Human
uggcuggcuuguucacugacug

SEQ ID NO: 462357 - RNA, 22 nt, Human
caaugauucugcaacugugugc

SEQ ID NO: 462358 - RNA, 22 nt, Human
gauacaaauucaugucugaauu

SEQ ID NO: 462359 - RNA, 22 nt, Human
gggcuggaggugagcaggacag

SEQ ID NO: 462360 - RNA, 22 nt, Human
aagcugcccucauucccagugc

SEQ ID NO: 462361 - RNA, 22 nt, Human
ucucccaggcuggagugcagug

SEQ ID NO: 462362 - RNA, 22 nt, Human
aagaugauguuguguuuucacu

SEQ ID NO: 462363 - RNA, 22 nt, Human
gaagcagcuuucuggugaggag

SEQ ID NO: 462364 - RNA, 22 nt, Human
aaacaucauaggcaugcaugau

SEQ ID NO: 462365 - RNA, 22 nt, Human
ucccaggaaaacacucgaggac

SEQ ID NO: 462366 - RNA, 22 nt, Human
guugaaaguagaugcuauuugg

SEQ ID NO: 462367 - RNA, 22 nt, Human
augaggcagauguugcaugagg

SEQ ID NO: 462368 - RNA, 22 nt, Human
caggccugggcuucggggcuga

SEQ ID NO: 462369 - RNA, 22 nt, Human
acacagggucuagaguuaggcc

SEQ ID NO: 462370 - RNA, 22 nt, Human
acagcugugaaaauccacagga

SEQ ID NO: 462371 - RNA, 22 nt, Human
ucacauuuauuucaaaguuacu

SEQ ID NO: 462372 - RNA, 22 nt, Human
caggaguggugugagggacucc

SEQ ID NO: 462373 - RNA, 22 nt, Human
uuuuauuaucuuugaaugggac

SEQ ID NO: 462374 - RNA, 22 nt, Human
aggcacagcacaccuggccccc

SEQ ID NO: 462375 - RNA, 22 nt, Human
gaggccacagcuaucagggaca

SEQ ID NO: 462376 - RNA, 22 nt, Human
cagaggcuaagaugagugggug

SEQ ID NO: 462377 - RNA, 22 nt, Human
ggauggcagucugcaugagaaa

SEQ ID NO: 462378 - RNA, 22 nt, Human
cacuuggaggaaggccuauuca

SEQ ID NO: 462379 - RNA, 22 nt, Human
ugggcagacugagcccuguccc

SEQ ID NO: 462380 - RNA, 21 nt, Human
aggcagaaagagcccaggcug

SEQ ID NO: 462381 - RNA, 22 nt, Human
aaauuagucgguuuaggaauuu

SEQ ID NO: 462382 - RNA, 22 nt, Human
ucagagugcagcgggaggcugg

SEQ ID NO: 462383 - RNA, 22 nt, Human
uaaaugugaccuucauuuuaua

SEQ ID NO: 462384 - RNA, 22 nt, Human
cccuggagggacagcugcucua

SEQ ID NO: 462385 - RNA, 22 nt, Human
uaggcagaaaggaaggcaaguu

SEQ ID NO: 462386 - RNA, 18 nt, Human
uucagcagcagacacacu

SEQ ID NO: 462387 - RNA, 22 nt, Human
ucagaggaacacuguuucaugc

SEQ ID NO: 462388 - RNA, 22 nt, Human
ugucccagauacuggacauaga

SEQ ID NO: 462389 - RNA, 21 nt, Human
acagaguaguugaaacagaga

SEQ ID NO: 462390 - RNA, 22 nt, Human
ucuucaaauccuacagugucug

SEQ ID NO: 462391 - RNA, 22 nt, Human
agaggccuaauugcuacccuuu

SEQ ID NO: 462392 - RNA, 22 nt, Human
aauuaacaaauguagcugugau

SEQ ID NO: 462393 - RNA, 22 nt, Human
cuuccucccccacacacucacu

SEQ ID NO: 462394 - RNA, 22 nt, Human
ucccuuaaaacucauguguugu

SEQ ID NO: 462395 - RNA, 22 nt, Human
cugggccucaaucucagaguuu

SEQ ID NO: 462396 - RNA, 22 nt, Human
uauacuuuccugcaacuuugau

SEQ ID NO: 462397 - RNA, 22 nt, Human
gaggaggaaguucucuguaggc

SEQ ID NO: 462398 - RNA, 22 nt, Human
cauaucccauuggccaggacau

SEQ ID NO: 462399 - RNA, 20 nt, Human
uucuuaaagaccucacuuug

SEQ ID NO: 462400 - RNA, 22 nt, Human
ucucccagaggaucccagugga

SEQ ID NO: 462401 - RNA, 17 nt, Human
uccuucagggccucaca

SEQ ID NO: 462402 - RNA, 22 nt, Human
uccagagccuauauguucaacu

SEQ ID NO: 462403 - RNA, 22 nt, Human
aggagcuggaguccaggcaagu

SEQ ID NO: 462404 - RNA, 22 nt, Human
auuuaugacuggugaauagaac

SEQ ID NO: 462405 - RNA, 22 nt, Human
ggcugccaggagaagcucagug

SEQ ID NO: 462406 - RNA, 22 nt, Human
ugagaaccaugaaaagcuguca

SEQ ID NO: 462407 - RNA, 22 nt, Human
ugauuucccucaucauaacaga

SEQ ID NO: 462408 - RNA, 22 nt, Human
uacacacagaggccaugggauu

SEQ ID NO: 462409 - RNA, 22 nt, Human
agcugggaugauaaccucaguc

SEQ ID NO: 462410 - RNA, 22 nt, Human
ugacagcugagccccaggcaag

SEQ ID NO: 462411 - RNA, 20 nt, Human
auaaaauaacugccacaaga

SEQ ID NO: 462412 - RNA, 18 nt, Human
aagaacugagguccuaga

SEQ ID NO: 462413 - RNA, 22 nt, Human
aaguggagagcccuggaggucu

SEQ ID NO: 462414 - RNA, 22 nt, Human
gggcuggugaggcugcccugca

SEQ ID NO: 462415 - RNA, 22 nt, Human
ucacgagaggcacagaauagag

SEQ ID NO: 462416 - RNA, 22 nt, Human
ggaggugguggcagugacaauu

SEQ ID NO: 462417 - RNA, 22 nt, Human
cuggcaggucucgcugacgugu

SEQ ID NO: 462418 - RNA, 17 nt, Human
acaggccugcuugcacu

SEQ ID NO: 462419 - RNA, 22 nt, Human
ccuuuggguucaaucucggucu

SEQ ID NO: 462420 - RNA, 22 nt, Human
auguccagggcacacagcagug

SEQ ID NO: 462421 - RNA, 22 nt, Human
ucagcuuuuaaaaacaagaagu

SEQ ID NO: 462422 - RNA, 22 nt, Human
cucuuuccaggguaccccaggu

SEQ ID NO: 462423 - RNA, 22 nt, Human
acaauucucucauaucuuauua

SEQ ID NO: 462424 - RNA, 22 nt, Human
aggcucugguuggcaaguaaag

SEQ ID NO: 462425 - RNA, 22 nt, Human
ugggcugaguguggaacuaguu

SEQ ID NO: 462426 - RNA, 22 nt, Human
ccagagccccugagcuucccug

SEQ ID NO: 462427 - RNA, 22 nt, Human
cucugagcuccuggaagcgugc

SEQ ID NO: 462428 - RNA, 22 nt, Human
uugucuuaaauggauggacaau

SEQ ID NO: 462429 - RNA, 21 nt, Human
uggcucugcucagagcagucc

SEQ ID NO: 462430 - RNA, 22 nt, Human
ugggcugcagggguugagagcu

SEQ ID NO: 462431 - RNA, 22 nt, Human
agaccgagaaguucuccaggcc

SEQ ID NO: 462432 - RNA, 22 nt, Human
uugagaagaggcuuuguaggaa

SEQ ID NO: 462433 - RNA, 22 nt, Human
auugcacaaacacagucagacu

SEQ ID NO: 462434 - RNA, 22 nt, Human
gcugagaguccaggaaaacauc

SEQ ID NO: 462435 - RNA, 22 nt, Human
gcagaggagaugaagauacuuu

SEQ ID NO: 462436 - RNA, 22 nt, Human
ugugaaggcagcagcucugucc

SEQ ID NO: 462437 - RNA, 22 nt, Human
gaaagccaucuggcugcuggga

SEQ ID NO: 462438 - RNA, 22 nt, Human
acgugcaggaucugguuggcga

SEQ ID NO: 462439 - RNA, 22 nt, Human
ccugugaggucaucugugguaa

SEQ ID NO: 462440 - RNA, 20 nt, Human
agagccuggaaaaagacauc

SEQ ID NO: 462441 - RNA, 22 nt, Human
cuuauguaaaacggaaagggaa

SEQ ID NO: 462442 - RNA, 22 nt, Human
cuacauuaaauuggcuuacuua

SEQ ID NO: 462443 - RNA, 22 nt, Human
uguaguaagugcgcaauaaaua

SEQ ID NO: 462444 - RNA, 20 nt, Human
ugcuggggacauacagggug

SEQ ID NO: 462445 - RNA, 22 nt, Human
uagaaaagaauuuuauuugaua

SEQ ID NO: 462446 - RNA, 22 nt, Human
caggccuggcccccggcacacc

SEQ ID NO: 462447 - RNA, 22 nt, Human
aagaguuaagcaacagauacca

SEQ ID NO: 462448 - RNA, 22 nt, Human
cuccuguauguugggcuucaca

SEQ ID NO: 462449 - RNA, 22 nt, Human
agccccugggaguagcugcugc

SEQ ID NO: 462450 - RNA, 22 nt, Human
ugggcugcugagaaugagagag

SEQ ID NO: 462451 - RNA, 22 nt, Human
caggggacauuaaagcuccaua

SEQ ID NO: 462452 - RNA, 22 nt, Human
ugaggcagguggauuacaaggu

SEQ ID NO: 462453 - RNA, 22 nt, Human
cuggcagcuuagcacucugguu

SEQ ID NO: 462454 - RNA, 19 nt, Human
uuugaaagaguuuuauugg

SEQ ID NO: 462455 - RNA, 22 nt, Human
aagagcauauuaauaguggaga

SEQ ID NO: 462456 - RNA, 22 nt, Human
accaucagucacauguagagaa

SEQ ID NO: 462457 - RNA, 22 nt, Human
uagagcuggaaaacugcaggua

SEQ ID NO: 462458 - RNA, 22 nt, Human
gcagucaguaaggcagccagaa

SEQ ID NO: 462459 - RNA, 21 nt, Human
gagacagcccagugccagggc

SEQ ID NO: 462460 - RNA, 22 nt, Human
cugcuuuguggaaucacacugg

SEQ ID NO: 462461 - RNA, 22 nt, Human
gauuucuucauucauuagaugg

SEQ ID NO: 462462 - RNA, 22 nt, Human
cagcugagaagugauagcugca

SEQ ID NO: 462463 - RNA, 22 nt, Human
auucuguauuucuaauaagauc

SEQ ID NO: 462464 - RNA, 22 nt, Human
ccacagagacagagcccagggu

SEQ ID NO: 462465 - RNA, 22 nt, Human
ugggcagaguugugaugaacug

SEQ ID NO: 462466 - RNA, 22 nt, Human
agauuucaaugugagcauuagu

SEQ ID NO: 462467 - RNA, 22 nt, Human
gcagcuggggaggucgugggga

SEQ ID NO: 462468 - RNA, 22 nt, Human
ugcagggcagauaugacuguag

SEQ ID NO: 462469 - RNA, 22 nt, Human
ucugaaaugcaggcaauuugcu

SEQ ID NO: 462470 - RNA, 19 nt, Human
agugguagaugagcaggag

SEQ ID NO: 462471 - RNA, 22 nt, Human
gcagggcucaacaggacacccc

SEQ ID NO: 462472 - RNA, 22 nt, Human
gaagcagcaaaucugcaguauc

SEQ ID NO: 462473 - RNA, 22 nt, Human
gggcucugguacuuccuggcuc

SEQ ID NO: 462474 - RNA, 22 nt, Human
cucagagaaaaggagcaagggu

SEQ ID NO: 462475 - RNA, 22 nt, Human
ccguggaguugugcugaguaug

SEQ ID NO: 462476 - RNA, 22 nt, Human
gacaucauagggugggaggaaa

SEQ ID NO: 462477 - RNA, 22 nt, Human
caggucagaggcgcagccccca

SEQ ID NO: 462478 - RNA, 21 nt, Human
gccuggcagguggaagggcuc

SEQ ID NO: 462479 - RNA, 17 nt, Human
agcugccagggagugug

SEQ ID NO: 462480 - RNA, 22 nt, Human
cagggcuccccgcaccgcagcc

SEQ ID NO: 462481 - RNA, 22 nt, Human
cagaagcagugagagaugugca

SEQ ID NO: 462482 - RNA, 22 nt, Human
cugugccuuuguagcugugccu

SEQ ID NO: 462483 - RNA, 17 nt, Human
gugcagggaugaaggau

SEQ ID NO: 462484 - RNA, 19 nt, Human
gguguccuagagauaagag

SEQ ID NO: 462485 - RNA, 22 nt, Human
gagcugcugguugcuggugccu

SEQ ID NO: 462486 - RNA, 22 nt, Human
auggccuggccagagcucugcu

SEQ ID NO: 462487 - RNA, 22 nt, Human
uagaggcacccuggaggagacu

SEQ ID NO: 462488 - RNA, 22 nt, Human
gcugagguggcugccuuaguaa

SEQ ID NO: 462489 - RNA, 22 nt, Human
aggagcugucagagugccagag

SEQ ID NO: 462490 - RNA, 21 nt, Human
uuuguucaggggcaaaguuaa

SEQ ID NO: 462491 - RNA, 22 nt, Human
uccagcuugacaaaugauuuua

SEQ ID NO: 462492 - RNA, 22 nt, Human
ggcagagcuugcagugagccga

SEQ ID NO: 462493 - RNA, 22 nt, Human
ccagccuggguguuagaagaca

SEQ ID NO: 462494 - RNA, 22 nt, Human
cgccugggaguccacaccugcu

SEQ ID NO: 462495 - RNA, 22 nt, Human
gcaggguccauggaggcagccc

SEQ ID NO: 462496 - RNA, 22 nt, Human
uccagggacacagaguccuucu

SEQ ID NO: 462497 - RNA, 22 nt, Human
cagcaauaacucaaagccauuu

SEQ ID NO: 462498 - RNA, 20 nt, Human
ccagguggugccuggagagg

SEQ ID NO: 462499 - RNA, 17 nt, Human
aggugcagaggcagagc

SEQ ID NO: 462500 - RNA, 22 nt, Human
uuucauuuugguuaugccauaa

SEQ ID NO: 462501 - RNA, 22 nt, Human
ucugcagcgugcaggcuggugc

SEQ ID NO: 462502 - RNA, 21 nt, Human
aaagagguuaauauuguaagu

SEQ ID NO: 462503 - RNA, 22 nt, Human
ugguccugccccgugcacagag

SEQ ID NO: 462504 - RNA, 22 nt, Human
gugcaaugugcuucgugccaug

SEQ ID NO: 462505 - RNA, 22 nt, Human
ccugccugcguccucugagggc

SEQ ID NO: 462506 - RNA, 22 nt, Human
ccuggcagcuccuccccggcgg

SEQ ID NO: 462507 - RNA, 22 nt, Human
ccacaggggcccacgagccgcu

SEQ ID NO: 462508 - RNA, 22 nt, Human
ugcagaaguauuccaggcccca

SEQ ID NO: 462509 - RNA, 22 nt, Human
aagcagccuggcaugaugcuuu

SEQ ID NO: 462510 - RNA, 22 nt, Human
cagugcugggcagaggagagcg

SEQ ID NO: 462511 - RNA, 18 nt, Human
ugggcugccuggccucug

SEQ ID NO: 462512 - RNA, 22 nt, Human
agaagagccuggggaccauggc

SEQ ID NO: 462513 - RNA, 22 nt, Human
augggaguuuucucugaugcuc

SEQ ID NO: 462514 - RNA, 22 nt, Human
acauaaaggugacuaacaucuu

SEQ ID NO: 462515 - RNA, 22 nt, Human
gcccauggcagaacugugagca

SEQ ID NO: 462516 - RNA, 22 nt, Human
agcucugggccaggaacccuaa

SEQ ID NO: 462517 - RNA, 22 nt, Human
accaaggagccacauacaaccu

SEQ ID NO: 462518 - RNA, 22 nt, Human
uuuguaaaaggaggaagcaugg

SEQ ID NO: 462519 - RNA, 22 nt, Human
ucagugcuucggcgagcaccua

SEQ ID NO: 462520 - RNA, 22 nt, Human
uguggaaaagaauaagggagau

SEQ ID NO: 462521 - RNA, 22 nt, Human
ugugaugguucacugggcauga

SEQ ID NO: 462522 - RNA, 22 nt, Human
aggguauguuuuuaucuacugu

SEQ ID NO: 462523 - RNA, 22 nt, Human
agcuucuguucaucuuccaggc

SEQ ID NO: 462524 - RNA, 22 nt, Human
gagcucagauucuggugucaga

SEQ ID NO: 462525 - RNA, 22 nt, Human
ugcaugcagcuggugauaagaa

SEQ ID NO: 462526 - RNA, 22 nt, Human
ugcugguggagaaaguggaggu

SEQ ID NO: 462527 - RNA, 22 nt, Human
cccaccccuggacaggugagug

SEQ ID NO: 462528 - RNA, 22 nt, Human
accugaggccuccccagcagac

SEQ ID NO: 462529 - RNA, 20 nt, Human
ccugucuggagacaaagaga

SEQ ID NO: 462530 - RNA, 22 nt, Human
ucucagagauuuauggaaaacu

SEQ ID NO: 462531 - RNA, 22 nt, Human
gagaggaguagacacuuugguu

SEQ ID NO: 462532 - RNA, 22 nt, Human
ggcuucaccgcgggguugcagg

SEQ ID NO: 462533 - RNA, 22 nt, Human
aggcucaguucacgucaacuuu

SEQ ID NO: 462534 - RNA, 19 nt, Human
auuuacugccuaaaaucuc

SEQ ID NO: 462535 - RNA, 22 nt, Human
ucuuucaaugagcauucuuucc

SEQ ID NO: 462536 - RNA, 20 nt, Human
ucucugcuguccacauuugc

SEQ ID NO: 462537 - RNA, 22 nt, Human
uucacaggcuuggagguggggg

SEQ ID NO: 462538 - RNA, 22 nt, Human
ucucugagaaguuccuuuguga

SEQ ID NO: 462539 - RNA, 22 nt, Human
uaagugcaauguuuuacuuaaa

SEQ ID NO: 462540 - RNA, 22 nt, Human
cuggcucagacagcugugcagu

SEQ ID NO: 462541 - RNA, 22 nt, Human
aauguguagcauuuaaugcagu

SEQ ID NO: 462542 - RNA, 22 nt, Human
cagcugccaugacauguccugc

SEQ ID NO: 462543 - RNA, 22 nt, Human
uuuccaaaaugaaucuaaugca

SEQ ID NO: 462544 - RNA, 23 nt, Human
aggcugagcucucccagcuucag

SEQ ID NO: 462545 - RNA, 22 nt, Human
ggccucugcaacuggcuguggc

SEQ ID NO: 462546 - RNA, 22 nt, Human
ggcagggguccugguguugacu

SEQ ID NO: 462547 - RNA, 22 nt, Human
caggggcucccugggugccagu

SEQ ID NO: 462548 - RNA, 19 nt, Human
cagaacagaggucauggcc

SEQ ID NO: 462549 - RNA, 22 nt, Human
ggucagcagugcagggcagagc

SEQ ID NO: 462550 - RNA, 22 nt, Human
gcacccagccagcaucucagag

SEQ ID NO: 462551 - RNA, 22 nt, Human
aguguuucccaguaggaugaaa

SEQ ID NO: 462552 - RNA, 22 nt, Human
uuuauccagaaucaggauuuuu

SEQ ID NO: 462553 - RNA, 22 nt, Human
gagauggggucagcugggacau

SEQ ID NO: 462554 - RNA, 22 nt, Human
uuguaaauaguaguaagaugcc

SEQ ID NO: 462555 - RNA, 22 nt, Human
acccugagggguauagcagaag

SEQ ID NO: 462556 - RNA, 22 nt, Human
uguccucaggaccuggcacagu

SEQ ID NO: 462557 - RNA, 22 nt, Human
agauuucaauggauauugcaag

SEQ ID NO: 462558 - RNA, 22 nt, Human
ugggaccugcucuuggaaugag

SEQ ID NO: 462559 - RNA, 22 nt, Human
ucugguaaccuuuaucccuccu

SEQ ID NO: 462560 - RNA, 22 nt, Human
aggccagaaaugucagggagug

SEQ ID NO: 462561 - RNA, 22 nt, Human
aaggccugaacaugaggagaug

SEQ ID NO: 462562 - RNA, 22 nt, Human
ggaggccaggaaggcucggaga

SEQ ID NO: 462563 - RNA, 21 nt, Human
gagugcagcaagguagagucu

SEQ ID NO: 462564 - RNA, 22 nt, Human
ccuggccugugaaucugagagc

SEQ ID NO: 462565 - RNA, 22 nt, Human
aaccugcaguuuuuauucugag

SEQ ID NO: 462566 - RNA, 22 nt, Human
uccauuuacuauucucauaucg

SEQ ID NO: 462567 - RNA, 22 nt, Human
aaguuucaaauauaaaauuaca

SEQ ID NO: 462568 - RNA, 19 nt, Human
uggcaggcccaggauggac

SEQ ID NO: 462569 - RNA, 20 nt, Human
agcuggccuguccuaggccu

SEQ ID NO: 462570 - RNA, 22 nt, Human
cugggcaggagggcucuaugga

SEQ ID NO: 462571 - RNA, 22 nt, Human
aggcugagucgggaggaucacu

SEQ ID NO: 462572 - RNA, 22 nt, Human
cagaggaagcuggguguggagu

SEQ ID NO: 462573 - RNA, 22 nt, Human
gcucucugaggugcuggcagag

SEQ ID NO: 462574 - RNA, 22 nt, Human
cagaagccugccucagaugcac

SEQ ID NO: 462575 - RNA, 22 nt, Human
uggaaagaaaaacaggccauga

SEQ ID NO: 462576 - RNA, 21 nt, Human
uccugcaggaggccugagagg

SEQ ID NO: 462577 - RNA, 22 nt, Human
aagagccagcuagugaagaggc

SEQ ID NO: 462578 - RNA, 22 nt, Human
auuauucuuaugucaucauggc

SEQ ID NO: 462579 - RNA, 21 nt, Human
cugcucugacagugaggccag

SEQ ID NO: 462580 - RNA, 23 nt, Human
uccagcagagccuuccaggaggg

SEQ ID NO: 462581 - RNA, 22 nt, Human
acugucugcuggccccugguua

SEQ ID NO: 462582 - RNA, 22 nt, Human
caugagaaguggccuucaaaaa

SEQ ID NO: 462583 - RNA, 22 nt, Human
acagccagggucucaggaggcg

SEQ ID NO: 462584 - RNA, 22 nt, Human
agucccagugacuuggccagaa

SEQ ID NO: 462585 - RNA, 22 nt, Human
cacacaggagagugcuggaggu

SEQ ID NO: 462586 - RNA, 19 nt, Human
aucugccuguuaucacaua

SEQ ID NO: 462587 - RNA, 18 nt, Human
ggcucaggcuauccuaac

SEQ ID NO: 462588 - RNA, 22 nt, Human
cagagaaacucagauagcugau

SEQ ID NO: 462589 - RNA, 22 nt, Human
ucacguuuuacugagugagaua

SEQ ID NO: 462590 - RNA, 22 nt, Human
cagagacagaaaauggaucuag

SEQ ID NO: 462591 - RNA, 22 nt, Human
ggcugagccuggagcaucuggu

SEQ ID NO: 462592 - RNA, 22 nt, Human
ggcugggcuccgggagcaugcg

SEQ ID NO: 462593 - RNA, 22 nt, Human
uugugaaauguuucaaaauagu

SEQ ID NO: 462594 - RNA, 20 nt, Human
uccagcugucuuucagagac

SEQ ID NO: 462595 - RNA, 22 nt, Human
cucagcagugacaagagaguau

SEQ ID NO: 462596 - RNA, 18 nt, Human
ggaaaaggagugucuagc

SEQ ID NO: 462597 - RNA, 22 nt, Human
cagcauuuucuuaauguaggug

SEQ ID NO: 462598 - RNA, 22 nt, Human
aaugcuguauaucuuagcuaau

SEQ ID NO: 462599 - RNA, 22 nt, Human
ggcuccacugcugaccacucca

SEQ ID NO: 462600 - RNA, 21 nt, Human
ucuuuccugcccaguugcccu

SEQ ID NO: 462601 - RNA, 22 nt, Human
aggaccugccaggugcaaagca

SEQ ID NO: 462602 - RNA, 22 nt, Human
ugccaggcccagcagggcggcc

SEQ ID NO: 462603 - RNA, 22 nt, Human
ugcaagaggaauucuagaagca

SEQ ID NO: 462604 - RNA, 22 nt, Human
uuguacuugccauagaacaaca

SEQ ID NO: 462605 - RNA, 22 nt, Human
ccugccugucccucaguccaca

SEQ ID NO: 462606 - RNA, 22 nt, Human
agcacagauucugaagaguccu

SEQ ID NO: 462607 - RNA, 22 nt, Human
ucuggcuuucauuuguuuaaag

SEQ ID NO: 462608 - RNA, 22 nt, Human
ggagaaggaagaaagcuacuau

SEQ ID NO: 462609 - RNA, 22 nt, Human
cugccucuguugggcauggucu

SEQ ID NO: 462610 - RNA, 22 nt, Human
ugugaaaggagccauagacagu

SEQ ID NO: 462611 - RNA, 22 nt, Human
aucuggcuccuacacuugaaga

SEQ ID NO: 462612 - RNA, 19 nt, Human
agggccugcagcucaagcu

SEQ ID NO: 462613 - RNA, 21 nt, Human
aaauguguuccauaaugcuuu

SEQ ID NO: 462614 - RNA, 21 nt, Human
aagggagauaggaaucaggcc

SEQ ID NO: 462615 - RNA, 22 nt, Human
aaagccagcaaggugaguuuca

SEQ ID NO: 462616 - RNA, 22 nt, Human
aucaggaucacagaaacuuuua

SEQ ID NO: 462617 - RNA, 22 nt, Human
cagcauggagacaaagugggca

SEQ ID NO: 462618 - RNA, 20 nt, Human
uccaagggcagcagaaucag

SEQ ID NO: 462619 - RNA, 22 nt, Human
cugcaggcccccuuccuggagu

SEQ ID NO: 462620 - RNA, 22 nt, Human
cagaggcagaggucaucucugg

SEQ ID NO: 462621 - RNA, 22 nt, Human
acuucuugggacccuggcaccg

SEQ ID NO: 462622 - RNA, 22 nt, Human
ugucacauaauuuaucuguagg

SEQ ID NO: 462623 - RNA, 22 nt, Human
gaggagcaugggaaggcucugg

SEQ ID NO: 462624 - RNA, 22 nt, Human
agcagaggacaguucuuaggaa

SEQ ID NO: 462625 - RNA, 22 nt, Human
cugggguggaggagcuccccug

SEQ ID NO: 462626 - RNA, 22 nt, Human
ugcugccacauuuaaagagggg

SEQ ID NO: 462627 - RNA, 22 nt, Human
caggauggugugagugugagga

SEQ ID NO: 462628 - RNA, 22 nt, Human
ugaggcaggaaguuauauaaug

SEQ ID NO: 462629 - RNA, 22 nt, Human
cagacacagauaugcauauggc

SEQ ID NO: 462630 - RNA, 22 nt, Human
caggaaugacugcagauggggc

SEQ ID NO: 462631 - RNA, 22 nt, Human
ucucaccaaagccuugaccaua

SEQ ID NO: 462632 - RNA, 18 nt, Human
gcaggugccacugcuguu

SEQ ID NO: 462633 - RNA, 22 nt, Human
aaguccagacuccuuugcgugg

SEQ ID NO: 462634 - RNA, 22 nt, Human
ggcucuggucagugaggggccu

SEQ ID NO: 462635 - RNA, 22 nt, Human
agccuggccacucagggccuga

SEQ ID NO: 462636 - RNA, 19 nt, Human
ccuguacauuauucucccc

SEQ ID NO: 462637 - RNA, 18 nt, Human
ugcucuguuuaaugauuu

SEQ ID NO: 462638 - RNA, 22 nt, Human
uucaagauggcugcaaauacuu

SEQ ID NO: 462639 - RNA, 22 nt, Human
auacaucuuccuuuuaaaaugc

SEQ ID NO: 462640 - RNA, 22 nt, Human
acagcagcauaaacugacuaag

SEQ ID NO: 462641 - RNA, 22 nt, Human
aggaaaaaagucugugauuaua

SEQ ID NO: 462642 - RNA, 22 nt, Human
ggcuuuauuauguggccaugug

SEQ ID NO: 462643 - RNA, 22 nt, Human
accaaaaauuguggggcugaau

SEQ ID NO: 462644 - RNA, 22 nt, Human
uuugcauuacuugacuuuaguu

SEQ ID NO: 462645 - RNA, 22 nt, Human
aauggcugggaguguauuuugg

SEQ ID NO: 462646 - RNA, 22 nt, Human
accagggcugacaaucugaugg

SEQ ID NO: 462647 - RNA, 22 nt, Human
uuuccucuuauacaguguuuau

SEQ ID NO: 462648 - RNA, 22 nt, Human
ggaagccaggccaaugagaaca

SEQ ID NO: 462649 - RNA, 20 nt, Human
aauuuacucacagaaugaau

SEQ ID NO: 462650 - RNA, 22 nt, Human
gggcugagugaccucaggccaa

SEQ ID NO: 462651 - RNA, 22 nt, Human
aggguauaaagagcaagcagaa

SEQ ID NO: 462652 - RNA, 22 nt, Human
ucacacacauggauaguauuuu

SEQ ID NO: 462653 - RNA, 22 nt, Human
uuaauuuauguccaaaccagau

SEQ ID NO: 462654 - RNA, 22 nt, Human
cccuggagcugcuugcauguug

SEQ ID NO: 462655 - RNA, 22 nt, Human
gggcagcagcaggaggucucug

SEQ ID NO: 462656 - RNA, 22 nt, Human
ggagcacuauaauagagauuuu

SEQ ID NO: 462657 - RNA, 22 nt, Human
aaugauugcaaacauugagaac

SEQ ID NO: 462658 - RNA, 22 nt, Human
cacugaagccugggaguaagac

SEQ ID NO: 462659 - RNA, 22 nt, Human
aauguguagggugccuguuuuu

SEQ ID NO: 462660 - RNA, 22 nt, Human
agagaaggucacuaaggaccca

SEQ ID NO: 462661 - RNA, 22 nt, Human
ccaggaggcggaagguacagug

SEQ ID NO: 462662 - RNA, 22 nt, Human
gcacaggcacagagggccacug

SEQ ID NO: 462663 - RNA, 22 nt, Human
uucacaaaacacuauuuucugg

SEQ ID NO: 462664 - RNA, 20 nt, Human
uuugucuguuaaguguuucu

SEQ ID NO: 462665 - RNA, 22 nt, Human
cccagcccccgagugucuggaa

SEQ ID NO: 462666 - RNA, 22 nt, Human
uggcagagugcggcauccccug

SEQ ID NO: 462667 - RNA, 23 nt, Human
agaggcaggaguggcuugcccgg

SEQ ID NO: 462668 - RNA, 22 nt, Human
cagugcccuuccaggacugcag

SEQ ID NO: 462669 - RNA, 22 nt, Human
aaagaagggacagacugccucu

SEQ ID NO: 462670 - RNA, 20 nt, Human
ugccaggcacggagugcaug

SEQ ID NO: 462671 - RNA, 20 nt, Human
aaaggaauauaugaaguaua

SEQ ID NO: 462672 - RNA, 22 nt, Human
cuuuggaagugaccacaauccu

SEQ ID NO: 462673 - RNA, 22 nt, Human
uaaauguguuguggaugaaguu

SEQ ID NO: 462674 - RNA, 22 nt, Human
guaagcaucugucucuucugca

SEQ ID NO: 462675 - RNA, 22 nt, Human
agggucagcuggcugucagggg

SEQ ID NO: 462676 - RNA, 22 nt, Human
aaguucuaauuuugcauucagg

SEQ ID NO: 462677 - RNA, 22 nt, Human
gugcaugugucuuuauaguagc

SEQ ID NO: 462678 - RNA, 22 nt, Human
uauucacaggcuggagugaugu

SEQ ID NO: 462679 - RNA, 22 nt, Human
gugcaggggaucagguugcagc

SEQ ID NO: 462680 - RNA, 21 nt, Human
gagacagacuuucguccccug

SEQ ID NO: 462681 - RNA, 22 nt, Human
cuucaagauauuucuagaauca

SEQ ID NO: 462682 - RNA, 22 nt, Human
gcaggugauucacccugggccu

SEQ ID NO: 462683 - RNA, 22 nt, Human
ccauuguaaagaguauacuuug

SEQ ID NO: 462684 - RNA, 22 nt, Human
gcuuuuauugucuuuacgacga

SEQ ID NO: 462685 - RNA, 22 nt, Human
ucaccuuagcuagaggaagaga

SEQ ID NO: 462686 - RNA, 22 nt, Human
uugcauugauguuccuucuugc

SEQ ID NO: 462687 - RNA, 22 nt, Human
gcucugugcaguucagggacac

SEQ ID NO: 462688 - RNA, 17 nt, Human
ccaggugggaggugggg

SEQ ID NO: 462689 - RNA, 20 nt, Human
gccagcccugacacaggagc

SEQ ID NO: 462690 - RNA, 22 nt, Human
ugcagggacaggcucuggggau

SEQ ID NO: 462691 - RNA, 22 nt, Human
uaaaauagcaugugcagugaaa

SEQ ID NO: 462692 - RNA, 22 nt, Human
gcagggcacagacagugccaag

SEQ ID NO: 462693 - RNA, 19 nt, Human
gcgaggaagucacuguggu

SEQ ID NO: 462694 - RNA, 20 nt, Human
uggcagaguugucccaccca

SEQ ID NO: 462695 - RNA, 20 nt, Human
ccagacagcaccugccuggu

SEQ ID NO: 462696 - RNA, 22 nt, Human
ucaccacugaacagaccuuugg

SEQ ID NO: 462697 - RNA, 22 nt, Human
acauuucuugaugccucuguga

SEQ ID NO: 462698 - RNA, 22 nt, Human
uccuucaguuaaagaucucaca

SEQ ID NO: 462699 - RNA, 22 nt, Human
ccuccagggcagacggggagca

SEQ ID NO: 462700 - RNA, 22 nt, Human
aggggccuggacauggacgcgc

SEQ ID NO: 462701 - RNA, 22 nt, Human
caggccugauacacugaacucu

SEQ ID NO: 462702 - RNA, 22 nt, Human
ggcagcugagcauggcuaccuu

SEQ ID NO: 462703 - RNA, 20 nt, Human
aucaggauucuugcuuuguu

SEQ ID NO: 462704 - RNA, 22 nt, Human
gcuggccuugugucugaggaag

SEQ ID NO: 462705 - RNA, 22 nt, Human
aagauggagcacgagcagaagc

SEQ ID NO: 462706 - RNA, 17 nt, Human
ucauuuguugugacuag

SEQ ID NO: 462707 - RNA, 22 nt, Human
cuccuggacauggagcggagga

SEQ ID NO: 462708 - RNA, 22 nt, Human
gaugguuuaugauagaugggaa

SEQ ID NO: 462709 - RNA, 22 nt, Human
acucugggccccagguggagcu

SEQ ID NO: 462710 - RNA, 22 nt, Human
gucaggauuggggucaugaguc

SEQ ID NO: 462711 - RNA, 22 nt, Human
uacauguaauuuucauaguaag

SEQ ID NO: 462712 - RNA, 22 nt, Human
uuguccuuggaugaagcuggga

SEQ ID NO: 462713 - RNA, 22 nt, Human
ggcugugagcaggcagaaugcu

SEQ ID NO: 462714 - RNA, 22 nt, Human
cagguggcuucucccuaggcca

SEQ ID NO: 462715 - RNA, 21 nt, Human
aggucccagguuugggcagca

SEQ ID NO: 462716 - RNA, 22 nt, Human
ucagcuggauguggaagugcua

SEQ ID NO: 462717 - RNA, 22 nt, Human
ugguuucccauuaucugcagga

SEQ ID NO: 462718 - RNA, 22 nt, Human
agcccucugcaaacaccugaua

SEQ ID NO: 462719 - RNA, 22 nt, Human
gauuucaaaaguagauccauca

SEQ ID NO: 462720 - RNA, 22 nt, Human
cagucccagcugcucagaaggc

SEQ ID NO: 462721 - RNA, 22 nt, Human
agaucucaccucuguguauuau

SEQ ID NO: 462722 - RNA, 22 nt, Human
uagaaaucagcaggcauaugua

SEQ ID NO: 462723 - RNA, 22 nt, Human
gccagggcugugcagguuuguu

SEQ ID NO: 462724 - RNA, 20 nt, Human
uccuggccucccuggggcuc

SEQ ID NO: 462725 - RNA, 22 nt, Human
ccugucagcugauggcuaugua

SEQ ID NO: 462726 - RNA, 21 nt, Human
gccugcaguuuugaagcccuu

SEQ ID NO: 462727 - RNA, 22 nt, Human
caugccaguuuugagaugcacc

SEQ ID NO: 462728 - RNA, 20 nt, Human
cucaggauacugcaaaguug

SEQ ID NO: 462729 - RNA, 22 nt, Human
agagccugugauugucaucacc

SEQ ID NO: 462730 - RNA, 22 nt, Human
uuucuacaguacugauuucaua

SEQ ID NO: 462731 - RNA, 22 nt, Human
cuuucuuauaccugucagggcc

SEQ ID NO: 462732 - RNA, 21 nt, Human
ucauuuuuauugcuaccuugc

SEQ ID NO: 462733 - RNA, 19 nt, Human
cuggugcuugagugaguca

SEQ ID NO: 462734 - RNA, 22 nt, Human
ucuguacaacaaagggaugaga

SEQ ID NO: 462735 - RNA, 22 nt, Human
gcacugaaauuauaugcauuug

SEQ ID NO: 462736 - RNA, 22 nt, Human
agugcagaguacauuuguggca

SEQ ID NO: 462737 - RNA, 22 nt, Human
aaauuauuacaagcuaguuggc

SEQ ID NO: 462738 - RNA, 19 nt, Human
cuugguuaugguaugaugc

SEQ ID NO: 462739 - RNA, 22 nt, Human
aauucuagcauugugaaaauau

SEQ ID NO: 462740 - RNA, 22 nt, Human
gcccucucuucugcagccucca

SEQ ID NO: 462741 - RNA, 22 nt, Human
auuguguaauuuucagcucaua

SEQ ID NO: 462742 - RNA, 22 nt, Human
ggagagcugguagcuggcucca

SEQ ID NO: 462743 - RNA, 22 nt, Human
gucagcugucuccccagagugg

SEQ ID NO: 462744 - RNA, 22 nt, Human
gagcuuuaagggauaaaaugau

SEQ ID NO: 462745 - RNA, 22 nt, Human
uccuugaauauaauaacaguag

SEQ ID NO: 462746 - RNA, 22 nt, Human
gaauucugucgcuuacuagaug

SEQ ID NO: 462747 - RNA, 22 nt, Human
aucaggaugaagcuguagcgaa

SEQ ID NO: 462748 - RNA, 22 nt, Human
cucugguucagggcucccuggc

SEQ ID NO: 462749 - RNA, 22 nt, Human
caagauggagaagcagcaaggg

SEQ ID NO: 462750 - RNA, 22 nt, Human
uccucaggaugugggguagaau

SEQ ID NO: 462751 - RNA, 22 nt, Human
augggaggaaggaggcccuuga

SEQ ID NO: 462752 - RNA, 22 nt, Human
cccauuuaaacacaagcuuuca

SEQ ID NO: 462753 - RNA, 22 nt, Human
aucucagggcuggagcccugga

SEQ ID NO: 462754 - RNA, 22 nt, Human
gcugcccauuccacuggauggu

SEQ ID NO: 462755 - RNA, 22 nt, Human
gggcacuguggggcccaugcug

SEQ ID NO: 462756 - RNA, 22 nt, Human
uggguagagcaggcuggggcuu

SEQ ID NO: 462757 - RNA, 22 nt, Human
aucacaggugguaggaaaagaa

SEQ ID NO: 462758 - RNA, 22 nt, Human
uuaacauuucuuuuccacucau

SEQ ID NO: 462759 - RNA, 22 nt, Human
uccucccugaguggggacagcu

SEQ ID NO: 462760 - RNA, 22 nt, Human
guauuaggugguggaauuguag

SEQ ID NO: 462761 - RNA, 22 nt, Human
ccaggcugcagucaaggggcau

SEQ ID NO: 462762 - RNA, 22 nt, Human
guucaaagcuccugguacagua

SEQ ID NO: 462763 - RNA, 22 nt, Human
caaagccauagaguagauaaga

SEQ ID NO: 462764 - RNA, 22 nt, Human
gggagccagcagggcauggagc

SEQ ID NO: 462765 - RNA, 22 nt, Human
ccagcuuuuagugggcuuauua

SEQ ID NO: 462766 - RNA, 22 nt, Human
cauugcacuccaucuugggcaa

SEQ ID NO: 462767 - RNA, 20 nt, Human
ggggcagguuuuuauggcua

SEQ ID NO: 462768 - RNA, 22 nt, Human
ugcuucaggaagaaacgccagg

SEQ ID NO: 462769 - RNA, 22 nt, Human
gcaggcugaugacuggaguugg

SEQ ID NO: 462770 - RNA, 21 nt, Human
auuuucauuuccaggggagga

SEQ ID NO: 462771 - RNA, 22 nt, Human
caggauggagaguuguugguug

SEQ ID NO: 462772 - RNA, 22 nt, Human
ggaggccacgguuuagcaccga

SEQ ID NO: 462773 - RNA, 22 nt, Human
aacaugaaacccaaacagaaua

SEQ ID NO: 462774 - RNA, 22 nt, Human
uggcccugaggacccagugugg

SEQ ID NO: 462775 - RNA, 22 nt, Human
uuaaauuuuagaaacagacucu

SEQ ID NO: 462776 - RNA, 22 nt, Human
aagcccaguuucacacugagac

SEQ ID NO: 462777 - RNA, 22 nt, Human
accugccuaguugguucugccc

SEQ ID NO: 462778 - RNA, 20 nt, Human
cugggcugcccagcuauggg

SEQ ID NO: 462779 - RNA, 21 nt, Human
ucccugcuuucuggcccaguc

SEQ ID NO: 462780 - RNA, 22 nt, Human
ugcacuccaggcugggugacag

SEQ ID NO: 462781 - RNA, 22 nt, Human
gcucccuguucucagccaugau

SEQ ID NO: 462782 - RNA, 22 nt, Human
caggugcuguccugcacauguc

SEQ ID NO: 462783 - RNA, 22 nt, Human
auucuuggagcagucaaagaag

SEQ ID NO: 462784 - RNA, 22 nt, Human
gaaugcacuuccaacaucuauu

SEQ ID NO: 462785 - RNA, 22 nt, Human
guaggcagucucucaggugauc

SEQ ID NO: 462786 - RNA, 22 nt, Human
cccuucucuuucacucacuauu

SEQ ID NO: 462787 - RNA, 22 nt, Human
ugcaggcugggaagagggacaa

SEQ ID NO: 462788 - RNA, 22 nt, Human
cagcagggaagcugugcuguuu

SEQ ID NO: 462789 - RNA, 22 nt, Human
uccaggcuagguuuacaggaca

SEQ ID NO: 462790 - RNA, 22 nt, Human
uguacauugucacucaucaagu

SEQ ID NO: 462791 - RNA, 22 nt, Human
agguggcaggaggucagagaaa

SEQ ID NO: 462792 - RNA, 22 nt, Human
cacuuggaggcccccugugccc

SEQ ID NO: 462793 - RNA, 22 nt, Human
ucucacagugcaggucugucuc

SEQ ID NO: 462794 - RNA, 22 nt, Human
agcaaacagugugcuaagaaau

SEQ ID NO: 462795 - RNA, 21 nt, Human
ucacaugcccauuacuggagc

SEQ ID NO: 462796 - RNA, 22 nt, Human
cauugcacuccagcuugggcaa

SEQ ID NO: 462797 - RNA, 22 nt, Human
cuucuuaacuguauauacuaug

SEQ ID NO: 462798 - RNA, 22 nt, Human
guuauuaguaagacucgcacau

SEQ ID NO: 462799 - RNA, 22 nt, Human
aaauguguuucgaaaacuggug

SEQ ID NO: 462800 - RNA, 22 nt, Human
augaugugugcugaucaagcuu

SEQ ID NO: 462801 - RNA, 22 nt, Human
ucagggcacugucaccugauau

SEQ ID NO: 462802 - RNA, 22 nt, Human
ucaggcaggcagagggcaaaug

SEQ ID NO: 462803 - RNA, 22 nt, Human
ggugaaggcacaagagggcaag

SEQ ID NO: 462804 - RNA, 22 nt, Human
agguggggaggagugucucuuu

SEQ ID NO: 462805 - RNA, 22 nt, Human
ucccagagcccaaguuggagag

SEQ ID NO: 462806 - RNA, 22 nt, Human
gccucugcaucuucgccgcacu

SEQ ID NO: 462807 - RNA, 23 nt, Human
cucugcaggagagugggcagggc

SEQ ID NO: 462808 - RNA, 22 nt, Human
agcagagccugggcuaggggug

SEQ ID NO: 462809 - RNA, 22 nt, Human
ugaguccaagagccagugggaa

SEQ ID NO: 462810 - RNA, 22 nt, Human
cagaaauggagcccaggaaucu

SEQ ID NO: 462811 - RNA, 21 nt, Human
ucugggcccaugcugccucac

SEQ ID NO: 462812 - RNA, 22 nt, Human
cagggccuuuuagcaucuucuc

SEQ ID NO: 462813 - RNA, 22 nt, Human
uggcucagccuggcccuuucau

SEQ ID NO: 462814 - RNA, 22 nt, Human
uguuccaugucuuuguaggacu

SEQ ID NO: 462815 - RNA, 22 nt, Human
uaacagaagaaaacauauugga

SEQ ID NO: 462816 - RNA, 19 nt, Human
ucagaggauuuggcuauga

SEQ ID NO: 462817 - RNA, 22 nt, Human
acucugccuuucagcagaugaa

SEQ ID NO: 462818 - RNA, 22 nt, Human
uucucuucuguucagugcccaa

SEQ ID NO: 462819 - RNA, 22 nt, Human
agaaaucacaggaggcagaagg

SEQ ID NO: 462820 - RNA, 22 nt, Human
cuggcugcgucugcucugacag

SEQ ID NO: 462821 - RNA, 18 nt, Human
cauaauuuucuuucuuua

SEQ ID NO: 462822 - RNA, 22 nt, Human
cugugcugauucagcacaggcc

SEQ ID NO: 462823 - RNA, 22 nt, Human
auaaagaggauguauuuacagc

SEQ ID NO: 462824 - RNA, 22 nt, Human
gcagccacccucaaggcugaau

SEQ ID NO: 462825 - RNA, 22 nt, Human
gcugcagcaagcccuccagggg

SEQ ID NO: 462826 - RNA, 21 nt, Human
ugauccuuucccccauguugc

SEQ ID NO: 462827 - RNA, 22 nt, Human
aggcccagcccguccucgugcu

SEQ ID NO: 462828 - RNA, 22 nt, Human
uucaaugagcccaagaacguga

SEQ ID NO: 462829 - RNA, 22 nt, Human
acauucuagaagucuuugcaau

SEQ ID NO: 462830 - RNA, 22 nt, Human
acagccuguuugaucuggugcu

SEQ ID NO: 462831 - RNA, 22 nt, Human
aaucuggcauguaagcuuagag

SEQ ID NO: 462832 - RNA, 22 nt, Human
agguaagggucacaguucauau

SEQ ID NO: 462833 - RNA, 18 nt, Human
agagcagcggcaucacac

SEQ ID NO: 462834 - RNA, 22 nt, Human
guuucgucaggcuuauucuauc

SEQ ID NO: 462835 - RNA, 22 nt, Human
acagaauugaaaguauaaucug

SEQ ID NO: 462836 - RNA, 22 nt, Human
guuucaaagcacagcucacauu

SEQ ID NO: 462837 - RNA, 22 nt, Human
gaagccccaaacccucgccauc

SEQ ID NO: 462838 - RNA, 22 nt, Human
cuguuuauaaauagaggggagu

SEQ ID NO: 462839 - RNA, 22 nt, Human
gcugucucggggcuuucuccug

SEQ ID NO: 462840 - RNA, 22 nt, Human
caagggugguauugggagcaua

SEQ ID NO: 462841 - RNA, 22 nt, Human
ccucuggucccagcucugcugc

SEQ ID NO: 462842 - RNA, 17 nt, Human
gcagccagugcagcagg

SEQ ID NO: 462843 - RNA, 22 nt, Human
agcugucagugcugugccugua

SEQ ID NO: 462844 - RNA, 22 nt, Human
ccugcuuaacauugccaugaca

SEQ ID NO: 462845 - RNA, 22 nt, Human
uuccuucucagcccucgaggau

SEQ ID NO: 462846 - RNA, 22 nt, Human
ccuggcagaauauuaaagugca

SEQ ID NO: 462847 - RNA, 19 nt, Human
aggcagcauucuggggcuu

SEQ ID NO: 462848 - RNA, 22 nt, Human
auugacaaucuacuauguucug

SEQ ID NO: 462849 - RNA, 22 nt, Human
agagcaauggcauccagcugau

SEQ ID NO: 462850 - RNA, 22 nt, Human
cagagcuguauuuaucuuucca

SEQ ID NO: 462851 - RNA, 22 nt, Human
cagggcuggauuucauuucuag

SEQ ID NO: 462852 - RNA, 22 nt, Human
gaugcugaagugaagugaucuu

SEQ ID NO: 462853 - RNA, 22 nt, Human
ugaggaaacugaggcacagaug

SEQ ID NO: 462854 - RNA, 22 nt, Human
gcucccugcagcugagaguucc

SEQ ID NO: 462855 - RNA, 21 nt, Human
agagccugagaucuuccagca

SEQ ID NO: 462856 - RNA, 22 nt, Human
uggagaagcuguagguggacuc

SEQ ID NO: 462857 - RNA, 22 nt, Human
auagacauauggcuuuguuucu

SEQ ID NO: 462858 - RNA, 22 nt, Human
uauuucuucgggauucaagcua

SEQ ID NO: 462859 - RNA, 22 nt, Human
acuguacaugcaucuugucuau

SEQ ID NO: 462860 - RNA, 22 nt, Human
cucagggcaguauggcugagag

SEQ ID NO: 462861 - RNA, 22 nt, Human
aguggcagagccaagauaugau

SEQ ID NO: 462862 - RNA, 22 nt, Human
ucugggcuuuacacugugcuua

SEQ ID NO: 462863 - RNA, 22 nt, Human
aagagcuggaguuugcagcccu

SEQ ID NO: 462864 - RNA, 22 nt, Human
cagcagcuacuuggagcagcag

SEQ ID NO: 462865 - RNA, 18 nt, Human
ucauuuguuuugcaugaa

SEQ ID NO: 462866 - RNA, 22 nt, Human
caggagugaaaugaggcccagg

SEQ ID NO: 462867 - RNA, 22 nt, Human
ugcuauugugaacagugccaca

SEQ ID NO: 462868 - RNA, 22 nt, Human
guguccucuuauugcucuuggc

SEQ ID NO: 462869 - RNA, 21 nt, Human
ucagagagucacagugaacug

SEQ ID NO: 462870 - RNA, 22 nt, Human
agggagccuuccuggcuguggu

SEQ ID NO: 462871 - RNA, 22 nt, Human
ccugcccagcuucccgagugca

SEQ ID NO: 462872 - RNA, 22 nt, Human
agguacaguagacagacaguua

SEQ ID NO: 462873 - RNA, 22 nt, Human
gaggcacauauauacagagccc

SEQ ID NO: 462874 - RNA, 22 nt, Human
agaaaauauucauugagaggcu

SEQ ID NO: 462875 - RNA, 22 nt, Human
gccagccccuuagggcucuccc

SEQ ID NO: 462876 - RNA, 22 nt, Human
cagggcucaccacugggauccu

SEQ ID NO: 462877 - RNA, 22 nt, Human
cucuuaaauaacaucauugcuu

SEQ ID NO: 462878 - RNA, 22 nt, Human
auuguauuuccagcuugaaugu

SEQ ID NO: 462879 - RNA, 22 nt, Human
aaaaguuaccucuguaauauaa

SEQ ID NO: 462880 - RNA, 22 nt, Human
ggugggcagcucuuggcaggca

SEQ ID NO: 462881 - RNA, 22 nt, Human
uggaaacuaagacuagagagac

SEQ ID NO: 462882 - RNA, 22 nt, Human
agacccagaaagcagcugcauu

SEQ ID NO: 462883 - RNA, 22 nt, Human
uggugcugacaguucugagugc

SEQ ID NO: 462884 - RNA, 22 nt, Human
cugucucucuaggacacugggg

SEQ ID NO: 462885 - RNA, 19 nt, Human
ggagaagcaucuagaaaua

SEQ ID NO: 462886 - RNA, 21 nt, Human
ccagagccugcugagcccccu

SEQ ID NO: 462887 - RNA, 20 nt, Human
cuuagaaauuuuuacccugg

SEQ ID NO: 462888 - RNA, 22 nt, Human
gcagggcaaauguggaaaggag

SEQ ID NO: 462889 - RNA, 22 nt, Human
gacagccaugcacuucugcugu

SEQ ID NO: 462890 - RNA, 22 nt, Human
cuucuuaaugacagauuaaaau

SEQ ID NO: 462891 - RNA, 22 nt, Human
ggagagaauuccauggacaugu

SEQ ID NO: 462892 - RNA, 22 nt, Human
ggggauggugggaaggcaaucu

SEQ ID NO: 462893 - RNA, 22 nt, Human
ucuuagaaugucaacugauguu

SEQ ID NO: 462894 - RNA, 22 nt, Human
gcagggaggaagagaugcuucc

SEQ ID NO: 462895 - RNA, 22 nt, Human
aggcacugugcuucuuauaugu

SEQ ID NO: 462896 - RNA, 22 nt, Human
uuugaaagaauuuauguacuuu

SEQ ID NO: 462897 - RNA, 22 nt, Human
auacauacguacauacguaugu

SEQ ID NO: 462898 - RNA, 22 nt, Human
cugccuugaaaaugaagcuuua

SEQ ID NO: 462899 - RNA, 22 nt, Human
ccaggcagccaagugugugugu

SEQ ID NO: 462900 - RNA, 22 nt, Human
uguuaaucaaucaacaguauua

SEQ ID NO: 462901 - RNA, 22 nt, Human
uuacaaguauuuaagaugcugu

SEQ ID NO: 462902 - RNA, 22 nt, Human
gugcugucguggaacugggcug

SEQ ID NO: 462903 - RNA, 22 nt, Human
ucaguggagcuaagcaugagau

SEQ ID NO: 462904 - RNA, 22 nt, Human
gccuggagaauuaaaaggaagg

SEQ ID NO: 462905 - RNA, 22 nt, Human
cagggcagggauguugcggcag

SEQ ID NO: 462906 - RNA, 22 nt, Human
caugucuugcccugauuaguag

SEQ ID NO: 462907 - RNA, 22 nt, Human
acaguguucacuuaacaaugga

SEQ ID NO: 462908 - RNA, 22 nt, Human
ucucaugugauucccgugcaug

SEQ ID NO: 462909 - RNA, 22 nt, Human
auggagugggccaauuuuagug

SEQ ID NO: 462910 - RNA, 22 nt, Human
agagcuuagaauuucagaugau

SEQ ID NO: 462911 - RNA, 22 nt, Human
cacagcugccauggcugcacuu

SEQ ID NO: 462912 - RNA, 22 nt, Human
aaagcugcugccaaucaggcuu

SEQ ID NO: 462913 - RNA, 22 nt, Human
uugcucaggcuuagagcuacua

SEQ ID NO: 462914 - RNA, 22 nt, Human
uuuucaucucugcuuuguaccu

SEQ ID NO: 462915 - RNA, 22 nt, Human
gggcagaggggcgcuucccucu

SEQ ID NO: 462916 - RNA, 22 nt, Human
uugaagcacaaugucuuuuauc

SEQ ID NO: 462917 - RNA, 22 nt, Human
caauguguguguuuuucucaac

SEQ ID NO: 462918 - RNA, 22 nt, Human
ggugucccaggccagcugugug

SEQ ID NO: 462919 - RNA, 22 nt, Human
gagucccaugaugauagccaca

SEQ ID NO: 462920 - RNA, 22 nt, Human
ugucaugcuuauguuacauacu

SEQ ID NO: 462921 - RNA, 22 nt, Human
auauuaggugcucaauacaugc

SEQ ID NO: 462922 - RNA, 22 nt, Human
ggccucagugggccgcugcagg

SEQ ID NO: 462923 - RNA, 22 nt, Human
uuucuuccuuaccuuacuagag

SEQ ID NO: 462924 - RNA, 18 nt, Human
agcuggcccuggcugccg

SEQ ID NO: 462925 - RNA, 22 nt, Human
aacuuaaacccacucauguaga

SEQ ID NO: 462926 - RNA, 22 nt, Human
aagucagagcaacugagacauu

SEQ ID NO: 462927 - RNA, 22 nt, Human
gcggcaggaagagcgcagcccc

SEQ ID NO: 462928 - RNA, 22 nt, Human
gcagagugccgagauggaagcg

SEQ ID NO: 462929 - RNA, 22 nt, Human
ugucaccucuuuggcugcagcu

SEQ ID NO: 462930 - RNA, 23 nt, Human
uggcagcagaucuuaaagugacc

SEQ ID NO: 462931 - RNA, 22 nt, Human
cacagggccuggggcagcugcu

SEQ ID NO: 462932 - RNA, 22 nt, Human
uucaaucauuagaaucucaggc

SEQ ID NO: 462933 - RNA, 22 nt, Human
uuuuuaagagauucuccagucu

SEQ ID NO: 462934 - RNA, 22 nt, Human
gagcagcuguccccaaagcuuc

SEQ ID NO: 462935 - RNA, 22 nt, Human
caugcacaacauacucaagagg

SEQ ID NO: 462936 - RNA, 22 nt, Human
guugaaaguggagaaccugguu

SEQ ID NO: 462937 - RNA, 22 nt, Human
agugugggugagggaggcccuc

SEQ ID NO: 462938 - RNA, 22 nt, Human
agaaaaggauugauggaucaga

SEQ ID NO: 462939 - RNA, 22 nt, Human
agaaaguucacugguauauuuu

SEQ ID NO: 462940 - RNA, 22 nt, Human
ccaccuccaccuauugccagcc

SEQ ID NO: 462941 - RNA, 21 nt, Human
aggcccagcuuuccucuugcu

SEQ ID NO: 462942 - RNA, 22 nt, Human
ugcagggaaaguguuggcagca

SEQ ID NO: 462943 - RNA, 22 nt, Human
ucuggagaacuugcaagaggau

SEQ ID NO: 462944 - RNA, 22 nt, Human
auccuucaaggggcugacagcu

SEQ ID NO: 462945 - RNA, 22 nt, Human
agcaugcacaugacuggcuuaa

SEQ ID NO: 462946 - RNA, 20 nt, Human
uuccagagaucugcauuuua

SEQ ID NO: 462947 - RNA, 22 nt, Human
uuucuauugaucuaauaaacau

SEQ ID NO: 462948 - RNA, 22 nt, Human
caguagcagggauuauuuuagg

SEQ ID NO: 462949 - RNA, 22 nt, Human
aaguguuaaaagauuaaaugcu

SEQ ID NO: 462950 - RNA, 22 nt, Human
cugccaggcacgugcagcauca

SEQ ID NO: 462951 - RNA, 21 nt, Human
aaguggagaagaaaagcugga

SEQ ID NO: 462952 - RNA, 22 nt, Human
uaaaauguuugcaagagaccag

SEQ ID NO: 462953 - RNA, 22 nt, Human
agggcacagccuaaagccuaug

SEQ ID NO: 462954 - RNA, 22 nt, Human
auggggugaccaugagcauuua

SEQ ID NO: 462955 - RNA, 22 nt, Human
aaggcugcuuuuaacaugcaua

SEQ ID NO: 462956 - RNA, 22 nt, Human
gaggccagaaugagcugaaugc

SEQ ID NO: 462957 - RNA, 22 nt, Human
cagcacaauuuucaggagucca

SEQ ID NO: 462958 - RNA, 22 nt, Human
cugcagaggguuugagcauccu

SEQ ID NO: 462959 - RNA, 22 nt, Human
caggcagaagaaguggaaggac

SEQ ID NO: 462960 - RNA, 22 nt, Human
uacaugaacaaaauagcagaaa

SEQ ID NO: 462961 - RNA, 22 nt, Human
uagccggguguugugucaugca

SEQ ID NO: 462962 - RNA, 22 nt, Human
guccucaguaagagggccucug

SEQ ID NO: 462963 - RNA, 22 nt, Human
agcagggcaugaauaaggguuu

SEQ ID NO: 462964 - RNA, 22 nt, Human
ugacaugcuuguuuuccuugaa

SEQ ID NO: 462965 - RNA, 22 nt, Human
aaggccaggagacuuggaguca

SEQ ID NO: 462966 - RNA, 22 nt, Human
ugaaaucuccucuuuauauauc

SEQ ID NO: 462967 - RNA, 22 nt, Human
gccaggcucagcagucaaccug

SEQ ID NO: 462968 - RNA, 22 nt, Human
gagaggcugacuggcuguccug

SEQ ID NO: 462969 - RNA, 22 nt, Human
cagagguacaagcuaaguuggg

SEQ ID NO: 462970 - RNA, 22 nt, Human
cucugggcacauuuuccaggac

SEQ ID NO: 462971 - RNA, 22 nt, Human
aaugauuuggcaaaggaaucca

SEQ ID NO: 462972 - RNA, 22 nt, Human
acuguacauauggauucuaaga

SEQ ID NO: 462973 - RNA, 22 nt, Human
gccuuaggggucagacagagcu

SEQ ID NO: 462974 - RNA, 22 nt, Human
ugggcugcuuccucagcugaga

SEQ ID NO: 462975 - RNA, 22 nt, Human
cagcucugaagaaaggugucua

SEQ ID NO: 462976 - RNA, 22 nt, Human
auguccagaguaaagcacauuc

SEQ ID NO: 462977 - RNA, 22 nt, Human
ucugcaggaaaaaagugccugg

SEQ ID NO: 462978 - RNA, 22 nt, Human
agcaguccaacugagguggcau

SEQ ID NO: 462979 - RNA, 22 nt, Human
gggcaaguccggugcccagagc

SEQ ID NO: 462980 - RNA, 22 nt, Human
agggagccagaguugggagcuc

SEQ ID NO: 462981 - RNA, 22 nt, Human
cugaagcaaaggaucgagcuaa

SEQ ID NO: 462982 - RNA, 22 nt, Human
gggcugaaaggccgccucagau

SEQ ID NO: 462983 - RNA, 22 nt, Human
gaaaggccagcucacagaugag

SEQ ID NO: 462984 - RNA, 22 nt, Human
uccugcagugugucuccugcac

SEQ ID NO: 462985 - RNA, 22 nt, Human
ugcaggugugguuccucagcca

SEQ ID NO: 462986 - RNA, 22 nt, Human
ugaaggcagcaugcacacuagu

SEQ ID NO: 462987 - RNA, 22 nt, Human
gccagcagcccagaaggacuuu

SEQ ID NO: 462988 - RNA, 21 nt, Human
aggaaaggccagcacguaggg

SEQ ID NO: 462989 - RNA, 22 nt, Human
caguuccuaugggcaaaacaca

SEQ ID NO: 462990 - RNA, 22 nt, Human
ccuucccuaaagcgucgcuuag

SEQ ID NO: 462991 - RNA, 23 nt, Human
uccuuccuuugagaggcuccauc

SEQ ID NO: 462992 - RNA, 22 nt, Human
cuggcagcauuaacagagagca

SEQ ID NO: 462993 - RNA, 22 nt, Human
uuuguuagagugugggaggcug

SEQ ID NO: 462994 - RNA, 22 nt, Human
ucugggcuugguuagggcuguu

SEQ ID NO: 462995 - RNA, 22 nt, Human
gguuucaaugagaagugcuugu

SEQ ID NO: 462996 - RNA, 22 nt, Human
caguacuugggggguucuaagu

SEQ ID NO: 462997 - RNA, 22 nt, Human
agaaaucauucccaaacccaua

SEQ ID NO: 462998 - RNA, 22 nt, Human
ggaggcucgcuggucgcacagc

SEQ ID NO: 462999 - RNA, 22 nt, Human
ugaucaguguugguucuaucua

SEQ ID NO: 463000 - RNA, 23 nt, Human
cacaccaggagccgucugggcca

SEQ ID NO: 463001 - RNA, 22 nt, Human
aagcacagaaaaggagcaugga

SEQ ID NO: 463002 - RNA, 22 nt, Human
cugcccugaccugccucagagu

SEQ ID NO: 463003 - RNA, 20 nt, Human
acuuuggggucuuucucaga

SEQ ID NO: 463004 - RNA, 22 nt, Human
ugggaguggggcauagaaggua

SEQ ID NO: 463005 - RNA, 22 nt, Human
gcuuggccagcagccgggaugc

SEQ ID NO: 463006 - RNA, 22 nt, Human
ugaagugaccuggggcagugua

SEQ ID NO: 463007 - RNA, 22 nt, Human
ccaaaugcuccacugacuuugg

SEQ ID NO: 463008 - RNA, 22 nt, Human
ucaggcagaggauggggagcgu

SEQ ID NO: 463009 - RNA, 22 nt, Human
agcagcauguugggaugugaaa

SEQ ID NO: 463010 - RNA, 22 nt, Human
ucaggacagccagggugcagac

SEQ ID NO: 463011 - RNA, 22 nt, Human
uuaugacauaugaguacaagua

SEQ ID NO: 463012 - RNA, 22 nt, Human
agugaaaugacugaaucagaua

SEQ ID NO: 463013 - RNA, 22 nt, Human
aggcugugacagggucauggag

SEQ ID NO: 463014 - RNA, 22 nt, Human
agugauggugagugagaagcuc

SEQ ID NO: 463015 - RNA, 20 nt, Human
ggcagcaggaguuuccucuu

SEQ ID NO: 463016 - RNA, 17 nt, Human
ucugucuugacugucac

SEQ ID NO: 463017 - RNA, 22 nt, Human
aaaugugugcacaaagacagcu

SEQ ID NO: 463018 - RNA, 22 nt, Human
ccagcuggcaggagagucaggg

SEQ ID NO: 463019 - RNA, 23 nt, Human
aaggccagaauuucaauggugcc

SEQ ID NO: 463020 - RNA, 22 nt, Human
aaggcgacacaggcagcaggcc

SEQ ID NO: 463021 - RNA, 22 nt, Human
aaaaguauaggguuuggaguca

SEQ ID NO: 463022 - RNA, 22 nt, Human
ugggcacuguagcuggugcugg

SEQ ID NO: 463023 - RNA, 22 nt, Human
gcuggcuuugcacugggugcau

SEQ ID NO: 463024 - RNA, 22 nt, Human
ucucagaggugcccuggcaucu

SEQ ID NO: 463025 - RNA, 22 nt, Human
agggcagagaaauguaguugag

SEQ ID NO: 463026 - RNA, 22 nt, Human
cugccugugcaugcagucagaa

SEQ ID NO: 463027 - RNA, 22 nt, Human
cuccagugcgcaggacagcccc

SEQ ID NO: 463028 - RNA, 22 nt, Human
uucaaguucauguguagucagu

SEQ ID NO: 463029 - RNA, 22 nt, Human
gccagcccagcuccaggggaaa

SEQ ID NO: 463030 - RNA, 22 nt, Human
uggcauuuuguucaguauaugg

SEQ ID NO: 463031 - RNA, 22 nt, Human
acagaaauaacuuuuuauguuu

SEQ ID NO: 463032 - RNA, 22 nt, Human
agggcaguucaacuucauagug

SEQ ID NO: 463033 - RNA, 22 nt, Human
guccuggcuuaguucgcuguaa

SEQ ID NO: 463034 - RNA, 22 nt, Human
uugaaaggccuguuuauccagc

SEQ ID NO: 463035 - RNA, 22 nt, Human
cucagagucccuucccucgugg

SEQ ID NO: 463036 - RNA, 22 nt, Human
ggcacagggagccgcaguugca

SEQ ID NO: 463037 - RNA, 22 nt, Human
auguagcagauauuugugcaca

SEQ ID NO: 463038 - RNA, 18 nt, Human
cagaaguccuucaaggcc

SEQ ID NO: 463039 - RNA, 22 nt, Human
cuggagccccagacagggagag

SEQ ID NO: 463040 - RNA, 22 nt, Human
ggggagaguccuuuccaguucc

SEQ ID NO: 463041 - RNA, 19 nt, Human
gagcccucuccauggccac

SEQ ID NO: 463042 - RNA, 22 nt, Human
aggagggagcuuaagccaggca

SEQ ID NO: 463043 - RNA, 22 nt, Human
aaugcacauaaauauggucuua

SEQ ID NO: 463044 - RNA, 22 nt, Human
aguccagucucacucuuggcag

SEQ ID NO: 463045 - RNA, 22 nt, Human
ggauccuucuuugaccucacag

SEQ ID NO: 463046 - RNA, 20 nt, Human
aguuuauuccaggagaacug

SEQ ID NO: 463047 - RNA, 22 nt, Human
ggcaguggugggaggcucgcuc

SEQ ID NO: 463048 - RNA, 22 nt, Human
cacugccugugagcugugugcc

SEQ ID NO: 463049 - RNA, 22 nt, Human
auuugauuagcuguguaauuuu

SEQ ID NO: 463050 - RNA, 22 nt, Human
ccagguggugaaagugggcccu

SEQ ID NO: 463051 - RNA, 22 nt, Human
uauuuuguuaauaauccagucc

SEQ ID NO: 463052 - RNA, 23 nt, Human
agguucaggagauggaggaacaa

SEQ ID NO: 463053 - RNA, 22 nt, Human
ucccagggcagcuguccagaag

SEQ ID NO: 463054 - RNA, 22 nt, Human
ugccugucuuuccucccucgua

SEQ ID NO: 463055 - RNA, 22 nt, Human
ucugaaauguucucuuguuuug

SEQ ID NO: 463056 - RNA, 22 nt, Human
agagcugccgagcuggggccau

SEQ ID NO: 463057 - RNA, 20 nt, Human
ugacucugcaaccgucucuc

SEQ ID NO: 463058 - RNA, 22 nt, Human
ucugggggcgaccagggacugc

SEQ ID NO: 463059 - RNA, 22 nt, Human
ucuuuauugcuacugguuuguc

SEQ ID NO: 463060 - RNA, 22 nt, Human
ugcagagaaaccaguggaggac

SEQ ID NO: 463061 - RNA, 23 nt, Human
ugcagagggacugaagccagcuu

SEQ ID NO: 463062 - RNA, 23 nt, Human
ugagcugguauuguccaucucca

SEQ ID NO: 463063 - RNA, 22 nt, Human
agauuucagguuggggcagaag

SEQ ID NO: 463064 - RNA, 22 nt, Human
ugucucagaguaucccugaacu

SEQ ID NO: 463065 - RNA, 22 nt, Human
gcuucuauuauuuggagcugag

SEQ ID NO: 463066 - RNA, 22 nt, Human
ugucagugaguuaguugcaagu

SEQ ID NO: 463067 - RNA, 22 nt, Human
caccugagugucaguauucuca

SEQ ID NO: 463068 - RNA, 20 nt, Human
ugggcugaggaucaggugcc

SEQ ID NO: 463069 - RNA, 22 nt, Human
uaacagaaaagaacugaguuug

SEQ ID NO: 463070 - RNA, 22 nt, Human
cucccuggaggugagcuggcac

SEQ ID NO: 463071 - RNA, 22 nt, Human
ucagcuuucucucgccaucagg

SEQ ID NO: 463072 - RNA, 21 nt, Human
gagcauggcuuacaucagcag

SEQ ID NO: 463073 - RNA, 22 nt, Human
uggaggaaguugcuggaaguca

SEQ ID NO: 463074 - RNA, 22 nt, Human
ugucucugaggugagggucagc

SEQ ID NO: 463075 - RNA, 22 nt, Human
aaaacaggugucagcaaacuau

SEQ ID NO: 463076 - RNA, 22 nt, Human
ccucucaucauuaucgcuuugu

SEQ ID NO: 463077 - RNA, 22 nt, Human
ggaugcaggacggcauggaugu

SEQ ID NO: 463078 - RNA, 22 nt, Human
uccaugugccaaggggcagagg

SEQ ID NO: 463079 - RNA, 22 nt, Human
guagcuuauuagggauaauagu

SEQ ID NO: 463080 - RNA, 22 nt, Human
cugagccagagggagucggguc

SEQ ID NO: 463081 - RNA, 22 nt, Human
guacauuggcaacucucuuaga

SEQ ID NO: 463082 - RNA, 22 nt, Human
aggccaggaccauuagcccaga

SEQ ID NO: 463083 - RNA, 22 nt, Human
gaggccaggagugcuguaaguu

SEQ ID NO: 463084 - RNA, 22 nt, Human
aaacaugcauucaagaaaaucu

SEQ ID NO: 463085 - RNA, 22 nt, Human
uucauucccuuauauuagcauu

SEQ ID NO: 463086 - RNA, 22 nt, Human
agcagccacagucugggacagg

SEQ ID NO: 463087 - RNA, 22 nt, Human
cauugucacccaaagcucauag

SEQ ID NO: 463088 - RNA, 22 nt, Human
ggguggcuccuaugggcauagc

SEQ ID NO: 463089 - RNA, 22 nt, Human
auaaggcagucccuuaacaagg

SEQ ID NO: 463090 - RNA, 22 nt, Human
uugaaaggcacaggcaccuggg

SEQ ID NO: 463091 - RNA, 22 nt, Human
gucccacaccuugaggggucuu

SEQ ID NO: 463092 - RNA, 19 nt, Human
agagaggcugugugaggga

SEQ ID NO: 463093 - RNA, 22 nt, Human
acuuaaaaccagacagcgucau

SEQ ID NO: 463094 - RNA, 22 nt, Human
agggccugucagcgguguccug

SEQ ID NO: 463095 - RNA, 22 nt, Human
auccuugagaaaauaaaugacc

SEQ ID NO: 463096 - RNA, 22 nt, Human
ccucccucuuucagucccacag

SEQ ID NO: 463097 - RNA, 22 nt, Human
uugguuuacuaggauucaaauu

SEQ ID NO: 463098 - RNA, 22 nt, Human
gcucccaguucccaaagugacc

SEQ ID NO: 463099 - RNA, 22 nt, Human
uccaggcagggcagccaucaag

SEQ ID NO: 463100 - RNA, 22 nt, Human
ugcauaaagugccauaguauua

SEQ ID NO: 463101 - RNA, 22 nt, Human
agacuguaauugacaugucagc

SEQ ID NO: 463102 - RNA, 21 nt, Human
gcagagccggggcgagaaggc

SEQ ID NO: 463103 - RNA, 22 nt, Human
ggaggcugcugccucacguggg

SEQ ID NO: 463104 - RNA, 17 nt, Human
aggcugcugggccaggg

SEQ ID NO: 463105 - RNA, 22 nt, Human
agugcaaaauucagaagcaauu

SEQ ID NO: 463106 - RNA, 22 nt, Human
agugaguggguuacagauggga

SEQ ID NO: 463107 - RNA, 22 nt, Human
cgccaggcuugguagcucaugc

SEQ ID NO: 463108 - RNA, 22 nt, Human
guuugcauuuauuagucuucug

SEQ ID NO: 463109 - RNA, 22 nt, Human
aucuaagaguuaacaucaagaa

SEQ ID NO: 463110 - RNA, 22 nt, Human
acaguuucuccauuuacaccuu

SEQ ID NO: 463111 - RNA, 22 nt, Human
ugcugccagccaggccauggag

SEQ ID NO: 463112 - RNA, 22 nt, Human
ucuagaaaaaaacugcugugga

SEQ ID NO: 463113 - RNA, 22 nt, Human
ugggcugcggauaggccucgga

SEQ ID NO: 463114 - RNA, 20 nt, Human
cagcuuuagaucuuugauua

SEQ ID NO: 463115 - RNA, 22 nt, Human
gcucaggauuucauccaugugu

SEQ ID NO: 463116 - RNA, 22 nt, Human
auaguauuuaauaguuagcuca

SEQ ID NO: 463117 - RNA, 22 nt, Human
ugcagugggccggaggccaggg

SEQ ID NO: 463118 - RNA, 22 nt, Human
agcaggaaagaaaaaucugugu

SEQ ID NO: 463119 - RNA, 22 nt, Human
cuucccacuaguaucacagagc

SEQ ID NO: 463120 - RNA, 22 nt, Human
acuguggccugcuguaugggcu

SEQ ID NO: 463121 - RNA, 22 nt, Human
cuuggcugucuauaggaaagag

SEQ ID NO: 463122 - RNA, 20 nt, Human
cugcagggugagugggcgau

SEQ ID NO: 463123 - RNA, 22 nt, Human
uggaggccagagguacugggac

SEQ ID NO: 463124 - RNA, 22 nt, Human
aggcagccaguucagguuucuu

SEQ ID NO: 463125 - RNA, 22 nt, Human
auguuucaucaguaagguuuug

SEQ ID NO: 463126 - RNA, 22 nt, Human
ucuacaaagaagaauuaauguc

SEQ ID NO: 463127 - RNA, 22 nt, Human
cagcaucaccgccauuucugau

SEQ ID NO: 463128 - RNA, 22 nt, Human
aauguuaaaaccuucagugcuu

SEQ ID NO: 463129 - RNA, 22 nt, Human
ggagccuuccagacugcccaca

SEQ ID NO: 463130 - RNA, 22 nt, Human
guuccauaucacagcagacgaa

SEQ ID NO: 463131 - RNA, 22 nt, Human
agccuccaaaugucaggucccg

SEQ ID NO: 463132 - RNA, 22 nt, Human
aacaaucaaguuucuaaaugac

SEQ ID NO: 463133 - RNA, 22 nt, Human
ucuugccucuuccccuuuccau

SEQ ID NO: 463134 - RNA, 22 nt, Human
ccagagaggccuuggcaagaca

SEQ ID NO: 463135 - RNA, 22 nt, Human
agucacuguucugucaugucaa

SEQ ID NO: 463136 - RNA, 22 nt, Human
caaaugaagaaccuucucaccu

SEQ ID NO: 463137 - RNA, 22 nt, Human
uugccaggagcucaucugaggg

SEQ ID NO: 463138 - RNA, 22 nt, Human
caggcagcugggucaccguccc

SEQ ID NO: 463139 - RNA, 22 nt, Human
gagugcaguuggggugagggga

SEQ ID NO: 463140 - RNA, 22 nt, Human
agcuuuaucagaggagucucua

SEQ ID NO: 463141 - RNA, 22 nt, Human
cuccucccugcgauugcucugc

SEQ ID NO: 463142 - RNA, 22 nt, Human
cucagagauauagucccugcuu

SEQ ID NO: 463143 - RNA, 22 nt, Human
ugagcccagucugucugacaug

SEQ ID NO: 463144 - RNA, 21 nt, Human
guuuucaugauagagucugua

SEQ ID NO: 463145 - RNA, 22 nt, Human
ucaggggagguugaaucgucuc

SEQ ID NO: 463146 - RNA, 23 nt, Human
cuggccuccgacacuggccaaga

SEQ ID NO: 463147 - RNA, 22 nt, Human
aggcugggcuccgcccaacucc

SEQ ID NO: 463148 - RNA, 22 nt, Human
gagggcugauaaaugcgcaugg

SEQ ID NO: 463149 - RNA, 22 nt, Human
ggcuuucuagaucuagcucugu

SEQ ID NO: 463150 - RNA, 19 nt, Human
ggugugaagugaggaguua

SEQ ID NO: 463151 - RNA, 22 nt, Human
gguuugcauucugaaaggcuca

SEQ ID NO: 463152 - RNA, 22 nt, Human
gguagcagggcugugagucaga

SEQ ID NO: 463153 - RNA, 22 nt, Human
ucucauguauugcccuggugug

SEQ ID NO: 463154 - RNA, 22 nt, Human
agccucugguccucccucagcu

SEQ ID NO: 463155 - RNA, 19 nt, Human
uccaaaggacccaccucca

SEQ ID NO: 463156 - RNA, 22 nt, Human
auuuccaagaaagcuuuaggau

SEQ ID NO: 463157 - RNA, 22 nt, Human
uaccugcacagccagccaugug

SEQ ID NO: 463158 - RNA, 23 nt, Human
ucuggcuccauccuuggggaucc

SEQ ID NO: 463159 - RNA, 22 nt, Human
uuguuacagcacuuaaccuuuu

SEQ ID NO: 463160 - RNA, 22 nt, Human
cagcugcccauccugggaaaug

SEQ ID NO: 463161 - RNA, 22 nt, Human
ucucugucccuaggagccuugc

SEQ ID NO: 463162 - RNA, 22 nt, Human
gaggaacccagcugggguugcc

SEQ ID NO: 463163 - RNA, 22 nt, Human
ugaaagcacucacuucugcucu

SEQ ID NO: 463164 - RNA, 22 nt, Human
ccuguccuccaagagcacaucu

SEQ ID NO: 463165 - RNA, 22 nt, Human
cugcucugagaggcucuuccua

SEQ ID NO: 463166 - RNA, 22 nt, Human
ugcucuucggggccacugcuug

SEQ ID NO: 463167 - RNA, 22 nt, Human
acacaguauuacaauaggugcu

SEQ ID NO: 463168 - RNA, 22 nt, Human
ucaaaugcucuuugcagagagg

SEQ ID NO: 463169 - RNA, 22 nt, Human
cuggugccauucuguggccuag

SEQ ID NO: 463170 - RNA, 22 nt, Human
agggguggagaguguugccagu

SEQ ID NO: 463171 - RNA, 22 nt, Human
agccagcaugaagacagaggcc

SEQ ID NO: 463172 - RNA, 22 nt, Human
gagaagccgagucagcugagcc

SEQ ID NO: 463173 - RNA, 22 nt, Human
gagaggagguggcuaugacagc

SEQ ID NO: 463174 - RNA, 23 nt, Human
caugggagugagaaugccagcuc

SEQ ID NO: 463175 - RNA, 22 nt, Human
gaggccagcgcgcagcacuuuu

SEQ ID NO: 463176 - RNA, 22 nt, Human
gcuggggagcaagaguagugag

SEQ ID NO: 463177 - RNA, 22 nt, Human
ugagaagcugcuugugcuguau

SEQ ID NO: 463178 - RNA, 22 nt, Human
aagggcugccagggggugccag

SEQ ID NO: 463179 - RNA, 17 nt, Human
gcucccugaggacagcu

SEQ ID NO: 463180 - RNA, 22 nt, Human
ccucuugccaaucagcuacaga

SEQ ID NO: 463181 - RNA, 22 nt, Human
uguacuuccccaaugacagcac

SEQ ID NO: 463182 - RNA, 22 nt, Human
gccagguggagguugcagugag

SEQ ID NO: 463183 - RNA, 22 nt, Human
auuguggugucaguuauaggca

SEQ ID NO: 463184 - RNA, 22 nt, Human
agauuaugcuggcugcuacaag

SEQ ID NO: 463185 - RNA, 22 nt, Human
agacaaagaaaccguagaagca

SEQ ID NO: 463186 - RNA, 22 nt, Human
agagccugucugccuuucuacc

SEQ ID NO: 463187 - RNA, 22 nt, Human
aaggugugaagagaugggaaga

SEQ ID NO: 463188 - RNA, 22 nt, Human
ucagcugaguucuagagcacuc

SEQ ID NO: 463189 - RNA, 23 nt, Human
gcagaggagcaagcuggacacca

SEQ ID NO: 463190 - RNA, 22 nt, Human
gaggcugccccuuccucagcug

SEQ ID NO: 463191 - RNA, 16 nt, Human
gaggcuggcagauguc

SEQ ID NO: 463192 - RNA, 22 nt, Human
gcagggaccuugcccacccucc

SEQ ID NO: 463193 - RNA, 22 nt, Human
gcugggagccccgagccagcgc

SEQ ID NO: 463194 - RNA, 22 nt, Human
ucauuucaaguucugacagcua

SEQ ID NO: 463195 - RNA, 22 nt, Human
acccuuucuuacucacacgcuc

SEQ ID NO: 463196 - RNA, 22 nt, Human
ugcagaagcagagaguugccaa

SEQ ID NO: 463197 - RNA, 22 nt, Human
cagggacccuacuagcucacac

SEQ ID NO: 463198 - RNA, 22 nt, Human
auuguaaguagaaauguuaugg

SEQ ID NO: 463199 - RNA, 22 nt, Human
gggcugacucugcacugagcca

SEQ ID NO: 463200 - RNA, 22 nt, Human
gaaaggaaauauucuaagcacu

SEQ ID NO: 463201 - RNA, 22 nt, Human
uagaauaugugguaggaucugg

SEQ ID NO: 463202 - RNA, 20 nt, Human
aggcugggguguuuugccca

SEQ ID NO: 463203 - RNA, 22 nt, Human
gcucuggacccuggaguggcug

SEQ ID NO: 463204 - RNA, 22 nt, Human
cagggccacccucugcugggug

SEQ ID NO: 463205 - RNA, 22 nt, Human
ucuuuuaucuguuguguaacaa

SEQ ID NO: 463206 - RNA, 22 nt, Human
uucaggauccccaccgcguuua

SEQ ID NO: 463207 - RNA, 22 nt, Human
caggguccggcugccuggcugu

SEQ ID NO: 463208 - RNA, 22 nt, Human
ucagggcagguuaacuugggug

SEQ ID NO: 463209 - RNA, 22 nt, Human
gcugggcuucucaaugcugccu

SEQ ID NO: 463210 - RNA, 22 nt, Human
uguuaucugagcaacgucgacg

SEQ ID NO: 463211 - RNA, 22 nt, Human
gacagaggcaagaccagaagcc

SEQ ID NO: 463212 - RNA, 22 nt, Human
ucugcuggccuuagcaggucua

SEQ ID NO: 463213 - RNA, 22 nt, Human
caccuggcuggaagugcuccgg

SEQ ID NO: 463214 - RNA, 22 nt, Human
gucaugccagcggagcucggga

SEQ ID NO: 463215 - RNA, 20 nt, Human
aacacugugcgugguaggug

SEQ ID NO: 463216 - RNA, 22 nt, Human
aaggcacugacugugcagggga

SEQ ID NO: 463217 - RNA, 22 nt, Human
ugccugcuaggcccugcugggu

SEQ ID NO: 463218 - RNA, 22 nt, Human
gaggcaguggucugaugcaagg

SEQ ID NO: 463219 - RNA, 22 nt, Human
agaagaaacugucggggauauu

SEQ ID NO: 463220 - RNA, 22 nt, Human
agaggcuggauugagcauagac

SEQ ID NO: 463221 - RNA, 22 nt, Human
acagaauugauggaaaucucag

SEQ ID NO: 463222 - RNA, 22 nt, Human
gagccagcuacauggucugcaa

SEQ ID NO: 463223 - RNA, 22 nt, Human
aaauucuaugucaauguuuauu

SEQ ID NO: 463224 - RNA, 22 nt, Human
cugcagggcagaagggcauaga

SEQ ID NO: 463225 - RNA, 22 nt, Human
uagcagggaagaugaucagaau

SEQ ID NO: 463226 - RNA, 22 nt, Human
gcauuuguguucuuccuagagc

SEQ ID NO: 463227 - RNA, 19 nt, Human
aggagaaguagcagaaauu

SEQ ID NO: 463228 - RNA, 22 nt, Human
aaggccagacaggaccacaucu

SEQ ID NO: 463229 - RNA, 22 nt, Human
aggcugcuuccuuacguggcug

SEQ ID NO: 463230 - RNA, 22 nt, Human
gaggcaggguguugauuacaga

SEQ ID NO: 463231 - RNA, 22 nt, Human
uuuuccuuucaucaggacaaag

SEQ ID NO: 463232 - RNA, 22 nt, Human
auuugucugcuugcugccuucc

SEQ ID NO: 463233 - RNA, 22 nt, Human
gucccuaguggaaagacaugau

SEQ ID NO: 463234 - RNA, 22 nt, Human
aaccauuugccauuaucuuaag

SEQ ID NO: 463235 - RNA, 22 nt, Human
aucuggcuggauucuuagcguu

SEQ ID NO: 463236 - RNA, 22 nt, Human
aggaggggcaaugauagucugg

SEQ ID NO: 463237 - RNA, 22 nt, Human
agccagacauggcuccugcucc

SEQ ID NO: 463238 - RNA, 22 nt, Human
cagagcagguaucuuuggugaa

SEQ ID NO: 463239 - RNA, 22 nt, Human
cagguacacucccuugugcuga

SEQ ID NO: 463240 - RNA, 21 nt, Human
aggccucuucauggccaugau

SEQ ID NO: 463241 - RNA, 22 nt, Human
uacuguacugucuuuuuugcug

SEQ ID NO: 463242 - RNA, 22 nt, Human
agccacagugcaagagagaaaa

SEQ ID NO: 463243 - RNA, 22 nt, Human
cuuaauuuuuguaguagaugga

SEQ ID NO: 463244 - RNA, 22 nt, Human
uggcugagccuuuggggcuuuc

SEQ ID NO: 463245 - RNA, 22 nt, Human
gagauuggauuuaauggccaaa

SEQ ID NO: 463246 - RNA, 21 nt, Human
uccuucaguucugcacuuucu

SEQ ID NO: 463247 - RNA, 22 nt, Human
cagcucccgccaucgggaggca

SEQ ID NO: 463248 - RNA, 22 nt, Human
cagcccaaagccccaggcuaga

SEQ ID NO: 463249 - RNA, 22 nt, Human
cuuaacagcaagaucuguguca

SEQ ID NO: 463250 - RNA, 22 nt, Human
aaggaagacacagaugaaguga

SEQ ID NO: 463251 - RNA, 22 nt, Human
guuuuccauggaggucugaccu

SEQ ID NO: 463252 - RNA, 22 nt, Human
ggcucagagaccugcgaucuga

SEQ ID NO: 463253 - RNA, 22 nt, Human
gccagcugguaggcaccuagcc

SEQ ID NO: 463254 - RNA, 21 nt, Human
ccagagagagggaaguggguu

SEQ ID NO: 463255 - RNA, 22 nt, Human
agugugagcccuggaguggugc

SEQ ID NO: 463256 - RNA, 22 nt, Human
gagcucuguguagccugagggu

SEQ ID NO: 463257 - RNA, 22 nt, Human
uauugacaauaggcaacugagg

SEQ ID NO: 463258 - RNA, 22 nt, Human
agacucugugcuccuugcuuuc

SEQ ID NO: 463259 - RNA, 22 nt, Human
gcuggccugucuagagccuuac

SEQ ID NO: 463260 - RNA, 22 nt, Human
uggcucuguuuuaugaguacca

SEQ ID NO: 463261 - RNA, 21 nt, Human
uccucugcucucauaccacaa

SEQ ID NO: 463262 - RNA, 22 nt, Human
cugcagggcccgccugagcccu

SEQ ID NO: 463263 - RNA, 22 nt, Human
aucaggaugacuauaaggcugc

SEQ ID NO: 463264 - RNA, 22 nt, Human
auaguaacuggcauguuuauga

SEQ ID NO: 463265 - RNA, 20 nt, Human
agguggcuccugcugggggu

SEQ ID NO: 463266 - RNA, 22 nt, Human
gaggcucagagacuuuaaguuu

SEQ ID NO: 463267 - RNA, 22 nt, Human
aagcugccuagaguugaauguc

SEQ ID NO: 463268 - RNA, 22 nt, Human
ucaggaugguguggaggaaaua

SEQ ID NO: 463269 - RNA, 22 nt, Human
aaagucaaugauuucuccugga

SEQ ID NO: 463270 - RNA, 22 nt, Human
uguggccuggaaggggcugcuc

SEQ ID NO: 463271 - RNA, 22 nt, Human
ggggcuccagucuucacauuuu

SEQ ID NO: 463272 - RNA, 22 nt, Human
aucuagaaguggcaugaauuac

SEQ ID NO: 463273 - RNA, 22 nt, Human
ugaaaaaacaaguuggcccauu

SEQ ID NO: 463274 - RNA, 22 nt, Human
ucagagucucccccaguuuggg

SEQ ID NO: 463275 - RNA, 22 nt, Human
uuuauuugucuugccauuuagu

SEQ ID NO: 463276 - RNA, 17 nt, Human
uguggccuucugagcuu

SEQ ID NO: 463277 - RNA, 22 nt, Human
ggcucugguugaccaugauggc

SEQ ID NO: 463278 - RNA, 22 nt, Human
uaaggaaaguacauguuuugac

SEQ ID NO: 463279 - RNA, 22 nt, Human
gcuguccucuuggacucagggc

SEQ ID NO: 463280 - RNA, 22 nt, Human
ccugcagaaaggguccccagga

SEQ ID NO: 463281 - RNA, 20 nt, Human
ugaaaggugggaauuguggg

SEQ ID NO: 463282 - RNA, 22 nt, Human
augaaacugggauaacuauagc

SEQ ID NO: 463283 - RNA, 22 nt, Human
ccucacuggccagccaggggug

SEQ ID NO: 463284 - RNA, 20 nt, Human
caggcagaggaugcugacca

SEQ ID NO: 463285 - RNA, 20 nt, Human
agccaggccucaaguuaagu

SEQ ID NO: 463286 - RNA, 20 nt, Human
cccucccagaugcuucccaa

SEQ ID NO: 463287 - RNA, 22 nt, Human
gucagaggaggcugaguaggaa

SEQ ID NO: 463288 - RNA, 22 nt, Human
auucagcaguuccugcuucagu

SEQ ID NO: 463289 - RNA, 22 nt, Human
ugcaguggugguaaagaugcuc

SEQ ID NO: 463290 - RNA, 22 nt, Human
cucuggagggaggcugagcugg

SEQ ID NO: 463291 - RNA, 22 nt, Human
ugaagcaggaucguuugcuuca

SEQ ID NO: 463292 - RNA, 22 nt, Human
aagucaauuaguaaacuuggaa

SEQ ID NO: 463293 - RNA, 22 nt, Human
aggcuucuuagauuggcuggag

SEQ ID NO: 463294 - RNA, 22 nt, Human
aaucuggcauuugagaguagga

SEQ ID NO: 463295 - RNA, 22 nt, Human
ggccccacgggggaguccuagu

SEQ ID NO: 463296 - RNA, 22 nt, Human
acacacaauuaguuuuaugcuu

SEQ ID NO: 463297 - RNA, 22 nt, Human
aaauguucuacuuugauaauua

SEQ ID NO: 463298 - RNA, 22 nt, Human
cugcucugugguccaugagaca

SEQ ID NO: 463299 - RNA, 22 nt, Human
uucacagucacccuucuccaug

SEQ ID NO: 463300 - RNA, 22 nt, Human
gugcaugaagacucagaaaguc

SEQ ID NO: 463301 - RNA, 22 nt, Human
aggcagaauguuggaaaggaag

SEQ ID NO: 463302 - RNA, 22 nt, Human
gaggcagagaccuucaggaccu

SEQ ID NO: 463303 - RNA, 22 nt, Human
ggcuucuccccuuugagucuuc

SEQ ID NO: 463304 - RNA, 22 nt, Human
ugaaggugucuuugugaacauc

SEQ ID NO: 463305 - RNA, 22 nt, Human
gcaguggcuaagcucgcaugca

SEQ ID NO: 463306 - RNA, 22 nt, Human
cugagucucccggcaguggagg

SEQ ID NO: 463307 - RNA, 22 nt, Human
ucucaggggccuggaguccugg

SEQ ID NO: 463308 - RNA, 22 nt, Human
acccugggucauauacagugug

SEQ ID NO: 463309 - RNA, 22 nt, Human
agcuugauuucucugcagugug

SEQ ID NO: 463310 - RNA, 22 nt, Human
cccaggcacucuuggucauuuu

SEQ ID NO: 463311 - RNA, 22 nt, Human
cuuaaauucuuaaugcccucau

SEQ ID NO: 463312 - RNA, 22 nt, Human
ccugagugaauucccucacugu

SEQ ID NO: 463313 - RNA, 22 nt, Human
ucaggggacagccagcuggagg

SEQ ID NO: 463314 - RNA, 22 nt, Human
ucuauacaugugcacacacauc

SEQ ID NO: 463315 - RNA, 20 nt, Human
aggagccauugacugcagca

SEQ ID NO: 463316 - RNA, 22 nt, Human
acacagggcugcgccugacccc

SEQ ID NO: 463317 - RNA, 22 nt, Human
cacccagcagcacuuaagacua

SEQ ID NO: 463318 - RNA, 22 nt, Human
acaggcagcacuaaucucuggu

SEQ ID NO: 463319 - RNA, 22 nt, Human
aaaaaccuuucccauacuaaga

SEQ ID NO: 463320 - RNA, 22 nt, Human
ucucugggugauggcagggcac

SEQ ID NO: 463321 - RNA, 22 nt, Human
gcagagugaggaagagcuucca

SEQ ID NO: 463322 - RNA, 22 nt, Human
gcccaggcuagcguagagugca

SEQ ID NO: 463323 - RNA, 22 nt, Human
cccugggacccgcugcagaggc

SEQ ID NO: 463324 - RNA, 22 nt, Human
uagggcucugagaguucagccu

SEQ ID NO: 463325 - RNA, 19 nt, Human
agacagagacugaaauaga

SEQ ID NO: 463326 - RNA, 22 nt, Human
caguacuuuucuggcuuucuac

SEQ ID NO: 463327 - RNA, 22 nt, Human
cugcccugugaggguccuuggg

SEQ ID NO: 463328 - RNA, 22 nt, Human
acagaauacuacagacugguua

SEQ ID NO: 463329 - RNA, 21 nt, Human
aggcccagagucuugggggga

SEQ ID NO: 463330 - RNA, 22 nt, Human
caucacagauguuguguggagu

SEQ ID NO: 463331 - RNA, 22 nt, Human
gcucugcucuaacauuccugac

SEQ ID NO: 463332 - RNA, 22 nt, Human
ucugaaggugcuagagaaagcu

SEQ ID NO: 463333 - RNA, 22 nt, Human
cagccuccugggacacucaccg

SEQ ID NO: 463334 - RNA, 22 nt, Human
acagcagcuggguucccaccau

SEQ ID NO: 463335 - RNA, 22 nt, Human
cuugugcauuucauuccucagg

SEQ ID NO: 463336 - RNA, 22 nt, Human
cuucagggugacgcaggcugca

SEQ ID NO: 463337 - RNA, 23 nt, Human
ggucccaguggagaggccucacc

SEQ ID NO: 463338 - RNA, 22 nt, Human
gauuuauuuuuaaucagcaggg

SEQ ID NO: 463339 - RNA, 22 nt, Human
aaagguuaguucuuagaagugc

SEQ ID NO: 463340 - RNA, 22 nt, Human
gaggagagagggacugucugca

SEQ ID NO: 463341 - RNA, 22 nt, Human
ucuucagagugaaagucuguga

SEQ ID NO: 463342 - RNA, 22 nt, Human
gcugaggccccagggugauggg

SEQ ID NO: 463343 - RNA, 22 nt, Human
agcugcucucacuggacgccug

SEQ ID NO: 463344 - RNA, 22 nt, Human
ccuguacauggccaucuuuacc

SEQ ID NO: 463345 - RNA, 22 nt, Human
caggauccuggcugcauggacg

SEQ ID NO: 463346 - RNA, 22 nt, Human
uaauacuuuugccuuguauuca

SEQ ID NO: 463347 - RNA, 23 nt, Human
cccuguagcccaggacaggcuuu

SEQ ID NO: 463348 - RNA, 22 nt, Human
agcugauuccacuuuuucccca

SEQ ID NO: 463349 - RNA, 22 nt, Human
ccauguggugggaaggagaaug

SEQ ID NO: 463350 - RNA, 22 nt, Human
guucaaguucauaucucuuaac

SEQ ID NO: 463351 - RNA, 22 nt, Human
agggcugaccuaagcuccacuu

SEQ ID NO: 463352 - RNA, 22 nt, Human
aaagccuugagauccuauaguu

SEQ ID NO: 463353 - RNA, 22 nt, Human
ugcugccaccugguggcugaag

SEQ ID NO: 463354 - RNA, 22 nt, Human
cacagguggcuccaaguuagag

SEQ ID NO: 463355 - RNA, 22 nt, Human
cccagccucuggauucugcccu

SEQ ID NO: 463356 - RNA, 22 nt, Human
aauguguguauuucuaggcgag

SEQ ID NO: 463357 - RNA, 22 nt, Human
aaaucaguucucccuuucuuca

SEQ ID NO: 463358 - RNA, 22 nt, Human
guccagcugaucuugacccagc

SEQ ID NO: 463359 - RNA, 22 nt, Human
gggaccaggugggugcauuccg

SEQ ID NO: 463360 - RNA, 22 nt, Human
uccucagggcggccuccgucuu

SEQ ID NO: 463361 - RNA, 22 nt, Human
agcugucuccagauacaggauu

SEQ ID NO: 463362 - RNA, 22 nt, Human
ccagagccggcucccucagcuu

SEQ ID NO: 463363 - RNA, 22 nt, Human
cucugugccucaguuuucuucu

SEQ ID NO: 463364 - RNA, 20 nt, Human
ggguggaguugcggucugug

SEQ ID NO: 463365 - RNA, 22 nt, Human
cacagcagaaauaugaaggcag

SEQ ID NO: 463366 - RNA, 22 nt, Human
cagcaugcaaguccagaugugg

SEQ ID NO: 463367 - RNA, 22 nt, Human
uguagaaagaauauguuucaua

SEQ ID NO: 463368 - RNA, 22 nt, Human
ccugggcaacauagugagaccu

SEQ ID NO: 463369 - RNA, 22 nt, Human
agcugcuaugacaacaccagcc

SEQ ID NO: 463370 - RNA, 22 nt, Human
ccaagggcugcugaggugucca

SEQ ID NO: 463371 - RNA, 22 nt, Human
cugagaggcggagcuugcagug

SEQ ID NO: 463372 - RNA, 23 nt, Human
ucccagggaaggugagcgaggcu

SEQ ID NO: 463373 - RNA, 22 nt, Human
gcugccuuuugcuccucccacc

SEQ ID NO: 463374 - RNA, 22 nt, Human
cauugaaaaacguugacugagu

SEQ ID NO: 463375 - RNA, 22 nt, Human
cugggcaguuuuacaucauugc

SEQ ID NO: 463376 - RNA, 22 nt, Human
cgucccaguuccagccgcgcug

SEQ ID NO: 463377 - RNA, 22 nt, Human
gcagcuggagccagccagacac

SEQ ID NO: 463378 - RNA, 22 nt, Human
uuguuaaaaugcauauucuggu

SEQ ID NO: 463379 - RNA, 22 nt, Human
auucacaaagaagggaaguaca

SEQ ID NO: 463380 - RNA, 18 nt, Human
ccucacagacuuccaugu

SEQ ID NO: 463381 - RNA, 22 nt, Human
auuacacaggcuggcucuuuga

SEQ ID NO: 463382 - RNA, 22 nt, Human
uuuguuuagaugguaaaucagu

SEQ ID NO: 463383 - RNA, 18 nt, Human
cagaagcaggcagugcag

SEQ ID NO: 463384 - RNA, 22 nt, Human
cagggcucgcucuugcccuucg

SEQ ID NO: 463385 - RNA, 22 nt, Human
gcagagccccauugcuggcggg

SEQ ID NO: 463386 - RNA, 21 nt, Human
cccuugccugcacuccucggc

SEQ ID NO: 463387 - RNA, 22 nt, Human
ucuuuacaucacaauuguaugg

SEQ ID NO: 463388 - RNA, 22 nt, Human
gugcucuggcuggucucccggu

SEQ ID NO: 463389 - RNA, 22 nt, Human
auaucuuuguuuuugccaagau

SEQ ID NO: 463390 - RNA, 22 nt, Human
caagagcugaggcuggagaggu

SEQ ID NO: 463391 - RNA, 22 nt, Human
agcagccagagucugaacauua

SEQ ID NO: 463392 - RNA, 22 nt, Human
gagcucugacugcugggugaca

SEQ ID NO: 463393 - RNA, 22 nt, Human
aggcuucagguuugcuuugcag

SEQ ID NO: 463394 - RNA, 21 nt, Human
auucagaaagggaauaaacuc

SEQ ID NO: 463395 - RNA, 22 nt, Human
cauuucugugacacuuccaucu

SEQ ID NO: 463396 - RNA, 22 nt, Human
acauuuacagugcuagacaauc

SEQ ID NO: 463397 - RNA, 22 nt, Human
ugaacgcagguccacauggcuc

SEQ ID NO: 463398 - RNA, 22 nt, Human
ggugggcacccgagacuggauc

SEQ ID NO: 463399 - RNA, 22 nt, Human
uaaaugugucuuuuuaaggccu

SEQ ID NO: 463400 - RNA, 22 nt, Human
cuugaaagauuuggccucugug

SEQ ID NO: 463401 - RNA, 17 nt, Human
agcuccugcccauggcu

SEQ ID NO: 463402 - RNA, 22 nt, Human
ccagggcaggggcuggaguuca

SEQ ID NO: 463403 - RNA, 22 nt, Human
agagugucugguagcugcucug

SEQ ID NO: 463404 - RNA, 22 nt, Human
guggccuggcgagcuggcgcgg

SEQ ID NO: 463405 - RNA, 19 nt, Human
cagcugcaccgugaccauc

SEQ ID NO: 463406 - RNA, 22 nt, Human
aggagaaagacuggacagccaa

SEQ ID NO: 463407 - RNA, 17 nt, Human
uccuucagugccucugc

SEQ ID NO: 463408 - RNA, 22 nt, Human
gccuggagcagacgugucccgg

SEQ ID NO: 463409 - RNA, 21 nt, Human
ugguuugcggccaaaguuaaa

SEQ ID NO: 463410 - RNA, 22 nt, Human
ccugagagagaagcgaccuggu

SEQ ID NO: 463411 - RNA, 22 nt, Human
gagccaggguuugaaacuagac

SEQ ID NO: 463412 - RNA, 18 nt, Human
aggcaggugcuggaaguc

SEQ ID NO: 463413 - RNA, 19 nt, Human
ccauggcaaugaucugaug

SEQ ID NO: 463414 - RNA, 22 nt, Human
cagcugccccgcuggcugacca

SEQ ID NO: 463415 - RNA, 22 nt, Human
uaugcauacaaugagauauucc

SEQ ID NO: 463416 - RNA, 22 nt, Human
ugaggcagaaaauagcaguuca

SEQ ID NO: 463417 - RNA, 22 nt, Human
ccugucugcaugagugagcaua

SEQ ID NO: 463418 - RNA, 22 nt, Human
gcccugagggguggugucugua

SEQ ID NO: 463419 - RNA, 22 nt, Human
uggcccgaccucugcucaugca

SEQ ID NO: 463420 - RNA, 22 nt, Human
uacccagcccaugccuaccuca

SEQ ID NO: 463421 - RNA, 22 nt, Human
uguuuuaaucucccauugcucu

SEQ ID NO: 463422 - RNA, 22 nt, Human
uggcacugggaugcuacuguua

SEQ ID NO: 463423 - RNA, 22 nt, Human
gugcagguguuuuggcugccag

SEQ ID NO: 463424 - RNA, 22 nt, Human
cuggcagcagcuucuggaucga

SEQ ID NO: 463425 - RNA, 22 nt, Human
aggcugcguuagccucacuccc

SEQ ID NO: 463426 - RNA, 22 nt, Human
uggcuggcgccgggcuagccac

SEQ ID NO: 463427 - RNA, 22 nt, Human
ccuggccucagccuagggcuga

SEQ ID NO: 463428 - RNA, 17 nt, Human
uguuccauuugaccacc

SEQ ID NO: 463429 - RNA, 22 nt, Human
cugccaggccucaucccagcca

SEQ ID NO: 463430 - RNA, 22 nt, Human
caagcagacaguaggccuagaa

SEQ ID NO: 463431 - RNA, 22 nt, Human
guuacaaaggacugggggccac

SEQ ID NO: 463432 - RNA, 18 nt, Human
uuucacaaccuccagagg

SEQ ID NO: 463433 - RNA, 22 nt, Human
ccaggccuguguuguguggagg

SEQ ID NO: 463434 - RNA, 22 nt, Human
cucagaagaacaaaggcucuac

SEQ ID NO: 463435 - RNA, 22 nt, Human
uuaauacagucuccagaaguaa

SEQ ID NO: 463436 - RNA, 22 nt, Human
ccagggcuggugggagaugcug

SEQ ID NO: 463437 - RNA, 22 nt, Human
agugcauuauauguuucaaugg

SEQ ID NO: 463438 - RNA, 22 nt, Human
gaggcuggcagaaaagcacagg

SEQ ID NO: 463439 - RNA, 22 nt, Human
gccagggcucgcggucccucgu

SEQ ID NO: 463440 - RNA, 22 nt, Human
uacuuagagcgauaauuuauac

SEQ ID NO: 463441 - RNA, 22 nt, Human
aaggccaugaccacuugcugug

SEQ ID NO: 463442 - RNA, 22 nt, Human
ugcuuccuucccguucuucucc

SEQ ID NO: 463443 - RNA, 22 nt, Human
uggggacauagccagucuggcu

SEQ ID NO: 463444 - RNA, 22 nt, Human
ucugaaaugcaaauuugacuga

SEQ ID NO: 463445 - RNA, 22 nt, Human
guguuuuaucagacaaaguaua

SEQ ID NO: 463446 - RNA, 22 nt, Human
cugccucuauaggaguccacca

SEQ ID NO: 463447 - RNA, 22 nt, Human
aggaaagcucccaguagggcuc

SEQ ID NO: 463448 - RNA, 22 nt, Human
uggcuccuaucaaggagugggu

SEQ ID NO: 463449 - RNA, 22 nt, Human
uacaaagugagcaaccucuuuu

SEQ ID NO: 463450 - RNA, 22 nt, Human
ccaggcaggcagcguucucagg

SEQ ID NO: 463451 - RNA, 22 nt, Human
cagugcuccugauguacccuug

SEQ ID NO: 463452 - RNA, 22 nt, Human
cuggaggcugaguugggucucc

SEQ ID NO: 463453 - RNA, 22 nt, Human
caacauuucaaggucuuuagga

SEQ ID NO: 463454 - RNA, 22 nt, Human
guucacaucacuucacugaacc

SEQ ID NO: 463455 - RNA, 22 nt, Human
gaaggaaaaauacucuguaagg

SEQ ID NO: 463456 - RNA, 17 nt, Human
aggaaacauuuucuuuc

SEQ ID NO: 463457 - RNA, 22 nt, Human
cugggccugguagggcuugaaa

SEQ ID NO: 463458 - RNA, 22 nt, Human
uccaggcauguugggaagauga

SEQ ID NO: 463459 - RNA, 20 nt, Human
uccaguuuuggagacauucu

SEQ ID NO: 463460 - RNA, 22 nt, Human
auaguguuacccuucuuaaagu

SEQ ID NO: 463461 - RNA, 22 nt, Human
augagcuguaagguggcuuccu

SEQ ID NO: 463462 - RNA, 22 nt, Human
gagaggccaaaaucccugcccc

SEQ ID NO: 463463 - RNA, 19 nt, Human
gccagcagaaugaugaggc

SEQ ID NO: 463464 - RNA, 22 nt, Human
ggcugccugaacuuuggggaaa

SEQ ID NO: 463465 - RNA, 22 nt, Human
uaaaugugggggccacgggcuu

SEQ ID NO: 463466 - RNA, 22 nt, Human
ggcaggagaauggcgugaacuc

SEQ ID NO: 463467 - RNA, 22 nt, Human
ccaggggaaacagggagcacuc

SEQ ID NO: 463468 - RNA, 22 nt, Human
gacauaauaaucugaccuagau

SEQ ID NO: 463469 - RNA, 22 nt, Human
cuguccuggagggcauaggacg

SEQ ID NO: 463470 - RNA, 22 nt, Human
gaagccagccuugucugccucu

SEQ ID NO: 463471 - RNA, 22 nt, Human
aaaguguugauaugugacaucc

SEQ ID NO: 463472 - RNA, 22 nt, Human
uaaaguuuggcagacaauaaca

SEQ ID NO: 463473 - RNA, 20 nt, Human
cagcugccuggcucugggau

SEQ ID NO: 463474 - RNA, 19 nt, Human
ggucucagugcagcugcag

SEQ ID NO: 463475 - RNA, 22 nt, Human
ucucuuaauuuuggaauagugu

SEQ ID NO: 463476 - RNA, 22 nt, Human
uaaggccauuauggugggcccg

SEQ ID NO: 463477 - RNA, 22 nt, Human
acucugugugaguagagccugu

SEQ ID NO: 463478 - RNA, 22 nt, Human
cacugcuuaguugguaaaugug

SEQ ID NO: 463479 - RNA, 22 nt, Human
cccuggcauaaaacuucuccag

SEQ ID NO: 463480 - RNA, 18 nt, Human
acaguaaagaaaggaauu

SEQ ID NO: 463481 - RNA, 22 nt, Human
auuagagguacaaaccuucacu

SEQ ID NO: 463482 - RNA, 22 nt, Human
gaaaucuuuauggaaauaacaa

SEQ ID NO: 463483 - RNA, 22 nt, Human
ugucccaggccucauguugcca

SEQ ID NO: 463484 - RNA, 22 nt, Human
cugggcuucucccccuggcaga

SEQ ID NO: 463485 - RNA, 20 nt, Human
uuuuuccuucucuacaggca

SEQ ID NO: 463486 - RNA, 22 nt, Human
uggcugcucaagggaggaggcu

SEQ ID NO: 463487 - RNA, 22 nt, Human
ucccagacaaucauuggccacc

SEQ ID NO: 463488 - RNA, 22 nt, Human
aacacagcuaauuucugucaau

SEQ ID NO: 463489 - RNA, 22 nt, Human
ucaaaauuuuauuucucaagga

SEQ ID NO: 463490 - RNA, 21 nt, Human
ugcaggagucugugagucagg

SEQ ID NO: 463491 - RNA, 22 nt, Human
gaggcacaauacaugucucaag

SEQ ID NO: 463492 - RNA, 22 nt, Human
cuauugaauuaacuauuaaagu

SEQ ID NO: 463493 - RNA, 22 nt, Human
aacucaguucuuuccacaaugc

SEQ ID NO: 463494 - RNA, 22 nt, Human
aaaucuguaagcaauugcucag

SEQ ID NO: 463495 - RNA, 22 nt, Human
cuucauuaaccaaaaugcaaua

SEQ ID NO: 463496 - RNA, 22 nt, Human
cugguuuagcuguaagguuccc

SEQ ID NO: 463497 - RNA, 22 nt, Human
cagcugaguuacucugaggucu

SEQ ID NO: 463498 - RNA, 22 nt, Human
gcagugaaacaauaggaucaaa

SEQ ID NO: 463499 - RNA, 22 nt, Human
aacagaaugcaggggaugcugc

SEQ ID NO: 463500 - RNA, 22 nt, Human
ugcaccccauuuuacauuuaca

SEQ ID NO: 463501 - RNA, 22 nt, Human
cucugaacucuugggcagcaug

SEQ ID NO: 463502 - RNA, 22 nt, Human
aaugauguauuaguacaacaca

SEQ ID NO: 463503 - RNA, 22 nt, Human
agucaggagcugcugcauugua

SEQ ID NO: 463504 - RNA, 22 nt, Human
cacugcauggaugauggcugua

SEQ ID NO: 463505 - RNA, 22 nt, Human
acaaagucugaaaccugaggca

SEQ ID NO: 463506 - RNA, 22 nt, Human
ccuguggcugccacuuggguga

SEQ ID NO: 463507 - RNA, 22 nt, Human
gagcagggagacaacucuggug

SEQ ID NO: 463508 - RNA, 18 nt, Human
ucagagguacagaaaagu

SEQ ID NO: 463509 - RNA, 22 nt, Human
uauuuccaagcugaauccaaug

SEQ ID NO: 463510 - RNA, 22 nt, Human
cacccacauggaaauucacagu

SEQ ID NO: 463511 - RNA, 23 nt, Human
acagcaagaggaccagaugugag

SEQ ID NO: 463512 - RNA, 22 nt, Human
caaaggagguaaugggugugag

SEQ ID NO: 463513 - RNA, 21 nt, Human
accagcaggagaucagaagga

SEQ ID NO: 463514 - RNA, 22 nt, Human
uggcagcugauuagauggugcc

SEQ ID NO: 463515 - RNA, 22 nt, Human
ggcuggcacucuguccaguguc

SEQ ID NO: 463516 - RNA, 19 nt, Human
cucagagaggggcagugcc

SEQ ID NO: 463517 - RNA, 22 nt, Human
uggcagcacaagguggcccaug

SEQ ID NO: 463518 - RNA, 22 nt, Human
cugcagugcaagcccagaugga

SEQ ID NO: 463519 - RNA, 22 nt, Human
gagauuucuuuugaugccuguc

SEQ ID NO: 463520 - RNA, 22 nt, Human
agcugaguuaauucaucacuua

SEQ ID NO: 463521 - RNA, 19 nt, Human
gaaggagagcugaguuagg

SEQ ID NO: 463522 - RNA, 22 nt, Human
gaggcucaaaccuggacagagc

SEQ ID NO: 463523 - RNA, 22 nt, Human
guuccuauauagccuuaaggau

SEQ ID NO: 463524 - RNA, 22 nt, Human
uucaagaugacccagucacacg

SEQ ID NO: 463525 - RNA, 22 nt, Human
ucuucucccaucuccaggcagg

SEQ ID NO: 463526 - RNA, 22 nt, Human
aggcccuggguuagggcccacu

SEQ ID NO: 463527 - RNA, 20 nt, Human
agccagaagaaggcuggaga

SEQ ID NO: 463528 - RNA, 22 nt, Human
gcaggagccaggccgagcuggu

SEQ ID NO: 463529 - RNA, 22 nt, Human
uaauuuuaugacaguguauuuu

SEQ ID NO: 463530 - RNA, 22 nt, Human
uccaagaucuacagcaguuuag

SEQ ID NO: 463531 - RNA, 22 nt, Human
cacagcugugagaagggagccu

SEQ ID NO: 463532 - RNA, 22 nt, Human
acagaguaggugcugucgacug

SEQ ID NO: 463533 - RNA, 22 nt, Human
ggggcaggagguguucucuuuu

SEQ ID NO: 463534 - RNA, 22 nt, Human
uccuuggcuuucuggagcuucu

SEQ ID NO: 463535 - RNA, 22 nt, Human
ugcugcucuguaaagugaugag

SEQ ID NO: 463536 - RNA, 22 nt, Human
aaacuguaaacacagcaguaca

SEQ ID NO: 463537 - RNA, 20 nt, Human
aacauugcuucaauguaacc

SEQ ID NO: 463538 - RNA, 22 nt, Human
ugaggaagccaaacagcuacac

SEQ ID NO: 463539 - RNA, 22 nt, Human
ugaggccaggaucccaggcucu

SEQ ID NO: 463540 - RNA, 22 nt, Human
cugagcccaggcgggagcugag

SEQ ID NO: 463541 - RNA, 22 nt, Human
ggcccugggcagaggagugggc

SEQ ID NO: 463542 - RNA, 22 nt, Human
ucaagcaggguagcaagcuggu

SEQ ID NO: 463543 - RNA, 22 nt, Human
ucccagcagcauagcucagaau

SEQ ID NO: 463544 - RNA, 22 nt, Human
agucccagcucagaaccacuag

SEQ ID NO: 463545 - RNA, 22 nt, Human
aauucuauaggcaagcuauuuu

SEQ ID NO: 463546 - RNA, 22 nt, Human
uggccuuggacagagcgcuccu

SEQ ID NO: 463547 - RNA, 22 nt, Human
ucagccacuacccaccuuaaca

SEQ ID NO: 463548 - RNA, 22 nt, Human
cagcucugggugacaggagggc

SEQ ID NO: 463549 - RNA, 17 nt, Human
gggcagggacuccuggg

SEQ ID NO: 463550 - RNA, 22 nt, Human
gccugagacagugugguccaau

SEQ ID NO: 463551 - RNA, 22 nt, Human
ucugaggccccugggcaggaug

SEQ ID NO: 463552 - RNA, 22 nt, Human
ccaguccuggccaguaacauga

SEQ ID NO: 463553 - RNA, 22 nt, Human
uugcacuccagcccgagcaaca

SEQ ID NO: 463554 - RNA, 22 nt, Human
cugcccugcccaggccuugggc

SEQ ID NO: 463555 - RNA, 22 nt, Human
aggcacugcagauuacaggcgc

SEQ ID NO: 463556 - RNA, 22 nt, Human
ugaauaugugacuuugauuuca

SEQ ID NO: 463557 - RNA, 22 nt, Human
gagggagagugauggaccauug

SEQ ID NO: 463558 - RNA, 22 nt, Human
gggugggaacaggaugccagga

SEQ ID NO: 463559 - RNA, 19 nt, Human
caaggguugggucugucau

SEQ ID NO: 463560 - RNA, 22 nt, Human
gggacagaaggaagugagcaca

SEQ ID NO: 463561 - RNA, 17 nt, Human
cagggcugucugccuag

SEQ ID NO: 463562 - RNA, 22 nt, Human
cuacauaaauauuuaugugucu

SEQ ID NO: 463563 - RNA, 22 nt, Human
ggcagagcugcaugagcacuca

SEQ ID NO: 463564 - RNA, 22 nt, Human
uacuguuuucuauaauggcugu

SEQ ID NO: 463565 - RNA, 22 nt, Human
ccacagggccuuuccugcuggc

SEQ ID NO: 463566 - RNA, 22 nt, Human
acaaauguggacauggauaaug

SEQ ID NO: 463567 - RNA, 22 nt, Human
cccaggcauuuucaacuuuagu

SEQ ID NO: 463568 - RNA, 21 nt, Human
uuuucccacugaaagcuccca

SEQ ID NO: 463569 - RNA, 22 nt, Human
ggagccugggcauuaguaauuu

SEQ ID NO: 463570 - RNA, 22 nt, Human
uuucaugugcaauuagcaauau

SEQ ID NO: 463571 - RNA, 21 nt, Human
acccuggguucuccauacccu

SEQ ID NO: 463572 - RNA, 22 nt, Human
cagagguaccagcagccucugg

SEQ ID NO: 463573 - RNA, 22 nt, Human
agugcacuggcaccaucucagc

SEQ ID NO: 463574 - RNA, 22 nt, Human
agggcugcugaggaagccuugc

SEQ ID NO: 463575 - RNA, 22 nt, Human
cugggcuacguguugacagcau

SEQ ID NO: 463576 - RNA, 19 nt, Human
gcuccugggccucacucau

SEQ ID NO: 463577 - RNA, 22 nt, Human
uccagcagggaauuaguagucu

SEQ ID NO: 463578 - RNA, 22 nt, Human
agggugccuggaagccacucac

SEQ ID NO: 463579 - RNA, 22 nt, Human
ugcaccauuuugucaggcuacu

SEQ ID NO: 463580 - RNA, 22 nt, Human
agagcugaggauccagcugagc

SEQ ID NO: 463581 - RNA, 22 nt, Human
uagaaaauagggccuguggagc

SEQ ID NO: 463582 - RNA, 22 nt, Human
agcagaacauuuucagggcugu

SEQ ID NO: 463583 - RNA, 22 nt, Human
ggcugccuccugcugggcugga

SEQ ID NO: 463584 - RNA, 22 nt, Human
cagucucagaggugggaguggg

SEQ ID NO: 463585 - RNA, 20 nt, Human
uuucacaucugucccuuuaa

SEQ ID NO: 463586 - RNA, 22 nt, Human
ccagagaccagaacauggggau

SEQ ID NO: 463587 - RNA, 22 nt, Human
ccugucucuguuaccacauuug

SEQ ID NO: 463588 - RNA, 22 nt, Human
cccaggcagccccagaagcuug

SEQ ID NO: 463589 - RNA, 22 nt, Human
aggcaggccccugagaauagac

SEQ ID NO: 463590 - RNA, 22 nt, Human
ggauggcauguugggcucuguu

SEQ ID NO: 463591 - RNA, 22 nt, Human
aggcagugcagaguccucuucu

SEQ ID NO: 463592 - RNA, 22 nt, Human
auuugucuuuggaccugugaga

SEQ ID NO: 463593 - RNA, 22 nt, Human
aacaaauggggccuuguaugaa

SEQ ID NO: 463594 - RNA, 22 nt, Human
uucuggagaucugccuauggga

SEQ ID NO: 463595 - RNA, 22 nt, Human
cccuggaggaccccaauguggc

SEQ ID NO: 463596 - RNA, 22 nt, Human
uuccuggugguggugacagcac

SEQ ID NO: 463597 - RNA, 22 nt, Human
aguguuccacacaucuggggaa

SEQ ID NO: 463598 - RNA, 22 nt, Human
caauuucuaacauuccauggau

SEQ ID NO: 463599 - RNA, 22 nt, Human
caggcacugugcuagauccuug

SEQ ID NO: 463600 - RNA, 17 nt, Human
ucuuuccugccaugcuc

SEQ ID NO: 463601 - RNA, 22 nt, Human
ucuccuggauggaccuucucuu

SEQ ID NO: 463602 - RNA, 20 nt, Human
ggcagagcuaugucuguugc

SEQ ID NO: 463603 - RNA, 22 nt, Human
guggagccaggaucuccgcaca

SEQ ID NO: 463604 - RNA, 22 nt, Human
uucaagaucgaguuuaaaguga

SEQ ID NO: 463605 - RNA, 22 nt, Human
gagagugaggcaucaggggcag

SEQ ID NO: 463606 - RNA, 22 nt, Human
ccaggagcaaagaucacuggga

SEQ ID NO: 463607 - RNA, 22 nt, Human
cuuucucugugugguaaagggc

SEQ ID NO: 463608 - RNA, 17 nt, Human
cugucugcgcaugaggu

SEQ ID NO: 463609 - RNA, 22 nt, Human
ccuggcugugcauugccggccc

SEQ ID NO: 463610 - RNA, 22 nt, Human
caggccuggggcuggcuuccag

SEQ ID NO: 463611 - RNA, 22 nt, Human
ccagaauagaaggcagcuguca

SEQ ID NO: 463612 - RNA, 22 nt, Human
ugggcuggcugaggcauucacu

SEQ ID NO: 463613 - RNA, 22 nt, Human
agcagagcggggccuccggaag

SEQ ID NO: 463614 - RNA, 22 nt, Human
ugaagcugugggcaguggagcc

SEQ ID NO: 463615 - RNA, 22 nt, Human
ggagaguggauuccagcuguau

SEQ ID NO: 463616 - RNA, 22 nt, Human
agauuguagaaacuguagcauu

SEQ ID NO: 463617 - RNA, 22 nt, Human
uccagagggcgauggcuggggg

SEQ ID NO: 463618 - RNA, 22 nt, Human
cucuccagaauaugccgccgug

SEQ ID NO: 463619 - RNA, 22 nt, Human
uguuucauguggacauaguugu

SEQ ID NO: 463620 - RNA, 22 nt, Human
gaagccaagugcaaaugccuua

SEQ ID NO: 463621 - RNA, 22 nt, Human
ugccaggaggaggugggacaga

SEQ ID NO: 463622 - RNA, 22 nt, Human
aaccugcauguuucuaaaagca

SEQ ID NO: 463623 - RNA, 22 nt, Human
aaguucaaguaguguuacaugg

SEQ ID NO: 463624 - RNA, 22 nt, Human
agcugguguccuccuggagcug

SEQ ID NO: 463625 - RNA, 22 nt, Human
cccagcuccagagccagaaaca

SEQ ID NO: 463626 - RNA, 22 nt, Human
acccagaggcggagguugcagu

SEQ ID NO: 463627 - RNA, 21 nt, Human
gggagcuggaaacugggugac

SEQ ID NO: 463628 - RNA, 22 nt, Human
accuggcaugaagcaugccuua

SEQ ID NO: 463629 - RNA, 22 nt, Human
uaagacaauucuucagucacaa

SEQ ID NO: 463630 - RNA, 22 nt, Human
aucagcaaucucguguauuagg

SEQ ID NO: 463631 - RNA, 22 nt, Human
agcagggcagugaucagaaagg

SEQ ID NO: 463632 - RNA, 20 nt, Human
gcccuggagccuuguccugg

SEQ ID NO: 463633 - RNA, 22 nt, Human
gccaggcaguucaaguacacca

SEQ ID NO: 463634 - RNA, 22 nt, Human
ccuggagcgcgggucaagcugg

SEQ ID NO: 463635 - RNA, 17 nt, Human
agccgggcauggaccag

SEQ ID NO: 463636 - RNA, 22 nt, Human
aguguuccuugcuuucccagag

SEQ ID NO: 463637 - RNA, 22 nt, Human
ccacugucuuuuccaggcugaa

SEQ ID NO: 463638 - RNA, 20 nt, Human
cuggguggcaagcaaggggg

SEQ ID NO: 463639 - RNA, 22 nt, Human
ucucucugccaacucacagcca

SEQ ID NO: 463640 - RNA, 22 nt, Human
agaaggcacucacacuggcacg

SEQ ID NO: 463641 - RNA, 22 nt, Human
agccacagcuccuugguggaga

SEQ ID NO: 463642 - RNA, 22 nt, Human
uguacaguguagucaugagguu

SEQ ID NO: 463643 - RNA, 22 nt, Human
gcuguguccucacacagccuuu

SEQ ID NO: 463644 - RNA, 22 nt, Human
uucaggauucuuucagacuggg

SEQ ID NO: 463645 - RNA, 22 nt, Human
gugccugugcggacucagggaa

SEQ ID NO: 463646 - RNA, 22 nt, Human
ucaggaugguccuuuaugagaa

SEQ ID NO: 463647 - RNA, 22 nt, Human
caaagcaaggcucaguuugaac

SEQ ID NO: 463648 - RNA, 22 nt, Human
aggccagacagcuagaaacagg

SEQ ID NO: 463649 - RNA, 22 nt, Human
cugaaauuccauuucagccaca

SEQ ID NO: 463650 - RNA, 22 nt, Human
cucacaggcaucucaucaggcu

SEQ ID NO: 463651 - RNA, 22 nt, Human
ggagggagucagcugauuagaa

SEQ ID NO: 463652 - RNA, 21 nt, Human
ucuugaaaauuguagcaguuu

SEQ ID NO: 463653 - RNA, 22 nt, Human
cccagggcccuggacagcuaca

SEQ ID NO: 463654 - RNA, 22 nt, Human
cucuuaaaaacuugauauauuu

SEQ ID NO: 463655 - RNA, 22 nt, Human
ugucagagcaaggccaggccag

SEQ ID NO: 463656 - RNA, 22 nt, Human
auaagguaugaaaaguaaaugg

SEQ ID NO: 463657 - RNA, 22 nt, Human
cagggugggcacccagccucca

SEQ ID NO: 463658 - RNA, 22 nt, Human
ccugccaggagcuggugcugca

SEQ ID NO: 463659 - RNA, 21 nt, Human
cacuggaauuuucugugacau

SEQ ID NO: 463660 - RNA, 22 nt, Human
ugcaauaaggaguaauaguaaa

SEQ ID NO: 463661 - RNA, 22 nt, Human
agugauggagcuuccucugcua

SEQ ID NO: 463662 - RNA, 22 nt, Human
aaaaugugcaguuuuuaagcug

SEQ ID NO: 463663 - RNA, 21 nt, Human
agaaaaguagaguuuucagag

SEQ ID NO: 463664 - RNA, 22 nt, Human
aggcugaggcggguagaucacc

SEQ ID NO: 463665 - RNA, 22 nt, Human
ggggcagagaauaaaaaccuaa

SEQ ID NO: 463666 - RNA, 22 nt, Human
ucccagcauuaaugccugucag

SEQ ID NO: 463667 - RNA, 19 nt, Human
uucuaccuuacuguaggcu

SEQ ID NO: 463668 - RNA, 22 nt, Human
augaggcaucugcagucacuag

SEQ ID NO: 463669 - RNA, 20 nt, Human
agcaagaguaaggacagcga

SEQ ID NO: 463670 - RNA, 22 nt, Human
agagccugcagcugugaagaaa

SEQ ID NO: 463671 - RNA, 22 nt, Human
aauaauuuuagcucagaguugu

SEQ ID NO: 463672 - RNA, 23 nt, Human
ugggccuggaaagccuuagagag

SEQ ID NO: 463673 - RNA, 22 nt, Human
agccugagagccaagcugugca

SEQ ID NO: 463674 - RNA, 22 nt, Human
cagaguguugaccauaagccca

SEQ ID NO: 463675 - RNA, 22 nt, Human
guuacaaaggucauaaaagugu

SEQ ID NO: 463676 - RNA, 18 nt, Human
cacaggcucccagugagg

SEQ ID NO: 463677 - RNA, 22 nt, Human
auguaucagaaauagcauuggc

SEQ ID NO: 463678 - RNA, 22 nt, Human
uuguaacaaucugucauaaaug

SEQ ID NO: 463679 - RNA, 22 nt, Human
auuucacucucccugccacuua

SEQ ID NO: 463680 - RNA, 22 nt, Human
ugucuuccucuuggcuugagcu

SEQ ID NO: 463681 - RNA, 22 nt, Human
aggggcugggacagagccaagc

SEQ ID NO: 463682 - RNA, 22 nt, Human
cucaggauauugggcuggagca

SEQ ID NO: 463683 - RNA, 22 nt, Human
ucuguagcaagugagaggcauu

SEQ ID NO: 463684 - RNA, 22 nt, Human
agauuucucuuucccuggcuga

SEQ ID NO: 463685 - RNA, 22 nt, Human
uuucucugaggcuggccucccu

SEQ ID NO: 463686 - RNA, 22 nt, Human
uuugaaaguccuaggagagucc

SEQ ID NO: 463687 - RNA, 22 nt, Human
gcuggggaggcagcagagaaca

SEQ ID NO: 463688 - RNA, 22 nt, Human
caauauucaguggaaaagccau

SEQ ID NO: 463689 - RNA, 22 nt, Human
gaguaagagcuggcuuuggugu

SEQ ID NO: 463690 - RNA, 22 nt, Human
auacuuuggggguuaguguaga

SEQ ID NO: 463691 - RNA, 22 nt, Human
uuaugaaagacauuucuguugg

SEQ ID NO: 463692 - RNA, 20 nt, Human
gggagaagggcugaugagag

SEQ ID NO: 463693 - RNA, 19 nt, Human
gugaggauacugcucagag

SEQ ID NO: 463694 - RNA, 22 nt, Human
ugcagcuucuccaucuccuugu

SEQ ID NO: 463695 - RNA, 21 nt, Human
ugcuucucuagaucaacuacu

SEQ ID NO: 463696 - RNA, 22 nt, Human
aggagucagauuguuugaaugu

SEQ ID NO: 463697 - RNA, 22 nt, Human
gucccugcccuccugggacuca

SEQ ID NO: 463698 - RNA, 22 nt, Human
ugcugccacugguagucucauu

SEQ ID NO: 463699 - RNA, 22 nt, Human
cuguacauauacauuuuuuucc

SEQ ID NO: 463700 - RNA, 22 nt, Human
ugaggcagaaauuccuguuuuc

SEQ ID NO: 463701 - RNA, 19 nt, Human
cacacccaugcuugccaag

SEQ ID NO: 463702 - RNA, 22 nt, Human
uggcccugucccuggagccugg

SEQ ID NO: 463703 - RNA, 22 nt, Human
gcagagaaaguuuuguccucag

SEQ ID NO: 463704 - RNA, 22 nt, Human
cccagcaggucggugcugccug

SEQ ID NO: 463705 - RNA, 22 nt, Human
cugaagcaaaugaaacagcucu

SEQ ID NO: 463706 - RNA, 22 nt, Human
ugcagggcaucuuugaagugug

SEQ ID NO: 463707 - RNA, 22 nt, Human
gccuguuggguaacagaguuca

SEQ ID NO: 463708 - RNA, 18 nt, Human
ugaccugcgcuucacggu

SEQ ID NO: 463709 - RNA, 22 nt, Human
gccaggugcuaucccugcgcug

SEQ ID NO: 463710 - RNA, 22 nt, Human
ugcucagggacaauggagaggg

SEQ ID NO: 463711 - RNA, 22 nt, Human
ucugccuguucaagucuucuag

SEQ ID NO: 463712 - RNA, 22 nt, Human
agcuuuauuugucauucacggc

SEQ ID NO: 463713 - RNA, 22 nt, Human
ucaaaguuuguggcaauuuauu

SEQ ID NO: 463714 - RNA, 22 nt, Human
augauugaccaucugcugggcu

SEQ ID NO: 463715 - RNA, 22 nt, Human
acagaggucauggagaguucuc

SEQ ID NO: 463716 - RNA, 22 nt, Human
agccagcagggcuuagaggaca

SEQ ID NO: 463717 - RNA, 22 nt, Human
ggagccagaggcugcugcugug

SEQ ID NO: 463718 - RNA, 22 nt, Human
uuucacaaucaaauggugaaau

SEQ ID NO: 463719 - RNA, 22 nt, Human
aaucuuucccuauuaaaugugg

SEQ ID NO: 463720 - RNA, 22 nt, Human
ucagaagagcuggugcugccug

SEQ ID NO: 463721 - RNA, 22 nt, Human
aggccagguggucaugcuugcu

SEQ ID NO: 463722 - RNA, 22 nt, Human
uguggcccagaugagugugcua

SEQ ID NO: 463723 - RNA, 22 nt, Human
ucaauuaugccauugcaauauu

SEQ ID NO: 463724 - RNA, 22 nt, Human
aaugcuguaaagaugcuaucug

SEQ ID NO: 463725 - RNA, 22 nt, Human
aaaggagacuucagaucuccuu

SEQ ID NO: 463726 - RNA, 22 nt, Human
uccugugccuccaccugcuccg

SEQ ID NO: 463727 - RNA, 22 nt, Human
uggcugagccacuuguucagau

SEQ ID NO: 463728 - RNA, 22 nt, Human
ucacauuuucauauucucugag

SEQ ID NO: 463729 - RNA, 22 nt, Human
ucauuuaauagcuuuugucuuu

SEQ ID NO: 463730 - RNA, 22 nt, Human
gcagcaugagcuauacaaagua

SEQ ID NO: 463731 - RNA, 22 nt, Human
aguggcagccgagcaggagaug

SEQ ID NO: 463732 - RNA, 22 nt, Human
cuggccuggcagggagggcaug

SEQ ID NO: 463733 - RNA, 22 nt, Human
aguggcaguuugggagcuacag

SEQ ID NO: 463734 - RNA, 22 nt, Human
uuuccucuaaacgcauuugcuu

SEQ ID NO: 463735 - RNA, 22 nt, Human
ggcucugcccagaugaagagga

SEQ ID NO: 463736 - RNA, 22 nt, Human
gucccagagagcacuaguccau

SEQ ID NO: 463737 - RNA, 22 nt, Human
caguggggaggccaggauagaa

SEQ ID NO: 463738 - RNA, 22 nt, Human
ugcgcaggagcucugccaggag

SEQ ID NO: 463739 - RNA, 22 nt, Human
gccuggaguggacuuggccccu

SEQ ID NO: 463740 - RNA, 22 nt, Human
gcagcuggucuggccuagagua

SEQ ID NO: 463741 - RNA, 22 nt, Human
cccaggagauggagguugcagu

SEQ ID NO: 463742 - RNA, 22 nt, Human
cacagggcuucucauggggugc

SEQ ID NO: 463743 - RNA, 23 nt, Human
gcugucugucaucucugcgggag

SEQ ID NO: 463744 - RNA, 22 nt, Human
uucaggaugcucagaguagucu

SEQ ID NO: 463745 - RNA, 22 nt, Human
uggcuggggccugaauccugca

SEQ ID NO: 463746 - RNA, 22 nt, Human
guggccagaagacugcaaugcu

SEQ ID NO: 463747 - RNA, 22 nt, Human
gcuggcaggguucucacugaaa

SEQ ID NO: 463748 - RNA, 22 nt, Human
gcagggccagugcagagaggaa

SEQ ID NO: 463749 - RNA, 22 nt, Human
uuaucguacgcuucagaaauuu

SEQ ID NO: 463750 - RNA, 22 nt, Human
uuugagaagcaucugguccacu

SEQ ID NO: 463751 - RNA, 22 nt, Human
auguggaggaaaugaguguaca

SEQ ID NO: 463752 - RNA, 21 nt, Human
uguuuauggaaaagagacaaa

SEQ ID NO: 463753 - RNA, 22 nt, Human
cuggcuuuuagugugaagacuu

SEQ ID NO: 463754 - RNA, 20 nt, Human
cucuccuugccgacuuggca

SEQ ID NO: 463755 - RNA, 17 nt, Human
gcagcagagagacccuc

SEQ ID NO: 463756 - RNA, 23 nt, Human
cagggcugguagggaagagcgug

SEQ ID NO: 463757 - RNA, 22 nt, Human
cugccuggguucaaguccuguu

SEQ ID NO: 463758 - RNA, 22 nt, Human
cccugcaggcucagacuggagu

SEQ ID NO: 463759 - RNA, 22 nt, Human
ggaggcucccacgcagcucaca

SEQ ID NO: 463760 - RNA, 22 nt, Human
uggcccugccacucacugcuga

SEQ ID NO: 463761 - RNA, 22 nt, Human
aggguggagggagucccugagc

SEQ ID NO: 463762 - RNA, 22 nt, Human
aacauaaauuugaaguggcaaa

SEQ ID NO: 463763 - RNA, 22 nt, Human
aguagaaagaaggcacugggcc

SEQ ID NO: 463764 - RNA, 22 nt, Human
uugagucaguaauuccauuucu

SEQ ID NO: 463765 - RNA, 22 nt, Human
aucauuccacauguaccacuag

SEQ ID NO: 463766 - RNA, 22 nt, Human
caauguaucaaccagaaaguuc

SEQ ID NO: 463767 - RNA, 22 nt, Human
uggagcuggaauuugagcugga

SEQ ID NO: 463768 - RNA, 22 nt, Human
ucucagagaugucaagagucua

SEQ ID NO: 463769 - RNA, 22 nt, Human
uauaauccugcuucacauugaa

SEQ ID NO: 463770 - RNA, 22 nt, Human
uuucaucucucuaaaagacagu

SEQ ID NO: 463771 - RNA, 22 nt, Human
uaggcagcugcaaacuucgguc

SEQ ID NO: 463772 - RNA, 22 nt, Human
aaaguguggagauugaacuaaa

SEQ ID NO: 463773 - RNA, 22 nt, Human
aguguccccuacagaggcauuc

SEQ ID NO: 463774 - RNA, 22 nt, Human
cugccuggggaaugugaggauu

SEQ ID NO: 463775 - RNA, 22 nt, Human
cagaaauucccauuucagauuc

SEQ ID NO: 463776 - RNA, 22 nt, Human
gggcugagcuguucugaguuua

SEQ ID NO: 463777 - RNA, 17 nt, Human
ucaugcccaacuauuac

SEQ ID NO: 463778 - RNA, 22 nt, Human
aauguuacgaucaacaacacau

SEQ ID NO: 463779 - RNA, 17 nt, Human
ccuuucucuuucaucuc

SEQ ID NO: 463780 - RNA, 22 nt, Human
uuaguaaauaaagucuacuuuc

SEQ ID NO: 463781 - RNA, 22 nt, Human
cggcugugucuucacaggagcc

SEQ ID NO: 463782 - RNA, 22 nt, Human
ucaggagauguaaccuuagcug

SEQ ID NO: 463783 - RNA, 22 nt, Human
caugcacagugauaucugaaga

SEQ ID NO: 463784 - RNA, 22 nt, Human
uuuccucugaugcugacuugga

SEQ ID NO: 463785 - RNA, 22 nt, Human
caggaaagagcugccaggcagg

SEQ ID NO: 463786 - RNA, 22 nt, Human
gccuggguuccaugaucuccag

SEQ ID NO: 463787 - RNA, 22 nt, Human
gcugucccgaaccccugguaau

SEQ ID NO: 463788 - RNA, 22 nt, Human
auucuagaugcuguaaguagca

SEQ ID NO: 463789 - RNA, 22 nt, Human
aaugcacagcguuccaugcuug

SEQ ID NO: 463790 - RNA, 22 nt, Human
aggcagcauuucugcuuaucca

SEQ ID NO: 463791 - RNA, 22 nt, Human
uccucugcuggaagggcaagag

SEQ ID NO: 463792 - RNA, 22 nt, Human
agaaaugacacacaugagacau

SEQ ID NO: 463793 - RNA, 22 nt, Human
cucucaggcuugggucguggca

SEQ ID NO: 463794 - RNA, 18 nt, Human
agcuggggccucuggucc

SEQ ID NO: 463795 - RNA, 22 nt, Human
aggccagcucacccuggcuccu

SEQ ID NO: 463796 - RNA, 22 nt, Human
ccauaaggagccagacauucca

SEQ ID NO: 463797 - RNA, 22 nt, Human
cuuccuggccauugccauggca

SEQ ID NO: 463798 - RNA, 22 nt, Human
gcagagaccccgcagugaggcc

SEQ ID NO: 463799 - RNA, 22 nt, Human
uauucauaguaaacaaaagugg

SEQ ID NO: 463800 - RNA, 20 nt, Human
cugcugugauucccuccucc

SEQ ID NO: 463801 - RNA, 22 nt, Human
gcucaggaccgaggggugggaa

SEQ ID NO: 463802 - RNA, 22 nt, Human
agggccugcucuaucacucuca

SEQ ID NO: 463803 - RNA, 22 nt, Human
agcacuuuccuggcaaaugugg

SEQ ID NO: 463804 - RNA, 22 nt, Human
guuuuauaggugaaauauuacu

SEQ ID NO: 463805 - RNA, 17 nt, Human
cauuuguugaucaguug

SEQ ID NO: 463806 - RNA, 22 nt, Human
gagacugcauagauggccacaa

SEQ ID NO: 463807 - RNA, 22 nt, Human
ccuggccucgugcucacggcuc

SEQ ID NO: 463808 - RNA, 22 nt, Human
ugaagguggcauaggagagaug

SEQ ID NO: 463809 - RNA, 22 nt, Human
ucucagagcuucagaaagcacc

SEQ ID NO: 463810 - RNA, 22 nt, Human
ugaggcuggcaaggcugguauu

SEQ ID NO: 463811 - RNA, 22 nt, Human
agggccaggaucacagccaaga

SEQ ID NO: 463812 - RNA, 22 nt, Human
aaacagaaauuuccucaugcuc

SEQ ID NO: 463813 - RNA, 23 nt, Human
uggagaugccccacucccugucu

SEQ ID NO: 463814 - RNA, 22 nt, Human
ucagaacauugacauucuuauu

SEQ ID NO: 463815 - RNA, 22 nt, Human
cuguuuauuacacuggauagca

SEQ ID NO: 463816 - RNA, 18 nt, Human
gaaaugugauucuagggc

SEQ ID NO: 463817 - RNA, 22 nt, Human
gcagccagguuugaggaccacu

SEQ ID NO: 463818 - RNA, 22 nt, Human
ugcaguggaaagacucagacuu

SEQ ID NO: 463819 - RNA, 22 nt, Human
agagugauggguugugcugacc

SEQ ID NO: 463820 - RNA, 22 nt, Human
cauguuuuguguacagaauauu

SEQ ID NO: 463821 - RNA, 22 nt, Human
cugcaguguucuggaaugcauu

SEQ ID NO: 463822 - RNA, 22 nt, Human
guggagacuucuacuagagacc

SEQ ID NO: 463823 - RNA, 22 nt, Human
agagggcuggacgcagguugga

SEQ ID NO: 463824 - RNA, 22 nt, Human
cccuggaguccuggcaguugau

SEQ ID NO: 463825 - RNA, 19 nt, Human
acacagggaucagaggguu

SEQ ID NO: 463826 - RNA, 22 nt, Human
auaaaagaaguuuugguacuug

SEQ ID NO: 463827 - RNA, 22 nt, Human
uaaauucccaacucugcucuuc

SEQ ID NO: 463828 - RNA, 22 nt, Human
accagagaaaacacagcaggcu

SEQ ID NO: 463829 - RNA, 22 nt, Human
aaacaugagcaucucuucaagc

SEQ ID NO: 463830 - RNA, 22 nt, Human
gcugauccuuuuaugucuagcu

SEQ ID NO: 463831 - RNA, 23 nt, Human
aaaaaaccauguaggcacucagu

SEQ ID NO: 463832 - RNA, 22 nt, Human
guauccuccccgcuggccuuca

SEQ ID NO: 463833 - RNA, 22 nt, Human
uaacugauauugaaaaacauca

SEQ ID NO: 463834 - RNA, 22 nt, Human
ggggcagcucccgagggcagga

SEQ ID NO: 463835 - RNA, 22 nt, Human
augcaguguuuggaagcuuaag

SEQ ID NO: 463836 - RNA, 22 nt, Human
augcagcugugggcaagaaaug

SEQ ID NO: 463837 - RNA, 22 nt, Human
acagccagaggagccaggcugg

SEQ ID NO: 463838 - RNA, 22 nt, Human
gggugcaggcagcccaggcagg

SEQ ID NO: 463839 - RNA, 21 nt, Human
ccucuggcuugugcugugccc

SEQ ID NO: 463840 - RNA, 19 nt, Human
ugucucagugucccuuccu

SEQ ID NO: 463841 - RNA, 20 nt, Human
caggaugauuggacacgaug

SEQ ID NO: 463842 - RNA, 22 nt, Human
agcuggguggagggcccacggu

SEQ ID NO: 463843 - RNA, 22 nt, Human
aagccaggggcugcuuaggaga

SEQ ID NO: 463844 - RNA, 22 nt, Human
caccaggcuggagugcagaggu

SEQ ID NO: 463845 - RNA, 22 nt, Human
auggggcuguucucugcccugc

SEQ ID NO: 463846 - RNA, 23 nt, Human
aucaaacuggugagaaugucagu

SEQ ID NO: 463847 - RNA, 22 nt, Human
cuugaaagcacuuaguaaauua

SEQ ID NO: 463848 - RNA, 21 nt, Human
ugcuccuuagcugccccugcc

SEQ ID NO: 463849 - RNA, 22 nt, Human
aagucuggaagucucaguuuuc

SEQ ID NO: 463850 - RNA, 22 nt, Human
cugggccagauccagccucaca

SEQ ID NO: 463851 - RNA, 22 nt, Human
cuuguccuuuacuugagacuca

SEQ ID NO: 463852 - RNA, 21 nt, Human
aggcacuguuugugguuuggg

SEQ ID NO: 463853 - RNA, 22 nt, Human
aaguucuacagcuucgcaggca

SEQ ID NO: 463854 - RNA, 22 nt, Human
cagaaccaggaacugauggaga

SEQ ID NO: 463855 - RNA, 22 nt, Human
cuguauuugaaagaaaagauuu

SEQ ID NO: 463856 - RNA, 22 nt, Human
gaggcucagagagguccacaua

SEQ ID NO: 463857 - RNA, 22 nt, Human
ucagcugagcuccagcucauag

SEQ ID NO: 463858 - RNA, 22 nt, Human
gcagccacucucauuccacgug

SEQ ID NO: 463859 - RNA, 22 nt, Human
agcccagccggauucccaguuc

SEQ ID NO: 463860 - RNA, 22 nt, Human
ucucacuggguauaaaugagua

SEQ ID NO: 463861 - RNA, 22 nt, Human
uuauuuauggcacuguuggugg

SEQ ID NO: 463862 - RNA, 22 nt, Human
uauuggugggggcagagagaga

SEQ ID NO: 463863 - RNA, 22 nt, Human
cagagccagaacuagaccuugu

SEQ ID NO: 463864 - RNA, 22 nt, Human
uucaggauuguguuuuuccuga

SEQ ID NO: 463865 - RNA, 22 nt, Human
ugucauaaaacacaagcuguug

SEQ ID NO: 463866 - RNA, 22 nt, Human
uuaugcaaaggggccucuuccu

SEQ ID NO: 463867 - RNA, 22 nt, Human
cugcccugccuggccagugugg

SEQ ID NO: 463868 - RNA, 22 nt, Human
guaucuuuugguggaaaaauaa

SEQ ID NO: 463869 - RNA, 19 nt, Human
cugccuguuauggagagaa

SEQ ID NO: 463870 - RNA, 22 nt, Human
uagggcagcugcaucaggcacu

SEQ ID NO: 463871 - RNA, 22 nt, Human
ugcagggauuagaggccgggga

SEQ ID NO: 463872 - RNA, 22 nt, Human
acagccugcugccugcuucuug

SEQ ID NO: 463873 - RNA, 22 nt, Human
cccagccugugacagccguccu

SEQ ID NO: 463874 - RNA, 22 nt, Human
gggaguggauuauguggaccca

SEQ ID NO: 463875 - RNA, 22 nt, Human
cugagcagcaacccagagccuc

SEQ ID NO: 463876 - RNA, 22 nt, Human
aaggaagaagacucuuuacucc

SEQ ID NO: 463877 - RNA, 22 nt, Human
cuacacaguucugccuaauggc

SEQ ID NO: 463878 - RNA, 22 nt, Human
aggaagcaaaaggcagggucua

SEQ ID NO: 463879 - RNA, 22 nt, Human
uggagccaaugaacauuugcug

SEQ ID NO: 463880 - RNA, 18 nt, Human
gagguccugcucuagccc

SEQ ID NO: 463881 - RNA, 22 nt, Human
guccaggucuggacccugagcc

SEQ ID NO: 463882 - RNA, 22 nt, Human
auaaaauuugcuacuguuaaau

SEQ ID NO: 463883 - RNA, 22 nt, Human
ugaggccuggagggaggaguuu

SEQ ID NO: 463884 - RNA, 22 nt, Human
auaguuguguggggauucuggu

SEQ ID NO: 463885 - RNA, 20 nt, Human
uuuuauauguaggguauaug

SEQ ID NO: 463886 - RNA, 22 nt, Human
agggacuuguguccuauguaug

SEQ ID NO: 463887 - RNA, 22 nt, Human
uagggcaggggaggaaucugaa

SEQ ID NO: 463888 - RNA, 22 nt, Human
gggagagagagcucauguugaa

SEQ ID NO: 463889 - RNA, 22 nt, Human
acucaguacaucuggaguuggc

SEQ ID NO: 463890 - RNA, 22 nt, Human
acagcaggauuuggcgauguug

SEQ ID NO: 463891 - RNA, 22 nt, Human
aaugucugccugaacuuuauau

SEQ ID NO: 463892 - RNA, 22 nt, Human
uguggcugucuguucuccuagg

SEQ ID NO: 463893 - RNA, 22 nt, Human
aaggcuuuaugugaccaaaaga

SEQ ID NO: 463894 - RNA, 22 nt, Human
uucuucauggguucuuuuagga

SEQ ID NO: 463895 - RNA, 22 nt, Human
aagggcucugcugucucucccc

SEQ ID NO: 463896 - RNA, 22 nt, Human
aagacuguaugagacaauauaa

SEQ ID NO: 463897 - RNA, 22 nt, Human
aauagcuuuggucaccaucugg

SEQ ID NO: 463898 - RNA, 22 nt, Human
uuuuugaaggcugaugugauua

SEQ ID NO: 463899 - RNA, 17 nt, Human
aggccagaugaggcaag

SEQ ID NO: 463900 - RNA, 19 nt, Human
agccuggcuuugcucugcu

SEQ ID NO: 463901 - RNA, 22 nt, Human
gggcuggcaggaccugggcuga

SEQ ID NO: 463902 - RNA, 22 nt, Human
ugcuggggcucugaccacucca

SEQ ID NO: 463903 - RNA, 22 nt, Human
uggcucugugcuucuaguaucu

SEQ ID NO: 463904 - RNA, 22 nt, Human
uggcugaggcuggagugcagug

SEQ ID NO: 463905 - RNA, 22 nt, Human
aggccugucuggggcucagcca

SEQ ID NO: 463906 - RNA, 22 nt, Human
augcaguacugauacaugccac

SEQ ID NO: 463907 - RNA, 22 nt, Human
auaagaaacauuauucuuucca

SEQ ID NO: 463908 - RNA, 21 nt, Human
uuagcaaagcaaacacaugcu

SEQ ID NO: 463909 - RNA, 22 nt, Human
uugacagcuauuuugcuuugau

SEQ ID NO: 463910 - RNA, 22 nt, Human
aguggaccagaagacugaagcu

SEQ ID NO: 463911 - RNA, 22 nt, Human
aaaaaaucagaucuuugguuaa

SEQ ID NO: 463912 - RNA, 22 nt, Human
ucagggcaagauugguuaauaa

SEQ ID NO: 463913 - RNA, 22 nt, Human
gagaagucauuugaccaccuag

SEQ ID NO: 463914 - RNA, 22 nt, Human
uaagaacagugacagccaacau

SEQ ID NO: 463915 - RNA, 22 nt, Human
ccagggcagcgccccuccacgc

SEQ ID NO: 463916 - RNA, 22 nt, Human
guauuacauuuaguaauuaggc

SEQ ID NO: 463917 - RNA, 22 nt, Human
aguuuagaguucaaauuaguuc

SEQ ID NO: 463918 - RNA, 22 nt, Human
cuuggggcugucacucuggcau

SEQ ID NO: 463919 - RNA, 22 nt, Human
cugcuuugauuagaagaguaca

SEQ ID NO: 463920 - RNA, 22 nt, Human
ggaggccaaggcaggcggauca

SEQ ID NO: 463921 - RNA, 22 nt, Human
aaauaauugaguuggucaauau

SEQ ID NO: 463922 - RNA, 22 nt, Human
cugucuuugguccugucuguua

SEQ ID NO: 463923 - RNA, 22 nt, Human
gccagcucagugccaggccccu

SEQ ID NO: 463924 - RNA, 22 nt, Human
uguggcugcucaggugcagacc

SEQ ID NO: 463925 - RNA, 22 nt, Human
uguacaaugccgagacuaacuc

SEQ ID NO: 463926 - RNA, 22 nt, Human
agucucagaaaagaagcaugga

SEQ ID NO: 463927 - RNA, 22 nt, Human
cagcagcucccauccgcugagc

SEQ ID NO: 463928 - RNA, 22 nt, Human
cucagagaggcaguggaaguca

SEQ ID NO: 463929 - RNA, 22 nt, Human
ucucagaguuccucuggagucc

SEQ ID NO: 463930 - RNA, 22 nt, Human
gccucugcccuccugggacugc

SEQ ID NO: 463931 - RNA, 22 nt, Human
acauuuaggauguuuugagaga

SEQ ID NO: 463932 - RNA, 22 nt, Human
ucagggcauccauugccuguug

SEQ ID NO: 463933 - RNA, 22 nt, Human
cuggagguaauguuauuuuugu

SEQ ID NO: 463934 - RNA, 22 nt, Human
gcaaagguagccaaggagcuca

SEQ ID NO: 463935 - RNA, 19 nt, Human
cugagcagcggcagcacuu

SEQ ID NO: 463936 - RNA, 23 nt, Human
agcagggccagaauacuugcugu

SEQ ID NO: 463937 - RNA, 22 nt, Human
uugaccauaccuccaggcaguu

SEQ ID NO: 463938 - RNA, 22 nt, Human
agagccagagaccuggguucac

SEQ ID NO: 463939 - RNA, 18 nt, Human
agaagccacgaggagucc

SEQ ID NO: 463940 - RNA, 22 nt, Human
aauucauccaugaacaauucca

SEQ ID NO: 463941 - RNA, 22 nt, Human
auccucagcaucuagcaugaag

SEQ ID NO: 463942 - RNA, 21 nt, Human
auggagccuaagaguggaggu

SEQ ID NO: 463943 - RNA, 22 nt, Human
cccagcagaccgcugugauggc

SEQ ID NO: 463944 - RNA, 22 nt, Human
agcagcuccugccaugagugcu

SEQ ID NO: 463945 - RNA, 22 nt, Human
cucugucccagacccaccucuc

SEQ ID NO: 463946 - RNA, 21 nt, Human
aggagcuguguuagcuggucg

SEQ ID NO: 463947 - RNA, 22 nt, Human
ggggugggcgugcagggacacc

SEQ ID NO: 463948 - RNA, 22 nt, Human
aagcagccacuggccaguuaua

SEQ ID NO: 463949 - RNA, 22 nt, Human
cucaguuucugacauuaaaauc

SEQ ID NO: 463950 - RNA, 21 nt, Human
ucucugugucuuuaagcugga

SEQ ID NO: 463951 - RNA, 22 nt, Human
gcacccagaggucagcagugcu

SEQ ID NO: 463952 - RNA, 22 nt, Human
uccacuuuagcaaugauugaau

SEQ ID NO: 463953 - RNA, 23 nt, Human
uccaggcaugagcucuggaugga

SEQ ID NO: 463954 - RNA, 22 nt, Human
ggcacugauuccauucaugaag

SEQ ID NO: 463955 - RNA, 22 nt, Human
uguugauuugugggcugcaaaa

SEQ ID NO: 463956 - RNA, 22 nt, Human
guacauuuugagguuaaaacaa

SEQ ID NO: 463957 - RNA, 22 nt, Human
agcaguggugugaggagggcuc

SEQ ID NO: 463958 - RNA, 22 nt, Human
cucaggaguuggaggcuacagu

SEQ ID NO: 463959 - RNA, 22 nt, Human
ugggcagaauugugguaguuaa

SEQ ID NO: 463960 - RNA, 22 nt, Human
ugcugcucucagccaccaggaa

SEQ ID NO: 463961 - RNA, 22 nt, Human
ugcugccagggcucugcccaca

SEQ ID NO: 463962 - RNA, 22 nt, Human
guucagcccacagagggggccg

SEQ ID NO: 463963 - RNA, 22 nt, Human
ugggcugcagagcccggccuuc

SEQ ID NO: 463964 - RNA, 21 nt, Human
gcugagagguugggaaguuca

SEQ ID NO: 463965 - RNA, 22 nt, Human
agaggccagcagugccuaucug

SEQ ID NO: 463966 - RNA, 22 nt, Human
gggcugggauugcuugcuguga

SEQ ID NO: 463967 - RNA, 20 nt, Human
uccaggagaacugggagccg

SEQ ID NO: 463968 - RNA, 22 nt, Human
aucaggaugcugucaguuacca

SEQ ID NO: 463969 - RNA, 22 nt, Human
ggcuucugguaaagaccacacc

SEQ ID NO: 463970 - RNA, 22 nt, Human
uucaagauggccccagugagcc

SEQ ID NO: 463971 - RNA, 22 nt, Human
gcccccucuuuggagccagcca

SEQ ID NO: 463972 - RNA, 22 nt, Human
aagcagcuuaaauuagagccug

SEQ ID NO: 463973 - RNA, 22 nt, Human
ggcagcaggcgacuucccuauu

SEQ ID NO: 463974 - RNA, 22 nt, Human
cuuuauguuggggugucuuagu

SEQ ID NO: 463975 - RNA, 22 nt, Human
uauuucuuguucccuccaaguu

SEQ ID NO: 463976 - RNA, 22 nt, Human
uggggcugaggagccucacucu

SEQ ID NO: 463977 - RNA, 22 nt, Human
uauaauccauucauugauuucu

SEQ ID NO: 463978 - RNA, 22 nt, Human
cagugggcugugauggauucac

SEQ ID NO: 463979 - RNA, 22 nt, Human
gugcugucaauugcuuucagua

SEQ ID NO: 463980 - RNA, 22 nt, Human
aguggacucuucccagugcuug

SEQ ID NO: 463981 - RNA, 22 nt, Human
agaggcugucccuugcuauucc

SEQ ID NO: 463982 - RNA, 21 nt, Human
gggccacaccuucugcagacc

SEQ ID NO: 463983 - RNA, 22 nt, Human
ugaguccauugauggauaguga

SEQ ID NO: 463984 - RNA, 22 nt, Human
agcccggcuuccccgguugcua

SEQ ID NO: 463985 - RNA, 22 nt, Human
cccuggaguccggagcucaccu

SEQ ID NO: 463986 - RNA, 22 nt, Human
ggcaggguccacaccugggaaa

SEQ ID NO: 463987 - RNA, 22 nt, Human
ugggugagugggaaaagcccag

SEQ ID NO: 463988 - RNA, 22 nt, Human
cucugagagcggucuguggcuu

SEQ ID NO: 463989 - RNA, 22 nt, Human
guaaaugugcuucuuuuaacuu

SEQ ID NO: 463990 - RNA, 23 nt, Human
agucagagagugugagacaacug

SEQ ID NO: 463991 - RNA, 22 nt, Human
agugcagccgagaucaggugcu

SEQ ID NO: 463992 - RNA, 22 nt, Human
caagaacauugugaucacuuca

SEQ ID NO: 463993 - RNA, 22 nt, Human
uccugguggugccagcugcagg

SEQ ID NO: 463994 - RNA, 22 nt, Human
gcagagcugucuaagucacuuc

SEQ ID NO: 463995 - RNA, 22 nt, Human
gcagggacgccagggacagcaa

SEQ ID NO: 463996 - RNA, 22 nt, Human
ccacagggcucuaggcgcuucc

SEQ ID NO: 463997 - RNA, 22 nt, Human
cuuacauugugugcaugagggg

SEQ ID NO: 463998 - RNA, 22 nt, Human
cagcccaggccgacaguuccuc

SEQ ID NO: 463999 - RNA, 22 nt, Human
ccuguacagugaaugaauguga

SEQ ID NO: 464000 - RNA, 20 nt, Human
gcugccuguuucuguaagua

SEQ ID NO: 464001 - RNA, 19 nt, Human
agaggcugucaccuguagc

SEQ ID NO: 464002 - RNA, 22 nt, Human
uaagaacaguguuucaucucua

SEQ ID NO: 464003 - RNA, 22 nt, Human
gggcuccaccuagggacacugg

SEQ ID NO: 464004 - RNA, 22 nt, Human
caguggguggcuaaguggcuga

SEQ ID NO: 464005 - RNA, 22 nt, Human
cuuguauuccccuaucucuaaa

SEQ ID NO: 464006 - RNA, 22 nt, Human
caggguggcacaucacagcauu

SEQ ID NO: 464007 - RNA, 20 nt, Human
agaggccaguuaggagucua

SEQ ID NO: 464008 - RNA, 22 nt, Human
uugacaauguccuuugaauuuc

SEQ ID NO: 464009 - RNA, 17 nt, Human
cugaggcccagggccca

SEQ ID NO: 464010 - RNA, 22 nt, Human
aagaugcagcuuccacuuuugc

SEQ ID NO: 464011 - RNA, 23 nt, Human
ugggcaucuccucugugccaggc

SEQ ID NO: 464012 - RNA, 22 nt, Human
aggaauucaagaccagcugggc

SEQ ID NO: 464013 - RNA, 22 nt, Human
acagaggccccgugggagagcc

SEQ ID NO: 464014 - RNA, 22 nt, Human
agggacccugaugacugaggag

SEQ ID NO: 464015 - RNA, 22 nt, Human
uaguggaggccuguugugugca

SEQ ID NO: 464016 - RNA, 22 nt, Human
ccagcuuguuugaagcucguca

SEQ ID NO: 464017 - RNA, 22 nt, Human
ugcucugcaagcaggagcaaga

SEQ ID NO: 464018 - RNA, 22 nt, Human
cccuuccucccaggcuucugug

SEQ ID NO: 464019 - RNA, 22 nt, Human
cuggagccggaccagggacggu

SEQ ID NO: 464020 - RNA, 22 nt, Human
uuucaaauagaaucuuuccaaa

SEQ ID NO: 464021 - RNA, 22 nt, Human
ccuucagaccuagacaggaauc

SEQ ID NO: 464022 - RNA, 22 nt, Human
agggagagguugaaaccucagu

SEQ ID NO: 464023 - RNA, 22 nt, Human
gccugagauucccggagccgug

SEQ ID NO: 464024 - RNA, 22 nt, Human
acagcuggaggccccauugucc

SEQ ID NO: 464025 - RNA, 22 nt, Human
uuaacaugucuugacuucaucu

SEQ ID NO: 464026 - RNA, 22 nt, Human
gcauuucugugcauacacauga

SEQ ID NO: 464027 - RNA, 22 nt, Human
uccacugcagcuucugauggaa

SEQ ID NO: 464028 - RNA, 22 nt, Human
agcaggugagcacagccaggcu

SEQ ID NO: 464029 - RNA, 20 nt, Human
cucugcuuuaggagagucag

SEQ ID NO: 464030 - RNA, 22 nt, Human
cccaguggaaggaguagaagac

SEQ ID NO: 464031 - RNA, 22 nt, Human
ucaaaccaccuuguuacugggg

SEQ ID NO: 464032 - RNA, 22 nt, Human
guauuuucaugauuucagacca

SEQ ID NO: 464033 - RNA, 22 nt, Human
uggggcuggcacagucucuauu

SEQ ID NO: 464034 - RNA, 22 nt, Human
gccugaggaaugcuccugacuu

SEQ ID NO: 464035 - RNA, 22 nt, Human
cugcaggaauucaaagugagcu

SEQ ID NO: 464036 - RNA, 23 nt, Human
ggcugagacuacaggcgcuugcc

SEQ ID NO: 464037 - RNA, 22 nt, Human
caggcagagucagauuagacuu

SEQ ID NO: 464038 - RNA, 22 nt, Human
ucccuggccauuccucuaggcc

SEQ ID NO: 464039 - RNA, 22 nt, Human
guuguacagcauccagugcaga

SEQ ID NO: 464040 - RNA, 20 nt, Human
ccugccugccucggcucauu

SEQ ID NO: 464041 - RNA, 21 nt, Human
agugaaaugaaguguaugcuc

SEQ ID NO: 464042 - RNA, 22 nt, Human
aucuauuucugcuaauaacaau

SEQ ID NO: 464043 - RNA, 22 nt, Human
caggaugaagggcaaaggcaag

SEQ ID NO: 464044 - RNA, 20 nt, Human
agaaggcuccuuuugccaag

SEQ ID NO: 464045 - RNA, 22 nt, Human
uguagcucuccagccagcaagg

SEQ ID NO: 464046 - RNA, 22 nt, Human
ugagccugcaauaagcacagcc

SEQ ID NO: 464047 - RNA, 22 nt, Human
caggauagaaaggccauggagu

SEQ ID NO: 464048 - RNA, 22 nt, Human
gagagcacaugaacauggagga

SEQ ID NO: 464049 - RNA, 20 nt, Human
aggcugagggugauuguguc

SEQ ID NO: 464050 - RNA, 22 nt, Human
caguagcacuagauaugugugg

SEQ ID NO: 464051 - RNA, 23 nt, Human
uggcauuuuaguuagcuucagug

SEQ ID NO: 464052 - RNA, 22 nt, Human
uggggccuggucagagcugcac

SEQ ID NO: 464053 - RNA, 22 nt, Human
gcagggacaucuuugucuagua

SEQ ID NO: 464054 - RNA, 22 nt, Human
ccagcugcagguguuccagaug

SEQ ID NO: 464055 - RNA, 22 nt, Human
gaggaaaauaacaacuaagggc

SEQ ID NO: 464056 - RNA, 22 nt, Human
ugaugggaggugcugcaggacc

SEQ ID NO: 464057 - RNA, 22 nt, Human
ccacaaguuucagcacccagag

SEQ ID NO: 464058 - RNA, 22 nt, Human
agagccagcauuugacacuggc

SEQ ID NO: 464059 - RNA, 22 nt, Human
cauguaaaacacucagaacagu

SEQ ID NO: 464060 - RNA, 22 nt, Human
agcagagcgccugcucagaggg

SEQ ID NO: 464061 - RNA, 22 nt, Human
cuugccuguggcuaguuggcuc

SEQ ID NO: 464062 - RNA, 22 nt, Human
ggcugccuugacccuggcuccg

SEQ ID NO: 464063 - RNA, 22 nt, Human
agcagagcugcaguggccugcu

SEQ ID NO: 464064 - RNA, 22 nt, Human
ugagccagaggaggcugugugg

SEQ ID NO: 464065 - RNA, 22 nt, Human
aaguucaaggcagguccugagg

SEQ ID NO: 464066 - RNA, 22 nt, Human
accagggcacaggagucugaag

SEQ ID NO: 464067 - RNA, 22 nt, Human
gugcaguggcagauccuagcuc

SEQ ID NO: 464068 - RNA, 22 nt, Human
ccaggccuggccaggggaugcc

SEQ ID NO: 464069 - RNA, 22 nt, Human
augacagaaggccucccugaca

SEQ ID NO: 464070 - RNA, 22 nt, Human
ccacugcccccugaagaccagg

SEQ ID NO: 464071 - RNA, 22 nt, Human
acagcugugaagcaagcacucu

SEQ ID NO: 464072 - RNA, 22 nt, Human
cugggcacuugcucacagcucu

SEQ ID NO: 464073 - RNA, 22 nt, Human
cuggcccuucucuugcuuccug

SEQ ID NO: 464074 - RNA, 22 nt, Human
agggcugggcugcuuguuguca

SEQ ID NO: 464075 - RNA, 18 nt, Human
cuuguucuucucuuggcg

SEQ ID NO: 464076 - RNA, 22 nt, Human
ucacaacucuuuccauuuaaua

SEQ ID NO: 464077 - RNA, 22 nt, Human
aacaugauuuaguauaaugcag

SEQ ID NO: 464078 - RNA, 22 nt, Human
acucaggagggaucagcuauca

SEQ ID NO: 464079 - RNA, 22 nt, Human
ccugauggagcccugcugcaug

SEQ ID NO: 464080 - RNA, 19 nt, Human
acacagggcuagaguuaca

SEQ ID NO: 464081 - RNA, 22 nt, Human
agcugacuucuugauccaauga

SEQ ID NO: 464082 - RNA, 22 nt, Human
caggugaccuuuguccuaaguu

SEQ ID NO: 464083 - RNA, 16 nt, Human
agaggccuugaggaag

SEQ ID NO: 464084 - RNA, 19 nt, Human
uggcagggagaguuugaag

SEQ ID NO: 464085 - RNA, 22 nt, Human
caggugggcuugggagaacacu

SEQ ID NO: 464086 - RNA, 22 nt, Human
uuauuuauuguguaccuacugu

SEQ ID NO: 464087 - RNA, 22 nt, Human
ucagcagggcugugguguggcu

SEQ ID NO: 464088 - RNA, 22 nt, Human
uucuagaugauaaaccagcagc

SEQ ID NO: 464089 - RNA, 22 nt, Human
ccuagaugggauggcggccggg

SEQ ID NO: 464090 - RNA, 22 nt, Human
ugucacauugaauaugauuuau

SEQ ID NO: 464091 - RNA, 22 nt, Human
uuaaugcuugucuagaucuucu

SEQ ID NO: 464092 - RNA, 22 nt, Human
ugaggcucagugagcccugcag

SEQ ID NO: 464093 - RNA, 22 nt, Human
uagacagauuuaaaggaaugga

SEQ ID NO: 464094 - RNA, 22 nt, Human
gccucccugagucacccaagca

SEQ ID NO: 464095 - RNA, 22 nt, Human
cagggcugaagaaauucaaaag

SEQ ID NO: 464096 - RNA, 22 nt, Human
caagaauuguacaaacugggug

SEQ ID NO: 464097 - RNA, 22 nt, Human
ugggggugaaagucuggacagu

SEQ ID NO: 464098 - RNA, 22 nt, Human
ggagugaguacuggaguagcug

SEQ ID NO: 464099 - RNA, 22 nt, Human
caauaugcaagcuauuaaguau

SEQ ID NO: 464100 - RNA, 22 nt, Human
auugaaagagaauguagcucuu

SEQ ID NO: 464101 - RNA, 22 nt, Human
ugucugguggguugacaggcag

SEQ ID NO: 464102 - RNA, 22 nt, Human
uuuguuaaauauuuauugagug

SEQ ID NO: 464103 - RNA, 22 nt, Human
agcuaggaaauugaggcugaga

SEQ ID NO: 464104 - RNA, 22 nt, Human
gaaggccacuuuguguugagaa

SEQ ID NO: 464105 - RNA, 22 nt, Human
ccuggagcccaaggcagugaga

SEQ ID NO: 464106 - RNA, 22 nt, Human
ucugucacucuagagauggcag

SEQ ID NO: 464107 - RNA, 22 nt, Human
ccaguggccaugcacgagcagc

SEQ ID NO: 464108 - RNA, 22 nt, Human
ggagccuugggcgcucucccau

SEQ ID NO: 464109 - RNA, 22 nt, Human
cuuguacaggaauccaugguau

SEQ ID NO: 464110 - RNA, 22 nt, Human
ugauuucauaguauauacauga

SEQ ID NO: 464111 - RNA, 21 nt, Human
gaugaagcaaucuuucuguug

SEQ ID NO: 464112 - RNA, 23 nt, Human
cagagcugauuaaacuuaaucuc

SEQ ID NO: 464113 - RNA, 22 nt, Human
gaagagcuaaaggcacaggcuu

SEQ ID NO: 464114 - RNA, 22 nt, Human
uggcagagacuccuccugggag

SEQ ID NO: 464115 - RNA, 22 nt, Human
aggugcaggagcugugcaggga

SEQ ID NO: 464116 - RNA, 22 nt, Human
cagagccaggucuaggagucuc

SEQ ID NO: 464117 - RNA, 22 nt, Human
ucacauuuguguuuuauuagag

SEQ ID NO: 464118 - RNA, 22 nt, Human
gagcugcccugagcuuugcaug

SEQ ID NO: 464119 - RNA, 22 nt, Human
cugcuuccauaaauaaugugcu

SEQ ID NO: 464120 - RNA, 22 nt, Human
gucucccaaccccugugcccag

SEQ ID NO: 464121 - RNA, 22 nt, Human
uuugauuuacuggauauucuca

SEQ ID NO: 464122 - RNA, 22 nt, Human
caaagccucugauuucacuugu

SEQ ID NO: 464123 - RNA, 22 nt, Human
ccaggugugcucugcaguggau

SEQ ID NO: 464124 - RNA, 22 nt, Human
caaagugcugagauuacaggua

SEQ ID NO: 464125 - RNA, 22 nt, Human
ugggcuccucgucacucgcugu

SEQ ID NO: 464126 - RNA, 22 nt, Human
uggagcugacucacaccagcua

SEQ ID NO: 464127 - RNA, 23 nt, Human
gccugggacugguagugugaccu

SEQ ID NO: 464128 - RNA, 22 nt, Human
aaaugcagaucccugaaucuca

SEQ ID NO: 464129 - RNA, 18 nt, Human
gggcauggaugcagcauc

SEQ ID NO: 464130 - RNA, 22 nt, Human
agugcuguccaguuucacaggu

SEQ ID NO: 464131 - RNA, 22 nt, Human
aaaauaucagcaaagggugaca

SEQ ID NO: 464132 - RNA, 19 nt, Human
uccccagcaccucugaguc

SEQ ID NO: 464133 - RNA, 22 nt, Human
ugaggcucuccaagcagaugag

SEQ ID NO: 464134 - RNA, 22 nt, Human
cuggagcugucuucacaggccu

SEQ ID NO: 464135 - RNA, 22 nt, Human
cuuacauugucuuaguuuucaa

SEQ ID NO: 464136 - RNA, 22 nt, Human
agcugucuuucugccuccugau

SEQ ID NO: 464137 - RNA, 22 nt, Human
aaaugcacaaaguaaguguaau

SEQ ID NO: 464138 - RNA, 22 nt, Human
ccuuguccucugguuuccuguu

SEQ ID NO: 464139 - RNA, 22 nt, Human
uccuuggcaugccgucuucucc

SEQ ID NO: 464140 - RNA, 22 nt, Human
cugcagugaaaucaggaagcaa

SEQ ID NO: 464141 - RNA, 22 nt, Human
ggcuggucacaccacugcaggg

SEQ ID NO: 464142 - RNA, 22 nt, Human
aggccuggugaaugaaguaucu

SEQ ID NO: 464143 - RNA, 22 nt, Human
acuuucuaggucucaguccuuu

SEQ ID NO: 464144 - RNA, 22 nt, Human
agagcugcaauuucauguggug

SEQ ID NO: 464145 - RNA, 22 nt, Human
accuuuuuguucuguucucagc

SEQ ID NO: 464146 - RNA, 18 nt, Human
ucucagaggccauccuag

SEQ ID NO: 464147 - RNA, 22 nt, Human
gacugucauucuagugcccaug

SEQ ID NO: 464148 - RNA, 22 nt, Human
gcagccaccucccauggcgggg

SEQ ID NO: 464149 - RNA, 22 nt, Human
cccagagccucauucuguuggg

SEQ ID NO: 464150 - RNA, 22 nt, Human
uuucacacuagucagaauacca

SEQ ID NO: 464151 - RNA, 22 nt, Human
aaagccaaaugaaagaugguuc

SEQ ID NO: 464152 - RNA, 20 nt, Human
gggaguggugguagccugug

SEQ ID NO: 464153 - RNA, 22 nt, Human
cugaggcuuugugugcaugccu

SEQ ID NO: 464154 - RNA, 22 nt, Human
aaaugcauaucaaagacuugaa

SEQ ID NO: 464155 - RNA, 22 nt, Human
gccucugcugacaagauggaca

SEQ ID NO: 464156 - RNA, 22 nt, Human
uuccucugaaauggcuuggaaa

SEQ ID NO: 464157 - RNA, 22 nt, Human
augaaacaaaccucuauggagu

SEQ ID NO: 464158 - RNA, 19 nt, Human
cucuggagcagacacugga

SEQ ID NO: 464159 - RNA, 22 nt, Human
caggacagaaauaaggaauaua

SEQ ID NO: 464160 - RNA, 22 nt, Human
uuagccauggacugaauugacu

SEQ ID NO: 464161 - RNA, 22 nt, Human
cugcaggggcuggaguuggcuu

SEQ ID NO: 464162 - RNA, 22 nt, Human
agggcuggcaagggauugaaau

SEQ ID NO: 464163 - RNA, 22 nt, Human
gccuggagcucuccacuugggg

SEQ ID NO: 464164 - RNA, 22 nt, Human
cccaaggcauggcaugguggca

SEQ ID NO: 464165 - RNA, 22 nt, Human
aggggcaggugcugcacuuaga

SEQ ID NO: 464166 - RNA, 22 nt, Human
ucuguacaugaguugagaauca

SEQ ID NO: 464167 - RNA, 18 nt, Human
cccagcuggugggucagu

SEQ ID NO: 464168 - RNA, 22 nt, Human
uuuucaagggcagggaaaucau

SEQ ID NO: 464169 - RNA, 22 nt, Human
accagcucagaagccagaaaga

SEQ ID NO: 464170 - RNA, 22 nt, Human
uaggcagagguaugguaaggac

SEQ ID NO: 464171 - RNA, 18 nt, Human
uguuccaaggaaggaauc

SEQ ID NO: 464172 - RNA, 22 nt, Human
aaugcagugagccauuaaaugg

SEQ ID NO: 464173 - RNA, 22 nt, Human
cugugcuugacagugggaagca

SEQ ID NO: 464174 - RNA, 20 nt, Human
acuuucucgguuucucaccu

SEQ ID NO: 464175 - RNA, 22 nt, Human
ugagaauuacaaaugagucaca

SEQ ID NO: 464176 - RNA, 22 nt, Human
aggggugaaagagggcccucaa

SEQ ID NO: 464177 - RNA, 22 nt, Human
aaugcacauguuguaauaaaua

SEQ ID NO: 464178 - RNA, 22 nt, Human
ccaggacccugcaaacccuguu

SEQ ID NO: 464179 - RNA, 22 nt, Human
gaggggcuugaggcccugaugg

SEQ ID NO: 464180 - RNA, 22 nt, Human
ucccaaggcacagggcagggac

SEQ ID NO: 464181 - RNA, 22 nt, Human
gaugcacugcaguauauacugu

SEQ ID NO: 464182 - RNA, 22 nt, Human
uccucuggauauaagccucacc

SEQ ID NO: 464183 - RNA, 22 nt, Human
ccuguguguaggccaggggagu

SEQ ID NO: 464184 - RNA, 22 nt, Human
ucugcugcacaaauucaucucu

SEQ ID NO: 464185 - RNA, 22 nt, Human
caguccugcccaggcugacaga

SEQ ID NO: 464186 - RNA, 22 nt, Human
agauguaaacucucaugucauu

SEQ ID NO: 464187 - RNA, 19 nt, Human
ugcagggcugcgccugggg

SEQ ID NO: 464188 - RNA, 22 nt, Human
ggcagggaagcuggcaucacgg

SEQ ID NO: 464189 - RNA, 22 nt, Human
gcucaaagaauauucagaauga

SEQ ID NO: 464190 - RNA, 22 nt, Human
cuguaauucacuagggucagcg

SEQ ID NO: 464191 - RNA, 22 nt, Human
cagagccccucagcucucuccc

SEQ ID NO: 464192 - RNA, 23 nt, Human
ucucugaguuguacuuucccuug

SEQ ID NO: 464193 - RNA, 22 nt, Human
aaaucaguuguuauauuaaaga

SEQ ID NO: 464194 - RNA, 22 nt, Human
acauguguggacaugaaucuac

SEQ ID NO: 464195 - RNA, 22 nt, Human
gaagcagccacggggagacaga

SEQ ID NO: 464196 - RNA, 22 nt, Human
ucucagaguaauucuuuaaggu

SEQ ID NO: 464197 - RNA, 23 nt, Human
agugcugaauugaaagcuccagg

SEQ ID NO: 464198 - RNA, 23 nt, Human
agaugaggcuucuccauguuggu

SEQ ID NO: 464199 - RNA, 22 nt, Human
caaacugagcaucagaaaguuu

SEQ ID NO: 464200 - RNA, 22 nt, Human
ggcagcaguaggagcuaaucuu

SEQ ID NO: 464201 - RNA, 22 nt, Human
cuuauucuacuccacaagcucu

SEQ ID NO: 464202 - RNA, 22 nt, Human
ccugccagggccuuggaagaaa

SEQ ID NO: 464203 - RNA, 22 nt, Human
uagcugucaccagaaauggcca

SEQ ID NO: 464204 - RNA, 22 nt, Human
gucccaggaguugcugggccuu

SEQ ID NO: 464205 - RNA, 22 nt, Human
uaaagaacacagggaauagcac

SEQ ID NO: 464206 - RNA, 22 nt, Human
gguuucaaaguggacaguuagu

SEQ ID NO: 464207 - RNA, 22 nt, Human
agguggaacguucaggugcuag

SEQ ID NO: 464208 - RNA, 22 nt, Human
auugucugaauccaaagcucug

SEQ ID NO: 464209 - RNA, 22 nt, Human
gguggcaggcccugagcauccc

SEQ ID NO: 464210 - RNA, 22 nt, Human
auguaaggcugccuaugacacu

SEQ ID NO: 464211 - RNA, 22 nt, Human
agucucugagguucagaugccu

SEQ ID NO: 464212 - RNA, 22 nt, Human
aaauauguauggaguucaugaa

SEQ ID NO: 464213 - RNA, 22 nt, Human
aagcagaaguugaucuaccaua

SEQ ID NO: 464214 - RNA, 22 nt, Human
uggagcugggguuugaaucugg

SEQ ID NO: 464215 - RNA, 22 nt, Human
aucaaaaugcuccagugauggu

SEQ ID NO: 464216 - RNA, 22 nt, Human
gaagaggaugacaggagccggu

SEQ ID NO: 464217 - RNA, 22 nt, Human
gccaccuggacagcugugcccu

SEQ ID NO: 464218 - RNA, 22 nt, Human
aagccagcauuuucccauuccu

SEQ ID NO: 464219 - RNA, 22 nt, Human
cagaaggcauagaugaaggccu

SEQ ID NO: 464220 - RNA, 21 nt, Human
acagcaagccuuccuuucagg

SEQ ID NO: 464221 - RNA, 22 nt, Human
gcugcagccaaauucauuguca

SEQ ID NO: 464222 - RNA, 22 nt, Human
cucaggggaccuggcuccgagu

SEQ ID NO: 464223 - RNA, 22 nt, Human
aucaggauggguuuggcuuagg

SEQ ID NO: 464224 - RNA, 22 nt, Human
ugaaccagagucuccagugguu

SEQ ID NO: 464225 - RNA, 22 nt, Human
aagaggaagucuccauggagag

SEQ ID NO: 464226 - RNA, 22 nt, Human
gcuguacaaggccucugccauc

SEQ ID NO: 464227 - RNA, 22 nt, Human
ucucucagucagaugcuaaaga

SEQ ID NO: 464228 - RNA, 22 nt, Human
auuucacucauucauguuacuu

SEQ ID NO: 464229 - RNA, 21 nt, Human
gaguggaacgcucuucacacc

SEQ ID NO: 464230 - RNA, 22 nt, Human
aggcugggaaauguagucuucc

SEQ ID NO: 464231 - RNA, 22 nt, Human
gcagaggagugauuaugccgug

SEQ ID NO: 464232 - RNA, 22 nt, Human
agaauucucuuccauugaaaca

SEQ ID NO: 464233 - RNA, 22 nt, Human
cccaggcaggagugugguggcu

SEQ ID NO: 464234 - RNA, 22 nt, Human
ggagccuguggcugcuugaagc

SEQ ID NO: 464235 - RNA, 22 nt, Human
agauuuagacugccuuaaucau

SEQ ID NO: 464236 - RNA, 22 nt, Human
caaaaacugcaauuacuuuuac

SEQ ID NO: 464237 - RNA, 22 nt, Human
caagagcuagacuuugucagga

SEQ ID NO: 464238 - RNA, 22 nt, Human
cugggagucuggccucuggucc

SEQ ID NO: 464239 - RNA, 22 nt, Human
gcugagugagguccagagcuug

SEQ ID NO: 464240 - RNA, 22 nt, Human
gcugggcugagcuagacuuggc

SEQ ID NO: 464241 - RNA, 22 nt, Human
ucucucagggggaaggcugaag

SEQ ID NO: 464242 - RNA, 22 nt, Human
ucagaguguuuuacuaaacaag

SEQ ID NO: 464243 - RNA, 22 nt, Human
cccagcuugcaaauggguugcu

SEQ ID NO: 464244 - RNA, 22 nt, Human
uugugucccccuuugagagcca

SEQ ID NO: 464245 - RNA, 22 nt, Human
ugggcugccagcucuccagaug

SEQ ID NO: 464246 - RNA, 22 nt, Human
aagggcugcuguagaagcagag

SEQ ID NO: 464247 - RNA, 22 nt, Human
ccuggccugcucggcucuuaag

SEQ ID NO: 464248 - RNA, 22 nt, Human
uggcugagcucccuguguguug

SEQ ID NO: 464249 - RNA, 17 nt, Human
uccuggcucugccacug

SEQ ID NO: 464250 - RNA, 22 nt, Human
agaauuagaggccauguacuug

SEQ ID NO: 464251 - RNA, 22 nt, Human
ucauguuuuaguaaagugaagg

SEQ ID NO: 464252 - RNA, 22 nt, Human
cuggagcuccagggucuccucu

SEQ ID NO: 464253 - RNA, 22 nt, Human
uaagcuauuccugaagaagguu

SEQ ID NO: 464254 - RNA, 18 nt, Human
agcugcagaccaggaggu

SEQ ID NO: 464255 - RNA, 22 nt, Human
ugggcagaggcagcagaaaccu

SEQ ID NO: 464256 - RNA, 22 nt, Human
gacagggaggagcagagcuucu

SEQ ID NO: 464257 - RNA, 22 nt, Human
aggucauuccuugucuucuugc

SEQ ID NO: 464258 - RNA, 22 nt, Human
uuuuuccuagugcuuucuggua

SEQ ID NO: 464259 - RNA, 22 nt, Human
gaggggcuggcuguggucccau

SEQ ID NO: 464260 - RNA, 22 nt, Human
caaaguauauuggauugaaugg

SEQ ID NO: 464261 - RNA, 19 nt, Human
agacucugugugagacuuu

SEQ ID NO: 464262 - RNA, 22 nt, Human
caagcuggaguuccucagagug

SEQ ID NO: 464263 - RNA, 22 nt, Human
uuuuccuacugauaaacaguua

SEQ ID NO: 464264 - RNA, 22 nt, Human
cagcuggcccuuugguagccuu

SEQ ID NO: 464265 - RNA, 22 nt, Human
ugggagcccaagggagcugccg

SEQ ID NO: 464266 - RNA, 22 nt, Human
gcugggcagccuggccgcugcc

SEQ ID NO: 464267 - RNA, 22 nt, Human
ggggaugguagaccggugacgu

SEQ ID NO: 464268 - RNA, 22 nt, Human
uggcagcagggccccuggagga

SEQ ID NO: 464269 - RNA, 22 nt, Human
cagagagaggccacugcuauua

SEQ ID NO: 464270 - RNA, 22 nt, Human
caggaaccuaaagagacauuac

SEQ ID NO: 464271 - RNA, 22 nt, Human
caacauauaauauuugaguucu

SEQ ID NO: 464272 - RNA, 22 nt, Human
uguguacacaaugauugcagag

SEQ ID NO: 464273 - RNA, 22 nt, Human
aaucaguuagaaggaagagaau

SEQ ID NO: 464274 - RNA, 22 nt, Human
cugcaggauucucccaguugga

SEQ ID NO: 464275 - RNA, 22 nt, Human
gggcaagcucuucagaagcucu

SEQ ID NO: 464276 - RNA, 22 nt, Human
gcacccaggcuugggcagcaac

SEQ ID NO: 464277 - RNA, 22 nt, Human
uagagcugcuggacuguaacag

SEQ ID NO: 464278 - RNA, 22 nt, Human
aaauacagauuccagggucuua

SEQ ID NO: 464279 - RNA, 21 nt, Human
uuagcuuucuagaaucuuugu

SEQ ID NO: 464280 - RNA, 22 nt, Human
aaacucuuccuuucuuuaaagu

SEQ ID NO: 464281 - RNA, 20 nt, Human
aacagggggcugcagagggc

SEQ ID NO: 464282 - RNA, 22 nt, Human
guaggaaagggagugaagggaa

SEQ ID NO: 464283 - RNA, 22 nt, Human
cccaggaggcagagguugcagu

SEQ ID NO: 464284 - RNA, 22 nt, Human
augcacagcagugaguucagug

SEQ ID NO: 464285 - RNA, 22 nt, Human
ccucccuuggccauagccagcc

SEQ ID NO: 464286 - RNA, 22 nt, Human
uccuucagcuacucaguuucca

SEQ ID NO: 464287 - RNA, 22 nt, Human
ugcuggcccaugaagacgcagu

SEQ ID NO: 464288 - RNA, 22 nt, Human
uucugcagcccaacaguaguuu

SEQ ID NO: 464289 - RNA, 22 nt, Human
gagggggcgugcaaggcuccgc

SEQ ID NO: 464290 - RNA, 22 nt, Human
acaguggaugugauguccaggu

SEQ ID NO: 464291 - RNA, 20 nt, Human
ccucaggaugagggugagca

SEQ ID NO: 464292 - RNA, 22 nt, Human
ucagccuuguggcccugcucca

SEQ ID NO: 464293 - RNA, 22 nt, Human
guccugggcccaggggcugccu

SEQ ID NO: 464294 - RNA, 22 nt, Human
ccacuguuuuucaguuaacuuu

SEQ ID NO: 464295 - RNA, 22 nt, Human
ccugcagguaaggcuaacugcc

SEQ ID NO: 464296 - RNA, 21 nt, Human
gguugguguguccaguggcca

SEQ ID NO: 464297 - RNA, 22 nt, Human
ugggcagacgcuguuggaaggc

SEQ ID NO: 464298 - RNA, 22 nt, Human
acuguguccuauuuccuugaca

SEQ ID NO: 464299 - RNA, 21 nt, Human
agcugagcccagaagacuggu

SEQ ID NO: 464300 - RNA, 22 nt, Human
ggagaugcuuuccaguggggau

SEQ ID NO: 464301 - RNA, 23 nt, Human
gggaccugguaggaggugauugg

SEQ ID NO: 464302 - RNA, 22 nt, Human
cagcccugagagaaccaucuau

SEQ ID NO: 464303 - RNA, 22 nt, Human
ccacucugauuuuggcuccacu

SEQ ID NO: 464304 - RNA, 22 nt, Human
aggcugaggcgggaggaucacu

SEQ ID NO: 464305 - RNA, 22 nt, Human
agggcacccucucugcaguacc

SEQ ID NO: 464306 - RNA, 22 nt, Human
ggccagcagucacagggucaga

SEQ ID NO: 464307 - RNA, 22 nt, Human
ucuuuccagaggaauuuuuaga

SEQ ID NO: 464308 - RNA, 22 nt, Human
guggccugggguuuguucugag

SEQ ID NO: 464309 - RNA, 22 nt, Human
acccagccacagcauugaggga

SEQ ID NO: 464310 - RNA, 23 nt, Human
ccagcuccgugagccucgggcuc

SEQ ID NO: 464311 - RNA, 22 nt, Human
caaaugcaggucagcagguguc

SEQ ID NO: 464312 - RNA, 20 nt, Human
caccacagaauuggggacag

SEQ ID NO: 464313 - RNA, 22 nt, Human
guggcagagguuccucagugug

SEQ ID NO: 464314 - RNA, 22 nt, Human
aagcacaaugaacaucuuagau

SEQ ID NO: 464315 - RNA, 22 nt, Human
agacagggucuugaucagagcu

SEQ ID NO: 464316 - RNA, 22 nt, Human
uguaauggaagugggauugcau

SEQ ID NO: 464317 - RNA, 22 nt, Human
gcuguauuuauuuucuaggguu

SEQ ID NO: 464318 - RNA, 22 nt, Human
ucugcaucauuuuucagagccg

SEQ ID NO: 464319 - RNA, 22 nt, Human
cgcuggccauagccuccugugu

SEQ ID NO: 464320 - RNA, 22 nt, Human
caucaucaaaagugacagagaa

SEQ ID NO: 464321 - RNA, 22 nt, Human
ccagggagccuggugugucagc

SEQ ID NO: 464322 - RNA, 22 nt, Human
agcaucuggucaugagugagaa

SEQ ID NO: 464323 - RNA, 22 nt, Human
ggccagagagccgcuguuagga

SEQ ID NO: 464324 - RNA, 22 nt, Human
cauggacucugguuuggggagc

SEQ ID NO: 464325 - RNA, 22 nt, Human
agggcagaccacgugcaaggau

SEQ ID NO: 464326 - RNA, 20 nt, Human
agauggugaaggccagggag

SEQ ID NO: 464327 - RNA, 22 nt, Human
agaaaugugagccccuuaucaa

SEQ ID NO: 464328 - RNA, 20 nt, Human
ucauugcacauaauggaagc

SEQ ID NO: 464329 - RNA, 22 nt, Human
cuuucauuugauaagaaugcca

SEQ ID NO: 464330 - RNA, 22 nt, Human
cuggccuggucuggccucucca

SEQ ID NO: 464331 - RNA, 22 nt, Human
uccuugaaaggggcugcagggc

SEQ ID NO: 464332 - RNA, 23 nt, Human
ggcacugaagcuacaauggugag

SEQ ID NO: 464333 - RNA, 22 nt, Human
ugggcacuggaagccugcugug

SEQ ID NO: 464334 - RNA, 22 nt, Human
augcuuuacaguuuuccaaaca

SEQ ID NO: 464335 - RNA, 22 nt, Human
gcccaggauucuuucuuccuua

SEQ ID NO: 464336 - RNA, 22 nt, Human
caaggccacuccagagacuggu

SEQ ID NO: 464337 - RNA, 22 nt, Human
uucuugcucaaugucuguuuaa

SEQ ID NO: 464338 - RNA, 22 nt, Human
caagggcucuuuugaggaaugu

SEQ ID NO: 464339 - RNA, 22 nt, Human
acuguacauguaaacauuguca

SEQ ID NO: 464340 - RNA, 22 nt, Human
uggcugagggcacuaugaagcc

SEQ ID NO: 464341 - RNA, 22 nt, Human
agaguguaauaagggcaagggc

SEQ ID NO: 464342 - RNA, 20 nt, Human
aaucagaaagugugagcucu

SEQ ID NO: 464343 - RNA, 22 nt, Human
agccuccaguagcugaagagac

SEQ ID NO: 464344 - RNA, 22 nt, Human
gcaggaugccagggcagcagcg

SEQ ID NO: 464345 - RNA, 20 nt, Human
ccugucuccucuuaccuggc

SEQ ID NO: 464346 - RNA, 22 nt, Human
caccugcaaggagcuuucauuu

SEQ ID NO: 464347 - RNA, 22 nt, Human
gggacccugggaggcuggcgca

SEQ ID NO: 464348 - RNA, 22 nt, Human
gugugcaggccacaggccaggg

SEQ ID NO: 464349 - RNA, 22 nt, Human
guuauuagaagugaaggauugu

SEQ ID NO: 464350 - RNA, 22 nt, Human
aaaaucugcuuccuuuuacaga

SEQ ID NO: 464351 - RNA, 22 nt, Human
ucagaggagaugguuaccaggg

SEQ ID NO: 464352 - RNA, 22 nt, Human
cccagcucucucaguucugcuu

SEQ ID NO: 464353 - RNA, 22 nt, Human
uacauguaagacaugagacucu

SEQ ID NO: 464354 - RNA, 23 nt, Human
uggcucagcuaguuuuccauuuc

SEQ ID NO: 464355 - RNA, 22 nt, Human
uggggaggacgggcgccuuccu

SEQ ID NO: 464356 - RNA, 22 nt, Human
uaaggcaccuguccaggcuggg

SEQ ID NO: 464357 - RNA, 22 nt, Human
agauggggcagaauggagccau

SEQ ID NO: 464358 - RNA, 22 nt, Human
ggacuucuaagugccagacacu

SEQ ID NO: 464359 - RNA, 23 nt, Human
agcacagacuagaaaggucuuuc

SEQ ID NO: 464360 - RNA, 22 nt, Human
cugggccagucucggccgcucu

SEQ ID NO: 464361 - RNA, 22 nt, Human
uccuggaggcaaaugaagacuc

SEQ ID NO: 464362 - RNA, 22 nt, Human
ggccccuggcaccaggcugauu

SEQ ID NO: 464363 - RNA, 22 nt, Human
ucuccucaccaccagcagcaga

SEQ ID NO: 464364 - RNA, 22 nt, Human
acguggagagaauagggcacca

SEQ ID NO: 464365 - RNA, 22 nt, Human
ugggugcuucgucagcucugag

SEQ ID NO: 464366 - RNA, 22 nt, Human
auccuugaacuuagacacuagg

SEQ ID NO: 464367 - RNA, 22 nt, Human
cagaggaggccaccgcauaggc

SEQ ID NO: 464368 - RNA, 22 nt, Human
cucccaagauaaauaaggcagu

SEQ ID NO: 464369 - RNA, 22 nt, Human
ucuuagaaaugaaguucuuucu

SEQ ID NO: 464370 - RNA, 22 nt, Human
uugaagaggacuuugcagcugu

SEQ ID NO: 464371 - RNA, 22 nt, Human
acaguggauauauuaaaugaga

SEQ ID NO: 464372 - RNA, 22 nt, Human
ucugggagacguguguugucag

SEQ ID NO: 464373 - RNA, 22 nt, Human
cccuggaggcaaagguugcagu

SEQ ID NO: 464374 - RNA, 22 nt, Human
cucugagcugaaacaugagcau

SEQ ID NO: 464375 - RNA, 22 nt, Human
ucacagaauagcacuguaagcg

SEQ ID NO: 464376 - RNA, 22 nt, Human
ugcagugguguccagguguacu

SEQ ID NO: 464377 - RNA, 22 nt, Human
aggcccagggcugcucucugaa

SEQ ID NO: 464378 - RNA, 22 nt, Human
guacaguuuucaguguucacug

SEQ ID NO: 464379 - RNA, 22 nt, Human
acauuuuuauucaucaaagcag

SEQ ID NO: 464380 - RNA, 22 nt, Human
ugaggcagggaguuuaauuguc

SEQ ID NO: 464381 - RNA, 23 nt, Human
ccaaagucgaagucuaguccaga

SEQ ID NO: 464382 - RNA, 22 nt, Human
acauuucugagcagggagcugu

SEQ ID NO: 464383 - RNA, 22 nt, Human
aaggcacuuuuccugagaugau

SEQ ID NO: 464384 - RNA, 17 nt, Human
aguguuuccuuaucauu

SEQ ID NO: 464385 - RNA, 22 nt, Human
uccucaggugacuagguaucuu

SEQ ID NO: 464386 - RNA, 22 nt, Human
guccucugggagccuugagccu

SEQ ID NO: 464387 - RNA, 22 nt, Human
ugaagcaacuggacaaguuggc

SEQ ID NO: 464388 - RNA, 22 nt, Human
ugggacuuguguggcaguauuu

SEQ ID NO: 464389 - RNA, 22 nt, Human
ggcucuggugggaagguuagau

SEQ ID NO: 464390 - RNA, 22 nt, Human
gcuggcaucacuggcuucggug

SEQ ID NO: 464391 - RNA, 22 nt, Human
ugcagaaggccugacauugcac

SEQ ID NO: 464392 - RNA, 22 nt, Human
agucucugcaugaugcagcaca

SEQ ID NO: 464393 - RNA, 22 nt, Human
augggcugugagguccggcagg

SEQ ID NO: 464394 - RNA, 22 nt, Human
agccagugaugaagacucugga

SEQ ID NO: 464395 - RNA, 19 nt, Human
accucugcagagauguuua

SEQ ID NO: 464396 - RNA, 22 nt, Human
ggguccagacacuccagaggaa

SEQ ID NO: 464397 - RNA, 22 nt, Human
gaggcucagagggacuuucaag

SEQ ID NO: 464398 - RNA, 19 nt, Human
aauuagggagucgguuaag

SEQ ID NO: 464399 - RNA, 22 nt, Human
cuuccugguuugaagcucgccg

SEQ ID NO: 464400 - RNA, 22 nt, Human
uggucucugacucugaagaccc

SEQ ID NO: 464401 - RNA, 19 nt, Human
ucaggcaguuauucacaaa

SEQ ID NO: 464402 - RNA, 21 nt, Human
ucucuacacuuucacuaggcu

SEQ ID NO: 464403 - RNA, 22 nt, Human
uuccuguaguugugcaauguac

SEQ ID NO: 464404 - RNA, 22 nt, Human
caggauggucuucauuuggcuc

SEQ ID NO: 464405 - RNA, 22 nt, Human
agauuuagugguggaauuuugg

SEQ ID NO: 464406 - RNA, 19 nt, Human
cccagcuugaccaccugcu

SEQ ID NO: 464407 - RNA, 22 nt, Human
cccaggcagugugugcaugcgu

SEQ ID NO: 464408 - RNA, 22 nt, Human
ccccaccugugcgucugccgca

SEQ ID NO: 464409 - RNA, 22 nt, Human
uuuccucuccaccaggaggucu

SEQ ID NO: 464410 - RNA, 22 nt, Human
agcucccauuaucuucugaaac

SEQ ID NO: 464411 - RNA, 22 nt, Human
ugcugucaguuggcaggaugag

SEQ ID NO: 464412 - RNA, 22 nt, Human
gaggaaaagagacagguuauug

SEQ ID NO: 464413 - RNA, 22 nt, Human
uaaggccaauuacauauguuca

SEQ ID NO: 464414 - RNA, 22 nt, Human
uccagucaucucccuucacauu

SEQ ID NO: 464415 - RNA, 22 nt, Human
aggugucugugaugggagcgau

SEQ ID NO: 464416 - RNA, 17 nt, Human
ggccuuggggccucagu

SEQ ID NO: 464417 - RNA, 22 nt, Human
acaguccuguacaggccauauc

SEQ ID NO: 464418 - RNA, 22 nt, Human
caggacaguuugcuuugcccug

SEQ ID NO: 464419 - RNA, 19 nt, Human
gcaggcaguggcauucgga

SEQ ID NO: 464420 - RNA, 21 nt, Human
agcugccacccuagcuucuga

SEQ ID NO: 464421 - RNA, 22 nt, Human
uucuuugaguuaguacagucca

SEQ ID NO: 464422 - RNA, 22 nt, Human
gcccugucccuuggcuucuagg

SEQ ID NO: 464423 - RNA, 22 nt, Human
agucaauucuuuucaacucaag

SEQ ID NO: 464424 - RNA, 22 nt, Human
gcagggacaacugugcaccuga

SEQ ID NO: 464425 - RNA, 22 nt, Human
ugccagugggugugcagagacu

SEQ ID NO: 464426 - RNA, 22 nt, Human
ggaagaggcucucauugagggc

SEQ ID NO: 464427 - RNA, 22 nt, Human
cuuucaaaacgcucuguaugca

SEQ ID NO: 464428 - RNA, 23 nt, Human
auggagcugguacuagcuaccuc

SEQ ID NO: 464429 - RNA, 22 nt, Human
auguacaaaaugccacugaauu

SEQ ID NO: 464430 - RNA, 22 nt, Human
cuuacauuaaguaagagauuga

SEQ ID NO: 464431 - RNA, 21 nt, Human
ucagaacaauuccaugccucc

SEQ ID NO: 464432 - RNA, 22 nt, Human
ugcagcugguuuagaacuagau

SEQ ID NO: 464433 - RNA, 22 nt, Human
ccccaccagcacccucucuauc

SEQ ID NO: 464434 - RNA, 22 nt, Human
aguugaaauuagaguccuggcu

SEQ ID NO: 464435 - RNA, 23 nt, Human
agagcuuagggaauucacaugag

SEQ ID NO: 464436 - RNA, 22 nt, Human
aagugccugaccuagccuggag

SEQ ID NO: 464437 - RNA, 22 nt, Human
acagacagggcaccugccuccu

SEQ ID NO: 464438 - RNA, 22 nt, Human
cuauuagguaugugguugcuau

SEQ ID NO: 464439 - RNA, 22 nt, Human
uaccugcaaaguuccuuuugcc

SEQ ID NO: 464440 - RNA, 21 nt, Human
aggcucagagagaaacucuug

SEQ ID NO: 464441 - RNA, 22 nt, Human
aaacuucagugaaugacuuaug

SEQ ID NO: 464442 - RNA, 22 nt, Human
gcugccugaucauacaccaggg

SEQ ID NO: 464443 - RNA, 22 nt, Human
ugggagagugcucaaugugcaa

SEQ ID NO: 464444 - RNA, 22 nt, Human
aggcagugugggccaagcuucc

SEQ ID NO: 464445 - RNA, 22 nt, Human
ucauuuguucaucugcucuucu

SEQ ID NO: 464446 - RNA, 22 nt, Human
gagaaggcuggucuuaagucga

SEQ ID NO: 464447 - RNA, 22 nt, Human
uacaaaugaaccaacuuugaug

SEQ ID NO: 464448 - RNA, 22 nt, Human
cuggaguguaaagagcauagaa

SEQ ID NO: 464449 - RNA, 22 nt, Human
auguccaggaucuauccccaga

SEQ ID NO: 464450 - RNA, 22 nt, Human
ucuauuucgcauauaaguuuug

SEQ ID NO: 464451 - RNA, 22 nt, Human
gcuggccauagaagccaaagag

SEQ ID NO: 464452 - RNA, 22 nt, Human
uggcccugcuaugauccugcaa

SEQ ID NO: 464453 - RNA, 22 nt, Human
ugccaggcagugucagauugag

SEQ ID NO: 464454 - RNA, 22 nt, Human
cugucaggggcggguggagcgg

SEQ ID NO: 464455 - RNA, 22 nt, Human
cagguggggcgcccucaggcag

SEQ ID NO: 464456 - RNA, 18 nt, Human
ugcuuuaugcuuauauaa

SEQ ID NO: 464457 - RNA, 22 nt, Human
gcagguguggaguggggugagc

SEQ ID NO: 464458 - RNA, 22 nt, Human
aggccugagccccagguuuguu

SEQ ID NO: 464459 - RNA, 22 nt, Human
cuucuuuaauguauacaaaaga

SEQ ID NO: 464460 - RNA, 22 nt, Human
gggagggacacaaagaguuccc

SEQ ID NO: 464461 - RNA, 22 nt, Human
agaauaaacugcuuuagggcag

SEQ ID NO: 464462 - RNA, 22 nt, Human
agucaggauaugccuugugggc

SEQ ID NO: 464463 - RNA, 22 nt, Human
acacagggcggaaagcaugaga

SEQ ID NO: 464464 - RNA, 22 nt, Human
cuuuggcaugguccucacuaua

SEQ ID NO: 464465 - RNA, 22 nt, Human
cagagcagaaaccugggugauu

SEQ ID NO: 464466 - RNA, 21 nt, Human
agcagaacagucgagcacugc

SEQ ID NO: 464467 - RNA, 22 nt, Human
gguccccguggaggcuggagcg

SEQ ID NO: 464468 - RNA, 22 nt, Human
gcauuuaaauuugaacuucaga

SEQ ID NO: 464469 - RNA, 22 nt, Human
aucagcaaggcaaucacugcag

SEQ ID NO: 464470 - RNA, 22 nt, Human
gcacagggcccugugcguaggu

SEQ ID NO: 464471 - RNA, 22 nt, Human
cuccagggaugagacagaguag

SEQ ID NO: 464472 - RNA, 21 nt, Human
aucuuuauuacgcagagaaga

SEQ ID NO: 464473 - RNA, 22 nt, Human
uggguggcggccugguucugag

SEQ ID NO: 464474 - RNA, 22 nt, Human
uugucuguaaagacggccacca

SEQ ID NO: 464475 - RNA, 22 nt, Human
cucaggaggaugacugccuugg

SEQ ID NO: 464476 - RNA, 22 nt, Human
ugccaggccacguagcuucaag

SEQ ID NO: 464477 - RNA, 19 nt, Human
agggcuaggcacauagggc

SEQ ID NO: 464478 - RNA, 20 nt, Human
guccugggagccacagcaca

SEQ ID NO: 464479 - RNA, 22 nt, Human
ggcuccuggggaggugagcuug

SEQ ID NO: 464480 - RNA, 22 nt, Human
gagagcugggggacuguggaug

SEQ ID NO: 464481 - RNA, 20 nt, Human
aggcucagauacccagggaa

SEQ ID NO: 464482 - RNA, 21 nt, Human
uucagcaguccucuagagaua

SEQ ID NO: 464483 - RNA, 21 nt, Human
ugcugccauagaccugaggga

SEQ ID NO: 464484 - RNA, 22 nt, Human
cuuucacauaauugaccuugaa

SEQ ID NO: 464485 - RNA, 17 nt, Human
acucaggaucugggagu

SEQ ID NO: 464486 - RNA, 22 nt, Human
uauuucuuguuauucucguuga

SEQ ID NO: 464487 - RNA, 22 nt, Human
agguaggguuaauggagauaua

SEQ ID NO: 464488 - RNA, 22 nt, Human
aguuucuaacauauagcauugg

SEQ ID NO: 464489 - RNA, 22 nt, Human
uuccagaaaucuuucagcucaa

SEQ ID NO: 464490 - RNA, 22 nt, Human
ucagaagaagagacuccacagc

SEQ ID NO: 464491 - RNA, 22 nt, Human
caguggcacccacgggcugggc

SEQ ID NO: 464492 - RNA, 23 nt, Human
cccagcagauuguaaagugucca

SEQ ID NO: 464493 - RNA, 22 nt, Human
uauguguuugacacccugcaag

SEQ ID NO: 464494 - RNA, 22 nt, Human
gugguaauagagcuccaaacua

SEQ ID NO: 464495 - RNA, 22 nt, Human
ggcugcuggggacgugggagag

SEQ ID NO: 464496 - RNA, 22 nt, Human
acaggcuucucacagaaaaggg

SEQ ID NO: 464497 - RNA, 22 nt, Human
ggcucugcaugugagugggugg

SEQ ID NO: 464498 - RNA, 22 nt, Human
aaucaguucuacaucuuaucca

SEQ ID NO: 464499 - RNA, 18 nt, Human
accugccuguucuucucu

SEQ ID NO: 464500 - RNA, 16 nt, Human
gcaggcagaucacaug

SEQ ID NO: 464501 - RNA, 22 nt, Human
gugcuucucuucacacccaacu

SEQ ID NO: 464502 - RNA, 22 nt, Human
ccuggcugcauuuugcuggaug

SEQ ID NO: 464503 - RNA, 17 nt, Human
aguggcaggcagauggg

SEQ ID NO: 464504 - RNA, 22 nt, Human
uguagaaagcucuucugaaauc

SEQ ID NO: 464505 - RNA, 22 nt, Human
ugcuuuauaggggauugcaggc

SEQ ID NO: 464506 - RNA, 22 nt, Human
ggcugaggcucaugccaucuug

SEQ ID NO: 464507 - RNA, 22 nt, Human
guggcugcuguccucucugguu

SEQ ID NO: 464508 - RNA, 22 nt, Human
agggauggaagcucgucugcaa

SEQ ID NO: 464509 - RNA, 22 nt, Human
ggaugcugcuaucaggcuucga

SEQ ID NO: 464510 - RNA, 22 nt, Human
guggauggacaugggcaagagg

SEQ ID NO: 464511 - RNA, 22 nt, Human
uuuuagaaauacugauuuagug

SEQ ID NO: 464512 - RNA, 22 nt, Human
ucaggcugcagcugucagcagc

SEQ ID NO: 464513 - RNA, 22 nt, Human
uucucuuauucuggauaugcag

SEQ ID NO: 464514 - RNA, 22 nt, Human
aacaaaugauuguugguuggag

SEQ ID NO: 464515 - RNA, 22 nt, Human
cacaccagagguuaccugcaaa

SEQ ID NO: 464516 - RNA, 22 nt, Human
uaaguucauaagcuuauucuua

SEQ ID NO: 464517 - RNA, 19 nt, Human
uguggccaugguucagcug

SEQ ID NO: 464518 - RNA, 22 nt, Human
uguuugaauuuugcuaacgugu

SEQ ID NO: 464519 - RNA, 22 nt, Human
uccugggcccaggcugccaggg

SEQ ID NO: 464520 - RNA, 22 nt, Human
cuggaaugagcagggcuuaugg

SEQ ID NO: 464521 - RNA, 22 nt, Human
uggccuggaagagaggucgagg

SEQ ID NO: 464522 - RNA, 22 nt, Human
cauuuguaucugggcugcugug

SEQ ID NO: 464523 - RNA, 22 nt, Human
ucccagggcacucacccucccu

SEQ ID NO: 464524 - RNA, 20 nt, Human
uauaacaguguugggugugu

SEQ ID NO: 464525 - RNA, 22 nt, Human
auucacagggacaaugggagag

SEQ ID NO: 464526 - RNA, 22 nt, Human
ggugaguugggguucacagguc

SEQ ID NO: 464527 - RNA, 18 nt, Human
gguggccuugacuucucu

SEQ ID NO: 464528 - RNA, 22 nt, Human
agcaggaaggucugugugaguc

SEQ ID NO: 464529 - RNA, 22 nt, Human
uagagcuggccgggacagcugg

SEQ ID NO: 464530 - RNA, 22 nt, Human
acucaggaaaugaagacugguu

SEQ ID NO: 464531 - RNA, 22 nt, Human
ccucauggaccucagacugucc

SEQ ID NO: 464532 - RNA, 22 nt, Human
acuuucucccacccacccgucu

SEQ ID NO: 464533 - RNA, 22 nt, Human
gcuucccacagcuggacugggg

SEQ ID NO: 464534 - RNA, 22 nt, Human
gaggaagaagcaaaccagcuaa

SEQ ID NO: 464535 - RNA, 22 nt, Human
gcugugcagguccccacugccu

SEQ ID NO: 464536 - RNA, 22 nt, Human
gagagcugcagccgagaggggg

SEQ ID NO: 464537 - RNA, 22 nt, Human
cagaaugcaaauuuuauaauau

SEQ ID NO: 464538 - RNA, 22 nt, Human
aaguaacaaugcuguugaauug

SEQ ID NO: 464539 - RNA, 22 nt, Human
cuggagccuucaccaggggaaa

SEQ ID NO: 464540 - RNA, 22 nt, Human
cucagagagggcaccagggcca

SEQ ID NO: 464541 - RNA, 22 nt, Human
agaaaucagaacccugaaguuc

SEQ ID NO: 464542 - RNA, 22 nt, Human
ugcaccugagaggucucugagg

SEQ ID NO: 464543 - RNA, 22 nt, Human
acaaaggcagagaauucaacau

SEQ ID NO: 464544 - RNA, 22 nt, Human
ugaggaugacgauggcaauggc

SEQ ID NO: 464545 - RNA, 22 nt, Human
cauggccugccuccuccuggug

SEQ ID NO: 464546 - RNA, 22 nt, Human
ugagcuggucuugaguguagcu

SEQ ID NO: 464547 - RNA, 22 nt, Human
caaggaaaaagcgagcucgggg

SEQ ID NO: 464548 - RNA, 22 nt, Human
acagggcagguggcuacugguc

SEQ ID NO: 464549 - RNA, 22 nt, Human
ucugaacagaaaagaugcacaa

SEQ ID NO: 464550 - RNA, 22 nt, Human
ugcugucugcaacaguacuaca

SEQ ID NO: 464551 - RNA, 22 nt, Human
aaggaggagcggaggcuuguug

SEQ ID NO: 464552 - RNA, 22 nt, Human
ugggccuggcccuguggaggag

SEQ ID NO: 464553 - RNA, 20 nt, Human
uaucaaucagaaagaagacu

SEQ ID NO: 464554 - RNA, 22 nt, Human
cggggcugcgcucuuccugccg

SEQ ID NO: 464555 - RNA, 22 nt, Human
gaauucugguccuguccaaggu

SEQ ID NO: 464556 - RNA, 18 nt, Human
cuguccaguagacucugc

SEQ ID NO: 464557 - RNA, 22 nt, Human
agggacccauagagagaccagu

SEQ ID NO: 464558 - RNA, 22 nt, Human
acauuaucccuggcacaacugc

SEQ ID NO: 464559 - RNA, 22 nt, Human
cuuaauuuaaaauaguucaggc

SEQ ID NO: 464560 - RNA, 22 nt, Human
uaucuuuaacuugcaguauuua

SEQ ID NO: 464561 - RNA, 22 nt, Human
gaccaaggaagaggggagccag

SEQ ID NO: 464562 - RNA, 18 nt, Human
acagggagggcgcugggg

SEQ ID NO: 464563 - RNA, 22 nt, Human
cagauuuagaguggggcuugga

SEQ ID NO: 464564 - RNA, 22 nt, Human
ggcagauggagaagcagcaggu

SEQ ID NO: 464565 - RNA, 22 nt, Human
cuuccaaagcacuuuauggacc

SEQ ID NO: 464566 - RNA, 22 nt, Human
agguggggugagcugcagacua

SEQ ID NO: 464567 - RNA, 22 nt, Human
aggacaguccgggguccuccac

SEQ ID NO: 464568 - RNA, 23 nt, Human
ucccuggaggcagguccagggcc

SEQ ID NO: 464569 - RNA, 22 nt, Human
aguccuucaagaaaucuggaaa

SEQ ID NO: 464570 - RNA, 19 nt, Human
ugucucugaaagaugagcu

SEQ ID NO: 464571 - RNA, 22 nt, Human
aucacgucaugguuugaucugg

SEQ ID NO: 464572 - RNA, 21 nt, Human
cagaggggcuagccuggcugc

SEQ ID NO: 464573 - RNA, 22 nt, Human
cagcuucuucaguccuggagcu

SEQ ID NO: 464574 - RNA, 22 nt, Human
cucugcagaauuugagcugcuc

SEQ ID NO: 464575 - RNA, 22 nt, Human
aaguucaaucagaugaaaaagc

SEQ ID NO: 464576 - RNA, 22 nt, Human
ugcagaggaccauuguccugga

SEQ ID NO: 464577 - RNA, 22 nt, Human
acugagcugugacaaugcuuaa

SEQ ID NO: 464578 - RNA, 22 nt, Human
cagggcucgcugccagcuucag

SEQ ID NO: 464579 - RNA, 22 nt, Human
uucaaaggcaggauagcagcug

SEQ ID NO: 464580 - RNA, 22 nt, Human
uauccaaaguggcauauuauag

SEQ ID NO: 464581 - RNA, 22 nt, Human
ugggccuggacaaggccacuag

SEQ ID NO: 464582 - RNA, 22 nt, Human
uacagucuuuggaaagagauag

SEQ ID NO: 464583 - RNA, 22 nt, Human
uauccaauucaccauugauggg

SEQ ID NO: 464584 - RNA, 21 nt, Human
agaggccuuacaggauagacc

SEQ ID NO: 464585 - RNA, 22 nt, Human
aauguacaauaagacaaagagg

SEQ ID NO: 464586 - RNA, 22 nt, Human
uuuggaaaguugucacuuuaga

SEQ ID NO: 464587 - RNA, 22 nt, Human
cuacaggucaguaagaccuaga

SEQ ID NO: 464588 - RNA, 22 nt, Human
gaaguggaagccaucggcaguc

SEQ ID NO: 464589 - RNA, 22 nt, Human
aggcacuggguaauuaguagcu

SEQ ID NO: 464590 - RNA, 22 nt, Human
ucugccugaaauucacauguaa

SEQ ID NO: 464591 - RNA, 22 nt, Human
ugauuuccaguugcugggugcu

SEQ ID NO: 464592 - RNA, 22 nt, Human
caggaugggauguagugggccc

SEQ ID NO: 464593 - RNA, 22 nt, Human
cagggcucccuugcaaggaggg

SEQ ID NO: 464594 - RNA, 22 nt, Human
cccagccagccucuucccauau

SEQ ID NO: 464595 - RNA, 22 nt, Human
caggcugagcucuggccugggc

SEQ ID NO: 464596 - RNA, 22 nt, Human
auuuugaaaagcauuugaguaa

SEQ ID NO: 464597 - RNA, 23 nt, Human
gcucugagggcuuaucccuccca

SEQ ID NO: 464598 - RNA, 22 nt, Human
aagcccagcaucccugcaccag

SEQ ID NO: 464599 - RNA, 22 nt, Human
cuccagggaggagcacggguuc

SEQ ID NO: 464600 - RNA, 22 nt, Human
uggcccugcugggucagagcug

SEQ ID NO: 464601 - RNA, 23 nt, Human
gacagagugagaccuugucuuac

SEQ ID NO: 464602 - RNA, 22 nt, Human
agcagaugagccucaugacugg

SEQ ID NO: 464603 - RNA, 22 nt, Human
gugaauggggcaggaaggaugg

SEQ ID NO: 464604 - RNA, 22 nt, Human
ugcugccuugaccuccugggcu

SEQ ID NO: 464605 - RNA, 22 nt, Human
cagugcagguuuagggcugggg

SEQ ID NO: 464606 - RNA, 22 nt, Human
aggcaaaauuacaaaguuauua

SEQ ID NO: 464607 - RNA, 22 nt, Human
aaugcacagcuaaagugguucc

SEQ ID NO: 464608 - RNA, 22 nt, Human
gcaaaaaaugcuuguugcuuag

SEQ ID NO: 464609 - RNA, 22 nt, Human
cacauuuaaagguugaagcuga

SEQ ID NO: 464610 - RNA, 22 nt, Human
ugugccuggcauucugggcuuc

SEQ ID NO: 464611 - RNA, 22 nt, Human
gagcuuuaggagaaggagguca

SEQ ID NO: 464612 - RNA, 22 nt, Human
gaaagaagcuuuagauggcuau

SEQ ID NO: 464613 - RNA, 22 nt, Human
caauguguuugcauauuaaaau

SEQ ID NO: 464614 - RNA, 22 nt, Human
agcaggugcauggcgagcgcgg

SEQ ID NO: 464615 - RNA, 22 nt, Human
ugaggcaggagaaucaccggaa

SEQ ID NO: 464616 - RNA, 22 nt, Human
acauuucugcaucucagagcua

SEQ ID NO: 464617 - RNA, 22 nt, Human
cauuagaagaacaguuauauua

SEQ ID NO: 464618 - RNA, 22 nt, Human
aggaagugaaagggaaggaguu

SEQ ID NO: 464619 - RNA, 22 nt, Human
ggagugaaucacuagaugcaga

SEQ ID NO: 464620 - RNA, 22 nt, Human
aggacuucuccgauaagucaga

SEQ ID NO: 464621 - RNA, 22 nt, Human
uucuaguuuagggcucuucaac

SEQ ID NO: 464622 - RNA, 22 nt, Human
gccugagcccaggugugcagag

SEQ ID NO: 464623 - RNA, 22 nt, Human
cagggcucccugcagccucugu

SEQ ID NO: 464624 - RNA, 22 nt, Human
gaggucagucagaccaggguuu

SEQ ID NO: 464625 - RNA, 22 nt, Human
cccagaggugcuucagaggugc

SEQ ID NO: 464626 - RNA, 22 nt, Human
gugauuccuauuaguacaugca

SEQ ID NO: 464627 - RNA, 22 nt, Human
gcugccugauguccagcaggac

SEQ ID NO: 464628 - RNA, 22 nt, Human
aucagcaaaaaugccuucagaa

SEQ ID NO: 464629 - RNA, 22 nt, Human
gccaccagguuagauccagccu

SEQ ID NO: 464630 - RNA, 22 nt, Human
cugagggccuuggcuccugccc

SEQ ID NO: 464631 - RNA, 22 nt, Human
uuauuuacaacucuucucuucc

SEQ ID NO: 464632 - RNA, 22 nt, Human
cugggcugcgggcgccccucca

SEQ ID NO: 464633 - RNA, 22 nt, Human
ucugccugcggcugcagguggc

SEQ ID NO: 464634 - RNA, 22 nt, Human
aaaagaggagugguuuaugaca

SEQ ID NO: 464635 - RNA, 22 nt, Human
agggccucuaccauccaagguu

SEQ ID NO: 464636 - RNA, 22 nt, Human
gaguggggcguggauccagcgu

SEQ ID NO: 464637 - RNA, 22 nt, Human
gagcaggaugggagcuggggcc

SEQ ID NO: 464638 - RNA, 22 nt, Human
gcaguaggagaagaggaugcuu

SEQ ID NO: 464639 - RNA, 22 nt, Human
aaagcaguauauugguaguugu

SEQ ID NO: 464640 - RNA, 21 nt, Human
aagccagcccacagugguuug

SEQ ID NO: 464641 - RNA, 22 nt, Human
ugaggcagcaauugauuauuca

SEQ ID NO: 464642 - RNA, 20 nt, Human
aggagaaauucgggacaccu

SEQ ID NO: 464643 - RNA, 18 nt, Human
uggaggcagaguucuggc

SEQ ID NO: 464644 - RNA, 22 nt, Human
uggcucagaacuacuucuaguu

SEQ ID NO: 464645 - RNA, 22 nt, Human
cuaaaugcccuacaaugacugg

SEQ ID NO: 464646 - RNA, 22 nt, Human
aaaagguuuugaguacaaauau

SEQ ID NO: 464647 - RNA, 22 nt, Human
caggagccagcugucccaacca

SEQ ID NO: 464648 - RNA, 22 nt, Human
uucaggagcuggcugcgaagga

SEQ ID NO: 464649 - RNA, 22 nt, Human
ucucugggauaaacugggccag

SEQ ID NO: 464650 - RNA, 19 nt, Human
ugaaggagggggauggcca

SEQ ID NO: 464651 - RNA, 22 nt, Human
cacaggagguuaggaagugguc

SEQ ID NO: 464652 - RNA, 22 nt, Human
gggccugugcacaguucuguua

SEQ ID NO: 464653 - RNA, 22 nt, Human
cucucuguuaugcuuucaugaa

SEQ ID NO: 464654 - RNA, 22 nt, Human
gaacaaacacaucccagcagug

SEQ ID NO: 464655 - RNA, 22 nt, Human
uacagaaaucacaucgcuuuga

SEQ ID NO: 464656 - RNA, 22 nt, Human
gaauuucuggacccuuugagaa

SEQ ID NO: 464657 - RNA, 22 nt, Human
gccaggcauguccucugcagaa

SEQ ID NO: 464658 - RNA, 22 nt, Human
ccagucccaucucugucgcuua

SEQ ID NO: 464659 - RNA, 22 nt, Human
accagguggccccagcgugguu

SEQ ID NO: 464660 - RNA, 22 nt, Human
uugcaagacacuuggaagcaca

SEQ ID NO: 464661 - RNA, 22 nt, Human
ugugaaggagaugaagggagug

SEQ ID NO: 464662 - RNA, 22 nt, Human
aaaggccagguuggcugguauu

SEQ ID NO: 464663 - RNA, 20 nt, Human
ugaggcucagagagguugag

SEQ ID NO: 464664 - RNA, 20 nt, Human
gggagucuggaugaaagaug

SEQ ID NO: 464665 - RNA, 22 nt, Human
gggcugcacguauucugcucac

SEQ ID NO: 464666 - RNA, 22 nt, Human
gagcagcuagauaaagcccuuc

SEQ ID NO: 464667 - RNA, 22 nt, Human
uuucucuaaauagggaggcuua

SEQ ID NO: 464668 - RNA, 22 nt, Human
ucaggcugaggucaucugcauc

SEQ ID NO: 464669 - RNA, 22 nt, Human
ugcugccaaaugcgagcucugu

SEQ ID NO: 464670 - RNA, 22 nt, Human
gaaaucugcggugaggccugag

SEQ ID NO: 464671 - RNA, 22 nt, Human
ccagagcugauuccugggacuu

SEQ ID NO: 464672 - RNA, 22 nt, Human
agggucugacugaauggaaaag

SEQ ID NO: 464673 - RNA, 22 nt, Human
aggcccagagagccaguuagug

SEQ ID NO: 464674 - RNA, 22 nt, Human
uuuucauuagaaugacugagaa

SEQ ID NO: 464675 - RNA, 22 nt, Human
cagccaggacagggaaacuagu

SEQ ID NO: 464676 - RNA, 22 nt, Human
aggcagagaaaaaccagauaug

SEQ ID NO: 464677 - RNA, 22 nt, Human
ugccaggcuccggaacgacagu

SEQ ID NO: 464678 - RNA, 22 nt, Human
ugccucugcugcuguggcauca

SEQ ID NO: 464679 - RNA, 22 nt, Human
guauuagguuggugcaaaagua

SEQ ID NO: 464680 - RNA, 22 nt, Human
cccagggcuuuucucacuagac

SEQ ID NO: 464681 - RNA, 22 nt, Human
cugagaggugacagcgugcugg

SEQ ID NO: 464682 - RNA, 23 nt, Human
auuuccuacuauaaaagagguaa

SEQ ID NO: 464683 - RNA, 21 nt, Human
uggcacugcuuagcagguucc

SEQ ID NO: 464684 - RNA, 22 nt, Human
aguaauaauuuauauuagggag

SEQ ID NO: 464685 - RNA, 22 nt, Human
gguggccucgguggugcacagg

SEQ ID NO: 464686 - RNA, 22 nt, Human
ccagagccucgcccggagccuc

SEQ ID NO: 464687 - RNA, 22 nt, Human
gagagugaggccugggaaucua

SEQ ID NO: 464688 - RNA, 18 nt, Human
aaggcuucaaagaguaga

SEQ ID NO: 464689 - RNA, 22 nt, Human
gggcugacucaaccuugcaaag

SEQ ID NO: 464690 - RNA, 22 nt, Human
acauuuuuuagagucccacauu

SEQ ID NO: 464691 - RNA, 22 nt, Human
agugcauugcaucucugcuuca

SEQ ID NO: 464692 - RNA, 22 nt, Human
auuucuuccucugucaguaacu

SEQ ID NO: 464693 - RNA, 22 nt, Human
ggguggaguagaaagaugaauu

SEQ ID NO: 464694 - RNA, 22 nt, Human
gcugccuguccugaggaguccg

SEQ ID NO: 464695 - RNA, 22 nt, Human
ucccaguguggcaggccaugga

SEQ ID NO: 464696 - RNA, 22 nt, Human
aagagcuggaugaagaaaucaa

SEQ ID NO: 464697 - RNA, 22 nt, Human
ucuuucuacaucauuugcuucu

SEQ ID NO: 464698 - RNA, 22 nt, Human
gggcugggaauggcuaaguaug

SEQ ID NO: 464699 - RNA, 22 nt, Human
agcuuuauggugccucacuuga

SEQ ID NO: 464700 - RNA, 20 nt, Human
cagagacccaggcuucagcu

SEQ ID NO: 464701 - RNA, 22 nt, Human
ccagggugugagaaggaaguag

SEQ ID NO: 464702 - RNA, 22 nt, Human
ccagguggaggugugagguccu

SEQ ID NO: 464703 - RNA, 22 nt, Human
ccugggagugucagacuugcuu

SEQ ID NO: 464704 - RNA, 22 nt, Human
cagccaccauacagcagaagcu

SEQ ID NO: 464705 - RNA, 22 nt, Human
agcagccaagguaaccugugcu

SEQ ID NO: 464706 - RNA, 22 nt, Human
uugcauuguugcaaugaaguau

SEQ ID NO: 464707 - RNA, 22 nt, Human
gaagcucucaaacucuccccuu

SEQ ID NO: 464708 - RNA, 22 nt, Human
gcuguacauucugcacaggccc

SEQ ID NO: 464709 - RNA, 22 nt, Human
ugcuaaauaaguggaauagaca

SEQ ID NO: 464710 - RNA, 22 nt, Human
gcaggcagagucaauuugaucc

SEQ ID NO: 464711 - RNA, 22 nt, Human
cagcagggcccccgggugcgcc

SEQ ID NO: 464712 - RNA, 22 nt, Human
gggcaggagagaacagucaugg

SEQ ID NO: 464713 - RNA, 22 nt, Human
uaucuacaggugucagguaaga

SEQ ID NO: 464714 - RNA, 22 nt, Human
aagucacacuagacaacugagg

SEQ ID NO: 464715 - RNA, 22 nt, Human
gcucuccacugaccacggggca

SEQ ID NO: 464716 - RNA, 22 nt, Human
ucucuggaauuggcugaggcaa

SEQ ID NO: 464717 - RNA, 22 nt, Human
agggcuagaguugagaugggga

SEQ ID NO: 464718 - RNA, 20 nt, Human
cacugaagacuucuugcuca

SEQ ID NO: 464719 - RNA, 22 nt, Human
gaaagccauagcccagcuuuac

SEQ ID NO: 464720 - RNA, 22 nt, Human
ucucugcugagaagggcuggca

SEQ ID NO: 464721 - RNA, 22 nt, Human
cccaggccccagggcuugucag

SEQ ID NO: 464722 - RNA, 22 nt, Human
ucagcagauggguuguguuggc

SEQ ID NO: 464723 - RNA, 22 nt, Human
aagaacaguguccugggacucg

SEQ ID NO: 464724 - RNA, 22 nt, Human
ucaguuuuguauguuguaaguc

SEQ ID NO: 464725 - RNA, 22 nt, Human
aaauuucuugaggcucucuagc

SEQ ID NO: 464726 - RNA, 22 nt, Human
ccagcuucucucugaugcagcu

SEQ ID NO: 464727 - RNA, 22 nt, Human
ccuuuuucaauauagaauugca

SEQ ID NO: 464728 - RNA, 21 nt, Human
agguggggcugcaccucugcu

SEQ ID NO: 464729 - RNA, 22 nt, Human
ugaugguuuuauuaauaggacc

SEQ ID NO: 464730 - RNA, 19 nt, Human
uguguaaagucugugguca

SEQ ID NO: 464731 - RNA, 22 nt, Human
ugaaggaauggaggaucagagc

SEQ ID NO: 464732 - RNA, 22 nt, Human
ggcuuuauuugcagccauuguu

SEQ ID NO: 464733 - RNA, 22 nt, Human
auguaguguagagauuagucuc

SEQ ID NO: 464734 - RNA, 22 nt, Human
guaucuuuuacaccaggaaauu

SEQ ID NO: 464735 - RNA, 22 nt, Human
gugugcagggcugccugugccg

SEQ ID NO: 464736 - RNA, 22 nt, Human
uaguaucuauuaguaacaagag

SEQ ID NO: 464737 - RNA, 22 nt, Human
uggaggaugccuggggaggccu

SEQ ID NO: 464738 - RNA, 22 nt, Human
uggcagagcaaaaagauagaau

SEQ ID NO: 464739 - RNA, 17 nt, Human
aggagucucagaugagc

SEQ ID NO: 464740 - RNA, 22 nt, Human
cucagaguccccaguggguuug

SEQ ID NO: 464741 - RNA, 22 nt, Human
guacauuucauuuaaaugaugu

SEQ ID NO: 464742 - RNA, 22 nt, Human
uuagggaaggcugcugucagcu

SEQ ID NO: 464743 - RNA, 17 nt, Human
uuagcaaaauagcacuu

SEQ ID NO: 464744 - RNA, 22 nt, Human
uggcccugcuguaucaucugcu

SEQ ID NO: 464745 - RNA, 22 nt, Human
uccaaagggaagcgcuuucugu

SEQ ID NO: 464746 - RNA, 22 nt, Human
ugcuucugggcaaaugugugug

SEQ ID NO: 464747 - RNA, 17 nt, Human
cagcuuuaugcuacugu

SEQ ID NO: 464748 - RNA, 22 nt, Human
aggagucauugagagggguccu

SEQ ID NO: 464749 - RNA, 22 nt, Human
aacucuauuuacccuacuaaac

SEQ ID NO: 464750 - RNA, 22 nt, Human
uauugaugcuuggauugggcca

SEQ ID NO: 464751 - RNA, 22 nt, Human
ugaggccaaugacccugggcag

SEQ ID NO: 464752 - RNA, 22 nt, Human
ccagggcaugggaagaacugaa

SEQ ID NO: 464753 - RNA, 22 nt, Human
auggggagagaagggcugagcu

SEQ ID NO: 464754 - RNA, 22 nt, Human
cugcugcucgaccagucccagg

SEQ ID NO: 464755 - RNA, 22 nt, Human
cacagggcuaaaugaaggguug

SEQ ID NO: 464756 - RNA, 21 nt, Human
uuagaaagcucacuacaguua

SEQ ID NO: 464757 - RNA, 22 nt, Human
cccaugccuucugacucacagg

SEQ ID NO: 464758 - RNA, 23 nt, Human
ugcugggcagagcuggugcugag

SEQ ID NO: 464759 - RNA, 22 nt, Human
ugggugggagcgcccugucugg

SEQ ID NO: 464760 - RNA, 22 nt, Human
caggagaaacauaauuuucugg

SEQ ID NO: 464761 - RNA, 23 nt, Human
acagcugcaccuggccgccuggc

SEQ ID NO: 464762 - RNA, 22 nt, Human
ggaggacaggggcugcagcaca

SEQ ID NO: 464763 - RNA, 22 nt, Human
cagugagggaagaucucagcac

SEQ ID NO: 464764 - RNA, 22 nt, Human
aguggcagagcugugucuugaa

SEQ ID NO: 464765 - RNA, 22 nt, Human
guuauuuucauuggcucagacu

SEQ ID NO: 464766 - RNA, 22 nt, Human
cagcccuggccccagguggucu

SEQ ID NO: 464767 - RNA, 19 nt, Human
aucugaaguaggugcagcu

SEQ ID NO: 464768 - RNA, 22 nt, Human
caugggagcuaucuccaucacu

SEQ ID NO: 464769 - RNA, 22 nt, Human
cagugcauaaucuaaauggggg

SEQ ID NO: 464770 - RNA, 22 nt, Human
uccucaggagagcuccuaugcc

SEQ ID NO: 464771 - RNA, 22 nt, Human
uggcucuggugcgggcuccugc

SEQ ID NO: 464772 - RNA, 23 nt, Human
caguggagacucaugcuuccuua

SEQ ID NO: 464773 - RNA, 22 nt, Human
ucuugcacuucaugaauauguu

SEQ ID NO: 464774 - RNA, 22 nt, Human
uuggcauuuauucuaaggucaa

SEQ ID NO: 464775 - RNA, 22 nt, Human
cuggaugcuuccucucugcuag

SEQ ID NO: 464776 - RNA, 22 nt, Human
aggcucagaggugagcaucugc

SEQ ID NO: 464777 - RNA, 22 nt, Human
gaaggagcuaaagggagcccug

SEQ ID NO: 464778 - RNA, 22 nt, Human
ugcauacacaagcauacaugua

SEQ ID NO: 464779 - RNA, 18 nt, Human
cggcagagugcuucuagc

SEQ ID NO: 464780 - RNA, 22 nt, Human
ucagcuuuggucacauugaguu

SEQ ID NO: 464781 - RNA, 22 nt, Human
agggcuccugaggcccuucugg

SEQ ID NO: 464782 - RNA, 16 nt, Human
cuuccucuucacuggc

SEQ ID NO: 464783 - RNA, 22 nt, Human
acccagggaccccgcugacgcc

SEQ ID NO: 464784 - RNA, 21 nt, Human
ccaggguccagcugccauggu

SEQ ID NO: 464785 - RNA, 22 nt, Human
ucugucaccauucagcuugaau

SEQ ID NO: 464786 - RNA, 18 nt, Human
ccucagggagagagacgc

SEQ ID NO: 464787 - RNA, 22 nt, Human
cugggccuagcaacagaggagu

SEQ ID NO: 464788 - RNA, 22 nt, Human
aggccugaggaccagauaaaug

SEQ ID NO: 464789 - RNA, 22 nt, Human
cuagggaccucagcuccuggag

SEQ ID NO: 464790 - RNA, 22 nt, Human
uggagcagagaugguggccuuc

SEQ ID NO: 464791 - RNA, 22 nt, Human
cagcagcuggugagacacagcc

SEQ ID NO: 464792 - RNA, 22 nt, Human
cugagccagcgggcucacuuuu

SEQ ID NO: 464793 - RNA, 22 nt, Human
gucaggaucaaauugaaguuau

SEQ ID NO: 464794 - RNA, 22 nt, Human
ggcccagcugugcuuccagccc

SEQ ID NO: 464795 - RNA, 22 nt, Human
ggcacagagcccagcuuccuag

SEQ ID NO: 464796 - RNA, 22 nt, Human
cuguauuuguccucuauuuauu

SEQ ID NO: 464797 - RNA, 20 nt, Human
cccagccccuaccuguugcc

SEQ ID NO: 464798 - RNA, 22 nt, Human
uggccugauuuugcuaagagaa

SEQ ID NO: 464799 - RNA, 22 nt, Human
aaaaagauguccugaaguuuag

SEQ ID NO: 464800 - RNA, 22 nt, Human
agcaguggagcgagauguuuaa

SEQ ID NO: 464801 - RNA, 17 nt, Human
uauacacagacagacug

SEQ ID NO: 464802 - RNA, 22 nt, Human
aucaaaguucguaacugauaac

SEQ ID NO: 464803 - RNA, 22 nt, Human
gaggccuggcugggaggaggug

SEQ ID NO: 464804 - RNA, 22 nt, Human
gguuugcaugugauguugggca

SEQ ID NO: 464805 - RNA, 22 nt, Human
cuuaggaacgcucugccuagug

SEQ ID NO: 464806 - RNA, 22 nt, Human
ggcauccaguucugaucaacaa

SEQ ID NO: 464807 - RNA, 22 nt, Human
gagagugaugaaugguuaaaca

SEQ ID NO: 464808 - RNA, 22 nt, Human
gugccugcugcagagucgcugu

SEQ ID NO: 464809 - RNA, 22 nt, Human
cagugccucuuaagugucaccc

SEQ ID NO: 464810 - RNA, 19 nt, Human
aucuuacagagcagaguac

SEQ ID NO: 464811 - RNA, 18 nt, Human
gucauugcaacauacugu

SEQ ID NO: 464812 - RNA, 22 nt, Human
ucuuaagcagagaagaaguuga

SEQ ID NO: 464813 - RNA, 22 nt, Human
gcugaaggaggcucugguacua

SEQ ID NO: 464814 - RNA, 22 nt, Human
ggcaggcagaggcugagacagg

SEQ ID NO: 464815 - RNA, 19 nt, Human
caggagagcaugcacuuug

SEQ ID NO: 464816 - RNA, 22 nt, Human
gggcagugacaaaggggaugaa

SEQ ID NO: 464817 - RNA, 22 nt, Human
aggagcugggcugcugcuggga

SEQ ID NO: 464818 - RNA, 23 nt, Human
agccuucaggcaaugucaguaga

SEQ ID NO: 464819 - RNA, 22 nt, Human
augauacaagcaaaacuaauca

SEQ ID NO: 464820 - RNA, 22 nt, Human
gggcagugucggggcccaggga

SEQ ID NO: 464821 - RNA, 20 nt, Human
ccagaagagaugaucaucca

SEQ ID NO: 464822 - RNA, 22 nt, Human
ccugugugucugucacugcaca

SEQ ID NO: 464823 - RNA, 22 nt, Human
aucuucaaagcacaucguuugu

SEQ ID NO: 464824 - RNA, 20 nt, Human
cugcccagccacugagggau

SEQ ID NO: 464825 - RNA, 20 nt, Human
uugauaggcagcuugucagg

SEQ ID NO: 464826 - RNA, 22 nt, Human
gagagaagggggauaugagccu

SEQ ID NO: 464827 - RNA, 22 nt, Human
agggcuccaggggcugggugac

SEQ ID NO: 464828 - RNA, 22 nt, Human
uuccagcuaacucacaucccuu

SEQ ID NO: 464829 - RNA, 22 nt, Human
uccugcaggccagaggggugag

SEQ ID NO: 464830 - RNA, 22 nt, Human
cuuauuagugucugucugaguu

SEQ ID NO: 464831 - RNA, 22 nt, Human
agucagcagugaaagcacagcc

SEQ ID NO: 464832 - RNA, 22 nt, Human
cagagccuaaaacgacuccacu

SEQ ID NO: 464833 - RNA, 22 nt, Human
caggguggcccuguggucucau

SEQ ID NO: 464834 - RNA, 22 nt, Human
caggggaagaugccaagggaga

SEQ ID NO: 464835 - RNA, 18 nt, Human
uaaaugcauguuaauaac

SEQ ID NO: 464836 - RNA, 22 nt, Human
cugccucucagccugaccgcca

SEQ ID NO: 464837 - RNA, 22 nt, Human
cucagggggaaucaggucacag

SEQ ID NO: 464838 - RNA, 22 nt, Human
uaaagcaggccacauaugugau

SEQ ID NO: 464839 - RNA, 22 nt, Human
uugcaaaagccgaggcacucca

SEQ ID NO: 464840 - RNA, 22 nt, Human
cacugaagccacuggaagagga

SEQ ID NO: 464841 - RNA, 22 nt, Human
ggccagaggccacagcuguguc

SEQ ID NO: 464842 - RNA, 22 nt, Human
gggagcugguuccugcccucca

SEQ ID NO: 464843 - RNA, 23 nt, Human
cagguggcuccacgagggguggg

SEQ ID NO: 464844 - RNA, 22 nt, Human
gugaaggcuacaagagaucaag

SEQ ID NO: 464845 - RNA, 22 nt, Human
cccagggagguagcaggagaaa

SEQ ID NO: 464846 - RNA, 22 nt, Human
ugucucugagaugacucccacc

SEQ ID NO: 464847 - RNA, 22 nt, Human
ggcaccaggcugggcauaggcc

SEQ ID NO: 464848 - RNA, 22 nt, Human
gcugccugccuaguuccacagu

SEQ ID NO: 464849 - RNA, 22 nt, Human
aaaugccucugcuguacacaau

SEQ ID NO: 464850 - RNA, 22 nt, Human
gagcagugaagacagaaguaca

SEQ ID NO: 464851 - RNA, 22 nt, Human
aagcugcccuguguuagaguuc

SEQ ID NO: 464852 - RNA, 22 nt, Human
uguauauucugccuaaaagcuu

SEQ ID NO: 464853 - RNA, 22 nt, Human
ucaggaucggccuuuuuuuaag

SEQ ID NO: 464854 - RNA, 21 nt, Human
uucuucaugaugauuaauggc

SEQ ID NO: 464855 - RNA, 22 nt, Human
uaaauguguaaaccuccauuac

SEQ ID NO: 464856 - RNA, 22 nt, Human
gggaccugaggcccugcuccac

SEQ ID NO: 464857 - RNA, 19 nt, Human
ucugaggguccagaugcau

SEQ ID NO: 464858 - RNA, 22 nt, Human
ccagggcagcagaauuggggca

SEQ ID NO: 464859 - RNA, 22 nt, Human
uaacagaaauaguaggugaggg

SEQ ID NO: 464860 - RNA, 22 nt, Human
ugggccacgugacccuuacccu

SEQ ID NO: 464861 - RNA, 22 nt, Human
cuuccucaugugcaaugcaagc

SEQ ID NO: 464862 - RNA, 22 nt, Human
auugaaaaaugacuauugcuua

SEQ ID NO: 464863 - RNA, 22 nt, Human
cuuuauguucaguacaaugcuu

SEQ ID NO: 464864 - RNA, 22 nt, Human
guggcaggucccauuggagcag

SEQ ID NO: 464865 - RNA, 18 nt, Human
uucacaggaaaugucuuu

SEQ ID NO: 464866 - RNA, 22 nt, Human
cacuucaauuaacuucagcauu

SEQ ID NO: 464867 - RNA, 22 nt, Human
aauuauauguuaaucuucaauu

SEQ ID NO: 464868 - RNA, 22 nt, Human
ggagccuguggccgucacgacu

SEQ ID NO: 464869 - RNA, 22 nt, Human
acugcagccuuugggcucauaa

SEQ ID NO: 464870 - RNA, 22 nt, Human
ugccuugguucucuacuuggag

SEQ ID NO: 464871 - RNA, 22 nt, Human
uucuggaguauuccuggcaccu

SEQ ID NO: 464872 - RNA, 22 nt, Human
cagccugcauuuguaucuguau

SEQ ID NO: 464873 - RNA, 22 nt, Human
gcaggagccacuucagggaugc

SEQ ID NO: 464874 - RNA, 19 nt, Human
ugggcagcucccucugucc

SEQ ID NO: 464875 - RNA, 22 nt, Human
uuugcauuaucucacuuauaua

SEQ ID NO: 464876 - RNA, 22 nt, Human
ugaggccacuuccccacagccc

SEQ ID NO: 464877 - RNA, 22 nt, Human
ggcaggcaagucugcucuguga

SEQ ID NO: 464878 - RNA, 21 nt, Human
uagcuuuaauauucccacauu

SEQ ID NO: 464879 - RNA, 22 nt, Human
acagaacuuccugcuggagugg

SEQ ID NO: 464880 - RNA, 22 nt, Human
aaauagcacagcagcugaggcu

SEQ ID NO: 464881 - RNA, 22 nt, Human
agcuugccucuuaaucaccuca

SEQ ID NO: 464882 - RNA, 22 nt, Human
acagauuuguucuuuugggcua

SEQ ID NO: 464883 - RNA, 22 nt, Human
ucacaguaucacacaaggauua

SEQ ID NO: 464884 - RNA, 22 nt, Human
cagagccauccaggugccuguu

SEQ ID NO: 464885 - RNA, 20 nt, Human
gagccugggaagucuaaggu

SEQ ID NO: 464886 - RNA, 22 nt, Human
ccugcuggccaguggagggcug

SEQ ID NO: 464887 - RNA, 22 nt, Human
caggcugucugaauggaggccc

SEQ ID NO: 464888 - RNA, 19 nt, Human
ccagagacauuggcaucuu

SEQ ID NO: 464889 - RNA, 19 nt, Human
uggcugggugccaauggcc

SEQ ID NO: 464890 - RNA, 20 nt, Human
gcacugaaauucaauguuug

SEQ ID NO: 464891 - RNA, 22 nt, Human
cauugcacagcccuguggugau

SEQ ID NO: 464892 - RNA, 22 nt, Human
aggagccaagcagaacuaagga

SEQ ID NO: 464893 - RNA, 20 nt, Human
gccuguccugagugucaugg

SEQ ID NO: 464894 - RNA, 23 nt, Human
ccucccaccuauuucacuuucuu

SEQ ID NO: 464895 - RNA, 22 nt, Human
ugucucaucucuuaaccccacu

SEQ ID NO: 464896 - RNA, 22 nt, Human
aagcuuuaaggaauuuuaugga

SEQ ID NO: 464897 - RNA, 22 nt, Human
ucauaacagcuaagucccuuuc

SEQ ID NO: 464898 - RNA, 22 nt, Human
aguggcaguagaugagcugguu

SEQ ID NO: 464899 - RNA, 22 nt, Human
ccagccagcugcccuuggggcc

SEQ ID NO: 464900 - RNA, 22 nt, Human
aaguucaagucugcaucuuuuu

SEQ ID NO: 464901 - RNA, 22 nt, Human
uaggggaacuggcacagggcag

SEQ ID NO: 464902 - RNA, 22 nt, Human
cagaggccucacuuccagccag

SEQ ID NO: 464903 - RNA, 22 nt, Human
ucucuccuuaucauuguguuua

SEQ ID NO: 464904 - RNA, 22 nt, Human
cagaggguugaugugaggcuua

SEQ ID NO: 464905 - RNA, 20 nt, Human
cuuggccuacuuagcuuugu

SEQ ID NO: 464906 - RNA, 22 nt, Human
gaggccugaaaggggaccuaug

SEQ ID NO: 464907 - RNA, 22 nt, Human
ccaaaguccauaguuuacauaa

SEQ ID NO: 464908 - RNA, 22 nt, Human
uuauuuaggagaaggaacccug

SEQ ID NO: 464909 - RNA, 22 nt, Human
acuaaauaguuuugacagaaca

SEQ ID NO: 464910 - RNA, 19 nt, Human
augauacaggugaaaauug

SEQ ID NO: 464911 - RNA, 22 nt, Human
cuuucucuguguuucacaugcu

SEQ ID NO: 464912 - RNA, 22 nt, Human
ugggcaggagagaagcuaaaga

SEQ ID NO: 464913 - RNA, 22 nt, Human
ucaggaugaccacgagccucua

SEQ ID NO: 464914 - RNA, 22 nt, Human
ggcuuccuaauacucccuacac

SEQ ID NO: 464915 - RNA, 22 nt, Human
ucacaccuguaaucccaggccu

SEQ ID NO: 464916 - RNA, 22 nt, Human
auggcagccuguggacagucaa

SEQ ID NO: 464917 - RNA, 22 nt, Human
aaugaugguauugaugagcuaa

SEQ ID NO: 464918 - RNA, 22 nt, Human
uccucacaagcaagcacaggua

SEQ ID NO: 464919 - RNA, 22 nt, Human
cagcuauuuucucauuaaggau

SEQ ID NO: 464920 - RNA, 22 nt, Human
agcuggugcucaggggcaugga

SEQ ID NO: 464921 - RNA, 22 nt, Human
uagggcugccuauggcuagaua

SEQ ID NO: 464922 - RNA, 22 nt, Human
cuuggcagcuuuuggaggagcc

SEQ ID NO: 464923 - RNA, 22 nt, Human
cagaacauucacucauaugugg

SEQ ID NO: 464924 - RNA, 22 nt, Human
ggcaugggagugagcaaccuua

SEQ ID NO: 464925 - RNA, 22 nt, Human
gaaaugcauggaucuuggcaga

SEQ ID NO: 464926 - RNA, 22 nt, Human
ccagccuccauguagauagcug

SEQ ID NO: 464927 - RNA, 22 nt, Human
uaggccaggacagagcuuccag

SEQ ID NO: 464928 - RNA, 22 nt, Human
cugccuggaaugccagcuucuc

SEQ ID NO: 464929 - RNA, 22 nt, Human
ggggcugguggugguuucucca

SEQ ID NO: 464930 - RNA, 22 nt, Human
gcugaguugaaagcagaggaua

SEQ ID NO: 464931 - RNA, 22 nt, Human
uuuugagauggagucuugcucu

SEQ ID NO: 464932 - RNA, 22 nt, Human
caggguggggcuggcuaucaaa

SEQ ID NO: 464933 - RNA, 22 nt, Human
gcagacagcauguugggcuauu

SEQ ID NO: 464934 - RNA, 22 nt, Human
gccugucucuuggaacuuggua

SEQ ID NO: 464935 - RNA, 23 nt, Human
agggccacugggaaggauuacug

SEQ ID NO: 464936 - RNA, 22 nt, Human
acugaaggcuuaacucuuucau

SEQ ID NO: 464937 - RNA, 22 nt, Human
gucagaggaauggaugagugau

SEQ ID NO: 464938 - RNA, 21 nt, Human
cucuugugucagagccagagg

SEQ ID NO: 464939 - RNA, 22 nt, Human
aggcaggagcaagcccuacaag

SEQ ID NO: 464940 - RNA, 22 nt, Human
uuuucauuguuacuaugagcua

SEQ ID NO: 464941 - RNA, 22 nt, Human
cuucugcaauaaguuuuggucc

SEQ ID NO: 464942 - RNA, 22 nt, Human
augaauacgcggucauacacau

SEQ ID NO: 464943 - RNA, 19 nt, Human
ccagagcccgccagauggg

SEQ ID NO: 464944 - RNA, 17 nt, Human
gcugagugcagggaguc

SEQ ID NO: 464945 - RNA, 22 nt, Human
ugcuggcuggccuggccuggac

SEQ ID NO: 464946 - RNA, 22 nt, Human
acaaaugcuuaguucaccaaaa

SEQ ID NO: 464947 - RNA, 22 nt, Human
acauuucucuugaugucucuau

SEQ ID NO: 464948 - RNA, 23 nt, Human
gcugcagcuguggauguucucag

SEQ ID NO: 464949 - RNA, 22 nt, Human
cuccucuuuggggauuuacaca

SEQ ID NO: 464950 - RNA, 22 nt, Human
caaaguccuagaacagugcuug

SEQ ID NO: 464951 - RNA, 22 nt, Human
agaggcuccuagccacuggcuu

SEQ ID NO: 464952 - RNA, 22 nt, Human
acagccagguaaaggcauggca

SEQ ID NO: 464953 - RNA, 22 nt, Human
aacaguaaugugguguuggguu

SEQ ID NO: 464954 - RNA, 22 nt, Human
ugcugugcuggcggcagaggcc

SEQ ID NO: 464955 - RNA, 22 nt, Human
cuucagaacuauaaaaaguacu

SEQ ID NO: 464956 - RNA, 19 nt, Human
aggcucugagcuccuggag

SEQ ID NO: 464957 - RNA, 22 nt, Human
gcagcuuggugaaaggugaugg

SEQ ID NO: 464958 - RNA, 22 nt, Human
agcauuuaggagaauuugagaa

SEQ ID NO: 464959 - RNA, 22 nt, Human
aggcaggcuagucgcuugagcc

SEQ ID NO: 464960 - RNA, 22 nt, Human
ugucaccagcugcuccucagga

SEQ ID NO: 464961 - RNA, 22 nt, Human
gcuggccauggccugcgccauc

SEQ ID NO: 464962 - RNA, 22 nt, Human
cacccagggcugugccugccca

SEQ ID NO: 464963 - RNA, 22 nt, Human
ucagaaauacuaucagcuuuug

SEQ ID NO: 464964 - RNA, 22 nt, Human
gcagcuuuaaaggaggcucuga

SEQ ID NO: 464965 - RNA, 22 nt, Human
guggaggacaaaagaagccuuu

SEQ ID NO: 464966 - RNA, 21 nt, Human
ccugccaggaaacugaguguc

SEQ ID NO: 464967 - RNA, 22 nt, Human
acagagagaggcccgaggcugc

SEQ ID NO: 464968 - RNA, 22 nt, Human
caggcagcaucagucugcugua

SEQ ID NO: 464969 - RNA, 22 nt, Human
ccucuggcuguaccacuggcac

SEQ ID NO: 464970 - RNA, 20 nt, Human
cuggcaggagcgagucuacc

SEQ ID NO: 464971 - RNA, 20 nt, Human
uggagcugugguaaggagca

SEQ ID NO: 464972 - RNA, 22 nt, Human
ugcuuuauuaagagagaaauuu

SEQ ID NO: 464973 - RNA, 22 nt, Human
cuggcucccucgcugaggugcu

SEQ ID NO: 464974 - RNA, 22 nt, Human
ggagccugagcggcccagggcc

SEQ ID NO: 464975 - RNA, 22 nt, Human
uacaucuuugucuaugaccagc

SEQ ID NO: 464976 - RNA, 22 nt, Human
ugcugggcuugaaagcugcuaa

SEQ ID NO: 464977 - RNA, 22 nt, Human
gagccugagugcugccuccccu

SEQ ID NO: 464978 - RNA, 22 nt, Human
ggcaucuguccaucucuccagc

SEQ ID NO: 464979 - RNA, 22 nt, Human
agaaauaugcugauuagaugaa

SEQ ID NO: 464980 - RNA, 22 nt, Human
uccugcagccacugcaggcaga

SEQ ID NO: 464981 - RNA, 22 nt, Human
cgacccuacagacagugcugag

SEQ ID NO: 464982 - RNA, 22 nt, Human
ucagagucauugcaaguagaag

SEQ ID NO: 464983 - RNA, 22 nt, Human
cuauugcauuugcaucuucauc

SEQ ID NO: 464984 - RNA, 22 nt, Human
ucaccaggcaacuauguacucc

SEQ ID NO: 464985 - RNA, 22 nt, Human
uggcauuucaccuuucauuucc

SEQ ID NO: 464986 - RNA, 22 nt, Human
uuuccucuucuucccaugucau

SEQ ID NO: 464987 - RNA, 22 nt, Human
acagccagaggugguccugggu

SEQ ID NO: 464988 - RNA, 22 nt, Human
caggggacaguaugguggauga

SEQ ID NO: 464989 - RNA, 22 nt, Human
cucucugggcccaguuggcacc

SEQ ID NO: 464990 - RNA, 22 nt, Human
ggccugcuccgggggcugagcu

SEQ ID NO: 464991 - RNA, 22 nt, Human
ugcaggaguccaaucaggagac

SEQ ID NO: 464992 - RNA, 22 nt, Human
auaauaacaccugaauaggaaa

SEQ ID NO: 464993 - RNA, 22 nt, Human
cugccugcaugcugccauagcu

SEQ ID NO: 464994 - RNA, 22 nt, Human
gucaggauguuuauucuccagu

SEQ ID NO: 464995 - RNA, 22 nt, Human
ucaucacuguaucauugauaga

SEQ ID NO: 464996 - RNA, 22 nt, Human
uccucaugccgggucucacgcu

SEQ ID NO: 464997 - RNA, 22 nt, Human
ggaagccacccagcuuugauag

SEQ ID NO: 464998 - RNA, 22 nt, Human
aaauguguuuagaugguuuauu

SEQ ID NO: 464999 - RNA, 20 nt, Human
auucuacaagaauaagcaug

SEQ ID NO: 465000 - RNA, 22 nt, Human
cuggcagcugcccgagaugccc

SEQ ID NO: 465001 - RNA, 22 nt, Human
gcauuauuaauagcugcaugag

SEQ ID NO: 465002 - RNA, 22 nt, Human
gugcucacugugagacguccug

SEQ ID NO: 465003 - RNA, 21 nt, Human
ccaccaggucuucugcucggg

SEQ ID NO: 465004 - RNA, 20 nt, Human
uacagaaacaggacuuuugg

SEQ ID NO: 465005 - RNA, 22 nt, Human
uccaggcaaaaaccaacuacag

SEQ ID NO: 465006 - RNA, 22 nt, Human
gcagggcuaauggggcaaguag

SEQ ID NO: 465007 - RNA, 22 nt, Human
uggcuggcccugggagugcaga

SEQ ID NO: 465008 - RNA, 22 nt, Human
ucucagagauucagggagaagu

SEQ ID NO: 465009 - RNA, 22 nt, Human
ggcagcaggagccaucugguag

SEQ ID NO: 465010 - RNA, 22 nt, Human
agccuggagaagauguguauug

SEQ ID NO: 465011 - RNA, 22 nt, Human
uucauuccugagcccauauuua

SEQ ID NO: 465012 - RNA, 22 nt, Human
aggccucagugaucaucaucag

SEQ ID NO: 465013 - RNA, 22 nt, Human
agaauguagucuuggagauuua

SEQ ID NO: 465014 - RNA, 22 nt, Human
ucaguuuucucaucuguaauuu

SEQ ID NO: 465015 - RNA, 22 nt, Human
agcagccauagauagcaugcaa

SEQ ID NO: 465016 - RNA, 21 nt, Human
agagaagaggacuuucucaca

SEQ ID NO: 465017 - RNA, 20 nt, Human
gaaauucucguauuaguuua

SEQ ID NO: 465018 - RNA, 19 nt, Human
uggcagggagugauauuag

SEQ ID NO: 465019 - RNA, 20 nt, Human
agagugagacuccaucucag

SEQ ID NO: 465020 - RNA, 22 nt, Human
aacaugaaguuuucuauaguga

SEQ ID NO: 465021 - RNA, 22 nt, Human
auguaguauuuggaaauguaaa

SEQ ID NO: 465022 - RNA, 22 nt, Human
cuugugcaauugacauugaauc

SEQ ID NO: 465023 - RNA, 22 nt, Human
cccccagccagcagugcucagc

SEQ ID NO: 465024 - RNA, 22 nt, Human
ucagggcagaauccaaagaauu

SEQ ID NO: 465025 - RNA, 22 nt, Human
ggccuuggugcucuguguugca

SEQ ID NO: 465026 - RNA, 22 nt, Human
gugauuucuaaucaucugaaug

SEQ ID NO: 465027 - RNA, 22 nt, Human
cucaaguaagaaacagaauugg

SEQ ID NO: 465028 - RNA, 22 nt, Human
ucugggagggagccucagaauc

SEQ ID NO: 465029 - RNA, 22 nt, Human
cacaggugcuccucggggagcu

SEQ ID NO: 465030 - RNA, 22 nt, Human
uaaauguguuagucaugguuuu

SEQ ID NO: 465031 - RNA, 22 nt, Human
cugggagcccgcguccuggugg

SEQ ID NO: 465032 - RNA, 22 nt, Human
guuauguaaucuaacacucagu

SEQ ID NO: 465033 - RNA, 19 nt, Human
ugagcaugcgagcugagaa

SEQ ID NO: 465034 - RNA, 22 nt, Human
ugaaugaguuuggcugcuguuc

SEQ ID NO: 465035 - RNA, 22 nt, Human
gaagagcuguagccugcucuuu

SEQ ID NO: 465036 - RNA, 21 nt, Human
ugccagggauuuacagagccu

SEQ ID NO: 465037 - RNA, 22 nt, Human
gccuggcacucacugaagaggc

SEQ ID NO: 465038 - RNA, 22 nt, Human
aaagccacguggccuggggagc

SEQ ID NO: 465039 - RNA, 19 nt, Human
cuguccuuggcugcacugu

SEQ ID NO: 465040 - RNA, 22 nt, Human
aguuggagugaacaugagauug

SEQ ID NO: 465041 - RNA, 22 nt, Human
aagaacuuccuaauauauuuuc

SEQ ID NO: 465042 - RNA, 22 nt, Human
gccccugggagcagagccacca

SEQ ID NO: 465043 - RNA, 22 nt, Human
cucuggaggccuaaggaagugg

SEQ ID NO: 465044 - RNA, 22 nt, Human
uggaggaaaauuacuggggucu

SEQ ID NO: 465045 - RNA, 23 nt, Human
gccaggcuccggucuguggccac

SEQ ID NO: 465046 - RNA, 22 nt, Human
gggccaggucggugaaugguca

SEQ ID NO: 465047 - RNA, 22 nt, Human
uucaggaucacuaaacccucca

SEQ ID NO: 465048 - RNA, 22 nt, Human
uggcugcagacaccuauggcag

SEQ ID NO: 465049 - RNA, 23 nt, Human
aggcacugaaugugucagugagu

SEQ ID NO: 465050 - RNA, 22 nt, Human
acauuucucuuagaguuggacu

SEQ ID NO: 465051 - RNA, 22 nt, Human
cagagccugcucacgucucugu

SEQ ID NO: 465052 - RNA, 22 nt, Human
uggccuggcugcccugucugga

SEQ ID NO: 465053 - RNA, 19 nt, Human
ucacaggcaucuccccaga

SEQ ID NO: 465054 - RNA, 22 nt, Human
gagaaagggaacuuacagagug

SEQ ID NO: 465055 - RNA, 22 nt, Human
ggcugccuucccugagccccgg

SEQ ID NO: 465056 - RNA, 22 nt, Human
ccagccagucccgcaugaccgc

SEQ ID NO: 465057 - RNA, 19 nt, Human
cugcugggugcugagggag

SEQ ID NO: 465058 - RNA, 22 nt, Human
ugucuccucauacugucauauu

SEQ ID NO: 465059 - RNA, 22 nt, Human
uuuuggucagguuggucucgaa

SEQ ID NO: 465060 - RNA, 22 nt, Human
cucaggauuaaggaaucuaaau

SEQ ID NO: 465061 - RNA, 21 nt, Human
aaguaaaucagagaaauaacc

SEQ ID NO: 465062 - RNA, 22 nt, Human
ggaggggcagccauggaacucc

SEQ ID NO: 465063 - RNA, 22 nt, Human
ucaucuuuccucaaaagaucca

SEQ ID NO: 465064 - RNA, 22 nt, Human
ucucugucugagccuggcagac

SEQ ID NO: 465065 - RNA, 22 nt, Human
ggucccugcugaagccuuggug

SEQ ID NO: 465066 - RNA, 22 nt, Human
auuuuccaaaauaauuguuacu

SEQ ID NO: 465067 - RNA, 16 nt, Human
ccaccugcagcucuca

SEQ ID NO: 465068 - RNA, 22 nt, Human
aggcagccugguuugaauggaa

SEQ ID NO: 465069 - RNA, 22 nt, Human
gaaggucaccuccccucucugg

SEQ ID NO: 465070 - RNA, 22 nt, Human
acaaguaccaaaugcucaagua

SEQ ID NO: 465071 - RNA, 22 nt, Human
ccagcccuugagauggaaggga

SEQ ID NO: 465072 - RNA, 22 nt, Human
ccuccaggcugaauaucuagaa

SEQ ID NO: 465073 - RNA, 22 nt, Human
ucccggcgcugggagguggguc

SEQ ID NO: 465074 - RNA, 22 nt, Human
agaggcucugccgccucaggua

SEQ ID NO: 465075 - RNA, 22 nt, Human
cucccaggcacagggaggagcc

SEQ ID NO: 465076 - RNA, 20 nt, Human
aagaaacuugaaaguacaag

SEQ ID NO: 465077 - RNA, 22 nt, Human
ggucucagaucuuuauuaaggc

SEQ ID NO: 465078 - RNA, 22 nt, Human
agcugcagugaacuguuuuguc

SEQ ID NO: 465079 - RNA, 22 nt, Human
ucugggcccuaaaccagcucua

SEQ ID NO: 465080 - RNA, 22 nt, Human
ucugagccguauggcuuggcua

SEQ ID NO: 465081 - RNA, 22 nt, Human
cuguccugcaguugggggcagg

SEQ ID NO: 465082 - RNA, 22 nt, Human
ucaaaggcugcuugucuucugg

SEQ ID NO: 465083 - RNA, 22 nt, Human
uuugaaaggugucgagaugugu

SEQ ID NO: 465084 - RNA, 22 nt, Human
ucagaacauuuaaaaagugguu

SEQ ID NO: 465085 - RNA, 22 nt, Human
agagcugggugaagugccauca

SEQ ID NO: 465086 - RNA, 22 nt, Human
acagccugcagccccaggucgc

SEQ ID NO: 465087 - RNA, 22 nt, Human
uccugcaggccuguucccagua

SEQ ID NO: 465088 - RNA, 22 nt, Human
caggagcucuuaaggaugugau

SEQ ID NO: 465089 - RNA, 22 nt, Human
gaggcugcaggcaaugcugccc

SEQ ID NO: 465090 - RNA, 22 nt, Human
ggagcagagcauuucacagccu

SEQ ID NO: 465091 - RNA, 22 nt, Human
ugccaggcauguaguagacuug

SEQ ID NO: 465092 - RNA, 22 nt, Human
ucucaguguuuaaaaagauuuc

SEQ ID NO: 465093 - RNA, 22 nt, Human
ggaggccaaggugggcggauca

SEQ ID NO: 465094 - RNA, 21 nt, Human
uaaagaagaugaaugugauca

SEQ ID NO: 465095 - RNA, 22 nt, Human
cugcugugcuuguggccacccg

SEQ ID NO: 465096 - RNA, 22 nt, Human
uaaauuaugucacaugacucug

SEQ ID NO: 465097 - RNA, 22 nt, Human
uuuccucuuugugacacagcug

SEQ ID NO: 465098 - RNA, 22 nt, Human
augcuauacucaaagaaauuca

SEQ ID NO: 465099 - RNA, 22 nt, Human
gugucccaauguucaggacggc

SEQ ID NO: 465100 - RNA, 22 nt, Human
caaaugcagauucaggaguucu

SEQ ID NO: 465101 - RNA, 22 nt, Human
ggacaggaugcugaagaugaag

SEQ ID NO: 465102 - RNA, 22 nt, Human
uacaaaaaauugauacugacga

SEQ ID NO: 465103 - RNA, 22 nt, Human
gugccuuccccgguggucuguu

SEQ ID NO: 465104 - RNA, 22 nt, Human
guuagguagaaguuuacuuuga

SEQ ID NO: 465105 - RNA, 22 nt, Human
cucuggaauguuuacaugcccu

SEQ ID NO: 465106 - RNA, 22 nt, Human
aggacuccauguguccuggaga

SEQ ID NO: 465107 - RNA, 21 nt, Human
auuuccaaggguaccuaagau

SEQ ID NO: 465108 - RNA, 22 nt, Human
cagucaccaccagguggcagua

SEQ ID NO: 465109 - RNA, 22 nt, Human
cagagcugcacauucuaugaug

SEQ ID NO: 465110 - RNA, 22 nt, Human
ggcuguggcagcuggaaguggu

SEQ ID NO: 465111 - RNA, 22 nt, Human
agggcgacaauggagagcguuu

SEQ ID NO: 465112 - RNA, 22 nt, Human
gcucugggauuaccagccuuag

SEQ ID NO: 465113 - RNA, 22 nt, Human
aggagcagaccguaguccugca

SEQ ID NO: 465114 - RNA, 22 nt, Human
cugagagaaucaugcugcaggu

SEQ ID NO: 465115 - RNA, 23 nt, Human
aggcagugggggccacuuugcuu

SEQ ID NO: 465116 - RNA, 22 nt, Human
auccacagucuuagccaucaaa

SEQ ID NO: 465117 - RNA, 22 nt, Human
caggcagagaggagcauuuaau

SEQ ID NO: 465118 - RNA, 17 nt, Human
gcugccaccuuuggagc

SEQ ID NO: 465119 - RNA, 22 nt, Human
agggacuugaugucagggagau

SEQ ID NO: 465120 - RNA, 22 nt, Human
ggcugaaacagauuucaagaca

SEQ ID NO: 465121 - RNA, 22 nt, Human
gggcgccgugggaaacagccgg

SEQ ID NO: 465122 - RNA, 22 nt, Human
uaacagaauagcagaaacagaa

SEQ ID NO: 465123 - RNA, 22 nt, Human
cacaccuguaauaccagcuacu

SEQ ID NO: 465124 - RNA, 22 nt, Human
aagagcugcacauauuuauauc

SEQ ID NO: 465125 - RNA, 23 nt, Human
ucguugaauagcaauagcacaac

SEQ ID NO: 465126 - RNA, 22 nt, Human
uucacauuagugguucuauaua

SEQ ID NO: 465127 - RNA, 22 nt, Human
ucaggcagguuggcugcagguc

SEQ ID NO: 465128 - RNA, 19 nt, Human
gucagcaccauggacaggg

SEQ ID NO: 465129 - RNA, 23 nt, Human
acagagaucuugacuuguaugga

SEQ ID NO: 465130 - RNA, 22 nt, Human
gggcagguggcaaagccagagg

SEQ ID NO: 465131 - RNA, 22 nt, Human
auagucuuagaucagauaaagu

SEQ ID NO: 465132 - RNA, 22 nt, Human
uccaggcaaagugcugggcugc

SEQ ID NO: 465133 - RNA, 22 nt, Human
ucccccacucuaaaggagccuu

SEQ ID NO: 465134 - RNA, 22 nt, Human
cagggagcuggcuggcugugcc

SEQ ID NO: 465135 - RNA, 20 nt, Human
uagggcucauuaugaucucc

SEQ ID NO: 465136 - RNA, 22 nt, Human
aaaggccacugcaagggaaggu

SEQ ID NO: 465137 - RNA, 22 nt, Human
cugggcagugcagcuauagaac

SEQ ID NO: 465138 - RNA, 22 nt, Human
aaguugaagcaugaaccaaggu

SEQ ID NO: 465139 - RNA, 22 nt, Human
uugggcugaaguagagggcaga

SEQ ID NO: 465140 - RNA, 22 nt, Human
uagacacaagagaaggguauaa

SEQ ID NO: 465141 - RNA, 22 nt, Human
augaagauaagaccaggcugga

SEQ ID NO: 465142 - RNA, 22 nt, Human
gugggaugguagguagguaaua

SEQ ID NO: 465143 - RNA, 22 nt, Human
ccaggguguagggauuccagau

SEQ ID NO: 465144 - RNA, 22 nt, Human
ugccucagucuaaagucucuca

SEQ ID NO: 465145 - RNA, 22 nt, Human
ccuccuagaggaaccccagggc

SEQ ID NO: 465146 - RNA, 22 nt, Human
acuguguggaccacucugaggc

SEQ ID NO: 465147 - RNA, 22 nt, Human
gauuuucaugauaaacuuguga

SEQ ID NO: 465148 - RNA, 22 nt, Human
caaggcaguuccccagagggcu

SEQ ID NO: 465149 - RNA, 22 nt, Human
gagggcucacugagaaagcagu

SEQ ID NO: 465150 - RNA, 22 nt, Human
gccacguugccacccgggugac

SEQ ID NO: 465151 - RNA, 22 nt, Human
acagguggagugguuagcaggc

SEQ ID NO: 465152 - RNA, 19 nt, Human
ucgagucaagacacuaggc

SEQ ID NO: 465153 - RNA, 22 nt, Human
caggcugggaacgccacccgcu

SEQ ID NO: 465154 - RNA, 19 nt, Human
agguggucuaggcuggaga

SEQ ID NO: 465155 - RNA, 22 nt, Human
agaacagaagggaggaaggccu

SEQ ID NO: 465156 - RNA, 22 nt, Human
ccugggcuucugucuagauguu

SEQ ID NO: 465157 - RNA, 22 nt, Human
acuuugcaauacuuaauacaaa

SEQ ID NO: 465158 - RNA, 22 nt, Human
cagcagcuucuguugaucagaa

SEQ ID NO: 465159 - RNA, 22 nt, Human
ugccaggcccugcgggguccca

SEQ ID NO: 465160 - RNA, 22 nt, Human
uggcugccuuucaccucaucuc

SEQ ID NO: 465161 - RNA, 22 nt, Human
ucaagagaagugcuccacagua

SEQ ID NO: 465162 - RNA, 22 nt, Human
cucacagaugcugugggucagg

SEQ ID NO: 465163 - RNA, 22 nt, Human
cuucugugcuucacaguugcca

SEQ ID NO: 465164 - RNA, 22 nt, Human
gccuucaguagugucagcugua

SEQ ID NO: 465165 - RNA, 22 nt, Human
ggggccuguagagcuucaggga

SEQ ID NO: 465166 - RNA, 22 nt, Human
uggaccugagccuggcccugcc

SEQ ID NO: 465167 - RNA, 22 nt, Human
cccugcagcauucucuaacugg

SEQ ID NO: 465168 - RNA, 22 nt, Human
agcccccaaaagugcuuaugau

SEQ ID NO: 465169 - RNA, 22 nt, Human
ccagggccaguaagauuggcau

SEQ ID NO: 465170 - RNA, 22 nt, Human
ugggcagguuguuauuugacau

SEQ ID NO: 465171 - RNA, 22 nt, Human
ggcugccaggagggaggccagu

SEQ ID NO: 465172 - RNA, 22 nt, Human
cucagagaaaugucacaacaau

SEQ ID NO: 465173 - RNA, 22 nt, Human
augaggcagcugcuggagaacg

SEQ ID NO: 465174 - RNA, 22 nt, Human
uccugccucuuuucuuauucca

SEQ ID NO: 465175 - RNA, 22 nt, Human
acaaaggcaggauugacuuagu

SEQ ID NO: 465176 - RNA, 21 nt, Human
agggaaagaaaaugagcuaau

SEQ ID NO: 465177 - RNA, 22 nt, Human
aagucuguuugagugucacacu

SEQ ID NO: 465178 - RNA, 22 nt, Human
uggagauggguuaauggagaga

SEQ ID NO: 465179 - RNA, 22 nt, Human
uauuuucuggacagucuugcuu

SEQ ID NO: 465180 - RNA, 22 nt, Human
ucauuuuucacacagggucacc

SEQ ID NO: 465181 - RNA, 22 nt, Human
ccagagggcaaaaugaagcuua

SEQ ID NO: 465182 - RNA, 21 nt, Human
agcagaggggacauguuugau

SEQ ID NO: 465183 - RNA, 22 nt, Human
cugcuccacaccuccauuuccu

SEQ ID NO: 465184 - RNA, 22 nt, Human
ucauugucuugauaugauuguc

SEQ ID NO: 465185 - RNA, 22 nt, Human
ggaaggucgagcugcaucuggc

SEQ ID NO: 465186 - RNA, 22 nt, Human
uuccaggggcagcagugauggu

SEQ ID NO: 465187 - RNA, 22 nt, Human
agggccucugacgcccccagcc

SEQ ID NO: 465188 - RNA, 22 nt, Human
ccaaggagcaaguuuacaccug

SEQ ID NO: 465189 - RNA, 22 nt, Human
ucacaggagggagagacaccca

SEQ ID NO: 465190 - RNA, 22 nt, Human
agcuuuaucccuugcccaucga

SEQ ID NO: 465191 - RNA, 20 nt, Human
aggcucagagcaguaguaca

SEQ ID NO: 465192 - RNA, 22 nt, Human
ugccaggcacgugagaguggcc

SEQ ID NO: 465193 - RNA, 22 nt, Human
gaggccuggaccagccacagag

SEQ ID NO: 465194 - RNA, 18 nt, Human
cucagggcaucagucugg

SEQ ID NO: 465195 - RNA, 19 nt, Human
ccuggaggugaagguucuc

SEQ ID NO: 465196 - RNA, 20 nt, Human
uauuucugggcaaccauuua

SEQ ID NO: 465197 - RNA, 22 nt, Human
ugucucugugacuccuuccgcc

SEQ ID NO: 465198 - RNA, 22 nt, Human
uccugcugagcgucugucauuu

SEQ ID NO: 465199 - RNA, 22 nt, Human
uauaauuuuagaagagauggaa

SEQ ID NO: 465200 - RNA, 22 nt, Human
agggugucagccacggaauggg

SEQ ID NO: 465201 - RNA, 22 nt, Human
cagugaggugcccagccugccc

SEQ ID NO: 465202 - RNA, 22 nt, Human
acccagcuggaugcauggaggc

SEQ ID NO: 465203 - RNA, 22 nt, Human
gaggaaaauggaguguaauuaa

SEQ ID NO: 465204 - RNA, 22 nt, Human
ucccugcagacguccugcgggu

SEQ ID NO: 465205 - RNA, 22 nt, Human
cuggguggcgucuggggccagu

SEQ ID NO: 465206 - RNA, 21 nt, Human
gcugugcacauaguagaagug

SEQ ID NO: 465207 - RNA, 22 nt, Human
cugggcugcaucaaagaggcau

SEQ ID NO: 465208 - RNA, 22 nt, Human
ugaaaggugacauuucuuggau

SEQ ID NO: 465209 - RNA, 22 nt, Human
aauuaggaauaaaugaguacuu

SEQ ID NO: 465210 - RNA, 22 nt, Human
ggccuucacgugaccuggcgug

SEQ ID NO: 465211 - RNA, 22 nt, Human
gccaccagggggcuccagugag

SEQ ID NO: 465212 - RNA, 23 nt, Human
uggcccugaaucuguccuggagg

SEQ ID NO: 465213 - RNA, 22 nt, Human
ggccucggcccacugcugcggu

SEQ ID NO: 465214 - RNA, 22 nt, Human
gcaguguuaggaauaaaaauga

SEQ ID NO: 465215 - RNA, 22 nt, Human
ccagguggacggcgaguacagg

SEQ ID NO: 465216 - RNA, 22 nt, Human
uauuuguugaguuguuaugucu

SEQ ID NO: 465217 - RNA, 22 nt, Human
uucauucauuacgugccaggca

SEQ ID NO: 465218 - RNA, 22 nt, Human
gccuccugaaaggaagagcucc

SEQ ID NO: 465219 - RNA, 22 nt, Human
ucucugggaaugggccugggua

SEQ ID NO: 465220 - RNA, 22 nt, Human
uggagaaggacagccugagaaa

SEQ ID NO: 465221 - RNA, 22 nt, Human
cucagcuggcaauucuggcucc

SEQ ID NO: 465222 - RNA, 22 nt, Human
ucacauucucagcaucuauaca

SEQ ID NO: 465223 - RNA, 22 nt, Human
caguggaggccuugggaccuuu

SEQ ID NO: 465224 - RNA, 22 nt, Human
ucagauggcacacagagccugc

SEQ ID NO: 465225 - RNA, 22 nt, Human
uucucuuagcuguaaagucaau

SEQ ID NO: 465226 - RNA, 22 nt, Human
auguaacaaaugguauacaugu

SEQ ID NO: 465227 - RNA, 22 nt, Human
uucuguuugccauauauaguag

SEQ ID NO: 465228 - RNA, 22 nt, Human
cugucaguucuuccagauagag

SEQ ID NO: 465229 - RNA, 22 nt, Human
uguguacaggccuugcuagacu

SEQ ID NO: 465230 - RNA, 22 nt, Human
uggggacacagagguucguugg

SEQ ID NO: 465231 - RNA, 22 nt, Human
uccaggcaugucccaagccgga

SEQ ID NO: 465232 - RNA, 22 nt, Human
uccagcuggggcaguggcuggg

SEQ ID NO: 465233 - RNA, 22 nt, Human
ucuccucucuuaccugguacaa

SEQ ID NO: 465234 - RNA, 22 nt, Human
ugaagccagcuuuggaagacac

SEQ ID NO: 465235 - RNA, 22 nt, Human
aggugccagugcuguggucccc

SEQ ID NO: 465236 - RNA, 17 nt, Human
gcuuccugugcugggga

SEQ ID NO: 465237 - RNA, 22 nt, Human
cugagagaugauauagcuuaau

SEQ ID NO: 465238 - RNA, 22 nt, Human
ugucugagugugccugggcauu

SEQ ID NO: 465239 - RNA, 22 nt, Human
acccaggagccgugagagguua

SEQ ID NO: 465240 - RNA, 22 nt, Human
agggaguguaaauggugcucag

SEQ ID NO: 465241 - RNA, 22 nt, Human
agcagugggugacagagcugag

SEQ ID NO: 465242 - RNA, 22 nt, Human
ggcucuggguucugcaaugcgu

SEQ ID NO: 465243 - RNA, 22 nt, Human
ugacuucaaaggcucuacuccu

SEQ ID NO: 465244 - RNA, 22 nt, Human
cucaggagcuuccucagcccau

SEQ ID NO: 465245 - RNA, 22 nt, Human
gagcagaacaggccggguggga

SEQ ID NO: 465246 - RNA, 22 nt, Human
agguccagcuguugcagccucc

SEQ ID NO: 465247 - RNA, 22 nt, Human
guguggcugauugacaugguca

SEQ ID NO: 465248 - RNA, 22 nt, Human
acagccaggagccaugggcagg

SEQ ID NO: 465249 - RNA, 22 nt, Human
ucuaugaaaagucuauucauuc

SEQ ID NO: 465250 - RNA, 22 nt, Human
gaagagcugcucagaacaugau

SEQ ID NO: 465251 - RNA, 22 nt, Human
gcugggaggaucucucccuguc

SEQ ID NO: 465252 - RNA, 22 nt, Human
cugugacagagcuugagugaga

SEQ ID NO: 465253 - RNA, 22 nt, Human
aguccaggaguugggugacauu

SEQ ID NO: 465254 - RNA, 22 nt, Human
gcugucuucacuuccugguuuc

SEQ ID NO: 465255 - RNA, 22 nt, Human
aaucagucauuagcucugaccu

SEQ ID NO: 465256 - RNA, 22 nt, Human
aaggcuaugaucuuuuucauga

SEQ ID NO: 465257 - RNA, 22 nt, Human
ugucuuuaaaauuaaacacauc

SEQ ID NO: 465258 - RNA, 22 nt, Human
agccaggcucaaggccugcucc

SEQ ID NO: 465259 - RNA, 22 nt, Human
cuuauuauaaaauccuguuuga

SEQ ID NO: 465260 - RNA, 22 nt, Human
agaugcagaaaaacuaagugau

SEQ ID NO: 465261 - RNA, 22 nt, Human
cagucccagacccagaaggugg

SEQ ID NO: 465262 - RNA, 22 nt, Human
cugauuccugauucaugcucuu

SEQ ID NO: 465263 - RNA, 22 nt, Human
ugggcuguggagcaccuuugca

SEQ ID NO: 465264 - RNA, 22 nt, Human
ugcagggagcucuggggugcag

SEQ ID NO: 465265 - RNA, 22 nt, Human
ucaugcaaggcugaaacauggu

SEQ ID NO: 465266 - RNA, 22 nt, Human
cugugcccuggccaggccucuc

SEQ ID NO: 465267 - RNA, 17 nt, Human
caaggccagcaucuuca

SEQ ID NO: 465268 - RNA, 22 nt, Human
gcauggcauuugaagguagaag

SEQ ID NO: 465269 - RNA, 22 nt, Human
ugcagccaggaaauauuugcug

SEQ ID NO: 465270 - RNA, 22 nt, Human
ccugggcaaaugccagagacaa

SEQ ID NO: 465271 - RNA, 22 nt, Human
agaguuaagacguacaugagug

SEQ ID NO: 465272 - RNA, 21 nt, Human
uuugagaauuggucagagugc

SEQ ID NO: 465273 - RNA, 21 nt, Human
ugaaaucugaugggacaaaug

SEQ ID NO: 465274 - RNA, 22 nt, Human
uugaaaggaauacagaggccua

SEQ ID NO: 465275 - RNA, 22 nt, Human
cccagcuccuuggaugggcagg

SEQ ID NO: 465276 - RNA, 22 nt, Human
gcucagagaaucagcagacacc

SEQ ID NO: 465277 - RNA, 22 nt, Human
agcagcugguaggaguggccac

SEQ ID NO: 465278 - RNA, 18 nt, Human
ugucauugccagggaagc

SEQ ID NO: 465279 - RNA, 22 nt, Human
ucaucugucccaggcuuuuuuc

SEQ ID NO: 465280 - RNA, 22 nt, Human
agggaggucuggcugcccugag

SEQ ID NO: 465281 - RNA, 22 nt, Human
uggcagagaauaaaucuugacu

SEQ ID NO: 465282 - RNA, 22 nt, Human
gaaggcacugaacuccuucugg

SEQ ID NO: 465283 - RNA, 19 nt, Human
gcaucagagcagaaggggu

SEQ ID NO: 465284 - RNA, 23 nt, Human
ccugggcauuggcugcagcuucu

SEQ ID NO: 465285 - RNA, 22 nt, Human
ugguuuaccccuguccuauauc

SEQ ID NO: 465286 - RNA, 22 nt, Human
cccagcacuuugaauaugucac

SEQ ID NO: 465287 - RNA, 22 nt, Human
uggggcuccuccuggcaggagg

SEQ ID NO: 465288 - RNA, 22 nt, Human
gggcuguaggagcuggaauggg

SEQ ID NO: 465289 - RNA, 22 nt, Human
ggcagcuguggacgucgucauu

SEQ ID NO: 465290 - RNA, 19 nt, Human
gggcuucugggaucaagag

SEQ ID NO: 465291 - RNA, 22 nt, Human
ugccugggggacuaaggccaaa

SEQ ID NO: 465292 - RNA, 22 nt, Human
auagaaauggcagcuggugcua

SEQ ID NO: 465293 - RNA, 22 nt, Human
ucauugcagacuaacaaucuca

SEQ ID NO: 465294 - RNA, 22 nt, Human
aacaugaaaaccuccacagcaa

SEQ ID NO: 465295 - RNA, 22 nt, Human
cagguuuagguggacgugcagg

SEQ ID NO: 465296 - RNA, 22 nt, Human
cagggccuuauccugccauuga

SEQ ID NO: 465297 - RNA, 22 nt, Human
agccuggcccugcugaacucug

SEQ ID NO: 465298 - RNA, 16 nt, Human
ggcaccagugaacaca

SEQ ID NO: 465299 - RNA, 22 nt, Human
ugcauuaugcuugugcuguaua

SEQ ID NO: 465300 - RNA, 22 nt, Human
cucuggagaacuccuugugucu

SEQ ID NO: 465301 - RNA, 22 nt, Human
ucagccugcgucauggugacac

SEQ ID NO: 465302 - RNA, 19 nt, Human
uccuuugaauaucaguuga

SEQ ID NO: 465303 - RNA, 22 nt, Human
aauuuuauuaacuggauguagc

SEQ ID NO: 465304 - RNA, 22 nt, Human
uccaggcagcccuuccugacuc

SEQ ID NO: 465305 - RNA, 20 nt, Human
cuguggcucaugcaucugcc

SEQ ID NO: 465306 - RNA, 22 nt, Human
uguacauagaucuugaaaauua

SEQ ID NO: 465307 - RNA, 22 nt, Human
cuggaggcacccuuagagaggc

SEQ ID NO: 465308 - RNA, 23 nt, Human
ucacacagcuggucagguacaga

SEQ ID NO: 465309 - RNA, 23 nt, Human
ggagccuggcauaugagacgcau

SEQ ID NO: 465310 - RNA, 22 nt, Human
uaaugcacauagaaguacuuag

SEQ ID NO: 465311 - RNA, 22 nt, Human
gccucugcaccaguacugugcc

SEQ ID NO: 465312 - RNA, 22 nt, Human
ucuguacauuuggggaccccag

SEQ ID NO: 465313 - RNA, 22 nt, Human
ucacuuaaaaauucuaguuaug

SEQ ID NO: 465314 - RNA, 22 nt, Human
gugucccaggccucuggaauua

SEQ ID NO: 465315 - RNA, 22 nt, Human
uugaggagcacuagucagguau

SEQ ID NO: 465316 - RNA, 18 nt, Human
ggacaucaucaggugcuu

SEQ ID NO: 465317 - RNA, 22 nt, Human
aaagucauguaaugauaugauu

SEQ ID NO: 465318 - RNA, 22 nt, Human
auguaacuucugugaaucugac

SEQ ID NO: 465319 - RNA, 22 nt, Human
acauuucuuugcuagacagcag

SEQ ID NO: 465320 - RNA, 22 nt, Human
aaugggagguaguaugggaggu

SEQ ID NO: 465321 - RNA, 22 nt, Human
uuucagauggagguuuaggaca

SEQ ID NO: 465322 - RNA, 22 nt, Human
agccaggauggucucgaucggc

SEQ ID NO: 465323 - RNA, 22 nt, Human
cggucaggugcagcguuggcac

SEQ ID NO: 465324 - RNA, 21 nt, Human
uguggcagauguugggaggca

SEQ ID NO: 465325 - RNA, 23 nt, Human
uggauaaagcugugcugcauagg

SEQ ID NO: 465326 - RNA, 19 nt, Human
cuggaaugagaacaugccc

SEQ ID NO: 465327 - RNA, 22 nt, Human
ccugagaggcccucucacuguc

SEQ ID NO: 465328 - RNA, 22 nt, Human
gagccuggagcuggaacgaagc

SEQ ID NO: 465329 - RNA, 22 nt, Human
uccucugccaaagggaguugcc

SEQ ID NO: 465330 - RNA, 21 nt, Human
uccaggaguggcugggcaggg

SEQ ID NO: 465331 - RNA, 22 nt, Human
uacaagauaagaauuggcaagg

SEQ ID NO: 465332 - RNA, 22 nt, Human
agccagccaguucacuaggaaa

SEQ ID NO: 465333 - RNA, 22 nt, Human
auucuggauuaucaguccacca

SEQ ID NO: 465334 - RNA, 22 nt, Human
aggaccagaggccagagucagc

SEQ ID NO: 465335 - RNA, 22 nt, Human
cccagcauggagugaggacuca

SEQ ID NO: 465336 - RNA, 22 nt, Human
ccauuugucaccucugcacucc

SEQ ID NO: 465337 - RNA, 22 nt, Human
aggcaggggagcuggaagggua

SEQ ID NO: 465338 - RNA, 22 nt, Human
agccaggauuggcugagccuua

SEQ ID NO: 465339 - RNA, 22 nt, Human
augcacaagaggcuagaaaaga

SEQ ID NO: 465340 - RNA, 22 nt, Human
uguguacaagaguguuuacugu

SEQ ID NO: 465341 - RNA, 22 nt, Human
ucaguuaagaggccacggcagu

SEQ ID NO: 465342 - RNA, 22 nt, Human
accaaggagacaaagguguauu

SEQ ID NO: 465343 - RNA, 22 nt, Human
cacagaggaaaggcaguuggua

SEQ ID NO: 465344 - RNA, 22 nt, Human
gccugggagagggauagugcag

SEQ ID NO: 465345 - RNA, 22 nt, Human
cuggcagggugggcuuugcuuu

SEQ ID NO: 465346 - RNA, 22 nt, Human
aagcagcacaguaauauuggug

SEQ ID NO: 465347 - RNA, 22 nt, Human
cagcacaguacaaggcacggau

SEQ ID NO: 465348 - RNA, 22 nt, Human
ucaggcuggagugcaguggcgc

SEQ ID NO: 465349 - RNA, 22 nt, Human
gaaacccaaacuaagacaguag

SEQ ID NO: 465350 - RNA, 22 nt, Human
uccugccuucauacugcuguau

SEQ ID NO: 465351 - RNA, 22 nt, Human
cagcuucugagcaagccagggg

SEQ ID NO: 465352 - RNA, 22 nt, Human
agaaaauuagauuuuacugugu

SEQ ID NO: 465353 - RNA, 23 nt, Human
ccugcagcugcuggggcuccacc

SEQ ID NO: 465354 - RNA, 22 nt, Human
uccuuccugcaggccaaguccu

SEQ ID NO: 465355 - RNA, 22 nt, Human
uuccauaaugagauucccagcc

SEQ ID NO: 465356 - RNA, 18 nt, Human
aagaggaggagcagguug

SEQ ID NO: 465357 - RNA, 22 nt, Human
caggcagcucaaccuugggagc

SEQ ID NO: 465358 - RNA, 21 nt, Human
uggcagaguugaguaguuaug

SEQ ID NO: 465359 - RNA, 22 nt, Human
acucaggaaaaauguagugaua

SEQ ID NO: 465360 - RNA, 20 nt, Human
gaggccucagccucagcucc

SEQ ID NO: 465361 - RNA, 22 nt, Human
cagaggccuauccaguguccau

SEQ ID NO: 465362 - RNA, 22 nt, Human
uuauuaggaaaaggucagaugu

SEQ ID NO: 465363 - RNA, 22 nt, Human
cacccaggcuggagugcagggg

SEQ ID NO: 465364 - RNA, 22 nt, Human
uccugggcugcagggaagagca

SEQ ID NO: 465365 - RNA, 22 nt, Human
acagggcagagaggcaggcuug

SEQ ID NO: 465366 - RNA, 22 nt, Human
uuuuucaucugauugauaacuc

SEQ ID NO: 465367 - RNA, 22 nt, Human
cacagggcuuugauggcugagu

SEQ ID NO: 465368 - RNA, 22 nt, Human
cucccaagggguaagggagcug

SEQ ID NO: 465369 - RNA, 22 nt, Human
augggaugaacuugaucugcuu

SEQ ID NO: 465370 - RNA, 22 nt, Human
auuaaauuuucacuaggcuccc

SEQ ID NO: 465371 - RNA, 22 nt, Human
gccucuggucccucaugcugug

SEQ ID NO: 465372 - RNA, 22 nt, Human
cugcucugcaaggcacagugau

SEQ ID NO: 465373 - RNA, 22 nt, Human
aggcugugauuccaccacucuc

SEQ ID NO: 465374 - RNA, 22 nt, Human
acacccagagcgccagugccga

SEQ ID NO: 465375 - RNA, 22 nt, Human
uuagaaaucaccucugaagauc

SEQ ID NO: 465376 - RNA, 22 nt, Human
uggauaaacucacuguaaguug

SEQ ID NO: 465377 - RNA, 22 nt, Human
agugaaauacugucguuuuuag

SEQ ID NO: 465378 - RNA, 22 nt, Human
ccagcucuagccccauguggcu

SEQ ID NO: 465379 - RNA, 23 nt, Human
agaaaagcuuggacacauggccu

SEQ ID NO: 465380 - RNA, 22 nt, Human
cagggccugagggcugcucugc

SEQ ID NO: 465381 - RNA, 22 nt, Human
ggccucugcccucacuccuguc

SEQ ID NO: 465382 - RNA, 22 nt, Human
ccuguacacaauuccgaggaua

SEQ ID NO: 465383 - RNA, 22 nt, Human
ucccagccuuccuuguggugaa

SEQ ID NO: 465384 - RNA, 22 nt, Human
auuauaggcuugagccaccgug

SEQ ID NO: 465385 - RNA, 22 nt, Human
ugagcagagucgcuccagagug

SEQ ID NO: 465386 - RNA, 22 nt, Human
cuuccaaacccaggguaugggc

SEQ ID NO: 465387 - RNA, 22 nt, Human
ccuggcagcgccgaagcuggcc

SEQ ID NO: 465388 - RNA, 22 nt, Human
ugcagaagauggucugagcacc

SEQ ID NO: 465389 - RNA, 22 nt, Human
ccagacuguggaguuccuggug

SEQ ID NO: 465390 - RNA, 22 nt, Human
cucuccuggggagcacacacac

SEQ ID NO: 465391 - RNA, 22 nt, Human
cacagcuuguuuagugacucac

SEQ ID NO: 465392 - RNA, 22 nt, Human
acagacaaguaguucagacaag

SEQ ID NO: 465393 - RNA, 22 nt, Human
uuugcauuuguuuagaaccuga

SEQ ID NO: 465394 - RNA, 22 nt, Human
gcuggggagggcgucaaggcca

SEQ ID NO: 465395 - RNA, 22 nt, Human
ucucagaguuugaaucuggagu

SEQ ID NO: 465396 - RNA, 22 nt, Human
uccucucagugugguuguggga

SEQ ID NO: 465397 - RNA, 22 nt, Human
aagggugggcccuggcagccau

SEQ ID NO: 465398 - RNA, 22 nt, Human
cagggcagggccacacccccug

SEQ ID NO: 465399 - RNA, 22 nt, Human
agggaccucuucuugcagcuga

SEQ ID NO: 465400 - RNA, 22 nt, Human
ucuuugcaggagcccuuugaac

SEQ ID NO: 465401 - RNA, 22 nt, Human
aucuuuaggaaccuaaccuauu

SEQ ID NO: 465402 - RNA, 16 nt, Human
gcacacacaucaauga

SEQ ID NO: 465403 - RNA, 19 nt, Human
auacacauacguaaacuga

SEQ ID NO: 465404 - RNA, 22 nt, Human
uuccuguaugucagugaagagc

SEQ ID NO: 465405 - RNA, 21 nt, Human
agucccaggggugagugaugu

SEQ ID NO: 465406 - RNA, 22 nt, Human
uuucuguagggauuucacaguu

SEQ ID NO: 465407 - RNA, 22 nt, Human
uccgcccgcacguauggagugg

SEQ ID NO: 465408 - RNA, 22 nt, Human
gcugcucucucccuaaguuggg

SEQ ID NO: 465409 - RNA, 22 nt, Human
gcuuuccuggcccugucccugc

SEQ ID NO: 465410 - RNA, 22 nt, Human
aaggaagagucuagaacaggca

SEQ ID NO: 465411 - RNA, 22 nt, Human
augcauaauguauguauugacu

SEQ ID NO: 465412 - RNA, 22 nt, Human
uucuacuuuggacauaaaggac

SEQ ID NO: 465413 - RNA, 23 nt, Human
agugagcagcuguagggcaagga

SEQ ID NO: 465414 - RNA, 22 nt, Human
uggcuuccugcauggauccucu

SEQ ID NO: 465415 - RNA, 18 nt, Human
cccagugcucacugccuc

SEQ ID NO: 465416 - RNA, 22 nt, Human
uuagcaucugcuguaagcuuau

SEQ ID NO: 465417 - RNA, 22 nt, Human
ccaggcugccgaggaaagaaag

SEQ ID NO: 465418 - RNA, 21 nt, Human
aggcucccagaaaugggcauc

SEQ ID NO: 465419 - RNA, 22 nt, Human
acaggcucucagccaguuggca

SEQ ID NO: 465420 - RNA, 22 nt, Human
agccuggagcuugaguuaugag

SEQ ID NO: 465421 - RNA, 18 nt, Human
uggcagcaggaagccauu

SEQ ID NO: 465422 - RNA, 22 nt, Human
ccgggccucgggacaccgggua

SEQ ID NO: 465423 - RNA, 22 nt, Human
ccaaggcaggggaucaaaguuu

SEQ ID NO: 465424 - RNA, 21 nt, Human
ggcagugaugugaagugcauc

SEQ ID NO: 465425 - RNA, 22 nt, Human
uggcuuccugcacagugucugc

SEQ ID NO: 465426 - RNA, 22 nt, Human
ugccugcucuuaccacucuccc

SEQ ID NO: 465427 - RNA, 22 nt, Human
auuuugaaaccaaguuauuucc

SEQ ID NO: 465428 - RNA, 22 nt, Human
guguuuccaguucagaaagcaa

SEQ ID NO: 465429 - RNA, 22 nt, Human
aagccagguguuuaggccagcg

SEQ ID NO: 465430 - RNA, 22 nt, Human
gaggaaccaaucugugauauuc

SEQ ID NO: 465431 - RNA, 22 nt, Human
ggccugagucacaucaggagag

SEQ ID NO: 465432 - RNA, 22 nt, Human
agggacuggcucucugagcagg

SEQ ID NO: 465433 - RNA, 22 nt, Human
cuuagaugaagucacagaaccc

SEQ ID NO: 465434 - RNA, 22 nt, Human
ggcucaggccagaccacgacuc

SEQ ID NO: 465435 - RNA, 22 nt, Human
uaggccaguggcagguugugug

SEQ ID NO: 465436 - RNA, 22 nt, Human
cagucccacaagaucuccacaa

SEQ ID NO: 465437 - RNA, 17 nt, Human
ucaggcugggugcagug

SEQ ID NO: 465438 - RNA, 22 nt, Human
ugcagggcccuugggguugaac

SEQ ID NO: 465439 - RNA, 22 nt, Human
ccuagagcucugcuuuaucuaa

SEQ ID NO: 465440 - RNA, 22 nt, Human
ccuuucucauuuuaagcauuag

SEQ ID NO: 465441 - RNA, 22 nt, Human
ucacaggguaucugggauggau

SEQ ID NO: 465442 - RNA, 17 nt, Human
uggagcugcguguguuc

SEQ ID NO: 465443 - RNA, 22 nt, Human
cagucccaugagcccagaacau

SEQ ID NO: 465444 - RNA, 20 nt, Human
auuuggcaugaaguauugau

SEQ ID NO: 465445 - RNA, 22 nt, Human
ccuggccaggcauggagucaca

SEQ ID NO: 465446 - RNA, 22 nt, Human
uucuggaggccccuuccuucuc

SEQ ID NO: 465447 - RNA, 22 nt, Human
uccaggagguagugcuuaauuu

SEQ ID NO: 465448 - RNA, 19 nt, Human
aggugaugugacucuagaa

SEQ ID NO: 465449 - RNA, 22 nt, Human
gcagaggagcaaguugcuacag

SEQ ID NO: 465450 - RNA, 22 nt, Human
uauugacaauuugugaaacuau

SEQ ID NO: 465451 - RNA, 22 nt, Human
ucaggugggaccugcuaggaca

SEQ ID NO: 465452 - RNA, 22 nt, Human
auuuucaugacuaccuuaaaua

SEQ ID NO: 465453 - RNA, 22 nt, Human
gccacccccaaguagguggucu

SEQ ID NO: 465454 - RNA, 22 nt, Human
acugcuuacaaaaggaaagaau

SEQ ID NO: 465455 - RNA, 17 nt, Human
aaucuguuuacagucag

SEQ ID NO: 465456 - RNA, 22 nt, Human
cuggggugagcagaaacagggg

SEQ ID NO: 465457 - RNA, 21 nt, Human
aacuuuagaaagacugggaag

SEQ ID NO: 465458 - RNA, 22 nt, Human
cagaagcacuaggaggaaacgu

SEQ ID NO: 465459 - RNA, 18 nt, Human
ugucucaggcugaaacag

SEQ ID NO: 465460 - RNA, 20 nt, Human
acagccagaggaggcagaca

SEQ ID NO: 465461 - RNA, 22 nt, Human
agucccagccuguaggauuggg

SEQ ID NO: 465462 - RNA, 22 nt, Human
cugcuguguuucacaccucugg

SEQ ID NO: 465463 - RNA, 22 nt, Human
gggaguggagagcaauggauga

SEQ ID NO: 465464 - RNA, 22 nt, Human
ucacuguauuugcugaugcaua

SEQ ID NO: 465465 - RNA, 22 nt, Human
aaagagcuucauuuccauuuau

SEQ ID NO: 465466 - RNA, 19 nt, Human
ccuggguccacucagacua

SEQ ID NO: 465467 - RNA, 18 nt, Human
agggaucaucacugcagc

SEQ ID NO: 465468 - RNA, 22 nt, Human
caggccugugaguugaggcccc

SEQ ID NO: 465469 - RNA, 22 nt, Human
auuguauuagcacaauacaauu

SEQ ID NO: 465470 - RNA, 22 nt, Human
caggaugcacuaggaaccaggg

SEQ ID NO: 465471 - RNA, 22 nt, Human
gcccagcaggacagagugguuu

SEQ ID NO: 465472 - RNA, 22 nt, Human
uuucacaugguacugccuguuu

SEQ ID NO: 465473 - RNA, 22 nt, Human
gcacaugagcugcugggauggg

SEQ ID NO: 465474 - RNA, 22 nt, Human
ggcagaccucuccagccccaca

SEQ ID NO: 465475 - RNA, 22 nt, Human
agcagcauucucugguaugggg

SEQ ID NO: 465476 - RNA, 22 nt, Human
gauccucuuuuccuaggaaggu

SEQ ID NO: 465477 - RNA, 22 nt, Human
auucagcauaaucaguagcuug

SEQ ID NO: 465478 - RNA, 22 nt, Human
ugaggccugaagccuggagccu

SEQ ID NO: 465479 - RNA, 22 nt, Human
ucagcuggcaguucagaggcug

SEQ ID NO: 465480 - RNA, 22 nt, Human
aguuuuauuccaaugugcagca

SEQ ID NO: 465481 - RNA, 22 nt, Human
uuccauuuauucuuguccagau

SEQ ID NO: 465482 - RNA, 22 nt, Human
auucauuccaggucagucagac

SEQ ID NO: 465483 - RNA, 22 nt, Human
ccugaagggacuccagagagca

SEQ ID NO: 465484 - RNA, 22 nt, Human
acagggcagagggcaguuggua

SEQ ID NO: 465485 - RNA, 22 nt, Human
agucaauuaucucuaggucauc

SEQ ID NO: 465486 - RNA, 22 nt, Human
cccuggugguacggcacuggca

SEQ ID NO: 465487 - RNA, 22 nt, Human
ucagagagaaauaguuuuugac

SEQ ID NO: 465488 - RNA, 22 nt, Human
gugucccaaucuacuuuucccu

SEQ ID NO: 465489 - RNA, 22 nt, Human
gguuccaccuggcgagggguau

SEQ ID NO: 465490 - RNA, 20 nt, Human
agugcaagaaagcacagcug

SEQ ID NO: 465491 - RNA, 22 nt, Human
acaaagaucuugcuuuccuacu

SEQ ID NO: 465492 - RNA, 22 nt, Human
aggugcuggaguagaagaaaaa

SEQ ID NO: 465493 - RNA, 22 nt, Human
gggcugugggacccggcacuuu

SEQ ID NO: 465494 - RNA, 22 nt, Human
uucucaggugaggcugaggcug

SEQ ID NO: 465495 - RNA, 22 nt, Human
gagccugggacugggggucaug

SEQ ID NO: 465496 - RNA, 22 nt, Human
uugaaaggugaacaugaugcac

SEQ ID NO: 465497 - RNA, 22 nt, Human
gagacugcauuguccaaggguu

SEQ ID NO: 465498 - RNA, 22 nt, Human
agccugguuuaagcauuuuaua

SEQ ID NO: 465499 - RNA, 22 nt, Human
ucauuucuguugugcaucacug

SEQ ID NO: 465500 - RNA, 22 nt, Human
ucagcuuuccuugcuuuagauu

SEQ ID NO: 465501 - RNA, 23 nt, Human
aagaauaaaugacauuaaaggug

SEQ ID NO: 465502 - RNA, 22 nt, Human
aggcuuccgaguagcugggacu

SEQ ID NO: 465503 - RNA, 22 nt, Human
uuugaaaauuagacacaggcua

SEQ ID NO: 465504 - RNA, 22 nt, Human
uggcugagagcaauugacucug

SEQ ID NO: 465505 - RNA, 22 nt, Human
aaauccuaccaagaaauucccu

SEQ ID NO: 465506 - RNA, 22 nt, Human
aagaaugucguugguauuuuaa

SEQ ID NO: 465507 - RNA, 22 nt, Human
ccacagggauaggaauggggcu

SEQ ID NO: 465508 - RNA, 19 nt, Human
agugucaucagcuacucag

SEQ ID NO: 465509 - RNA, 22 nt, Human
agccuggaggccaggagacagu

SEQ ID NO: 465510 - RNA, 22 nt, Human
ugcucuggguccugggccuccu

SEQ ID NO: 465511 - RNA, 22 nt, Human
uggcagaggaggcucagauuga

SEQ ID NO: 465512 - RNA, 21 nt, Human
ggacaccagucacacuggauu

SEQ ID NO: 465513 - RNA, 22 nt, Human
agccaggaaccagcuacagucu

SEQ ID NO: 465514 - RNA, 19 nt, Human
ggucacagggguuacaagg

SEQ ID NO: 465515 - RNA, 22 nt, Human
ucgugucagaucagagguuccu

SEQ ID NO: 465516 - RNA, 22 nt, Human
ugguccagaugccuuggcuuua

SEQ ID NO: 465517 - RNA, 22 nt, Human
cccaggaggcagaaguugcagu

SEQ ID NO: 465518 - RNA, 22 nt, Human
uagagcauuuagaggggcagga

SEQ ID NO: 465519 - RNA, 22 nt, Human
gagcuucccucugcagucccug

SEQ ID NO: 465520 - RNA, 22 nt, Human
uugaaaguuaucuagauucuga

SEQ ID NO: 465521 - RNA, 22 nt, Human
ugucaugccaccguuucccaga

SEQ ID NO: 465522 - RNA, 22 nt, Human
aucaaaguuucccagaaguugu

SEQ ID NO: 465523 - RNA, 22 nt, Human
uucuaguuuugccuuaucaaca

SEQ ID NO: 465524 - RNA, 22 nt, Human
ccugccuggcugucagcagagc

SEQ ID NO: 465525 - RNA, 22 nt, Human
gggacuucauagcuaggcacuu

SEQ ID NO: 465526 - RNA, 22 nt, Human
auuucucagugaaaugacaggc

SEQ ID NO: 465527 - RNA, 22 nt, Human
gacuacucaaacuuucucuaua

SEQ ID NO: 465528 - RNA, 22 nt, Human
aaggcacugaacuuaaauucug

SEQ ID NO: 465529 - RNA, 22 nt, Human
guuucaaaagucaggcuauucu

SEQ ID NO: 465530 - RNA, 22 nt, Human
cugccaggggccucacaggcca

SEQ ID NO: 465531 - RNA, 22 nt, Human
uaucugcaucugcauguguauu

SEQ ID NO: 465532 - RNA, 22 nt, Human
aaagauuugaaauuaggcauca

SEQ ID NO: 465533 - RNA, 22 nt, Human
uacccaggggcugagcagaggu

SEQ ID NO: 465534 - RNA, 22 nt, Human
cagcugaacauguagagcaucu

SEQ ID NO: 465535 - RNA, 22 nt, Human
aaagaaggaccuggaggaggau

SEQ ID NO: 465536 - RNA, 16 nt, Human
uccaggcauaucugag

SEQ ID NO: 465537 - RNA, 22 nt, Human
cugugugcugaaaugcagugag

SEQ ID NO: 465538 - RNA, 22 nt, Human
uugaagcagagaaauacuugaa

SEQ ID NO: 465539 - RNA, 22 nt, Human
cagcugagaccagaaugcaggu

SEQ ID NO: 465540 - RNA, 22 nt, Human
ucagagaaaugaaguagggauu

SEQ ID NO: 465541 - RNA, 22 nt, Human
accugccucagugcagcuggau

SEQ ID NO: 465542 - RNA, 22 nt, Human
cagggccugccugguuccugga

SEQ ID NO: 465543 - RNA, 22 nt, Human
caggugucuaauucucaccccc

SEQ ID NO: 465544 - RNA, 20 nt, Human
guauuagguguuccucuuuc

SEQ ID NO: 465545 - RNA, 23 nt, Human
uggcccugugcaugcugcuuccc

SEQ ID NO: 465546 - RNA, 22 nt, Human
cugaaggauuagagagcacuua

SEQ ID NO: 465547 - RNA, 22 nt, Human
ggcagauguuauaugaucugag

SEQ ID NO: 465548 - RNA, 20 nt, Human
uuacucaguuccugccaugc

SEQ ID NO: 465549 - RNA, 22 nt, Human
ugagggaguuggguguauagga

SEQ ID NO: 465550 - RNA, 22 nt, Human
gguacaaggagugaagguuugg

SEQ ID NO: 465551 - RNA, 22 nt, Human
agcuggaggggccagcaggugu

SEQ ID NO: 465552 - RNA, 22 nt, Human
ugugcugguacaugugaggaug

SEQ ID NO: 465553 - RNA, 22 nt, Human
uggcccugcagaacuagccugg

SEQ ID NO: 465554 - RNA, 22 nt, Human
ggcucagggaaugaggaagaau

SEQ ID NO: 465555 - RNA, 22 nt, Human
ucugcagcuugcacaggcaggc

SEQ ID NO: 465556 - RNA, 22 nt, Human
agcaugcugguguucauggcag

SEQ ID NO: 465557 - RNA, 21 nt, Human
ggacuuacauagguaaggggu

SEQ ID NO: 465558 - RNA, 22 nt, Human
uuguuuguaugcugagaagaau

SEQ ID NO: 465559 - RNA, 22 nt, Human
ccaggagcaccaggccugugcc

SEQ ID NO: 465560 - RNA, 22 nt, Human
auuuaguguguauugcuauuau

SEQ ID NO: 465561 - RNA, 20 nt, Human
cugcugugugugccucagcc

SEQ ID NO: 465562 - RNA, 21 nt, Human
ggugggcacaggagagcagag

SEQ ID NO: 465563 - RNA, 22 nt, Human
gcucacugccauucucuagaug

SEQ ID NO: 465564 - RNA, 22 nt, Human
aagagcugugggugguaguccu

SEQ ID NO: 465565 - RNA, 22 nt, Human
gccagagccggcuucacaggau

SEQ ID NO: 465566 - RNA, 22 nt, Human
gccuucaggaggguuccagaca

SEQ ID NO: 465567 - RNA, 21 nt, Human
ucuuguccuugcucucccacu

SEQ ID NO: 465568 - RNA, 22 nt, Human
acaggcagguccugucccagcu

SEQ ID NO: 465569 - RNA, 22 nt, Human
aaggaagauauaucaagcuuaa

SEQ ID NO: 465570 - RNA, 22 nt, Human
cugagcugcucccgcugcagcg

SEQ ID NO: 465571 - RNA, 22 nt, Human
guggcagagggugagcuggacu

SEQ ID NO: 465572 - RNA, 22 nt, Human
ccuccugggccuugcucuguga

SEQ ID NO: 465573 - RNA, 22 nt, Human
cagggcagagggaaacuccuuu

SEQ ID NO: 465574 - RNA, 22 nt, Human
uaguuaggguucugcagagaca

SEQ ID NO: 465575 - RNA, 22 nt, Human
cuuuacaaagcaauuuugucuc

SEQ ID NO: 465576 - RNA, 22 nt, Human
ccaggauggggagcagauagaa

SEQ ID NO: 465577 - RNA, 20 nt, Human
ucagccagcuaacaugggga

SEQ ID NO: 465578 - RNA, 17 nt, Human
ugcauuguuggaaauuu

SEQ ID NO: 465579 - RNA, 22 nt, Human
ugggggagauugugcaucucua

SEQ ID NO: 465580 - RNA, 22 nt, Human
ggcugcugguggaaugguaggc

SEQ ID NO: 465581 - RNA, 22 nt, Human
aaaugcaggaaauuaugcuuuu

SEQ ID NO: 465582 - RNA, 22 nt, Human
uguacuugaacuugacuguaga

SEQ ID NO: 465583 - RNA, 22 nt, Human
uggguaaacugggucuggagag

SEQ ID NO: 465584 - RNA, 22 nt, Human
gcagugaacauaacacagaagg

SEQ ID NO: 465585 - RNA, 21 nt, Human
gcugcaucaaucuacccaggg

SEQ ID NO: 465586 - RNA, 22 nt, Human
agagccuugaagaucuggaaaa

SEQ ID NO: 465587 - RNA, 22 nt, Human
agcauuuaguuaguaaauguuu

SEQ ID NO: 465588 - RNA, 22 nt, Human
cagguacauucguagacccauu

SEQ ID NO: 465589 - RNA, 22 nt, Human
ugcugcucaaugagaugccauc

SEQ ID NO: 465590 - RNA, 22 nt, Human
cacugcucgcugcagcauggcc

SEQ ID NO: 465591 - RNA, 22 nt, Human
guuauugcaguauagaggucua

SEQ ID NO: 465592 - RNA, 22 nt, Human
auacaaagcuaaauaugguuuc

SEQ ID NO: 465593 - RNA, 23 nt, Human
aggaacugaggccuagggaggua

SEQ ID NO: 465594 - RNA, 20 nt, Human
aauguauuguuuuguuucag

SEQ ID NO: 465595 - RNA, 22 nt, Human
gcugucaggaacaugccuuggu

SEQ ID NO: 465596 - RNA, 22 nt, Human
aggccugagguuccugugcuca

SEQ ID NO: 465597 - RNA, 22 nt, Human
ccucugcagcagagagccagag

SEQ ID NO: 465598 - RNA, 22 nt, Human
gcugucagugaggugagacaug

SEQ ID NO: 465599 - RNA, 22 nt, Human
uggcaggaaaaagggccagagg

SEQ ID NO: 465600 - RNA, 23 nt, Human
aaaguugauuugcaguuuaagag

SEQ ID NO: 465601 - RNA, 22 nt, Human
ggccuggcauggggacuaaggg

SEQ ID NO: 465602 - RNA, 21 nt, Human
uugaagcaaggguggcucuga

SEQ ID NO: 465603 - RNA, 22 nt, Human
cuguggcauugugaggacugca

SEQ ID NO: 465604 - RNA, 22 nt, Human
gccuggagcucaugugggcauu

SEQ ID NO: 465605 - RNA, 22 nt, Human
ccuucugcuggucaucccagug

SEQ ID NO: 465606 - RNA, 22 nt, Human
gaggagaaauuauccuuggugu

SEQ ID NO: 465607 - RNA, 22 nt, Human
aggaggccgauuucagaggucg

SEQ ID NO: 465608 - RNA, 22 nt, Human
aggcuucccagcugagcucagc

SEQ ID NO: 465609 - RNA, 22 nt, Human
aaagauuucacaucccaagccu

SEQ ID NO: 465610 - RNA, 22 nt, Human
cuguggcuaugguguacauacu

SEQ ID NO: 465611 - RNA, 22 nt, Human
caggaggcaucauggagcggac

SEQ ID NO: 465612 - RNA, 22 nt, Human
agaaauguauucuguauguuuu

SEQ ID NO: 465613 - RNA, 22 nt, Human
gaagaaggugcuacacagggca

SEQ ID NO: 465614 - RNA, 22 nt, Human
cauuugcaagagauaaauguuu

SEQ ID NO: 465615 - RNA, 22 nt, Human
ccaucccuucaccacagcagua

SEQ ID NO: 465616 - RNA, 22 nt, Human
cuccucugucuaccacgagggu

SEQ ID NO: 465617 - RNA, 17 nt, Human
aaggccauuuccaccca

SEQ ID NO: 465618 - RNA, 22 nt, Human
guaaaucccauccuuucucugg

SEQ ID NO: 465619 - RNA, 22 nt, Human
aaggguugaagauaaauaaggu

SEQ ID NO: 465620 - RNA, 23 nt, Human
uggcuccaugaaaauuacgagga

SEQ ID NO: 465621 - RNA, 22 nt, Human
ggccuuggggaggauggugucc

SEQ ID NO: 465622 - RNA, 22 nt, Human
uauauuaacacccacuugccuc

SEQ ID NO: 465623 - RNA, 22 nt, Human
ugaaaucuucacuaagucucuu

SEQ ID NO: 465624 - RNA, 22 nt, Human
gaggcuccccaugaggccccag

SEQ ID NO: 465625 - RNA, 22 nt, Human
agaucacaguggcaacucccuu

SEQ ID NO: 465626 - RNA, 23 nt, Human
aggcagagccaaggucaaaaccc

SEQ ID NO: 465627 - RNA, 22 nt, Human
aggcccagagcaggaaaggguu

SEQ ID NO: 465628 - RNA, 22 nt, Human
gagacagcagggccagggccug

SEQ ID NO: 465629 - RNA, 22 nt, Human
uccuggcccgaucccugugaag

SEQ ID NO: 465630 - RNA, 22 nt, Human
agugccuugugugugggcagcc

SEQ ID NO: 465631 - RNA, 22 nt, Human
cugccugcuucugagccagagg

SEQ ID NO: 465632 - RNA, 22 nt, Human
aggacuucaucaccuguauaaa

SEQ ID NO: 465633 - RNA, 19 nt, Human
agcuuccauauucucuagu

SEQ ID NO: 465634 - RNA, 22 nt, Human
guggggcaugcacgcugcuccu

SEQ ID NO: 465635 - RNA, 22 nt, Human
uuaacagauguuuauggagcau

SEQ ID NO: 465636 - RNA, 22 nt, Human
acacuacaaucucagaacuaua

SEQ ID NO: 465637 - RNA, 22 nt, Human
gcucagaggaugcuccuuuaug

SEQ ID NO: 465638 - RNA, 22 nt, Human
gagggccaacuagcaccacuuu

SEQ ID NO: 465639 - RNA, 19 nt, Human
ggagaggcuggagggaugc

SEQ ID NO: 465640 - RNA, 22 nt, Human
gcuggcagucccaucagcuggg

SEQ ID NO: 465641 - RNA, 22 nt, Human
auuucucacucacaguccaugu

SEQ ID NO: 465642 - RNA, 22 nt, Human
gugggcuggacccuccugcucc

SEQ ID NO: 465643 - RNA, 22 nt, Human
ugcauuguuuagaacucuuugg

SEQ ID NO: 465644 - RNA, 20 nt, Human
ccuaggcaugcugagucucc

SEQ ID NO: 465645 - RNA, 21 nt, Human
ucaggcagugcaaauacaugg

SEQ ID NO: 465646 - RNA, 22 nt, Human
auuagggcuggaugcaaggaaa

SEQ ID NO: 465647 - RNA, 22 nt, Human
acuguaaccaguguggugagag

SEQ ID NO: 465648 - RNA, 22 nt, Human
agcagacaacccagaugaccca

SEQ ID NO: 465649 - RNA, 23 nt, Human
agggcccaagccuggacagcagg

SEQ ID NO: 465650 - RNA, 22 nt, Human
acauuucuuagccuaguuccag

SEQ ID NO: 465651 - RNA, 22 nt, Human
aggcugagggcuccugagggca

SEQ ID NO: 465652 - RNA, 22 nt, Human
gaagucuggcugacgagaguua

SEQ ID NO: 465653 - RNA, 22 nt, Human
ucccuccuggugagcaggggcu

SEQ ID NO: 465654 - RNA, 22 nt, Human
ugcauuuuuaacaaggcuaauu

SEQ ID NO: 465655 - RNA, 22 nt, Human
auucuacaacccaauaauaauu

SEQ ID NO: 465656 - RNA, 22 nt, Human
uagggcuauucugaguaauaau

SEQ ID NO: 465657 - RNA, 22 nt, Human
ccugggagugugccaucucugu

SEQ ID NO: 465658 - RNA, 21 nt, Human
cccaggucguggucuucccag

SEQ ID NO: 465659 - RNA, 22 nt, Human
gugcccugguccccagcauaua

SEQ ID NO: 465660 - RNA, 22 nt, Human
agagagcauggcacagaggggu

SEQ ID NO: 465661 - RNA, 22 nt, Human
ugaaaucugcaugcaaaguccu

SEQ ID NO: 465662 - RNA, 22 nt, Human
ccaggaggcagaaguugcagug

SEQ ID NO: 465663 - RNA, 22 nt, Human
cugggcuggagugcaauggcgc

SEQ ID NO: 465664 - RNA, 22 nt, Human
uggcagagguaauucaaauccc

SEQ ID NO: 465665 - RNA, 22 nt, Human
gaugcagggcuggcaggagcuu

SEQ ID NO: 465666 - RNA, 22 nt, Human
uccagggagagccgcugcucca

SEQ ID NO: 465667 - RNA, 22 nt, Human
gagggcugauguugccaccuca

SEQ ID NO: 465668 - RNA, 22 nt, Human
auggcagagaaagcgagccaca

SEQ ID NO: 465669 - RNA, 22 nt, Human
agagccugcaucaggcuugggg

SEQ ID NO: 465670 - RNA, 22 nt, Human
cacaggaggaggugcccgggcc

SEQ ID NO: 465671 - RNA, 19 nt, Human
uggcagaggcaguuuguac

SEQ ID NO: 465672 - RNA, 22 nt, Human
ugauuuccccagucuugcugcu

SEQ ID NO: 465673 - RNA, 22 nt, Human
gcacagggagcaggucucuggu

SEQ ID NO: 465674 - RNA, 22 nt, Human
aggcacaggccucagcacccag

SEQ ID NO: 465675 - RNA, 22 nt, Human
uccugccucacaguugaaguuu

SEQ ID NO: 465676 - RNA, 22 nt, Human
uugaaaaaauugguagaggaug

SEQ ID NO: 465677 - RNA, 22 nt, Human
ggugaagguggaacgcagagca

SEQ ID NO: 465678 - RNA, 21 nt, Human
aagaagcaauuuauuggaagg

SEQ ID NO: 465679 - RNA, 22 nt, Human
aaggagaguacaggaguuggua

SEQ ID NO: 465680 - RNA, 22 nt, Human
ugcagcugaggccagcuaugcc

SEQ ID NO: 465681 - RNA, 22 nt, Human
ggagcuguaacgagccauugcu

SEQ ID NO: 465682 - RNA, 22 nt, Human
accaaaggcagagcugaacacu

SEQ ID NO: 465683 - RNA, 22 nt, Human
uagggcugugucuccaggacca

SEQ ID NO: 465684 - RNA, 22 nt, Human
gaaaaugugucaucccuacugu

SEQ ID NO: 465685 - RNA, 22 nt, Human
gagcugccaguguaugaauucu

SEQ ID NO: 465686 - RNA, 18 nt, Human
gggcacuggggacuggag

SEQ ID NO: 465687 - RNA, 22 nt, Human
uccuuuguugagauaaauuggg

SEQ ID NO: 465688 - RNA, 22 nt, Human
ugugacaucgcugugucuguuu

SEQ ID NO: 465689 - RNA, 22 nt, Human
ccaaguacagauuccuccacug

SEQ ID NO: 465690 - RNA, 22 nt, Human
agggccaccagagcagggcagu

SEQ ID NO: 465691 - RNA, 22 nt, Human
cagcuuugccaaguaaggucuu

SEQ ID NO: 465692 - RNA, 22 nt, Human
acacacuguugcucauccaggc

SEQ ID NO: 465693 - RNA, 23 nt, Human
uggggcugauggagacggaccag

SEQ ID NO: 465694 - RNA, 22 nt, Human
aauguguacaugacagauagaa

SEQ ID NO: 465695 - RNA, 22 nt, Human
aggcugcuucagcugcagggag

SEQ ID NO: 465696 - RNA, 22 nt, Human
ugcuuccugaggccgucuucuc

SEQ ID NO: 465697 - RNA, 22 nt, Human
cugcuguggaugcaggaccuca

SEQ ID NO: 465698 - RNA, 22 nt, Human
ccaggaguuugaggcugcagug

SEQ ID NO: 465699 - RNA, 22 nt, Human
ccaaggagcaaggcucaacaag

SEQ ID NO: 465700 - RNA, 22 nt, Human
gacagggcgagacucagucuca

SEQ ID NO: 465701 - RNA, 22 nt, Human
uggcucaggagggaucuuugcu

SEQ ID NO: 465702 - RNA, 22 nt, Human
ucaucacauaugucaugauuug

SEQ ID NO: 465703 - RNA, 22 nt, Human
caggcagcucgaugccuuguug

SEQ ID NO: 465704 - RNA, 22 nt, Human
acagcuuuguuuucccugcuga

SEQ ID NO: 465705 - RNA, 22 nt, Human
aaaauccacaacgcucauuuca

SEQ ID NO: 465706 - RNA, 22 nt, Human
uagcagggucucaggagucagg

SEQ ID NO: 465707 - RNA, 22 nt, Human
gccaggcugcuggcugcugucc

SEQ ID NO: 465708 - RNA, 22 nt, Human
uccaucaccacagaggacagag

SEQ ID NO: 465709 - RNA, 23 nt, Human
ccuggaguacuaaggggauggaa

SEQ ID NO: 465710 - RNA, 22 nt, Human
caggugggccaugaaaaaugac

SEQ ID NO: 465711 - RNA, 22 nt, Human
uccucagggaagaugagccuca

SEQ ID NO: 465712 - RNA, 22 nt, Human
agagccuguacuuuucugugaa

SEQ ID NO: 465713 - RNA, 22 nt, Human
aggcgugggaggaucugaggcc

SEQ ID NO: 465714 - RNA, 22 nt, Human
aggaaaugcugaugcuccugga

SEQ ID NO: 465715 - RNA, 22 nt, Human
augucuuucgcaucaguagcua

SEQ ID NO: 465716 - RNA, 22 nt, Human
cagggcccagucccugcuguca

SEQ ID NO: 465717 - RNA, 22 nt, Human
cagcaagauuuuuaaagcaagg

SEQ ID NO: 465718 - RNA, 22 nt, Human
uaccaggcagcugcacagaggc

SEQ ID NO: 465719 - RNA, 23 nt, Human
gagguacagcaccagugaauagg

SEQ ID NO: 465720 - RNA, 22 nt, Human
augaacacauguacacauuucu

SEQ ID NO: 465721 - RNA, 22 nt, Human
gcugagggcuguaacagcagag

SEQ ID NO: 465722 - RNA, 22 nt, Human
caguguuucugaguuccagcuc

SEQ ID NO: 465723 - RNA, 20 nt, Human
agucccagaucaaauuucug

SEQ ID NO: 465724 - RNA, 17 nt, Human
aagacagaagccaugag

SEQ ID NO: 465725 - RNA, 22 nt, Human
gccucugcggggcccgagcccg

SEQ ID NO: 465726 - RNA, 22 nt, Human
augaaggcuguguagauggaug

SEQ ID NO: 465727 - RNA, 22 nt, Human
ugggcuggugagggaucauuua

SEQ ID NO: 465728 - RNA, 22 nt, Human
gugugcagugagcaaaagaucu

SEQ ID NO: 465729 - RNA, 22 nt, Human
auguaacacccacuuuuauagc

SEQ ID NO: 465730 - RNA, 22 nt, Human
agggccuggcuucacuuucuca

SEQ ID NO: 465731 - RNA, 22 nt, Human
gcacacagauuaggaaacagaa

SEQ ID NO: 465732 - RNA, 22 nt, Human
uggguaggccaggaagcagugu

SEQ ID NO: 465733 - RNA, 22 nt, Human
uggcucugaccagguagaggag

SEQ ID NO: 465734 - RNA, 22 nt, Human
ugccucugugggccuuccuggc

SEQ ID NO: 465735 - RNA, 22 nt, Human
uuguccaaggucccacaguuag

SEQ ID NO: 465736 - RNA, 22 nt, Human
uccugggcugugugccacucug

SEQ ID NO: 465737 - RNA, 19 nt, Human
cuuauuagagugagagcuu

SEQ ID NO: 465738 - RNA, 22 nt, Human
ugggccuggagcccuggagagu

SEQ ID NO: 465739 - RNA, 22 nt, Human
uggcugaaucugcagcaggaag

SEQ ID NO: 465740 - RNA, 22 nt, Human
uuacuuuguucucaagauaugu

SEQ ID NO: 465741 - RNA, 22 nt, Human
ucagaggauuggacuuuuaugu

SEQ ID NO: 465742 - RNA, 22 nt, Human
uaagauaugguaggaaguuugg

SEQ ID NO: 465743 - RNA, 22 nt, Human
cuucccagaccuuagagugcag

SEQ ID NO: 465744 - RNA, 22 nt, Human
gcagaacauuucacaguaucuu

SEQ ID NO: 465745 - RNA, 22 nt, Human
uccagggaaggugugaggcugg

SEQ ID NO: 465746 - RNA, 22 nt, Human
cagucucuugcuucauuaguug

SEQ ID NO: 465747 - RNA, 22 nt, Human
cacagaagaaucaugcuguguu

SEQ ID NO: 465748 - RNA, 22 nt, Human
gagucacaaaagaugcccaggg

SEQ ID NO: 465749 - RNA, 22 nt, Human
agaaaucaugacuaagagcagu

SEQ ID NO: 465750 - RNA, 22 nt, Human
agaggaaguaaucaggaccugc

SEQ ID NO: 465751 - RNA, 22 nt, Human
cucucuggcuuggcacggagau

SEQ ID NO: 465752 - RNA, 22 nt, Human
ucccaaggccaggcaucuagaa

SEQ ID NO: 465753 - RNA, 22 nt, Human
ucagggcauguauguuucuuua

SEQ ID NO: 465754 - RNA, 22 nt, Human
cagccugggcuccagagucccu

SEQ ID NO: 465755 - RNA, 22 nt, Human
ccucugccaccucccacgaggc

SEQ ID NO: 465756 - RNA, 22 nt, Human
agcauggggcuccgcaaugaac

SEQ ID NO: 465757 - RNA, 22 nt, Human
gcccaugcacuuucugugaugg

SEQ ID NO: 465758 - RNA, 22 nt, Human
aggcucagggacggggccccuu

SEQ ID NO: 465759 - RNA, 22 nt, Human
uguucuugggaaucuuacaguu

SEQ ID NO: 465760 - RNA, 19 nt, Human
agagaaggauccuaugguu

SEQ ID NO: 465761 - RNA, 22 nt, Human
auaguuuucuaugcacuguuau

SEQ ID NO: 465762 - RNA, 22 nt, Human
cagggccugcuuccuucuuguu

SEQ ID NO: 465763 - RNA, 22 nt, Human
uagcuuuaaugaguugguaaga

SEQ ID NO: 465764 - RNA, 22 nt, Human
uucuugcaggucacucacugag

SEQ ID NO: 465765 - RNA, 21 nt, Human
aucagcaaaugccugucuccc

SEQ ID NO: 465766 - RNA, 22 nt, Human
ucuguacacuucagcaugcauc

SEQ ID NO: 465767 - RNA, 22 nt, Human
caggaggcagagguugcaguga

SEQ ID NO: 465768 - RNA, 22 nt, Human
uuauuauaaugagggauaaaaa

SEQ ID NO: 465769 - RNA, 22 nt, Human
ugaaggaaaugacggcagaaga

SEQ ID NO: 465770 - RNA, 22 nt, Human
gaggaugugucuggucugggca

SEQ ID NO: 465771 - RNA, 16 nt, Human
gagccaggugccuuga

SEQ ID NO: 465772 - RNA, 22 nt, Human
uauuaucauugguaauaugguc

SEQ ID NO: 465773 - RNA, 22 nt, Human
guuagggaucaggaacaagagc

SEQ ID NO: 465774 - RNA, 22 nt, Human
guggagcccugccuugcucaug

SEQ ID NO: 465775 - RNA, 22 nt, Human
ugugucagagguagagauggca

SEQ ID NO: 465776 - RNA, 22 nt, Human
aucaggaucacugggagucuug

SEQ ID NO: 465777 - RNA, 22 nt, Human
cauugcacaucugagaagagau

SEQ ID NO: 465778 - RNA, 22 nt, Human
ugauugaacugagcuucaagau

SEQ ID NO: 465779 - RNA, 22 nt, Human
cugaaggagaaggccacuguuc

SEQ ID NO: 465780 - RNA, 22 nt, Human
aguaacuaugcuugagaaucag

SEQ ID NO: 465781 - RNA, 22 nt, Human
cauuuauucauuugcuagggcu

SEQ ID NO: 465782 - RNA, 22 nt, Human
uucccucuccuacucaggaaag

SEQ ID NO: 465783 - RNA, 22 nt, Human
ucccacuggacgucugugcugg

SEQ ID NO: 465784 - RNA, 22 nt, Human
uccaggcauuccagccauucca

SEQ ID NO: 465785 - RNA, 22 nt, Human
uggccucucuaccaggcagccu

SEQ ID NO: 465786 - RNA, 18 nt, Human
uuccauaauguauguaac

SEQ ID NO: 465787 - RNA, 22 nt, Human
aggagcugcuuaaaugguuggu

SEQ ID NO: 465788 - RNA, 23 nt, Human
uggccucuccccaccuggcagaa

SEQ ID NO: 465789 - RNA, 22 nt, Human
ccaggugcucuugccagggcug

SEQ ID NO: 465790 - RNA, 22 nt, Human
gcacagggcugccaggcggcuu

SEQ ID NO: 465791 - RNA, 22 nt, Human
ccuuaaaagaacuaucucuucu

SEQ ID NO: 465792 - RNA, 22 nt, Human
cacaggcuuccaguccccagcu

SEQ ID NO: 465793 - RNA, 22 nt, Human
uagaaguuaaaggaauacagaa

SEQ ID NO: 465794 - RNA, 22 nt, Human
ucagaggauagaaauacuuauu

SEQ ID NO: 465795 - RNA, 22 nt, Human
cagggcuggguuaaaagcaggg

SEQ ID NO: 465796 - RNA, 22 nt, Human
gaauuagguaauagaacuagua

SEQ ID NO: 465797 - RNA, 22 nt, Human
uaugcauaauuggauaaguaga

SEQ ID NO: 465798 - RNA, 22 nt, Human
caaaugcaggucauaaccugag

SEQ ID NO: 465799 - RNA, 23 nt, Human
ugcaggggaggcuuaaagcaggu

SEQ ID NO: 465800 - RNA, 22 nt, Human
agacucugauucccucauguca

SEQ ID NO: 465801 - RNA, 22 nt, Human
cccucccagaugggcuugaggu

SEQ ID NO: 465802 - RNA, 22 nt, Human
ugucugucugcaagccagaaag

SEQ ID NO: 465803 - RNA, 22 nt, Human
cauucacagagggggaagcauc

SEQ ID NO: 465804 - RNA, 18 nt, Human
aguaguggguuuagcuuc

SEQ ID NO: 465805 - RNA, 21 nt, Human
ugcucacagaugugcucagug

SEQ ID NO: 465806 - RNA, 22 nt, Human
uacauaauugucuuuguccuca

SEQ ID NO: 465807 - RNA, 22 nt, Human
ucuccugguuuguuaaauaauu

SEQ ID NO: 465808 - RNA, 22 nt, Human
uguaugcuuuccaaaaaugcug

SEQ ID NO: 465809 - RNA, 19 nt, Human
ccugcagggaugagagguu

SEQ ID NO: 465810 - RNA, 22 nt, Human
agaaaugcauuagcacauauag

SEQ ID NO: 465811 - RNA, 22 nt, Human
cccucugcucaggugcauaggc

SEQ ID NO: 465812 - RNA, 22 nt, Human
gcagcccagguguagcucuuug

SEQ ID NO: 465813 - RNA, 22 nt, Human
uccauuuucuaaguaucacuua

SEQ ID NO: 465814 - RNA, 22 nt, Human
uuuguucaugccuauauucuca

SEQ ID NO: 465815 - RNA, 22 nt, Human
uggaggaaucagggcuuaggcu

SEQ ID NO: 465816 - RNA, 22 nt, Human
cugaggagagaucacguggugu

SEQ ID NO: 465817 - RNA, 22 nt, Human
ugucccucauugacgcugugcc

SEQ ID NO: 465818 - RNA, 22 nt, Human
augagcuucccagacaggaugg

SEQ ID NO: 465819 - RNA, 20 nt, Human
agccugccagcuggcccaga

SEQ ID NO: 465820 - RNA, 22 nt, Human
cagcaauaaugucuacaaaucu

SEQ ID NO: 465821 - RNA, 22 nt, Human
cagccugcagggcugccuguug

SEQ ID NO: 465822 - RNA, 21 nt, Human
gccagccuguuuaccuguggu

SEQ ID NO: 465823 - RNA, 22 nt, Human
ccagcugcuugggaaaaugucu

SEQ ID NO: 465824 - RNA, 22 nt, Human
ugggcagauuaaugcaguggcu

SEQ ID NO: 465825 - RNA, 22 nt, Human
aauuagggaaaauuuacuugua

SEQ ID NO: 465826 - RNA, 22 nt, Human
aucagagaaauggagggcgcuu

SEQ ID NO: 465827 - RNA, 22 nt, Human
uuguuuugcuaaagggucauca

SEQ ID NO: 465828 - RNA, 22 nt, Human
gucccagaggacagggucacau

SEQ ID NO: 465829 - RNA, 21 nt, Human
guccagagagccggcuccuga

SEQ ID NO: 465830 - RNA, 22 nt, Human
gcucaggaucagccaccucuuu

SEQ ID NO: 465831 - RNA, 22 nt, Human
agucucuuggcauucugaaaca

SEQ ID NO: 465832 - RNA, 22 nt, Human
aaauauguaagauuagcacuag

SEQ ID NO: 465833 - RNA, 22 nt, Human
augggcagagcuggugggaggc

SEQ ID NO: 465834 - RNA, 22 nt, Human
uggaccugggguggccuccucu

SEQ ID NO: 465835 - RNA, 21 nt, Human
agggcagauuagcuguaagag

SEQ ID NO: 465836 - RNA, 22 nt, Human
auuauucaacacuugagaaauu

SEQ ID NO: 465837 - RNA, 22 nt, Human
uccugcagacauuuacaccuuu

SEQ ID NO: 465838 - RNA, 22 nt, Human
uauguacaguccuuaacuuaaa

SEQ ID NO: 465839 - RNA, 18 nt, Human
gcugccugcauuccucac

SEQ ID NO: 465840 - RNA, 22 nt, Human
cuucuggaggacacuggcccca

SEQ ID NO: 465841 - RNA, 22 nt, Human
aaguugagaugucauaggagac

SEQ ID NO: 465842 - RNA, 22 nt, Human
ccaguggacuucucccuguggu

SEQ ID NO: 465843 - RNA, 22 nt, Human
accaucagagcacaguccgugc

SEQ ID NO: 465844 - RNA, 20 nt, Human
ccagcugagccaaggggaga

SEQ ID NO: 465845 - RNA, 22 nt, Human
agugguaacuaaguccugcuua

SEQ ID NO: 465846 - RNA, 18 nt, Human
aggaagcaggaggaaggc

SEQ ID NO: 465847 - RNA, 22 nt, Human
acagagguaggacaugagauau

SEQ ID NO: 465848 - RNA, 22 nt, Human
gcuguuccugcuuagaggucgg

SEQ ID NO: 465849 - RNA, 22 nt, Human
cuugccuucuguuccuauagaa

SEQ ID NO: 465850 - RNA, 22 nt, Human
ugaggcucagaagugccaagug

SEQ ID NO: 465851 - RNA, 22 nt, Human
gauuucaaccuaacaguaugac

SEQ ID NO: 465852 - RNA, 22 nt, Human
aaggcucuuggagugaaugcag

SEQ ID NO: 465853 - RNA, 22 nt, Human
ccagcugucacucagaaaggcc

SEQ ID NO: 465854 - RNA, 22 nt, Human
aagagcuggauugugcugcaga

SEQ ID NO: 465855 - RNA, 23 nt, Human
aagcugccagucugaagccuggg

SEQ ID NO: 465856 - RNA, 22 nt, Human
ucagggaccccucugaguggag

SEQ ID NO: 465857 - RNA, 22 nt, Human
uucucuucaucucaguaaaugu

SEQ ID NO: 465858 - RNA, 22 nt, Human
ucccagagcaguacuccaggag

SEQ ID NO: 465859 - RNA, 22 nt, Human
ggccucucucccuggcuugcag

SEQ ID NO: 465860 - RNA, 22 nt, Human
uagauuuuacuucugucauuac

SEQ ID NO: 465861 - RNA, 22 nt, Human
cagcaaaagccagcauaagcuc

SEQ ID NO: 465862 - RNA, 22 nt, Human
uuucauaaccucaagcuacagu

SEQ ID NO: 465863 - RNA, 22 nt, Human
auaugcauaugucaaaacuuau

SEQ ID NO: 465864 - RNA, 22 nt, Human
gcuggccacauugugccguccu

SEQ ID NO: 465865 - RNA, 22 nt, Human
uagugauuaaaggcagaauguu

SEQ ID NO: 465866 - RNA, 23 nt, Human
uccuccuuuugcuugugcuuccc

SEQ ID NO: 465867 - RNA, 22 nt, Human
uccaggcuggaaaugucaaacu

SEQ ID NO: 465868 - RNA, 22 nt, Human
uggcucugggaaucuguugcuu

SEQ ID NO: 465869 - RNA, 22 nt, Human
cagagcugcaaaugccccuccg

SEQ ID NO: 465870 - RNA, 22 nt, Human
cugugacuguguuggaugcaca

SEQ ID NO: 465871 - RNA, 22 nt, Human
ugguuuauuucucugaaagguu

SEQ ID NO: 465872 - RNA, 22 nt, Human
ugcuggcccaguauggacugca

SEQ ID NO: 465873 - RNA, 22 nt, Human
ugaggccagugacauauauuaa

SEQ ID NO: 465874 - RNA, 22 nt, Human
gcaggccagcugugcagauggg

SEQ ID NO: 465875 - RNA, 22 nt, Human
gagguagcaugcuggaagggac

SEQ ID NO: 465876 - RNA, 22 nt, Human
agcaauauuuaaagguuugcaa

SEQ ID NO: 465877 - RNA, 22 nt, Human
ccucucuguaagggucccuccc

SEQ ID NO: 465878 - RNA, 22 nt, Human
ucuacagacagagcagguggga

SEQ ID NO: 465879 - RNA, 22 nt, Human
caggagcaugcugaugccagaa

SEQ ID NO: 465880 - RNA, 22 nt, Human
ugggcucugaagucagucugcu

SEQ ID NO: 465881 - RNA, 22 nt, Human
aagagcugauuaagucaugagg

SEQ ID NO: 465882 - RNA, 22 nt, Human
agagaauuacagaagaauguca

SEQ ID NO: 465883 - RNA, 22 nt, Human
ugcauacacaugugcacauacg

SEQ ID NO: 465884 - RNA, 22 nt, Human
aaggaagggaaauagugauguc

SEQ ID NO: 465885 - RNA, 22 nt, Human
ccuggcaggccccuccuggauu

SEQ ID NO: 465886 - RNA, 22 nt, Human
auuaaauuggacgcugggggaa

SEQ ID NO: 465887 - RNA, 22 nt, Human
ccuucucuacuccugaugcaug

SEQ ID NO: 465888 - RNA, 22 nt, Human
uagcuguguagacacucagagc

SEQ ID NO: 465889 - RNA, 22 nt, Human
cuguccucaacccauccuucuc

SEQ ID NO: 465890 - RNA, 17 nt, Human
gacaagacagaauucau

SEQ ID NO: 465891 - RNA, 22 nt, Human
agcuuuauauguuguuucucca

SEQ ID NO: 465892 - RNA, 22 nt, Human
uggucaggcugcucugcggcgu

SEQ ID NO: 465893 - RNA, 22 nt, Human
aggcagguuucccggcugucaa

SEQ ID NO: 465894 - RNA, 21 nt, Human
ggcagcugaccgcgcggugca

SEQ ID NO: 465895 - RNA, 22 nt, Human
cagaggcacaagaaagcaaggc

SEQ ID NO: 465896 - RNA, 22 nt, Human
ugcuuaaacauacuauuuauau

SEQ ID NO: 465897 - RNA, 22 nt, Human
aggggccauuguucugcccgcu

SEQ ID NO: 465898 - RNA, 22 nt, Human
agcagagcuauucuugugcaau

SEQ ID NO: 465899 - RNA, 22 nt, Human
aguguggguuuuauggagcccu

SEQ ID NO: 465900 - RNA, 22 nt, Human
auuuauuaugggauuuggcuca

SEQ ID NO: 465901 - RNA, 22 nt, Human
aggaguguggccagggcucugg

SEQ ID NO: 465902 - RNA, 22 nt, Human
gauugaaacauaggcagucgag

SEQ ID NO: 465903 - RNA, 22 nt, Human
accaggcaugauguggagcaca

SEQ ID NO: 465904 - RNA, 22 nt, Human
ugauugaagaggugaggaaguu

SEQ ID NO: 465905 - RNA, 22 nt, Human
cauuuacuuaaaucuuuacaag

SEQ ID NO: 465906 - RNA, 22 nt, Human
ggugcagcugcagccugggagc

SEQ ID NO: 465907 - RNA, 22 nt, Human
cauagcaacagcaucaagucaa

SEQ ID NO: 465908 - RNA, 22 nt, Human
cccagcuccgagcuccgagccg

SEQ ID NO: 465909 - RNA, 22 nt, Human
uugauaaaaugauaucuucuuu

SEQ ID NO: 465910 - RNA, 22 nt, Human
uacaaagauaguguuagaguaa

SEQ ID NO: 465911 - RNA, 22 nt, Human
accucuggccuucaggcaucau

SEQ ID NO: 465912 - RNA, 22 nt, Human
ucuuccagcaaugugaaaucac

SEQ ID NO: 465913 - RNA, 22 nt, Human
gcagaauguaggccuucagugu

SEQ ID NO: 465914 - RNA, 22 nt, Human
augcugaggacaaagagaucaa

SEQ ID NO: 465915 - RNA, 22 nt, Human
agugacugggcagggcagggcc

SEQ ID NO: 465916 - RNA, 22 nt, Human
cucaggauguacuacagaaggc

SEQ ID NO: 465917 - RNA, 22 nt, Human
gaaugcagauggcugguguaug

SEQ ID NO: 465918 - RNA, 22 nt, Human
uggcuucugggacuugugagca

SEQ ID NO: 465919 - RNA, 18 nt, Human
agcagcugucagaaugcc

SEQ ID NO: 465920 - RNA, 22 nt, Human
cagugguauuugagagaaugga

SEQ ID NO: 465921 - RNA, 22 nt, Human
gcugucccaugguugcaagaug

SEQ ID NO: 465922 - RNA, 22 nt, Human
uuacaagauaaccugaugcugu

SEQ ID NO: 465923 - RNA, 22 nt, Human
cuggugggagcagcaggcagcu

SEQ ID NO: 465924 - RNA, 22 nt, Human
agcugacucuggccucuggucc

SEQ ID NO: 465925 - RNA, 18 nt, Human
gcagcugcaguuguagcu

SEQ ID NO: 465926 - RNA, 22 nt, Human
guacauguugguuguuuccagu

SEQ ID NO: 465927 - RNA, 22 nt, Human
aauguacaaggguuccaguuuu

SEQ ID NO: 465928 - RNA, 22 nt, Human
ugcuuuaucaaagcuauaguga

SEQ ID NO: 465929 - RNA, 22 nt, Human
gagcucccuggagguucagaua

SEQ ID NO: 465930 - RNA, 22 nt, Human
agcccuccucacaucagcgucc

SEQ ID NO: 465931 - RNA, 17 nt, Human
ucagcaggggccaagcu

SEQ ID NO: 465932 - RNA, 22 nt, Human
acaggugggcuuaagagucggc

SEQ ID NO: 465933 - RNA, 20 nt, Human
gacauucauaguuauuacca

SEQ ID NO: 465934 - RNA, 22 nt, Human
ucuuugcauggacauguguuuu

SEQ ID NO: 465935 - RNA, 22 nt, Human
agggugccugcugcagguucag

SEQ ID NO: 465936 - RNA, 22 nt, Human
gcacccagaauaaggacaggac

SEQ ID NO: 465937 - RNA, 22 nt, Human
ccaaugauggugcccacgauga

SEQ ID NO: 465938 - RNA, 22 nt, Human
ucccagagccucugccacucug

SEQ ID NO: 465939 - RNA, 22 nt, Human
gcauuucuuccuggugugagcc

SEQ ID NO: 465940 - RNA, 22 nt, Human
cugugucucuccuuacaagacu

SEQ ID NO: 465941 - RNA, 22 nt, Human
uacauuugcuuugauuuucagc

SEQ ID NO: 465942 - RNA, 21 nt, Human
uuacuuuugcaccaaccuaau

SEQ ID NO: 465943 - RNA, 17 nt, Human
auccccagcaucuagaa

SEQ ID NO: 465944 - RNA, 22 nt, Human
augagcugugggauuccagagg

SEQ ID NO: 465945 - RNA, 22 nt, Human
ggagccugacagugcccagcau

SEQ ID NO: 465946 - RNA, 22 nt, Human
cuucucucugcauaggcauggg

SEQ ID NO: 465947 - RNA, 22 nt, Human
gugucacaugguuuacugcagc

SEQ ID NO: 465948 - RNA, 22 nt, Human
aagggcagcuuaaauugguagc

SEQ ID NO: 465949 - RNA, 22 nt, Human
agggcagaaaucgauuacaccu

SEQ ID NO: 465950 - RNA, 22 nt, Human
cucaccacagagccuguccagc

SEQ ID NO: 465951 - RNA, 22 nt, Human
agguacagggugaaaguuuaug

SEQ ID NO: 465952 - RNA, 22 nt, Human
gaggccagaagucugagaucag

SEQ ID NO: 465953 - RNA, 22 nt, Human
cuuucacagcacaagccugccu

SEQ ID NO: 465954 - RNA, 21 nt, Human
guauugcagaguuaugugcuc

SEQ ID NO: 465955 - RNA, 22 nt, Human
ccagagagaaauggauuugagu

SEQ ID NO: 465956 - RNA, 22 nt, Human
gagugagggcagcaggggcugc

SEQ ID NO: 465957 - RNA, 22 nt, Human
uuucacaaguuucaggauucug

SEQ ID NO: 465958 - RNA, 22 nt, Human
uggcagcuccggguaggggcug

SEQ ID NO: 465959 - RNA, 22 nt, Human
gacaggggucccucugggcugu

SEQ ID NO: 465960 - RNA, 22 nt, Human
ccacucugcugugcuccaugau

SEQ ID NO: 465961 - RNA, 23 nt, Human
ccaggccucucagagggugugcc

SEQ ID NO: 465962 - RNA, 22 nt, Human
gcugucugcaagccaggaaaug

SEQ ID NO: 465963 - RNA, 22 nt, Human
ggcucaggaccugggauugcca

SEQ ID NO: 465964 - RNA, 22 nt, Human
ucaggaguaaagacagaguucc

SEQ ID NO: 465965 - RNA, 22 nt, Human
ggcacugaaccaggacacaagc

SEQ ID NO: 465966 - RNA, 22 nt, Human
uucugaggcacuggcucuccca

SEQ ID NO: 465967 - RNA, 22 nt, Human
ugccugaggagucagggcaggu

SEQ ID NO: 465968 - RNA, 23 nt, Human
agaugaaagcuucccaucacagu

SEQ ID NO: 465969 - RNA, 17 nt, Human
agcagcuggguugaucu

SEQ ID NO: 465970 - RNA, 22 nt, Human
caggaggaaaugugacccugcu

SEQ ID NO: 465971 - RNA, 22 nt, Human
cagaauuuuucgaauguacugu

SEQ ID NO: 465972 - RNA, 22 nt, Human
gcuguggccuggcgcagagcug

SEQ ID NO: 465973 - RNA, 21 nt, Human
ugggaccuauuucaacuggau

SEQ ID NO: 465974 - RNA, 19 nt, Human
cucugccucuggcuguggc

SEQ ID NO: 465975 - RNA, 22 nt, Human
uuguauuagcuguaaauuuucu

SEQ ID NO: 465976 - RNA, 22 nt, Human
ccagcaugagacgaugaugaag

SEQ ID NO: 465977 - RNA, 22 nt, Human
caggauggucucgaucuccuga

SEQ ID NO: 465978 - RNA, 22 nt, Human
agacccugcaccucucgugggc

SEQ ID NO: 465979 - RNA, 22 nt, Human
aaaagguagauucuccuucuau

SEQ ID NO: 465980 - RNA, 22 nt, Human
gucuuguuugggauguggaugg

SEQ ID NO: 465981 - RNA, 22 nt, Human
ucucagggagggcgagucagcg

SEQ ID NO: 465982 - RNA, 20 nt, Human
gaagcagcuucauguagaca

SEQ ID NO: 465983 - RNA, 22 nt, Human
ucuuuccuaggugauaugcaau

SEQ ID NO: 465984 - RNA, 22 nt, Human
ucugccuuccccauaaucugau

SEQ ID NO: 465985 - RNA, 22 nt, Human
aggaggggcauagaaauguaau

SEQ ID NO: 465986 - RNA, 22 nt, Human
augcagaaggagccaugcuugc

SEQ ID NO: 465987 - RNA, 22 nt, Human
uaugcacauuaucuaauccauu

SEQ ID NO: 465988 - RNA, 20 nt, Human
ucacaucuggcagcugauga

SEQ ID NO: 465989 - RNA, 22 nt, Human
auacaaagcuuucugucuggua

SEQ ID NO: 465990 - RNA, 22 nt, Human
ugaauaaacuaugaggaggaau

SEQ ID NO: 465991 - RNA, 22 nt, Human
uagcugccuuugggcuccugcu

SEQ ID NO: 465992 - RNA, 21 nt, Human
uucuacaggaugaaugaaaac

SEQ ID NO: 465993 - RNA, 22 nt, Human
uacaggaggauuaucaaaggau

SEQ ID NO: 465994 - RNA, 22 nt, Human
gccaguggcccucuggagaagg

SEQ ID NO: 465995 - RNA, 22 nt, Human
uccuggccucacaguccugggu

SEQ ID NO: 465996 - RNA, 22 nt, Human
cccagcccaucucaaaggucua

SEQ ID NO: 465997 - RNA, 22 nt, Human
uucagucuccucauuuuacaaa

SEQ ID NO: 465998 - RNA, 22 nt, Human
uggcucuguuuguuaacuagac

SEQ ID NO: 465999 - RNA, 22 nt, Human
ugggcuccuugggagcaaguga

SEQ ID NO: 466000 - RNA, 21 nt, Human
aucaccagcagaagcugcaga

SEQ ID NO: 466001 - RNA, 22 nt, Human
gagcagcuccagccgcaugacu

SEQ ID NO: 466002 - RNA, 22 nt, Human
agccacagagagggagcugcaa

SEQ ID NO: 466003 - RNA, 22 nt, Human
caguacuuaacuuauaggagag

SEQ ID NO: 466004 - RNA, 22 nt, Human
uccucaggcggugaggaggggc

SEQ ID NO: 466005 - RNA, 22 nt, Human
acaacugucaguaaagaauauu

SEQ ID NO: 466006 - RNA, 22 nt, Human
caguccuguguuaaacaagagc

SEQ ID NO: 466007 - RNA, 22 nt, Human
uuacacaacagugcaucagcag

SEQ ID NO: 466008 - RNA, 22 nt, Human
cauggcccucuucuggagcaau

SEQ ID NO: 466009 - RNA, 22 nt, Human
agaguccauaugugggaggagu

SEQ ID NO: 466010 - RNA, 22 nt, Human
aaaucugggucaagguggagug

SEQ ID NO: 466011 - RNA, 22 nt, Human
cucaagacugaucgcaguggaa

SEQ ID NO: 466012 - RNA, 22 nt, Human
ugcagccauuuucugccaaugc

SEQ ID NO: 466013 - RNA, 22 nt, Human
ggucccagaauugguuagcaca

SEQ ID NO: 466014 - RNA, 22 nt, Human
cccagagcuccgguccugccca

SEQ ID NO: 466015 - RNA, 22 nt, Human
ucuggcuccacucugugcaugc

SEQ ID NO: 466016 - RNA, 22 nt, Human
ccucagaguaggucucagcugu

SEQ ID NO: 466017 - RNA, 22 nt, Human
gcaggaagaugagcucagguaa

SEQ ID NO: 466018 - RNA, 22 nt, Human
ugggcagagaucuggaucaaac

SEQ ID NO: 466019 - RNA, 22 nt, Human
gagcugaguuaccuccagauca

SEQ ID NO: 466020 - RNA, 22 nt, Human
ucagggugaaccaggcaggaau

SEQ ID NO: 466021 - RNA, 22 nt, Human
auuccaaaggcuggccuggagg

SEQ ID NO: 466022 - RNA, 22 nt, Human
cucacuggcaagacuacaggug

SEQ ID NO: 466023 - RNA, 22 nt, Human
ggcaggagaaaggucucuucuu

SEQ ID NO: 466024 - RNA, 22 nt, Human
acauuucuccuacuuguuauuu

SEQ ID NO: 466025 - RNA, 20 nt, Human
ucuguacacucaucuucugc

SEQ ID NO: 466026 - RNA, 22 nt, Human
auacaaauuuauagaugcauuu

SEQ ID NO: 466027 - RNA, 22 nt, Human
cagcuggaggagcagcuuccag

SEQ ID NO: 466028 - RNA, 22 nt, Human
ucugucugagggagugacauuu

SEQ ID NO: 466029 - RNA, 22 nt, Human
cagaggcuguguaggcagacug

SEQ ID NO: 466030 - RNA, 22 nt, Human
gcugucugcugggucgcucagg

SEQ ID NO: 466031 - RNA, 22 nt, Human
ccagggcuccauugcucauccu

SEQ ID NO: 466032 - RNA, 22 nt, Human
gccuucugugcuccuggccuuu

SEQ ID NO: 466033 - RNA, 22 nt, Human
agagcagagggcucugggacaa

SEQ ID NO: 466034 - RNA, 22 nt, Human
gccucuggggcagcugagucau

SEQ ID NO: 466035 - RNA, 22 nt, Human
uacaaaugaccauagccacuua

SEQ ID NO: 466036 - RNA, 22 nt, Human
ugucaaauuuuuauugcaguau

SEQ ID NO: 466037 - RNA, 22 nt, Human
uacauagcaaggaaaugacaga

SEQ ID NO: 466038 - RNA, 22 nt, Human
guuauguaugagggaaugauua

SEQ ID NO: 466039 - RNA, 21 nt, Human
cacugcagccuugaccugggc

SEQ ID NO: 466040 - RNA, 22 nt, Human
agggcagaaguacagacacuua

SEQ ID NO: 466041 - RNA, 22 nt, Human
ccugucugagccagggugggca

SEQ ID NO: 466042 - RNA, 22 nt, Human
aggcucagacaggaaaaguaac

SEQ ID NO: 466043 - RNA, 22 nt, Human
uuuuuuaguuaggucagaaugu

SEQ ID NO: 466044 - RNA, 22 nt, Human
aguguccaacucagcuugucaa

SEQ ID NO: 466045 - RNA, 22 nt, Human
acuucucuucauagguggcaau

SEQ ID NO: 466046 - RNA, 22 nt, Human
ccacagagagugucagccuuug

SEQ ID NO: 466047 - RNA, 22 nt, Human
ugggccugugaugcugggcuau

SEQ ID NO: 466048 - RNA, 22 nt, Human
gcucaaggcaggcagacaugag

SEQ ID NO: 466049 - RNA, 22 nt, Human
cuacccaggcuggagugcagua

SEQ ID NO: 466050 - RNA, 22 nt, Human
ucucaguguggugcuuaggaua

SEQ ID NO: 466051 - RNA, 22 nt, Human
uaaacaaggguuacugagcaug

SEQ ID NO: 466052 - RNA, 22 nt, Human
ucgccagggaugcuguaaggaa

SEQ ID NO: 466053 - RNA, 22 nt, Human
ucgagucauguucucccauuaa

SEQ ID NO: 466054 - RNA, 22 nt, Human
aaggcagucugguuucaaagca

SEQ ID NO: 466055 - RNA, 22 nt, Human
aaaagguaguugccaaauaagg

SEQ ID NO: 466056 - RNA, 22 nt, Human
caggaaaggugugucaugaugg

SEQ ID NO: 466057 - RNA, 15 nt, Human
ugauuuccuacuaac

SEQ ID NO: 466058 - RNA, 20 nt, Human
uccuucaggcagggccuagu

SEQ ID NO: 466059 - RNA, 22 nt, Human
ucagagagugcaaaauauagcu

SEQ ID NO: 466060 - RNA, 22 nt, Human
acaugauuuuaguaucauaaua

SEQ ID NO: 466061 - RNA, 22 nt, Human
gucccagaggcuuuggccacag

SEQ ID NO: 466062 - RNA, 22 nt, Human
aggacccugagcgggcaugccg

SEQ ID NO: 466063 - RNA, 22 nt, Human
aucccuggacggcgccucccca

SEQ ID NO: 466064 - RNA, 22 nt, Human
aggccuggcaugagaccugaga

SEQ ID NO: 466065 - RNA, 23 nt, Human
ggcuggcccggggcugcuccuga

SEQ ID NO: 466066 - RNA, 22 nt, Human
ucaggcagcauuaaacuucagc

SEQ ID NO: 466067 - RNA, 22 nt, Human
ggccaccucugcccuacugagu

SEQ ID NO: 466068 - RNA, 22 nt, Human
ugggcagaaugugggauccaga

SEQ ID NO: 466069 - RNA, 22 nt, Human
cuacauuuuucaccgagccucu

SEQ ID NO: 466070 - RNA, 22 nt, Human
accaggcagcacuuuccuugca

SEQ ID NO: 466071 - RNA, 22 nt, Human
cugggugguucuaacuguugau

SEQ ID NO: 466072 - RNA, 22 nt, Human
gggcagaggcucuggcccaucc

SEQ ID NO: 466073 - RNA, 22 nt, Human
aggcaagcauugggaacagggc

SEQ ID NO: 466074 - RNA, 22 nt, Human
uagcagagaggggacaguggca

SEQ ID NO: 466075 - RNA, 22 nt, Human
caggcagcauuuacucugauga

SEQ ID NO: 466076 - RNA, 22 nt, Human
cugaggcacagugaacuucucc

SEQ ID NO: 466077 - RNA, 22 nt, Human
gcaguggggcgcugggaguugg

SEQ ID NO: 466078 - RNA, 22 nt, Human
aggugaguugguaggaaguuug

SEQ ID NO: 466079 - RNA, 22 nt, Human
ugucucugggugauucaguccu

SEQ ID NO: 466080 - RNA, 22 nt, Human
gacuuuggcaucuagacauugu

SEQ ID NO: 466081 - RNA, 22 nt, Human
caaaguuaugaaugauaagauu

SEQ ID NO: 466082 - RNA, 22 nt, Human
ugaugaaaauaugauucugagg

SEQ ID NO: 466083 - RNA, 21 nt, Human
uggaaagauucaaagaccagg

SEQ ID NO: 466084 - RNA, 22 nt, Human
ggccugugagcccuugcaugua

SEQ ID NO: 466085 - RNA, 22 nt, Human
uuggaaagcaagcuggacauac

SEQ ID NO: 466086 - RNA, 22 nt, Human
uggcugcaguucacaggagcaa

SEQ ID NO: 466087 - RNA, 22 nt, Human
gcagggacaaggcagguguucu

SEQ ID NO: 466088 - RNA, 22 nt, Human
gaaaaagugaccuugguagcua

SEQ ID NO: 466089 - RNA, 22 nt, Human
cucaggagaugacagaagguau

SEQ ID NO: 466090 - RNA, 22 nt, Human
aaggcagagggcuggaucagag

SEQ ID NO: 466091 - RNA, 22 nt, Human
auucuucacuguuucagaauga

SEQ ID NO: 466092 - RNA, 22 nt, Human
cagcuguggagggaggaaaugc

SEQ ID NO: 466093 - RNA, 22 nt, Human
aguaaacauaauuuaccuguag

SEQ ID NO: 466094 - RNA, 22 nt, Human
cuacauggagaagaaaauucuu

SEQ ID NO: 466095 - RNA, 22 nt, Human
gggacuguaaauucauauggcc

SEQ ID NO: 466096 - RNA, 22 nt, Human
gccugcagcugcuuccacacac

SEQ ID NO: 466097 - RNA, 23 nt, Human
ccugucugugcuggguggacaca

SEQ ID NO: 466098 - RNA, 22 nt, Human
cugaggccucuguucaccagaa

SEQ ID NO: 466099 - RNA, 22 nt, Human
caucauuucacuuagaugaagu

SEQ ID NO: 466100 - RNA, 22 nt, Human
agcagcagaagggagacccagg

SEQ ID NO: 466101 - RNA, 22 nt, Human
ucaaaugcuguauuguaguaau

SEQ ID NO: 466102 - RNA, 22 nt, Human
gccuggcacauugcaguggauu

SEQ ID NO: 466103 - RNA, 23 nt, Human
accaugaugggagugcaaauaag

SEQ ID NO: 466104 - RNA, 22 nt, Human
cucagggacguuagaggacagg

SEQ ID NO: 466105 - RNA, 22 nt, Human
ucccaggugaugcugaggccac

SEQ ID NO: 466106 - RNA, 22 nt, Human
cuagagggauguuaggauagca

SEQ ID NO: 466107 - RNA, 22 nt, Human
caagucaaagacuagaacuagu

SEQ ID NO: 466108 - RNA, 22 nt, Human
auaucuuuuagagcaagcuugu

SEQ ID NO: 466109 - RNA, 21 nt, Human
ccugagggugguugugaagau

SEQ ID NO: 466110 - RNA, 22 nt, Human
cagaggcagacccuccagggcg

SEQ ID NO: 466111 - RNA, 22 nt, Human
ugaggcagugcugggaagccug

SEQ ID NO: 466112 - RNA, 22 nt, Human
ugaagaauguugcagugagcau

SEQ ID NO: 466113 - RNA, 22 nt, Human
gcugcaggcgccugcggucucu

SEQ ID NO: 466114 - RNA, 22 nt, Human
ggccuggaaugcuuuccuacca

SEQ ID NO: 466115 - RNA, 22 nt, Human
gcagccccaggagacgcccagg

SEQ ID NO: 466116 - RNA, 22 nt, Human
guggccuuuccugaagaaauga

SEQ ID NO: 466117 - RNA, 22 nt, Human
ucucuggaguauaaccagggau

SEQ ID NO: 466118 - RNA, 17 nt, Human
aaguccagccugcagcu

SEQ ID NO: 466119 - RNA, 19 nt, Human
uuagaaacuguugacacug

SEQ ID NO: 466120 - RNA, 22 nt, Human
ggcaggaggugaguggcgggug

SEQ ID NO: 466121 - RNA, 22 nt, Human
uggcaggguuggccaccuuacc

SEQ ID NO: 466122 - RNA, 22 nt, Human
uccuggccugucuggaguagcu

SEQ ID NO: 466123 - RNA, 22 nt, Human
gcucugaggcugggagcacucu

SEQ ID NO: 466124 - RNA, 22 nt, Human
ggcucugcugguaagaugccuc

SEQ ID NO: 466125 - RNA, 22 nt, Human
caggccagugugcuucccaggc

SEQ ID NO: 466126 - RNA, 22 nt, Human
gagccugcccagcccuguccac

SEQ ID NO: 466127 - RNA, 22 nt, Human
cugcuuccauggucuggagacu

SEQ ID NO: 466128 - RNA, 22 nt, Human
gcagggacaucuucagaucacu

SEQ ID NO: 466129 - RNA, 18 nt, Human
ucugggcuucccgaggcu

SEQ ID NO: 466130 - RNA, 22 nt, Human
agcugcagagguuugugcaaca

SEQ ID NO: 466131 - RNA, 22 nt, Human
gcaguggcaccgcuggcucugg

SEQ ID NO: 466132 - RNA, 22 nt, Human
acccucccauuuccauguagca

SEQ ID NO: 466133 - RNA, 22 nt, Human
agugucugaaccaccggggcau

SEQ ID NO: 466134 - RNA, 22 nt, Human
gcagggcaguaagagcuagagu

SEQ ID NO: 466135 - RNA, 22 nt, Human
acacacacaagcagguugugga

SEQ ID NO: 466136 - RNA, 22 nt, Human
uuagggacagcucuguagguga

SEQ ID NO: 466137 - RNA, 22 nt, Human
gcguggugcugcccugcacaca

SEQ ID NO: 466138 - RNA, 22 nt, Human
gaauuugaaaagugaugggaau

SEQ ID NO: 466139 - RNA, 19 nt, Human
uugaggggccaggggagau

SEQ ID NO: 466140 - RNA, 22 nt, Human
gcugccugccuugccuggagga

SEQ ID NO: 466141 - RNA, 22 nt, Human
ccagcuggagcucgcagauagg

SEQ ID NO: 466142 - RNA, 22 nt, Human
uuuaugaacuacagauauaacu

SEQ ID NO: 466143 - RNA, 22 nt, Human
uucuaccagcuacucacugaua

SEQ ID NO: 466144 - RNA, 22 nt, Human
ucaggcagagggagaagccaag

SEQ ID NO: 466145 - RNA, 22 nt, Human
cagucccaguuugagacucugg

SEQ ID NO: 466146 - RNA, 22 nt, Human
ggcagcacgacaggaguggaag

SEQ ID NO: 466147 - RNA, 22 nt, Human
uuucaagcauaacugggaagag

SEQ ID NO: 466148 - RNA, 22 nt, Human
aguggcaggcggagauguagga

SEQ ID NO: 466149 - RNA, 22 nt, Human
gcccacagcucguuccucuccu

SEQ ID NO: 466150 - RNA, 22 nt, Human
caaaugugacuuuugggcuucu

SEQ ID NO: 466151 - RNA, 22 nt, Human
caagcuggcugggagaggcacg

SEQ ID NO: 466152 - RNA, 22 nt, Human
aggaagcccuugucauuucugu

SEQ ID NO: 466153 - RNA, 22 nt, Human
gaagcagcuggugagauggagc

SEQ ID NO: 466154 - RNA, 22 nt, Human
ucaacacucuuuggcacaguua

SEQ ID NO: 466155 - RNA, 22 nt, Human
ugagccuggggccugggcagcg

SEQ ID NO: 466156 - RNA, 22 nt, Human
ucauugcaggcauuccccugcc

SEQ ID NO: 466157 - RNA, 22 nt, Human
cagagcugucauuugccaguga

SEQ ID NO: 466158 - RNA, 22 nt, Human
cacccaggcuagagugcagugg

SEQ ID NO: 466159 - RNA, 19 nt, Human
ccagcccugucacuucuug

SEQ ID NO: 466160 - RNA, 22 nt, Human
ugcccagggauaagccuagaga

SEQ ID NO: 466161 - RNA, 22 nt, Human
ucugagagucucugaggcagau

SEQ ID NO: 466162 - RNA, 22 nt, Human
agggaugguggagguugcaagu

SEQ ID NO: 466163 - RNA, 22 nt, Human
uggccuggcucacagugagauu

SEQ ID NO: 466164 - RNA, 22 nt, Human
agccaggcuaaaugagccauga

SEQ ID NO: 466165 - RNA, 22 nt, Human
gccucugcaauuacauugugcc

SEQ ID NO: 466166 - RNA, 22 nt, Human
cucccagagagcaggugggccg

SEQ ID NO: 466167 - RNA, 22 nt, Human
aggcuucuaggguuggcagcgg

SEQ ID NO: 466168 - RNA, 22 nt, Human
aagaugcagcuuuacaauaagg

SEQ ID NO: 466169 - RNA, 19 nt, Human
ucaaaugccaaugucacag

SEQ ID NO: 466170 - RNA, 22 nt, Human
agggcccuuacgcaggcccuuc

SEQ ID NO: 466171 - RNA, 22 nt, Human
gggcugcuguagagaacauguu

SEQ ID NO: 466172 - RNA, 22 nt, Human
cacagaggacuguagcggggag

SEQ ID NO: 466173 - RNA, 22 nt, Human
aucuggaaaacacaguguagac

SEQ ID NO: 466174 - RNA, 17 nt, Human
gucugggcuuuagagac

SEQ ID NO: 466175 - RNA, 22 nt, Human
agggcucugggguggcagagau

SEQ ID NO: 466176 - RNA, 22 nt, Human
uuccaaagaaguucacauuuac

SEQ ID NO: 466177 - RNA, 22 nt, Human
cccagcugcaccucuauggccu

SEQ ID NO: 466178 - RNA, 22 nt, Human
uuucagugcuucuguuuaccgg

SEQ ID NO: 466179 - RNA, 22 nt, Human
ugccagcccaccuuggggccuc

SEQ ID NO: 466180 - RNA, 22 nt, Human
agagccaggugcugcuguuuga

SEQ ID NO: 466181 - RNA, 22 nt, Human
ucugcucuccauacuuccgcac

SEQ ID NO: 466182 - RNA, 16 nt, Human
uguuagcugugcauua

SEQ ID NO: 466183 - RNA, 22 nt, Human
ucagaggaaaggucagauggcu

SEQ ID NO: 466184 - RNA, 22 nt, Human
uucacagggccacuggcaggag

SEQ ID NO: 466185 - RNA, 21 nt, Human
accaucuuccaugcauuauau

SEQ ID NO: 466186 - RNA, 22 nt, Human
aaggucauuuaacaauuuauga

SEQ ID NO: 466187 - RNA, 22 nt, Human
ugcuccuuccucauccugugca

SEQ ID NO: 466188 - RNA, 22 nt, Human
ucagugaucuaaggguauggcc

SEQ ID NO: 466189 - RNA, 22 nt, Human
caggugggcguggcgagaaggc

SEQ ID NO: 466190 - RNA, 22 nt, Human
cacauuucuaggaaauuaaaug

SEQ ID NO: 466191 - RNA, 22 nt, Human
cagagcagacguugagauuaag

SEQ ID NO: 466192 - RNA, 23 nt, Human
auaaggcauaaagguacauugga

SEQ ID NO: 466193 - RNA, 22 nt, Human
ccaggcagagugcuccagaaag

SEQ ID NO: 466194 - RNA, 22 nt, Human
cagugagguggauggauggccu

SEQ ID NO: 466195 - RNA, 22 nt, Human
gugugcagcagagacaggacuc

SEQ ID NO: 466196 - RNA, 22 nt, Human
cagacuuucaaggagugaaggc

SEQ ID NO: 466197 - RNA, 22 nt, Human
aacugcauucagaaagcucacu

SEQ ID NO: 466198 - RNA, 22 nt, Human
caucuuuaaaggggagacaccc

SEQ ID NO: 466199 - RNA, 19 nt, Human
gcugugugaccuugggcaa

SEQ ID NO: 466200 - RNA, 22 nt, Human
aaguuugagaagcuuauagaua

SEQ ID NO: 466201 - RNA, 22 nt, Human
ggagugaaguggcgcgaucucg

SEQ ID NO: 466202 - RNA, 22 nt, Human
ggggaggcugaugugggcaaag

SEQ ID NO: 466203 - RNA, 22 nt, Human
ccugcagggugcugccacagau

SEQ ID NO: 466204 - RNA, 22 nt, Human
caaaugaagggagcugaagucu

SEQ ID NO: 466205 - RNA, 22 nt, Human
cugagaguguggcuuccaggcc

SEQ ID NO: 466206 - RNA, 22 nt, Human
cuggcucauagagcagcuccaa

SEQ ID NO: 466207 - RNA, 22 nt, Human
uguguuuugaacucaucuacug

SEQ ID NO: 466208 - RNA, 22 nt, Human
caggacaguauaggcuuuagga

SEQ ID NO: 466209 - RNA, 22 nt, Human
uuguaaaugaccuuuucuaauu

SEQ ID NO: 466210 - RNA, 22 nt, Human
gccuccuggauuuuagugccau

SEQ ID NO: 466211 - RNA, 22 nt, Human
ugccuggguguaaagggccaac

SEQ ID NO: 466212 - RNA, 18 nt, Human
aggugcagccucugaggc

SEQ ID NO: 466213 - RNA, 21 nt, Human
caguguggugaccagggucuc

SEQ ID NO: 466214 - RNA, 22 nt, Human
ccuggggcucaagauggcgccg

SEQ ID NO: 466215 - RNA, 22 nt, Human
uggcucaguagcagugugguca

SEQ ID NO: 466216 - RNA, 22 nt, Human
uaguaaaaguuuaguugaaagu

SEQ ID NO: 466217 - RNA, 22 nt, Human
gagcugccuguugcauagcaac

SEQ ID NO: 466218 - RNA, 22 nt, Human
gcagagcacccugcagugguau

SEQ ID NO: 466219 - RNA, 22 nt, Human
uuguuacaucuuauguaagugg

SEQ ID NO: 466220 - RNA, 22 nt, Human
uguggccagcagguggcugugu

SEQ ID NO: 466221 - RNA, 17 nt, Human
gccugcaggcccgcaga

SEQ ID NO: 466222 - RNA, 22 nt, Human
uggggcagggaugggaaacuau

SEQ ID NO: 466223 - RNA, 22 nt, Human
ggauaagaaaauuguaauaacu

SEQ ID NO: 466224 - RNA, 22 nt, Human
ugucacagggauaccauggggc

SEQ ID NO: 466225 - RNA, 22 nt, Human
uuagaaaugauuucaccucuuu

SEQ ID NO: 466226 - RNA, 22 nt, Human
gaggagcuggcagcgucuccgc

SEQ ID NO: 466227 - RNA, 19 nt, Human
ucucccagcugagaagggc

SEQ ID NO: 466228 - RNA, 22 nt, Human
uaugcauagguaucuauacuca

SEQ ID NO: 466229 - RNA, 22 nt, Human
ggagaaggaauauuggaguagg

SEQ ID NO: 466230 - RNA, 18 nt, Human
caugucugcgccacaagg

SEQ ID NO: 466231 - RNA, 22 nt, Human
ucggggucuuugacacgcucug

SEQ ID NO: 466232 - RNA, 22 nt, Human
uguauguguauguacauaugca

SEQ ID NO: 466233 - RNA, 22 nt, Human
cuggcagcgugagcagcaucca

SEQ ID NO: 466234 - RNA, 22 nt, Human
uguaccuuuuucugugcaugcu

SEQ ID NO: 466235 - RNA, 22 nt, Human
cagaagaauggugucugagcuc

SEQ ID NO: 466236 - RNA, 22 nt, Human
aaaugucuaucuggcauauucc

SEQ ID NO: 466237 - RNA, 22 nt, Human
uggaguucauccaugacagcuu

SEQ ID NO: 466238 - RNA, 22 nt, Human
aaaaaguuucaacugccaacuc

SEQ ID NO: 466239 - RNA, 22 nt, Human
agcugaaggcuagaacagcugg

SEQ ID NO: 466240 - RNA, 22 nt, Human
aaaaguucccugguuagaaaag

SEQ ID NO: 466241 - RNA, 22 nt, Human
cugccuggcuaaacucaagucg

SEQ ID NO: 466242 - RNA, 22 nt, Human
aaaagcaguuaucugggaggaa

SEQ ID NO: 466243 - RNA, 22 nt, Human
agugucauaugccacugcaucc

SEQ ID NO: 466244 - RNA, 22 nt, Human
gcucccagcauugcuucccagg

SEQ ID NO: 466245 - RNA, 22 nt, Human
cugagcacugggcacauagcug

SEQ ID NO: 466246 - RNA, 22 nt, Human
agacccucuccaugcccacugc

SEQ ID NO: 466247 - RNA, 18 nt, Human
cugccuguugcugagagg

SEQ ID NO: 466248 - RNA, 23 nt, Human
aaccagauaaauggcuccagggc

SEQ ID NO: 466249 - RNA, 22 nt, Human
acaaaauuaugaagaggccuug

SEQ ID NO: 466250 - RNA, 22 nt, Human
uggagcagccaugaugacagag

SEQ ID NO: 466251 - RNA, 22 nt, Human
cugcugggaaggucugcucagu

SEQ ID NO: 466252 - RNA, 22 nt, Human
auauuucuccaaauguuuucaa

SEQ ID NO: 466253 - RNA, 22 nt, Human
gcugggagaggcccugaaguga

SEQ ID NO: 466254 - RNA, 22 nt, Human
ucugccugcaguguggcagggc

SEQ ID NO: 466255 - RNA, 22 nt, Human
cugcuucuccaaaguaggacuu

SEQ ID NO: 466256 - RNA, 22 nt, Human
gccaccagcagaaaaggggcca

SEQ ID NO: 466257 - RNA, 22 nt, Human
acacaugcauaagccuucccuu

SEQ ID NO: 466258 - RNA, 22 nt, Human
acacaucucaggggacacucuc

SEQ ID NO: 466259 - RNA, 22 nt, Human
agagcaucuaacacauaagccu

SEQ ID NO: 466260 - RNA, 22 nt, Human
ccccagccuuccaugggaauug

SEQ ID NO: 466261 - RNA, 22 nt, Human
ggcagggcagcgcugauuaggg

SEQ ID NO: 466262 - RNA, 22 nt, Human
uguuaggguccugugcaggggc

SEQ ID NO: 466263 - RNA, 22 nt, Human
auaagagcuagucuuuuccuug

SEQ ID NO: 466264 - RNA, 22 nt, Human
gcauucaucuuccuccaugcag

SEQ ID NO: 466265 - RNA, 17 nt, Human
aucuggcugcuucuaga

SEQ ID NO: 466266 - RNA, 22 nt, Human
aucaggauucaguaucuccagc

SEQ ID NO: 466267 - RNA, 21 nt, Human
gugcucugggcagcagagggc

SEQ ID NO: 466268 - RNA, 22 nt, Human
ucccagaggucucugcugguuc

SEQ ID NO: 466269 - RNA, 22 nt, Human
caggaagagguaucaccgagca

SEQ ID NO: 466270 - RNA, 22 nt, Human
agggcugagugggagagaguug

SEQ ID NO: 466271 - RNA, 22 nt, Human
uacagaaaaacuggcauugaag

SEQ ID NO: 466272 - RNA, 22 nt, Human
aacucaguguguuucuuaguau

SEQ ID NO: 466273 - RNA, 19 nt, Human
aguggcagaucuggaagua

SEQ ID NO: 466274 - RNA, 22 nt, Human
agcagccaauuggaggaugaag

SEQ ID NO: 466275 - RNA, 22 nt, Human
augaggcauuccacucaaacuc

SEQ ID NO: 466276 - RNA, 22 nt, Human
uuuacuuugugucaagucaaga

SEQ ID NO: 466277 - RNA, 22 nt, Human
uggagcuggcuuguggaaguug

SEQ ID NO: 466278 - RNA, 19 nt, Human
ggacacagaaagcugcauu

SEQ ID NO: 466279 - RNA, 18 nt, Human
gagcagaggcucaacugg

SEQ ID NO: 466280 - RNA, 19 nt, Human
gagaggccugugcuugaag

SEQ ID NO: 466281 - RNA, 22 nt, Human
ugaacagaucaauagaacugac

SEQ ID NO: 466282 - RNA, 22 nt, Human
ucaaaauuaaaccaacguccag

SEQ ID NO: 466283 - RNA, 21 nt, Human
uugaaggaucacuucuguacc

SEQ ID NO: 466284 - RNA, 22 nt, Human
cacaugaugguggaagccauag

SEQ ID NO: 466285 - RNA, 19 nt, Human
agggaguuuauauuugcac

SEQ ID NO: 466286 - RNA, 22 nt, Human
auuuagaaguuggagggcaaga

SEQ ID NO: 466287 - RNA, 23 nt, Human
gagcugggauacaggcuuacugc

SEQ ID NO: 466288 - RNA, 19 nt, Human
aggcaggugcagagguccc

SEQ ID NO: 466289 - RNA, 22 nt, Human
gagccuucaucgcagccuuguu

SEQ ID NO: 466290 - RNA, 22 nt, Human
aaugcacauauauguguauaca

SEQ ID NO: 466291 - RNA, 22 nt, Human
aggguccaucaaggacugcaca

SEQ ID NO: 466292 - RNA, 18 nt, Human
gccaggcaggguggggaa

SEQ ID NO: 466293 - RNA, 22 nt, Human
uagagcuggaauuugcagcaag

SEQ ID NO: 466294 - RNA, 22 nt, Human
uggcagcagacaaaaggccauu

SEQ ID NO: 466295 - RNA, 22 nt, Human
ggcaggcaguguggugugaaac

SEQ ID NO: 466296 - RNA, 22 nt, Human
uggcugaacuaaugugcuguuu

SEQ ID NO: 466297 - RNA, 22 nt, Human
gccagggggucagcaggcacuu

SEQ ID NO: 466298 - RNA, 22 nt, Human
acuuucuauucccacagagaua

SEQ ID NO: 466299 - RNA, 22 nt, Human
uaguuaggaaaguccagggagc

SEQ ID NO: 466300 - RNA, 22 nt, Human
agccuggauccauguggcuacc

SEQ ID NO: 466301 - RNA, 22 nt, Human
gagccuccuccuggugugccga

SEQ ID NO: 466302 - RNA, 22 nt, Human
gccucugcccauccaccaucag

SEQ ID NO: 466303 - RNA, 22 nt, Human
gguucaguuuacauuaaaaucu

SEQ ID NO: 466304 - RNA, 20 nt, Human
gugccuggagaagaggcugu

SEQ ID NO: 466305 - RNA, 22 nt, Human
uggcucaguuuagcagcucagu

SEQ ID NO: 466306 - RNA, 22 nt, Human
gcaggcaguugcaguuuucuag

SEQ ID NO: 466307 - RNA, 22 nt, Human
uuuuagauaguuuaacugcacu

SEQ ID NO: 466308 - RNA, 22 nt, Human
gggaggaaaugugcagcgaauu

SEQ ID NO: 466309 - RNA, 22 nt, Human
aauauuuuaggcuuuccaggcu

SEQ ID NO: 466310 - RNA, 22 nt, Human
aggcagcaaagaaaugaugcug

SEQ ID NO: 466311 - RNA, 22 nt, Human
uucagagcaucucuaaagccag

SEQ ID NO: 466312 - RNA, 22 nt, Human
ucugccuggaugauggcagggc

SEQ ID NO: 466313 - RNA, 22 nt, Human
ucagcugccucucccuggaaga

SEQ ID NO: 466314 - RNA, 22 nt, Human
cugaggugcuagggucccugcu

SEQ ID NO: 466315 - RNA, 22 nt, Human
uguuuucauuugauguaacaaa

SEQ ID NO: 466316 - RNA, 22 nt, Human
aaguguuuauuuauaacgaucu

SEQ ID NO: 466317 - RNA, 22 nt, Human
gcugccucugcgacucugggcg

SEQ ID NO: 466318 - RNA, 22 nt, Human
augaggcucucaggggagcugu

SEQ ID NO: 466319 - RNA, 22 nt, Human
gcaggcuggaggcuguucuggg

SEQ ID NO: 466320 - RNA, 22 nt, Human
uaaaauguguuucuguaugguu

SEQ ID NO: 466321 - RNA, 23 nt, Human
gcuguacaggaaccaguuuggag

SEQ ID NO: 466322 - RNA, 22 nt, Human
aaugagacacgugaagcagaug

SEQ ID NO: 466323 - RNA, 22 nt, Human
uaaggccaaggggccauagucu

SEQ ID NO: 466324 - RNA, 22 nt, Human
uccaggaggaggaaggcugcca

SEQ ID NO: 466325 - RNA, 22 nt, Human
gggcagcagagcccugccgagu

SEQ ID NO: 466326 - RNA, 22 nt, Human
gaggcagagugcaccccaggag

SEQ ID NO: 466327 - RNA, 22 nt, Human
aauuucuccaagaaugcuuaga

SEQ ID NO: 466328 - RNA, 22 nt, Human
aagucaaucacaugcacacuga

SEQ ID NO: 466329 - RNA, 22 nt, Human
gggaccuggggacuccuuguuc

SEQ ID NO: 466330 - RNA, 22 nt, Human
uuauuacacugaaagaauugcg

SEQ ID NO: 466331 - RNA, 22 nt, Human
uaaaacugaauacauacugagg

SEQ ID NO: 466332 - RNA, 18 nt, Human
aucuuuccauagcauguu

SEQ ID NO: 466333 - RNA, 21 nt, Human
acagacagggccagugucccc

SEQ ID NO: 466334 - RNA, 22 nt, Human
cagccccucccucaggcaggug

SEQ ID NO: 466335 - RNA, 22 nt, Human
ugucaugccauuuaaaauguuu

SEQ ID NO: 466336 - RNA, 22 nt, Human
cugcagccucaaccuccugagc

SEQ ID NO: 466337 - RNA, 22 nt, Human
cccaggcaucccauuaaggagc

SEQ ID NO: 466338 - RNA, 22 nt, Human
cugagcugguucucuugugaaa

SEQ ID NO: 466339 - RNA, 22 nt, Human
ucugucuuuagaggccugugcu

SEQ ID NO: 466340 - RNA, 22 nt, Human
caggugcucccagagaagugcu

SEQ ID NO: 466341 - RNA, 22 nt, Human
ggagacaguauggcuuguagcu

SEQ ID NO: 466342 - RNA, 22 nt, Human
ugaugaaauguugaggcaguga

SEQ ID NO: 466343 - RNA, 22 nt, Human
ggguccagcuacaucagggugg

SEQ ID NO: 466344 - RNA, 22 nt, Human
gaggcagcaggcugaggaggau

SEQ ID NO: 466345 - RNA, 22 nt, Human
uuuaaaaucagaugggaguugg

SEQ ID NO: 466346 - RNA, 22 nt, Human
gcugucugucuucacaucucgc

SEQ ID NO: 466347 - RNA, 22 nt, Human
gagccagccgcaagagcuguga

SEQ ID NO: 466348 - RNA, 22 nt, Human
aggaggaauacaauccagcagc

SEQ ID NO: 466349 - RNA, 22 nt, Human
cugccugugccaccgccucauu

SEQ ID NO: 466350 - RNA, 22 nt, Human
gcaggagagccagcaggcuucc

SEQ ID NO: 466351 - RNA, 22 nt, Human
cacugcuuuaaggcugaguaac

SEQ ID NO: 466352 - RNA, 23 nt, Human
gugcaugugucuuuacaguagca

SEQ ID NO: 466353 - RNA, 18 nt, Human
gaggauggaaggagaugc

SEQ ID NO: 466354 - RNA, 22 nt, Human
agaaaguuuugugcuauauaug

SEQ ID NO: 466355 - RNA, 22 nt, Human
cagcccuggugccaagguuccc

SEQ ID NO: 466356 - RNA, 22 nt, Human
cccaggcugaugggaugggcca

SEQ ID NO: 466357 - RNA, 22 nt, Human
ggcagcagggucuagauugaug

SEQ ID NO: 466358 - RNA, 22 nt, Human
ccuggagcucacugggagccgg

SEQ ID NO: 466359 - RNA, 22 nt, Human
cccuggagucagguuggccugg

SEQ ID NO: 466360 - RNA, 22 nt, Human
cacuguacugugaauaaggagg

SEQ ID NO: 466361 - RNA, 22 nt, Human
uagcccagagucccaauuccag

SEQ ID NO: 466362 - RNA, 22 nt, Human
ugcauugcauuugucaugaaga

SEQ ID NO: 466363 - RNA, 22 nt, Human
acaaaggugcgucccuucagcu

SEQ ID NO: 466364 - RNA, 22 nt, Human
cagcaggaccauugaggcauca

SEQ ID NO: 466365 - RNA, 22 nt, Human
cagugcaguuucccagaugcug

SEQ ID NO: 466366 - RNA, 21 nt, Human
uucauaaaccauucucaugca

SEQ ID NO: 466367 - RNA, 22 nt, Human
cccaggcagaauuaguguuuca

SEQ ID NO: 466368 - RNA, 22 nt, Human
gcaggaagcauagaagaaugcc

SEQ ID NO: 466369 - RNA, 22 nt, Human
uggaggugagugugguacagca

SEQ ID NO: 466370 - RNA, 22 nt, Human
cccagcuucugagggggccuug

SEQ ID NO: 466371 - RNA, 22 nt, Human
aaugcaguuucauuuguagaau

SEQ ID NO: 466372 - RNA, 22 nt, Human
agccaggcgggucuuugcuccu

SEQ ID NO: 466373 - RNA, 23 nt, Human
uguagcaucucuuauuucucagc

SEQ ID NO: 466374 - RNA, 22 nt, Human
cuggagccccaggcugugcaga

SEQ ID NO: 466375 - RNA, 19 nt, Human
ucucugcuucucuuggcau

SEQ ID NO: 466376 - RNA, 22 nt, Human
gugauuucaaauauagagugag

SEQ ID NO: 466377 - RNA, 22 nt, Human
uagccgggugugguggaacucc

SEQ ID NO: 466378 - RNA, 22 nt, Human
aauauuuguuaguguuuuaaug

SEQ ID NO: 466379 - RNA, 22 nt, Human
gacaagacaccucucuccaucc

SEQ ID NO: 466380 - RNA, 22 nt, Human
cacuacuugaaagaauuacaga

SEQ ID NO: 466381 - RNA, 22 nt, Human
ggauuucuuccuuccucagaag

SEQ ID NO: 466382 - RNA, 22 nt, Human
gcuggaccaggugugcacaggc

SEQ ID NO: 466383 - RNA, 22 nt, Human
gagcugccagacaugggaauga

SEQ ID NO: 466384 - RNA, 22 nt, Human
cagcugggcuaagaguagaggc

SEQ ID NO: 466385 - RNA, 17 nt, Human
ugagaaguaggcaucau

SEQ ID NO: 466386 - RNA, 22 nt, Human
uggcucucaggccugcugcguu

SEQ ID NO: 466387 - RNA, 22 nt, Human
cuggagcagguuuaggaguccc

SEQ ID NO: 466388 - RNA, 22 nt, Human
aagacagaccacgugacagggc

SEQ ID NO: 466389 - RNA, 22 nt, Human
aacaacugaaaagcuuuuucug

SEQ ID NO: 466390 - RNA, 22 nt, Human
aaguguguugacugaauugggg

SEQ ID NO: 466391 - RNA, 22 nt, Human
aagacaagcaucaaaucaggca

SEQ ID NO: 466392 - RNA, 22 nt, Human
uccauuuucuugcucuagguaa

SEQ ID NO: 466393 - RNA, 22 nt, Human
cauugcugugggcauuugcugc

SEQ ID NO: 466394 - RNA, 22 nt, Human
aguucccaggugaugcugaugu

SEQ ID NO: 466395 - RNA, 22 nt, Human
caauguaucaagaagcaucagu

SEQ ID NO: 466396 - RNA, 22 nt, Human
uggcucaguuucaguccugguu

SEQ ID NO: 466397 - RNA, 22 nt, Human
agccaugcaccuuacucuugcu

SEQ ID NO: 466398 - RNA, 22 nt, Human
caugggaggucugcaaggugcu

SEQ ID NO: 466399 - RNA, 22 nt, Human
ccaucuccacugucccugucaa

SEQ ID NO: 466400 - RNA, 22 nt, Human
agcugcugcggaaagaugccac

SEQ ID NO: 466401 - RNA, 20 nt, Human
uccugcaguuccuaggaggg

SEQ ID NO: 466402 - RNA, 22 nt, Human
cucuggaguucuucaagcuacu

SEQ ID NO: 466403 - RNA, 22 nt, Human
cagggcaggaauuugacauugc

SEQ ID NO: 466404 - RNA, 22 nt, Human
uauuugaaaguguacaaaaacu

SEQ ID NO: 466405 - RNA, 19 nt, Human
ggcuccuguggcugcagcc

SEQ ID NO: 466406 - RNA, 22 nt, Human
uggccuuggcagugagaagagu

SEQ ID NO: 466407 - RNA, 22 nt, Human
gugcauuuggugacucucaccc

SEQ ID NO: 466408 - RNA, 22 nt, Human
gggacugggagauccuccuggc

SEQ ID NO: 466409 - RNA, 19 nt, Human
ugccuggcaccagcuccac

SEQ ID NO: 466410 - RNA, 22 nt, Human
gagagucacugucugcauuucc

SEQ ID NO: 466411 - RNA, 22 nt, Human
gaaggaagugcucauacuaguu

SEQ ID NO: 466412 - RNA, 22 nt, Human
ugcuuuauggagcccaucucau

SEQ ID NO: 466413 - RNA, 20 nt, Human
aggcugaguucuaugcacuu

SEQ ID NO: 466414 - RNA, 22 nt, Human
cacauggaagagauacagugag

SEQ ID NO: 466415 - RNA, 23 nt, Human
aaguucaagucacagccugucuu

SEQ ID NO: 466416 - RNA, 22 nt, Human
gaacaauagugguaacaaagcc

SEQ ID NO: 466417 - RNA, 22 nt, Human
cugaggcugcccagggccaggu

SEQ ID NO: 466418 - RNA, 22 nt, Human
uuucacaaacugaggagacaau

SEQ ID NO: 466419 - RNA, 19 nt, Human
accaggccucagaggcccu

SEQ ID NO: 466420 - RNA, 22 nt, Human
gaggcugcacuggcuaaaggcu

SEQ ID NO: 466421 - RNA, 22 nt, Human
guguggcugugggagauguuca

SEQ ID NO: 466422 - RNA, 22 nt, Human
gugcucaggaagcuguuccugc

SEQ ID NO: 466423 - RNA, 22 nt, Human
uguggccuccuguuccugggua

SEQ ID NO: 466424 - RNA, 22 nt, Human
uggcucaguuaggucagaaaca

SEQ ID NO: 466425 - RNA, 22 nt, Human
cuucuuaaucccuuauauauuu

SEQ ID NO: 466426 - RNA, 22 nt, Human
agacagcaugauacaugaugcu

SEQ ID NO: 466427 - RNA, 22 nt, Human
cuggggcuucaaugcuucggug

SEQ ID NO: 466428 - RNA, 22 nt, Human
agagcuggggccagagucaagg

SEQ ID NO: 466429 - RNA, 22 nt, Human
uaccuugggguuuuguugcucu

SEQ ID NO: 466430 - RNA, 22 nt, Human
gaaaucugcccagugcacuggu

SEQ ID NO: 466431 - RNA, 22 nt, Human
aaggaaaggaugagcaugcauu

SEQ ID NO: 466432 - RNA, 22 nt, Human
gccaagagaaugugagagaaau

SEQ ID NO: 466433 - RNA, 22 nt, Human
ugucucugccagcuagcagaau

SEQ ID NO: 466434 - RNA, 20 nt, Human
cagagcuguuauggaugaug

SEQ ID NO: 466435 - RNA, 22 nt, Human
gucaggaucucccaguacauau

SEQ ID NO: 466436 - RNA, 19 nt, Human
ccaggccaucccaguuccc

SEQ ID NO: 466437 - RNA, 22 nt, Human
gacauaaaccuugagauauuaa

SEQ ID NO: 466438 - RNA, 22 nt, Human
ugauuuccaugaagcugaaggc

SEQ ID NO: 466439 - RNA, 22 nt, Human
agcaggugacagggcuguggug

SEQ ID NO: 466440 - RNA, 22 nt, Human
gcugugcaguaguagguacagu

SEQ ID NO: 466441 - RNA, 22 nt, Human
gcagugauuggaucagagaugg

SEQ ID NO: 466442 - RNA, 22 nt, Human
aggugagguuugggagguguca

SEQ ID NO: 466443 - RNA, 22 nt, Human
agcagggcuucugugccugugc

SEQ ID NO: 466444 - RNA, 22 nt, Human
cauuucugcagaauugcucuuc

SEQ ID NO: 466445 - RNA, 22 nt, Human
aaaucagucccucuuggaauuu

SEQ ID NO: 466446 - RNA, 22 nt, Human
caguugcuacaguucaagugug

SEQ ID NO: 466447 - RNA, 22 nt, Human
gguggccugcccugaucccugg

SEQ ID NO: 466448 - RNA, 22 nt, Human
uggcagaggagaauuaagauua

SEQ ID NO: 466449 - RNA, 23 nt, Human
gccauggcugccccacaggccuc

SEQ ID NO: 466450 - RNA, 23 nt, Human
cauuucugggagauuuauaaaau

SEQ ID NO: 466451 - RNA, 22 nt, Human
ccagggccaagagaccucgagg

SEQ ID NO: 466452 - RNA, 19 nt, Human
agcuguggggccuagcacc

SEQ ID NO: 466453 - RNA, 22 nt, Human
aggcucagauccuuguguccug

SEQ ID NO: 466454 - RNA, 22 nt, Human
guguccagagaaacucacagcu

SEQ ID NO: 466455 - RNA, 22 nt, Human
acuuucucaaaucagacuuuaa

SEQ ID NO: 466456 - RNA, 22 nt, Human
aagaaaugcagaaaugugcugg

SEQ ID NO: 466457 - RNA, 22 nt, Human
acaguggagcucagaugaaaau

SEQ ID NO: 466458 - RNA, 22 nt, Human
aagacuuucucccaaauccuca

SEQ ID NO: 466459 - RNA, 22 nt, Human
cagacagacagccguggccacc

SEQ ID NO: 466460 - RNA, 22 nt, Human
acucccagguugccuggcaggc

SEQ ID NO: 466461 - RNA, 22 nt, Human
acuuugcacuaaguuacucauu

SEQ ID NO: 466462 - RNA, 22 nt, Human
cugugcauugucuugucuguag

SEQ ID NO: 466463 - RNA, 22 nt, Human
acuuuauuuccuauugcaucca

SEQ ID NO: 466464 - RNA, 22 nt, Human
agacaggacacaagcugcauaa

SEQ ID NO: 466465 - RNA, 22 nt, Human
caagagcuggagaggcagucua

SEQ ID NO: 466466 - RNA, 22 nt, Human
ugcaugcauaaauguacacaca

SEQ ID NO: 466467 - RNA, 22 nt, Human
gggcugacaccacccaggcgca

SEQ ID NO: 466468 - RNA, 22 nt, Human
ucucagucuuugcaaggaugcu

SEQ ID NO: 466469 - RNA, 22 nt, Human
agcaucuggugagggccuaguu

SEQ ID NO: 466470 - RNA, 22 nt, Human
caccaggcugaaccagagggga

SEQ ID NO: 466471 - RNA, 22 nt, Human
ggccugucucacccccgggugc

SEQ ID NO: 466472 - RNA, 22 nt, Human
gucagaggggacaagacacaga

SEQ ID NO: 466473 - RNA, 22 nt, Human
agcuuuuaguacguuaaaauug

SEQ ID NO: 466474 - RNA, 22 nt, Human
ugcaccauacccauuccccucu

SEQ ID NO: 466475 - RNA, 22 nt, Human
uaggugugggcucaggaaugug

SEQ ID NO: 466476 - RNA, 22 nt, Human
gaggaggaggaaguggaaccca

SEQ ID NO: 466477 - RNA, 22 nt, Human
ucauuguuucugcuuuucauga

SEQ ID NO: 466478 - RNA, 22 nt, Human
agaggcuccuucacucuggcac

SEQ ID NO: 466479 - RNA, 22 nt, Human
ugaaauguuugaagaccacuga

SEQ ID NO: 466480 - RNA, 22 nt, Human
acuguucauuuggauuucucug

SEQ ID NO: 466481 - RNA, 22 nt, Human
ucucaguguguuuucucucaga

SEQ ID NO: 466482 - RNA, 22 nt, Human
ucagucucaucaacucuauucc

SEQ ID NO: 466483 - RNA, 22 nt, Human
aguacauuuauuaaugguaaaa

SEQ ID NO: 466484 - RNA, 22 nt, Human
acccacgaagaugagcggcaug

SEQ ID NO: 466485 - RNA, 22 nt, Human
ugucucuggcccaugagcagag

SEQ ID NO: 466486 - RNA, 22 nt, Human
uguaggacauguacuuguaaca

SEQ ID NO: 466487 - RNA, 22 nt, Human
cugcagggaacugaggcccaga

SEQ ID NO: 466488 - RNA, 22 nt, Human
agcucccagggcugggcaaguu

SEQ ID NO: 466489 - RNA, 22 nt, Human
ggucucagcuggaguccuuggu

SEQ ID NO: 466490 - RNA, 22 nt, Human
cuggcuuucauuucaagcacgu

SEQ ID NO: 466491 - RNA, 22 nt, Human
gcaggagugacauggaugugga

SEQ ID NO: 466492 - RNA, 22 nt, Human
uagucuuuugagaaguauaucu

SEQ ID NO: 466493 - RNA, 22 nt, Human
gcaagauguuaacauagggaga

SEQ ID NO: 466494 - RNA, 22 nt, Human
aguuauauaacuaucuagaugc

SEQ ID NO: 466495 - RNA, 22 nt, Human
ccuuccuggcuguccgccugau

SEQ ID NO: 466496 - RNA, 22 nt, Human
uuugaaagggaaauaaacuccu

SEQ ID NO: 466497 - RNA, 22 nt, Human
ugggccuggguuccuccugggc

SEQ ID NO: 466498 - RNA, 22 nt, Human
auggcagggaccaagcugucau

SEQ ID NO: 466499 - RNA, 22 nt, Human
cccagcuccaagggacagcgaa

SEQ ID NO: 466500 - RNA, 22 nt, Human
ucucccaguggugcagaaagca

SEQ ID NO: 466501 - RNA, 22 nt, Human
ccagaggaguugaggcuuuggg

SEQ ID NO: 466502 - RNA, 22 nt, Human
aggaggcccuagagcucuagag

SEQ ID NO: 466503 - RNA, 19 nt, Human
uuugaaaggauuguuauuu

SEQ ID NO: 466504 - RNA, 22 nt, Human
acauuucuauagugcaucuguu

SEQ ID NO: 466505 - RNA, 22 nt, Human
uaccugagcccagugcagcaua

SEQ ID NO: 466506 - RNA, 22 nt, Human
gagccugaauuugaccugcuua

SEQ ID NO: 466507 - RNA, 22 nt, Human
ugcagcugauuaaagggcagac

SEQ ID NO: 466508 - RNA, 22 nt, Human
uggcagggaauacagauguuua

SEQ ID NO: 466509 - RNA, 22 nt, Human
aguggcagcugucaugcccuag

SEQ ID NO: 466510 - RNA, 22 nt, Human
uggcacugagcagccgcggcag

SEQ ID NO: 466511 - RNA, 22 nt, Human
cugccagcaaugugaccaugcu

SEQ ID NO: 466512 - RNA, 22 nt, Human
uggccuguggcuuaaggucugu

SEQ ID NO: 466513 - RNA, 22 nt, Human
ugucccaguuuugcagguuaga

SEQ ID NO: 466514 - RNA, 22 nt, Human
cacuggcaugugaggcgguggc

SEQ ID NO: 466515 - RNA, 22 nt, Human
agaaaagggcaggagggauaca

SEQ ID NO: 466516 - RNA, 22 nt, Human
uggcuucagacuucugcuacgu

SEQ ID NO: 466517 - RNA, 22 nt, Human
cucugaauggacacuccagugu

SEQ ID NO: 466518 - RNA, 22 nt, Human
aagggaggaggauuuauuguac

SEQ ID NO: 466519 - RNA, 22 nt, Human
aggcugaugcuggcugaggcug

SEQ ID NO: 466520 - RNA, 22 nt, Human
ccaguggaaauguggucaggau

SEQ ID NO: 466521 - RNA, 22 nt, Human
agugaaaugauaguguaaauac

SEQ ID NO: 466522 - RNA, 22 nt, Human
uagggcucgggcacaggacagg

SEQ ID NO: 466523 - RNA, 19 nt, Human
acccagagcccuuugcagg

SEQ ID NO: 466524 - RNA, 22 nt, Human
cucuggagaugguucucaauug

SEQ ID NO: 466525 - RNA, 22 nt, Human
uggcagguuuccuccucauagu

SEQ ID NO: 466526 - RNA, 22 nt, Human
gggccucucccuucucacgcau

SEQ ID NO: 466527 - RNA, 22 nt, Human
uggccucuuaggacauccucua

SEQ ID NO: 466528 - RNA, 22 nt, Human
acuucauuguaauauuauagca

SEQ ID NO: 466529 - RNA, 22 nt, Human
caguacuuguccucagguguua

SEQ ID NO: 466530 - RNA, 22 nt, Human
guggcugcagagccagcaagcu

SEQ ID NO: 466531 - RNA, 19 nt, Human
caggccagugucagggggc

SEQ ID NO: 466532 - RNA, 22 nt, Human
cccugagcccauaguugacauu

SEQ ID NO: 466533 - RNA, 22 nt, Human
ggcugcugugaccucaggugau

SEQ ID NO: 466534 - RNA, 22 nt, Human
gacaggcuuugagucccagaac

SEQ ID NO: 466535 - RNA, 22 nt, Human
cagggcaguuugugccuaugag

SEQ ID NO: 466536 - RNA, 22 nt, Human
cagggcugugcccaucuucccc

SEQ ID NO: 466537 - RNA, 22 nt, Human
uuuuuaguagagguggguuuca

SEQ ID NO: 466538 - RNA, 22 nt, Human
ccaggguggaggcuggauggag

SEQ ID NO: 466539 - RNA, 22 nt, Human
agggcagcagcuccuccuagcu

SEQ ID NO: 466540 - RNA, 22 nt, Human
uaugcacacaggcuuaauucau

SEQ ID NO: 466541 - RNA, 22 nt, Human
acucccacuccagaguagaagc

SEQ ID NO: 466542 - RNA, 22 nt, Human
ugcagcauugcaaagcagucuu

SEQ ID NO: 466543 - RNA, 21 nt, Human
gcaggcuggucaaaccucagu

SEQ ID NO: 466544 - RNA, 22 nt, Human
ggccucuguuuggagccaggau

SEQ ID NO: 466545 - RNA, 22 nt, Human
ucacagaaauaagauaguuauu

SEQ ID NO: 466546 - RNA, 22 nt, Human
cacagggccacuuucccaguaa

SEQ ID NO: 466547 - RNA, 22 nt, Human
ugaaccaggaggcagccagcac

SEQ ID NO: 466548 - RNA, 22 nt, Human
ugcuucucccaaccagggccug

SEQ ID NO: 466549 - RNA, 22 nt, Human
gcaggagcugcucuccugacga

SEQ ID NO: 466550 - RNA, 22 nt, Human
uaaggguucagaaugcaguggu

SEQ ID NO: 466551 - RNA, 22 nt, Human
acagaaauauagaagguaggaa

SEQ ID NO: 466552 - RNA, 20 nt, Human
cuguccccgaggucaccagg

SEQ ID NO: 466553 - RNA, 22 nt, Human
acaguaaaaagccuuagaauuu

SEQ ID NO: 466554 - RNA, 22 nt, Human
caaggagaguaauugaaugaga

SEQ ID NO: 466555 - RNA, 22 nt, Human
uuuuaagaugcuaguauuucag

SEQ ID NO: 466556 - RNA, 22 nt, Human
ugcucagugagucugugacagg

SEQ ID NO: 466557 - RNA, 22 nt, Human
uaucuuuauuaugucuaucugc

SEQ ID NO: 466558 - RNA, 22 nt, Human
aaaggccacacagagcagggag

SEQ ID NO: 466559 - RNA, 22 nt, Human
gaucauuuacuuguucuggacu

SEQ ID NO: 466560 - RNA, 22 nt, Human
cuccuuccugccccagugauaa

SEQ ID NO: 466561 - RNA, 22 nt, Human
agaggccuuucuguugagugaa

SEQ ID NO: 466562 - RNA, 22 nt, Human
augaggcuaugaauggggagau

SEQ ID NO: 466563 - RNA, 22 nt, Human
accaaggaagaaucuauuugag

SEQ ID NO: 466564 - RNA, 22 nt, Human
aggugccagcucucaggcagga

SEQ ID NO: 466565 - RNA, 22 nt, Human
cagggcaguuuuacuucucucu

SEQ ID NO: 466566 - RNA, 19 nt, Human
ucaggaguuaguugugcuc

SEQ ID NO: 466567 - RNA, 22 nt, Human
uuucacagguacaaacacuccu

SEQ ID NO: 466568 - RNA, 22 nt, Human
uuagaaaucugcugccaugcaa

SEQ ID NO: 466569 - RNA, 17 nt, Human
cucagaguugcuuuguc

SEQ ID NO: 466570 - RNA, 22 nt, Human
agguacagcaauauaagagguc

SEQ ID NO: 466571 - RNA, 22 nt, Human
uguguguauaugcauuuaucua

SEQ ID NO: 466572 - RNA, 22 nt, Human
gaaggccauuagagccugugcc

SEQ ID NO: 466573 - RNA, 22 nt, Human
ugcuucuggaaacaguggcugu

SEQ ID NO: 466574 - RNA, 22 nt, Human
gagagguccauuccccugucag

SEQ ID NO: 466575 - RNA, 22 nt, Human
gcuuagucaauuauaaauaggc

SEQ ID NO: 466576 - RNA, 22 nt, Human
gcugccaauccagcugugggag

SEQ ID NO: 466577 - RNA, 22 nt, Human
cuuaacagagagaaguguugcu

SEQ ID NO: 466578 - RNA, 22 nt, Human
ugggcaggugcuauuuuccaug

SEQ ID NO: 466579 - RNA, 22 nt, Human
ccauggcauuuuaugugucuua

SEQ ID NO: 466580 - RNA, 22 nt, Human
gggcugagaaguugaucccaag

SEQ ID NO: 466581 - RNA, 22 nt, Human
gcugggagcccuggucugcucc

SEQ ID NO: 466582 - RNA, 22 nt, Human
uaacagaaaggcucaggugcuc

SEQ ID NO: 466583 - RNA, 22 nt, Human
acaguggaugacauccuuuugc

SEQ ID NO: 466584 - RNA, 22 nt, Human
uguacaguaggaacuuguuauu

SEQ ID NO: 466585 - RNA, 20 nt, Human
ccagagcagccacugaaguu

SEQ ID NO: 466586 - RNA, 22 nt, Human
aguugcagacgcagagauguug

SEQ ID NO: 466587 - RNA, 22 nt, Human
guggguggaucaccugagguca

SEQ ID NO: 466588 - RNA, 22 nt, Human
uaaggccagcaugaaugcagca

SEQ ID NO: 466589 - RNA, 22 nt, Human
agugugcugcuuaaacaguugu

SEQ ID NO: 466590 - RNA, 17 nt, Human
gguguauggggagggaa

SEQ ID NO: 466591 - RNA, 22 nt, Human
ucccagccauuccuuuaggugu

SEQ ID NO: 466592 - RNA, 20 nt, Human
ugggcagcacugcuggcugg

SEQ ID NO: 466593 - RNA, 22 nt, Human
agaccaugggcucugaagagca

SEQ ID NO: 466594 - RNA, 22 nt, Human
auuuuuccaugauacuuaucug

SEQ ID NO: 466595 - RNA, 21 nt, Human
aucagaaguuuuggucaguag

SEQ ID NO: 466596 - RNA, 22 nt, Human
ggaaagagcccagcagugcuug

SEQ ID NO: 466597 - RNA, 22 nt, Human
ucaggcagaauuaucaaaagau

SEQ ID NO: 466598 - RNA, 22 nt, Human
aggcugagccacggggcuggcu

SEQ ID NO: 466599 - RNA, 22 nt, Human
cugggaggauucauugagguga

SEQ ID NO: 466600 - RNA, 22 nt, Human
cagcucuggcgucagggagcga

SEQ ID NO: 466601 - RNA, 22 nt, Human
ccucccugcgcuccugcggcgg

SEQ ID NO: 466602 - RNA, 22 nt, Human
cugcccuguggcucugagucau

SEQ ID NO: 466603 - RNA, 22 nt, Human
gccuggagccucagcaaggagg

SEQ ID NO: 466604 - RNA, 21 nt, Human
cugugcuucuuccuaagccag

SEQ ID NO: 466605 - RNA, 22 nt, Human
ggcagcucugcuccacaugagu

SEQ ID NO: 466606 - RNA, 19 nt, Human
aacuagaaagguuuugaga

SEQ ID NO: 466607 - RNA, 23 nt, Human
ugcucugugaauaguuggugacu

SEQ ID NO: 466608 - RNA, 22 nt, Human
caggccuggcugcagcucgccu

SEQ ID NO: 466609 - RNA, 22 nt, Human
agaagccaaucagcucucugcu

SEQ ID NO: 466610 - RNA, 22 nt, Human
ccugccugaaggucagccaccc

SEQ ID NO: 466611 - RNA, 22 nt, Human
gcaccuggacagugacccuagc

SEQ ID NO: 466612 - RNA, 22 nt, Human
aaugcacaugccacauguggua

SEQ ID NO: 466613 - RNA, 22 nt, Human
auugaauagaugcauuauacua

SEQ ID NO: 466614 - RNA, 21 nt, Human
uuucugucucugccacuaguu

SEQ ID NO: 466615 - RNA, 22 nt, Human
uugacaagaaucguugccuugg

SEQ ID NO: 466616 - RNA, 23 nt, Human
cuguggcugaguccuguuggagu

SEQ ID NO: 466617 - RNA, 22 nt, Human
cuuugaaaacuuaaauaacagc

SEQ ID NO: 466618 - RNA, 22 nt, Human
gcgguagcucaagcuuguaauc

SEQ ID NO: 466619 - RNA, 22 nt, Human
cuggccugggagcugcuagcgu

SEQ ID NO: 466620 - RNA, 22 nt, Human
cagagcucagagcagggcacuc

SEQ ID NO: 466621 - RNA, 21 nt, Human
cagagcagcguucugcugugg

SEQ ID NO: 466622 - RNA, 22 nt, Human
accugccuaucagcugccugcu

SEQ ID NO: 466623 - RNA, 22 nt, Human
gaaggcuggcuuucugagagca

SEQ ID NO: 466624 - RNA, 22 nt, Human
ugcauugcaguuaacucaguau

SEQ ID NO: 466625 - RNA, 22 nt, Human
uguacauacauagauauacaca

SEQ ID NO: 466626 - RNA, 22 nt, Human
uuaacagagaacauagaaguag

SEQ ID NO: 466627 - RNA, 22 nt, Human
gcagcuuucuuuuugcaugucu

SEQ ID NO: 466628 - RNA, 19 nt, Human
ggcugccuuuccuuaccag

SEQ ID NO: 466629 - RNA, 22 nt, Human
gggcugacaaccaucugacaag

SEQ ID NO: 466630 - RNA, 22 nt, Human
ugucucaggcccaagccaguaa

SEQ ID NO: 466631 - RNA, 22 nt, Human
uggccuggcccugaggcccugu

SEQ ID NO: 466632 - RNA, 22 nt, Human
aaugggaagucacuacuguuac

SEQ ID NO: 466633 - RNA, 22 nt, Human
ucauccaguaccauggaaggca

SEQ ID NO: 466634 - RNA, 22 nt, Human
acagcuuuguguuaaugggaag

SEQ ID NO: 466635 - RNA, 22 nt, Human
caugaagcauguuuugucauga

SEQ ID NO: 466636 - RNA, 22 nt, Human
agauggagaccuuggaugaacu

SEQ ID NO: 466637 - RNA, 22 nt, Human
uuuaaauaggacuccugggggu

SEQ ID NO: 466638 - RNA, 22 nt, Human
cccauucauccucgcuuccuuc

SEQ ID NO: 466639 - RNA, 21 nt, Human
aggcagcucaggcccagagag

SEQ ID NO: 466640 - RNA, 22 nt, Human
ggccugggcccacugucaagag

SEQ ID NO: 466641 - RNA, 22 nt, Human
ggcaccuggauguagcagugaa

SEQ ID NO: 466642 - RNA, 22 nt, Human
auggggcucugcggcugcuccc

SEQ ID NO: 466643 - RNA, 19 nt, Human
ugaggccaaggucacagau

SEQ ID NO: 466644 - RNA, 22 nt, Human
acuguguggaaauuugugaggg

SEQ ID NO: 466645 - RNA, 22 nt, Human
uucuguguggguagcuccuguu

SEQ ID NO: 466646 - RNA, 22 nt, Human
agggccuggugaccuggguccu

SEQ ID NO: 466647 - RNA, 22 nt, Human
ugcuuuauucccuucugaugug

SEQ ID NO: 466648 - RNA, 18 nt, Human
ucucugaauauuuuaugu

SEQ ID NO: 466649 - RNA, 22 nt, Human
auucaguaggucuagaauaaga

SEQ ID NO: 466650 - RNA, 22 nt, Human
cagucacuggaauagcugagga

SEQ ID NO: 466651 - RNA, 22 nt, Human
agaguguuauuugcucuguauu

SEQ ID NO: 466652 - RNA, 22 nt, Human
gggcccacuggcugucugaccc

SEQ ID NO: 466653 - RNA, 22 nt, Human
ucaaagucuaucuguaauuacu

SEQ ID NO: 466654 - RNA, 22 nt, Human
uuaaacagacaguaaaugaaac

SEQ ID NO: 466655 - RNA, 22 nt, Human
aaaguguacuaugucaugaaca

SEQ ID NO: 466656 - RNA, 22 nt, Human
agggagaaugaccaagguauau

SEQ ID NO: 466657 - RNA, 22 nt, Human
agggccagcacuccuggcagga

SEQ ID NO: 466658 - RNA, 22 nt, Human
ucuggagcuggagggcaaggca

SEQ ID NO: 466659 - RNA, 22 nt, Human
auggaaagggaagcaaggaaca

SEQ ID NO: 466660 - RNA, 22 nt, Human
uccuggagaauccugccaccug

SEQ ID NO: 466661 - RNA, 22 nt, Human
aaagauucgagcgauguauaaa

SEQ ID NO: 466662 - RNA, 22 nt, Human
aggugcagcaugaguccaacgg

SEQ ID NO: 466663 - RNA, 22 nt, Human
uuccucuccucccaccagguga

SEQ ID NO: 466664 - RNA, 22 nt, Human
agucccaggcagccgagccggu

SEQ ID NO: 466665 - RNA, 22 nt, Human
guccucaggaaggcuuucugac

SEQ ID NO: 466666 - RNA, 22 nt, Human
ccagagccucuuaugaagaucg

SEQ ID NO: 466667 - RNA, 22 nt, Human
gagguacagaguguuccaaugu

SEQ ID NO: 466668 - RNA, 22 nt, Human
ggcugugggaugcauaggagcu

SEQ ID NO: 466669 - RNA, 19 nt, Human
ggccaccucucuucccagg

SEQ ID NO: 466670 - RNA, 22 nt, Human
ucagaggacaagcucccuggug

SEQ ID NO: 466671 - RNA, 22 nt, Human
acauuucucccugcaugccugc

SEQ ID NO: 466672 - RNA, 22 nt, Human
ugaagcaggguggccagauugu

SEQ ID NO: 466673 - RNA, 22 nt, Human
cugagcugcuuugcuuuugggg

SEQ ID NO: 466674 - RNA, 22 nt, Human
uuucacauguggaaugccaggu

SEQ ID NO: 466675 - RNA, 22 nt, Human
cugagccaguagucagggacaa

SEQ ID NO: 466676 - RNA, 22 nt, Human
uuuaauuuuccucuuccuggag

SEQ ID NO: 466677 - RNA, 21 nt, Human
agaguaauuccugcuggaaag

SEQ ID NO: 466678 - RNA, 22 nt, Human
uuucagaugugugucucugaag

SEQ ID NO: 466679 - RNA, 22 nt, Human
cuucuugcaauuuucaucuuau

SEQ ID NO: 466680 - RNA, 22 nt, Human
guuuuuccugcugacuuggguc

SEQ ID NO: 466681 - RNA, 22 nt, Human
augcuuuauuauuuugcaggga

SEQ ID NO: 466682 - RNA, 22 nt, Human
gaguguuccagaaacuggcccu

SEQ ID NO: 466683 - RNA, 22 nt, Human
cugcugugugcuuacuuggguu

SEQ ID NO: 466684 - RNA, 19 nt, Human
cgcaggagccgaggugacc

SEQ ID NO: 466685 - RNA, 22 nt, Human
aucuacaggauuuuacagaguu

SEQ ID NO: 466686 - RNA, 22 nt, Human
gccaggcagauaugugagcuua

SEQ ID NO: 466687 - RNA, 22 nt, Human
uuucugaauaacucuaugauau

SEQ ID NO: 466688 - RNA, 22 nt, Human
cuucaucaacucuaacaaaugu

SEQ ID NO: 466689 - RNA, 22 nt, Human
agcugccagcaucccggaaggg

SEQ ID NO: 466690 - RNA, 22 nt, Human
aauggccagcugggagaguuga

SEQ ID NO: 466691 - RNA, 22 nt, Human
guccucagucaguuuggugggg

SEQ ID NO: 466692 - RNA, 22 nt, Human
uacuuucuagcucuccccaguu

SEQ ID NO: 466693 - RNA, 22 nt, Human
uuucuagaggcuccaggggagu

SEQ ID NO: 466694 - RNA, 22 nt, Human
gaagcccaggcuuccuuggcuu

SEQ ID NO: 466695 - RNA, 22 nt, Human
aaagaauuuguacacccuacua

SEQ ID NO: 466696 - RNA, 22 nt, Human
ucaguggauugacaugaaaaag

SEQ ID NO: 466697 - RNA, 22 nt, Human
guguccuuauuucugucucuca

SEQ ID NO: 466698 - RNA, 19 nt, Human
ugccagcauuaggcugaag

SEQ ID NO: 466699 - RNA, 21 nt, Human
agccuggcccagggggaggcu

SEQ ID NO: 466700 - RNA, 22 nt, Human
cuacaagauuuuuaaaacugua

SEQ ID NO: 466701 - RNA, 22 nt, Human
ugggcagaaggaagagccaccu

SEQ ID NO: 466702 - RNA, 22 nt, Human
cauuuagacauuugauuugggg

SEQ ID NO: 466703 - RNA, 23 nt, Human
gcaggugguucgaacagaaguuu

SEQ ID NO: 466704 - RNA, 22 nt, Human
aggaaacagugaacuuggcagg

SEQ ID NO: 466705 - RNA, 22 nt, Human
gacaugcaacaauuuggcauuu

SEQ ID NO: 466706 - RNA, 22 nt, Human
gguggguauaguuagggccucu

SEQ ID NO: 466707 - RNA, 22 nt, Human
agauggagaaugacaauuaagg

SEQ ID NO: 466708 - RNA, 23 nt, Human
agccacuucuaucuugcuccugg

SEQ ID NO: 466709 - RNA, 22 nt, Human
cugccucuugacagaucguggc

SEQ ID NO: 466710 - RNA, 22 nt, Human
gcacugcagguggguggagagg

SEQ ID NO: 466711 - RNA, 22 nt, Human
agccucuguagaaagcagugug

SEQ ID NO: 466712 - RNA, 22 nt, Human
aagcagaaaaacugagcuccaa

SEQ ID NO: 466713 - RNA, 18 nt, Human
ucuuggaguaaugaucaa

SEQ ID NO: 466714 - RNA, 22 nt, Human
agcucacagaaauccugcagga

SEQ ID NO: 466715 - RNA, 22 nt, Human
cuggcagcuuccuuugcaucug

SEQ ID NO: 466716 - RNA, 22 nt, Human
gggcacagagggucuugaagaa

SEQ ID NO: 466717 - RNA, 22 nt, Human
ucuucacaugaccuucaugucu

SEQ ID NO: 466718 - RNA, 22 nt, Human
ggccucagaccggagcuggcca

SEQ ID NO: 466719 - RNA, 22 nt, Human
caguagacacauuaauauggaa

SEQ ID NO: 466720 - RNA, 22 nt, Human
gaaggaaaacagaucugccuga

SEQ ID NO: 466721 - RNA, 22 nt, Human
gaggucaggggagaggcugaug

SEQ ID NO: 466722 - RNA, 22 nt, Human
agggccugggguagcuuacugc

SEQ ID NO: 466723 - RNA, 22 nt, Human
caucacuguccaaaguucaguu

SEQ ID NO: 466724 - RNA, 22 nt, Human
guacccagaggcaugaucccag

SEQ ID NO: 466725 - RNA, 22 nt, Human
cagucccagaagagccugggag

SEQ ID NO: 466726 - RNA, 22 nt, Human
ucagcccugaggacagaggcag

SEQ ID NO: 466727 - RNA, 22 nt, Human
auggcagcaaaugucuggcugg

SEQ ID NO: 466728 - RNA, 22 nt, Human
uccagaccauggauggcugcaa

SEQ ID NO: 466729 - RNA, 22 nt, Human
cagcuuugauucuuucugccau

SEQ ID NO: 466730 - RNA, 22 nt, Human
auguagcagaagauguuuuccu

SEQ ID NO: 466731 - RNA, 22 nt, Human
aaaaugaggucaauauccuuuu

SEQ ID NO: 466732 - RNA, 17 nt, Human
aggugcuggagcaucag

SEQ ID NO: 466733 - RNA, 22 nt, Human
uuuauuguuguuagucauaagu

SEQ ID NO: 466734 - RNA, 22 nt, Human
accccagcccugcuucugggag

SEQ ID NO: 466735 - RNA, 22 nt, Human
guccucagagugggcagguccu

SEQ ID NO: 466736 - RNA, 21 nt, Human
aaagagcccgcugagagguuc

SEQ ID NO: 466737 - RNA, 22 nt, Human
aagugaagaaauacaugagaau

SEQ ID NO: 466738 - RNA, 22 nt, Human
cagagcugcucaugguggccag

SEQ ID NO: 466739 - RNA, 19 nt, Human
uacuuuuucaggacagagu

SEQ ID NO: 466740 - RNA, 22 nt, Human
cagccaggagccucugcaacua

SEQ ID NO: 466741 - RNA, 22 nt, Human
augugcaaauccaaugugaaug

SEQ ID NO: 466742 - RNA, 22 nt, Human
uggcucagaguucaucuuuuag

SEQ ID NO: 466743 - RNA, 21 nt, Human
gcacagcaugaguguuggcau

SEQ ID NO: 466744 - RNA, 22 nt, Human
auagaauuacaguguguuugga

SEQ ID NO: 466745 - RNA, 22 nt, Human
ggcugcugggaauaugccagcu

SEQ ID NO: 466746 - RNA, 22 nt, Human
ccaccagcuuugccacccugcu

SEQ ID NO: 466747 - RNA, 22 nt, Human
gagaagcaaucaguggccaccc

SEQ ID NO: 466748 - RNA, 22 nt, Human
ucccagcagucagagcuaugug

SEQ ID NO: 466749 - RNA, 22 nt, Human
ucauuuaauaauuuuugaguag

SEQ ID NO: 466750 - RNA, 22 nt, Human
uuguuucugaguuuucauguau

SEQ ID NO: 466751 - RNA, 22 nt, Human
uauaauuuuaagugguaaauua

SEQ ID NO: 466752 - RNA, 22 nt, Human
gguuccacgguguuuggaggca

SEQ ID NO: 466753 - RNA, 22 nt, Human
caguggcuguuucuggaaggca

SEQ ID NO: 466754 - RNA, 19 nt, Human
ggaaacaggggccagagga

SEQ ID NO: 466755 - RNA, 22 nt, Human
gaaaguuuauagguuauauaau

SEQ ID NO: 466756 - RNA, 22 nt, Human
ucaagagagugcugcuuggggu

SEQ ID NO: 466757 - RNA, 22 nt, Human
uggcuggcaguaggcuaguggc

SEQ ID NO: 466758 - RNA, 22 nt, Human
aauuagagaucaguucuuugac

SEQ ID NO: 466759 - RNA, 22 nt, Human
aucaggaugacaacugcugggu

SEQ ID NO: 466760 - RNA, 20 nt, Human
ugucaugcauuagaugaaga

SEQ ID NO: 466761 - RNA, 22 nt, Human
agccucucuguuagucacuggg

SEQ ID NO: 466762 - RNA, 22 nt, Human
aauguguguucggggcccagag

SEQ ID NO: 466763 - RNA, 22 nt, Human
aucucagacauguuguccauga

SEQ ID NO: 466764 - RNA, 22 nt, Human
gacaggguacgggcuaggcaca

SEQ ID NO: 466765 - RNA, 22 nt, Human
acagucauagcagccuuuguua

SEQ ID NO: 466766 - RNA, 22 nt, Human
gagccuguguuuccuguagcca

SEQ ID NO: 466767 - RNA, 18 nt, Human
gagcugccauauuuaguu

SEQ ID NO: 466768 - RNA, 22 nt, Human
acccuggguucccgcagcacca

SEQ ID NO: 466769 - RNA, 22 nt, Human
aagggcucucugcauugaaauu

SEQ ID NO: 466770 - RNA, 22 nt, Human
uacaaaguuuucuuggauugag

SEQ ID NO: 466771 - RNA, 22 nt, Human
agggaguuccgaucugugcacc

SEQ ID NO: 466772 - RNA, 22 nt, Human
uacaaagucaccagcuucuugc

SEQ ID NO: 466773 - RNA, 22 nt, Human
agggaggaaggauguuccaaag

SEQ ID NO: 466774 - RNA, 22 nt, Human
agcuuccuguugagagagggag

SEQ ID NO: 466775 - RNA, 22 nt, Human
ggacacaguggaagacagcuug

SEQ ID NO: 466776 - RNA, 23 nt, Human
cuacaagagcaagcauggacaag

SEQ ID NO: 466777 - RNA, 22 nt, Human
acagggcccuugccagcacaag

SEQ ID NO: 466778 - RNA, 22 nt, Human
auaugcaagcacauagaauacu

SEQ ID NO: 466779 - RNA, 22 nt, Human
guggcaggagagacacagccau

SEQ ID NO: 466780 - RNA, 22 nt, Human
aggccuccuggcuccaggccuu

SEQ ID NO: 466781 - RNA, 22 nt, Human
uauuucuuuucgugacuuauug

SEQ ID NO: 466782 - RNA, 22 nt, Human
uuuccucuucgauuaaguuugg

SEQ ID NO: 466783 - RNA, 23 nt, Human
agcagccagagauccucggcccu

SEQ ID NO: 466784 - RNA, 22 nt, Human
cuaguccagucucaaaaugcua

SEQ ID NO: 466785 - RNA, 22 nt, Human
caggccucuccuuagucuggca

SEQ ID NO: 466786 - RNA, 22 nt, Human
auaugugugaugcauggacuaa

SEQ ID NO: 466787 - RNA, 22 nt, Human
ggcuucccagcagagggcgcac

SEQ ID NO: 466788 - RNA, 22 nt, Human
agccuggauccuaggcucagcu

SEQ ID NO: 466789 - RNA, 22 nt, Human
uggcuuccuccagagcaggagg

SEQ ID NO: 466790 - RNA, 22 nt, Human
cuguccucaccuuggcaggggg

SEQ ID NO: 466791 - RNA, 22 nt, Human
guggccucugugcuccugccua

SEQ ID NO: 466792 - RNA, 22 nt, Human
agcccaaggcuucccugcuggc

SEQ ID NO: 466793 - RNA, 22 nt, Human
uugcauugaaaauauauuuuaa

SEQ ID NO: 466794 - RNA, 22 nt, Human
uucuuucccagaagauauguuu

SEQ ID NO: 466795 - RNA, 22 nt, Human
auaauacaugguugaucuuuuc

SEQ ID NO: 466796 - RNA, 22 nt, Human
ccucccacauccuagcucugcu

SEQ ID NO: 466797 - RNA, 22 nt, Human
guacuucccugggaggcaagca

SEQ ID NO: 466798 - RNA, 22 nt, Human
gcuggccuccugcuagauggaa

SEQ ID NO: 466799 - RNA, 19 nt, Human
cagcucaguuugauucucu

SEQ ID NO: 466800 - RNA, 22 nt, Human
cuugccuucuuuuccuauagaa

SEQ ID NO: 466801 - RNA, 22 nt, Human
gaggccugguuugcaugagaau

SEQ ID NO: 466802 - RNA, 22 nt, Human
acugaguguaggacuuugaguu

SEQ ID NO: 466803 - RNA, 21 nt, Human
cugcuuuacuucagaggaucu

SEQ ID NO: 466804 - RNA, 22 nt, Human
uuuucauuguuccucgagcauu

SEQ ID NO: 466805 - RNA, 22 nt, Human
gcugguuaggugagggugcgcc

SEQ ID NO: 466806 - RNA, 22 nt, Human
caggcccugggcaggaucagcc

SEQ ID NO: 466807 - RNA, 17 nt, Human
acagagcacaucaagau

SEQ ID NO: 466808 - RNA, 22 nt, Human
gcagcugaaagggaucucuaca

SEQ ID NO: 466809 - RNA, 22 nt, Human
uuagggacaaauuugcagaacc

SEQ ID NO: 466810 - RNA, 22 nt, Human
acaguaaugauucugagucucu

SEQ ID NO: 466811 - RNA, 22 nt, Human
gugcgccagcucaaggggaggc

SEQ ID NO: 466812 - RNA, 21 nt, Human
cagaggcagguccugggacgg

SEQ ID NO: 466813 - RNA, 22 nt, Human
acaggggcuccgaaggugaggg

SEQ ID NO: 466814 - RNA, 22 nt, Human
uccuuuccagccucaccucagc

SEQ ID NO: 466815 - RNA, 22 nt, Human
ugguagggacacuaugcagaaa

SEQ ID NO: 466816 - RNA, 22 nt, Human
uggcucuggcgugaagcccaga

SEQ ID NO: 466817 - RNA, 22 nt, Human
ucucagugagcuuuucuauguu

SEQ ID NO: 466818 - RNA, 22 nt, Human
ccucccucuguuagagcugucu

SEQ ID NO: 466819 - RNA, 22 nt, Human
ggcgcucaguguugccccagag

SEQ ID NO: 466820 - RNA, 22 nt, Human
auacuguaucacuugugaguga

SEQ ID NO: 466821 - RNA, 22 nt, Human
ucagagaggauuuuaauaagug

SEQ ID NO: 466822 - RNA, 22 nt, Human
aguuaacaaguuggcaaucaac

SEQ ID NO: 466823 - RNA, 22 nt, Human
uucacauugugcagauuauggu

SEQ ID NO: 466824 - RNA, 19 nt, Human
ccagcagacacagcugccc

SEQ ID NO: 466825 - RNA, 22 nt, Human
uuucuguaauuaaaagggcagg

SEQ ID NO: 466826 - RNA, 22 nt, Human
uacaaaguagaaauucaguaaa

SEQ ID NO: 466827 - RNA, 22 nt, Human
cugcagagcaaguaacauccuc

SEQ ID NO: 466828 - RNA, 22 nt, Human
cacacauugaauucauucuugu

SEQ ID NO: 466829 - RNA, 22 nt, Human
ucuggcucuguguccucaccca

SEQ ID NO: 466830 - RNA, 21 nt, Human
gucagcagauccagcacuugu

SEQ ID NO: 466831 - RNA, 22 nt, Human
ucagaggguggcugggagcauc

SEQ ID NO: 466832 - RNA, 22 nt, Human
ccaggccugauugggaaucuug

SEQ ID NO: 466833 - RNA, 22 nt, Human
cggcagggcuccaugcauuucu

SEQ ID NO: 466834 - RNA, 22 nt, Human
ugacauuuaagccucugauuuc

SEQ ID NO: 466835 - RNA, 22 nt, Human
ugggcagagucguggggaauag

SEQ ID NO: 466836 - RNA, 22 nt, Human
ccaggaugacccccacuuuccu

SEQ ID NO: 466837 - RNA, 22 nt, Human
ugucccagguccuagaugacca

SEQ ID NO: 466838 - RNA, 22 nt, Human
ggcaaaguuuucaucucauaac

SEQ ID NO: 466839 - RNA, 22 nt, Human
cugggcacauuuugacuagugu

SEQ ID NO: 466840 - RNA, 22 nt, Human
uucuggaaguguuagaaucugg

SEQ ID NO: 466841 - RNA, 22 nt, Human
uggccugggucacaccaggguc

SEQ ID NO: 466842 - RNA, 22 nt, Human
agcagggcugcggccccaccac

SEQ ID NO: 466843 - RNA, 22 nt, Human
cccaggucccgccccagcucua

SEQ ID NO: 466844 - RNA, 22 nt, Human
cagagccccccuucugaucaca

SEQ ID NO: 466845 - RNA, 22 nt, Human
ucaaacuguuuacagugagaua

SEQ ID NO: 466846 - RNA, 21 nt, Human
agaaaaaccagcauguuuuca

SEQ ID NO: 466847 - RNA, 22 nt, Human
acuuccugggcaugcagagucc

SEQ ID NO: 466848 - RNA, 22 nt, Human
gagacauggcaaaagcacuggu

SEQ ID NO: 466849 - RNA, 22 nt, Human
gcccucagaugggaaaggaggg

SEQ ID NO: 466850 - RNA, 22 nt, Human
gccacaugucaugugcucagua

SEQ ID NO: 466851 - RNA, 22 nt, Human
aacacuguggucuuuucaguaa

SEQ ID NO: 466852 - RNA, 22 nt, Human
agucccuguacuuuccacugcc

SEQ ID NO: 466853 - RNA, 22 nt, Human
ccucuuccacugggccccaucc

SEQ ID NO: 466854 - RNA, 23 nt, Human
aacaccaaggcucagagagauaa

SEQ ID NO: 466855 - RNA, 22 nt, Human
auguaucagauaaagcaugugg

SEQ ID NO: 466856 - RNA, 20 nt, Human
gauuucaaagcagaguggcc

SEQ ID NO: 466857 - RNA, 22 nt, Human
uggcagaaguacacaagcaugc

SEQ ID NO: 466858 - RNA, 22 nt, Human
gccgaagcugccgucugguccu

SEQ ID NO: 466859 - RNA, 22 nt, Human
gaguccaguaguuaggacagag

SEQ ID NO: 466860 - RNA, 22 nt, Human
uggcuaggcuccaagagcugga

SEQ ID NO: 466861 - RNA, 22 nt, Human
acucucagaggguggcagcaau

SEQ ID NO: 466862 - RNA, 22 nt, Human
gccaggcaugggcuucugggcg

SEQ ID NO: 466863 - RNA, 22 nt, Human
agugcaugccuuccuguggaug

SEQ ID NO: 466864 - RNA, 22 nt, Human
aucuggcucucucauuuacaaa

SEQ ID NO: 466865 - RNA, 22 nt, Human
aaacaaacauagguuugaaagu

SEQ ID NO: 466866 - RNA, 17 nt, Human
ucaggauguagcaguag

SEQ ID NO: 466867 - RNA, 22 nt, Human
gggcugcugccaccagguggau

SEQ ID NO: 466868 - RNA, 20 nt, Human
auaauuuacccugcaccacu

SEQ ID NO: 466869 - RNA, 22 nt, Human
guguaauuauauaaagaucuac

SEQ ID NO: 466870 - RNA, 22 nt, Human
gagccauacaaccuauaaagug

SEQ ID NO: 466871 - RNA, 22 nt, Human
guuuaauuuuagguugucaagc

SEQ ID NO: 466872 - RNA, 22 nt, Human
agaggaggcucugggaucgucc

SEQ ID NO: 466873 - RNA, 21 nt, Human
gaacauuuggguuguuucuac

SEQ ID NO: 466874 - RNA, 22 nt, Human
gcugaagagagaugcguccagc

SEQ ID NO: 466875 - RNA, 22 nt, Human
aggugcuggagucugggcagga

SEQ ID NO: 466876 - RNA, 22 nt, Human
cucaggcccacagcagacccac

SEQ ID NO: 466877 - RNA, 22 nt, Human
ugaagcagcaccauuuuagagc

SEQ ID NO: 466878 - RNA, 22 nt, Human
uuaaaaccaucagcuguaagau

SEQ ID NO: 466879 - RNA, 22 nt, Human
cagcuggcuggucagugcacaa

SEQ ID NO: 466880 - RNA, 22 nt, Human
guaacaaaguuucuaggugcug

SEQ ID NO: 466881 - RNA, 22 nt, Human
guuuuauaauugcuucauaaga

SEQ ID NO: 466882 - RNA, 22 nt, Human
uggaagggggaagacagcucug

SEQ ID NO: 466883 - RNA, 22 nt, Human
cagaggcucagauggcccuggc

SEQ ID NO: 466884 - RNA, 22 nt, Human
ugccaggcauuugacagacacu

SEQ ID NO: 466885 - RNA, 22 nt, Human
uacccagcaaucccuagagguu

SEQ ID NO: 466886 - RNA, 22 nt, Human
ucagagguaagggcugagagga

SEQ ID NO: 466887 - RNA, 20 nt, Human
gagagcuggggaugaggcug

SEQ ID NO: 466888 - RNA, 22 nt, Human
ucauuguuauguuuugcugucu

SEQ ID NO: 466889 - RNA, 22 nt, Human
gaggcagagacuccaccuucag

SEQ ID NO: 466890 - RNA, 22 nt, Human
uuagauaaauuaagacuuuaca

SEQ ID NO: 466891 - RNA, 22 nt, Human
ggucccugaagaggccuggggu

SEQ ID NO: 466892 - RNA, 22 nt, Human
auaaaaguuuccaaucaugccu

SEQ ID NO: 466893 - RNA, 22 nt, Human
ucauugcaguugaguuguguua

SEQ ID NO: 466894 - RNA, 21 nt, Human
ugcagaggcacaaacaagccc

SEQ ID NO: 466895 - RNA, 22 nt, Human
uuucuuagcgaugcuugauaaa

SEQ ID NO: 466896 - RNA, 22 nt, Human
aucuggcuuuuaccccacggcc

SEQ ID NO: 466897 - RNA, 22 nt, Human
aaaguguugggaagaaagugca

SEQ ID NO: 466898 - RNA, 22 nt, Human
accagagauggggcuucucugu

SEQ ID NO: 466899 - RNA, 22 nt, Human
gcagcuuucuacuuccuacagc

SEQ ID NO: 466900 - RNA, 22 nt, Human
acagucuugagcaucagccaga

SEQ ID NO: 466901 - RNA, 22 nt, Human
ccucacugaagaggugacauuu

SEQ ID NO: 466902 - RNA, 22 nt, Human
gagggauggugugagaggcuca

SEQ ID NO: 466903 - RNA, 22 nt, Human
ggacaggguaaguacuagugug

SEQ ID NO: 466904 - RNA, 23 nt, Human
uggcaccaggcauucuaggggua

SEQ ID NO: 466905 - RNA, 22 nt, Human
uuugcauuuccagaguagcaga

SEQ ID NO: 466906 - RNA, 22 nt, Human
auccagggauaaaaguaagguu

SEQ ID NO: 466907 - RNA, 22 nt, Human
aguuucuagccucacuguuuag

SEQ ID NO: 466908 - RNA, 22 nt, Human
gugugccaacaaaagacagugc

SEQ ID NO: 466909 - RNA, 22 nt, Human
gguggccucugcaggccucgac

SEQ ID NO: 466910 - RNA, 22 nt, Human
ucuguccauucagccauccauc

SEQ ID NO: 466911 - RNA, 22 nt, Human
ccuggcucuguccucgcgcaaa

SEQ ID NO: 466912 - RNA, 22 nt, Human
ugcucuguugugcaugugggau

SEQ ID NO: 466913 - RNA, 18 nt, Human
aagcugcccucaggcagg

SEQ ID NO: 466914 - RNA, 20 nt, Human
ucacauccucucccaacaug

SEQ ID NO: 466915 - RNA, 22 nt, Human
aguuucuauguaagcuacguga

SEQ ID NO: 466916 - RNA, 22 nt, Human
ccuguacuagggucucauugcc

SEQ ID NO: 466917 - RNA, 22 nt, Human
aggacagaccuaggacuggagc

SEQ ID NO: 466918 - RNA, 19 nt, Human
gcauaaaaugucaaugugu

SEQ ID NO: 466919 - RNA, 22 nt, Human
guuuuauaugucucugcugaca

SEQ ID NO: 466920 - RNA, 22 nt, Human
aggcacuggucuaccccuuagu

SEQ ID NO: 466921 - RNA, 22 nt, Human
ccagcccugucaccaacuggag

SEQ ID NO: 466922 - RNA, 22 nt, Human
ugaggcucagaaauguaaguuu

SEQ ID NO: 466923 - RNA, 22 nt, Human
gugcaugugcauccauguguac

SEQ ID NO: 466924 - RNA, 22 nt, Human
uccugucagugaggcagaugaa

SEQ ID NO: 466925 - RNA, 22 nt, Human
agugcaauagcaaagaacaaca

SEQ ID NO: 466926 - RNA, 22 nt, Human
cucacuguccaacaggcuuuac

SEQ ID NO: 466927 - RNA, 22 nt, Human
acuuccugcaaucguccacucc

SEQ ID NO: 466928 - RNA, 22 nt, Human
cuguacaggugaggagggggcu

SEQ ID NO: 466929 - RNA, 22 nt, Human
uccugcagcucugagaagcauc

SEQ ID NO: 466930 - RNA, 22 nt, Human
aaagagcuaacauugccgagau

SEQ ID NO: 466931 - RNA, 19 nt, Human
aaggcagaaguuggauaug

SEQ ID NO: 466932 - RNA, 22 nt, Human
agauuuccugcacugccuuuga

SEQ ID NO: 466933 - RNA, 22 nt, Human
gacagguggggaaacuaaggua

SEQ ID NO: 466934 - RNA, 22 nt, Human
aaugaugguuaaacacuggagg

SEQ ID NO: 466935 - RNA, 22 nt, Human
ugcagcagacugaguaugagaa

SEQ ID NO: 466936 - RNA, 22 nt, Human
ugguaucagagccaucuguauu

SEQ ID NO: 466937 - RNA, 22 nt, Human
gccaguggucacugaggaagaa

SEQ ID NO: 466938 - RNA, 22 nt, Human
acagccaggaauucuggagaag

SEQ ID NO: 466939 - RNA, 22 nt, Human
cagggcacggagaagucacccc

SEQ ID NO: 466940 - RNA, 22 nt, Human
ucaaagucacaacucucuaauu

SEQ ID NO: 466941 - RNA, 22 nt, Human
cucuggccugcuuccucaggua

SEQ ID NO: 466942 - RNA, 22 nt, Human
ggucccagguugacagggagac

SEQ ID NO: 466943 - RNA, 22 nt, Human
ugcugaggagguggcugugcuu

SEQ ID NO: 466944 - RNA, 22 nt, Human
uauaguacauggaaucuucaua

SEQ ID NO: 466945 - RNA, 22 nt, Human
ggagggcaucaaucaggccugg

SEQ ID NO: 466946 - RNA, 22 nt, Human
cagagcugcuucccaguuugug

SEQ ID NO: 466947 - RNA, 22 nt, Human
ucccucuguguugggcaugccu

SEQ ID NO: 466948 - RNA, 22 nt, Human
auucaaguggcugcuauguuaa

SEQ ID NO: 466949 - RNA, 22 nt, Human
accaucuuaaggggacuucuua

SEQ ID NO: 466950 - RNA, 22 nt, Human
cugggcagugguggcaucuuug

SEQ ID NO: 466951 - RNA, 22 nt, Human
uggggcuguccuuagucugaga

SEQ ID NO: 466952 - RNA, 22 nt, Human
agagcagcuggggcagagacca

SEQ ID NO: 466953 - RNA, 22 nt, Human
cagcuuuauuaaugauugucuu

SEQ ID NO: 466954 - RNA, 22 nt, Human
agcucccugagaugccacagca

SEQ ID NO: 466955 - RNA, 22 nt, Human
ccagcuuuucagaaucugccug

SEQ ID NO: 466956 - RNA, 21 nt, Human
cagcuucuucugugaccuggu

SEQ ID NO: 466957 - RNA, 19 nt, Human
ucaaagcaagcauguucug

SEQ ID NO: 466958 - RNA, 22 nt, Human
ucaggcagguggcuggcuaugg

SEQ ID NO: 466959 - RNA, 22 nt, Human
caguggguaggaaaggcucuuc

SEQ ID NO: 466960 - RNA, 22 nt, Human
uccuugaauggacauuacacug

SEQ ID NO: 466961 - RNA, 22 nt, Human
ucucuggguuuuuguccuguac

SEQ ID NO: 466962 - RNA, 22 nt, Human
ggcccacuugaaauggagcuca

SEQ ID NO: 466963 - RNA, 22 nt, Human
ugggcagcagcaaagccagacu

SEQ ID NO: 466964 - RNA, 22 nt, Human
agcacccucagccuuauccaga

SEQ ID NO: 466965 - RNA, 22 nt, Human
gcagggcagaaggugcugagga

SEQ ID NO: 466966 - RNA, 22 nt, Human
agggcuccaaggaaguguagcu

SEQ ID NO: 466967 - RNA, 22 nt, Human
ugcugccaugcagagcaacaga

SEQ ID NO: 466968 - RNA, 22 nt, Human
gcugucagcgcccaaggagcuc

SEQ ID NO: 466969 - RNA, 22 nt, Human
ggccugcuauuggugggcagac

SEQ ID NO: 466970 - RNA, 21 nt, Human
aaggccugcuuacugcuaguu

SEQ ID NO: 466971 - RNA, 22 nt, Human
auaacagaguugggaagugaaa

SEQ ID NO: 466972 - RNA, 22 nt, Human
aaugccaguguguugauuccag

SEQ ID NO: 466973 - RNA, 22 nt, Human
cuguugucuucauugucauauc

SEQ ID NO: 466974 - RNA, 22 nt, Human
ucucacugauuugagaccaagg

SEQ ID NO: 466975 - RNA, 22 nt, Human
aagagcugcaucuaagccauga

SEQ ID NO: 466976 - RNA, 22 nt, Human
ccacugaaggucaacauagagc

SEQ ID NO: 466977 - RNA, 22 nt, Human
gccugggugucgaucacuagug

SEQ ID NO: 466978 - RNA, 23 nt, Human
ugggggugcacgggccacaucuu

SEQ ID NO: 466979 - RNA, 20 nt, Human
ccugggcuccaggagccccg

SEQ ID NO: 466980 - RNA, 22 nt, Human
augcugugucaggaauuugaua

SEQ ID NO: 466981 - RNA, 22 nt, Human
ucucaggaguagugggauccau

SEQ ID NO: 466982 - RNA, 22 nt, Human
caggaggaacaagagguucugg

SEQ ID NO: 466983 - RNA, 22 nt, Human
cagggagcuuucccaggacccu

SEQ ID NO: 466984 - RNA, 22 nt, Human
aucaguuucacuugcuugcaaa

SEQ ID NO: 466985 - RNA, 22 nt, Human
gagaaggacuacacaucuggcc

SEQ ID NO: 466986 - RNA, 22 nt, Human
uagaaaugcccagauucugcua

SEQ ID NO: 466987 - RNA, 22 nt, Human
gcucugggugaacuuggagcaa

SEQ ID NO: 466988 - RNA, 22 nt, Human
aggcuucccaagcagcugcaaa

SEQ ID NO: 466989 - RNA, 22 nt, Human
gggcugugagaguggggcugcu

SEQ ID NO: 466990 - RNA, 22 nt, Human
aauaugugagguauguucagug

SEQ ID NO: 466991 - RNA, 22 nt, Human
uauguagaagcugcucaaagaa

SEQ ID NO: 466992 - RNA, 22 nt, Human
ugcagggaaucuguggcuggac

SEQ ID NO: 466993 - RNA, 22 nt, Human
cacugaagguaggaccaaggcu

SEQ ID NO: 466994 - RNA, 22 nt, Human
uucacauuucauaccacagcuu

SEQ ID NO: 466995 - RNA, 22 nt, Human
ugggcuggcguggagaguuuag

SEQ ID NO: 466996 - RNA, 22 nt, Human
aaaaguauuuugagcacuuuau

SEQ ID NO: 466997 - RNA, 22 nt, Human
ucugagcauugaauuuucuucc

SEQ ID NO: 466998 - RNA, 22 nt, Human
ggugcagaaggaagggagcugg

SEQ ID NO: 466999 - RNA, 22 nt, Human
aggagcagaacuguuguggagg

SEQ ID NO: 467000 - RNA, 22 nt, Human
aaauccuaaugacaaguuuagu

SEQ ID NO: 467001 - RNA, 22 nt, Human
cgcuggggcuuuuugcuugaga

SEQ ID NO: 467002 - RNA, 22 nt, Human
agcuggccuucggugucacugg

SEQ ID NO: 467003 - RNA, 22 nt, Human
gggugggccacugagcagcgug

SEQ ID NO: 467004 - RNA, 22 nt, Human
ucucugaguaagugacaguuca

SEQ ID NO: 467005 - RNA, 22 nt, Human
ggccagggggcuucagacucca

SEQ ID NO: 467006 - RNA, 22 nt, Human
auuucacucuuaauugcuuccu

SEQ ID NO: 467007 - RNA, 22 nt, Human
uggaggaaguggacaguugugu

SEQ ID NO: 467008 - RNA, 22 nt, Human
guuuuauaggcuguugcuauau

SEQ ID NO: 467009 - RNA, 18 nt, Human
ucuggcucaggacugaac

SEQ ID NO: 467010 - RNA, 20 nt, Human
ucauccaggacaggaguggc

SEQ ID NO: 467011 - RNA, 22 nt, Human
gcugugcacuaccuauacaucc

SEQ ID NO: 467012 - RNA, 21 nt, Human
ggucuuccaaauaaggagaaa

SEQ ID NO: 467013 - RNA, 20 nt, Human
ugcagggcugccucccagcu

SEQ ID NO: 467014 - RNA, 22 nt, Human
caaauguguaaggaaguguuag

SEQ ID NO: 467015 - RNA, 22 nt, Human
agaauaauacugaaaugcugaa

SEQ ID NO: 467016 - RNA, 22 nt, Human
auacaaaauauauacuggagac

SEQ ID NO: 467017 - RNA, 22 nt, Human
agagaacaaauuaaaggugguu

SEQ ID NO: 467018 - RNA, 22 nt, Human
ugcagcucugaacagucaugaa

SEQ ID NO: 467019 - RNA, 22 nt, Human
ccugggaggcagagguugcagu

SEQ ID NO: 467020 - RNA, 20 nt, Human
uacugggcaagcccacagac

SEQ ID NO: 467021 - RNA, 22 nt, Human
gagggguguggagccaucaguu

SEQ ID NO: 467022 - RNA, 19 nt, Human
gcugucugaugcugagguc

SEQ ID NO: 467023 - RNA, 22 nt, Human
ggagucagccugucagagugua

SEQ ID NO: 467024 - RNA, 22 nt, Human
ggcacucagagauucaggcugu

SEQ ID NO: 467025 - RNA, 22 nt, Human
ggccccaggaccuccacggucc

SEQ ID NO: 467026 - RNA, 19 nt, Human
uggggccuccugucccugg

SEQ ID NO: 467027 - RNA, 22 nt, Human
cagaguacugggagaacagaag

SEQ ID NO: 467028 - RNA, 21 nt, Human
cagcaaaucauugggcagacu

SEQ ID NO: 467029 - RNA, 22 nt, Human
acuuuggggaacuuuucuccuc

SEQ ID NO: 467030 - RNA, 22 nt, Human
caaaguuuaaaguagauuucag

SEQ ID NO: 467031 - RNA, 22 nt, Human
gcuccucugucaaaugagagug

SEQ ID NO: 467032 - RNA, 19 nt, Human
ccaggccuggcgucuccgc

SEQ ID NO: 467033 - RNA, 22 nt, Human
ccagggcauguaacuaauggug

SEQ ID NO: 467034 - RNA, 22 nt, Human
uuuguacauccuaauucugagu

SEQ ID NO: 467035 - RNA, 22 nt, Human
uucauugucucuguuugccuuc

SEQ ID NO: 467036 - RNA, 22 nt, Human
cagugcaguggcugagcuggag

SEQ ID NO: 467037 - RNA, 22 nt, Human
aagagcuggcccaaucugagca

SEQ ID NO: 467038 - RNA, 22 nt, Human
uuguggcucgugagauguuagg

SEQ ID NO: 467039 - RNA, 22 nt, Human
ggucccaggcucccucuugucc

SEQ ID NO: 467040 - RNA, 22 nt, Human
ccugagcugaacuaagcaguuu

SEQ ID NO: 467041 - RNA, 22 nt, Human
auguuacauaguccuuauuugu

SEQ ID NO: 467042 - RNA, 19 nt, Human
ugaggggcucacagucuca

SEQ ID NO: 467043 - RNA, 22 nt, Human
ugcauccuuaaccagcaucacu

SEQ ID NO: 467044 - RNA, 23 nt, Human
gggugggccaaauuagguagccu

SEQ ID NO: 467045 - RNA, 22 nt, Human
uucacauuugcccuuaugugug

SEQ ID NO: 467046 - RNA, 22 nt, Human
aucaauucuuaggaaaauagcu

SEQ ID NO: 467047 - RNA, 22 nt, Human
cuuauuagaguuguguucuguu

SEQ ID NO: 467048 - RNA, 22 nt, Human
agcucccagagcucgagaguaa

SEQ ID NO: 467049 - RNA, 17 nt, Human
ugagacagggcaggccc

SEQ ID NO: 467050 - RNA, 22 nt, Human
caggcugcagugcaguggcuau

SEQ ID NO: 467051 - RNA, 22 nt, Human
ggccugcuuuccgagccugcag

SEQ ID NO: 467052 - RNA, 22 nt, Human
ugcagggcauaggguccaguuu

SEQ ID NO: 467053 - RNA, 22 nt, Human
gcugccugucccaggaugagga

SEQ ID NO: 467054 - RNA, 22 nt, Human
uagaaacauguucuguucuguu

SEQ ID NO: 467055 - RNA, 22 nt, Human
gcucaggagcucuugguggcgc

SEQ ID NO: 467056 - RNA, 22 nt, Human
uuucuguauuuaaaagaucugg

SEQ ID NO: 467057 - RNA, 22 nt, Human
uucagagaugacaccugguguu

SEQ ID NO: 467058 - RNA, 22 nt, Human
ggcauguuucaucacaucaaga

SEQ ID NO: 467059 - RNA, 22 nt, Human
acacugcagaugaaagcauaag

SEQ ID NO: 467060 - RNA, 22 nt, Human
gagcagaugugugccaggaugc

SEQ ID NO: 467061 - RNA, 22 nt, Human
ccuaggcccuaggcuuccauca

SEQ ID NO: 467062 - RNA, 22 nt, Human
gagucgagcagaaagccgucgg

SEQ ID NO: 467063 - RNA, 22 nt, Human
uaguccagccuuggguguagcc

SEQ ID NO: 467064 - RNA, 22 nt, Human
guuacaaacucaggugccaaaa

SEQ ID NO: 467065 - RNA, 22 nt, Human
caaagggcucuagacucagcag

SEQ ID NO: 467066 - RNA, 22 nt, Human
ggccaagauggaaggagagaug

SEQ ID NO: 467067 - RNA, 22 nt, Human
cucaccaggaacagcugcggag

SEQ ID NO: 467068 - RNA, 17 nt, Human
aucuggaagcuagcuga

SEQ ID NO: 467069 - RNA, 23 nt, Human
ucuggcucuaugugacagcucuc

SEQ ID NO: 467070 - RNA, 22 nt, Human
caaacuguucucugugggauuc

SEQ ID NO: 467071 - RNA, 22 nt, Human
cggcagagugugugcgugcaug

SEQ ID NO: 467072 - RNA, 22 nt, Human
uugcagcuucuaccacuguuuc

SEQ ID NO: 467073 - RNA, 22 nt, Human
cagugcagaggugcaagcaugu

SEQ ID NO: 467074 - RNA, 22 nt, Human
gggcauggugaugugcaccugu

SEQ ID NO: 467075 - RNA, 22 nt, Human
gccaaaucuugcacacucuugu

SEQ ID NO: 467076 - RNA, 22 nt, Human
acacaggaagucagcacugaug

SEQ ID NO: 467077 - RNA, 22 nt, Human
ucaaucacguguuccauguucu

SEQ ID NO: 467078 - RNA, 22 nt, Human
uugcagcugcaguaaauguuca

SEQ ID NO: 467079 - RNA, 22 nt, Human
ggacucuguuuuccugaucacu

SEQ ID NO: 467080 - RNA, 22 nt, Human
gcaagcaguuguggcuucugag

SEQ ID NO: 467081 - RNA, 17 nt, Human
uccaggcauaucuccua

SEQ ID NO: 467082 - RNA, 22 nt, Human
ggcagcacugcagcuuguuggg

SEQ ID NO: 467083 - RNA, 22 nt, Human
ccuggcugggguagaagugagg

SEQ ID NO: 467084 - RNA, 19 nt, Human
gaggaggaaaacuagugua

SEQ ID NO: 467085 - RNA, 22 nt, Human
gccaguggcuugccaggcagga

SEQ ID NO: 467086 - RNA, 17 nt, Human
ggcagcugccacuuuuu

SEQ ID NO: 467087 - RNA, 22 nt, Human
ucccagagcugauaagccuuua

SEQ ID NO: 467088 - RNA, 22 nt, Human
gcuguggcugaccaccaggggg

SEQ ID NO: 467089 - RNA, 22 nt, Human
gaguuauuucagaaggaaagau

SEQ ID NO: 467090 - RNA, 20 nt, Human
cagggcacacugcagccucg

SEQ ID NO: 467091 - RNA, 22 nt, Human
gaggaaaauauucagggagguu

SEQ ID NO: 467092 - RNA, 23 nt, Human
ggccucuguguucugcccacaug

SEQ ID NO: 467093 - RNA, 22 nt, Human
gggacagcuguagugcuuggcu

SEQ ID NO: 467094 - RNA, 22 nt, Human
cuccagcuucccucagcugugg

SEQ ID NO: 467095 - RNA, 22 nt, Human
caagcccaggauuccccaguua

SEQ ID NO: 467096 - RNA, 22 nt, Human
ggagccagugcccucuggugga

SEQ ID NO: 467097 - RNA, 22 nt, Human
ccugggcaacauagugagaccc

SEQ ID NO: 467098 - RNA, 22 nt, Human
gcucccagcuggagccucaaca

SEQ ID NO: 467099 - RNA, 22 nt, Human
cugcugugcaacauugcaccua

SEQ ID NO: 467100 - RNA, 22 nt, Human
ggcugcuguuucagagacuguu

SEQ ID NO: 467101 - RNA, 22 nt, Human
uccuugaagcaacgugcagaca

SEQ ID NO: 467102 - RNA, 22 nt, Human
uucucauggugucuuuauacau

SEQ ID NO: 467103 - RNA, 22 nt, Human
ggcagcuguaagaugagugaau

SEQ ID NO: 467104 - RNA, 22 nt, Human
cuggucugagggcucuugaggc

SEQ ID NO: 467105 - RNA, 22 nt, Human
cuagaaauauuuuacagucaag

SEQ ID NO: 467106 - RNA, 19 nt, Human
uguagcaguuuaaaacaac

SEQ ID NO: 467107 - RNA, 18 nt, Human
cuucagugacagucuggc

SEQ ID NO: 467108 - RNA, 22 nt, Human
aguccaaagcagaugagggcca

SEQ ID NO: 467109 - RNA, 22 nt, Human
aggagugggggcgagaaguuaa

SEQ ID NO: 467110 - RNA, 22 nt, Human
gccucugcacuguggcacacca

SEQ ID NO: 467111 - RNA, 22 nt, Human
auaaggcaagcugucaguuugu

SEQ ID NO: 467112 - RNA, 22 nt, Human
uuccaggaauucagcucucagu

SEQ ID NO: 467113 - RNA, 22 nt, Human
aggucauuacaauuaucauuuu

SEQ ID NO: 467114 - RNA, 22 nt, Human
gccaggcugcuccagggaggcc

SEQ ID NO: 467115 - RNA, 22 nt, Human
uuauuucauguaaaauuuaugu

SEQ ID NO: 467116 - RNA, 22 nt, Human
uaaagguagcaugaaacugcaa

SEQ ID NO: 467117 - RNA, 22 nt, Human
agccagggacgcugcaggcuac

SEQ ID NO: 467118 - RNA, 23 nt, Human
uguugaaguaacuguuacauaga

SEQ ID NO: 467119 - RNA, 22 nt, Human
aaauacagaguugcuuaaaagc

SEQ ID NO: 467120 - RNA, 22 nt, Human
ccugucucuuucaaucugagag

SEQ ID NO: 467121 - RNA, 22 nt, Human
ggaggccaaggcagguggauca

SEQ ID NO: 467122 - RNA, 22 nt, Human
ugaaagguagcuggccucauag

SEQ ID NO: 467123 - RNA, 18 nt, Human
cccagcccaccauuucuc

SEQ ID NO: 467124 - RNA, 22 nt, Human
gaggcccuccagcugucagcug

SEQ ID NO: 467125 - RNA, 22 nt, Human
caaugauugcuauuuacauaaa

SEQ ID NO: 467126 - RNA, 22 nt, Human
caguggaaacuaugcugcugga

SEQ ID NO: 467127 - RNA, 22 nt, Human
cagugaggcucugcugagcggu

SEQ ID NO: 467128 - RNA, 22 nt, Human
ccaggugucaugcgugugaccc

SEQ ID NO: 467129 - RNA, 22 nt, Human
agccaucauuucugucacuggc

SEQ ID NO: 467130 - RNA, 22 nt, Human
cagccagcugaauguaccauga

SEQ ID NO: 467131 - RNA, 22 nt, Human
uuuuauuaguggcuagaugggg

SEQ ID NO: 467132 - RNA, 22 nt, Human
aucaaaguaggcauauguuuuu

SEQ ID NO: 467133 - RNA, 22 nt, Human
uaugcacauucacacaaaaaug

SEQ ID NO: 467134 - RNA, 22 nt, Human
gcauaauauacaugcuugaucc

SEQ ID NO: 467135 - RNA, 22 nt, Human
gguggguauugaauacaggugu

SEQ ID NO: 467136 - RNA, 22 nt, Human
aggugcuagguguguaguggag

SEQ ID NO: 467137 - RNA, 22 nt, Human
agcauuuaauuacaguuuaauu

SEQ ID NO: 467138 - RNA, 21 nt, Human
ugaggcucaucuuauguggcu

SEQ ID NO: 467139 - RNA, 22 nt, Human
uuuaucacagaauaagaaguca

SEQ ID NO: 467140 - RNA, 22 nt, Human
acagaccaaaaaaggauauugg

SEQ ID NO: 467141 - RNA, 22 nt, Human
aauugcuaaagauuauguuuuc

SEQ ID NO: 467142 - RNA, 22 nt, Human
agaggaggccaggcccacaccu

SEQ ID NO: 467143 - RNA, 22 nt, Human
ucucuggagggcuccaggcggg

SEQ ID NO: 467144 - RNA, 22 nt, Human
cuagggacagaaagaggguaga

SEQ ID NO: 467145 - RNA, 22 nt, Human
acaggacaggcugggcuagacu

SEQ ID NO: 467146 - RNA, 22 nt, Human
ucaggcagaugcagggauggau

SEQ ID NO: 467147 - RNA, 22 nt, Human
ucuauuugcugguugcuucugu

SEQ ID NO: 467148 - RNA, 17 nt, Human
gccucugcuugugucau

SEQ ID NO: 467149 - RNA, 22 nt, Human
gcugccuucaguucugauucau

SEQ ID NO: 467150 - RNA, 22 nt, Human
augaagucuagcaagcauugaa

SEQ ID NO: 467151 - RNA, 22 nt, Human
ggggaggaagcuggaacacggg

SEQ ID NO: 467152 - RNA, 22 nt, Human
acauugaugaaaagguaucauu

SEQ ID NO: 467153 - RNA, 22 nt, Human
cccaggcucccaggugggacaa

SEQ ID NO: 467154 - RNA, 23 nt, Human
uugcuucugugcaauucaguacu

SEQ ID NO: 467155 - RNA, 22 nt, Human
uggcagcaaaaccagaaucaga

SEQ ID NO: 467156 - RNA, 22 nt, Human
cugagguguugaugaccuaugc

SEQ ID NO: 467157 - RNA, 22 nt, Human
gcuccucuauuccccacauuuu

SEQ ID NO: 467158 - RNA, 22 nt, Human
agagauucauguuuacuguagg

SEQ ID NO: 467159 - RNA, 22 nt, Human
aacuguaaugaauuguucauga

SEQ ID NO: 467160 - RNA, 22 nt, Human
ucucagggccucccucuguuuc

SEQ ID NO: 467161 - RNA, 22 nt, Human
uacauuguucaugcaugagaaa

SEQ ID NO: 467162 - RNA, 22 nt, Human
aguuacuugagacguuuaugaa

SEQ ID NO: 467163 - RNA, 22 nt, Human
ccuccugggacaggcuggcaca

SEQ ID NO: 467164 - RNA, 22 nt, Human
gaggggcugggcagucccugga

SEQ ID NO: 467165 - RNA, 22 nt, Human
agggaggaccaaugugugguua

SEQ ID NO: 467166 - RNA, 22 nt, Human
uaacaucuuuagcagcucgaac

SEQ ID NO: 467167 - RNA, 22 nt, Human
guauucuugguuaucaaaauac

SEQ ID NO: 467168 - RNA, 22 nt, Human
aguuuuucuccccuggcuucau

SEQ ID NO: 467169 - RNA, 22 nt, Human
uuguggcagaccaugagucuaa

SEQ ID NO: 467170 - RNA, 20 nt, Human
cccagagccauagccagaca

SEQ ID NO: 467171 - RNA, 22 nt, Human
uggcagagccuugccaaacucc

SEQ ID NO: 467172 - RNA, 22 nt, Human
aauguauaaaguguuaauaacu

SEQ ID NO: 467173 - RNA, 22 nt, Human
ccaggcucugucuggucagaag

SEQ ID NO: 467174 - RNA, 22 nt, Human
aggaaggagggcagauauuaag

SEQ ID NO: 467175 - RNA, 22 nt, Human
ucugaggcccugcaggcagugu

SEQ ID NO: 467176 - RNA, 22 nt, Human
guggcacagugggagagcccca

SEQ ID NO: 467177 - RNA, 22 nt, Human
uuuuuccuuagggguuacucac

SEQ ID NO: 467178 - RNA, 22 nt, Human
aaaagagucuuaggcagucaua

SEQ ID NO: 467179 - RNA, 22 nt, Human
ugugggcucccccucacucugu

SEQ ID NO: 467180 - RNA, 22 nt, Human
uggcuucugcuuucaguggagg

SEQ ID NO: 467181 - RNA, 22 nt, Human
gcuucucgggccugaugucguc

SEQ ID NO: 467182 - RNA, 22 nt, Human
cauauaaauacaacauguguua

SEQ ID NO: 467183 - RNA, 22 nt, Human
uuugcauuuuagauuuaggccu

SEQ ID NO: 467184 - RNA, 22 nt, Human
gggcccuggggccugauuugca

SEQ ID NO: 467185 - RNA, 22 nt, Human
uauuugcaaagaacuacacuag

SEQ ID NO: 467186 - RNA, 22 nt, Human
augcugugauuguagaaauauu

SEQ ID NO: 467187 - RNA, 18 nt, Human
uccugcagcuucuaugua

SEQ ID NO: 467188 - RNA, 22 nt, Human
cgcccagggcaggaggccgcuc

SEQ ID NO: 467189 - RNA, 22 nt, Human
caggggcugagaaggaacgucc

SEQ ID NO: 467190 - RNA, 22 nt, Human
gaaaauguuuguccggagcuga

SEQ ID NO: 467191 - RNA, 22 nt, Human
ggcaugggccgaggugccuccu

SEQ ID NO: 467192 - RNA, 22 nt, Human
gggugggguucaggaaucuuca

SEQ ID NO: 467193 - RNA, 22 nt, Human
uacuuuaaaaacugauaauuca

SEQ ID NO: 467194 - RNA, 22 nt, Human
uuacaaagagugccagagugug

SEQ ID NO: 467195 - RNA, 22 nt, Human
acacaaugugcaggacaccugu

SEQ ID NO: 467196 - RNA, 22 nt, Human
cauccagggcagccauggccug

SEQ ID NO: 467197 - RNA, 22 nt, Human
aggacagugguguucuggagug

SEQ ID NO: 467198 - RNA, 22 nt, Human
acugggccggugcagaguaguu

SEQ ID NO: 467199 - RNA, 22 nt, Human
aagucagcacuccaggaagcca

SEQ ID NO: 467200 - RNA, 22 nt, Human
gccugaugagcuuccagcugag

SEQ ID NO: 467201 - RNA, 22 nt, Human
aagggcugaaugaaggguugaa

SEQ ID NO: 467202 - RNA, 22 nt, Human
cugugccuaagaugcaugucuc

SEQ ID NO: 467203 - RNA, 22 nt, Human
aaggaggaauuucagggugaau

SEQ ID NO: 467204 - RNA, 22 nt, Human
ucucagagcuucaguuauuuuc

SEQ ID NO: 467205 - RNA, 22 nt, Human
auuacaguaacagcuacaaugc

SEQ ID NO: 467206 - RNA, 22 nt, Human
aguuuauguaaaauuaguaaug

SEQ ID NO: 467207 - RNA, 22 nt, Human
ucuuuauuuaagucuguuguaa

SEQ ID NO: 467208 - RNA, 17 nt, Human
aggcauggucuggggug

SEQ ID NO: 467209 - RNA, 22 nt, Human
ggcucuggagcacagacgucug

SEQ ID NO: 467210 - RNA, 21 nt, Human
ucugucugguuuuagaguggc

SEQ ID NO: 467211 - RNA, 22 nt, Human
gucccauaaguagugcaacuug

SEQ ID NO: 467212 - RNA, 22 nt, Human
aggacaggauugagcugaacug

SEQ ID NO: 467213 - RNA, 20 nt, Human
agcccaggccugugugaguc

SEQ ID NO: 467214 - RNA, 22 nt, Human
acauccagaucucagcauggcu

SEQ ID NO: 467215 - RNA, 22 nt, Human
uuuuccucaggaaugcuaagcu

SEQ ID NO: 467216 - RNA, 21 nt, Human
ucucugggcccuccugugggg

SEQ ID NO: 467217 - RNA, 22 nt, Human
ucucacucauuuccuaggucuu

SEQ ID NO: 467218 - RNA, 22 nt, Human
aagcuggaacaucuugaggaag

SEQ ID NO: 467219 - RNA, 22 nt, Human
gcaggagcucguuuccaggcug

SEQ ID NO: 467220 - RNA, 22 nt, Human
ucuuugcagaauuuaacuuugc

SEQ ID NO: 467221 - RNA, 22 nt, Human
gcagaggaucaggcucuggaaa

SEQ ID NO: 467222 - RNA, 22 nt, Human
acagagcacauagauuggaguu

SEQ ID NO: 467223 - RNA, 22 nt, Human
uacauguuuacuccaagucagg

SEQ ID NO: 467224 - RNA, 22 nt, Human
auuaagacugcccauguuuuua

SEQ ID NO: 467225 - RNA, 22 nt, Human
cacagcauaaugaaauauacuu

SEQ ID NO: 467226 - RNA, 22 nt, Human
agagugaaaagcuagagcagua

SEQ ID NO: 467227 - RNA, 22 nt, Human
gaggaaccaaaucagcuugcac

SEQ ID NO: 467228 - RNA, 22 nt, Human
uccuauugguagacauuucugu

SEQ ID NO: 467229 - RNA, 22 nt, Human
ucuggccacccgaggccccugc

SEQ ID NO: 467230 - RNA, 22 nt, Human
uggcugaauaaaauaugguguu

SEQ ID NO: 467231 - RNA, 22 nt, Human
ugcaggagaaaguacggagcgu

SEQ ID NO: 467232 - RNA, 22 nt, Human
acagugaaugcccaagaaaagu

SEQ ID NO: 467233 - RNA, 22 nt, Human
uacaaacucuuuauauuucaua

SEQ ID NO: 467234 - RNA, 22 nt, Human
cugggugguuuugaugugaauu

SEQ ID NO: 467235 - RNA, 22 nt, Human
aguggcagacacaaugugggca

SEQ ID NO: 467236 - RNA, 22 nt, Human
ggggccagcacugugccuuugu

SEQ ID NO: 467237 - RNA, 22 nt, Human
auaaaaguaggaccaacuuaca

SEQ ID NO: 467238 - RNA, 22 nt, Human
ugauuuuuagcuauucugaaga

SEQ ID NO: 467239 - RNA, 22 nt, Human
ucagaagacuacuaggacacau

SEQ ID NO: 467240 - RNA, 22 nt, Human
uacauuguuuuuucuugccauc

SEQ ID NO: 467241 - RNA, 22 nt, Human
ugccuggaugugcuggccucac

SEQ ID NO: 467242 - RNA, 22 nt, Human
uucagugucaauuuuuaaauau

SEQ ID NO: 467243 - RNA, 22 nt, Human
aggucauuaaaguuaaaugagg

SEQ ID NO: 467244 - RNA, 20 nt, Human
ggucccugcccucugucauc

SEQ ID NO: 467245 - RNA, 21 nt, Human
agcugcuuucagcuccuagag

SEQ ID NO: 467246 - RNA, 21 nt, Human
ccugcagcaccagaaggagau

SEQ ID NO: 467247 - RNA, 22 nt, Human
ggcaguggcuccucucuacucc

SEQ ID NO: 467248 - RNA, 20 nt, Human
uggcuccucuuggcuguggc

SEQ ID NO: 467249 - RNA, 21 nt, Human
agcagagugcuuugacuuugu

SEQ ID NO: 467250 - RNA, 22 nt, Human
gcugaggccucagaaggcugag

SEQ ID NO: 467251 - RNA, 22 nt, Human
ucagggcauacucuucaagguc

SEQ ID NO: 467252 - RNA, 22 nt, Human
uaauuucuaauucauuuucagu

SEQ ID NO: 467253 - RNA, 22 nt, Human
gccaggcuggugucacaacucu

SEQ ID NO: 467254 - RNA, 22 nt, Human
acugagcugcaagucagggagg

SEQ ID NO: 467255 - RNA, 22 nt, Human
aaaugcacagguuuuaaauccu

SEQ ID NO: 467256 - RNA, 22 nt, Human
gaaacaaucaucaugugauuug

SEQ ID NO: 467257 - RNA, 20 nt, Human
gcagcugaaaguaugacacc

SEQ ID NO: 467258 - RNA, 21 nt, Human
ccagaggccucucuuggccac

SEQ ID NO: 467259 - RNA, 22 nt, Human
ggucuuccgagaggccugugcu

SEQ ID NO: 467260 - RNA, 22 nt, Human
cagggcugguuugucgaagaaa

SEQ ID NO: 467261 - RNA, 22 nt, Human
cagguccuggcaucaggcaggu

SEQ ID NO: 467262 - RNA, 22 nt, Human
gugcugagcugcagaugcgcuc

SEQ ID NO: 467263 - RNA, 22 nt, Human
cagugcagaggccagggaggau

SEQ ID NO: 467264 - RNA, 22 nt, Human
acuacuuugggccauuuguuua

SEQ ID NO: 467265 - RNA, 22 nt, Human
gcccaggccggagagcagugcu

SEQ ID NO: 467266 - RNA, 22 nt, Human
caaagugcuggaauuacaggug

SEQ ID NO: 467267 - RNA, 22 nt, Human
auuuuuaugacaaaccauccuc

SEQ ID NO: 467268 - RNA, 22 nt, Human
gcaaagucugcaucuggaucag

SEQ ID NO: 467269 - RNA, 22 nt, Human
gagcaggcuugcagagaagggg

SEQ ID NO: 467270 - RNA, 22 nt, Human
auuaaaagcuucccaagaguua

SEQ ID NO: 467271 - RNA, 22 nt, Human
uccaugagggacacuggaugcu

SEQ ID NO: 467272 - RNA, 22 nt, Human
gggcuacauugugagagaaguu

SEQ ID NO: 467273 - RNA, 21 nt, Human
cauugucgacauuuuccccuc

SEQ ID NO: 467274 - RNA, 22 nt, Human
cuaguucuagaucccugaggaa

SEQ ID NO: 467275 - RNA, 22 nt, Human
ggcuuccuggggccuccugcaa

SEQ ID NO: 467276 - RNA, 22 nt, Human
uggcagcaauuagcuagagcug

SEQ ID NO: 467277 - RNA, 22 nt, Human
uggggcuggggaucuugagccu

SEQ ID NO: 467278 - RNA, 22 nt, Human
cucaggacccgguccagguggg

SEQ ID NO: 467279 - RNA, 22 nt, Human
gcagccacuuugcaaccaagag

SEQ ID NO: 467280 - RNA, 23 nt, Human
aggcccaacucugugagggcugc

SEQ ID NO: 467281 - RNA, 22 nt, Human
agggaccuugauggguuuggga

SEQ ID NO: 467282 - RNA, 22 nt, Human
cagagccaggguugcaccccug

SEQ ID NO: 467283 - RNA, 22 nt, Human
caggccugcaggaaaggcuccc

SEQ ID NO: 467284 - RNA, 22 nt, Human
gucaccagucccagcuccugaa

SEQ ID NO: 467285 - RNA, 22 nt, Human
ggcagcaugagccuggugaauu

SEQ ID NO: 467286 - RNA, 22 nt, Human
uuauccaaacuggugaaucauu

SEQ ID NO: 467287 - RNA, 23 nt, Human
gaagccacacaaaggucgccaag

SEQ ID NO: 467288 - RNA, 22 nt, Human
uaguaucuuucuauauuuccca

SEQ ID NO: 467289 - RNA, 18 nt, Human
cagcagagacauucaaaa

SEQ ID NO: 467290 - RNA, 22 nt, Human
acaggcugcugggcuccgugcu

SEQ ID NO: 467291 - RNA, 22 nt, Human
gaggcaggcccugaaugaguca

SEQ ID NO: 467292 - RNA, 22 nt, Human
gcuggcugaggucuagcucuuu

SEQ ID NO: 467293 - RNA, 23 nt, Human
gcauugucuccccacuucugggc

SEQ ID NO: 467294 - RNA, 22 nt, Human
uugaacauuaacuucagucuau

SEQ ID NO: 467295 - RNA, 22 nt, Human
gcucccugacucaguuccugag

SEQ ID NO: 467296 - RNA, 22 nt, Human
acccugggcuuggccugcucag

SEQ ID NO: 467297 - RNA, 22 nt, Human
uccugcagagucccacugauuu

SEQ ID NO: 467298 - RNA, 22 nt, Human
uuaccaaaucccgugcacauuc

SEQ ID NO: 467299 - RNA, 22 nt, Human
aaggugucggguuagcucagcc

SEQ ID NO: 467300 - RNA, 22 nt, Human
agggcuggcuccguuaccuuga

SEQ ID NO: 467301 - RNA, 22 nt, Human
ucugagccaauuucugugucca

SEQ ID NO: 467302 - RNA, 22 nt, Human
uggagcccagacacuggcauug

SEQ ID NO: 467303 - RNA, 22 nt, Human
gacuguacgucauugaaggcca

SEQ ID NO: 467304 - RNA, 22 nt, Human
aagggcucccugccugaggugg

SEQ ID NO: 467305 - RNA, 22 nt, Human
ccagggcacuuaggcccagccc

SEQ ID NO: 467306 - RNA, 22 nt, Human
cauuuucucaaugaacccucuu

SEQ ID NO: 467307 - RNA, 22 nt, Human
ugugccuggaucucugugacaa

SEQ ID NO: 467308 - RNA, 22 nt, Human
auucucugugcagauuuaagac

SEQ ID NO: 467309 - RNA, 22 nt, Human
gggcagguggagggcccagcca

SEQ ID NO: 467310 - RNA, 22 nt, Human
gauggguggucucagacuugcc

SEQ ID NO: 467311 - RNA, 22 nt, Human
cccagccucuggguucugccgg

SEQ ID NO: 467312 - RNA, 22 nt, Human
cugggcuggcgcauccgacacg

SEQ ID NO: 467313 - RNA, 22 nt, Human
cacaucagguagaccuacagag

SEQ ID NO: 467314 - RNA, 22 nt, Human
gggcugagggguaucucauggg

SEQ ID NO: 467315 - RNA, 22 nt, Human
ccuggcagucaggggaguccuu

SEQ ID NO: 467316 - RNA, 22 nt, Human
uaaggaaacaacuuguauuuuu

SEQ ID NO: 467317 - RNA, 22 nt, Human
agaugggcgcccuggacugagg

SEQ ID NO: 467318 - RNA, 22 nt, Human
ccagagccucaacacagguccu

SEQ ID NO: 467319 - RNA, 17 nt, Human
agugaaauuuacauugc

SEQ ID NO: 467320 - RNA, 18 nt, Human
cuuuaugugcagagcuuu

SEQ ID NO: 467321 - RNA, 22 nt, Human
gcaggugguccccguggagugg

SEQ ID NO: 467322 - RNA, 22 nt, Human
ugaccuauuagauuuccuugcc

SEQ ID NO: 467323 - RNA, 22 nt, Human
cagggcucgcucgcucgcucgc

SEQ ID NO: 467324 - RNA, 22 nt, Human
uuuccaaagguggcaggaacaa

SEQ ID NO: 467325 - RNA, 22 nt, Human
aggcgcagacauacagggucug

SEQ ID NO: 467326 - RNA, 22 nt, Human
aguggcaggcagaagcuucuca

SEQ ID NO: 467327 - RNA, 22 nt, Human
auuauaaaccuuugaggguggg

SEQ ID NO: 467328 - RNA, 22 nt, Human
gugcagugagcagugcagcacc

SEQ ID NO: 467329 - RNA, 22 nt, Human
ugcagcucauugguguccuggu

SEQ ID NO: 467330 - RNA, 23 nt, Human
ccuucagaagaaguaacaggggc

SEQ ID NO: 467331 - RNA, 22 nt, Human
ugugcuucuugcagcuccugua

SEQ ID NO: 467332 - RNA, 22 nt, Human
aaauguauccuacuuccugagu

SEQ ID NO: 467333 - RNA, 22 nt, Human
cagaaauggaauuuuccaucac

SEQ ID NO: 467334 - RNA, 22 nt, Human
gcacacagccagcugagggcua

SEQ ID NO: 467335 - RNA, 22 nt, Human
uguauuagaucugagaacuucu

SEQ ID NO: 467336 - RNA, 20 nt, Human
gcugggggugugcugaguga

SEQ ID NO: 467337 - RNA, 22 nt, Human
uagcuuuccuuguugccugugc

SEQ ID NO: 467338 - RNA, 22 nt, Human
aagccgggccugagaaaugaca

SEQ ID NO: 467339 - RNA, 22 nt, Human
uggaaggggagcuggaaagggg

SEQ ID NO: 467340 - RNA, 22 nt, Human
uaacacugauuuguucucaggg

SEQ ID NO: 467341 - RNA, 22 nt, Human
ugagccugggagauggaggcug

SEQ ID NO: 467342 - RNA, 22 nt, Human
ugaggcagaguaagauacauga

SEQ ID NO: 467343 - RNA, 22 nt, Human
uugaggagcaggaugggaggcu

SEQ ID NO: 467344 - RNA, 20 nt, Human
cucaggauugucuagccccu

SEQ ID NO: 467345 - RNA, 22 nt, Human
auuuuucucucacacuuaccag

SEQ ID NO: 467346 - RNA, 22 nt, Human
ggggcagaguagcuggggugug

SEQ ID NO: 467347 - RNA, 22 nt, Human
cagagccaacgccaccugccca

SEQ ID NO: 467348 - RNA, 22 nt, Human
gcaugucaugucauguaggaau

SEQ ID NO: 467349 - RNA, 22 nt, Human
aaguccagcagugcuuguugau

SEQ ID NO: 467350 - RNA, 22 nt, Human
cagagcuggagaaguggauuua

SEQ ID NO: 467351 - RNA, 22 nt, Human
cagccagcuggcacugugagua

SEQ ID NO: 467352 - RNA, 22 nt, Human
uggcuccuucauucuccugcca

SEQ ID NO: 467353 - RNA, 22 nt, Human
uaaggcacccauguucauacag

SEQ ID NO: 467354 - RNA, 22 nt, Human
cucuuaaagaauguuccagcug

SEQ ID NO: 467355 - RNA, 22 nt, Human
cuggagagggagcccuggcagu

SEQ ID NO: 467356 - RNA, 22 nt, Human
uugcagcuuagugauguuaucu

SEQ ID NO: 467357 - RNA, 22 nt, Human
ccagcucccugaagccuggucu

SEQ ID NO: 467358 - RNA, 22 nt, Human
ggaccagagcucgggcuucuca

SEQ ID NO: 467359 - RNA, 22 nt, Human
cugucugucaccaaaacagacu

SEQ ID NO: 467360 - RNA, 22 nt, Human
ugagcccuaagggucaagcagg

SEQ ID NO: 467361 - RNA, 22 nt, Human
gccugucaauuuuguguacaau

SEQ ID NO: 467362 - RNA, 22 nt, Human
uccugccugagcguggaggagg

SEQ ID NO: 467363 - RNA, 20 nt, Human
ccuggcugcauucaggacgg

SEQ ID NO: 467364 - RNA, 22 nt, Human
aggccucacucucagagcuucu

SEQ ID NO: 467365 - RNA, 22 nt, Human
cacucacuuauuucuaacagaa

SEQ ID NO: 467366 - RNA, 22 nt, Human
gucaggaugacaagugcuuuca

SEQ ID NO: 467367 - RNA, 22 nt, Human
uuugucuuguguccuuaggacc

SEQ ID NO: 467368 - RNA, 22 nt, Human
aaguccagugcuuuagauucca

SEQ ID NO: 467369 - RNA, 22 nt, Human
cagucccaaggaggaagcaguc

SEQ ID NO: 467370 - RNA, 22 nt, Human
ccauuaaaauggaauguaguga

SEQ ID NO: 467371 - RNA, 22 nt, Human
ugugaaagauacuaggcagagg

SEQ ID NO: 467372 - RNA, 22 nt, Human
cucccuggcacagcgagagguu

SEQ ID NO: 467373 - RNA, 22 nt, Human
cccagcuugucugauucagccu

SEQ ID NO: 467374 - RNA, 22 nt, Human
uccucagucguuugagccaaaa

SEQ ID NO: 467375 - RNA, 22 nt, Human
gagccaaggguugccauggaga

SEQ ID NO: 467376 - RNA, 22 nt, Human
agugucauuuuguccaucuucu

SEQ ID NO: 467377 - RNA, 22 nt, Human
agaugcugccucuccucacaag

SEQ ID NO: 467378 - RNA, 22 nt, Human
aagcaggcauuccagagacaau

SEQ ID NO: 467379 - RNA, 22 nt, Human
cuaguggaaacuaacuggaauu

SEQ ID NO: 467380 - RNA, 22 nt, Human
ugggugaggaugaugaggcagc

SEQ ID NO: 467381 - RNA, 22 nt, Human
cagggcugucuccaaaggcccc

SEQ ID NO: 467382 - RNA, 22 nt, Human
gcuguggaaaugccuaacauga

SEQ ID NO: 467383 - RNA, 22 nt, Human
ggagugucagaaacaguguccu

SEQ ID NO: 467384 - RNA, 22 nt, Human
gaugauuuuaugucuugucauu

SEQ ID NO: 467385 - RNA, 17 nt, Human
uggcucugaggcugaau

SEQ ID NO: 467386 - RNA, 22 nt, Human
uuauguauggauggcugaaagu

SEQ ID NO: 467387 - RNA, 22 nt, Human
ucaggauguccaaaauccagcc

SEQ ID NO: 467388 - RNA, 19 nt, Human
ugggcagguucaguaaugg

SEQ ID NO: 467389 - RNA, 22 nt, Human
ugcauuguugaccaguugugca

SEQ ID NO: 467390 - RNA, 22 nt, Human
agcagcagaggucagaaaggua

SEQ ID NO: 467391 - RNA, 22 nt, Human
uuagcugcauuaucaaaguuau

SEQ ID NO: 467392 - RNA, 22 nt, Human
uucaagucaaggaaagaggucu

SEQ ID NO: 467393 - RNA, 21 nt, Human
gcccagcaaggugagaaggcc

SEQ ID NO: 467394 - RNA, 22 nt, Human
aggucagcugcugauaggcagc

SEQ ID NO: 467395 - RNA, 22 nt, Human
agccugcaggaugggcagcacc

SEQ ID NO: 467396 - RNA, 21 nt, Human
acuuugggcacuuuccugccc

SEQ ID NO: 467397 - RNA, 22 nt, Human
cucugggcaaagaugccucauc

SEQ ID NO: 467398 - RNA, 22 nt, Human
uaguucuucaugaauucagcuu

SEQ ID NO: 467399 - RNA, 22 nt, Human
cgcagagggcaggcagugcugg

SEQ ID NO: 467400 - RNA, 22 nt, Human
gugucccagccccacaggccug

SEQ ID NO: 467401 - RNA, 22 nt, Human
ugacagggcuagaggcaaugca

SEQ ID NO: 467402 - RNA, 22 nt, Human
auuucuucaggucagaaauaga

SEQ ID NO: 467403 - RNA, 22 nt, Human
ccagaggagggcucugaugagg

SEQ ID NO: 467404 - RNA, 23 nt, Human
acacauuuuucccguucugaggu

SEQ ID NO: 467405 - RNA, 22 nt, Human
agucauaauuauaaacaucagu

SEQ ID NO: 467406 - RNA, 22 nt, Human
cauccugcggggagcagagggc

SEQ ID NO: 467407 - RNA, 22 nt, Human
uuaugcuaagugcaacaagcca

SEQ ID NO: 467408 - RNA, 22 nt, Human
auggcaagcaagcugaagagau

SEQ ID NO: 467409 - RNA, 23 nt, Human
cuagggcaguauuucacagacac

SEQ ID NO: 467410 - RNA, 22 nt, Human
uagcugcccaucuuuccuuuag

SEQ ID NO: 467411 - RNA, 18 nt, Human
gcuggcugcacuucugcu

SEQ ID NO: 467412 - RNA, 22 nt, Human
aggcaagaacagacaugggagu

SEQ ID NO: 467413 - RNA, 22 nt, Human
uugaagcaaauucugugcagua

SEQ ID NO: 467414 - RNA, 22 nt, Human
ccagaagaggacacagugugga

SEQ ID NO: 467415 - RNA, 22 nt, Human
ggccuuggugccauggccaguu

SEQ ID NO: 467416 - RNA, 22 nt, Human
agccaccaccacugaaagguua

SEQ ID NO: 467417 - RNA, 22 nt, Human
auuuccacauaagggaaauaag

SEQ ID NO: 467418 - RNA, 17 nt, Human
guccugggaggagagag

SEQ ID NO: 467419 - RNA, 22 nt, Human
ucucuuaaaagauuuuaaugac

SEQ ID NO: 467420 - RNA, 22 nt, Human
gccagcaguccugcugugugcc

SEQ ID NO: 467421 - RNA, 22 nt, Human
ugaugggacugccagcugcuga

SEQ ID NO: 467422 - RNA, 22 nt, Human
ucagggacuaggugcugccuga

SEQ ID NO: 467423 - RNA, 22 nt, Human
aaaaacuguaauuacuuuugca

SEQ ID NO: 467424 - RNA, 22 nt, Human
caagagcauuuaguuagcuggu

SEQ ID NO: 467425 - RNA, 23 nt, Human
uucuuucaagaaguucacagugc

SEQ ID NO: 467426 - RNA, 19 nt, Human
acagggcagcaauaggaua

SEQ ID NO: 467427 - RNA, 22 nt, Human
aagggcagggaguuugugucua

SEQ ID NO: 467428 - RNA, 22 nt, Human
gagcugagccuggguggaccgc

SEQ ID NO: 467429 - RNA, 22 nt, Human
aucugccuccaaguccaugugu

SEQ ID NO: 467430 - RNA, 22 nt, Human
guaacugaggcagcuuuuaaga

SEQ ID NO: 467431 - RNA, 22 nt, Human
gcagaggacacaggagggcaag

SEQ ID NO: 467432 - RNA, 22 nt, Human
ggugccaggcucccagcucagg

SEQ ID NO: 467433 - RNA, 22 nt, Human
ucaucucaaaacccaaggggca

SEQ ID NO: 467434 - RNA, 22 nt, Human
uccauucauucauugaugaaca

SEQ ID NO: 467435 - RNA, 22 nt, Human
agcagggcuggauuuggcaaga

SEQ ID NO: 467436 - RNA, 19 nt, Human
auagaaaggguuaaagaca

SEQ ID NO: 467437 - RNA, 22 nt, Human
ugagcuuacuucuguacacaga

SEQ ID NO: 467438 - RNA, 22 nt, Human
gccagcagccacagaagucacu

SEQ ID NO: 467439 - RNA, 22 nt, Human
gcuguccaugucuggccucagu

SEQ ID NO: 467440 - RNA, 22 nt, Human
ucauccaguuguggagagggaa

SEQ ID NO: 467441 - RNA, 22 nt, Human
ccggcucggcgaccaggcugaa

SEQ ID NO: 467442 - RNA, 19 nt, Human
ggcugccuggagcgagggc

SEQ ID NO: 467443 - RNA, 22 nt, Human
aagaacagguucuagaaccauu

SEQ ID NO: 467444 - RNA, 18 nt, Human
acagaacucaggggcacc

SEQ ID NO: 467445 - RNA, 22 nt, Human
ucauggauggccgggaggugau

SEQ ID NO: 467446 - RNA, 22 nt, Human
ccaggcucugcgcuggacaugg

SEQ ID NO: 467447 - RNA, 22 nt, Human
aucuggcuuggguguggguagc

SEQ ID NO: 467448 - RNA, 20 nt, Human
gggugagauguaggagaggg

SEQ ID NO: 467449 - RNA, 20 nt, Human
ccaggccugggccugcucua

SEQ ID NO: 467450 - RNA, 22 nt, Human
cacucaggcugugucaggagga

SEQ ID NO: 467451 - RNA, 22 nt, Human
ccagcuccaaguuugggcauca

SEQ ID NO: 467452 - RNA, 23 nt, Human
agcauggaauaggaaagaggcag

SEQ ID NO: 467453 - RNA, 22 nt, Human
agagccugggcagcuccucugg

SEQ ID NO: 467454 - RNA, 17 nt, Human
ucugccgacugccagcu

SEQ ID NO: 467455 - RNA, 22 nt, Human
agccucucugaugugacagcua

SEQ ID NO: 467456 - RNA, 22 nt, Human
aaagaaauagauggcauuuaaa

SEQ ID NO: 467457 - RNA, 22 nt, Human
aagcuuuaugacuuggagacag

SEQ ID NO: 467458 - RNA, 22 nt, Human
uauuugcaacauaaaacucuga

SEQ ID NO: 467459 - RNA, 22 nt, Human
ucauugcagcuucagguguuca

SEQ ID NO: 467460 - RNA, 22 nt, Human
gaggucaggcuugcagcagggu

SEQ ID NO: 467461 - RNA, 22 nt, Human
uaagaacagugucugucucaca

SEQ ID NO: 467462 - RNA, 22 nt, Human
cccaggucuaugccagcucuga

SEQ ID NO: 467463 - RNA, 22 nt, Human
ucccaggccauaaaacucagag

SEQ ID NO: 467464 - RNA, 22 nt, Human
cugagccaaccacagcaggagc

SEQ ID NO: 467465 - RNA, 22 nt, Human
uggcugaaggaagauucuucua

SEQ ID NO: 467466 - RNA, 22 nt, Human
uccagggccaagucauggaacc

SEQ ID NO: 467467 - RNA, 22 nt, Human
aucagaagaaauggaugugacu

SEQ ID NO: 467468 - RNA, 22 nt, Human
auaugugugccauuucagcagu

SEQ ID NO: 467469 - RNA, 22 nt, Human
gagcaacaguuuaugguuuuuc

SEQ ID NO: 467470 - RNA, 22 nt, Human
ggggaccuuuccauuucugaga

SEQ ID NO: 467471 - RNA, 17 nt, Human
gcccgugggcuacggua

SEQ ID NO: 467472 - RNA, 22 nt, Human
agggaaauuaaugugagcaaug

SEQ ID NO: 467473 - RNA, 22 nt, Human
guaugucuuaggguucaguaac

SEQ ID NO: 467474 - RNA, 22 nt, Human
acugguuuuggaaaucaguaca

SEQ ID NO: 467475 - RNA, 22 nt, Human
acgcggugcggcaaguucaugg

SEQ ID NO: 467476 - RNA, 23 nt, Human
gagcugggauacaggcuuacugc

SEQ ID NO: 467477 - RNA, 22 nt, Human
ugcuccaggcugcugaagaucu

SEQ ID NO: 467478 - RNA, 22 nt, Human
ugggcagggagcuggaaccaca

SEQ ID NO: 467479 - RNA, 22 nt, Human
gggcaugguggcaggcaccugu

SEQ ID NO: 467480 - RNA, 22 nt, Human
ucggggauggugucugagggag

SEQ ID NO: 467481 - RNA, 18 nt, Human
gccagcccuccaaccucc

SEQ ID NO: 467482 - RNA, 22 nt, Human
ggccgggcuguggagaaggggu

SEQ ID NO: 467483 - RNA, 22 nt, Human
uccugugccuccaccugcuccg

SEQ ID NO: 467484 - RNA, 22 nt, Human
aggcgaagggaccagacgguag

SEQ ID NO: 467485 - RNA, 22 nt, Human
ucagauggaaugaugccacugc

SEQ ID NO: 467486 - RNA, 21 nt, Human
ggccuuggcgggggccgaauu

SEQ ID NO: 467487 - RNA, 22 nt, Human
gccagagggauuccuggugugu

SEQ ID NO: 467488 - RNA, 22 nt, Human
gucccagaggacagggucacau

SEQ ID NO: 467489 - RNA, 22 nt, Human
gcugguggcagagcuccgcggc

SEQ ID NO: 467490 - RNA, 22 nt, Human
acugcacuccagcccgagcaac

SEQ ID NO: 467491 - RNA, 22 nt, Human
ggcgcggugacucagccucgcu

SEQ ID NO: 467492 - RNA, 22 nt, Human
uagcccauggacuggucagcug

SEQ ID NO: 467493 - RNA, 22 nt, Human
uaagggaacagcuucaaacuca

SEQ ID NO: 467494 - RNA, 22 nt, Human
ccccuuucucccgcgucuggcc

SEQ ID NO: 467495 - RNA, 22 nt, Human
gcggggacagaaggcgguucuc

SEQ ID NO: 467496 - RNA, 22 nt, Human
ggcagguguggugaccagagau

SEQ ID NO: 467497 - RNA, 22 nt, Human
gcgaguccacuggggggcgcag

SEQ ID NO: 467498 - RNA, 22 nt, Human
ggcgagcaugagucacucuggg

SEQ ID NO: 467499 - RNA, 22 nt, Human
ugagcugcuucuuauaaugugu

SEQ ID NO: 467500 - RNA, 22 nt, Human
auggugguagaagcacuaugug

SEQ ID NO: 467501 - RNA, 22 nt, Human
gcuaugggaugugcuguggaug

SEQ ID NO: 467502 - RNA, 22 nt, Human
uggcacagcuugucauaaacuc

SEQ ID NO: 467503 - RNA, 22 nt, Human
cuguccuaugaguacucacuag

SEQ ID NO: 467504 - RNA, 22 nt, Human
ugguccucacccuacccagcug

SEQ ID NO: 467505 - RNA, 22 nt, Human
ggagcugugcugggugaucagg

SEQ ID NO: 467506 - RNA, 22 nt, Human
acagccaggaauucuggagaag

SEQ ID NO: 467507 - RNA, 22 nt, Human
gccagccccagacauccuaucg

SEQ ID NO: 467508 - RNA, 22 nt, Human
uggcccgggaguuuugaagagu

SEQ ID NO: 467509 - RNA, 22 nt, Human
ggccuugguaaauuggcauuug

SEQ ID NO: 467510 - RNA, 20 nt, Human
gcuccccuucucugggccuc

SEQ ID NO: 467511 - RNA, 22 nt, Human
agggggcuccuuggugugcaga

SEQ ID NO: 467512 - RNA, 22 nt, Human
cacggccacugcagcaccccag

SEQ ID NO: 467513 - RNA, 19 nt, Human
ugguggaggugcaccugac

SEQ ID NO: 467514 - RNA, 22 nt, Human
uuccuccagccuggagcacuuc

SEQ ID NO: 467515 - RNA, 22 nt, Human
ggcagaggaagcuggaaguggg

SEQ ID NO: 467516 - RNA, 22 nt, Human
gcggcccgagcaggacgggugg

SEQ ID NO: 467517 - RNA, 22 nt, Human
uccggcggccggccugagcccg

SEQ ID NO: 467518 - RNA, 22 nt, Human
uggcaggaaaaagggccagagg

SEQ ID NO: 467519 - RNA, 22 nt, Human
ggagcugcucagagccaguccc

SEQ ID NO: 467520 - RNA, 22 nt, Human
ugcucccaggcauucucuguug

SEQ ID NO: 467521 - RNA, 20 nt, Human
ucugugugccaucaccuaac

SEQ ID NO: 467522 - RNA, 18 nt, Human
ggccucagccuggccgga

SEQ ID NO: 467523 - RNA, 22 nt, Human
gauggaggagauggcagggugc

SEQ ID NO: 467524 - RNA, 22 nt, Human
ucugggugucacuccugccugc

SEQ ID NO: 467525 - RNA, 23 nt, Human
gggugcugccuguagucaugcug

SEQ ID NO: 467526 - RNA, 22 nt, Human
ccuaggccgcccggugcguggg

SEQ ID NO: 467527 - RNA, 22 nt, Human
gggaaacuuucacaauguccag

SEQ ID NO: 467528 - RNA, 22 nt, Human
cuggccagggugcgaucguggu

SEQ ID NO: 467529 - RNA, 22 nt, Human
uccagccauaucuuguagcccu

SEQ ID NO: 467530 - RNA, 22 nt, Human
cacgcacgcuggguggaggcgc

SEQ ID NO: 467531 - RNA, 22 nt, Human
uuacgcagcugcuccaggaagc

SEQ ID NO: 467532 - RNA, 22 nt, Human
caugaccagagaggacggccag

SEQ ID NO: 467533 - RNA, 22 nt, Human
aggcaguggcuuuuguuguguu

SEQ ID NO: 467534 - RNA, 22 nt, Human
ucaccggcagacguggccugau

SEQ ID NO: 467535 - RNA, 22 nt, Human
cugcaccgugucucgggcugcc

SEQ ID NO: 467536 - RNA, 22 nt, Human
gggagccagcagggcauggagc

SEQ ID NO: 467537 - RNA, 21 nt, Human
acagaagcggcgaguggcccc

SEQ ID NO: 467538 - RNA, 22 nt, Human
uucuccccgucucucugaggcc

SEQ ID NO: 467539 - RNA, 22 nt, Human
ugggugaagaggcuaugcuacu

SEQ ID NO: 467540 - RNA, 22 nt, Human
gccaggucgucuccauguccaa

SEQ ID NO: 467541 - RNA, 22 nt, Human
cuucuggcguuggaggucugag

SEQ ID NO: 467542 - RNA, 22 nt, Human
aggcuccaugguucucccucag

SEQ ID NO: 467543 - RNA, 22 nt, Human
caggaaugguuaaucuaaagug

SEQ ID NO: 467544 - RNA, 22 nt, Human
ggccgcggauuuucccgcuggc

SEQ ID NO: 467545 - RNA, 19 nt, Human
acccagcccaggaguggca

SEQ ID NO: 467546 - RNA, 22 nt, Human
uggggcuccuccuggcaggagg

SEQ ID NO: 467547 - RNA, 22 nt, Human
agaguggagagaaacaacucug

SEQ ID NO: 467548 - RNA, 22 nt, Human
acgucuucguuggcagagauuu

SEQ ID NO: 467549 - RNA, 22 nt, Human
ccaugcccuugucaucuccagg

SEQ ID NO: 467550 - RNA, 22 nt, Human
uugacguccucgauggggaacu

SEQ ID NO: 467551 - RNA, 22 nt, Human
cugggcccaggcggcucucgga

SEQ ID NO: 467552 - RNA, 18 nt, Human
cugccagugugcucuccg

SEQ ID NO: 467553 - RNA, 22 nt, Human
caggccgggcacugcgcuaggu

SEQ ID NO: 467554 - RNA, 22 nt, Human
uuccuuggaaagagacgucgcu

SEQ ID NO: 467555 - RNA, 22 nt, Human
gccaggaccucagaugcagggc

SEQ ID NO: 467556 - RNA, 22 nt, Human
cugggaagggacgccagugccu

SEQ ID NO: 467557 - RNA, 22 nt, Human
acggccgaugacuccagcaugg

SEQ ID NO: 467558 - RNA, 20 nt, Human
cgggacacucaagcucuggg

SEQ ID NO: 467559 - RNA, 22 nt, Human
aaagcugggcuggccaacccag

SEQ ID NO: 467560 - RNA, 22 nt, Human
cgggaagguggagguugcagug

SEQ ID NO: 467561 - RNA, 22 nt, Human
ggaagcuguuaucaucuguauc

SEQ ID NO: 467562 - RNA, 22 nt, Human
ugcaaaaagagcgaggagcccu

SEQ ID NO: 467563 - RNA, 22 nt, Human
uucuuucugggguccuucggcu

SEQ ID NO: 467564 - RNA, 22 nt, Human
ugacucacuuaauuuacaaguc

SEQ ID NO: 467565 - RNA, 22 nt, Human
uguguggcaagcuguaugcuag

SEQ ID NO: 467566 - RNA, 22 nt, Human
auccgggguucauuuucacuga

SEQ ID NO: 467567 - RNA, 22 nt, Human
uacagcgaaaauuuagcuugau

SEQ ID NO: 467568 - RNA, 22 nt, Human
aaagcugcaagcuccugaggaa

SEQ ID NO: 467569 - RNA, 22 nt, Human
acucccuugguggagaaugcaa

SEQ ID NO: 467570 - RNA, 23 nt, Human
caccccacccugaggaggaggga

SEQ ID NO: 467571 - RNA, 21 nt, Human
agggccagaucaccaaggagc

SEQ ID NO: 467572 - RNA, 22 nt, Human
uuucuuggucuucccgaccugg

SEQ ID NO: 467573 - RNA, 21 nt, Human
ucuuggggaggagggcugcac

SEQ ID NO: 467574 - RNA, 22 nt, Human
auacagaagaccccuccgucau

SEQ ID NO: 467575 - RNA, 22 nt, Human
uuggggccgggauaagguuguu

SEQ ID NO: 467576 - RNA, 22 nt, Human
guggcagcggcccaggccgucu

SEQ ID NO: 467577 - RNA, 22 nt, Human
caggcccuuuccugggcauagg

SEQ ID NO: 467578 - RNA, 22 nt, Human
aaggggaguuagugauaaaacc

SEQ ID NO: 467579 - RNA, 22 nt, Human
ggcugcccucggggucgcaggc

SEQ ID NO: 467580 - RNA, 22 nt, Human
uacaaagugauuuuggaauuga

SEQ ID NO: 467581 - RNA, 22 nt, Human
cugggcccacgagggcucuggg

SEQ ID NO: 467582 - RNA, 22 nt, Human
gcagcagcggggccccugcgcg

SEQ ID NO: 467583 - RNA, 22 nt, Human
uccuggggaggucgaggcugag

SEQ ID NO: 467584 - RNA, 23 nt, Human
gguuggcuguacccaggcucccu

SEQ ID NO: 467585 - RNA, 22 nt, Human
ggcacugggugagggucacugg

SEQ ID NO: 467586 - RNA, 20 nt, Human
ugugcccaauguccagguuc

SEQ ID NO: 467587 - RNA, 22 nt, Human
aucauccauggcugaucauaaa

SEQ ID NO: 467588 - RNA, 22 nt, Human
cugcgggcugucaggcgugcca

SEQ ID NO: 467589 - RNA, 22 nt, Human
gagggugguggcuuaaggugcu

SEQ ID NO: 467590 - RNA, 22 nt, Human
cagcccaggacugcagguguuu

SEQ ID NO: 467591 - RNA, 19 nt, Human
cagcaaacacuguaaaugg

SEQ ID NO: 467592 - RNA, 22 nt, Human
agaaaucugacugcugugcaca

SEQ ID NO: 467593 - RNA, 22 nt, Human
uguaccacucuacuaaggguuc

SEQ ID NO: 467594 - RNA, 22 nt, Human
uggggucagcaggccuggccug

SEQ ID NO: 467595 - RNA, 20 nt, Human
uccagccacuuccgcugguc

SEQ ID NO: 467596 - RNA, 22 nt, Human
acucgcggcggacggcggccag

SEQ ID NO: 467597 - RNA, 20 nt, Human
ucucuggcaagaagcugcag

SEQ ID NO: 467598 - RNA, 22 nt, Human
caggguggaacaggcaauacuu

SEQ ID NO: 467599 - RNA, 22 nt, Human
uugggagaaauaguugauccgc

SEQ ID NO: 467600 - RNA, 22 nt, Human
ugaggauggaaugcugugcaag

SEQ ID NO: 467601 - RNA, 22 nt, Human
caggcacaaugagcgccaucuu

SEQ ID NO: 467602 - RNA, 22 nt, Human
cccaggaguuagagguuguggu

SEQ ID NO: 467603 - RNA, 22 nt, Human
aggaggguggggucugccuguc

SEQ ID NO: 467604 - RNA, 22 nt, Human
cacaggaagcaagccuggggcc

SEQ ID NO: 467605 - RNA, 20 nt, Human
gcagcagacagacaggggac

SEQ ID NO: 467606 - RNA, 22 nt, Human
ccugagcuuacaauuuaagaac

SEQ ID NO: 467607 - RNA, 22 nt, Human
uaaaaguuagcuaggacaaagu

SEQ ID NO: 467608 - RNA, 22 nt, Human
gcugccuggaauaacggcuggc

SEQ ID NO: 467609 - RNA, 22 nt, Human
gagcugcuggccuccugcggga

SEQ ID NO: 467610 - RNA, 22 nt, Human
gagguuggagggcuggccugca

SEQ ID NO: 467611 - RNA, 22 nt, Human
aaggaccaguuuugcagaauug

SEQ ID NO: 467612 - RNA, 22 nt, Human
aguguuugaguuugcggcauug

SEQ ID NO: 467613 - RNA, 22 nt, Human
uuuuuugucuugaagaaauggu

SEQ ID NO: 467614 - RNA, 22 nt, Human
cccagaggcugaguugggagca

SEQ ID NO: 467615 - RNA, 22 nt, Human
acccacagccgcugugcguccc

SEQ ID NO: 467616 - RNA, 22 nt, Human
ggucccagucccuuuccaccgu

SEQ ID NO: 467617 - RNA, 22 nt, Human
uccucuccaggugagccgaaau

SEQ ID NO: 467618 - RNA, 22 nt, Human
gaagcccuggggucagugucgu

SEQ ID NO: 467619 - RNA, 22 nt, Human
cagagccaaaccucagggcccg

SEQ ID NO: 467620 - RNA, 22 nt, Human
gccuggcaaggcccuguugacu

SEQ ID NO: 467621 - RNA, 22 nt, Human
agcaggccugccaccucggggu

SEQ ID NO: 467622 - RNA, 19 nt, Human
uccagaacugcccuggccu

SEQ ID NO: 467623 - RNA, 22 nt, Human
cgggcuccgggucuuugcaguc

SEQ ID NO: 467624 - RNA, 22 nt, Human
aggcuguagaucuagacaugua

SEQ ID NO: 467625 - RNA, 22 nt, Human
cucccagccuucgccagucuga

SEQ ID NO: 467626 - RNA, 22 nt, Human
auguuuguguuucccauucagg

SEQ ID NO: 467627 - RNA, 22 nt, Human
ggucauacaaggcacuggugau

SEQ ID NO: 467628 - RNA, 22 nt, Human
gugggggcaggcagugcuagga

SEQ ID NO: 467629 - RNA, 22 nt, Human
gugcucuggccaagcgcgugcg

SEQ ID NO: 467630 - RNA, 22 nt, Human
gcagggcugauggcuucccuca

SEQ ID NO: 467631 - RNA, 22 nt, Human
aagugcaggucucagcuacucu

SEQ ID NO: 467632 - RNA, 22 nt, Human
cgugcggccucggggcccggcu

SEQ ID NO: 467633 - RNA, 18 nt, Human
gccuggcuucggagccgc

SEQ ID NO: 467634 - RNA, 22 nt, Human
caucucccacuuccuugggggu

SEQ ID NO: 467635 - RNA, 22 nt, Human
ccaggagaaugggauuacccua

SEQ ID NO: 467636 - RNA, 22 nt, Human
ccaguccaggccauggauuuug

SEQ ID NO: 467637 - RNA, 22 nt, Human
ggagaagggaacugaguuuuug

SEQ ID NO: 467638 - RNA, 22 nt, Human
augaugaagcaugguuacacug

SEQ ID NO: 467639 - RNA, 17 nt, Human
ucuccuggcucuaucag

SEQ ID NO: 467640 - RNA, 22 nt, Human
uuggcgcccaggacgccgccgc

SEQ ID NO: 467641 - RNA, 22 nt, Human
aggcugucucaccucaggaggg

SEQ ID NO: 467642 - RNA, 22 nt, Human
uuaaaagaauccuguuauccuc

SEQ ID NO: 467643 - RNA, 22 nt, Human
gcuggccugaccugaggcuggg

SEQ ID NO: 467644 - RNA, 22 nt, Human
uccugcagccauuagaggucaa

SEQ ID NO: 467645 - RNA, 21 nt, Human
gccaccucaaucuucuagcgc

SEQ ID NO: 467646 - RNA, 22 nt, Human
guucuuaaagauucaucaagca

SEQ ID NO: 467647 - RNA, 22 nt, Human
gggcuguuugcauauguuuaua

SEQ ID NO: 467648 - RNA, 22 nt, Human
guuguuuuugaacggugguggc

SEQ ID NO: 467649 - RNA, 22 nt, Human
ucaggaugagucaucaagcugc

SEQ ID NO: 467650 - RNA, 22 nt, Human
gccacaggaaagcacccuggag

SEQ ID NO: 467651 - RNA, 22 nt, Human
uaaaaucaugacagauugacau

SEQ ID NO: 467652 - RNA, 22 nt, Human
cggucguaguucuucagcaggu

SEQ ID NO: 467653 - RNA, 22 nt, Human
cucaugucggcaggacucgccc

SEQ ID NO: 467654 - RNA, 22 nt, Human
aaaucugagaaauauuguccag

SEQ ID NO: 467655 - RNA, 22 nt, Human
agauugucauugacgaugagca

SEQ ID NO: 467656 - RNA, 22 nt, Human
acacaucagaaauaugaaugag

SEQ ID NO: 467657 - RNA, 22 nt, Human
cgcagcugcugcucugaaacag

SEQ ID NO: 467658 - RNA, 22 nt, Human
uggaagggguuacgcagcagga

SEQ ID NO: 467659 - RNA, 22 nt, Human
ccccagcagacucagggcaggu

SEQ ID NO: 467660 - RNA, 22 nt, Human
agccccaguucccuggaagucu

SEQ ID NO: 467661 - RNA, 22 nt, Human
ccacagcaugcaggccugacac

SEQ ID NO: 467662 - RNA, 22 nt, Human
gggagggucugagagcugcacc

SEQ ID NO: 467663 - RNA, 22 nt, Human
ccugguccccaucggcccagcg

SEQ ID NO: 467664 - RNA, 22 nt, Human
cccagcugaacuugcauuccaa

SEQ ID NO: 467665 - RNA, 22 nt, Human
acagauccugguuacagccauu

SEQ ID NO: 467666 - RNA, 22 nt, Human
ccugcacuaccuggggcugcug

SEQ ID NO: 467667 - RNA, 22 nt, Human
gagcaccgccuccacgaugccc

SEQ ID NO: 467668 - RNA, 22 nt, Human
ccaggcagccaagugugugugu

SEQ ID NO: 467669 - RNA, 18 nt, Human
cgauguguaugugauuug

SEQ ID NO: 467670 - RNA, 23 nt, Human
agguggagcugugcagccggggc

SEQ ID NO: 467671 - RNA, 22 nt, Human
uuauuuaaaauguagguuggga

SEQ ID NO: 467672 - RNA, 22 nt, Human
gagaaagggaacuuacagagug

SEQ ID NO: 467673 - RNA, 22 nt, Human
ucugggaguuucugugggagcu

SEQ ID NO: 467674 - RNA, 20 nt, Human
ccuggagccuggaaggaguc

SEQ ID NO: 467675 - RNA, 22 nt, Human
ucaccgccuugcccggccgggc

SEQ ID NO: 467676 - RNA, 22 nt, Human
ucccggcgcugggagguggguc

SEQ ID NO: 467677 - RNA, 22 nt, Human
acacacagaaggaagccccacu

SEQ ID NO: 467678 - RNA, 22 nt, Human
caggaaugccaaccagugcaug

SEQ ID NO: 467679 - RNA, 22 nt, Human
cuggcuccauccuugagcucug

SEQ ID NO: 467680 - RNA, 22 nt, Human
ucccagauuccugcucuuauau

SEQ ID NO: 467681 - RNA, 22 nt, Human
gcugcagggagcuggaaggcuc

SEQ ID NO: 467682 - RNA, 22 nt, Human
ggcggcgcguagccggagacuu

SEQ ID NO: 467683 - RNA, 22 nt, Human
ugcugcgggacccacugugggc

SEQ ID NO: 467684 - RNA, 22 nt, Human
ccaggagcccugccacaauggu

SEQ ID NO: 467685 - RNA, 22 nt, Human
cugguuuuccaauguuuugacu

SEQ ID NO: 467686 - RNA, 22 nt, Human
ugcccuccacaguggcuccacc

SEQ ID NO: 467687 - RNA, 22 nt, Human
acccacgaagaugagcggcaug

SEQ ID NO: 467688 - RNA, 20 nt, Human
gcugugccaugacccucgag

SEQ ID NO: 467689 - RNA, 22 nt, Human
acggagcccgugucagguggga

SEQ ID NO: 467690 - RNA, 22 nt, Human
aggcccugcugaggccucccuc

SEQ ID NO: 467691 - RNA, 22 nt, Human
uuggccguuucacugggcaguu

SEQ ID NO: 467692 - RNA, 22 nt, Human
uacguuuuaaacacggagccag

SEQ ID NO: 467693 - RNA, 22 nt, Human
auacaacagaaaaugauuauuc

SEQ ID NO: 467694 - RNA, 22 nt, Human
ggggaccuggccacccauccuu

SEQ ID NO: 467695 - RNA, 22 nt, Human
uggagugcaguugggaggacac

SEQ ID NO: 467696 - RNA, 22 nt, Human
uccuuucuucuucugcccaugg

SEQ ID NO: 467697 - RNA, 19 nt, Human
gggucccacugcccgucug

SEQ ID NO: 467698 - RNA, 22 nt, Human
cacgugcaggucuuaggagaca

SEQ ID NO: 467699 - RNA, 22 nt, Human
ugcucccaaaccugacaggcuc

SEQ ID NO: 467700 - RNA, 22 nt, Human
uguuugcucugacuaucuugcg

SEQ ID NO: 467701 - RNA, 22 nt, Human
augcggagccccaagcuugaag

SEQ ID NO: 467702 - RNA, 22 nt, Human
acuggcccuggcugcuaggcug

SEQ ID NO: 467703 - RNA, 22 nt, Human
gucacccguuugacuauccacc

SEQ ID NO: 467704 - RNA, 21 nt, Human
aucuuaaaaggucuuaacuuu

SEQ ID NO: 467705 - RNA, 17 nt, Human
gccuggcccagccuggc

SEQ ID NO: 467706 - RNA, 22 nt, Human
gaccaaggaagaggggagccag

SEQ ID NO: 467707 - RNA, 22 nt, Human
cucgccccggcacaguguccgu

SEQ ID NO: 467708 - RNA, 22 nt, Human
cuguguccaauggccuuagcag

SEQ ID NO: 467709 - RNA, 22 nt, Human
ccugcgcgucugggucugucuc

SEQ ID NO: 467710 - RNA, 21 nt, Human
cacuccacuuagaacaggguu

SEQ ID NO: 467711 - RNA, 22 nt, Human
gguggcagaggugcaucagccc

SEQ ID NO: 467712 - RNA, 19 nt, Human
ugcuccaggccuugccgca

SEQ ID NO: 467713 - RNA, 22 nt, Human
gugcaggugguuggcccagccg

SEQ ID NO: 467714 - RNA, 22 nt, Human
gaugggcaucaaacaugacgug

SEQ ID NO: 467715 - RNA, 22 nt, Human
agacacauuuucagcucugcca

SEQ ID NO: 467716 - RNA, 22 nt, Human
uuccuucuucauuguguuacag

SEQ ID NO: 467717 - RNA, 22 nt, Human
ggcgaggugucugccaucaagc

SEQ ID NO: 467718 - RNA, 22 nt, Human
gggcccuggacguggcggcaga

SEQ ID NO: 467719 - RNA, 22 nt, Human
ugugagauuuuauuugauaugc

SEQ ID NO: 467720 - RNA, 22 nt, Human
gggcagcaaaucugagucuggu

SEQ ID NO: 467721 - RNA, 22 nt, Human
gggagccccaccucggugcccg

SEQ ID NO: 467722 - RNA, 22 nt, Human
cagagguagccgagugcaaucg

SEQ ID NO: 467723 - RNA, 22 nt, Human
gagggcugccacguugggcgag

SEQ ID NO: 467724 - RNA, 22 nt, Human
ccugggacuuggucugggguuu

SEQ ID NO: 467725 - RNA, 22 nt, Human
gccuggagcucggcugagggcg

SEQ ID NO: 467726 - RNA, 22 nt, Human
ggccuuggaguccuccacugga

SEQ ID NO: 467727 - RNA, 22 nt, Human
ccaggccuguguuguguggagg

SEQ ID NO: 467728 - RNA, 22 nt, Human
caaugcagauaccuuccagaga

SEQ ID NO: 467729 - RNA, 22 nt, Human
accgugucugacacuuugggcg

SEQ ID NO: 467730 - RNA, 17 nt, Human
uaagggggaaacggagc

SEQ ID NO: 467731 - RNA, 22 nt, Human
aaagaggcucaaggugggccag

SEQ ID NO: 467732 - RNA, 22 nt, Human
cuccaggacugaggacagagcu

SEQ ID NO: 467733 - RNA, 17 nt, Human
uggcacagaggugcuau

SEQ ID NO: 467734 - RNA, 23 nt, Human
cagcacaguacauuuccugucuc

SEQ ID NO: 467735 - RNA, 20 nt, Human
aucaggcuuucuguugcgau

SEQ ID NO: 467736 - RNA, 22 nt, Human
cuacauuauguuuauugggacu

SEQ ID NO: 467737 - RNA, 22 nt, Human
ggagggaaccuuggcuggauug

SEQ ID NO: 467738 - RNA, 22 nt, Human
ggagccuggaguuucugauggg

SEQ ID NO: 467739 - RNA, 22 nt, Human
cugggaggcccacguugggaag

SEQ ID NO: 467740 - RNA, 22 nt, Human
uggugaagucagcggagcccgg

SEQ ID NO: 467741 - RNA, 22 nt, Human
ccaggcccugcuccucacacca

SEQ ID NO: 467742 - RNA, 22 nt, Human
gggaggaaggcuugggugagua

SEQ ID NO: 467743 - RNA, 22 nt, Human
gcauuuaaauuugaacuucaga

SEQ ID NO: 467744 - RNA, 22 nt, Human
uccuccuuuccccgcuggagcc

SEQ ID NO: 467745 - RNA, 22 nt, Human
gcgagucgccgcugcagcccua

SEQ ID NO: 467746 - RNA, 22 nt, Human
cagcuggcgacucuccucgaug

SEQ ID NO: 467747 - RNA, 20 nt, Human
caauaauuuacuucccuauu

SEQ ID NO: 467748 - RNA, 18 nt, Human
cugccuguugcugagagg

SEQ ID NO: 467749 - RNA, 22 nt, Human
gcacugccugugagcccugguu

SEQ ID NO: 467750 - RNA, 22 nt, Human
aggagggagcuuaagccaggca

SEQ ID NO: 467751 - RNA, 22 nt, Human
guggaaauuuuaggaucaucuu

SEQ ID NO: 467752 - RNA, 22 nt, Human
gggacuggaguagaggccggug

SEQ ID NO: 467753 - RNA, 18 nt, Human
ccucagggagagagacgc

SEQ ID NO: 467754 - RNA, 22 nt, Human
uccaggcuccccugcgugcucc

SEQ ID NO: 467755 - RNA, 22 nt, Human
gauugcugggucccacucccag

SEQ ID NO: 467756 - RNA, 22 nt, Human
cucccugggccucaguuucucu

SEQ ID NO: 467757 - RNA, 22 nt, Human
ugggaagauaugagugaccaac

SEQ ID NO: 467758 - RNA, 22 nt, Human
acuucccacugcagugacugag

SEQ ID NO: 467759 - RNA, 17 nt, Human
gcuccagaauucuaguc

SEQ ID NO: 467760 - RNA, 22 nt, Human
cggggccuagucuaccucggca

SEQ ID NO: 467761 - RNA, 22 nt, Human
ucgggacgguggcauuugugcc

SEQ ID NO: 467762 - RNA, 17 nt, Human
ucugcagggggccgugu

SEQ ID NO: 467763 - RNA, 22 nt, Human
agcuccagggaaagaguggauc

SEQ ID NO: 467764 - RNA, 18 nt, Human
agguguguuucuaggagc

SEQ ID NO: 467765 - RNA, 22 nt, Human
ucccuguccugggcaaucccag

SEQ ID NO: 467766 - RNA, 22 nt, Human
caggcucgguccaguggcaccc

SEQ ID NO: 467767 - RNA, 22 nt, Human
gaggggcucuugggcaugaagg

SEQ ID NO: 467768 - RNA, 22 nt, Human
cagggccagggcuauggugaag

SEQ ID NO: 467769 - RNA, 22 nt, Human
uuuccucacacagaagaucuug

SEQ ID NO: 467770 - RNA, 19 nt, Human
acugcagggaggaggugug

SEQ ID NO: 467771 - RNA, 22 nt, Human
ggccuugggauguggcugcagc

SEQ ID NO: 467772 - RNA, 22 nt, Human
gggcuccagaggcucacccugg

SEQ ID NO: 467773 - RNA, 20 nt, Human
uguauuuaaugaaggcuuuu

SEQ ID NO: 467774 - RNA, 22 nt, Human
gaagcgcggcgucggcgugggu

SEQ ID NO: 467775 - RNA, 17 nt, Human
uuuguucguuaguccgg

SEQ ID NO: 467776 - RNA, 22 nt, Human
ucucucugcagcccgggacacu

SEQ ID NO: 467777 - RNA, 22 nt, Human
agguggucuuguggaugccgca

SEQ ID NO: 467778 - RNA, 22 nt, Human
uccaggaggacugagggggcug

SEQ ID NO: 467779 - RNA, 22 nt, Human
aggccgugugagcaugugugag

SEQ ID NO: 467780 - RNA, 22 nt, Human
gcagccuccgcacugcgagucc

SEQ ID NO: 467781 - RNA, 22 nt, Human
guggggacgggauggcucacug

SEQ ID NO: 467782 - RNA, 22 nt, Human
cgugaugcucaggaggucauag

SEQ ID NO: 467783 - RNA, 22 nt, Human
cugcagggcagggccuccuggc

SEQ ID NO: 467784 - RNA, 22 nt, Human
gggggacaggaugaauaucugu

SEQ ID NO: 467785 - RNA, 22 nt, Human
ccaccgaaacgucugcggaucc

SEQ ID NO: 467786 - RNA, 22 nt, Human
ggagcggagggagggccacugu

SEQ ID NO: 467787 - RNA, 22 nt, Human
ggcacagcugaugcagacacac

SEQ ID NO: 467788 - RNA, 22 nt, Human
cggagcagagccacucgggccg

SEQ ID NO: 467789 - RNA, 22 nt, Human
ccgcguggcacccuccuggagg

SEQ ID NO: 467790 - RNA, 22 nt, Human
augaaacaacagacuuggucaa

SEQ ID NO: 467791 - RNA, 22 nt, Human
caauuaccaguaauugagguuu

SEQ ID NO: 467792 - RNA, 22 nt, Human
gaggcagagacuccaccuucag

SEQ ID NO: 467793 - RNA, 22 nt, Human
uguuccugacggccaaagaggu

SEQ ID NO: 467794 - RNA, 22 nt, Human
acaaacagaguugaaaaauagg

SEQ ID NO: 467795 - RNA, 22 nt, Human
gcagcagcaggcgcucggccgu

SEQ ID NO: 467796 - RNA, 19 nt, Human
gcacacccugcaccaccau

SEQ ID NO: 467797 - RNA, 22 nt, Human
aaagcagaacugagagagcugg

SEQ ID NO: 467798 - RNA, 22 nt, Human
gucguucucugccagggcguug

SEQ ID NO: 467799 - RNA, 22 nt, Human
ccuccccacagcccaggagacu

SEQ ID NO: 467800 - RNA, 22 nt, Human
ccuggggaccugccucagcccu

SEQ ID NO: 467801 - RNA, 22 nt, Human
aggggagguguccccaaaucuc

SEQ ID NO: 467802 - RNA, 22 nt, Human
caggcuguguuccuggaacccc

SEQ ID NO: 467803 - RNA, 22 nt, Human
uggaaggggagcuggaaagggg

SEQ ID NO: 467804 - RNA, 22 nt, Human
ccaguucuuucugugugcaaca

SEQ ID NO: 467805 - RNA, 22 nt, Human
ugggaaggggagcuggaaagga

SEQ ID NO: 467806 - RNA, 22 nt, Human
gggagggcuuggacccagaugu

SEQ ID NO: 467807 - RNA, 22 nt, Human
cccacaggcaggugcaugggcu

SEQ ID NO: 467808 - RNA, 22 nt, Human
guguuucccuggcacaagaacc

SEQ ID NO: 467809 - RNA, 22 nt, Human
gagcuccuauggucgguggcuc

SEQ ID NO: 467810 - RNA, 22 nt, Human
acagggcaccugagguaggaag

SEQ ID NO: 467811 - RNA, 22 nt, Human
cauugagcgacccugcaugacu

SEQ ID NO: 467812 - RNA, 22 nt, Human
gccagguugcugacgacgaucu

SEQ ID NO: 467813 - RNA, 19 nt, Human
acccucuccccacuggguc

SEQ ID NO: 467814 - RNA, 22 nt, Human
ggcuguggucauuaggagguug

SEQ ID NO: 467815 - RNA, 22 nt, Human
aucaugugacuagguuuggcca

SEQ ID NO: 467816 - RNA, 22 nt, Human
ugucuguccaucugucugggac

SEQ ID NO: 467817 - RNA, 22 nt, Human
aggcucgcaugcccugcaccac

SEQ ID NO: 467818 - RNA, 21 nt, Human
gucuuuuuaauugcgauuucc

SEQ ID NO: 467819 - RNA, 19 nt, Human
cugaaacacagagagggcu

SEQ ID NO: 467820 - RNA, 22 nt, Human
gguguggcaguggaccugugaa

SEQ ID NO: 467821 - RNA, 22 nt, Human
ggagaggguguggaaaguuauc

SEQ ID NO: 467822 - RNA, 22 nt, Human
ugguuaaaugcuccgaucuugg

SEQ ID NO: 467823 - RNA, 22 nt, Human
aguccagggcuuagucagcggg

SEQ ID NO: 467824 - RNA, 22 nt, Human
ccagcagccaccuucucgaaau

SEQ ID NO: 467825 - RNA, 22 nt, Human
gcccagcccagaaagguucgga

SEQ ID NO: 467826 - RNA, 22 nt, Human
uccgggagcugaacgucuugcg

SEQ ID NO: 467827 - RNA, 22 nt, Human
gcgcuccucccggcccuggugg

SEQ ID NO: 467828 - RNA, 22 nt, Human
uucuuuuaauagagauccugug

SEQ ID NO: 467829 - RNA, 22 nt, Human
gcugcaggcucugcaggaauug

SEQ ID NO: 467830 - RNA, 19 nt, Human
cgcacagccugccaggcgc

SEQ ID NO: 467831 - RNA, 22 nt, Human
aacccgggagguggagguuaug

SEQ ID NO: 467832 - RNA, 22 nt, Human
ugacagcccaccucacaggauu

SEQ ID NO: 467833 - RNA, 22 nt, Human
caauaaaguggaggcccgggcu

SEQ ID NO: 467834 - RNA, 23 nt, Human
cugagggcuggucugaagucugc

SEQ ID NO: 467835 - RNA, 22 nt, Human
cgauuuccgcuugaucugaucu

SEQ ID NO: 467836 - RNA, 22 nt, Human
agccacccuaccagcccugaaa

SEQ ID NO: 467837 - RNA, 22 nt, Human
uuauuuaaaagugguaagauuc

SEQ ID NO: 467838 - RNA, 22 nt, Human
acccaggucucucgacuucugg

SEQ ID NO: 467839 - RNA, 22 nt, Human
guucugucugagcaccacagga

SEQ ID NO: 467840 - RNA, 22 nt, Human
gaauacaaauaauaccaaggug

SEQ ID NO: 467841 - RNA, 22 nt, Human
gccacaggucggcuagaggguc

SEQ ID NO: 467842 - RNA, 22 nt, Human
caugcagugcuuugcgccgggc

SEQ ID NO: 467843 - RNA, 22 nt, Human
gccagugccugcugcucagggc

SEQ ID NO: 467844 - RNA, 22 nt, Human
gaaggacccucuggggucucag

SEQ ID NO: 467845 - RNA, 22 nt, Human
ggcggcacgcaggcugcugucg

SEQ ID NO: 467846 - RNA, 22 nt, Human
uggcagcagggccccuggagga

SEQ ID NO: 467847 - RNA, 22 nt, Human
gccccagcagcaaugcgguuga

SEQ ID NO: 467848 - RNA, 22 nt, Human
cuucucggccguguggaugcgc

SEQ ID NO: 467849 - RNA, 22 nt, Human
cuggccucacagaggcuaagcc

SEQ ID NO: 467850 - RNA, 22 nt, Human
gggcuccagccaggugucccca

SEQ ID NO: 467851 - RNA, 22 nt, Human
uacuuucuagcucuccccaguu

SEQ ID NO: 467852 - RNA, 22 nt, Human
cugcucaauuccggcacgcugg

SEQ ID NO: 467853 - RNA, 22 nt, Human
gaguggggcccacugcugggug

SEQ ID NO: 467854 - RNA, 22 nt, Human
cucaggcuaagaaggccaagug

SEQ ID NO: 467855 - RNA, 22 nt, Human
ucccucugcuagugcuugagcu

SEQ ID NO: 467856 - RNA, 22 nt, Human
ggccaaggcucuugagggcuga

SEQ ID NO: 467857 - RNA, 22 nt, Human
aggggcacgaguagagcucuag

SEQ ID NO: 467858 - RNA, 22 nt, Human
ugggugguugcugaggcuccuu

SEQ ID NO: 467859 - RNA, 22 nt, Human
acaugcauaaacuacuucuuau

SEQ ID NO: 467860 - RNA, 22 nt, Human
gggacagcuguagugcuuggcu

SEQ ID NO: 467861 - RNA, 22 nt, Human
uggagccagcaggacucagagg

SEQ ID NO: 467862 - RNA, 22 nt, Human
cccaggagacugagcuguaacc

SEQ ID NO: 467863 - RNA, 22 nt, Human
gggggaaaguggagguucguga

SEQ ID NO: 467864 - RNA, 22 nt, Human
caggcacaagaucggcuagaua

SEQ ID NO: 467865 - RNA, 22 nt, Human
uugacacagucaacuugauuuu

SEQ ID NO: 467866 - RNA, 17 nt, Human
ugggggcccuguguaga

SEQ ID NO: 467867 - RNA, 22 nt, Human
gagaugggcgagaagguggacu

SEQ ID NO: 467868 - RNA, 22 nt, Human
ggcagaggagcuggaaacaugg

SEQ ID NO: 467869 - RNA, 18 nt, Human
ggaggcucugugguuucc

SEQ ID NO: 467870 - RNA, 22 nt, Human
agaagagccacuguugacggca

SEQ ID NO: 467871 - RNA, 22 nt, Human
gugucccaaagauuagaaauca

SEQ ID NO: 467872 - RNA, 22 nt, Human
cugacagcgagagaguugcccc

SEQ ID NO: 467873 - RNA, 22 nt, Human
ggcggccugugggucggccuca

SEQ ID NO: 467874 - RNA, 22 nt, Human
ggacagacuuuacagccccggg

SEQ ID NO: 467875 - RNA, 22 nt, Human
ccugugggagggagcggcugga

SEQ ID NO: 467876 - RNA, 22 nt, Human
cuccuuccugguuagcaccuua

SEQ ID NO: 467877 - RNA, 22 nt, Human
aggagucaccugcccaaaguca

SEQ ID NO: 467878 - RNA, 22 nt, Human
gauggcgguggccaccuccuug

SEQ ID NO: 467879 - RNA, 22 nt, Human
caggaggaaaguuccacucaac

SEQ ID NO: 467880 - RNA, 22 nt, Human
agacagcacuuuuguauggggg

SEQ ID NO: 467881 - RNA, 22 nt, Human
gcucugugcaguucagggacac

SEQ ID NO: 467882 - RNA, 22 nt, Human
acugggcaaggauaugaugggu

SEQ ID NO: 467883 - RNA, 22 nt, Human
ugggucagauugagccccuggu

SEQ ID NO: 467884 - RNA, 22 nt, Human
aggaaagcucccaguagggcuc

SEQ ID NO: 467885 - RNA, 22 nt, Human
ccagcugggucccugcuggggc

SEQ ID NO: 467886 - RNA, 22 nt, Human
aagccgggccugagaaaugaca

SEQ ID NO: 467887 - RNA, 22 nt, Human
caggacccaaccucccugcucu

SEQ ID NO: 467888 - RNA, 22 nt, Human
agggugugcuguugggucuuuc

SEQ ID NO: 467889 - RNA, 22 nt, Human
ccucguccacaauccuugcaca

SEQ ID NO: 467890 - RNA, 22 nt, Human
cccacucccugcacgccugccg

SEQ ID NO: 467891 - RNA, 22 nt, Human
gggaggugauuaggaccaugua

SEQ ID NO: 467892 - RNA, 22 nt, Human
aaggcacauauuuuagagucac

SEQ ID NO: 467893 - RNA, 22 nt, Human
gaggugggaugugugugcuacu

SEQ ID NO: 467894 - RNA, 22 nt, Human
uuucugugauaggcugcgacgc

SEQ ID NO: 467895 - RNA, 15 nt, Human
uggugguguugagac

SEQ ID NO: 467896 - RNA, 22 nt, Human
gcggggccauguccaacggccu

SEQ ID NO: 467897 - RNA, 22 nt, Human
aggcagccuauggggagcucag

SEQ ID NO: 467898 - RNA, 22 nt, Human
aagcucucuguccccuggacug

SEQ ID NO: 467899 - RNA, 22 nt, Human
ccauggccaggaaagccaaggu

SEQ ID NO: 467900 - RNA, 22 nt, Human
gcaaaacagucgaugccuccca

SEQ ID NO: 467901 - RNA, 22 nt, Human
gcugucucauacaaggcccugc

SEQ ID NO: 467902 - RNA, 22 nt, Human
cagaguccugcaccagcuccag

SEQ ID NO: 467903 - RNA, 22 nt, Human
uccugaccacuaggaccaggcu

SEQ ID NO: 467904 - RNA, 22 nt, Human
agcuccugaaaauccagacugg

SEQ ID NO: 467905 - RNA, 21 nt, Human
uggcaggcagcuggaagcuug

SEQ ID NO: 467906 - RNA, 22 nt, Human
ccugggacgacucuguacccuu

SEQ ID NO: 467907 - RNA, 22 nt, Human
ucccagccugacagugcaucaa

SEQ ID NO: 467908 - RNA, 22 nt, Human
uccgguccggguacuccucucu

SEQ ID NO: 467909 - RNA, 22 nt, Human
agcuuuauuugucauucacggc

SEQ ID NO: 467910 - RNA, 22 nt, Human
ggggucccugcaccagcauguc

SEQ ID NO: 467911 - RNA, 19 nt, Human
ggguccauggugucaagga

SEQ ID NO: 467912 - RNA, 15 nt, Human
agcucuuucagcuac

SEQ ID NO: 467913 - RNA, 22 nt, Human
ggcaaucauuggcauucucugg

SEQ ID NO: 467914 - RNA, 18 nt, Human
cccacggugcuguagggc

SEQ ID NO: 467915 - RNA, 22 nt, Human
cuccguggcuguggacgcagcc

SEQ ID NO: 467916 - RNA, 22 nt, Human
caaucaaugcugcuaguuccuu

SEQ ID NO: 467917 - RNA, 22 nt, Human
agaggagguccuuuucugaugu

SEQ ID NO: 467918 - RNA, 22 nt, Human
gccagcagcgagaguuuaaccu

SEQ ID NO: 467919 - RNA, 21 nt, Human
uccaggagcacgggacuagga

SEQ ID NO: 467920 - RNA, 22 nt, Human
aaggugccacuucccucagacu

SEQ ID NO: 467921 - RNA, 22 nt, Human
agagggcgcccaggcccacgcc

SEQ ID NO: 467922 - RNA, 22 nt, Human
ccuaugaaagacaggagaugcg

SEQ ID NO: 467923 - RNA, 22 nt, Human
ugccuggcugggcugcucaugg

SEQ ID NO: 467924 - RNA, 22 nt, Human
uuggaaauguagaaaagcagau

SEQ ID NO: 467925 - RNA, 22 nt, Human
cgcgcugcagacagcggaggcc

SEQ ID NO: 467926 - RNA, 22 nt, Human
cugcacagccugucugggggcc

SEQ ID NO: 467927 - RNA, 22 nt, Human
agguggcuaugaggaugcaguc

SEQ ID NO: 467928 - RNA, 22 nt, Human
aaugcauacguguuuguggcaa

SEQ ID NO: 467929 - RNA, 22 nt, Human
gcagcugccgugagcucacgcc

SEQ ID NO: 467930 - RNA, 22 nt, Human
ggggcccagcaccccuccucgc

SEQ ID NO: 467931 - RNA, 22 nt, Human
cagccggaccugagggauuccu

SEQ ID NO: 467932 - RNA, 22 nt, Human
aagggccagggcucuagagaua

SEQ ID NO: 467933 - RNA, 23 nt, Human
uugggcaaaucacuaacgucucc

SEQ ID NO: 467934 - RNA, 22 nt, Human
uggggugccgacagggagggca

SEQ ID NO: 467935 - RNA, 22 nt, Human
ggugggugagcccugggagcug

SEQ ID NO: 467936 - RNA, 22 nt, Human
ugaggagcaggguggcuuacuc

SEQ ID NO: 467937 - RNA, 22 nt, Human
cuucuccgacaaccgacgccgg

SEQ ID NO: 467938 - RNA, 22 nt, Human
gggcugacaccacccaggcgca

SEQ ID NO: 467939 - RNA, 22 nt, Human
gcagagcugguacuugagccug

SEQ ID NO: 467940 - RNA, 22 nt, Human
ugucauggacuggauuucugcu

SEQ ID NO: 467941 - RNA, 22 nt, Human
uucuguucccuaggaccugggg

SEQ ID NO: 467942 - RNA, 22 nt, Human
gccacccuggacgcacuguucg

SEQ ID NO: 467943 - RNA, 18 nt, Human
uggggggcuugucugaag

SEQ ID NO: 467944 - RNA, 22 nt, Human
gcugccauggcugggggccgug

SEQ ID NO: 467945 - RNA, 22 nt, Human
ggcagagcuugcagugagccga

SEQ ID NO: 467946 - RNA, 23 nt, Human
cguuuuuuccucagauguucugg

SEQ ID NO: 467947 - RNA, 22 nt, Human
gggccccaagaaccuccuccug

SEQ ID NO: 467948 - RNA, 22 nt, Human
ucucacacuaaugcucuaucag

SEQ ID NO: 467949 - RNA, 22 nt, Human
ucuccaggcuuaaucucagcuu

SEQ ID NO: 467950 - RNA, 19 nt, Human
uccugcccaccagccaggg

SEQ ID NO: 467951 - RNA, 22 nt, Human
ugcgggucccagggucacaggc

SEQ ID NO: 467952 - RNA, 22 nt, Human
agcuccacucccugccuguuuc

SEQ ID NO: 467953 - RNA, 22 nt, Human
cuggcuccucaggacugcggga

SEQ ID NO: 467954 - RNA, 22 nt, Human
uggcccagaucucugaccuuga

SEQ ID NO: 467955 - RNA, 22 nt, Human
cuguuuauucucaucuaaaaug

SEQ ID NO: 467956 - RNA, 22 nt, Human
agcagugugggcugcacgcugg

SEQ ID NO: 467957 - RNA, 22 nt, Human
gggagacaaaggugagguucuu

SEQ ID NO: 467958 - RNA, 22 nt, Human
ucggagcuguagaugaaacccu

SEQ ID NO: 467959 - RNA, 22 nt, Human
ugggggagccuucacaguagcu

SEQ ID NO: 467960 - RNA, 22 nt, Human
cuugcuuuaucugguuucucau

SEQ ID NO: 467961 - RNA, 22 nt, Human
cccgaccucgcaaagcgcacuc

SEQ ID NO: 467962 - RNA, 22 nt, Human
gagguggcugcuugcugggaaa

SEQ ID NO: 467963 - RNA, 22 nt, Human
cuuuggucuccgucaucaauca

SEQ ID NO: 467964 - RNA, 22 nt, Human
cagagccacugucugccaggca

SEQ ID NO: 467965 - RNA, 22 nt, Human
ccucccugccggcuggacuagu

SEQ ID NO: 467966 - RNA, 22 nt, Human
ugaaucaaugaauugcacuuca

SEQ ID NO: 467967 - RNA, 22 nt, Human
aaugccuuggagagccuagagg

SEQ ID NO: 467968 - RNA, 22 nt, Human
gcaggggcugagcaccagcggg

SEQ ID NO: 467969 - RNA, 22 nt, Human
gccacguagaagugccgcgaga

SEQ ID NO: 467970 - RNA, 22 nt, Human
cagcugccuaugaccuagccuc

SEQ ID NO: 467971 - RNA, 22 nt, Human
ucuguuauaaaucacacugcau

SEQ ID NO: 467972 - RNA, 18 nt, Human
acagggagggcgcugggg

SEQ ID NO: 467973 - RNA, 22 nt, Human
cagggcuccccagagagccucu

SEQ ID NO: 467974 - RNA, 22 nt, Human
ugcugcccacuguauuucucca

SEQ ID NO: 467975 - RNA, 22 nt, Human
uggggugugcucagagcagggg

SEQ ID NO: 467976 - RNA, 22 nt, Human
ugggaccugcucuuggaaugag

SEQ ID NO: 467977 - RNA, 22 nt, Human
ucccacacagcccgcucaccgg

SEQ ID NO: 467978 - RNA, 22 nt, Human
ggagugacucucggggccacua

SEQ ID NO: 467979 - RNA, 22 nt, Human
auucccuuugacgaucccuagg

SEQ ID NO: 467980 - RNA, 22 nt, Human
cagcuccagcccaggcagcucc

SEQ ID NO: 467981 - RNA, 22 nt, Human
ccuuuguucacuggagagugga

SEQ ID NO: 467982 - RNA, 22 nt, Human
accuggaccugccaccuaugag

SEQ ID NO: 467983 - RNA, 22 nt, Human
cccaggucgucagcaguguggu

SEQ ID NO: 467984 - RNA, 22 nt, Human
acagugauuggcacugauucag

SEQ ID NO: 467985 - RNA, 22 nt, Human
ucaugucccguugcuggcugcc

SEQ ID NO: 467986 - RNA, 22 nt, Human
agcugcaccggcuggaccacug

SEQ ID NO: 467987 - RNA, 22 nt, Human
uaauuuugucacagugacaugc

SEQ ID NO: 467988 - RNA, 22 nt, Human
cugggaccugugugccugggcc

SEQ ID NO: 467989 - RNA, 22 nt, Human
uggcacaguuaaaguuguagaa

SEQ ID NO: 467990 - RNA, 22 nt, Human
ggcagcagaacuggcccuguau

SEQ ID NO: 467991 - RNA, 22 nt, Human
caggggcggguaaaaggccucc

SEQ ID NO: 467992 - RNA, 22 nt, Human
cgugcagcggagcuggucacug

SEQ ID NO: 467993 - RNA, 22 nt, Human
cuguggguggcugugccccagg

SEQ ID NO: 467994 - RNA, 22 nt, Human
cuggcuuucauggcgcaguuga

SEQ ID NO: 467995 - RNA, 22 nt, Human
gggggcgccgccgcucaucuca

SEQ ID NO: 467996 - RNA, 22 nt, Human
uauggcaagaugacauguucuc

SEQ ID NO: 467997 - RNA, 22 nt, Human
gugcugauugggagcugggauu

SEQ ID NO: 467998 - RNA, 22 nt, Human
cccucucccugcagaauguggc

SEQ ID NO: 467999 - RNA, 20 nt, Human
ggccggggagcucuccaggg

SEQ ID NO: 468000 - RNA, 22 nt, Human
ucgucugugaaauugggauaag

SEQ ID NO: 468001 - RNA, 21 nt, Human
ugcuccaggagggggcagucc

SEQ ID NO: 468002 - RNA, 22 nt, Human
ggggcuuccagcgcccgccggu

SEQ ID NO: 468003 - RNA, 22 nt, Human
agcagcaggagccgugggguga

SEQ ID NO: 468004 - RNA, 22 nt, Human
ugggagagauaggcuucuggac

SEQ ID NO: 468005 - RNA, 22 nt, Human
agccacugugugaccagcuguc

SEQ ID NO: 468006 - RNA, 22 nt, Human
acagaagugacaauuucuuggg

SEQ ID NO: 468007 - RNA, 22 nt, Human
cugggcuccuaaccauccaggu

SEQ ID NO: 468008 - RNA, 22 nt, Human
guugcauuaaucugcucaggcu

SEQ ID NO: 468009 - RNA, 21 nt, Human
cccuugccugcacuccucggc

SEQ ID NO: 468010 - RNA, 22 nt, Human
guauuucuuuacauaugcucau

SEQ ID NO: 468011 - RNA, 22 nt, Human
cgccguccccuaggaaagagcu

SEQ ID NO: 468012 - RNA, 22 nt, Human
uccaggagcucauccacgucaa

SEQ ID NO: 468013 - RNA, 22 nt, Human
agccagggacgcugcaggcuac

SEQ ID NO: 468014 - RNA, 22 nt, Human
ugucugccugcgggccggcaca

SEQ ID NO: 468015 - RNA, 22 nt, Human
uucccuuucuuaaagaguuagg

SEQ ID NO: 468016 - RNA, 21 nt, Human
gcccacagugaggaggauccc

SEQ ID NO: 468017 - RNA, 22 nt, Human
aggcaguguguagcuggaagag

SEQ ID NO: 468018 - RNA, 22 nt, Human
cccaggaggcagaaguugcagu

SEQ ID NO: 468019 - RNA, 22 nt, Human
gcuuucuuuucaagaauguauu

SEQ ID NO: 468020 - RNA, 22 nt, Human
gcuggguggaucggaggcucug

SEQ ID NO: 468021 - RNA, 22 nt, Human
ccagcaggagacuagcaacaua

SEQ ID NO: 468022 - RNA, 22 nt, Human
gcagauggauguggacggcgcc

SEQ ID NO: 468023 - RNA, 20 nt, Human
uccuccuugcagagcccaga

SEQ ID NO: 468024 - RNA, 22 nt, Human
uuuaauuuucugggcccagcag

SEQ ID NO: 468025 - RNA, 22 nt, Human
ccggcucggcgaccaggcugaa

SEQ ID NO: 468026 - RNA, 21 nt, Human
agggccucuguguacuggggg

SEQ ID NO: 468027 - RNA, 22 nt, Human
uggaaauaguugugagucaggc

SEQ ID NO: 468028 - RNA, 22 nt, Human
cugguggaauggcagagggaac

SEQ ID NO: 468029 - RNA, 20 nt, Human
ucccuggggcccuacuuccu

SEQ ID NO: 468030 - RNA, 22 nt, Human
cuggcacaggauccgagaccuu

SEQ ID NO: 468031 - RNA, 20 nt, Human
ggggcccaagcccucuugcc

SEQ ID NO: 468032 - RNA, 22 nt, Human
uucaauagaaagucccuaguua

SEQ ID NO: 468033 - RNA, 22 nt, Human
gccccacuguggaaccuaaguc

SEQ ID NO: 468034 - RNA, 22 nt, Human
ggugugggucagcuuuauuaau

SEQ ID NO: 468035 - RNA, 22 nt, Human
uauucacagcugccgcacucag

SEQ ID NO: 468036 - RNA, 22 nt, Human
guccaggccugccucugaggag

SEQ ID NO: 468037 - RNA, 18 nt, Human
uggcagccagcugcuccu

SEQ ID NO: 468038 - RNA, 23 nt, Human
auaauaacgucugucuugucucu

SEQ ID NO: 468039 - RNA, 19 nt, Human
uccuggggaggggcauggc

SEQ ID NO: 468040 - RNA, 22 nt, Human
gaggcaaagcauguggcucagg

SEQ ID NO: 468041 - RNA, 22 nt, Human
gugccuccaggcucgacuaguc

SEQ ID NO: 468042 - RNA, 22 nt, Human
gcguuggggaccccgaagcugg

SEQ ID NO: 468043 - RNA, 22 nt, Human
gucugcccuuggccugggacuu

SEQ ID NO: 468044 - RNA, 22 nt, Human
agggccacgugcaccgcggucu

SEQ ID NO: 468045 - RNA, 22 nt, Human
uggcccagcucagggugggcgg

SEQ ID NO: 468046 - RNA, 22 nt, Human
gggagcugaaggagccggcggg

SEQ ID NO: 468047 - RNA, 22 nt, Human
cccacugcugcucuccauggca

SEQ ID NO: 468048 - RNA, 22 nt, Human
ugugguuuugguucagaaacaa

SEQ ID NO: 468049 - RNA, 22 nt, Human
cccaggacucugacacccccaa

SEQ ID NO: 468050 - RNA, 22 nt, Human
cccaggaguaagugacauuguu

SEQ ID NO: 468051 - RNA, 22 nt, Human
augaacugcaguauaaacuugg

SEQ ID NO: 468052 - RNA, 22 nt, Human
ucccagaacccugccagguccu

SEQ ID NO: 468053 - RNA, 22 nt, Human
gggagaguagcuggaagguucu

SEQ ID NO: 468054 - RNA, 22 nt, Human
uuccuggcagaggccccgacag

SEQ ID NO: 468055 - RNA, 17 nt, Human
gcaggcacugcugccug

SEQ ID NO: 468056 - RNA, 22 nt, Human
aggcuguccucucuugcucagu

SEQ ID NO: 468057 - RNA, 22 nt, Human
ggcucacgcaauuaucccggcc

SEQ ID NO: 468058 - RNA, 22 nt, Human
agccccaguccgcugcgggcgg

SEQ ID NO: 468059 - RNA, 22 nt, Human
aauacagauggcaugugaagau

SEQ ID NO: 468060 - RNA, 22 nt, Human
aggcggcuccgggagugugggc

SEQ ID NO: 468061 - RNA, 22 nt, Human
cggagaggugggggcagcaucu

SEQ ID NO: 468062 - RNA, 22 nt, Human
gccagaggggcucgaaggcgcg

SEQ ID NO: 468063 - RNA, 22 nt, Human
gcugcugcuugaaggcucggag

SEQ ID NO: 468064 - RNA, 22 nt, Human
cgggcagugcccagcggggcag

SEQ ID NO: 468065 - RNA, 21 nt, Human
ucagagggcccuggaggcuca

SEQ ID NO: 468066 - RNA, 22 nt, Human
uccacagggaugccugcggcuu

SEQ ID NO: 468067 - RNA, 22 nt, Human
gccggacugcugcagcugcuag

SEQ ID NO: 468068 - RNA, 22 nt, Human
cugggugagcuggccagagggu

SEQ ID NO: 468069 - RNA, 22 nt, Human
uuccuuggagucaaacagggag

SEQ ID NO: 468070 - RNA, 22 nt, Human
uggcccaggugcacccagaggc

SEQ ID NO: 468071 - RNA, 22 nt, Human
gagggccaaugugucccugagc

SEQ ID NO: 468072 - RNA, 22 nt, Human
ccucccagaugugcccaaugga

SEQ ID NO: 468073 - RNA, 22 nt, Human
agaguggcaccuuaccugagac

SEQ ID NO: 468074 - RNA, 22 nt, Human
ccucuggccuaggccgggagag

SEQ ID NO: 468075 - RNA, 22 nt, Human
ugcuggccucggcgcugggccu

SEQ ID NO: 468076 - RNA, 22 nt, Human
cucccagggucuaggcugcugg

SEQ ID NO: 468077 - RNA, 22 nt, Human
gaggagagaagcuaacggugcu

SEQ ID NO: 468078 - RNA, 22 nt, Human
ugcagggcagcuagggagcuuu

SEQ ID NO: 468079 - RNA, 22 nt, Human
ucuggcccaucuucugccacca

SEQ ID NO: 468080 - RNA, 22 nt, Human
agccaggucaggaaagguccca

SEQ ID NO: 468081 - RNA, 22 nt, Human
gguggcugugagcauuauguga

SEQ ID NO: 468082 - RNA, 22 nt, Human
uacugucuuuuccuaaaugggu

SEQ ID NO: 468083 - RNA, 22 nt, Human
cgaggaggaaacgcggagaacu

SEQ ID NO: 468084 - RNA, 22 nt, Human
aggugcugccccgagaaggaug

SEQ ID NO: 468085 - RNA, 22 nt, Human
uuuguguuguacuucugugcau

SEQ ID NO: 468086 - RNA, 22 nt, Human
cccccagcucugcugggucccg

SEQ ID NO: 468087 - RNA, 22 nt, Human
ucccugccuccuggcagugcca

SEQ ID NO: 468088 - RNA, 22 nt, Human
agcggcgccgagcuuggccagg

SEQ ID NO: 468089 - RNA, 22 nt, Human
uaacaaaguauuguuuguguau

SEQ ID NO: 468090 - RNA, 22 nt, Human
gccagagaggccuuagaaucca

SEQ ID NO: 468091 - RNA, 22 nt, Human
cacagaggaugcccaagcgauc

SEQ ID NO: 468092 - RNA, 18 nt, Human
ggguccccagcugcaggg

SEQ ID NO: 468093 - RNA, 22 nt, Human
gcggcgccugggacccgccagc

SEQ ID NO: 468094 - RNA, 22 nt, Human
augggucccuggccgcccucgg

SEQ ID NO: 468095 - RNA, 22 nt, Human
ggagacucaccccgcauucuag

SEQ ID NO: 468096 - RNA, 22 nt, Human
ugcccacaggaagacaccagcg

SEQ ID NO: 468097 - RNA, 22 nt, Human
guagaggggugauucugugaga

SEQ ID NO: 468098 - RNA, 22 nt, Human
ggguggaaaguauuuggggacc

SEQ ID NO: 468099 - RNA, 22 nt, Human
ccugggcaaaugccagagacaa

SEQ ID NO: 468100 - RNA, 22 nt, Human
gccggggcuggggagagacaug

SEQ ID NO: 468101 - RNA, 22 nt, Human
cgcaggugccggcagauggggu

SEQ ID NO: 468102 - RNA, 22 nt, Human
cugggucccggcuucuauccac

SEQ ID NO: 468103 - RNA, 22 nt, Human
ccugggaaggugaggcccugga

SEQ ID NO: 468104 - RNA, 22 nt, Human
cagggccucugugggcucucuc

SEQ ID NO: 468105 - RNA, 22 nt, Human
cagcccuguugcgcuuccggcg

SEQ ID NO: 468106 - RNA, 22 nt, Human
agcugccgaugcccagcugcau

SEQ ID NO: 468107 - RNA, 22 nt, Human
gaacugggaaugcugucccauc

SEQ ID NO: 468108 - RNA, 22 nt, Human
agagcagaggcauggccguggg

SEQ ID NO: 468109 - RNA, 23 nt, Human
gacagagugagaccuugucuuac

SEQ ID NO: 468110 - RNA, 22 nt, Human
gcucccuggaauguuggcugcc

SEQ ID NO: 468111 - RNA, 22 nt, Human
gcucuggcuacuguggcuaccg

SEQ ID NO: 468112 - RNA, 22 nt, Human
gcuucccacagcuggacugggg

SEQ ID NO: 468113 - RNA, 22 nt, Human
ccccagugguugcaacagcaga

SEQ ID NO: 468114 - RNA, 22 nt, Human
ucugggccggagccgacggcag

SEQ ID NO: 468115 - RNA, 22 nt, Human
gcucaugggcccagagcagccc

SEQ ID NO: 468116 - RNA, 22 nt, Human
gccuggcgccgggcugccuguc

SEQ ID NO: 468117 - RNA, 22 nt, Human
gucccuggucuaccguggcuuc

SEQ ID NO: 468118 - RNA, 22 nt, Human
cagugcagccaaggacaggcac

SEQ ID NO: 468119 - RNA, 22 nt, Human
agggccagcagcuuggccaacc

SEQ ID NO: 468120 - RNA, 21 nt, Human
uuggccgugcagaugaacagc

SEQ ID NO: 468121 - RNA, 22 nt, Human
agcccugugugcuuguguuccu

SEQ ID NO: 468122 - RNA, 22 nt, Human
auggguggccccgugugcaguc

SEQ ID NO: 468123 - RNA, 22 nt, Human
ggcaguggugggaggcucgcuc

SEQ ID NO: 468124 - RNA, 22 nt, Human
gagccaggcccguacuugcugu

SEQ ID NO: 468125 - RNA, 22 nt, Human
aggccuuccucggagacaggga

SEQ ID NO: 468126 - RNA, 22 nt, Human
aaagcuauuuuauugcagcucu

SEQ ID NO: 468127 - RNA, 22 nt, Human
cggcagagcccugagucagccu

SEQ ID NO: 468128 - RNA, 22 nt, Human
ccuggccugugaaucugagagc

SEQ ID NO: 468129 - RNA, 22 nt, Human
aucccuggccacgaagcugccc

SEQ ID NO: 468130 - RNA, 22 nt, Human
agccccaggcccggacgccucu

SEQ ID NO: 468131 - RNA, 22 nt, Human
agcagcaccuguccucgcugcu

SEQ ID NO: 468132 - RNA, 22 nt, Human
ugggugugagcccgggagccgc

SEQ ID NO: 468133 - RNA, 22 nt, Human
aacugguucuggaggcugcagg

SEQ ID NO: 468134 - RNA, 22 nt, Human
gcccuguuuucuggguuccuug

SEQ ID NO: 468135 - RNA, 22 nt, Human
aggagccgggccugggcccugc

SEQ ID NO: 468136 - RNA, 22 nt, Human
gggcagagguucaacuucaaca

SEQ ID NO: 468137 - RNA, 22 nt, Human
uucuguuuauaauuugcaguug

SEQ ID NO: 468138 - RNA, 22 nt, Human
ugaaacagucuccagacuugga

SEQ ID NO: 468139 - RNA, 22 nt, Human
ccccaacccugguuccguggcg

SEQ ID NO: 468140 - RNA, 22 nt, Human
gugcgggccuggggguuucucu

SEQ ID NO: 468141 - RNA, 22 nt, Human
ugccgcgcgcccagguuaggug

SEQ ID NO: 468142 - RNA, 23 nt, Human
gggaaaucaaaagauauuucuuc

SEQ ID NO: 468143 - RNA, 22 nt, Human
auccaggcgaaugcagaaggcc

SEQ ID NO: 468144 - RNA, 22 nt, Human
aaccccgcucaggcugggugag

SEQ ID NO: 468145 - RNA, 22 nt, Human
uuccuuuucuucuaccacaugu

SEQ ID NO: 468146 - RNA, 22 nt, Human
aggcaguguggagggcuguugc

SEQ ID NO: 468147 - RNA, 22 nt, Human
agggcucacuacaacccuggga

SEQ ID NO: 468148 - RNA, 22 nt, Human
ccugucucugcagggcccugcc

SEQ ID NO: 468149 - RNA, 22 nt, Human
uuuguguuggaagaaaugcuac

SEQ ID NO: 468150 - RNA, 22 nt, Human
aaaguaauugugguucuugcca

SEQ ID NO: 468151 - RNA, 22 nt, Human
uccugccaccggggguggcgau

SEQ ID NO: 468152 - RNA, 22 nt, Human
cagggcucgcucuugcccuucg

SEQ ID NO: 468153 - RNA, 23 nt, Human
agacagaggcugaggcuggccgc

SEQ ID NO: 468154 - RNA, 22 nt, Human
ggggagaguauuuuauucaagu

SEQ ID NO: 468155 - RNA, 22 nt, Human
ugcgccugcgcaaagguuucug

SEQ ID NO: 468156 - RNA, 22 nt, Human
cgaggagugugaaggcuugucg

SEQ ID NO: 468157 - RNA, 17 nt, Human
gcguguccccgcgucuc

SEQ ID NO: 468158 - RNA, 22 nt, Human
ucggagcgucacuggcuggagg

SEQ ID NO: 468159 - RNA, 22 nt, Human
ucccgggcaggucgagcgagcc

SEQ ID NO: 468160 - RNA, 22 nt, Human
ccagagacaaggagcuggaguc

SEQ ID NO: 468161 - RNA, 22 nt, Human
gaggagaggcuggacgcgguga

SEQ ID NO: 468162 - RNA, 22 nt, Human
gggcuggagagucccacguggg

SEQ ID NO: 468163 - RNA, 22 nt, Human
ucguggaugcgcagggcggccu

SEQ ID NO: 468164 - RNA, 22 nt, Human
gaaaggagaggguuaaggagcu

SEQ ID NO: 468165 - RNA, 19 nt, Human
ggggcccggggucugcgag

SEQ ID NO: 468166 - RNA, 22 nt, Human
ggugacgaauccauagcaucga

SEQ ID NO: 468167 - RNA, 22 nt, Human
uccgcgcucucacccgcucccg

SEQ ID NO: 468168 - RNA, 22 nt, Human
uggguaaacugggucuggagag

SEQ ID NO: 468169 - RNA, 21 nt, Human
agggaaaaggcugagugaggg

SEQ ID NO: 468170 - RNA, 22 nt, Human
ccgcuguccuggagcugcugcu

SEQ ID NO: 468171 - RNA, 22 nt, Human
cggcgcaggcagaccgcgggcu

SEQ ID NO: 468172 - RNA, 22 nt, Human
cugaugcucuggauguagucaa

SEQ ID NO: 468173 - RNA, 22 nt, Human
ugcuuuauucgacaucugguag

SEQ ID NO: 468174 - RNA, 22 nt, Human
cgucaggguugagcagguagau

SEQ ID NO: 468175 - RNA, 22 nt, Human
guggcccaggcuuggcgcuggc

SEQ ID NO: 468176 - RNA, 22 nt, Human
acagggagucugaggggauagu

SEQ ID NO: 468177 - RNA, 22 nt, Human
gucugcccugcagacaugccuc

SEQ ID NO: 468178 - RNA, 22 nt, Human
cucuguccugguuuauacuggc

SEQ ID NO: 468179 - RNA, 22 nt, Human
cccgggaggaggaaguugcagu

SEQ ID NO: 468180 - RNA, 22 nt, Human
uacagcagcccaccuucuucug

SEQ ID NO: 468181 - RNA, 22 nt, Human
gcgacgcaggcacgacguguug

SEQ ID NO: 468182 - RNA, 22 nt, Human
gcccagccccuggguggacgug

SEQ ID NO: 468183 - RNA, 22 nt, Human
ggggugaagguuuucugaaagc

SEQ ID NO: 468184 - RNA, 22 nt, Human
gccccagcguggcuguguuagg

SEQ ID NO: 468185 - RNA, 22 nt, Human
ccauggccugaaggagugcauc

SEQ ID NO: 468186 - RNA, 22 nt, Human
gcugcuggcuuccugcuguuuu

SEQ ID NO: 468187 - RNA, 22 nt, Human
gccuggcucugaguuucucucc

SEQ ID NO: 468188 - RNA, 22 nt, Human
gccgugcgugcgcaggugcugu

SEQ ID NO: 468189 - RNA, 22 nt, Human
ggucuggccuccgggcaggugg

SEQ ID NO: 468190 - RNA, 22 nt, Human
gucuuuuuuacaccuuacauca

SEQ ID NO: 468191 - RNA, 23 nt, Human
uugcauuaauguggaggcacagg

SEQ ID NO: 468192 - RNA, 22 nt, Human
ccagagagggcgccaccuggag

SEQ ID NO: 468193 - RNA, 22 nt, Human
uugucgggcuuacgcagggcca

SEQ ID NO: 468194 - RNA, 22 nt, Human
gcugccaauccagcugugggag

SEQ ID NO: 468195 - RNA, 22 nt, Human
uucugggcacacaggcccuggu

SEQ ID NO: 468196 - RNA, 22 nt, Human
ggagacagugacuuagagacug

SEQ ID NO: 468197 - RNA, 22 nt, Human
gcggcuccgaagccaggccgcg

SEQ ID NO: 468198 - RNA, 22 nt, Human
gccuggggaacuugauccuguc

SEQ ID NO: 468199 - RNA, 22 nt, Human
gugcuaaugaauuggagugccu

SEQ ID NO: 468200 - RNA, 22 nt, Human
cuggccgcaguguggaguugug

SEQ ID NO: 468201 - RNA, 22 nt, Human
gaccugguccuuguacuuugaa

SEQ ID NO: 468202 - RNA, 22 nt, Human
ccagcagcgauagggugagugc

SEQ ID NO: 468203 - RNA, 22 nt, Human
ccucagucuauuuccagcaggu

SEQ ID NO: 468204 - RNA, 22 nt, Human
uuuauucucuaguuggucagau

SEQ ID NO: 468205 - RNA, 22 nt, Human
agcaguuuauccucauaaugga

SEQ ID NO: 468206 - RNA, 20 nt, Human
ucuuuuauuggcagauccug

SEQ ID NO: 468207 - RNA, 22 nt, Human
gguccccguggaggcuggagcg

SEQ ID NO: 468208 - RNA, 22 nt, Human
acaggcgcacaugagggccgug

SEQ ID NO: 468209 - RNA, 18 nt, Human
gguccugggccuggcuca

SEQ ID NO: 468210 - RNA, 20 nt, Human
ucucccugcccaucucagau

SEQ ID NO: 468211 - RNA, 22 nt, Human
ugguccugagcaccagccugac

SEQ ID NO: 468212 - RNA, 22 nt, Human
guguuuggucagacguccgggg

SEQ ID NO: 468213 - RNA, 22 nt, Human
gggcucggcaucuguggacucu

SEQ ID NO: 468214 - RNA, 15 nt, Human
gccccaggaaucaaa

SEQ ID NO: 468215 - RNA, 22 nt, Human
gccagcuggcugcaggucccag

SEQ ID NO: 468216 - RNA, 22 nt, Human
ucggugcgcgaggcgcgguccc

SEQ ID NO: 468217 - RNA, 22 nt, Human
aguccggggucuggacaccugg

SEQ ID NO: 468218 - RNA, 23 nt, Human
gguucugccgcuuacugcugugc

SEQ ID NO: 468219 - RNA, 21 nt, Human
cuguccccagugagcaccccc

SEQ ID NO: 468220 - RNA, 23 nt, Human
uccugcagauaagcugguugaca

SEQ ID NO: 468221 - RNA, 22 nt, Human
ucccugggguaucgcugaggca

SEQ ID NO: 468222 - RNA, 19 nt, Human
cccagaggaaugccuggaa

SEQ ID NO: 468223 - RNA, 22 nt, Human
gcacagagagcagugggggaca

SEQ ID NO: 468224 - RNA, 22 nt, Human
gucccugauaagagccaucgau

SEQ ID NO: 468225 - RNA, 19 nt, Human
ccuggcccugcugcgcggg

SEQ ID NO: 468226 - RNA, 22 nt, Human
uccagcaguccaugugagacac

SEQ ID NO: 468227 - RNA, 22 nt, Human
caggacccaucagccaggcacu

SEQ ID NO: 468228 - RNA, 21 nt, Human
aacaggucccccacgggcuuu

SEQ ID NO: 468229 - RNA, 22 nt, Human
gcugugcagaggugagaaucca

SEQ ID NO: 468230 - RNA, 22 nt, Human
aaagcacauuacaagcucaguc

SEQ ID NO: 468231 - RNA, 22 nt, Human
cagacugaaaaucccugguagu

SEQ ID NO: 468232 - RNA, 22 nt, Human
gccugccuucggugcgcagcgg

SEQ ID NO: 468233 - RNA, 22 nt, Human
gccuggcuucccuuggagcauu

SEQ ID NO: 468234 - RNA, 18 nt, Human
ugugccucugcaggacgu

SEQ ID NO: 468235 - RNA, 22 nt, Human
uggcaaggccacaggugcaguu

SEQ ID NO: 468236 - RNA, 22 nt, Human
uccuggguccauggcagccgaa

SEQ ID NO: 468237 - RNA, 22 nt, Human
cugggcuguuuguucuggucuc

SEQ ID NO: 468238 - RNA, 22 nt, Human
ggaccugcucucccaguucucu

SEQ ID NO: 468239 - RNA, 22 nt, Human
gccugagauucccggagccgug

SEQ ID NO: 468240 - RNA, 22 nt, Human
ugggaagaguuagagacagcug

SEQ ID NO: 468241 - RNA, 22 nt, Human
gagacagagagguacucaacau

SEQ ID NO: 468242 - RNA, 18 nt, Human
ggaaggugcuggagugca

SEQ ID NO: 468243 - RNA, 20 nt, Human
ugggguccuggaggggaucc

SEQ ID NO: 468244 - RNA, 20 nt, Human
gggugugggcccggccaggc

SEQ ID NO: 468245 - RNA, 22 nt, Human
gacggggcagccagcugguggc

SEQ ID NO: 468246 - RNA, 22 nt, Human
gcggagaggcagagacuccgcg

SEQ ID NO: 468247 - RNA, 22 nt, Human
gggaccuggacaugugugugcu

SEQ ID NO: 468248 - RNA, 19 nt, Human
agcagccaucgaccaugga

SEQ ID NO: 468249 - RNA, 22 nt, Human
cugggccacaagccugugugau

SEQ ID NO: 468250 - RNA, 22 nt, Human
ugguggggccagacuucagcuc

SEQ ID NO: 468251 - RNA, 22 nt, Human
gcaccagccugagccucuugca

SEQ ID NO: 468252 - RNA, 22 nt, Human
guggccaaggcagagaaagagc

SEQ ID NO: 468253 - RNA, 23 nt, Human
ggaagcucacguaguccugcacu

SEQ ID NO: 468254 - RNA, 22 nt, Human
cagggcucgcucgcucgcucgc

SEQ ID NO: 468255 - RNA, 22 nt, Human
ccugggcugcucauggggauga

SEQ ID NO: 468256 - RNA, 22 nt, Human
uggcggugacggcggcgccugg

SEQ ID NO: 468257 - RNA, 20 nt, Human
aggggcaccugcgacggggc

SEQ ID NO: 468258 - RNA, 22 nt, Human
ugucggccacgagggagccgcg

SEQ ID NO: 468259 - RNA, 22 nt, Human
gagauuuccauauuuuguaaca

SEQ ID NO: 468260 - RNA, 22 nt, Human
ccuggccgacauggugaaacgc

SEQ ID NO: 468261 - RNA, 22 nt, Human
ggaaggggagcuaaaucuacug

SEQ ID NO: 468262 - RNA, 22 nt, Human
uucuuuuaauuucugucugcag

SEQ ID NO: 468263 - RNA, 22 nt, Human
cagcgguggcaaggugacugug

SEQ ID NO: 468264 - RNA, 22 nt, Human
ugggcaaggcuggagccugcag

SEQ ID NO: 468265 - RNA, 22 nt, Human
cuggaaggagcccgggcggauc

SEQ ID NO: 468266 - RNA, 22 nt, Human
gaaggagaggauugugaggcug

SEQ ID NO: 468267 - RNA, 22 nt, Human
cuucagagugacucagcaucuu

SEQ ID NO: 468268 - RNA, 22 nt, Human
gcggggggcaggcaguacguug

SEQ ID NO: 468269 - RNA, 22 nt, Human
ggccagccuggggcucccagac

SEQ ID NO: 468270 - RNA, 22 nt, Human
ggagguggagcuggaaguucca

SEQ ID NO: 468271 - RNA, 22 nt, Human
ccuggggagaagagcuuccccc

SEQ ID NO: 468272 - RNA, 18 nt, Human
ggcggguguuuuauucac

SEQ ID NO: 468273 - RNA, 22 nt, Human
cccaggaacagcacagaacagc

SEQ ID NO: 468274 - RNA, 22 nt, Human
aggggagguggcagaaaugugc

SEQ ID NO: 468275 - RNA, 22 nt, Human
uccguuuucacacugcuauaaa

SEQ ID NO: 468276 - RNA, 22 nt, Human
accuuuaugaaacagcugucgu

SEQ ID NO: 468277 - RNA, 22 nt, Human
uccguggggccuguggcuuccg

SEQ ID NO: 468278 - RNA, 22 nt, Human
ucaggggcuugaggugcauguc

SEQ ID NO: 468279 - RNA, 20 nt, Human
uccugggguaagccaugguc

SEQ ID NO: 468280 - RNA, 22 nt, Human
ugcccuggcuccucccacgcug

SEQ ID NO: 468281 - RNA, 22 nt, Human
cuggccuggcaggggaccucua

SEQ ID NO: 468282 - RNA, 22 nt, Human
gagcagcaggccagguugcagg

SEQ ID NO: 468283 - RNA, 22 nt, Human
gcuuggccagcagccgggaugc

SEQ ID NO: 468284 - RNA, 22 nt, Human
cauuguguauuucuguaguacu

SEQ ID NO: 468285 - RNA, 22 nt, Human
cuggcagcugcccgagaugccc

SEQ ID NO: 468286 - RNA, 22 nt, Human
uguucuggugaggccauggggu

SEQ ID NO: 468287 - RNA, 22 nt, Human
uaugccuaccuccaaaauauau

SEQ ID NO: 468288 - RNA, 22 nt, Human
cugcacagucauuuccucucaa

SEQ ID NO: 468289 - RNA, 19 nt, Human
cucuggcuccugggcugcc

SEQ ID NO: 468290 - RNA, 22 nt, Human
uguguuuuggaaggaacaugca

SEQ ID NO: 468291 - RNA, 22 nt, Human
ccugguguuaucauaggucaug

SEQ ID NO: 468292 - RNA, 22 nt, Human
cagggagccccaauuccaugcc

SEQ ID NO: 468293 - RNA, 22 nt, Human
ggccauggcgggagccggcguc

SEQ ID NO: 468294 - RNA, 20 nt, Human
cagagcagugcccaggcggc

SEQ ID NO: 468295 - RNA, 22 nt, Human
gcccagcaccucucucaggguu

SEQ ID NO: 468296 - RNA, 22 nt, Human
ggggucacacuguggugacugg

SEQ ID NO: 468297 - RNA, 22 nt, Human
cagacagagucuucccaucagu

SEQ ID NO: 468298 - RNA, 22 nt, Human
ccaggcuccccaggaggcccuu

SEQ ID NO: 468299 - RNA, 22 nt, Human
ccgggagguggagauugcggug

SEQ ID NO: 468300 - RNA, 22 nt, Human
uccccaguaagccugcacugug

SEQ ID NO: 468301 - RNA, 22 nt, Human
agccagcuaccggggcuccugg

SEQ ID NO: 468302 - RNA, 22 nt, Human
agggcucagaaagcagguuuuc

SEQ ID NO: 468303 - RNA, 22 nt, Human
gccagcagcucuugggcgggca

SEQ ID NO: 468304 - RNA, 21 nt, Human
cagaggggcuagccuggcugc

SEQ ID NO: 468305 - RNA, 22 nt, Human
agcggcgccggagggaggugcg

SEQ ID NO: 468306 - RNA, 22 nt, Human
uccugucucaguguauuugcag

SEQ ID NO: 468307 - RNA, 22 nt, Human
guucuccaggggcuguucaucu

SEQ ID NO: 468308 - RNA, 22 nt, Human
guccuuucgagggugagugaaa

SEQ ID NO: 468309 - RNA, 22 nt, Human
cuggagcucuccagagccccgu

SEQ ID NO: 468310 - RNA, 22 nt, Human
cgcugcgaggcgcccuuguugc

SEQ ID NO: 468311 - RNA, 23 nt, Human
guccuagugcuuggugcccaggc

SEQ ID NO: 468312 - RNA, 22 nt, Human
ccacccagccagaugcaggaag

SEQ ID NO: 468313 - RNA, 22 nt, Human
cacucacccgguccuucccagu

SEQ ID NO: 468314 - RNA, 22 nt, Human
aaacacaucauucaugucguca

SEQ ID NO: 468315 - RNA, 22 nt, Human
uggaaauacaagaaguauguca

SEQ ID NO: 468316 - RNA, 22 nt, Human
cccaccacgugcuuugcuggag

SEQ ID NO: 468317 - RNA, 22 nt, Human
uuuaauuauaucugggcaguua

SEQ ID NO: 468318 - RNA, 22 nt, Human
aacagaaaucauuuagggcucu

SEQ ID NO: 468319 - RNA, 22 nt, Human
uggcuccacaggccagggugug

SEQ ID NO: 468320 - RNA, 22 nt, Human
acuucacagauauuuauuuggu

SEQ ID NO: 468321 - RNA, 20 nt, Human
cugcuccacccggcucucag

SEQ ID NO: 468322 - RNA, 22 nt, Human
ggugcggagacuccaugaggcc

SEQ ID NO: 468323 - RNA, 22 nt, Human
cggucaggugcagcguuggcac

SEQ ID NO: 468324 - RNA, 22 nt, Human
gugcaggacagcacaucuccug

SEQ ID NO: 468325 - RNA, 22 nt, Human
cuggcucgcauuauauuuuggg

SEQ ID NO: 468326 - RNA, 20 nt, Human
gaccagaucccuuaccagcu

SEQ ID NO: 468327 - RNA, 22 nt, Human
ugcacagagggaggcauaaaau

SEQ ID NO: 468328 - RNA, 18 nt, Human
agggagagaccgcggguc

SEQ ID NO: 468329 - RNA, 22 nt, Human
aagcaauucacaguucacuuaa

SEQ ID NO: 468330 - RNA, 22 nt, Human
cugguuuuuagugcuuaggagu

SEQ ID NO: 468331 - RNA, 22 nt, Human
gccuguuucuccuccuuggccc

SEQ ID NO: 468332 - RNA, 22 nt, Human
ggaaggggagcuggaaagggua

SEQ ID NO: 468333 - RNA, 19 nt, Human
acacaccagugccugugac

SEQ ID NO: 468334 - RNA, 21 nt, Human
acugggcuagccugacuucug

SEQ ID NO: 468335 - RNA, 20 nt, Human
ugagccugcuguaggaggcc

SEQ ID NO: 468336 - RNA, 22 nt, Human
uccaggagggggagccgugccg

SEQ ID NO: 468337 - RNA, 22 nt, Human
gagcuccugaaacguuccugcc

SEQ ID NO: 468338 - RNA, 22 nt, Human
accagaagcuggagcacaagga

SEQ ID NO: 468339 - RNA, 22 nt, Human
gaccacaguccagucaucaugg

SEQ ID NO: 468340 - RNA, 17 nt, Human
gugcuggccuggggcuc

SEQ ID NO: 468341 - RNA, 20 nt, Human
ugcuggaggcgccggcgcuc

SEQ ID NO: 468342 - RNA, 22 nt, Human
cccugcacagccuggcucucuu

SEQ ID NO: 468343 - RNA, 22 nt, Human
uuucuaguggguauucccuguu

SEQ ID NO: 468344 - RNA, 21 nt, Human
ggcagcucagcagauggggac

SEQ ID NO: 468345 - RNA, 22 nt, Human
ccagcagcucccucaggguccg

SEQ ID NO: 468346 - RNA, 22 nt, Human
cagcugcucugguggucucucc

SEQ ID NO: 468347 - RNA, 22 nt, Human
acagcagguuauuguuauggca

SEQ ID NO: 468348 - RNA, 22 nt, Human
uaggaaauaauucacucuggcu

SEQ ID NO: 468349 - RNA, 22 nt, Human
gcagacccugaacugggcaugg

SEQ ID NO: 468350 - RNA, 22 nt, Human
gcccagaguuugaagauacagu

SEQ ID NO: 468351 - RNA, 22 nt, Human
gcuguccugggaacaggcacua

SEQ ID NO: 468352 - RNA, 22 nt, Human
gggggcuggacuuucccacaca

SEQ ID NO: 468353 - RNA, 22 nt, Human
ugggugccaaccucugguggcc

SEQ ID NO: 468354 - RNA, 22 nt, Human
uuuucuaacaucuaguaauuug

SEQ ID NO: 468355 - RNA, 22 nt, Human
cgcccacgaaguagguggcauu

SEQ ID NO: 468356 - RNA, 22 nt, Human
gaaaacacuuugaucugaaagu

SEQ ID NO: 468357 - RNA, 22 nt, Human
ccaggaggaaagaccagcccau

SEQ ID NO: 468358 - RNA, 22 nt, Human
ggccucugccccgcggggcucg

SEQ ID NO: 468359 - RNA, 22 nt, Human
ggugggucuuguggggcagcuu

SEQ ID NO: 468360 - RNA, 22 nt, Human
aaagagcucggaaaguguugaa

SEQ ID NO: 468361 - RNA, 22 nt, Human
ccugugucaucagcuguggcua

SEQ ID NO: 468362 - RNA, 22 nt, Human
ccugguuuaaugcucacuguug

SEQ ID NO: 468363 - RNA, 22 nt, Human
uaucacauacuucucauccagg

SEQ ID NO: 468364 - RNA, 22 nt, Human
ggagaggguagggguccugccc

SEQ ID NO: 468365 - RNA, 22 nt, Human
uggccgggaagggacagugugg

SEQ ID NO: 468366 - RNA, 22 nt, Human
gaggggccuggcgaggacaugu

SEQ ID NO: 468367 - RNA, 22 nt, Human
uggcccugccgccacgacgucu

SEQ ID NO: 468368 - RNA, 22 nt, Human
aaggggggcaccugcaugcccg

SEQ ID NO: 468369 - RNA, 22 nt, Human
uguggguccuccugugugcccg

SEQ ID NO: 468370 - RNA, 22 nt, Human
aagucccaucugccuccaugua

SEQ ID NO: 468371 - RNA, 16 nt, Human
ccccucaggaaguaca

SEQ ID NO: 468372 - RNA, 22 nt, Human
ucccagucuagagccggauugg

SEQ ID NO: 468373 - RNA, 22 nt, Human
guggcgcagaggguggcagaga

SEQ ID NO: 468374 - RNA, 22 nt, Human
cagcuccagccaccggggggug

SEQ ID NO: 468375 - RNA, 22 nt, Human
gagcugcagcggcugacgcaac

SEQ ID NO: 468376 - RNA, 22 nt, Human
aguccgcgcuccaugggagucc

SEQ ID NO: 468377 - RNA, 22 nt, Human
aggcggguuuaggacaaugcuu

SEQ ID NO: 468378 - RNA, 22 nt, Human
aacccuggggcugcucugccug

SEQ ID NO: 468379 - RNA, 22 nt, Human
agcgcuggugaucucuauuuug

SEQ ID NO: 468380 - RNA, 22 nt, Human
gggccuuggcgaaguguggugg

SEQ ID NO: 468381 - RNA, 22 nt, Human
uggcuccguuguacaggcugga

SEQ ID NO: 468382 - RNA, 19 nt, Human
gggugaggaagagcguugc

SEQ ID NO: 468383 - RNA, 22 nt, Human
gcugucccgaaccccugguaau

SEQ ID NO: 468384 - RNA, 22 nt, Human
ugauuccugugcuuauuccagu

SEQ ID NO: 468385 - RNA, 22 nt, Human
gcgguauuugugugggugucga

SEQ ID NO: 468386 - RNA, 22 nt, Human
ccagacuggggcuccuugaggg

SEQ ID NO: 468387 - RNA, 22 nt, Human
uggccuuggcagugagaagagu

SEQ ID NO: 468388 - RNA, 22 nt, Human
acgccucugcagcugccgggcc

SEQ ID NO: 468389 - RNA, 21 nt, Human
cuuuucuagucccagccccgc

SEQ ID NO: 468390 - RNA, 23 nt, Human
uuaacaggaucucgggcaagagg

SEQ ID NO: 468391 - RNA, 22 nt, Human
ccuggccuccuggccuucucau

SEQ ID NO: 468392 - RNA, 22 nt, Human
ggggaagaaauagaacauuuug

SEQ ID NO: 468393 - RNA, 22 nt, Human
ggcggugguugagaggacggcg

SEQ ID NO: 468394 - RNA, 22 nt, Human
aagggugguguaggagaucaaa

SEQ ID NO: 468395 - RNA, 22 nt, Human
uccucuucaaaauagcucugaa

SEQ ID NO: 468396 - RNA, 22 nt, Human
aggaaaugccgcggcucucuuu

SEQ ID NO: 468397 - RNA, 22 nt, Human
gcgcugccucugcucuccccac

SEQ ID NO: 468398 - RNA, 22 nt, Human
ugccgcugucgccaccauggcu

SEQ ID NO: 468399 - RNA, 22 nt, Human
ugcuggaguggcacuguguggc

SEQ ID NO: 468400 - RNA, 22 nt, Human
cagaaacacuguauuuagggaa

SEQ ID NO: 468401 - RNA, 22 nt, Human
cagggagcuggugccagccgac

SEQ ID NO: 468402 - RNA, 19 nt, Human
ugccuggcaccagcuccac

SEQ ID NO: 468403 - RNA, 22 nt, Human
uccuggcccuguggccugcagu

SEQ ID NO: 468404 - RNA, 22 nt, Human
gucgaucaccucguccuccgug

SEQ ID NO: 468405 - RNA, 22 nt, Human
uuuggaaaugagaagccaccuu

SEQ ID NO: 468406 - RNA, 22 nt, Human
agcagcaggugaccucgaugcc

SEQ ID NO: 468407 - RNA, 22 nt, Human
caggccacacggcggcucccug

SEQ ID NO: 468408 - RNA, 22 nt, Human
auuggccagacuuauccuucag

SEQ ID NO: 468409 - RNA, 22 nt, Human
caggccagcagggccuccgugg

SEQ ID NO: 468410 - RNA, 22 nt, Human
gccuuuuaaggcagagggagau

SEQ ID NO: 468411 - RNA, 22 nt, Human
augaagcugguuuuggcuuggg

SEQ ID NO: 468412 - RNA, 22 nt, Human
gggagagcgcgcuagggccgag

SEQ ID NO: 468413 - RNA, 21 nt, Human
cccgugccuucagcaguccug

SEQ ID NO: 468414 - RNA, 22 nt, Human
ggccuuccauugcucuuuucua

SEQ ID NO: 468415 - RNA, 22 nt, Human
uuggaaaugcauuuguuauuau

SEQ ID NO: 468416 - RNA, 18 nt, Human
gaucgggggcgccccaag

SEQ ID NO: 468417 - RNA, 22 nt, Human
gcggggggcagcagucgcucag

SEQ ID NO: 468418 - RNA, 22 nt, Human
cgggagccucugggucacacug

SEQ ID NO: 468419 - RNA, 22 nt, Human
uuugggaaacuuaggggucaga

SEQ ID NO: 468420 - RNA, 22 nt, Human
gcugggucucucccugguccug

SEQ ID NO: 468421 - RNA, 22 nt, Human
gugccaccagaugcuguugcua

SEQ ID NO: 468422 - RNA, 22 nt, Human
ccugcgggcugugcugaagccu

SEQ ID NO: 468423 - RNA, 17 nt, Human
uccuggccuggugugug

SEQ ID NO: 468424 - RNA, 22 nt, Human
uugcauauccuccaacacaugg

SEQ ID NO: 468425 - RNA, 22 nt, Human
caggcgaccccuaggagcaaca

SEQ ID NO: 468426 - RNA, 22 nt, Human
gaggaggcuuccgggaggcacg

SEQ ID NO: 468427 - RNA, 22 nt, Human
cuggcuuuuuucccauuaugca

SEQ ID NO: 468428 - RNA, 22 nt, Human
gcagcugcgcugguguggggca

SEQ ID NO: 468429 - RNA, 22 nt, Human
gugcgccagcucaaggggaggc

SEQ ID NO: 468430 - RNA, 22 nt, Human
uggcuccaggggacacgcagua

SEQ ID NO: 468431 - RNA, 21 nt, Human
ucuccucccggggagaggccg

SEQ ID NO: 468432 - RNA, 22 nt, Human
uuggggaagcuuugaaauacuu

SEQ ID NO: 468433 - RNA, 22 nt, Human
uuccggacgcccgucuuccagc

SEQ ID NO: 468434 - RNA, 22 nt, Human
gcagaggggaagcugaggaauu

SEQ ID NO: 468435 - RNA, 20 nt, Human
guccugggagccacagcaca

SEQ ID NO: 468436 - RNA, 22 nt, Human
cguggggcggguggacacuugc

SEQ ID NO: 468437 - RNA, 22 nt, Human
augcuuuauuggagacagucau

SEQ ID NO: 468438 - RNA, 22 nt, Human
guguguggaaugcucauuuauu

SEQ ID NO: 468439 - RNA, 22 nt, Human
cagucccaguuugagacucugg

SEQ ID NO: 468440 - RNA, 23 nt, Human
gggcugcuccaggccaaggcugg

SEQ ID NO: 468441 - RNA, 22 nt, Human
gggcagcaggcuccacguuccu

SEQ ID NO: 468442 - RNA, 22 nt, Human
uccaggaguccuggguggcccc

SEQ ID NO: 468443 - RNA, 22 nt, Human
aagggaaacuuucacaaugucc

SEQ ID NO: 468444 - RNA, 23 nt, Human
aaggggauacuuccacuuucuuu

SEQ ID NO: 468445 - RNA, 22 nt, Human
cucggaauggaacaacagcggu

SEQ ID NO: 468446 - RNA, 22 nt, Human
cgcggucucuuuaaggcggguc

SEQ ID NO: 468447 - RNA, 22 nt, Human
ugugucuuuggcgaugucugga

SEQ ID NO: 468448 - RNA, 22 nt, Human
ccaggagagcucucguucagug

SEQ ID NO: 468449 - RNA, 22 nt, Human
ccuuuuauauggcucaucacag

SEQ ID NO: 468450 - RNA, 22 nt, Human
uccaggagugauaaggccacug

SEQ ID NO: 468451 - RNA, 22 nt, Human
ccacugugcccagccucauggg

SEQ ID NO: 468452 - RNA, 21 nt, Human
cccagaaguuccauggggggc

SEQ ID NO: 468453 - RNA, 22 nt, Human
cuccagauuccguuuauucagg

SEQ ID NO: 468454 - RNA, 22 nt, Human
gcccagcgagcagagguggacg

SEQ ID NO: 468455 - RNA, 22 nt, Human
ggaacuccugcuccaagcagcu

SEQ ID NO: 468456 - RNA, 22 nt, Human
augccccagugugugcuuccuu

SEQ ID NO: 468457 - RNA, 22 nt, Human
ucugguuucccaguuccuccgu

SEQ ID NO: 468458 - RNA, 22 nt, Human
accucccuaacccuuuuggcuc

SEQ ID NO: 468459 - RNA, 22 nt, Human
cuuccucuguggccagagugua

SEQ ID NO: 468460 - RNA, 22 nt, Human
aagggccacaugccauuuaaaa

SEQ ID NO: 468461 - RNA, 22 nt, Human
acgugcuggagaagagcucgcc

SEQ ID NO: 468462 - RNA, 22 nt, Human
aggggagccagggcugcgaguu

SEQ ID NO: 468463 - RNA, 15 nt, Human
cccaggaguucgaga

SEQ ID NO: 468464 - RNA, 22 nt, Human
cgccccagccaguugagcggcg

SEQ ID NO: 468465 - RNA, 22 nt, Human
uguuccucugaacuucuuccaa

SEQ ID NO: 468466 - RNA, 22 nt, Human
cuggcuuugaucagagugaccu

SEQ ID NO: 468467 - RNA, 22 nt, Human
aaccagacucuccaaaggcaaa

SEQ ID NO: 468468 - RNA, 19 nt, Human
aggaaggcggcggcugccc

SEQ ID NO: 468469 - RNA, 22 nt, Human
ucuccccaguauggauucucug

SEQ ID NO: 468470 - RNA, 22 nt, Human
uccuucccaggugucgccgccu

SEQ ID NO: 468471 - RNA, 22 nt, Human
uguuggcagugcuacagucagu

SEQ ID NO: 468472 - RNA, 21 nt, Human
uccugccuuaguccagagcag

SEQ ID NO: 468473 - RNA, 22 nt, Human
acugagggacucccaccuggca

SEQ ID NO: 468474 - RNA, 23 nt, Human
uggugggcccugcuugcucacug

SEQ ID NO: 468475 - RNA, 22 nt, Human
uuaugggcgaugcaaaccugau

SEQ ID NO: 468476 - RNA, 22 nt, Human
agggaagcagcagccgccuguc

SEQ ID NO: 468477 - RNA, 21 nt, Human
gcugcucgagauccagugcuu

SEQ ID NO: 468478 - RNA, 22 nt, Human
accccagaggcggaggcugcag

SEQ ID NO: 468479 - RNA, 22 nt, Human
aggcucccaagcacugacccca

SEQ ID NO: 468480 - RNA, 19 nt, Human
augggaagcggccagcgga

SEQ ID NO: 468481 - RNA, 22 nt, Human
ggagaggggaacuuguugcuug

SEQ ID NO: 468482 - RNA, 22 nt, Human
gugcagcugugguggagccagg

SEQ ID NO: 468483 - RNA, 17 nt, Human
ugcaugcgucugugaua

SEQ ID NO: 468484 - RNA, 22 nt, Human
accaggcccuccagcugcgugg

SEQ ID NO: 468485 - RNA, 22 nt, Human
cacagaggacuguagcggggag

SEQ ID NO: 468486 - RNA, 22 nt, Human
augugauacuccuucuagugga

SEQ ID NO: 468487 - RNA, 22 nt, Human
gggcccugcgacucgcggcgga

SEQ ID NO: 468488 - RNA, 22 nt, Human
agagcgagucuggggcucggau

SEQ ID NO: 468489 - RNA, 22 nt, Human
agggagcugcucugcuuccgug

SEQ ID NO: 468490 - RNA, 22 nt, Human
gagggaaacagauggguugugg

SEQ ID NO: 468491 - RNA, 22 nt, Human
gagcugggaagauagcuugagc

SEQ ID NO: 468492 - RNA, 22 nt, Human
caggguggcaggcaccauggcc

SEQ ID NO: 468493 - RNA, 19 nt, Human
augagcuggcauuucaggu

SEQ ID NO: 468494 - RNA, 20 nt, Human
acagagauccucucuuuauc

SEQ ID NO: 468495 - RNA, 22 nt, Human
ccggcgucucuuccacuuccua

SEQ ID NO: 468496 - RNA, 22 nt, Human
aggacagcagugcuggcacuug

SEQ ID NO: 468497 - RNA, 22 nt, Human
cagcagcaacaacggaagccuu

SEQ ID NO: 468498 - RNA, 22 nt, Human
uuccccuugcacuaucacccug

SEQ ID NO: 468499 - RNA, 22 nt, Human
ggaaggguuuaagcaggagagu

SEQ ID NO: 468500 - RNA, 22 nt, Human
ugcuggcugggcugcuggagac

SEQ ID NO: 468501 - RNA, 19 nt, Human
ugggcuuccccagggcaga

SEQ ID NO: 468502 - RNA, 22 nt, Human
ccaggcccugccugugguuccu

SEQ ID NO: 468503 - RNA, 22 nt, Human
aggagucauugagagggguccu

SEQ ID NO: 468504 - RNA, 22 nt, Human
gcacaaaagguacuucauguag

SEQ ID NO: 468505 - RNA, 22 nt, Human
cagaguggugcaagggcagugu

SEQ ID NO: 468506 - RNA, 22 nt, Human
uggcagaaugaagacuggggcc

SEQ ID NO: 468507 - RNA, 22 nt, Human
acgugcaggaucugguuggcga

SEQ ID NO: 468508 - RNA, 21 nt, Human
gcuccuggugcugcguggcgc

SEQ ID NO: 468509 - RNA, 22 nt, Human
gcuggccugcgagggcaggcug

SEQ ID NO: 468510 - RNA, 20 nt, Human
ccacccuguccggggcggag

SEQ ID NO: 468511 - RNA, 22 nt, Human
gccugagccgccugagcggcgg

SEQ ID NO: 468512 - RNA, 18 nt, Human
ucugagggugcgggagcu

SEQ ID NO: 468513 - RNA, 22 nt, Human
ggagggaguuucauuccugccc

SEQ ID NO: 468514 - RNA, 22 nt, Human
uguguuucugagaaucccaccu

SEQ ID NO: 468515 - RNA, 20 nt, Human
uggcccagcacgacgaggac

SEQ ID NO: 468516 - RNA, 22 nt, Human
guagcagagggcccagguaacu

SEQ ID NO: 468517 - RNA, 22 nt, Human
gccuggcuaagcagaaggaccc

SEQ ID NO: 468518 - RNA, 20 nt, Human
gggugugugcagggccuggu

SEQ ID NO: 468519 - RNA, 20 nt, Human
ccagagcugauggcugcccg

SEQ ID NO: 468520 - RNA, 22 nt, Human
agcucuuuuaucaugaggagag

SEQ ID NO: 468521 - RNA, 23 nt, Human
gcacagagcaguuaggggaagau

SEQ ID NO: 468522 - RNA, 22 nt, Human
cccguguggaugcgcuggugcu

SEQ ID NO: 468523 - RNA, 23 nt, Human
cuuuccuuucuuugacacccagc

SEQ ID NO: 468524 - RNA, 20 nt, Human
ccagguggugccuggagagg

SEQ ID NO: 468525 - RNA, 22 nt, Human
gcccagggcugcaaguggacgc

SEQ ID NO: 468526 - RNA, 22 nt, Human
cagcaguacuucucagagguau

SEQ ID NO: 468527 - RNA, 22 nt, Human
gcugggcaggccucgugagggc

SEQ ID NO: 468528 - RNA, 22 nt, Human
uggugcaggccaagcugcgagc

SEQ ID NO: 468529 - RNA, 22 nt, Human
acaccacaaguaacucuuuucc

SEQ ID NO: 468530 - RNA, 22 nt, Human
cggcagcgguuggagguuguag

SEQ ID NO: 468531 - RNA, 20 nt, Human
gcucagggccugggucugga

SEQ ID NO: 468532 - RNA, 22 nt, Human
ggggaggaagcuggaacacggg

SEQ ID NO: 468533 - RNA, 22 nt, Human
uuuuccuucugauacuccauuu

SEQ ID NO: 468534 - RNA, 22 nt, Human
ucucugucucccguguguccgg

SEQ ID NO: 468535 - RNA, 21 nt, Human
uggcccuggccacggcugcca

SEQ ID NO: 468536 - RNA, 22 nt, Human
gcucgguggccagccugaggcc

SEQ ID NO: 468537 - RNA, 22 nt, Human
gaugcgggcccgcuccacugcc

SEQ ID NO: 468538 - RNA, 22 nt, Human
gccaggaugacuauacaacagc

SEQ ID NO: 468539 - RNA, 22 nt, Human
cagaccagccauuugccucuuc

SEQ ID NO: 468540 - RNA, 22 nt, Human
uccagugguggcucccggaccu

SEQ ID NO: 468541 - RNA, 22 nt, Human
cugccguguuuuucauguuaaa

SEQ ID NO: 468542 - RNA, 22 nt, Human
ucguuagccucgagaucuuugu

SEQ ID NO: 468543 - RNA, 22 nt, Human
ugcacgugugagcauucacaug

SEQ ID NO: 468544 - RNA, 22 nt, Human
guuucgucaggcuuauucuauc

SEQ ID NO: 468545 - RNA, 22 nt, Human
ccacuguuggcccgaagggguc

SEQ ID NO: 468546 - RNA, 22 nt, Human
guacauauccuuuacguuuugu

SEQ ID NO: 468547 - RNA, 22 nt, Human
gccccucuccuugugcaccugc

SEQ ID NO: 468548 - RNA, 22 nt, Human
guucuucagauuccauuucagu

SEQ ID NO: 468549 - RNA, 22 nt, Human
cucgcggcgcccgaagcccuug

SEQ ID NO: 468550 - RNA, 22 nt, Human
gggcacagucugcagcccccca

SEQ ID NO: 468551 - RNA, 22 nt, Human
ccugaggaugccagcaugggug

SEQ ID NO: 468552 - RNA, 22 nt, Human
agaggcucuuugagcugggaga

SEQ ID NO: 468553 - RNA, 22 nt, Human
gaugugugugcccugggccugc

SEQ ID NO: 468554 - RNA, 22 nt, Human
ccaggcagccugcuccauucug

SEQ ID NO: 468555 - RNA, 22 nt, Human
ggacucucaggcugucggcuuc

SEQ ID NO: 468556 - RNA, 22 nt, Human
agacgcgguggugcaugccugu

SEQ ID NO: 468557 - RNA, 22 nt, Human
uuaaguauauccauuugacugg

SEQ ID NO: 468558 - RNA, 22 nt, Human
cagggucuuggcgccaucaccc

SEQ ID NO: 468559 - RNA, 22 nt, Human
uuuucuuggaguggcuguccuu

SEQ ID NO: 468560 - RNA, 22 nt, Human
ccuggguccaauucuggcuugu

SEQ ID NO: 468561 - RNA, 22 nt, Human
ugugcccuccugccaggggcug

SEQ ID NO: 468562 - RNA, 22 nt, Human
ccucuuccacugggccccaucc

SEQ ID NO: 468563 - RNA, 22 nt, Human
agacagcgaggacagaggggug

SEQ ID NO: 468564 - RNA, 22 nt, Human
gggcggggcuuccguccuccac

SEQ ID NO: 468565 - RNA, 22 nt, Human
gccaccagccccaugcgcugug

SEQ ID NO: 468566 - RNA, 22 nt, Human
gaccuccguguacaccucccag

SEQ ID NO: 468567 - RNA, 22 nt, Human
uggaaggggccaggcgcggagu

SEQ ID NO: 468568 - RNA, 22 nt, Human
uggcuggcuguccagcugggca

SEQ ID NO: 468569 - RNA, 22 nt, Human
uucuuuccucccagccuuugga

SEQ ID NO: 468570 - RNA, 22 nt, Human
gguggcaccuuacccugcgcag

SEQ ID NO: 468571 - RNA, 22 nt, Human
cccaccagaccugcaccggcac

SEQ ID NO: 468572 - RNA, 22 nt, Human
ccucuuccuucucacuguggaa

SEQ ID NO: 468573 - RNA, 18 nt, Human
ccucuggguuuuguuccc

SEQ ID NO: 468574 - RNA, 16 nt, Human
ggcagcagcuccgugc

SEQ ID NO: 468575 - RNA, 22 nt, Human
ggugugucugccaggaacugca

SEQ ID NO: 468576 - RNA, 22 nt, Human
gaaaccuuugccgauggggucc

SEQ ID NO: 468577 - RNA, 22 nt, Human
ucaucuccauacggucucgcag

SEQ ID NO: 468578 - RNA, 22 nt, Human
ggucucugcagcucccggcccc

SEQ ID NO: 468579 - RNA, 22 nt, Human
auggaggaugugcagcaugggc

SEQ ID NO: 468580 - RNA, 22 nt, Human
aacccagaaacgcaggcgguca

SEQ ID NO: 468581 - RNA, 22 nt, Human
gcagagcacccugcagugguau

SEQ ID NO: 468582 - RNA, 22 nt, Human
uggcugggagcuggaacugggc

SEQ ID NO: 468583 - RNA, 22 nt, Human
ccaagaggggaagggccgcagc

SEQ ID NO: 468584 - RNA, 22 nt, Human
ccugaggcccuggcugugcuga

SEQ ID NO: 468585 - RNA, 21 nt, Human
ccaccaggucuucugcucggg

SEQ ID NO: 468586 - RNA, 22 nt, Human
gcagcagaaggccaaggggagc

SEQ ID NO: 468587 - RNA, 22 nt, Human
uucuuugcccauguuuccuaag

SEQ ID NO: 468588 - RNA, 22 nt, Human
ggccgugcuccaaagucaucgu

SEQ ID NO: 468589 - RNA, 22 nt, Human
cccugccuacaggguuuucuuu

SEQ ID NO: 468590 - RNA, 22 nt, Human
acugcuuacccggccugacuuc

SEQ ID NO: 468591 - RNA, 22 nt, Human
aggaagagcuggaccagaggac

SEQ ID NO: 468592 - RNA, 22 nt, Human
cuuccugcaacaccuguguugc

SEQ ID NO: 468593 - RNA, 22 nt, Human
uugaugagaccauugccgcguc

SEQ ID NO: 468594 - RNA, 22 nt, Human
gcaggccugucuugcucgcccu

SEQ ID NO: 468595 - RNA, 22 nt, Human
cuggagggcugcagcgaggcug

SEQ ID NO: 468596 - RNA, 22 nt, Human
gggacaauggaggccucucucc

SEQ ID NO: 468597 - RNA, 22 nt, Human
ccgcgagguggagguugcagug

SEQ ID NO: 468598 - RNA, 22 nt, Human
uggaagggagcuggaauuugga

SEQ ID NO: 468599 - RNA, 22 nt, Human
agcagccuugugacuccggggu

SEQ ID NO: 468600 - RNA, 22 nt, Human
gggucugcuccaccugcagccc

SEQ ID NO: 468601 - RNA, 22 nt, Human
gucaggggccaugggccaagga

SEQ ID NO: 468602 - RNA, 18 nt, Human
ggugagggagcuggaagc

SEQ ID NO: 468603 - RNA, 22 nt, Human
cagugccaaggauggccuggga

SEQ ID NO: 468604 - RNA, 22 nt, Human
uuccaggccgggcaggaaacac

SEQ ID NO: 468605 - RNA, 22 nt, Human
uuccuuucucuggacugcagcc

SEQ ID NO: 468606 - RNA, 22 nt, Human
gcggcccggguccccagcagca

SEQ ID NO: 468607 - RNA, 22 nt, Human
cugaggagauccccccagaagu

SEQ ID NO: 468608 - RNA, 22 nt, Human
ucaggggacagccagcuggagg

SEQ ID NO: 468609 - RNA, 22 nt, Human
uccuggcaaagauguugguguu

SEQ ID NO: 468610 - RNA, 22 nt, Human
auggccugcagugcugccacag

SEQ ID NO: 468611 - RNA, 22 nt, Human
ugggguccucucacuuggaggg

SEQ ID NO: 468612 - RNA, 17 nt, Human
agcagcuggguugaucu

SEQ ID NO: 468613 - RNA, 22 nt, Human
gaccugugcagugacugguggc

SEQ ID NO: 468614 - RNA, 22 nt, Human
ucuuuuaucuguuguguaacaa

SEQ ID NO: 468615 - RNA, 22 nt, Human
ggcuggccuguguggccgccac

SEQ ID NO: 468616 - RNA, 21 nt, Human
gcuguucggcggcccucgcgc

SEQ ID NO: 468617 - RNA, 22 nt, Human
acaggaaaugaaaugguaucua

SEQ ID NO: 468618 - RNA, 22 nt, Human
cuccccacgccuggacuaagag

SEQ ID NO: 468619 - RNA, 19 nt, Human
ggccuggauuuagggcucc

SEQ ID NO: 468620 - RNA, 23 nt, Human
ggucccaguggagaggccucacc

SEQ ID NO: 468621 - RNA, 22 nt, Human
agggcuccuaugccccauggac

SEQ ID NO: 468622 - RNA, 22 nt, Human
agcgggcucacccgguuguugu

SEQ ID NO: 468623 - RNA, 22 nt, Human
augcccugggagugcuguacca

SEQ ID NO: 468624 - RNA, 22 nt, Human
aggccaagcucccagagaagcu

SEQ ID NO: 468625 - RNA, 22 nt, Human
ggagccaguuuagaccucaguu

SEQ ID NO: 468626 - RNA, 22 nt, Human
ccugguuugggugccagugagu

SEQ ID NO: 468627 - RNA, 22 nt, Human
ucugcuggaaaaccagggaauu

SEQ ID NO: 468628 - RNA, 22 nt, Human
ugagccuggccugcagagacca

SEQ ID NO: 468629 - RNA, 22 nt, Human
ggccuuccugcugcuccgggcc

SEQ ID NO: 468630 - RNA, 22 nt, Human
agagaugcuguggguagaggca

SEQ ID NO: 468631 - RNA, 22 nt, Human
aucuucccaggcuggggagagg

SEQ ID NO: 468632 - RNA, 19 nt, Human
aucaggcuucuauuuucuc

SEQ ID NO: 468633 - RNA, 22 nt, Human
aggccagugguucucugugucc

SEQ ID NO: 468634 - RNA, 22 nt, Human
caggcgggcaggugcggccccu

SEQ ID NO: 468635 - RNA, 22 nt, Human
acugugugccaggcgcuggucu

SEQ ID NO: 468636 - RNA, 22 nt, Human
agcuggguguagggcuggacaa

SEQ ID NO: 468637 - RNA, 22 nt, Human
cagaaccaggaacugauggaga

SEQ ID NO: 468638 - RNA, 22 nt, Human
auggggagcucaccaccuguuu

SEQ ID NO: 468639 - RNA, 22 nt, Human
agugggagcggcagucggggac

SEQ ID NO: 468640 - RNA, 22 nt, Human
ggcagcaggguagccauuucuc

SEQ ID NO: 468641 - RNA, 22 nt, Human herpesvirus 2
agguggucgagauggcgucgga

SEQ ID NO: 468642 - RNA, 22 nt, Human herpesvirus 2
agauggagguucagaucguacg

SEQ ID NO: 468643 - RNA, 22 nt, Human herpesvirus 2
aggcgcaugacguguuucaggc

SEQ ID NO: 468644 - RNA, 22 nt, Human herpesvirus 2
agugguuaaaucgaccgugaug

SEQ ID NO: 468645 - RNA, 19 nt, Human herpesvirus 2
agcugggccuggagcccgg

SEQ ID NO: 468646 - RNA, 22 nt, Human herpesvirus 2
agaccugguuuuuggugccccu

SEQ ID NO: 468647 - RNA, 22 nt, Human herpesvirus 2
gauguuggcaaucucgagacca

SEQ ID NO: 468648 - RNA, 22 nt, Human herpesvirus 2
acggaggcgaguugcuggacgu

SEQ ID NO: 468649 - RNA, 22 nt, Human herpesvirus 2
cccgcgccgggcgcuaaugaga

SEQ ID NO: 468650 - RNA, 23 nt, Human herpesvirus 2
ccgggcgugcguggccgccaggc

SEQ ID NO: 468651 - RNA, 22 nt, Human herpesvirus 2
cugucugauccacagcaccccg

SEQ ID NO: 468652 - RNA, 22 nt, Human herpesvirus 2
gaagcugcugcggucgcgcccc

SEQ ID NO: 468653 - RNA, 22 nt, Human herpesvirus 2
cgcgccuccgaaagaugguguu

SEQ ID NO: 468654 - RNA, 22 nt, Human herpesvirus 2
cggccaucugcaucgugggccc

SEQ ID NO: 468655 - RNA, 22 nt, Human herpesvirus 2
caugguggaccgcgggcucggc

SEQ ID NO: 468656 - RNA, 22 nt, Human herpesvirus 2
caucuucugcccuuccauccuc

SEQ ID NO: 468657 - RNA, 22 nt, Human herpesvirus 2
auuguccacguaggugcugaag

SEQ ID NO: 468658 - RNA, 20 nt, Human herpesvirus 2
agcgcgugaggccgggcgcc

SEQ ID NO: 468659 - RNA, 20 nt, Human herpesvirus 2
cagcuacaccgggagggcgu

SEQ ID NO: 468660 - RNA, 22 nt, Human herpesvirus 2
aaacugcacgccgccacggcgg

SEQ ID NO: 468661 - RNA, 22 nt, Human herpesvirus 2
agaggcuguccgccgggcguga

SEQ ID NO: 468662 - RNA, 22 nt, Human herpesvirus 2
ggguccuccgccgccgcgggcc

SEQ ID NO: 468663 - RNA, 20 nt, Human herpesvirus 2
gcggcuccccuagcugcagc

SEQ ID NO: 468664 - RNA, 22 nt, Human herpesvirus 2
gccugcuggccacguacgcaau

SEQ ID NO: 468665 - RNA, 18 nt, Human herpesvirus 2
gcucaugggcgacgagga

SEQ ID NO: 468666 - RNA, 22 nt, Human herpesvirus 2
gcuggcagcgguggccguggau

SEQ ID NO: 468667 - RNA, 22 nt, Human herpesvirus 2
ggacgccggcacccccgaagcc

SEQ ID NO: 468668 - RNA, 22 nt, Human herpesvirus 2
ggaggcccaagaugccggcggu

SEQ ID NO: 468669 - RNA, 22 nt, Human herpesvirus 2
gcccgccacccgcgacgagcug

SEQ ID NO: 468670 - RNA, 22 nt, Human herpesvirus 2
gcccggggcguuccgcucaaca

SEQ ID NO: 468671 - RNA, 23 nt, Human herpesvirus 2
uucaccgcgacuccaccuccgag

SEQ ID NO: 468672 - RNA, 22 nt, Human herpesvirus 2
uucaggagcccaaagucguccu

SEQ ID NO: 468673 - RNA, 22 nt, Human herpesvirus 2
uuggguuccgcggacgccgggc

SEQ ID NO: 468674 - RNA, 22 nt, Human herpesvirus 2
ucugaauuucccgcagaaccuc

SEQ ID NO: 468675 - RNA, 21 nt, Human herpesvirus 2
uggcgaccgucaaguccccga

SEQ ID NO: 468676 - RNA, 22 nt, Human herpesvirus 2
gucgaggcuucgggggugccgg

SEQ ID NO: 468677 - RNA, 22 nt, Human herpesvirus 2
ucacgcccggcggacagccucu

SEQ ID NO: 468678 - RNA, 20 nt, Human herpesvirus 2
ucagggagcuguggugggug

SEQ ID NO: 468679 - RNA, 22 nt, Human herpesvirus 2
ggcuccaggccgccacgcuggg

SEQ ID NO: 468680 - RNA, 22 nt, Human herpesvirus 2
ggcgcccggggacguggcgcug

SEQ ID NO: 468681 - RNA, 22 nt, Human herpesvirus 2
gggcguggccgcccuucuaaaa

SEQ ID NO: 468682 - RNA, 22 nt, Human herpesvirus 2
gggggaguuugagacggccgag

SEQ ID NO: 468683 - RNA, 22 nt, Human herpesvirus 2
ggucacccuggaguugcuccug

SEQ ID NO: 468684 - RNA, 22 nt, Human herpesvirus 2
gagaggccguggagcuugccag

SEQ ID NO: 468685 - RNA, 22 nt, Human herpesvirus 2
gaaagggguccguaaccaaagg

SEQ ID NO: 468686 - RNA, 22 nt, Human herpesvirus 2
cacgggcguccccggugucucc

SEQ ID NO: 468687 - RNA, 22 nt, Human herpesvirus 2
cgaagagcucccguaggauaag

SEQ ID NO: 468688 - RNA, 22 nt, Human herpesvirus 2
cugcugcagcuaggggagccgc

SEQ ID NO: 468689 - RNA, 22 nt, Human herpesvirus 2
ccagcgugucggggccgaagcg

SEQ ID NO: 468690 - RNA, 22 nt, Human herpesvirus 2
cagcucgcgcagcagcugcucg

SEQ ID NO: 468691 - RNA, 22 nt, Human herpesvirus 2
cagggcguggaggcagucgcgc

SEQ ID NO: 468692 - RNA, 22 nt, Human herpesvirus 2
caguuuuuccgcggugagcugc

SEQ ID NO: 468693 - RNA, 22 nt, Human herpesvirus 2
uuacaacaacaacgcccauguc

SEQ ID NO: 468694 - RNA, 23 nt, Human herpesvirus 2
uugcuggcggcggccguguacgc

SEQ ID NO: 468695 - RNA, 22 nt, Human herpesvirus 2
uggccagcugccggggcagcgu

SEQ ID NO: 468696 - RNA, 22 nt, Human herpesvirus 2
ugcgggccggcacggccgugga

SEQ ID NO: 468697 - RNA, 22 nt, Human herpesvirus 2
ucugagccugggucaugcgcga

SEQ ID NO: 468698 - RNA, 22 nt, Human herpesvirus 2
ucguacccgggcaccacguggc

SEQ ID NO: 468699 - RNA, 22 nt, Human herpesvirus 2
gucugggggccuuucucugugu

SEQ ID NO: 468700 - RNA, 22 nt, Human herpesvirus 2
uaggguagacucgagacggcgg

SEQ ID NO: 468701 - RNA, 22 nt, Human herpesvirus 2
gcagggcguuucguuggucuag

SEQ ID NO: 468702 - RNA, 22 nt, Human herpesvirus 2
gccccggcgcgucguccgucac

SEQ ID NO: 468703 - RNA, 22 nt, Human herpesvirus 2
gccuucccgguguuggucgacg

SEQ ID NO: 468704 - RNA, 22 nt, Human herpesvirus 2
guccccgcccaggcuguggagg

SEQ ID NO: 468705 - RNA, 22 nt, Human herpesvirus 2
gcucgguggccgcgcgguacgu

SEQ ID NO: 468706 - RNA, 22 nt, Human herpesvirus 2
gcggggcuuggagcgaccgagg

SEQ ID NO: 468707 - RNA, 18 nt, Human herpesvirus 2
guggaagacggugacggu

SEQ ID NO: 468708 - RNA, 22 nt, Human herpesvirus 2
auuagggcaaagugcgagcgcu

SEQ ID NO: 468709 - RNA, 22 nt, Human herpesvirus 2
cucggggcuccgccagggcgcc

SEQ ID NO: 468710 - RNA, 22 nt, Human herpesvirus 2
cugcagcagcgcgaggagccgu

SEQ ID NO: 468711 - RNA, 18 nt, Human herpesvirus 2
cuggaaggcacaucucga

SEQ ID NO: 468712 - RNA, 22 nt, Human herpesvirus 2
cuggagagacgcaucuacgccg

SEQ ID NO: 468713 - RNA, 22 nt, Human herpesvirus 2
cgcaucucgagggccccgggac

SEQ ID NO: 468714 - RNA, 22 nt, Human herpesvirus 2
cccugggcucucggggaacccg

SEQ ID NO: 468715 - RNA, 22 nt, Human herpesvirus 2
gcccagcaacggcuccucgcgc

SEQ ID NO: 468716 - RNA, 22 nt, Human herpesvirus 2
gccgucagcgggggagcccugg

SEQ ID NO: 468717 - RNA, 22 nt, Human herpesvirus 2
gcaccccaccgaaaaacggagc

SEQ ID NO: 468718 - RNA, 22 nt, Human herpesvirus 2
gaagaccagccugucgccuaug

SEQ ID NO: 468719 - RNA, 22 nt, Human herpesvirus 2
ccagggcgccaugcgcccgcac

SEQ ID NO: 468720 - RNA, 22 nt, Human herpesvirus 2
uccgaaggucugcgcgaggccg

SEQ ID NO: 468721 - RNA, 22 nt, Human herpesvirus 2
ucgaugguggacgaggccguuc

SEQ ID NO: 468722 - RNA, 22 nt, Human herpesvirus 2
ucaccaccauucgcgugacggu

SEQ ID NO: 468723 - RNA, 22 nt, Human herpesvirus 2
guccuuguuuucggucugguac

SEQ ID NO: 468724 - RNA, 22 nt, Human herpesvirus 2
gggccagcacguggccgugcug

SEQ ID NO: 468725 - RNA, 22 nt, Human herpesvirus 2
gggucgacucggucucgcagcg

SEQ ID NO: 468726 - RNA, 22 nt, Human herpesvirus 2
guccacggccgugccggcccgc

SEQ ID NO: 468727 - RNA, 22 nt, Human herpesvirus 2
guccaggauaaaccggguggug

SEQ ID NO: 468728 - RNA, 22 nt, Human herpesvirus 2
ugcccgacccggaggacgugcg

SEQ ID NO: 468729 - RNA, 22 nt, Human herpesvirus 2
ugggagucugcgguugggagcg

SEQ ID NO: 468730 - RNA, 22 nt, Human herpesvirus 2
ugugugcaccgcgaagaaucca

SEQ ID NO: 468731 - RNA, 22 nt, Human herpesvirus 2
uucaccgcgacuccaccuccga

SEQ ID NO: 468732 - RNA, 22 nt, Human herpesvirus 2
gguccggcauccagagggcgcu

SEQ ID NO: 468733 - RNA, 22 nt, Human herpesvirus 2
gggcggcgccuuggaaccaucg

SEQ ID NO: 468734 - RNA, 22 nt, Human herpesvirus 2
ggaaccaagcggaggcaccccg

SEQ ID NO: 468735 - RNA, 22 nt, Human herpesvirus 2
gaggauggaagggcagaagaug

SEQ ID NO: 468736 - RNA, 22 nt, Human herpesvirus 2
gccuccagggcgugggcgcgcu

SEQ ID NO: 468737 - RNA, 22 nt, Human herpesvirus 2
ucucgucgccgauuaccgcggc

SEQ ID NO: 468738 - RNA, 22 nt, Human herpesvirus 2
ucaaagggggcguggccgcccu

SEQ ID NO: 468739 - RNA, 22 nt, Human herpesvirus 2
ucaccaccauucgcgugacggu

SEQ ID NO: 468740 - RNA, 20 nt, Human herpesvirus 2
ucaccggcacgucggccucg

SEQ ID NO: 468741 - RNA, 22 nt, Human herpesvirus 2
ucacgcccggcggacagccucu

SEQ ID NO: 468742 - RNA, 22 nt, Human herpesvirus 2
ucacgcgggugcuggugucucg

SEQ ID NO: 468743 - RNA, 22 nt, Human herpesvirus 2
gauggucgugcugggccucagc

SEQ ID NO: 468744 - RNA, 22 nt, Human herpesvirus 2
gaggauggaagggcagaagaug

SEQ ID NO: 468745 - RNA, 22 nt, Human herpesvirus 2
gagcuggcggaggaucccgggu

SEQ ID NO: 468746 - RNA, 22 nt, Human herpesvirus 2
cgugcuggagcgccuggugccg

SEQ ID NO: 468747 - RNA, 22 nt, Human herpesvirus 2
gagaggccguggagcuugccag

SEQ ID NO: 468748 - RNA, 22 nt, Human herpesvirus 2
cgcgcacguccuccgggucggg

SEQ ID NO: 468749 - RNA, 22 nt, Human herpesvirus 2
cgcgccggguccguuguaucuu

SEQ ID NO: 468750 - RNA, 22 nt, Human herpesvirus 2
cgcgccuccgaaagaugguguu

SEQ ID NO: 468751 - RNA, 23 nt, Human herpesvirus 2
cggcccauaggaucucgcggcuc

SEQ ID NO: 468752 - RNA, 22 nt, Human herpesvirus 2
cggugccacgucagcuggcagg

SEQ ID NO: 468753 - RNA, 22 nt, Human herpesvirus 2
cggugccgucuggguggcuccc

SEQ ID NO: 468754 - RNA, 22 nt, Human herpesvirus 2
cggggccgccgguagcaccccg

SEQ ID NO: 468755 - RNA, 22 nt, Human herpesvirus 2
cgggggcugcagucggcgcuga

SEQ ID NO: 468756 - RNA, 22 nt, Human herpesvirus 2
cgcucgcuaugggguucgucug

SEQ ID NO: 468757 - RNA, 22 nt, Human herpesvirus 2
cgcgucguggacaucauggcgc

SEQ ID NO: 468758 - RNA, 22 nt, Human herpesvirus 2
cgcuggugcccauguccccgcg

SEQ ID NO: 468759 - RNA, 22 nt, Human herpesvirus 2
cgcuguucgaggccacgcgcgu

SEQ ID NO: 468760 - RNA, 22 nt, Human herpesvirus 2
cggccaucugcaucgugggccc

SEQ ID NO: 468761 - RNA, 22 nt, Human herpesvirus 2
uggccagcugccggggcagcgu

SEQ ID NO: 468762 - RNA, 22 nt, Human herpesvirus 2
uggccccgaacacaaccggcuc

SEQ ID NO: 468763 - RNA, 22 nt, Human herpesvirus 2
ugccgagugaacucucccgccc

SEQ ID NO: 468764 - RNA, 22 nt, Human herpesvirus 2
ugcccgacccggaggacgugcg

SEQ ID NO: 468765 - RNA, 22 nt, Human herpesvirus 2
ugcgcgaggccuuagacgcccu

SEQ ID NO: 468766 - RNA, 22 nt, Human herpesvirus 2
ugcgggccggcacggccgugga

SEQ ID NO: 468767 - RNA, 18 nt, Human herpesvirus 2
acaccucgaucaccgucc

SEQ ID NO: 468768 - RNA, 22 nt, Human herpesvirus 2
accgagcucguguucguggggg

SEQ ID NO: 468769 - RNA, 22 nt, Human herpesvirus 2
acgcgggugcuggugucucggg

SEQ ID NO: 468770 - RNA, 17 nt, Human herpesvirus 2
acgcggugucggcggug

SEQ ID NO: 468771 - RNA, 20 nt, Human herpesvirus 2
uacggccauggaccugguuc

SEQ ID NO: 468772 - RNA, 22 nt, Human herpesvirus 2
gugggccgugaugcgcgggcgg

SEQ ID NO: 468773 - RNA, 22 nt, Human herpesvirus 2
guggcgucggugguucuggucg

SEQ ID NO: 468774 - RNA, 22 nt, Human herpesvirus 2
gugcggcggcgaccgggacgcc

SEQ ID NO: 468775 - RNA, 22 nt, Human herpesvirus 2
gucccggucgccgccgcaccag

SEQ ID NO: 468776 - RNA, 22 nt, Human herpesvirus 2
gucggcgcggggguggccaaac

SEQ ID NO: 468777 - RNA, 22 nt, Human herpesvirus 2
gucgaggcuucgggggugccgg

SEQ ID NO: 468778 - RNA, 22 nt, Human herpesvirus 2
guccucgcccggcagcggcgag

SEQ ID NO: 468779 - RNA, 22 nt, Human herpesvirus 2
guccccgcccaggcuguggagg

SEQ ID NO: 468780 - RNA, 22 nt, Human herpesvirus 2
gucuggcaugacacccagcucu

SEQ ID NO: 468781 - RNA, 22 nt, Human herpesvirus 2
gucugggggccuuucucugugu

SEQ ID NO: 468782 - RNA, 22 nt, Human herpesvirus 2
uuggguuccgcggacgccgggc

SEQ ID NO: 468783 - RNA, 23 nt, Human herpesvirus 2
uugcuggcggcggccguguacgc

SEQ ID NO: 468784 - RNA, 22 nt, Human herpesvirus 2
uugacgagcuucgcgguacuac

SEQ ID NO: 468785 - RNA, 22 nt, Human herpesvirus 2
ccucggagguggagucgcggug

SEQ ID NO: 468786 - RNA, 22 nt, Human herpesvirus 2
ccggaccuguucuucaagcgcc

SEQ ID NO: 468787 - RNA, 22 nt, Human herpesvirus 2
ccuacgagggcacaagccccgg

SEQ ID NO: 468788 - RNA, 22 nt, Human herpesvirus 2
agguggucgagauggcgucgga

SEQ ID NO: 468789 - RNA, 22 nt, Human herpesvirus 2
aguuccugcugcagggacguca

SEQ ID NO: 468790 - RNA, 22 nt, Human herpesvirus 2
agugguuaaaucgaccgugaug

SEQ ID NO: 468791 - RNA, 22 nt, Human herpesvirus 2
cccgcggcgucgcgacagacca

SEQ ID NO: 468792 - RNA, 22 nt, Human herpesvirus 2
cccggcgcgccggacuucugcg

SEQ ID NO: 468793 - RNA, 22 nt, Human herpesvirus 2
cccgggauccuccgccagcucg

SEQ ID NO: 468794 - RNA, 18 nt, Human herpesvirus 2
cccgcgaugcuaaugaga

SEQ ID NO: 468795 - RNA, 22 nt, Human herpesvirus 2
cccgcgccgggcgcuaaugaga

SEQ ID NO: 468796 - RNA, 22 nt, Human herpesvirus 2
cccgccccguacguugugcacg

SEQ ID NO: 468797 - RNA, 22 nt, Human herpesvirus 2
cccugggcucucggggaacccg

SEQ ID NO: 468798 - RNA, 22 nt, Human herpesvirus 2
ccgaccgcgggcugacgcggcu

SEQ ID NO: 468799 - RNA, 22 nt, Human herpesvirus 2
ccgacgccgguggucccggcga

SEQ ID NO: 468800 - RNA, 23 nt, Human herpesvirus 2
ccgggcgugcguggccgccaggc

SEQ ID NO: 468801 - RNA, 22 nt, Human herpesvirus 2
ccgcgaauagcuacggccgcuu

SEQ ID NO: 468802 - RNA, 16 nt, Human herpesvirus 2
ccaucuccgugauggc

SEQ ID NO: 468803 - RNA, 22 nt, Human herpesvirus 2
cccccucguacuuccugaucgc

SEQ ID NO: 468804 - RNA, 22 nt, Human herpesvirus 2
augacgccccggaugacguggc

SEQ ID NO: 468805 - RNA, 22 nt, Human herpesvirus 2
aucgucggcuccccgccgcgcu

SEQ ID NO: 468806 - RNA, 22 nt, Human herpesvirus 2
ucgucggcggccccgcggaggu

SEQ ID NO: 468807 - RNA, 22 nt, Human herpesvirus 2
ucguacccgggcaccacguggc

SEQ ID NO: 468808 - RNA, 22 nt, Human herpesvirus 2
ucgggaaggccucgucggaccc

SEQ ID NO: 468809 - RNA, 22 nt, Human herpesvirus 2
ucgaugguggacgaggccguuc

SEQ ID NO: 468810 - RNA, 22 nt, Human herpesvirus 2
ucggcgcggagcaucucgucca

SEQ ID NO: 468811 - RNA, 22 nt, Human herpesvirus 2
guccacggccgugccggcccgc

SEQ ID NO: 468812 - RNA, 22 nt, Human herpesvirus 2
guccaggauaaaccggguggug

SEQ ID NO: 468813 - RNA, 22 nt, Human herpesvirus 2
ucgaccccgccguucgggcggu

SEQ ID NO: 468814 - RNA, 22 nt, Human herpesvirus 2
ggucgcgcaugacccaggcuca

SEQ ID NO: 468815 - RNA, 22 nt, Human herpesvirus 2
ggucgcgccugcccggcccaga

SEQ ID NO: 468816 - RNA, 22 nt, Human herpesvirus 2
gggucgacucggucucgcagcg

SEQ ID NO: 468817 - RNA, 22 nt, Human herpesvirus 2
gguccggcauccagagggcgcu

SEQ ID NO: 468818 - RNA, 22 nt, Human herpesvirus 2
ggggggcaagugcaguaaccca

SEQ ID NO: 468819 - RNA, 22 nt, Human herpesvirus 2
ggcccggaggaggcgcucguca

SEQ ID NO: 468820 - RNA, 20 nt, Human herpesvirus 2
ggccggacaugguguccgug

SEQ ID NO: 468821 - RNA, 22 nt, Human herpesvirus 2
ggccgucgaacagaucgggccg

SEQ ID NO: 468822 - RNA, 19 nt, Human herpesvirus 2
ggccuccgccucgacccgc

SEQ ID NO: 468823 - RNA, 22 nt, Human herpesvirus 2
ggcgcccggggacguggcgcug

SEQ ID NO: 468824 - RNA, 22 nt, Human herpesvirus 2
ggacgggugaguucgcuaggca

SEQ ID NO: 468825 - RNA, 22 nt, Human herpesvirus 2
ggacgugcgaucggaucccgcg

SEQ ID NO: 468826 - RNA, 22 nt, Human herpesvirus 2
ggacgccggcacccccgaagcc

SEQ ID NO: 468827 - RNA, 22 nt, Human herpesvirus 2
ggaggcccaagaugccggcggu

SEQ ID NO: 468828 - RNA, 22 nt, Human herpesvirus 2
gcgggcgagggcgucuaaggcc

SEQ ID NO: 468829 - RNA, 22 nt, Human herpesvirus 2
gcggaccuggugcccggacguc

SEQ ID NO: 468830 - RNA, 17 nt, Human herpesvirus 2
gcggaugcggguagcug

SEQ ID NO: 468831 - RNA, 22 nt, Human herpesvirus 2
gcggccgcgacaugucccacag

SEQ ID NO: 468832 - RNA, 23 nt, Human herpesvirus 2
gcggcgggggauguguccauggc

SEQ ID NO: 468833 - RNA, 20 nt, Human herpesvirus 2
gcggcuccccuagcugcagc

SEQ ID NO: 468834 - RNA, 22 nt, Human herpesvirus 2
gcgcucucgaccgcgguucccg

SEQ ID NO: 468835 - RNA, 22 nt, Human herpesvirus 2
gcgcagacggcagaugugcgcg

SEQ ID NO: 468836 - RNA, 20 nt, Human herpesvirus 2
gcgcgccaaccgcccaccag

SEQ ID NO: 468837 - RNA, 22 nt, Human herpesvirus 2
gcgcgccaaugggcucgggaaa

SEQ ID NO: 468838 - RNA, 22 nt, Human herpesvirus 2
aaggccgugguguugcggagcg

SEQ ID NO: 468839 - RNA, 22 nt, Human herpesvirus 2
gccuucccgguguuggucgacg

SEQ ID NO: 468840 - RNA, 22 nt, Human herpesvirus 2
aaacugcacgccgccacggcgg

SEQ ID NO: 468841 - RNA, 22 nt, Human herpesvirus 2
aaaguccgggaggggccgcagg

SEQ ID NO: 468842 - RNA, 20 nt, Human herpesvirus 2
aacgcccugggguugccgug

SEQ ID NO: 468843 - RNA, 23 nt, Human herpesvirus 2
aacgcccugggguugccgugagg

SEQ ID NO: 468844 - RNA, 22 nt, Human herpesvirus 2
ugggaaaucuauugaacucucc

SEQ ID NO: 468845 - RNA, 22 nt, Human herpesvirus 2
ccagggcgccaugcgcccgcac

SEQ ID NO: 468846 - RNA, 21 nt, Human herpesvirus 2
uggcgaccgucaaguccccga

SEQ ID NO: 468847 - RNA, 22 nt, Human herpesvirus 2
uggcggcguagaugcgucucuc

SEQ ID NO: 468848 - RNA, 22 nt, Human herpesvirus 2
ugggagucugcgguugggagcg

SEQ ID NO: 468849 - RNA, 22 nt, Human herpesvirus 2
ugggccgggcaggcgcgaccga

SEQ ID NO: 468850 - RNA, 22 nt, Human herpesvirus 2
ugggcgucgacgaggcgucggc

SEQ ID NO: 468851 - RNA, 22 nt, Human herpesvirus 2
ccagcgugucggggccgaagcg

SEQ ID NO: 468852 - RNA, 22 nt, Human herpesvirus 2
cagcucgcgcagcagcugcucg

SEQ ID NO: 468853 - RNA, 22 nt, Human herpesvirus 2
cagggcguggaggcagucgcgc

SEQ ID NO: 468854 - RNA, 22 nt, Human herpesvirus 2
caugguggaccgcgggcucggc

SEQ ID NO: 468855 - RNA, 22 nt, Human herpesvirus 2
caccgguccuucgcgggggccg

SEQ ID NO: 468856 - RNA, 22 nt, Human herpesvirus 2
caccucggucuccuccuccgag

SEQ ID NO: 468857 - RNA, 22 nt, Human herpesvirus 2
cacgagcucgcggcaccccggc

SEQ ID NO: 468858 - RNA, 22 nt, Human herpesvirus 2
cacgaagccccggcggguuugu

SEQ ID NO: 468859 - RNA, 22 nt, Human herpesvirus 2
cacggacggcgaccugcggcgc

SEQ ID NO: 468860 - RNA, 22 nt, Human herpesvirus 2
cacggccgacguccccagcgug

SEQ ID NO: 468861 - RNA, 22 nt, Human herpesvirus 2
cacgggcguccccggugucucc

SEQ ID NO: 468862 - RNA, 22 nt, Human herpesvirus 2
caccaacucguucgcgcgcugc

SEQ ID NO: 468863 - RNA, 22 nt, Human herpesvirus 2
cgaccgucaagagccugggccc

SEQ ID NO: 468864 - RNA, 22 nt, Human herpesvirus 2
cgaagagcucccguaggauaag

SEQ ID NO: 468865 - RNA, 22 nt, Human herpesvirus 2
cgacgcacccggagccgcuucu

SEQ ID NO: 468866 - RNA, 22 nt, Human herpesvirus 2
cgacggugcgcugguuuucggg

SEQ ID NO: 468867 - RNA, 17 nt, Human herpesvirus 2
cgaucccgugaccgacc

SEQ ID NO: 468868 - RNA, 22 nt, Human herpesvirus 2
cgagguuccgcccgaccgcacc

SEQ ID NO: 468869 - RNA, 22 nt, Human herpesvirus 2
cgcccgaacggcggggucgaug

SEQ ID NO: 468870 - RNA, 22 nt, Human herpesvirus 2
aggcgacaggcuggucuuccug

SEQ ID NO: 468871 - RNA, 22 nt, Human herpesvirus 2
agggucucauuagcaucgcggg

SEQ ID NO: 468872 - RNA, 22 nt, Human herpesvirus 2
aggcgcaugacguguuucaggc

SEQ ID NO: 468873 - RNA, 22 nt, Human herpesvirus 2
aggugcggcuggacgccaacga

SEQ ID NO: 468874 - RNA, 22 nt, Human herpesvirus 2
cgccgcugccgggcgaggaccu

SEQ ID NO: 468875 - RNA, 22 nt, Human herpesvirus 2
cgccgccuggcggaccgcaucu

SEQ ID NO: 468876 - RNA, 22 nt, Human herpesvirus 2
cgcaucucgagggccccgggac

SEQ ID NO: 468877 - RNA, 22 nt, Human herpesvirus 2
cgcccggaggacggccguggcg

SEQ ID NO: 468878 - RNA, 22 nt, Human herpesvirus 2
cgcccgugugggcgcccgagcu

SEQ ID NO: 468879 - RNA, 22 nt, Human herpesvirus 2
cgcccuccgcuacacgacccug

SEQ ID NO: 468880 - RNA, 22 nt, Human herpesvirus 2
uuugggucgggcucagggccag

SEQ ID NO: 468881 - RNA, 22 nt, Human herpesvirus 2
acggaggcgaguugcuggacgu

SEQ ID NO: 468882 - RNA, 20 nt, Human herpesvirus 2
agcgcgugaggccgggcgcc

SEQ ID NO: 468883 - RNA, 22 nt, Human herpesvirus 2
agcgccccgugugugaccgagg

SEQ ID NO: 468884 - RNA, 22 nt, Human herpesvirus 2
agcgcgccuccggagcgagcuc

SEQ ID NO: 468885 - RNA, 22 nt, Human herpesvirus 2
agcgcucgcacuuugcccuaau

SEQ ID NO: 468886 - RNA, 22 nt, Human herpesvirus 2
agaccugguuuuuggugccccu

SEQ ID NO: 468887 - RNA, 22 nt, Human herpesvirus 2
agaggcuguccgccgggcguga

SEQ ID NO: 468888 - RNA, 22 nt, Human herpesvirus 2
agaguggcuccuggagcgcucg

SEQ ID NO: 468889 - RNA, 22 nt, Human herpesvirus 2
gggcggcgccuuggaaccaucg

SEQ ID NO: 468890 - RNA, 22 nt, Human herpesvirus 2
gggcgcaugugucugccgagcg

SEQ ID NO: 468891 - RNA, 22 nt, Human herpesvirus 2
gggccagcacguggccgugcug

SEQ ID NO: 468892 - RNA, 22 nt, Human herpesvirus 2
gggggaguuugagacggccgag

SEQ ID NO: 468893 - RNA, 22 nt, Human herpesvirus 2
ggggcgcgucccuucagccacu

SEQ ID NO: 468894 - RNA, 22 nt, Human herpesvirus 2
ggggcgcugccgaagguucgug

SEQ ID NO: 468895 - RNA, 22 nt, Human herpesvirus 2
gggcguggccgcccuucuaaaa

SEQ ID NO: 468896 - RNA, 17 nt, Human herpesvirus 2
ggggaucaagauaggcu

SEQ ID NO: 468897 - RNA, 22 nt, Human herpesvirus 2
ggggccaacgugcgguaccgcg

SEQ ID NO: 468898 - RNA, 22 nt, Human herpesvirus 2
gcucgguggccgcgcgguacgu

SEQ ID NO: 468899 - RNA, 22 nt, Human herpesvirus 2
gcuggcagcgguggccguggau

SEQ ID NO: 468900 - RNA, 22 nt, Human herpesvirus 2
gcuguacgcguguuccacgugc

SEQ ID NO: 468901 - RNA, 18 nt, Human herpesvirus 2
gcggucggggucgcuacu

SEQ ID NO: 468902 - RNA, 22 nt, Human herpesvirus 2
gcggguccgggggucguucacu

SEQ ID NO: 468903 - RNA, 22 nt, Human herpesvirus 2
gcgguccccggcacgaggguga

SEQ ID NO: 468904 - RNA, 18 nt, Human herpesvirus 2
gcucaugggcgacgagga

SEQ ID NO: 468905 - RNA, 22 nt, Human herpesvirus 2
gcagggcguuucguuggucuag

SEQ ID NO: 468906 - RNA, 22 nt, Human herpesvirus 2
gcagaccgucacgcgaauggug

SEQ ID NO: 468907 - RNA, 22 nt, Human herpesvirus 2
gcauggccggcaacgaccgcgu

SEQ ID NO: 468908 - RNA, 22 nt, Human herpesvirus 2
gcaccccaccgaaaaacggagc

SEQ ID NO: 468909 - RNA, 22 nt, Human herpesvirus 2
gcccggggcguuccgcucaaca

SEQ ID NO: 468910 - RNA, 22 nt, Human herpesvirus 2
gcccgguucgaggccucgggcg

SEQ ID NO: 468911 - RNA, 22 nt, Human herpesvirus 2
gcccguuaaaagcugcuaauua

SEQ ID NO: 468912 - RNA, 22 nt, Human herpesvirus 2
gcccagcaacggcuccucgcgc

SEQ ID NO: 468913 - RNA, 22 nt, Human herpesvirus 2
gccccggcgcgucguccgucac

SEQ ID NO: 468914 - RNA, 22 nt, Human herpesvirus 2
gcccgccacccgcgacgagcug

SEQ ID NO: 468915 - RNA, 22 nt, Human herpesvirus 2
gcccgcccucaccgucggccag

SEQ ID NO: 468916 - RNA, 23 nt, Human herpesvirus 2
gccacgugcgugccgggcacgag

SEQ ID NO: 468917 - RNA, 22 nt, Human herpesvirus 2
gccgucagcgggggagcccugg

SEQ ID NO: 468918 - RNA, 22 nt, Human herpesvirus 2
gccuccagggcgugggcgcgcu

SEQ ID NO: 468919 - RNA, 22 nt, Human herpesvirus 2
gccugcgugggugccaucgcuc

SEQ ID NO: 468920 - RNA, 22 nt, Human herpesvirus 2
gccugcuggccacguacgcaau

SEQ ID NO: 468921 - RNA, 22 nt, Human herpesvirus 2
gcggggcuuggagcgaccgagg

SEQ ID NO: 468922 - RNA, 22 nt, Human herpesvirus 2
cguggucucgggagcagggcgc

SEQ ID NO: 468923 - RNA, 22 nt, Human herpesvirus 2
cgugggugugcuagaucgaacg

SEQ ID NO: 468924 - RNA, 22 nt, Human herpesvirus 2
cuccgacgccaucucgaccacc

SEQ ID NO: 468925 - RNA, 22 nt, Human herpesvirus 2
cucgccgucgagguggcggauc

SEQ ID NO: 468926 - RNA, 22 nt, Human herpesvirus 2
cucggggcuccgccagggcgcc

SEQ ID NO: 468927 - RNA, 22 nt, Human herpesvirus 2
cugcccgcgaagaaacucucgc

SEQ ID NO: 468928 - RNA, 22 nt, Human herpesvirus 2
cugcgcggcggagaccgggacg

SEQ ID NO: 468929 - RNA, 18 nt, Human herpesvirus 2
cuggaaggcacaucucga

SEQ ID NO: 468930 - RNA, 22 nt, Human herpesvirus 2
gaagcugcugcggucgcgcccc

SEQ ID NO: 468931 - RNA, 22 nt, Human herpesvirus 2
gaaagggguccguaaccaaagg

SEQ ID NO: 468932 - RNA, 17 nt, Human herpesvirus 2
gacgccgccauggccgc

SEQ ID NO: 468933 - RNA, 22 nt, Human herpesvirus 2
ggcuccaggccgccacgcuggg

SEQ ID NO: 468934 - RNA, 19 nt, Human herpesvirus 2
ggcggggagccgacgaucc

SEQ ID NO: 468935 - RNA, 22 nt, Human
gugccaaaagcuauaauuuggu

SEQ ID NO: 468936 - RNA, 22 nt, Human
cccaaggcugcagugagcauga

SEQ ID NO: 468937 - RNA, 22 nt, Human
ucugggagacguguguugucag

SEQ ID NO: 468938 - RNA, 22 nt, Human
augggcagacagggagcucacg

SEQ ID NO: 468939 - RNA, 22 nt, Human
gucugcccucacgccagcuggg

SEQ ID NO: 468940 - RNA, 22 nt, Human
uuucuucugagaucagggagaa

SEQ ID NO: 468941 - RNA, 22 nt, Human
agggcaguguggugggacugac

SEQ ID NO: 468942 - RNA, 22 nt, Human
uggcccugaggacccagugugg

SEQ ID NO: 468943 - RNA, 22 nt, Human
uccaguggcaccuuggcccuca

SEQ ID NO: 468944 - RNA, 20 nt, Human
ggaagccagggugcagggga

SEQ ID NO: 468945 - RNA, 22 nt, Human
ucucagagauuuauggaaaacu

SEQ ID NO: 468946 - RNA, 22 nt, Human
gugguaauuuaauccuacacug

SEQ ID NO: 468947 - RNA, 22 nt, Human
auugaaagauuuugggcucaug

SEQ ID NO: 468948 - RNA, 22 nt, Human
cagcugagaaauggggaaaggg

SEQ ID NO: 468949 - RNA, 22 nt, Human
ccugccagauccccugagcuga

SEQ ID NO: 468950 - RNA, 22 nt, Human
ccagagccggcucccucagcuu

SEQ ID NO: 468951 - RNA, 22 nt, Human
caguggcagagaacagagaccu

SEQ ID NO: 468952 - RNA, 22 nt, Human
augugcauuaaaugucaauguu

SEQ ID NO: 468953 - RNA, 22 nt, Human
caguacuuuucuggcuuucuac

SEQ ID NO: 468954 - RNA, 22 nt, Human
ugcccacauucaaaaggugaug

SEQ ID NO: 468955 - RNA, 22 nt, Human
uggagaaggggcagggucucca

SEQ ID NO: 468956 - RNA, 22 nt, Human
ggcaaaaaccacaauuacuuuu

SEQ ID NO: 468957 - RNA, 22 nt, Human
caggggccggcuguccgugccc

SEQ ID NO: 468958 - RNA, 22 nt, Human
agaagccagauuguagugggac

SEQ ID NO: 468959 - RNA, 22 nt, Human
cugcuguguaucauuuuagaug

SEQ ID NO: 468960 - RNA, 22 nt, Human
ugcauauugugaaaauguagau

SEQ ID NO: 468961 - RNA, 22 nt, Human
gugcuugggggaaguaacagac

SEQ ID NO: 468962 - RNA, 22 nt, Human
auacaucuugucagauucaugu

SEQ ID NO: 468963 - RNA, 22 nt, Human
uccagagguauguagagaguau

SEQ ID NO: 468964 - RNA, 22 nt, Human
caggagaagguuuggagugcag

SEQ ID NO: 468965 - RNA, 22 nt, Human
cccagggucccugcucucugug

SEQ ID NO: 468966 - RNA, 22 nt, Human
aaaugcuguaacugauauucug

SEQ ID NO: 468967 - RNA, 22 nt, Human
uacauucuacuuuuucacuccc

SEQ ID NO: 468968 - RNA, 22 nt, Human
auggggagagaagggcugagcu

SEQ ID NO: 468969 - RNA, 22 nt, Human
ggccuguccagccugccuggcu

SEQ ID NO: 468970 - RNA, 20 nt, Human
aaucagaaagugugagcucu

SEQ ID NO: 468971 - RNA, 22 nt, Human
cugccugugccaaugcuccuuu

SEQ ID NO: 468972 - RNA, 22 nt, Human
agacaucagcuugugugcaggg

SEQ ID NO: 468973 - RNA, 20 nt, Human
ccaagagcaugcaugaggaa

SEQ ID NO: 468974 - RNA, 22 nt, Human
accaaagggcagaacaugagca

SEQ ID NO: 468975 - RNA, 18 nt, Human
cuccagggaacucaguca

SEQ ID NO: 468976 - RNA, 22 nt, Human
ccucagccuuggccccaggcag

SEQ ID NO: 468977 - RNA, 22 nt, Human
gaggcugcugagagcccuguuu

SEQ ID NO: 468978 - RNA, 23 nt, Human
uccagcagccaagaaggguagaa

SEQ ID NO: 468979 - RNA, 22 nt, Human
uaagaacagugucugucucaca

SEQ ID NO: 468980 - RNA, 22 nt, Human
gggagcuguaguccagauaccg

SEQ ID NO: 468981 - RNA, 22 nt, Human
gcugggcuucucaaugcugccu

SEQ ID NO: 468982 - RNA, 22 nt, Human
caagagcucaccggagagcauu

SEQ ID NO: 468983 - RNA, 22 nt, Human
agcaggcuccuuccuucucugg

SEQ ID NO: 468984 - RNA, 22 nt, Human
cagggacccuacuagcucacac

SEQ ID NO: 468985 - RNA, 22 nt, Human
uuucuuagcgaugcuugauaaa

SEQ ID NO: 468986 - RNA, 22 nt, Human
acaaguaccaaaugcucaagua

SEQ ID NO: 468987 - RNA, 21 nt, Human
uggcucuguucaauauaugga

SEQ ID NO: 468988 - RNA, 22 nt, Human
cccuuccuugugacuggugggg

SEQ ID NO: 468989 - RNA, 19 nt, Human
ucacaggcaucuccccaga

SEQ ID NO: 468990 - RNA, 22 nt, Human
guaacaaaguuucuaggugcug

SEQ ID NO: 468991 - RNA, 22 nt, Human
aggacucaucccugcuugucag

SEQ ID NO: 468992 - RNA, 22 nt, Human
ccaccuccaccuauugccagcc

SEQ ID NO: 468993 - RNA, 22 nt, Human
ugcucacugaacucuugcuguc

SEQ ID NO: 468994 - RNA, 22 nt, Human
uuagagccaguuacaaggucaa

SEQ ID NO: 468995 - RNA, 22 nt, Human
agccuggagaagauguguauug

SEQ ID NO: 468996 - RNA, 22 nt, Human
aaguucaaucagaugaaaaagc

SEQ ID NO: 468997 - RNA, 22 nt, Human
uggcaccugaacuuagaggugu

SEQ ID NO: 468998 - RNA, 22 nt, Human
gcuggccugggcucaagaccag

SEQ ID NO: 468999 - RNA, 21 nt, Human
ccagagccugcugagcccccu

SEQ ID NO: 469000 - RNA, 22 nt, Human
cugcagggagaggggacagccu

SEQ ID NO: 469001 - RNA, 21 nt, Human
gcucuuggaaggggcucagcu

SEQ ID NO: 469002 - RNA, 22 nt, Human
caucagcaggcaacacucuugg

SEQ ID NO: 469003 - RNA, 22 nt, Human
uguacauugucacucaucaagu

SEQ ID NO: 469004 - RNA, 22 nt, Human
aggcuucagaugaccuuagcau

SEQ ID NO: 469005 - RNA, 22 nt, Human
aggcaggggagcuggaagggua

SEQ ID NO: 469006 - RNA, 22 nt, Human
gauuuagagaauguuuuguaag

SEQ ID NO: 469007 - RNA, 20 nt, Human
gccaacgcgcuggggcugcc

SEQ ID NO: 469008 - RNA, 18 nt, Human
cauaauuuucuuucuuua

SEQ ID NO: 469009 - RNA, 22 nt, Human
aggguggggugcuacaucuuua

SEQ ID NO: 469010 - RNA, 22 nt, Human
gaaaacacuuugaucugaaagu

SEQ ID NO: 469011 - RNA, 22 nt, Human
auccacccugugguggcuuucu

SEQ ID NO: 469012 - RNA, 22 nt, Human
agccucuggcccuagacugcuu

SEQ ID NO: 469013 - RNA, 22 nt, Human
caugaauauuuaguauuuacuu

SEQ ID NO: 469014 - RNA, 22 nt, Human
gauuuccuugcauauugguaau

SEQ ID NO: 469015 - RNA, 22 nt, Human
caguuuauuuccaagaugacaa

SEQ ID NO: 469016 - RNA, 22 nt, Human
cagcuggaugggagaccauguu

SEQ ID NO: 469017 - RNA, 22 nt, Human
aggcaggaacccugugugcgcc

SEQ ID NO: 469018 - RNA, 22 nt, Human
ggcugcagauagccagccacca

SEQ ID NO: 469019 - RNA, 22 nt, Human
cugagcugcuuugcuuuugggg

SEQ ID NO: 469020 - RNA, 22 nt, Human
cuuggcugucuauaggaaagag

SEQ ID NO: 469021 - RNA, 22 nt, Human
cuggagaggccccaagauauuu

SEQ ID NO: 469022 - RNA, 22 nt, Human
ggcagugacuguucagacgucc

SEQ ID NO: 469023 - RNA, 22 nt, Human
ucagagaguccuggucauuugc

SEQ ID NO: 469024 - RNA, 22 nt, Human
accaugccaguggcagccagac

SEQ ID NO: 469025 - RNA, 22 nt, Human
ccaggccuuucuucuuggucug

SEQ ID NO: 469026 - RNA, 22 nt, Human
auguuucaucaguaagguuuug

SEQ ID NO: 469027 - RNA, 22 nt, Human
cccuggaagguucucuggcuca

SEQ ID NO: 469028 - RNA, 22 nt, Human
agucauaauuauaaacaucagu

SEQ ID NO: 469029 - RNA, 22 nt, Human
gaggcagugucgguggcaggau

SEQ ID NO: 469030 - RNA, 22 nt, Human
ucauuuaauugguuuugcucgu

SEQ ID NO: 469031 - RNA, 22 nt, Human
aucuggcuauugacauguuaua

SEQ ID NO: 469032 - RNA, 22 nt, Human
cacagcagaaaguguaggagga

SEQ ID NO: 469033 - RNA, 22 nt, Human
cagggcuccaugcagggacucc

SEQ ID NO: 469034 - RNA, 22 nt, Human
uacuguuuuuuagacucauggu

SEQ ID NO: 469035 - RNA, 22 nt, Human
cucugguucagggcucccuggc

SEQ ID NO: 469036 - RNA, 20 nt, Human
cugccuggaggccucuaccu

SEQ ID NO: 469037 - RNA, 22 nt, Human
auugauaucaguuugcugauug

SEQ ID NO: 469038 - RNA, 22 nt, Human
aggcccagacucagcggggcgg

SEQ ID NO: 469039 - RNA, 20 nt, Human
aagaaacuugaaaguacaag

SEQ ID NO: 469040 - RNA, 22 nt, Human
aggccuguuccuuccugggcac

SEQ ID NO: 469041 - RNA, 22 nt, Human
cacauuucuaggaaauuaaaug

SEQ ID NO: 469042 - RNA, 22 nt, Human
aagcagcacgcuuugccaacaa

SEQ ID NO: 469043 - RNA, 22 nt, Human
aggugcaguggcucaugccugu

SEQ ID NO: 469044 - RNA, 22 nt, Human
gcucccugccuacacggaccuu

SEQ ID NO: 469045 - RNA, 22 nt, Human
guguuuccucuagaagccaugg

SEQ ID NO: 469046 - RNA, 22 nt, Human
uccaugugccaaggggcagagg

SEQ ID NO: 469047 - RNA, 22 nt, Human
cauuuauugguuaggccagcag

SEQ ID NO: 469048 - RNA, 23 nt, Human
cugcagccgcguggggacgugga

SEQ ID NO: 469049 - RNA, 21 nt, Human
gaaggagaaagcaagugcugc

SEQ ID NO: 469050 - RNA, 22 nt, Human
agauguggccggcuagggagag

SEQ ID NO: 469051 - RNA, 19 nt, Human
ggucucagugcagcugcag

SEQ ID NO: 469052 - RNA, 22 nt, Human
gagaagguggaccugaaggagc

SEQ ID NO: 469053 - RNA, 22 nt, Human
ucaguuuugaaaacauugaaug

SEQ ID NO: 469054 - RNA, 22 nt, Human
aagggcugagcacagugagcca

SEQ ID NO: 469055 - RNA, 22 nt, Human
cucuggagaugguucucaauug

SEQ ID NO: 469056 - RNA, 22 nt, Human
gggaagccaugcucagagguac

SEQ ID NO: 469057 - RNA, 22 nt, Human
uggcugaguguuccaaggagca

SEQ ID NO: 469058 - RNA, 22 nt, Human
uuuuggucagguuggucucgaa

SEQ ID NO: 469059 - RNA, 22 nt, Human
aaugcagugagccauuaaaugg

SEQ ID NO: 469060 - RNA, 21 nt, Human
gccaaggggguagcuauuccu

SEQ ID NO: 469061 - RNA, 22 nt, Human
uuuuaucuaccuaugcucauuu

SEQ ID NO: 469062 - RNA, 22 nt, Human
aaaauguguuuaugcauuucgu

SEQ ID NO: 469063 - RNA, 22 nt, Human
caaagccaggcuuucuaaugua

SEQ ID NO: 469064 - RNA, 22 nt, Human
agaggcaguauacaauccgagc

SEQ ID NO: 469065 - RNA, 20 nt, Human
ugcuccaucuaaagugauua

SEQ ID NO: 469066 - RNA, 18 nt, Human
gagcugccauauuuaguu

SEQ ID NO: 469067 - RNA, 22 nt, Human
cacagaagaaucaugcuguguu

SEQ ID NO: 469068 - RNA, 23 nt, Human
gcugucugucaucucugcgggag

SEQ ID NO: 469069 - RNA, 22 nt, Human
gcucccagauuucagccuugug

SEQ ID NO: 469070 - RNA, 22 nt, Human
auuuucaucgcuagguuggccu

SEQ ID NO: 469071 - RNA, 22 nt, Human
uagacacaagagaaggguauaa

SEQ ID NO: 469072 - RNA, 22 nt, Human
ucucagagaagugaugagcaau

SEQ ID NO: 469073 - RNA, 22 nt, Human
agcagccaguucucugugguag

SEQ ID NO: 469074 - RNA, 22 nt, Human
gucccagggaagaaggcagcac

SEQ ID NO: 469075 - RNA, 22 nt, Human
gcauuauuaauagcugcaugag

SEQ ID NO: 469076 - RNA, 22 nt, Human
gcugucacacaugggaucucag

SEQ ID NO: 469077 - RNA, 21 nt, Human
gcugccaccgcgugcuccagg

SEQ ID NO: 469078 - RNA, 22 nt, Human
guagggacaugccauuaucuca

SEQ ID NO: 469079 - RNA, 17 nt, Human
gugcagggaugaaggau

SEQ ID NO: 469080 - RNA, 22 nt, Human
ucacugcugcugccaugaugga

SEQ ID NO: 469081 - RNA, 22 nt, Human
aaggcuuuugggaauuuucaac

SEQ ID NO: 469082 - RNA, 22 nt, Human
cugauuccugauucaugcucuu

SEQ ID NO: 469083 - RNA, 22 nt, Human
uaaggccaaacuauuauaguuc

SEQ ID NO: 469084 - RNA, 22 nt, Human
agcaggaacucagggaguucuc

SEQ ID NO: 469085 - RNA, 22 nt, Human
guggcugcuaagucuccuuccu

SEQ ID NO: 469086 - RNA, 19 nt, Human
caaggccaccauuucuccg

SEQ ID NO: 469087 - RNA, 22 nt, Human
agggggcaggagagaccugcug

SEQ ID NO: 469088 - RNA, 22 nt, Human
gcagcuuuaaucugaauaagua

SEQ ID NO: 469089 - RNA, 22 nt, Human
gagaagccgagucagcugagcc

SEQ ID NO: 469090 - RNA, 22 nt, Human
ccaguggaauuaaaaauaagug

SEQ ID NO: 469091 - RNA, 22 nt, Human
cagggcagaacauauagauagu

SEQ ID NO: 469092 - RNA, 22 nt, Human
caguucuaauuaauaggaguaa

SEQ ID NO: 469093 - RNA, 22 nt, Human
uauauuaacacccacuugccuc

SEQ ID NO: 469094 - RNA, 22 nt, Human
gcuugaaaauucauagguauuu

SEQ ID NO: 469095 - RNA, 22 nt, Human
gagagcuguccggcugagcagc

SEQ ID NO: 469096 - RNA, 22 nt, Human
cccaggaguaagugacauuguu

SEQ ID NO: 469097 - RNA, 22 nt, Human
ugggaggaucgcuugagcccag

SEQ ID NO: 469098 - RNA, 22 nt, Human
gcugucugacuccaaguuggag

SEQ ID NO: 469099 - RNA, 22 nt, Human
uaugaagacaaugauagcauga

SEQ ID NO: 469100 - RNA, 22 nt, Human
caggguccggcugccuggcugu

SEQ ID NO: 469101 - RNA, 22 nt, Human
aggagagucuugagucacuggu

SEQ ID NO: 469102 - RNA, 22 nt, Human
aaacuugauuuagaacuaaggc

SEQ ID NO: 469103 - RNA, 22 nt, Human
ccacagggauaggaauggggcu

SEQ ID NO: 469104 - RNA, 22 nt, Human
gguggccugcccugaucccugg

SEQ ID NO: 469105 - RNA, 22 nt, Human
agagaugaaaaguggagacugg

SEQ ID NO: 469106 - RNA, 22 nt, Human
ccuggccacucagguguggggc

SEQ ID NO: 469107 - RNA, 22 nt, Human
gaugaggggucauuggcuggga

SEQ ID NO: 469108 - RNA, 22 nt, Human
agcagcaucaacccucccgugu

SEQ ID NO: 469109 - RNA, 22 nt, Human
aggcugcuggcaggcguggacg

SEQ ID NO: 469110 - RNA, 22 nt, Human
agugucugccaacugcaugguc

SEQ ID NO: 469111 - RNA, 22 nt, Human
gcucccaggaagagaagggcca

SEQ ID NO: 469112 - RNA, 22 nt, Human
cagagcagggguuucccagguu

SEQ ID NO: 469113 - RNA, 22 nt, Human
uaaggcauucucaugcugugaa

SEQ ID NO: 469114 - RNA, 22 nt, Human
caggggacauuaaagcuccaua

SEQ ID NO: 469115 - RNA, 22 nt, Human
ucccucuguguugggcaugccu

SEQ ID NO: 469116 - RNA, 22 nt, Human
aagauacauaaagguagagucu

SEQ ID NO: 469117 - RNA, 22 nt, Human
ccaggccuguguuguguggagg

SEQ ID NO: 469118 - RNA, 22 nt, Human
acagcuguggggacucuugccc

SEQ ID NO: 469119 - RNA, 22 nt, Human
ccagcagcccucuuccaagacu

SEQ ID NO: 469120 - RNA, 22 nt, Human
cccucccagaugggcuugaggu

SEQ ID NO: 469121 - RNA, 20 nt, Human
cacagcuugccuuuuaugac

SEQ ID NO: 469122 - RNA, 22 nt, Human
cugggagaugacucagagcagg

SEQ ID NO: 469123 - RNA, 22 nt, Human
ugcugccuccaacuccugggcu

SEQ ID NO: 469124 - RNA, 22 nt, Human
cucccaagcugugcugaacugu

SEQ ID NO: 469125 - RNA, 22 nt, Human
acucaagauagggaaaguacaa

SEQ ID NO: 469126 - RNA, 22 nt, Human
uugaaagugccaaguccuagug

SEQ ID NO: 469127 - RNA, 22 nt, Human
aguauggggcugugugugcaca

SEQ ID NO: 469128 - RNA, 21 nt, Human
ucccagggccaggugccauca

SEQ ID NO: 469129 - RNA, 22 nt, Human
ucccagagccucugccacucug

SEQ ID NO: 469130 - RNA, 22 nt, Human
cuguacagaguucugaguguac

SEQ ID NO: 469131 - RNA, 22 nt, Human
ggggaugguagaccggugacgu

SEQ ID NO: 469132 - RNA, 22 nt, Human
aggcucagacaggaaaaguaac

SEQ ID NO: 469133 - RNA, 21 nt, Human
uugaaggaucacuucuguacc

SEQ ID NO: 469134 - RNA, 22 nt, Human
ggccaggcugcugggaccccgc

SEQ ID NO: 469135 - RNA, 21 nt, Human
cagcuucuucugugaccuggu

SEQ ID NO: 469136 - RNA, 22 nt, Human
guuagaaagugucugcuugggu

SEQ ID NO: 469137 - RNA, 22 nt, Human
cuuagggaauugggaggaugcc

SEQ ID NO: 469138 - RNA, 22 nt, Human
ugcaggugaaaauuaugaggau

SEQ ID NO: 469139 - RNA, 22 nt, Human
cacaugaugguggaagccauag

SEQ ID NO: 469140 - RNA, 22 nt, Human
cucuggaguucucaugaggaac

SEQ ID NO: 469141 - RNA, 22 nt, Human
uuugcauugcauacaaggaacu

SEQ ID NO: 469142 - RNA, 22 nt, Human
uguggcuguguccaccugcugc

SEQ ID NO: 469143 - RNA, 22 nt, Human
ucugucugcucauuuaccucag

SEQ ID NO: 469144 - RNA, 23 nt, Human
cagaggguuccauggagcauggu

SEQ ID NO: 469145 - RNA, 22 nt, Human
aagggcucuguugccauuucag

SEQ ID NO: 469146 - RNA, 22 nt, Human
acagggcagagggcaguuggua

SEQ ID NO: 469147 - RNA, 22 nt, Human
uaguuaggaaaguccagggagc

SEQ ID NO: 469148 - RNA, 22 nt, Human
ucuacuguagugaugcugcagu

SEQ ID NO: 469149 - RNA, 22 nt, Human
ucuguacacuucagcaugcauc

SEQ ID NO: 469150 - RNA, 22 nt, Human
aaggaagguucauagucaaaga

SEQ ID NO: 469151 - RNA, 22 nt, Human
uucccucuccuacucaggaaag

SEQ ID NO: 469152 - RNA, 22 nt, Human
gcacagggcaacaggucuguua

SEQ ID NO: 469153 - RNA, 22 nt, Human
ucaggggcccuucccucagcag

SEQ ID NO: 469154 - RNA, 22 nt, Human
cuggcagcgugagcagcaucca

SEQ ID NO: 469155 - RNA, 22 nt, Human
ugacauuucgguguaugugaug

SEQ ID NO: 469156 - RNA, 18 nt, Human
ugaauagggguuugcaga

SEQ ID NO: 469157 - RNA, 22 nt, Human
gggugcagggucuccagcagcu

SEQ ID NO: 469158 - RNA, 22 nt, Human
ccuggccagccagggcuggggu

SEQ ID NO: 469159 - RNA, 22 nt, Human
ggcuguggcauuaggugaggcc

SEQ ID NO: 469160 - RNA, 22 nt, Human
gccuggaguagcauggcaagcc

SEQ ID NO: 469161 - RNA, 22 nt, Human
ucuggcucucucaucacccaau

SEQ ID NO: 469162 - RNA, 22 nt, Human
ggcacugaucugauuucccucc

SEQ ID NO: 469163 - RNA, 19 nt, Human
ggcugcugguuacagaggc

SEQ ID NO: 469164 - RNA, 22 nt, Human
gagcagugggaaggaacagggu

SEQ ID NO: 469165 - RNA, 22 nt, Human
aaugcacaugccacauguggua

SEQ ID NO: 469166 - RNA, 22 nt, Human
gcuggcaucacuggcuucggug

SEQ ID NO: 469167 - RNA, 22 nt, Human
aggcucuguuauucuagagggc

SEQ ID NO: 469168 - RNA, 22 nt, Human
aucagcaagcaugguuaggugu

SEQ ID NO: 469169 - RNA, 22 nt, Human
cuuauuagaguuguguucuguu

SEQ ID NO: 469170 - RNA, 22 nt, Human
cccagggacagaugggcagcua

SEQ ID NO: 469171 - RNA, 22 nt, Human
cagaggcugaugugggaugggc

SEQ ID NO: 469172 - RNA, 23 nt, Human
uguugaaguaacuguuacauaga

SEQ ID NO: 469173 - RNA, 22 nt, Human
cuggagcuccagggucuccucu

SEQ ID NO: 469174 - RNA, 22 nt, Human
ccuggccagaggcgugccugug

SEQ ID NO: 469175 - RNA, 22 nt, Human
uggcacauagcagguacucagu

SEQ ID NO: 469176 - RNA, 22 nt, Human
aaaggagacuucagaucuccuu

SEQ ID NO: 469177 - RNA, 22 nt, Human
cugccucuauaggaguccacca

SEQ ID NO: 469178 - RNA, 22 nt, Human
gagcuggaagucuguggucaga

SEQ ID NO: 469179 - RNA, 22 nt, Human
cagagagcaugggaggcccgag

SEQ ID NO: 469180 - RNA, 22 nt, Human
gaacagaauuaccgaagaucug

SEQ ID NO: 469181 - RNA, 22 nt, Human
ccagagcuucggggcggcugua

SEQ ID NO: 469182 - RNA, 22 nt, Human
uguacaguguagucaugagguu

SEQ ID NO: 469183 - RNA, 22 nt, Human
ggccagagucuauaugcagaca

SEQ ID NO: 469184 - RNA, 18 nt, Human
uccgaggcaccauaaaaa

SEQ ID NO: 469185 - RNA, 22 nt, Human
aggcucagauccuuguguccug

SEQ ID NO: 469186 - RNA, 22 nt, Human
ugaggcucagugagcccugcag

SEQ ID NO: 469187 - RNA, 22 nt, Human
agccuucaaccuagcuagagca

SEQ ID NO: 469188 - RNA, 22 nt, Human
ucucuggagcugcagauccagg

SEQ ID NO: 469189 - RNA, 20 nt, Human
gaggaaaagcugccaggccu

SEQ ID NO: 469190 - RNA, 22 nt, Human
gcuguacaguuuacuagguggg

SEQ ID NO: 469191 - RNA, 22 nt, Human
gucaggaugagggaugaggagu

SEQ ID NO: 469192 - RNA, 22 nt, Human
auauguguauuugguuagccua

SEQ ID NO: 469193 - RNA, 20 nt, Human
caggcaguuugugguuaggg

SEQ ID NO: 469194 - RNA, 22 nt, Human
ccucuggggugagugggccacu

SEQ ID NO: 469195 - RNA, 22 nt, Human
ugaggaaacugaggcacagaug

SEQ ID NO: 469196 - RNA, 22 nt, Human
cccugggcagucugcacuucag

SEQ ID NO: 469197 - RNA, 22 nt, Human
accaucagucauugucaguggg

SEQ ID NO: 469198 - RNA, 22 nt, Human
gggcugaguuccugccucacuc

SEQ ID NO: 469199 - RNA, 22 nt, Human
uggagaugcacgagcaggugga

SEQ ID NO: 469200 - RNA, 22 nt, Human
aucaguuugagugcugugucaa

SEQ ID NO: 469201 - RNA, 18 nt, Human
cagauccaggcagcuauu

SEQ ID NO: 469202 - RNA, 21 nt, Human
agggcagauuagcuguaagag

SEQ ID NO: 469203 - RNA, 22 nt, Human
ugaagccauuacuguguuaggg

SEQ ID NO: 469204 - RNA, 22 nt, Human
cuggcagccaagugggauacuc

SEQ ID NO: 469205 - RNA, 22 nt, Human
cagcauugaucccaggcugugg

SEQ ID NO: 469206 - RNA, 22 nt, Human
uggaguucauccaugacagcuu

SEQ ID NO: 469207 - RNA, 22 nt, Human
gaacagcccuguuaagucuguu

SEQ ID NO: 469208 - RNA, 22 nt, Human
caguuuuuagauuaguuggugg

SEQ ID NO: 469209 - RNA, 22 nt, Human
aaggugucggguuagcucagcc

SEQ ID NO: 469210 - RNA, 22 nt, Human
ccugccugguguaagucuaagg

SEQ ID NO: 469211 - RNA, 22 nt, Human
auuucucaguguacauuauguu

SEQ ID NO: 469212 - RNA, 22 nt, Human
auuuuuaugacaaaccauccuc

SEQ ID NO: 469213 - RNA, 22 nt, Human
aaaagguagauucuccuucuau

SEQ ID NO: 469214 - RNA, 21 nt, Human
ucaaagcacauauuugcacau

SEQ ID NO: 469215 - RNA, 22 nt, Human
acaguggagaaggcaugaggcu

SEQ ID NO: 469216 - RNA, 22 nt, Human
guccuggcuuaguucgcuguaa

SEQ ID NO: 469217 - RNA, 22 nt, Human
caggggacaguaugguggauga

SEQ ID NO: 469218 - RNA, 22 nt, Human
uaacagaaauuuuaguuagggg

SEQ ID NO: 469219 - RNA, 22 nt, Human
gaggcagagguuguugcaguga

SEQ ID NO: 469220 - RNA, 22 nt, Human
aggcuggggaauugaauuugcu

SEQ ID NO: 469221 - RNA, 22 nt, Human
cccuggaguccuggcaguugau

SEQ ID NO: 469222 - RNA, 22 nt, Human
cucuggagguugagcccagcaa

SEQ ID NO: 469223 - RNA, 22 nt, Human
gacauaauaaucugaccuagau

SEQ ID NO: 469224 - RNA, 22 nt, Human
uaauguguccugaaagcuucug

SEQ ID NO: 469225 - RNA, 22 nt, Human
ugaacagauggcccagcagagg

SEQ ID NO: 469226 - RNA, 22 nt, Human
gagggcucugaaaggaggucac

SEQ ID NO: 469227 - RNA, 22 nt, Human
acagaaauuagcagugaguuua

SEQ ID NO: 469228 - RNA, 21 nt, Human
uccugcagggcagcagagugg

SEQ ID NO: 469229 - RNA, 22 nt, Human
uauuucuaagcuguaagucuga

SEQ ID NO: 469230 - RNA, 22 nt, Human
gcagagugagauaugaacccag

SEQ ID NO: 469231 - RNA, 22 nt, Human
aaugccaguguguugauuccag

SEQ ID NO: 469232 - RNA, 22 nt, Human
ugccaggcauuugacagacacu

SEQ ID NO: 469233 - RNA, 22 nt, Human
agggcacccucucugcaguacc

SEQ ID NO: 469234 - RNA, 22 nt, Human
gagcagcuguccccaaagcuuc

SEQ ID NO: 469235 - RNA, 22 nt, Human
cuggcucauuuuagcaucaggu

SEQ ID NO: 469236 - RNA, 22 nt, Human
aucaggauguuuggcugucaua

SEQ ID NO: 469237 - RNA, 22 nt, Human
aaaugucuuugaguauuucugc

SEQ ID NO: 469238 - RNA, 22 nt, Human
uggaagcacuuggguuuuguug

SEQ ID NO: 469239 - RNA, 22 nt, Human
gggacuguaaauucauauggcc

SEQ ID NO: 469240 - RNA, 22 nt, Human
uggcuccuaggauggugccugg

SEQ ID NO: 469241 - RNA, 22 nt, Human
aguuucuaccgguacauucagg

SEQ ID NO: 469242 - RNA, 22 nt, Human
ugggccacaagccaugggacca

SEQ ID NO: 469243 - RNA, 22 nt, Human
auaguguuacccuucuuaaagu

SEQ ID NO: 469244 - RNA, 21 nt, Human
aaagagcccgcugagagguuc

SEQ ID NO: 469245 - RNA, 20 nt, Human
ucauuguguugccaauuccc

SEQ ID NO: 469246 - RNA, 22 nt, Human
ccagaagacaagaauguucuua

SEQ ID NO: 469247 - RNA, 22 nt, Human
cagaggaaaugggaaggagaua

SEQ ID NO: 469248 - RNA, 22 nt, Human
cucuguccacagguuugucccu

SEQ ID NO: 469249 - RNA, 22 nt, Human
gaguggggucugggcaucaguc

SEQ ID NO: 469250 - RNA, 22 nt, Human
auauucguggucaaguaaggcc

SEQ ID NO: 469251 - RNA, 22 nt, Human
acugaaauacugcucuuggauu

SEQ ID NO: 469252 - RNA, 22 nt, Human
caaagucagccagcuaguaggu

SEQ ID NO: 469253 - RNA, 22 nt, Human
guuaauuuaguagaguccagau

SEQ ID NO: 469254 - RNA, 22 nt, Human
ugauucuauggaaggcauaagg

SEQ ID NO: 469255 - RNA, 22 nt, Human
agauacaucauuuauaccuuca

SEQ ID NO: 469256 - RNA, 22 nt, Human
ugugccuuaugaauucuuucug

SEQ ID NO: 469257 - RNA, 22 nt, Human
ggccuagggaguggccaugccu

SEQ ID NO: 469258 - RNA, 20 nt, Human
ucugugugccaucaccuaac

SEQ ID NO: 469259 - RNA, 22 nt, Human
ucuuugcaggagcccuuugaac

SEQ ID NO: 469260 - RNA, 22 nt, Human
aucaggaucacugggagucuug

SEQ ID NO: 469261 - RNA, 22 nt, Human
cugccagccaggccagguaggc

SEQ ID NO: 469262 - RNA, 22 nt, Human
uagucccauuuugagguauuug

SEQ ID NO: 469263 - RNA, 22 nt, Human
uuucagauuaucucaacuuugg

SEQ ID NO: 469264 - RNA, 23 nt, Human
gccuggccaccccagggcugcuu

SEQ ID NO: 469265 - RNA, 22 nt, Human
uacuuuagaaggaaauaaguuc

SEQ ID NO: 469266 - RNA, 22 nt, Human
gcuuuccuggcccugucccugc

SEQ ID NO: 469267 - RNA, 22 nt, Human
cauccacuagaaugacagaguu

SEQ ID NO: 469268 - RNA, 22 nt, Human
gcccucugcuggccucaccucg

SEQ ID NO: 469269 - RNA, 22 nt, Human
agccuguggaucccugcacugg

SEQ ID NO: 469270 - RNA, 22 nt, Human
ucagugucuugaccugggugug

SEQ ID NO: 469271 - RNA, 22 nt, Human
cccucugccucugaguaggaca

SEQ ID NO: 469272 - RNA, 22 nt, Human
gggcugagucaucuggggccuc

SEQ ID NO: 469273 - RNA, 22 nt, Human
ucacaagacagaaaacauuuag

SEQ ID NO: 469274 - RNA, 22 nt, Human
aucuccaggcauuucaagagac

SEQ ID NO: 469275 - RNA, 22 nt, Human
cucaggaguaguucagcagcug

SEQ ID NO: 469276 - RNA, 22 nt, Human
acccagccacagcauugaggga

SEQ ID NO: 469277 - RNA, 22 nt, Human
uuauuauaaugagggauaaaaa

SEQ ID NO: 469278 - RNA, 22 nt, Human
ccagcugauucgguggugguug

SEQ ID NO: 469279 - RNA, 22 nt, Human
acaguggaguugggguagcccu

SEQ ID NO: 469280 - RNA, 22 nt, Human
ggaagccaggccaaugagaaca

SEQ ID NO: 469281 - RNA, 21 nt, Human
gcucucugcaugguggcucag

SEQ ID NO: 469282 - RNA, 22 nt, Human
uaagacauuugaaaugugaucc

SEQ ID NO: 469283 - RNA, 22 nt, Human
ucugggcagcagcagcuaguag

SEQ ID NO: 469284 - RNA, 22 nt, Human
caggaggcaucauggagcggac

SEQ ID NO: 469285 - RNA, 22 nt, Human
gcugcagcuguaggacacaauu

SEQ ID NO: 469286 - RNA, 22 nt, Human
uggcccgaccucugcucaugca

SEQ ID NO: 469287 - RNA, 22 nt, Human
ggccugagucccaccuggcugu

SEQ ID NO: 469288 - RNA, 22 nt, Human
agagugucugguagcugcucug

SEQ ID NO: 469289 - RNA, 22 nt, Human
cauuagggucucucagcugaau

SEQ ID NO: 469290 - RNA, 22 nt, Human
agcagaugagccucaugacugg

SEQ ID NO: 469291 - RNA, 22 nt, Human
caggggcuuaagugacagaagg

SEQ ID NO: 469292 - RNA, 22 nt, Human
caguucaggccggcugacucag

SEQ ID NO: 469293 - RNA, 22 nt, Human
uucucuuagcuguaaagucaau

SEQ ID NO: 469294 - RNA, 22 nt, Human
uuguuuuggaagaacuuacucu

SEQ ID NO: 469295 - RNA, 22 nt, Human
caaaauguucuggcaccuuuaa

SEQ ID NO: 469296 - RNA, 22 nt, Human
ggugggcaggcgaggcccaggu

SEQ ID NO: 469297 - RNA, 22 nt, Human
ccacugucagaggggcugugcc

SEQ ID NO: 469298 - RNA, 22 nt, Human
gucccaggcagagucaggaggg

SEQ ID NO: 469299 - RNA, 22 nt, Human
aggggcugcuggguccgccccu

SEQ ID NO: 469300 - RNA, 21 nt, Human
uucuucaugaugauuaauggc

SEQ ID NO: 469301 - RNA, 22 nt, Human
acucugugugaguagagccugu

SEQ ID NO: 469302 - RNA, 22 nt, Human
cgggcuccgggucuuugcaguc

SEQ ID NO: 469303 - RNA, 23 nt, Human
agucucagcuggaaacauguguc

SEQ ID NO: 469304 - RNA, 22 nt, Human
cucuggaguuagugaucugggc

SEQ ID NO: 469305 - RNA, 18 nt, Human
ucagagagcagcuuuauu

SEQ ID NO: 469306 - RNA, 22 nt, Human
aacuagaaaacaagaugcugau

SEQ ID NO: 469307 - RNA, 22 nt, Human
ccugcacuaccuggggcugcug

SEQ ID NO: 469308 - RNA, 22 nt, Human
ggcuccagggaguggagagaag

SEQ ID NO: 469309 - RNA, 20 nt, Human
agaaucugacccagagagac

SEQ ID NO: 469310 - RNA, 22 nt, Human
aguuuuaugcaguguucugaua

SEQ ID NO: 469311 - RNA, 22 nt, Human
cucccugguguccccuccagga

SEQ ID NO: 469312 - RNA, 22 nt, Human
uaaaauguguuucuguaugguu

SEQ ID NO: 469313 - RNA, 20 nt, Human
cagaggcaaggagacuugga

SEQ ID NO: 469314 - RNA, 22 nt, Human
caaagggcucuagacucagcag

SEQ ID NO: 469315 - RNA, 22 nt, Human
uggccugcagcucucagggaag

SEQ ID NO: 469316 - RNA, 22 nt, Human
cugcuuugaaaauaaacuuguc

SEQ ID NO: 469317 - RNA, 22 nt, Human
uaaaauagcaugugcagugaaa

SEQ ID NO: 469318 - RNA, 22 nt, Human
uccauucuaugcuuacauuuau

SEQ ID NO: 469319 - RNA, 22 nt, Human
gcagccucagggcacucagaug

SEQ ID NO: 469320 - RNA, 22 nt, Human
uucagcagucguccaggaaaag

SEQ ID NO: 469321 - RNA, 22 nt, Human
ccugcuggccaguggagggcug

SEQ ID NO: 469322 - RNA, 22 nt, Human
uucucuugugccaaguuguugc

SEQ ID NO: 469323 - RNA, 22 nt, Human
auuaaauuuucacuaggcuccc

SEQ ID NO: 469324 - RNA, 22 nt, Human
gggccaggucggugaaugguca

SEQ ID NO: 469325 - RNA, 22 nt, Human
uaugcauaauuggauaaguaga

SEQ ID NO: 469326 - RNA, 22 nt, Human
acgugcaggaucugguuggcga

SEQ ID NO: 469327 - RNA, 22 nt, Human
caggccuggagugcaauggcac

SEQ ID NO: 469328 - RNA, 22 nt, Human
ggcagauggagaagcagcaggu

SEQ ID NO: 469329 - RNA, 22 nt, Human
agccaggccuuuucucaagguu

SEQ ID NO: 469330 - RNA, 22 nt, Human
ugucaugccauuuaaaauguuu

SEQ ID NO: 469331 - RNA, 22 nt, Human
auguuuauguugggcuauauuu

SEQ ID NO: 469332 - RNA, 22 nt, Human
gggcugagcuaagcuggguuga

SEQ ID NO: 469333 - RNA, 22 nt, Human
cagcuucucagaaagcugaggu

SEQ ID NO: 469334 - RNA, 22 nt, Human
ccagagcugaugggcccagggu

SEQ ID NO: 469335 - RNA, 22 nt, Human
uuauucugcacuuuuaaaauau

SEQ ID NO: 469336 - RNA, 22 nt, Human
aucagaagaaauggaugugacu

SEQ ID NO: 469337 - RNA, 22 nt, Human
aacauaaauuugaaguggcaaa

SEQ ID NO: 469338 - RNA, 22 nt, Human
ccaggacuuuaaguccagcacu

SEQ ID NO: 469339 - RNA, 23 nt, Human
gggcuccagucucugcucaguug

SEQ ID NO: 469340 - RNA, 22 nt, Human
cucccaggcacagggaggagcc

SEQ ID NO: 469341 - RNA, 21 nt, Human
ugcagcagaguaagcagggga

SEQ ID NO: 469342 - RNA, 19 nt, Human
cagauguuuucaguucauu

SEQ ID NO: 469343 - RNA, 22 nt, Human
ugucuucaguaaaauacacuau

SEQ ID NO: 469344 - RNA, 21 nt, Human
ccaccaggucuucugcucggg

SEQ ID NO: 469345 - RNA, 22 nt, Human
aggugagguuugggagguguca

SEQ ID NO: 469346 - RNA, 22 nt, Human
cagcuuguuuuauuuggggacc

SEQ ID NO: 469347 - RNA, 22 nt, Human
cccagcucaucaggagccgccc

SEQ ID NO: 469348 - RNA, 21 nt, Human
gggcuggacaugguggcucau

SEQ ID NO: 469349 - RNA, 22 nt, Human
gcugccaccguggagaugagug

SEQ ID NO: 469350 - RNA, 22 nt, Human
guugaaagaugucuugguuccc

SEQ ID NO: 469351 - RNA, 22 nt, Human
cagugcaguuucccagaugcug

SEQ ID NO: 469352 - RNA, 21 nt, Human
uagggcucucugugucaggug

SEQ ID NO: 469353 - RNA, 22 nt, Human
agagaggcgaguuaccugugcu

SEQ ID NO: 469354 - RNA, 22 nt, Human
agccacagagcaggagaccuuu

SEQ ID NO: 469355 - RNA, 22 nt, Human
agaauucuuggugguuagaaua

SEQ ID NO: 469356 - RNA, 22 nt, Human
cugagcccaggcgggagcugag

SEQ ID NO: 469357 - RNA, 22 nt, Human
ugccucagaguugucccuacca

SEQ ID NO: 469358 - RNA, 21 nt, Human
ugcaugcuauguuuuuauuuc

SEQ ID NO: 469359 - RNA, 22 nt, Human
gaggucaggggagaggcugaug

SEQ ID NO: 469360 - RNA, 22 nt, Human
cugggcacaggggagcagaguc

SEQ ID NO: 469361 - RNA, 22 nt, Human
agggccugggucuguacuccuc

SEQ ID NO: 469362 - RNA, 20 nt, Human
cugcuguguuauuguagaac

SEQ ID NO: 469363 - RNA, 22 nt, Human
gcaccaggaggcccuucucauc

SEQ ID NO: 469364 - RNA, 22 nt, Human
uguccuuuaugaaaugguguuu

SEQ ID NO: 469365 - RNA, 22 nt, Human
cagcccugagaaggaggaucuc

SEQ ID NO: 469366 - RNA, 22 nt, Human
ggcugaggcucaugccaucuug

SEQ ID NO: 469367 - RNA, 22 nt, Human
agagccacugggagacagagca

SEQ ID NO: 469368 - RNA, 22 nt, Human
agucccagcucugccacuuacu

SEQ ID NO: 469369 - RNA, 22 nt, Human
uccucuucugcccaucagaggc

SEQ ID NO: 469370 - RNA, 22 nt, Human
aaagauuuaagaauaauuugug

SEQ ID NO: 469371 - RNA, 22 nt, Human
gccugugguuugauuaagcauu

SEQ ID NO: 469372 - RNA, 22 nt, Human
uagcauuucacugaucuucacu

SEQ ID NO: 469373 - RNA, 22 nt, Human
uguggcugacuccuggucccca

SEQ ID NO: 469374 - RNA, 22 nt, Human
gggcugggauggcuugaagauu

SEQ ID NO: 469375 - RNA, 22 nt, Human
ccaggugucuguggccagcccu

SEQ ID NO: 469376 - RNA, 22 nt, Human
gccaggugcuaucccugcgcug

SEQ ID NO: 469377 - RNA, 22 nt, Human
uucuuccucagcagggcugccu

SEQ ID NO: 469378 - RNA, 22 nt, Human
uacaaaguuugagaaugcuuuc

SEQ ID NO: 469379 - RNA, 22 nt, Human
cugguacaaaaugcugauauca

SEQ ID NO: 469380 - RNA, 22 nt, Human
agcauggggcaaugcaugugcu

SEQ ID NO: 469381 - RNA, 22 nt, Human
gaaggcaggcuucugauuaggu

SEQ ID NO: 469382 - RNA, 22 nt, Human
ccacucugcugugcuccaugau

SEQ ID NO: 469383 - RNA, 22 nt, Human
ucagaagcugguguccuuugaa

SEQ ID NO: 469384 - RNA, 22 nt, Human
aucuaggauuugaaugcacagu

SEQ ID NO: 469385 - RNA, 22 nt, Human
ccagcccuccuccaucagagga

SEQ ID NO: 469386 - RNA, 22 nt, Human
ugagaggcagaauggugccugc

SEQ ID NO: 469387 - RNA, 22 nt, Human
uggguagagacacagucugggg

SEQ ID NO: 469388 - RNA, 22 nt, Human
aaggagcucccggcagaccagg

SEQ ID NO: 469389 - RNA, 22 nt, Human
acuugauuuugaaccuuucuac

SEQ ID NO: 469390 - RNA, 22 nt, Human
gcugagguaggagguugcagug

SEQ ID NO: 469391 - RNA, 22 nt, Human
augggcagcagcugccauucau

SEQ ID NO: 469392 - RNA, 19 nt, Human
aggagaaguagcagaaauu

SEQ ID NO: 469393 - RNA, 22 nt, Human
guguccagagaaacucacagcu

SEQ ID NO: 469394 - RNA, 22 nt, Human
ggacccugggcuugcuccuggg

SEQ ID NO: 469395 - RNA, 22 nt, Human
cccuggaggucagaggccuggg

SEQ ID NO: 469396 - RNA, 22 nt, Human
ucuuuccuagaggcugaugagu

SEQ ID NO: 469397 - RNA, 17 nt, Human
ggccuguguggcugcag

SEQ ID NO: 469398 - RNA, 21 nt, Human
gcuccuggugcugcguggcgc

SEQ ID NO: 469399 - RNA, 22 nt, Human
agcugcaguaaagcucuccagg

SEQ ID NO: 469400 - RNA, 22 nt, Human
uacacauguuuggcaaguaugu

SEQ ID NO: 469401 - RNA, 23 nt, Human
cuuuucauugccuuagcgcagag

SEQ ID NO: 469402 - RNA, 22 nt, Human
caggggcaggugugagaucauc

SEQ ID NO: 469403 - RNA, 22 nt, Human
agcaggaguuugaugcuuuuau

SEQ ID NO: 469404 - RNA, 22 nt, Human
ggcuuccuaauacucccuacac

SEQ ID NO: 469405 - RNA, 22 nt, Human
uuuccucuuauacaguguuuau

SEQ ID NO: 469406 - RNA, 22 nt, Human
gucucccacuuucuggccucuu

SEQ ID NO: 469407 - RNA, 22 nt, Human
agcagggccucuggcacugguc

SEQ ID NO: 469408 - RNA, 22 nt, Human
auauuucuccaaauguuuucaa

SEQ ID NO: 469409 - RNA, 22 nt, Human
gcaaagucugcaucuggaucag

SEQ ID NO: 469410 - RNA, 22 nt, Human
agaaauguauagugaauuuuuc

SEQ ID NO: 469411 - RNA, 22 nt, Human
aggggcuggaguucgagguuac

SEQ ID NO: 469412 - RNA, 22 nt, Human
ccacauuuuugauacucucacu

SEQ ID NO: 469413 - RNA, 22 nt, Human
ccagagagaaaauggagggcca

SEQ ID NO: 469414 - RNA, 22 nt, Human
agagugauggguugugcugacc

SEQ ID NO: 469415 - RNA, 22 nt, Human
ccagccugaaaugccucauccu

SEQ ID NO: 469416 - RNA, 22 nt, Human
ggggaccuuuccauuucugaga

SEQ ID NO: 469417 - RNA, 17 nt, Human
cugcuuugugcaacgcu

SEQ ID NO: 469418 - RNA, 21 nt, Human
ggagauggguaucgccugggc

SEQ ID NO: 469419 - RNA, 22 nt, Human
aaggaagacacagaugaaguga

SEQ ID NO: 469420 - RNA, 22 nt, Human
ucaaaugcugccuuugugugcc

SEQ ID NO: 469421 - RNA, 22 nt, Human
uucaggaucacuaaacccucca

SEQ ID NO: 469422 - RNA, 22 nt, Human
uggcagagguauauugggagga

SEQ ID NO: 469423 - RNA, 22 nt, Human
ucuccccaaaggacucacucuc

SEQ ID NO: 469424 - RNA, 22 nt, Human
ugucucagauacgccaucaagg

SEQ ID NO: 469425 - RNA, 22 nt, Human
caugaagcuugaagcaguccac

SEQ ID NO: 469426 - RNA, 22 nt, Human
cugggcagcuaccaccacugcu

SEQ ID NO: 469427 - RNA, 22 nt, Human
cacuggcaugugaggcgguggc

SEQ ID NO: 469428 - RNA, 22 nt, Human
ccagagaguaucauggagagua

SEQ ID NO: 469429 - RNA, 22 nt, Human
uggacaggugagugacucaggg

SEQ ID NO: 469430 - RNA, 18 nt, Human
gcugucugaggucugagg

SEQ ID NO: 469431 - RNA, 21 nt, Human
gccagagcaguacaaugaggu

SEQ ID NO: 469432 - RNA, 22 nt, Human
ugccaggcccagcuccagagcu

SEQ ID NO: 469433 - RNA, 22 nt, Human
cugaagccacgauagcuuccua

SEQ ID NO: 469434 - RNA, 22 nt, Human
cccucaggagaugucagcugga

SEQ ID NO: 469435 - RNA, 22 nt, Human
uaaggcacccgugagcugccag

SEQ ID NO: 469436 - RNA, 21 nt, Human
agcugcuccagggagcucagg

SEQ ID NO: 469437 - RNA, 22 nt, Human
auccuugaacuuagacacuagg

SEQ ID NO: 469438 - RNA, 22 nt, Human
aagccagguuccauggaggagc

SEQ ID NO: 469439 - RNA, 22 nt, Human
aauuuggcagugucuugaagua

SEQ ID NO: 469440 - RNA, 22 nt, Human
aaucaguuagaaggaagagaau

SEQ ID NO: 469441 - RNA, 22 nt, Human
acagugucaugucguguucccc

SEQ ID NO: 469442 - RNA, 22 nt, Human
aacagcuuugcuucuggagaca

SEQ ID NO: 469443 - RNA, 23 nt, Human
caugggagugagaaugccagcuc

SEQ ID NO: 469444 - RNA, 22 nt, Human
agggcuggcaagggauugaaau

SEQ ID NO: 469445 - RNA, 22 nt, Human
caggcagcagaggaguguggga

SEQ ID NO: 469446 - RNA, 22 nt, Human
auucauuugcuauuguguaugg

SEQ ID NO: 469447 - RNA, 22 nt, Human
aggcacugggggaugagcaagg

SEQ ID NO: 469448 - RNA, 22 nt, Human
gaggccuggaccagccacagag

SEQ ID NO: 469449 - RNA, 22 nt, Human
ugaagcagcaaaugaugggaga

SEQ ID NO: 469450 - RNA, 22 nt, Human
cagaguguaucuguguaagcau

SEQ ID NO: 469451 - RNA, 22 nt, Human
cugcuuugcauagcugccagag

SEQ ID NO: 469452 - RNA, 22 nt, Human
caccugggcuaaacuaugcagg

SEQ ID NO: 469453 - RNA, 18 nt, Human
ggcugccuguuccugaag

SEQ ID NO: 469454 - RNA, 22 nt, Human
ucucugucugagccuggcagac

SEQ ID NO: 469455 - RNA, 19 nt, Human
ccuggguccacucagacua

SEQ ID NO: 469456 - RNA, 22 nt, Human
cucuccuugcagauggcugccu

SEQ ID NO: 469457 - RNA, 22 nt, Human
ucccagcagagccagcaagccg

SEQ ID NO: 469458 - RNA, 22 nt, Human
aagagcugugggugguaguccu

SEQ ID NO: 469459 - RNA, 22 nt, Human
uccagggagagccgcugcucca

SEQ ID NO: 469460 - RNA, 22 nt, Human
acaggcuuuuuuagaaugacau

SEQ ID NO: 469461 - RNA, 22 nt, Human
gcuggccucgcaggcaggaugu

SEQ ID NO: 469462 - RNA, 18 nt, Human
ucaagacaucaugaaaua

SEQ ID NO: 469463 - RNA, 22 nt, Human
acucugggccccagguggagcu

SEQ ID NO: 469464 - RNA, 22 nt, Human
gcaggcaggcuuccuugaacug

SEQ ID NO: 469465 - RNA, 22 nt, Human
cagcacaauuuucaggagucca

SEQ ID NO: 469466 - RNA, 22 nt, Human
ucaaacuguuuacagugagaua

SEQ ID NO: 469467 - RNA, 22 nt, Human
aagcagccucauuugugguaag

SEQ ID NO: 469468 - RNA, 22 nt, Human
gcucacugcaaccucugcuucc

SEQ ID NO: 469469 - RNA, 22 nt, Human
agccuggagguaaugaggaaac

SEQ ID NO: 469470 - RNA, 21 nt, Human
augacagaugcugcagaucgu

SEQ ID NO: 469471 - RNA, 22 nt, Human
augaaggcuguguagauggaug

SEQ ID NO: 469472 - RNA, 22 nt, Human
gggacaggcugagacuugagcu

SEQ ID NO: 469473 - RNA, 22 nt, Human
ccagcuuuucuuaucauuauaa

SEQ ID NO: 469474 - RNA, 22 nt, Human
uuguaacacuuuucuauuaaua

SEQ ID NO: 469475 - RNA, 22 nt, Human
agccacaccuguccugccagcu

SEQ ID NO: 469476 - RNA, 22 nt, Human
cuaguggaaacuaacuggaauu

SEQ ID NO: 469477 - RNA, 22 nt, Human
acucagaggcagcugcucaccc

SEQ ID NO: 469478 - RNA, 22 nt, Human
agucucagcuacuugggaggcu

SEQ ID NO: 469479 - RNA, 22 nt, Human
gccugguguccagaggcgagug

SEQ ID NO: 469480 - RNA, 22 nt, Human
ugaggcucugcuucuguggcuc

SEQ ID NO: 469481 - RNA, 22 nt, Human
cagcauuggguuaccuuuguuu

SEQ ID NO: 469482 - RNA, 22 nt, Human
ucuggcuccugaguccaugcuc

SEQ ID NO: 469483 - RNA, 22 nt, Human
uguguacagcaggauuucucaa

SEQ ID NO: 469484 - RNA, 22 nt, Human
ggaggacaggggcugcagcaca

SEQ ID NO: 469485 - RNA, 22 nt, Human
gagaagcaaucaguggccaccc

SEQ ID NO: 469486 - RNA, 22 nt, Human
uggccuccccuaacagccucuu

SEQ ID NO: 469487 - RNA, 22 nt, Human
gggcagguguuuccaaggugag

SEQ ID NO: 469488 - RNA, 22 nt, Human
aacuucuugguccugagcuguu

SEQ ID NO: 469489 - RNA, 22 nt, Human
ccagccagccuugaucugagua

SEQ ID NO: 469490 - RNA, 22 nt, Human
uccuucaaagcuccuagugagc

SEQ ID NO: 469491 - RNA, 22 nt, Human
ggcugagcguggcugccguggg

SEQ ID NO: 469492 - RNA, 22 nt, Human
uuuagaaauugcagagugggug

SEQ ID NO: 469493 - RNA, 20 nt, Human
uggagcugugguaaggagca

SEQ ID NO: 469494 - RNA, 22 nt, Human
agaugcuucaguguuuaauuua

SEQ ID NO: 469495 - RNA, 23 nt, Human
ucucugaguuguacuuucccuug

SEQ ID NO: 469496 - RNA, 22 nt, Human
uuguaacagguacuaaauaacu

SEQ ID NO: 469497 - RNA, 22 nt, Human
gcagggcagagggagaaucucu

SEQ ID NO: 469498 - RNA, 22 nt, Human
cuauuagguuggugcaaaagua

SEQ ID NO: 469499 - RNA, 22 nt, Human
gcagggacaucuuugucuagua

SEQ ID NO: 469500 - RNA, 22 nt, Human
auaaagaggauguauuuacagc

SEQ ID NO: 469501 - RNA, 21 nt, Human
uuugaaagcuacaucuauagc

SEQ ID NO: 469502 - RNA, 22 nt, Human
cagaggaaguuccuugaugaga

SEQ ID NO: 469503 - RNA, 22 nt, Human
ggagcugcuccuucagccaagu

SEQ ID NO: 469504 - RNA, 22 nt, Human
ucugccugagcagagggaggcc

SEQ ID NO: 469505 - RNA, 22 nt, Human
cggcugagacggccauagacac

SEQ ID NO: 469506 - RNA, 22 nt, Human
acagcugugaagcaagcacucu

SEQ ID NO: 469507 - RNA, 22 nt, Human
auuucucaucaagugccaacuc

SEQ ID NO: 469508 - RNA, 22 nt, Human
ggagcagagcugggcuuggcug

SEQ ID NO: 469509 - RNA, 22 nt, Human
ggcagcugugaagugccucaca

SEQ ID NO: 469510 - RNA, 22 nt, Human
gcugucacaucaaggcacuaaa

SEQ ID NO: 469511 - RNA, 22 nt, Human
uaugcacauugguuuccucauu

SEQ ID NO: 469512 - RNA, 22 nt, Human
agcauccaacaggagggaaggg

SEQ ID NO: 469513 - RNA, 22 nt, Human
ucacgagaggcacagaauagag

SEQ ID NO: 469514 - RNA, 22 nt, Human
cugcagccucaaccuccugagc

SEQ ID NO: 469515 - RNA, 22 nt, Human
agcugaggcauggacaggcugc

SEQ ID NO: 469516 - RNA, 22 nt, Human
cuguagcagugugcucuuuuuc

SEQ ID NO: 469517 - RNA, 22 nt, Human
cuccucuuuacccgcauggucu

SEQ ID NO: 469518 - RNA, 22 nt, Human
augaugugugcugaucaagcuu

SEQ ID NO: 469519 - RNA, 22 nt, Human
aagcccaguuucacacugagac

SEQ ID NO: 469520 - RNA, 22 nt, Human
caagggcuucaaguggccaaga

SEQ ID NO: 469521 - RNA, 23 nt, Human
aaggccagaauuucaauggugcc

SEQ ID NO: 469522 - RNA, 22 nt, Human
uagggcagauucgguggaguuu

SEQ ID NO: 469523 - RNA, 22 nt, Human
acguuuucuagagaauaugcag

SEQ ID NO: 469524 - RNA, 22 nt, Human
agagauguucauucagcauguu

SEQ ID NO: 469525 - RNA, 22 nt, Human
gaggggcucuugggcaugaagg

SEQ ID NO: 469526 - RNA, 22 nt, Human
gaggagaagcuauuggaaggac

SEQ ID NO: 469527 - RNA, 22 nt, Human
cugcaggggcuggaguuggcuu

SEQ ID NO: 469528 - RNA, 22 nt, Human
gaauacaagccugccaccugga

SEQ ID NO: 469529 - RNA, 22 nt, Human
aucaggaucugggagccugaaa

SEQ ID NO: 469530 - RNA, 21 nt, Human
aucucacagcccagagaagcc

SEQ ID NO: 469531 - RNA, 19 nt, Human
ccauggcaaugaucugaug

SEQ ID NO: 469532 - RNA, 23 nt, Human
uccuggugacaugccugagcauc

SEQ ID NO: 469533 - RNA, 22 nt, Human
uacuguacauuccguuuguugc

SEQ ID NO: 469534 - RNA, 22 nt, Human
uuuguaaaggccugaauuucag

SEQ ID NO: 469535 - RNA, 21 nt, Human
uuuauguacuucauagaguag

SEQ ID NO: 469536 - RNA, 22 nt, Human
gcugccugauuuacauagugaa

SEQ ID NO: 469537 - RNA, 22 nt, Human
ggcugccugccuccaagccggg

SEQ ID NO: 469538 - RNA, 22 nt, Human
cugagcugacaucuuccucuuu

SEQ ID NO: 469539 - RNA, 22 nt, Human
gaaagaagcuuuagauggcuau

SEQ ID NO: 469540 - RNA, 22 nt, Human
uagcaggguccaaugugaggca

SEQ ID NO: 469541 - RNA, 22 nt, Human
agaggcagccguauuucaaagg

SEQ ID NO: 469542 - RNA, 19 nt, Human
ggcucucuuaaagcuguuu

SEQ ID NO: 469543 - RNA, 22 nt, Human
acucugccuuucagcagaugaa

SEQ ID NO: 469544 - RNA, 22 nt, Human
aaggcugccucugccagaggag

SEQ ID NO: 469545 - RNA, 22 nt, Human
cagggacccgcacagguagcau

SEQ ID NO: 469546 - RNA, 22 nt, Human
cugaggcuggggaagggaagug

SEQ ID NO: 469547 - RNA, 22 nt, Human
gggcuccagcccgggaccaggu

SEQ ID NO: 469548 - RNA, 22 nt, Human
uaguggaggguguagcugcugg

SEQ ID NO: 469549 - RNA, 22 nt, Human
aguguacauguuuacagcaucu

SEQ ID NO: 469550 - RNA, 21 nt, Human
guguuuccuguuuauggcuug

SEQ ID NO: 469551 - RNA, 22 nt, Human
agggcagcugugagccacugug

SEQ ID NO: 469552 - RNA, 22 nt, Human
guggcaggagagacacagccau

SEQ ID NO: 469553 - RNA, 22 nt, Human
ccggggacuuaaagugaaggaa

SEQ ID NO: 469554 - RNA, 22 nt, Human
augucacagucugacucaguga

SEQ ID NO: 469555 - RNA, 22 nt, Human
cugccgaguacagccauagaaa

SEQ ID NO: 469556 - RNA, 22 nt, Human
ggcuggcacucuguccaguguc

SEQ ID NO: 469557 - RNA, 17 nt, Human
ggugaguguccaggugg

SEQ ID NO: 469558 - RNA, 17 nt, Human
agaggcagauacuugga

SEQ ID NO: 469559 - RNA, 18 nt, Human
ccugccagucuggagcag

SEQ ID NO: 469560 - RNA, 22 nt, Human
cugaggcuuggaggggucuggu

SEQ ID NO: 469561 - RNA, 22 nt, Human
ugcagcaggcacaggacggaag

SEQ ID NO: 469562 - RNA, 22 nt, Human
gcagugaaaaagugcacccugu

SEQ ID NO: 469563 - RNA, 22 nt, Human
uccugcaggccuguucccagua

SEQ ID NO: 469564 - RNA, 22 nt, Human
auggcagagaaagcgagccaca

SEQ ID NO: 469565 - RNA, 22 nt, Human
agagaauuuuaaaagccuugaa

SEQ ID NO: 469566 - RNA, 22 nt, Human
caugcuccaaaaacaagagaau

SEQ ID NO: 469567 - RNA, 22 nt, Human
cagagcugggaucccaugggcg

SEQ ID NO: 469568 - RNA, 22 nt, Human
uuagcugcauuaucaaaguuau

SEQ ID NO: 469569 - RNA, 21 nt, Human
gccaccucgucucggagcagc

SEQ ID NO: 469570 - RNA, 20 nt, Human
agacccucuggacugggccc

SEQ ID NO: 469571 - RNA, 22 nt, Human
cagguggcuucucccuaggcca

SEQ ID NO: 469572 - RNA, 22 nt, Human
gggcuuggcacaugggcucagc

SEQ ID NO: 469573 - RNA, 22 nt, Human
gugguaaucggauucuuaccgg

SEQ ID NO: 469574 - RNA, 22 nt, Human
cuaguccagucucaaaaugcua

SEQ ID NO: 469575 - RNA, 22 nt, Human
ggcagccaugucccagggcuuc

SEQ ID NO: 469576 - RNA, 22 nt, Human
ucagaggagccaaaguucugag

SEQ ID NO: 469577 - RNA, 22 nt, Human
gccuucugugcuccuggccuuu

SEQ ID NO: 469578 - RNA, 21 nt, Human
ggugggcacaggagagcagag

SEQ ID NO: 469579 - RNA, 22 nt, Human
ccauuguaguaucuguuuuagu

SEQ ID NO: 469580 - RNA, 22 nt, Human
cagcccugccauggagccuccu

SEQ ID NO: 469581 - RNA, 22 nt, Human
gagauuuccauauuuuguaaca

SEQ ID NO: 469582 - RNA, 22 nt, Human
gggccuggggugacguaccccu

SEQ ID NO: 469583 - RNA, 22 nt, Human
ucugagggcuugaggggaagua

SEQ ID NO: 469584 - RNA, 22 nt, Human
ucugucacucccugaugaugaa

SEQ ID NO: 469585 - RNA, 22 nt, Human
cgcagagggcaggcagugcugg

SEQ ID NO: 469586 - RNA, 22 nt, Human
gcagcaaucuucacagugucau

SEQ ID NO: 469587 - RNA, 22 nt, Human
agccuccuguagcccucaccca

SEQ ID NO: 469588 - RNA, 22 nt, Human
ugcagauucaaaugaaaugcaa

SEQ ID NO: 469589 - RNA, 22 nt, Human
uuuaucuuuaggacuuugcaga

SEQ ID NO: 469590 - RNA, 22 nt, Human
uggagaugaauauguguaccug

SEQ ID NO: 469591 - RNA, 22 nt, Human
guacuucccugggaggcaagca

SEQ ID NO: 469592 - RNA, 22 nt, Human
uguguugugacauucuuggaug

SEQ ID NO: 469593 - RNA, 22 nt, Human
caugucuuauauccugucuuca

SEQ ID NO: 469594 - RNA, 22 nt, Human
cuggccuggcaggggaccucua

SEQ ID NO: 469595 - RNA, 22 nt, Human
ucccacacagcccgcucaccgg

SEQ ID NO: 469596 - RNA, 22 nt, Human
ugccugggguuggcaaacugcu

SEQ ID NO: 469597 - RNA, 22 nt, Human
ugaggugaccgcagaugggaag

SEQ ID NO: 469598 - RNA, 22 nt, Human
accacugggcgggcagccugcu

SEQ ID NO: 469599 - RNA, 22 nt, Human
gcagagugccgagauggaagcg

SEQ ID NO: 469600 - RNA, 22 nt, Human
gaggcugcggggaggagccugc

SEQ ID NO: 469601 - RNA, 22 nt, Human
uuagauaauguuauuguaauuu

SEQ ID NO: 469602 - RNA, 22 nt, Human
gcagagaggaaugaagccaucc

SEQ ID NO: 469603 - RNA, 22 nt, Human
gaggcuggaauauuagaaaugu

SEQ ID NO: 469604 - RNA, 22 nt, Human
cagugagggcauucagugcugg

SEQ ID NO: 469605 - RNA, 22 nt, Human
gaaggccauuagagccugugcc

SEQ ID NO: 469606 - RNA, 22 nt, Human
ccaaggaguagagcaggaagcu

SEQ ID NO: 469607 - RNA, 22 nt, Human
auugaaagauauacuguucuca

SEQ ID NO: 469608 - RNA, 22 nt, Human
gccuggccgcuccgagcuccgc

SEQ ID NO: 469609 - RNA, 22 nt, Human
aggcagccaguucagguuucuu

SEQ ID NO: 469610 - RNA, 22 nt, Human
aaaugcagauuuugaugcagca

SEQ ID NO: 469611 - RNA, 22 nt, Human
aaagaaaccuaucagccacaug

SEQ ID NO: 469612 - RNA, 22 nt, Human
cugcccagaagcuuagagcuua

SEQ ID NO: 469613 - RNA, 22 nt, Human
gagagcugggaaagccguggag

SEQ ID NO: 469614 - RNA, 20 nt, Human
ucugucucugagcuagacuu

SEQ ID NO: 469615 - RNA, 22 nt, Human
cugacucuccucaagcauaaau

SEQ ID NO: 469616 - RNA, 22 nt, Human
ugcauaaagugccauaguauua

SEQ ID NO: 469617 - RNA, 22 nt, Human
ccacugcccaccccgacgucua

SEQ ID NO: 469618 - RNA, 22 nt, Human
agaugcugccucuccucacaag

SEQ ID NO: 469619 - RNA, 22 nt, Human
auuuuuccaauuaggauaaaga

SEQ ID NO: 469620 - RNA, 22 nt, Human
gggagaaguggaaaucucauua

SEQ ID NO: 469621 - RNA, 22 nt, Human
ggcucaggccagaccacgacuc

SEQ ID NO: 469622 - RNA, 22 nt, Human
agugacagcugggaaggugaaa

SEQ ID NO: 469623 - RNA, 22 nt, Human
gccucugcaugcucagcaccca

SEQ ID NO: 469624 - RNA, 22 nt, Human
uuuccauauucugcgucugcca

SEQ ID NO: 469625 - RNA, 22 nt, Human
gcugccacauuuucaggacuaa

SEQ ID NO: 469626 - RNA, 22 nt, Human
cccugggacccgcugcagaggc

SEQ ID NO: 469627 - RNA, 22 nt, Human
uuauuagguuuacauaaagguu

SEQ ID NO: 469628 - RNA, 22 nt, Human
gcugggcagccccuacagagag

SEQ ID NO: 469629 - RNA, 22 nt, Human
auggggcucugcggcugcuccc

SEQ ID NO: 469630 - RNA, 22 nt, Human
uauugacaauaggcaacugagg

SEQ ID NO: 469631 - RNA, 22 nt, Human
agcaguggugugaggagggcuc

SEQ ID NO: 469632 - RNA, 19 nt, Human
agggagaauuccaagagga

SEQ ID NO: 469633 - RNA, 22 nt, Human
caggaagcugugaaggagacgg

SEQ ID NO: 469634 - RNA, 22 nt, Human
acagggccauuaucuguucuag

SEQ ID NO: 469635 - RNA, 22 nt, Human
cuccagaagacccauccucaug

SEQ ID NO: 469636 - RNA, 22 nt, Human
cuucuggggauggagcccagaa

SEQ ID NO: 469637 - RNA, 22 nt, Human
uaauaucuacuucauagaguuu

SEQ ID NO: 469638 - RNA, 22 nt, Human
augcugcacaagccacauguag

SEQ ID NO: 469639 - RNA, 17 nt, Human
gccuuccuuccuccaca

SEQ ID NO: 469640 - RNA, 23 nt, Human
agucagagagugugagacaacug

SEQ ID NO: 469641 - RNA, 22 nt, Human
augugucaauuuucaaaugcuu

SEQ ID NO: 469642 - RNA, 22 nt, Human
aucaguuuggugcuuucaguga

SEQ ID NO: 469643 - RNA, 19 nt, Human
agcauccagucaugggauc

SEQ ID NO: 469644 - RNA, 19 nt, Human
accucugcagagauguuua

SEQ ID NO: 469645 - RNA, 22 nt, Human
auugacaaucuacuauguucug

SEQ ID NO: 469646 - RNA, 22 nt, Human
cagaacauucacucauaugugg

SEQ ID NO: 469647 - RNA, 23 nt, Human
aucaaaguggaaaucaauuaucu

SEQ ID NO: 469648 - RNA, 22 nt, Human
augaggcauucacagaaggcac

SEQ ID NO: 469649 - RNA, 22 nt, Human
ccagcuuuuggggugacaauuu

SEQ ID NO: 469650 - RNA, 22 nt, Human
caauguguguguuuuucucaac

SEQ ID NO: 469651 - RNA, 22 nt, Human
ucccagauucuucugugugggc

SEQ ID NO: 469652 - RNA, 22 nt, Human
cagccucuuuccacaucaggca

SEQ ID NO: 469653 - RNA, 22 nt, Human
ccaggcucugcgcuggacaugg

SEQ ID NO: 469654 - RNA, 22 nt, Human
gaaaaugugucaucccuacugu

SEQ ID NO: 469655 - RNA, 22 nt, Human
ucuuuuaucuguuguguaacaa

SEQ ID NO: 469656 - RNA, 22 nt, Human
agggagccuuccuggcuguggu

SEQ ID NO: 469657 - RNA, 22 nt, Human
ugugccugaguuggcugaguac

SEQ ID NO: 469658 - RNA, 22 nt, Human
aaugaugggaaggagaaaagca

SEQ ID NO: 469659 - RNA, 22 nt, Human
aggaggccgauuucagaggucg

SEQ ID NO: 469660 - RNA, 22 nt, Human
gcaggagcccuggcauguucuu

SEQ ID NO: 469661 - RNA, 22 nt, Human
agagcugauuugauuacagugc

SEQ ID NO: 469662 - RNA, 22 nt, Human
aggcacuggucuaccccuuagu

SEQ ID NO: 469663 - RNA, 22 nt, Human
aggcugcaggucugggucaugu

SEQ ID NO: 469664 - RNA, 22 nt, Human
acagaagagcacauuuaguaug

SEQ ID NO: 469665 - RNA, 22 nt, Human
gaagccagccuugucugccucu

SEQ ID NO: 469666 - RNA, 22 nt, Human
aaccugcauguuucuaaaagca

SEQ ID NO: 469667 - RNA, 22 nt, Human
aucaggauucaccccagagcug

SEQ ID NO: 469668 - RNA, 22 nt, Human
cccaggagagaggccaguuggc

SEQ ID NO: 469669 - RNA, 23 nt, Human
cagugugacgaggugaggcaggc

SEQ ID NO: 469670 - RNA, 22 nt, Human
agaccauggccauccuaggaaa

SEQ ID NO: 469671 - RNA, 22 nt, Human
ugacuuccugcacucaggugau

SEQ ID NO: 469672 - RNA, 20 nt, Human
ucaggcaguggggaaaggca

SEQ ID NO: 469673 - RNA, 22 nt, Human
aggaaaaaccuguuaaugguag

SEQ ID NO: 469674 - RNA, 22 nt, Human
uagucuuuugagaaguauaucu

SEQ ID NO: 469675 - RNA, 22 nt, Human
gcagagugaggaagagcuucca

SEQ ID NO: 469676 - RNA, 22 nt, Human
uggaggaugagugugggcucug

SEQ ID NO: 469677 - RNA, 22 nt, Human
acuccugggugcugaccagcgu

SEQ ID NO: 469678 - RNA, 18 nt, Human
ugcucuguuuaaugauuu

SEQ ID NO: 469679 - RNA, 23 nt, Human
gaagcagaugucugaguaggcag

SEQ ID NO: 469680 - RNA, 22 nt, Human
ugcagcagcagggaggaggcuc

SEQ ID NO: 469681 - RNA, 16 nt, Human
gccuggaguggcaggg

SEQ ID NO: 469682 - RNA, 22 nt, Human
aaguucaaguguaaucuuuauu

SEQ ID NO: 469683 - RNA, 22 nt, Human
cugccuuggcccuaguucaugg

SEQ ID NO: 469684 - RNA, 22 nt, Human
agcagaaccacagcacuguuga

SEQ ID NO: 469685 - RNA, 22 nt, Human
aucuacaggauuuuacagaguu

SEQ ID NO: 469686 - RNA, 22 nt, Human
auacauauaugguacuuccugg

SEQ ID NO: 469687 - RNA, 22 nt, Human
ccacaggggucucuguagcuga

SEQ ID NO: 469688 - RNA, 22 nt, Human
agcuguggcagcagccguggca

SEQ ID NO: 469689 - RNA, 22 nt, Human
uugccuugauucuucucaugug

SEQ ID NO: 469690 - RNA, 22 nt, Human
agagacaggguuuugccauguu

SEQ ID NO: 469691 - RNA, 22 nt, Human
aaagccagagcaagcugucaca

SEQ ID NO: 469692 - RNA, 22 nt, Human
auggaagguccuacagagcgca

SEQ ID NO: 469693 - RNA, 22 nt, Human
agggccagaguacaucagggcu

SEQ ID NO: 469694 - RNA, 22 nt, Human
agagcaauggcauccagcugau

SEQ ID NO: 469695 - RNA, 22 nt, Human
aucuuaaucgaguccaugaaaa

SEQ ID NO: 469696 - RNA, 22 nt, Human
cuacauaaucuggauuugucug

SEQ ID NO: 469697 - RNA, 22 nt, Human
gaaggcugaugacagauucugc

SEQ ID NO: 469698 - RNA, 20 nt, Human
ccugucucacguuccgcccc

SEQ ID NO: 469699 - RNA, 19 nt, Human
aggucauugauagugcagg

SEQ ID NO: 469700 - RNA, 22 nt, Human
ugcaucuuacguuuugaaaggg

SEQ ID NO: 469701 - RNA, 22 nt, Human
ugggcagauguggcucuccuug

SEQ ID NO: 469702 - RNA, 18 nt, Human
agugugugcccuuucagg

SEQ ID NO: 469703 - RNA, 22 nt, Human
cugugucccaguaccuugggua

SEQ ID NO: 469704 - RNA, 22 nt, Human
aguggcagagccaagauaugau

SEQ ID NO: 469705 - RNA, 22 nt, Human
gaccauuuguugaaaagauuau

SEQ ID NO: 469706 - RNA, 22 nt, Human
gcucagagaaucagcagacacc

SEQ ID NO: 469707 - RNA, 22 nt, Human
gguuucaacuuuugugaggaau

SEQ ID NO: 469708 - RNA, 22 nt, Human
aguuuauguagaauuggcaaua

SEQ ID NO: 469709 - RNA, 22 nt, Human
acaguaaaaagccuuagaauuu

SEQ ID NO: 469710 - RNA, 22 nt, Human
agagcuggccagggaucacucu

SEQ ID NO: 469711 - RNA, 22 nt, Human
caggagugucuccacacagcaa

SEQ ID NO: 469712 - RNA, 22 nt, Human
gcaggaugggagcuucacucug

SEQ ID NO: 469713 - RNA, 20 nt, Human
agcugaggcaccugagguua

SEQ ID NO: 469714 - RNA, 22 nt, Human
cauuaggguaauugaacacuua

SEQ ID NO: 469715 - RNA, 22 nt, Human
cccaggaggcagagcuugcagu

SEQ ID NO: 469716 - RNA, 22 nt, Human
uuugcuauaaaagggucacacg

SEQ ID NO: 469717 - RNA, 23 nt, Human
gggaccugguaggaggugauugg

SEQ ID NO: 469718 - RNA, 22 nt, Human
gcacacacaugugaguacaugc

SEQ ID NO: 469719 - RNA, 22 nt, Human
cuggcagcagcuucuggaucga

SEQ ID NO: 469720 - RNA, 22 nt, Human
ugagcuuccucccugcauccau

SEQ ID NO: 469721 - RNA, 22 nt, Human
uacccagcccaugccuaccuca

SEQ ID NO: 469722 - RNA, 22 nt, Human
cuugaaagauuuggccucugug

SEQ ID NO: 469723 - RNA, 22 nt, Human
ugggcuggcccaccacaccucg

SEQ ID NO: 469724 - RNA, 18 nt, Human
cucucuggucuggauccc

SEQ ID NO: 469725 - RNA, 22 nt, Human
ccuccagcgcgauccacuccgg

SEQ ID NO: 469726 - RNA, 22 nt, Human
cccaggcacucuuggucauuuu

SEQ ID NO: 469727 - RNA, 22 nt, Human
acuuccugcagcuucucagccc

SEQ ID NO: 469728 - RNA, 19 nt, Human
gcacacccugcaccaccau

SEQ ID NO: 469729 - RNA, 23 nt, Human
cuggcucauccugguugcagugg

SEQ ID NO: 469730 - RNA, 22 nt, Human
ggcuguccuuggccaaggcacu

SEQ ID NO: 469731 - RNA, 20 nt, Human
acaaaugcauucugugacau

SEQ ID NO: 469732 - RNA, 22 nt, Human
ccuggugccacuagagaauguc

SEQ ID NO: 469733 - RNA, 23 nt, Human
ccuggcuggauucucugcauuca

SEQ ID NO: 469734 - RNA, 22 nt, Human
uguggcagaaccagaauucaaa

SEQ ID NO: 469735 - RNA, 19 nt, Human
ugagugggccccugcagac

SEQ ID NO: 469736 - RNA, 22 nt, Human
ccccagcucagugcagggacau

SEQ ID NO: 469737 - RNA, 22 nt, Human
acagagcaguucuggagcuggc

SEQ ID NO: 469738 - RNA, 22 nt, Human
ccagaggucuccugcacgggau

SEQ ID NO: 469739 - RNA, 20 nt, Human
gagccuuccccucaccacug

SEQ ID NO: 469740 - RNA, 22 nt, Human
auuucuuccucugucaguaacu

SEQ ID NO: 469741 - RNA, 22 nt, Human
ugcauaaacuucucugguguga

SEQ ID NO: 469742 - RNA, 22 nt, Human
ugucucugaacagcuuacuaaa

SEQ ID NO: 469743 - RNA, 23 nt, Human
gcagaggagcaagcuggacacca

SEQ ID NO: 469744 - RNA, 22 nt, Human
gcagcuuuggagguggaacucu

SEQ ID NO: 469745 - RNA, 22 nt, Human
cugucugucaccaaaacagacu

SEQ ID NO: 469746 - RNA, 22 nt, Human
gcugccugccuugccuggagga

SEQ ID NO: 469747 - RNA, 22 nt, Human
ugacuccaaacagaaaacgaau

SEQ ID NO: 469748 - RNA, 22 nt, Human
ucucacuggguauaaaugagua

SEQ ID NO: 469749 - RNA, 22 nt, Human
gcugaggcuccucgggaggaca

SEQ ID NO: 469750 - RNA, 22 nt, Human
gaggcagugaacaauuccugug

SEQ ID NO: 469751 - RNA, 22 nt, Human
uccagccacucagcagggauug

SEQ ID NO: 469752 - RNA, 22 nt, Human
aacucagucauaaagcgaaugc

SEQ ID NO: 469753 - RNA, 22 nt, Human
uuaauuuauguccaaaccagau

SEQ ID NO: 469754 - RNA, 22 nt, Human
uguaucaaaccaaauuaauucu

SEQ ID NO: 469755 - RNA, 22 nt, Human
uuauguacaauguuaauguaaa

SEQ ID NO: 469756 - RNA, 22 nt, Human
aggguccugggugcaguugcuu

SEQ ID NO: 469757 - RNA, 22 nt, Human
guggggaaaggaguggggcuca

SEQ ID NO: 469758 - RNA, 22 nt, Human
ugauacagucagcucacaauug

SEQ ID NO: 469759 - RNA, 23 nt, Human
ugaguucucaucuuggcuucuau

SEQ ID NO: 469760 - RNA, 22 nt, Human
auucacaaagaagggaaguaca

SEQ ID NO: 469761 - RNA, 22 nt, Human
gguggcagaggugcaucagccc

SEQ ID NO: 469762 - RNA, 22 nt, Human
caguagcaggcacucagcacgu

SEQ ID NO: 469763 - RNA, 22 nt, Human
gaggccacagcuaucagggaca

SEQ ID NO: 469764 - RNA, 22 nt, Human
gaggcaggcccugaaugaguca

SEQ ID NO: 469765 - RNA, 22 nt, Human
agagccaggacugugucucacu

SEQ ID NO: 469766 - RNA, 22 nt, Human
ggagaaagcuguaguggaaugu

SEQ ID NO: 469767 - RNA, 22 nt, Human
ucauggauggccgggaggugau

SEQ ID NO: 469768 - RNA, 22 nt, Human
gcccucagcuccuggacacaug

SEQ ID NO: 469769 - RNA, 22 nt, Human
ccuuccuggcuguccgccugau

SEQ ID NO: 469770 - RNA, 22 nt, Human
gccaggcaaauuaaggaaugca

SEQ ID NO: 469771 - RNA, 22 nt, Human
cauggacucugguuuggggagc

SEQ ID NO: 469772 - RNA, 22 nt, Human
aaggcacuuuucuaaagaccuu

SEQ ID NO: 469773 - RNA, 22 nt, Human
ggcagcuguggacgucgucauu

SEQ ID NO: 469774 - RNA, 22 nt, Human
uuucccaauugagagguucugu

SEQ ID NO: 469775 - RNA, 22 nt, Human
ucccagaguauuagcaauugcu

SEQ ID NO: 469776 - RNA, 22 nt, Human
agaaaugcucuuccugaccaga

SEQ ID NO: 469777 - RNA, 22 nt, Human
ugcauuauacuuuuagaaauuu

SEQ ID NO: 469778 - RNA, 22 nt, Human
uuuguaaauagcaguacucaug

SEQ ID NO: 469779 - RNA, 20 nt, Human
agugucuggugcagggccuc

SEQ ID NO: 469780 - RNA, 23 nt, Human
uggugccucagaagcagugggcu

SEQ ID NO: 469781 - RNA, 22 nt, Human
ugggccuccaauuccagcggga

SEQ ID NO: 469782 - RNA, 22 nt, Human
aagggcuggcccugggaagagu

SEQ ID NO: 469783 - RNA, 22 nt, Human
gucaggaugacaagugcuuuca

SEQ ID NO: 469784 - RNA, 22 nt, Human
ucucccacagccgugcuucaag

SEQ ID NO: 469785 - RNA, 22 nt, Human
uggcagagcccagacuccaguc

SEQ ID NO: 469786 - RNA, 22 nt, Human
ccaggccuggaccaugccaggg

SEQ ID NO: 469787 - RNA, 22 nt, Human
acagaauuaaugaaaauuacaa

SEQ ID NO: 469788 - RNA, 22 nt, Human
gcugggagcaaguacucaucuu

SEQ ID NO: 469789 - RNA, 22 nt, Human
guggaggagaggcgccuugcgg

SEQ ID NO: 469790 - RNA, 22 nt, Human
ucacagcaaaagugugcagagc

SEQ ID NO: 469791 - RNA, 23 nt, Human
ggguccagagacaggcaugggug

SEQ ID NO: 469792 - RNA, 22 nt, Human
acaaggcugaacagugaagccg

SEQ ID NO: 469793 - RNA, 22 nt, Human
ccagcagggcagugcccuggac

SEQ ID NO: 469794 - RNA, 22 nt, Human
uugagaagaauguguugaguuu

SEQ ID NO: 469795 - RNA, 22 nt, Human
accaucaguacuggaugcugac

SEQ ID NO: 469796 - RNA, 22 nt, Human
uugcauugcuuggucuucaaga

SEQ ID NO: 469797 - RNA, 22 nt, Human
uucugcaggagcccuaguguau

SEQ ID NO: 469798 - RNA, 22 nt, Human
auaauaacaccugaauaggaaa

SEQ ID NO: 469799 - RNA, 22 nt, Human
accugcagcuaaagauguaggg

SEQ ID NO: 469800 - RNA, 22 nt, Human
uagagcugggcagugcucugag

SEQ ID NO: 469801 - RNA, 22 nt, Human
cugcagccuccugggguacaug

SEQ ID NO: 469802 - RNA, 22 nt, Human
cuuguacauagagaagaagccu

SEQ ID NO: 469803 - RNA, 22 nt, Human
uagaggugucacuuugggaagu

SEQ ID NO: 469804 - RNA, 23 nt, Human
cagagcuggcucagagcugccug

SEQ ID NO: 469805 - RNA, 22 nt, Human
uccaguggagugugggggugaa

SEQ ID NO: 469806 - RNA, 22 nt, Human
aaauuugauaagccauuguuac

SEQ ID NO: 469807 - RNA, 23 nt, Human
acuuuauugaccccaggucaguu

SEQ ID NO: 469808 - RNA, 22 nt, Human
uacccaggggcugagcagaggu

SEQ ID NO: 469809 - RNA, 22 nt, Human
uacaaaaaauugauacugacga

SEQ ID NO: 469810 - RNA, 22 nt, Human
cccaggcagugugugcaugcgu

SEQ ID NO: 469811 - RNA, 21 nt, Human
ccuccaggagcagagcccuga

SEQ ID NO: 469812 - RNA, 21 nt, Human
gccaccccuggcacaggugcu

SEQ ID NO: 469813 - RNA, 22 nt, Human
uuauuugcccauguuuagcaga

SEQ ID NO: 469814 - RNA, 22 nt, Human
gcagaggacagggauuuagauu

SEQ ID NO: 469815 - RNA, 22 nt, Human
ugggugggagcacccugucugg

SEQ ID NO: 469816 - RNA, 22 nt, Human
ccaggagcauuaagagaacaua

SEQ ID NO: 469817 - RNA, 22 nt, Human
cauggccuugagugacugcacu

SEQ ID NO: 469818 - RNA, 22 nt, Human
acuaaagaagccaaaguuuucu

SEQ ID NO: 469819 - RNA, 22 nt, Human
aaaguggucaccuucucauuuc

SEQ ID NO: 469820 - RNA, 22 nt, Human
cugggguggugcaggccucaug

SEQ ID NO: 469821 - RNA, 22 nt, Human
aggagugcaaauaguccagaga

SEQ ID NO: 469822 - RNA, 22 nt, Human
acagcagcgucaacuuaaaauu

SEQ ID NO: 469823 - RNA, 22 nt, Human
caguggagugggacuggucuga

SEQ ID NO: 469824 - RNA, 22 nt, Human
ccugcugugaaacuggcauaug

SEQ ID NO: 469825 - RNA, 22 nt, Human
acaaagcuagagaagagaauug

SEQ ID NO: 469826 - RNA, 22 nt, Human
cagagggcucggcggccgcucc

SEQ ID NO: 469827 - RNA, 22 nt, Human
acaggcuuacaggcugcaagua

SEQ ID NO: 469828 - RNA, 22 nt, Human
uggaggaugccuggggaggccu

SEQ ID NO: 469829 - RNA, 22 nt, Human
aggcgcagacauacagggucug

SEQ ID NO: 469830 - RNA, 22 nt, Human
aaaaaguuucaacugccaacuc

SEQ ID NO: 469831 - RNA, 22 nt, Human
agcagugagugggaggaccaug

SEQ ID NO: 469832 - RNA, 22 nt, Human
agggcugcuuugcuaaauaugg

SEQ ID NO: 469833 - RNA, 22 nt, Human
cugagagaugauauagcuuaau

SEQ ID NO: 469834 - RNA, 22 nt, Human
uuacugaaaauucuucaggauu

SEQ ID NO: 469835 - RNA, 23 nt, Human
aggcugagcucucccagcuucag

SEQ ID NO: 469836 - RNA, 22 nt, Human
ucucaaacuaacaaugauuaua

SEQ ID NO: 469837 - RNA, 22 nt, Human
agacucaagacugcagaagacg

SEQ ID NO: 469838 - RNA, 22 nt, Human
gugaccaucagagaauaacaaa

SEQ ID NO: 469839 - RNA, 22 nt, Human
accagagcgcucaagccuuccc

SEQ ID NO: 469840 - RNA, 22 nt, Human
uaggcucagggcugggugacgg

SEQ ID NO: 469841 - RNA, 22 nt, Human
gugggggcaggcagugcuagga

SEQ ID NO: 469842 - RNA, 22 nt, Human
gaggccagaagucugagaucag

SEQ ID NO: 469843 - RNA, 22 nt, Human
acagagcugggaucugaaccca

SEQ ID NO: 469844 - RNA, 22 nt, Human
ucaaucacguguuccauguucu

SEQ ID NO: 469845 - RNA, 22 nt, Human
auucuaggcuugaaacaugaag

SEQ ID NO: 469846 - RNA, 22 nt, Human
uauuuucuggacagucuugcuu

SEQ ID NO: 469847 - RNA, 22 nt, Human
aggccuguuggcgugggcucua

SEQ ID NO: 469848 - RNA, 22 nt, Human
caggcacuagcagaaugaggcu

SEQ ID NO: 469849 - RNA, 22 nt, Human
gaguccaguuagugaggcuggg

SEQ ID NO: 469850 - RNA, 22 nt, Human
agggaggaucugcuccuugucu

SEQ ID NO: 469851 - RNA, 22 nt, Human
uccuguggagaggacuggaggu

SEQ ID NO: 469852 - RNA, 22 nt, Human
caugggagguuggcuuggcaug

SEQ ID NO: 469853 - RNA, 22 nt, Human
ugccuggaugugcuggccucac

SEQ ID NO: 469854 - RNA, 22 nt, Human
gcuucuaucccuccacugcacu

SEQ ID NO: 469855 - RNA, 22 nt, Human
cagcagguauguuuguucagca

SEQ ID NO: 469856 - RNA, 22 nt, Human
ggcccacacugacagcugagcu

SEQ ID NO: 469857 - RNA, 22 nt, Human
cacaggccugucucuuucuaac

SEQ ID NO: 469858 - RNA, 22 nt, Human
aggaaccagagguugagcaacu

SEQ ID NO: 469859 - RNA, 22 nt, Human
cagaggcauuacugaaaaggug

SEQ ID NO: 469860 - RNA, 22 nt, Human
agcagcaggcuguguggacuga

SEQ ID NO: 469861 - RNA, 22 nt, Human
uuuuauuaguggcuagaugggg

SEQ ID NO: 469862 - RNA, 22 nt, Human
cacauacaaugguguuauuugg

SEQ ID NO: 469863 - RNA, 22 nt, Human
aaaguucagauuagacucaaga

SEQ ID NO: 469864 - RNA, 22 nt, Human
ggguguccugugccaagcuggg

SEQ ID NO: 469865 - RNA, 22 nt, Human
cagaggaagcagacacaucuug

SEQ ID NO: 469866 - RNA, 22 nt, Human
gggcugagagugacuguucugu

SEQ ID NO: 469867 - RNA, 22 nt, Human
ggcuggcaagugucugcucaug

SEQ ID NO: 469868 - RNA, 21 nt, Human
aggugggagaccauguagguc

SEQ ID NO: 469869 - RNA, 20 nt, Human
cccucugcuacacugggagc

SEQ ID NO: 469870 - RNA, 22 nt, Human
ucacauuuuaucugagauugac

SEQ ID NO: 469871 - RNA, 22 nt, Human
gaggcacaauacaugucucaag

SEQ ID NO: 469872 - RNA, 22 nt, Human
uccagaggcuccaaagggagau

SEQ ID NO: 469873 - RNA, 22 nt, Human
aggcucagaggugagcaucugc

SEQ ID NO: 469874 - RNA, 22 nt, Human
ugggcucugugccagguuggug

SEQ ID NO: 469875 - RNA, 22 nt, Human
guauuuucaagagcaguaguau

SEQ ID NO: 469876 - RNA, 22 nt, Human
guguaauuauauaaagaucuac

SEQ ID NO: 469877 - RNA, 22 nt, Human
agggcccuuacgcaggcccuuc

SEQ ID NO: 469878 - RNA, 20 nt, Human
ccuccaggcacacccaugug

SEQ ID NO: 469879 - RNA, 22 nt, Human
cagagcugauuggauccagaga

SEQ ID NO: 469880 - RNA, 22 nt, Human
gagccauacaaccuauaaagug

SEQ ID NO: 469881 - RNA, 22 nt, Human
uacauaauuaaucuuuaaguuc

SEQ ID NO: 469882 - RNA, 22 nt, Human
uuuccucuucgauuaaguuugg

SEQ ID NO: 469883 - RNA, 22 nt, Human
agagcccuuucuccaggcaccu

SEQ ID NO: 469884 - RNA, 22 nt, Human
ucagccacuacccaccuuaaca

SEQ ID NO: 469885 - RNA, 22 nt, Human
guggccagcaagugcugccucu

SEQ ID NO: 469886 - RNA, 22 nt, Human
gcugcuccgucugagcucuggu

SEQ ID NO: 469887 - RNA, 22 nt, Human
aauuugcaugaugagaacaaua

SEQ ID NO: 469888 - RNA, 22 nt, Human
acauguguggacaugaaucuac

SEQ ID NO: 469889 - RNA, 22 nt, Human
cacccaggcuagagugcagugg

SEQ ID NO: 469890 - RNA, 22 nt, Human
ugcagggcagauaugacuguag

SEQ ID NO: 469891 - RNA, 22 nt, Human
acuguguccuauuuccuugaca

SEQ ID NO: 469892 - RNA, 22 nt, Human
gugcauuggugcgccacuucac

SEQ ID NO: 469893 - RNA, 22 nt, Human
aagggacuuugucagcuuucca

SEQ ID NO: 469894 - RNA, 22 nt, Human
agagugaucagauaucaggugu

SEQ ID NO: 469895 - RNA, 21 nt, Human
aucagcaaaugccugucuccc

SEQ ID NO: 469896 - RNA, 22 nt, Human
uauguuuuucaagugcacacua

SEQ ID NO: 469897 - RNA, 22 nt, Human
ugagaagcagcuuacagguguc

SEQ ID NO: 469898 - RNA, 22 nt, Human
ggagcuguaacgagccauugcu

SEQ ID NO: 469899 - RNA, 19 nt, Human
guuuuucccagacgaggca

SEQ ID NO: 469900 - RNA, 22 nt, Human
cucuggaaaaccacuagcagga

SEQ ID NO: 469901 - RNA, 22 nt, Human
uccuggcccacuaugccagcau

SEQ ID NO: 469902 - RNA, 21 nt, Human
ucucuacacuuucacuaggcu

SEQ ID NO: 469903 - RNA, 22 nt, Human
cucuuaaagaauguuccagcug

SEQ ID NO: 469904 - RNA, 22 nt, Human
uggcuuccuggacagaugcggu

SEQ ID NO: 469905 - RNA, 22 nt, Human
ccugccugcguccucugagggc

SEQ ID NO: 469906 - RNA, 22 nt, Human
ucagagcuuuggagaccaggaa

SEQ ID NO: 469907 - RNA, 22 nt, Human
uuagagaaauucugguaaugua

SEQ ID NO: 469908 - RNA, 22 nt, Human
aagugaaacauguaucucuuua

SEQ ID NO: 469909 - RNA, 23 nt, Human
ugucccagagggagggauaggcu

SEQ ID NO: 469910 - RNA, 22 nt, Human
uuccauuguuucugucuucacu

SEQ ID NO: 469911 - RNA, 22 nt, Human
agcuuuauauguuguuucucca

SEQ ID NO: 469912 - RNA, 22 nt, Human
uagacagauuuaaaggaaugga

SEQ ID NO: 469913 - RNA, 22 nt, Human
ugcaaucucggcacuuugggag

SEQ ID NO: 469914 - RNA, 22 nt, Human
cugcugggaaggucugcucagu

SEQ ID NO: 469915 - RNA, 22 nt, Human
ugaggcucuccaagcagaugag

SEQ ID NO: 469916 - RNA, 22 nt, Human
ccacuggcauccagcugccauc

SEQ ID NO: 469917 - RNA, 22 nt, Human
aucaguuucacuugcuugcaaa

SEQ ID NO: 469918 - RNA, 22 nt, Human
uuuuucauugcagccucucucc

SEQ ID NO: 469919 - RNA, 22 nt, Human
ccucagggacuccaugcugcag

SEQ ID NO: 469920 - RNA, 22 nt, Human
acagguggggaggcugagguuc

SEQ ID NO: 469921 - RNA, 18 nt, Human
uuuuacucauagcaggcc

SEQ ID NO: 469922 - RNA, 22 nt, Human
ccugaagaugcuguggccuggu

SEQ ID NO: 469923 - RNA, 22 nt, Human
caagggaccugagauggucucu

SEQ ID NO: 469924 - RNA, 22 nt, Human
gcucccagguucuugggccuug

SEQ ID NO: 469925 - RNA, 22 nt, Human
uuuuugcaccaaccuaauagaa

SEQ ID NO: 469926 - RNA, 22 nt, Human
agucccagcuucccccaugcag

SEQ ID NO: 469927 - RNA, 22 nt, Human
ugcagggcccucauuccugucc

SEQ ID NO: 469928 - RNA, 22 nt, Human
cuucaagauauuucuagaauca

SEQ ID NO: 469929 - RNA, 20 nt, Human
agcccaggccugugugaguc

SEQ ID NO: 469930 - RNA, 22 nt, Human
aaugcacagcuaaagugguucc

SEQ ID NO: 469931 - RNA, 22 nt, Human
aacauacagugagcaguggacu

SEQ ID NO: 469932 - RNA, 22 nt, Human
gggcagguguugucaaucuaau

SEQ ID NO: 469933 - RNA, 22 nt, Human
gcagggcagcuuagucccuguc

SEQ ID NO: 469934 - RNA, 17 nt, Human
auccccagcaucuagaa

SEQ ID NO: 469935 - RNA, 22 nt, Human
aggaaaaucgagucuggaggca

SEQ ID NO: 469936 - RNA, 22 nt, Human
uuagaaaugauuucaccucuuu

SEQ ID NO: 469937 - RNA, 22 nt, Human
ggugcucaagagggcauccucu

SEQ ID NO: 469938 - RNA, 22 nt, Human
cucagcuggcaauucuggcucc

SEQ ID NO: 469939 - RNA, 22 nt, Human
gcagggacaaggcagguguucu

SEQ ID NO: 469940 - RNA, 22 nt, Human
agcagcauuuaaguuucuucua

SEQ ID NO: 469941 - RNA, 19 nt, Human
ccuuccuccccagggccau

SEQ ID NO: 469942 - RNA, 22 nt, Human
uccugcagaucaaagccuuuga

SEQ ID NO: 469943 - RNA, 22 nt, Human
aggcuuccucgugccuuagaua

SEQ ID NO: 469944 - RNA, 22 nt, Human
gccaggcauguccucugcagaa

SEQ ID NO: 469945 - RNA, 22 nt, Human
uauguguacaucugguugagca

SEQ ID NO: 469946 - RNA, 22 nt, Human
uuucaaauagaaucuuuccaaa

SEQ ID NO: 469947 - RNA, 22 nt, Human
uauuucuguaugcauaaaagga

SEQ ID NO: 469948 - RNA, 19 nt, Human
agggccaggauucuggaac

SEQ ID NO: 469949 - RNA, 22 nt, Human
uugcucaggcuuagagcuacua

SEQ ID NO: 469950 - RNA, 22 nt, Human
agcagacaacccagaugaccca

SEQ ID NO: 469951 - RNA, 22 nt, Human
uugaggaguguuuagggugagg

SEQ ID NO: 469952 - RNA, 22 nt, Human
cuggccacaugugugcugagca

SEQ ID NO: 469953 - RNA, 22 nt, Human
acaguggaagcaugaugcuauc

SEQ ID NO: 469954 - RNA, 22 nt, Human
auuagagguacaaaccuucacu

SEQ ID NO: 469955 - RNA, 19 nt, Human
agcaccugugagagccugg

SEQ ID NO: 469956 - RNA, 22 nt, Human
uccuucagugucccgcucaggu

SEQ ID NO: 469957 - RNA, 22 nt, Human
acacacagguaaaggagccugg

SEQ ID NO: 469958 - RNA, 22 nt, Human
uaauaaaugaaagugcuggcau

SEQ ID NO: 469959 - RNA, 22 nt, Human
ucaaguguaguggugucagguc

SEQ ID NO: 469960 - RNA, 22 nt, Human
auguaacaggugaagcucugag

SEQ ID NO: 469961 - RNA, 22 nt, Human
cauggcagaaaccugagcugcu

SEQ ID NO: 469962 - RNA, 22 nt, Human
cuggugcuggagccuagucccu

SEQ ID NO: 469963 - RNA, 22 nt, Human
gcugagggcauguguggcgacu

SEQ ID NO: 469964 - RNA, 22 nt, Human
ggaagccagagugcugggcagg

SEQ ID NO: 469965 - RNA, 22 nt, Human
acauuucucaucuaguagagua

SEQ ID NO: 469966 - RNA, 22 nt, Human
ugcacacaaaugugaacgugcc

SEQ ID NO: 469967 - RNA, 22 nt, Human
augugugccccuuuuacucuuu

SEQ ID NO: 469968 - RNA, 22 nt, Human
ucagaggaaaggucagauggcu

SEQ ID NO: 469969 - RNA, 17 nt, Human
aaggccauuuccaccca

SEQ ID NO: 469970 - RNA, 22 nt, Human
uccauuuucuaaguaucacuua

SEQ ID NO: 469971 - RNA, 22 nt, Human
ccuguacacaauuccgaggaua

SEQ ID NO: 469972 - RNA, 22 nt, Human
uuuguucaugccuauauucuca

SEQ ID NO: 469973 - RNA, 22 nt, Human
ggcucaggcuggagugcagugg

SEQ ID NO: 469974 - RNA, 22 nt, Human
ggaagagagggcugggccucaa

SEQ ID NO: 469975 - RNA, 22 nt, Human
gacccuguuucuacaaauaauu

SEQ ID NO: 469976 - RNA, 22 nt, Human
ugccucuguggaaauggugguc

SEQ ID NO: 469977 - RNA, 22 nt, Human
gcucccacgcaauucuuuucag

SEQ ID NO: 469978 - RNA, 22 nt, Human
cauuucuguacauguuuuggug

SEQ ID NO: 469979 - RNA, 22 nt, Human
gcugucugggaggccuccacuu

SEQ ID NO: 469980 - RNA, 22 nt, Human
uggcagguuuccuccucauagu

SEQ ID NO: 469981 - RNA, 22 nt, Human
cagucccagaagagccugggag

SEQ ID NO: 469982 - RNA, 22 nt, Human
agacuucuuugugagcauuuuc

SEQ ID NO: 469983 - RNA, 20 nt, Human
uaacagaaguagaagugggu

SEQ ID NO: 469984 - RNA, 22 nt, Human
gguccuggaaauugacggaaag

SEQ ID NO: 469985 - RNA, 22 nt, Human
uauugacagagggucagaagag

SEQ ID NO: 469986 - RNA, 22 nt, Human
cuuucauuugauaagaaugcca

SEQ ID NO: 469987 - RNA, 22 nt, Human
uugaagcacaaugucuuuuauc

SEQ ID NO: 469988 - RNA, 22 nt, Human
acaaggaggucuggggggcccu

SEQ ID NO: 469989 - RNA, 22 nt, Human
caguacuuuucaaccaguauga

SEQ ID NO: 469990 - RNA, 22 nt, Human
aaggcugagggcuguaccuggc

SEQ ID NO: 469991 - RNA, 22 nt, Human
auuguacuuuuauuacauguag

SEQ ID NO: 469992 - RNA, 22 nt, Human
gcuggaggaucacuugagccca

SEQ ID NO: 469993 - RNA, 22 nt, Human
ucucugggauaaacugggccag

SEQ ID NO: 469994 - RNA, 22 nt, Human
ggcuucucgugccgaagcaaga

SEQ ID NO: 469995 - RNA, 21 nt, Human
ggcagaaguagcauggacggg

SEQ ID NO: 469996 - RNA, 22 nt, Human
ucccaagugucuuggaccaggg

SEQ ID NO: 469997 - RNA, 22 nt, Human
agccaaggcagcuagagcucug

SEQ ID NO: 469998 - RNA, 22 nt, Human
uuggcugagagaggaaaagggc

SEQ ID NO: 469999 - RNA, 22 nt, Human
ucuggcucauaggaaggccauu

SEQ ID NO: 470000 - RNA, 22 nt, Human
caguuuauagcucuagcagcuu

SEQ ID NO: 470001 - RNA, 22 nt, Human
ggaggcuccacugcucuuccug

SEQ ID NO: 470002 - RNA, 22 nt, Human
uaaaucucacuggguauauugg

SEQ ID NO: 470003 - RNA, 22 nt, Human
uucuaccagcuacucacugaua

SEQ ID NO: 470004 - RNA, 22 nt, Human
aggcccaguuauccuacuuguu

SEQ ID NO: 470005 - RNA, 22 nt, Human
acaggcuucucacagaaaaggg

SEQ ID NO: 470006 - RNA, 22 nt, Human
agagggcuuugauucucaguuc

SEQ ID NO: 470007 - RNA, 21 nt, Human
ggccucugccuugccccacuc

SEQ ID NO: 470008 - RNA, 22 nt, Human
ugaaauguuugaagaccacuga

SEQ ID NO: 470009 - RNA, 22 nt, Human
uggggcugaggagccucacucu

SEQ ID NO: 470010 - RNA, 20 nt, Human
cuguaucagguuacaaagua

SEQ ID NO: 470011 - RNA, 22 nt, Human
cagggcaguuugugccuaugag

SEQ ID NO: 470012 - RNA, 22 nt, Human
aggcacugguccauuuucugca

SEQ ID NO: 470013 - RNA, 22 nt, Human
agccaaggagugcagguggcuu

SEQ ID NO: 470014 - RNA, 22 nt, Human
aggcagccuauggggagcucag

SEQ ID NO: 470015 - RNA, 18 nt, Human
uggacaggguggagaaaa

SEQ ID NO: 470016 - RNA, 22 nt, Human
gcagcagcccagggcucucaga

SEQ ID NO: 470017 - RNA, 22 nt, Human
acaggugggcuuaagagucggc

SEQ ID NO: 470018 - RNA, 22 nt, Human
ccaggaggcggaagguacagug

SEQ ID NO: 470019 - RNA, 22 nt, Human
uccagcuggggacaugggcuuc

SEQ ID NO: 470020 - RNA, 22 nt, Human
ccagaggugcugggagaggucu

SEQ ID NO: 470021 - RNA, 22 nt, Human
aaaugcuugcucuugauuauuu

SEQ ID NO: 470022 - RNA, 22 nt, Human
ugcugcucuucaccauggccuc

SEQ ID NO: 470023 - RNA, 22 nt, Human
uaacagaaauaguaggugaggg

SEQ ID NO: 470024 - RNA, 22 nt, Human
ucagaaaugaucguuauucauu

SEQ ID NO: 470025 - RNA, 22 nt, Human
gggacaggccccucgcuagcuu

SEQ ID NO: 470026 - RNA, 22 nt, Human
gauuucaauccagcuuucuucu

SEQ ID NO: 470027 - RNA, 22 nt, Human
agggcagaaaccaccuugaugg

SEQ ID NO: 470028 - RNA, 20 nt, Human
gcugcucuccacggucugca

SEQ ID NO: 470029 - RNA, 22 nt, Human
ugaaggccacuuccugugagcu

SEQ ID NO: 470030 - RNA, 22 nt, Human
cagcccaggccgacaguuccuc

SEQ ID NO: 470031 - RNA, 22 nt, Human
gaucauuugcaggaaacauuaa

SEQ ID NO: 470032 - RNA, 22 nt, Human
uucaggauuguguuuuuccuga

SEQ ID NO: 470033 - RNA, 22 nt, Human
gcagggacgccagggacagcaa

SEQ ID NO: 470034 - RNA, 22 nt, Human
uuccaugugaguacacugugau

SEQ ID NO: 470035 - RNA, 22 nt, Human
gcagaacauuucacaguaucuu

SEQ ID NO: 470036 - RNA, 22 nt, Human
gggaggagugaagauucaccug

SEQ ID NO: 470037 - RNA, 22 nt, Human
gcugagagcggccagcugggaa

SEQ ID NO: 470038 - RNA, 22 nt, Human
cuacauuaaauuggcuuacuua

SEQ ID NO: 470039 - RNA, 22 nt, Human
agaggccaggcugcagagggau

SEQ ID NO: 470040 - RNA, 22 nt, Human
aguuucuauuuucaugucuguu

SEQ ID NO: 470041 - RNA, 22 nt, Human
ugauugaagaggugaggaaguu

SEQ ID NO: 470042 - RNA, 19 nt, Human
uguguaaagucugugguca

SEQ ID NO: 470043 - RNA, 22 nt, Human
ugacacauuaaaugcucacaaa

SEQ ID NO: 470044 - RNA, 22 nt, Human
ucacugcagagaccucuaguca

SEQ ID NO: 470045 - RNA, 22 nt, Human
gguguccucaugauuuucuaga

SEQ ID NO: 470046 - RNA, 22 nt, Human
uccagggguaccggccaggcag

SEQ ID NO: 470047 - RNA, 22 nt, Human
uccaggcaaaaggaacugcuug

SEQ ID NO: 470048 - RNA, 20 nt, Human
gcaaauggaucccacaagcc

SEQ ID NO: 470049 - RNA, 22 nt, Human
cccaggcucccaggugggacaa

SEQ ID NO: 470050 - RNA, 21 nt, Human
gccugcagaccccaccaggcu

SEQ ID NO: 470051 - RNA, 22 nt, Human
ugcuuaauauugugauguaaua

SEQ ID NO: 470052 - RNA, 22 nt, Human
ucucucagucagaugcuaaaga

SEQ ID NO: 470053 - RNA, 22 nt, Human
aggcacaggccucagcacccag

SEQ ID NO: 470054 - RNA, 22 nt, Human
gggggcucugacucccucagcu

SEQ ID NO: 470055 - RNA, 23 nt, Human
cagcuuucagggcuuuagggaag

SEQ ID NO: 470056 - RNA, 22 nt, Human
acagaacuuccugcuggagugg

SEQ ID NO: 470057 - RNA, 22 nt, Human
acauuucugucuuagggacugu

SEQ ID NO: 470058 - RNA, 22 nt, Human
gggcucugguacuuccuggcuc

SEQ ID NO: 470059 - RNA, 22 nt, Human
acagggcagagugaaaugcuau

SEQ ID NO: 470060 - RNA, 22 nt, Human
aggcaguggcugagaccagggg

SEQ ID NO: 470061 - RNA, 22 nt, Human
gcugucacucaccaggccugca

SEQ ID NO: 470062 - RNA, 22 nt, Human
accagcuguguccuggcugcag

SEQ ID NO: 470063 - RNA, 22 nt, Human
gagagcugucagcguagcaccg

SEQ ID NO: 470064 - RNA, 19 nt, Human
uuugaaaggauuguuauuu

SEQ ID NO: 470065 - RNA, 22 nt, Human
uccugccuuagagcaaggaaaa

SEQ ID NO: 470066 - RNA, 22 nt, Human
aaggcuuuaugugaccaaaaga

SEQ ID NO: 470067 - RNA, 22 nt, Human
uuagggaaggcugcugucagcu

SEQ ID NO: 470068 - RNA, 22 nt, Human
uguuuauaccuugguauaacca

SEQ ID NO: 470069 - RNA, 22 nt, Human
cacauccuucagcugagcccag

SEQ ID NO: 470070 - RNA, 22 nt, Human
ccacagggcucuaggcgcuucc

SEQ ID NO: 470071 - RNA, 22 nt, Human
acuuccugcuaugagcuucugu

SEQ ID NO: 470072 - RNA, 20 nt, Human
aucuggcucagauccugcag

SEQ ID NO: 470073 - RNA, 22 nt, Human
gugcuuucugcaugguuccuac

SEQ ID NO: 470074 - RNA, 22 nt, Human
uggccugggccggcagauauac

SEQ ID NO: 470075 - RNA, 22 nt, Human
acauuucugcuagaauagguga

SEQ ID NO: 470076 - RNA, 22 nt, Human
caguuucucucauacauauuug

SEQ ID NO: 470077 - RNA, 22 nt, Human
ccacccugagccgcaagagcag

SEQ ID NO: 470078 - RNA, 22 nt, Human
aagauggagcacgagcagaagc

SEQ ID NO: 470079 - RNA, 22 nt, Human
gaaauccaguucccuacucuua

SEQ ID NO: 470080 - RNA, 22 nt, Human
gggcugcugccaaucacagccu

SEQ ID NO: 470081 - RNA, 22 nt, Human
ucucaccaaagccuugaccaua

SEQ ID NO: 470082 - RNA, 22 nt, Human
aacaugaagguaggaugguuuu

SEQ ID NO: 470083 - RNA, 22 nt, Human
cuguuauuucugccaggugagu

SEQ ID NO: 470084 - RNA, 19 nt, Human
gggcucuggccucaguggg

SEQ ID NO: 470085 - RNA, 20 nt, Human
gaaggaagggggcaagguga

SEQ ID NO: 470086 - RNA, 22 nt, Human
aaugaugguauugaugagcuaa

SEQ ID NO: 470087 - RNA, 22 nt, Human
ucagcaaugugauacugugcaa

SEQ ID NO: 470088 - RNA, 22 nt, Human
uagccgggugugguggaacucc

SEQ ID NO: 470089 - RNA, 18 nt, Human
agcagcugugccacacug

SEQ ID NO: 470090 - RNA, 20 nt, Human
gacauucauaguuauuacca

SEQ ID NO: 470091 - RNA, 22 nt, Human
gauaccagacagggagggagaa

SEQ ID NO: 470092 - RNA, 22 nt, Human
aaggccaacuaggaugagcuag

SEQ ID NO: 470093 - RNA, 22 nt, Human
uccagcucuaacaugcugggcc

SEQ ID NO: 470094 - RNA, 22 nt, Human
agggagcuuccgaacuacagcu

SEQ ID NO: 470095 - RNA, 22 nt, Human
acuuugcagagccagaagagaa

SEQ ID NO: 470096 - RNA, 22 nt, Human
cagucccagcugcucagaaggc

SEQ ID NO: 470097 - RNA, 22 nt, Human
uucaggauaugugauaucugaa

SEQ ID NO: 470098 - RNA, 22 nt, Human
ucuguuccauguuuuguuccau

SEQ ID NO: 470099 - RNA, 22 nt, Human
uguaaguaguaauggaaggaca

SEQ ID NO: 470100 - RNA, 22 nt, Human
uccugcagcugaagcucaugug

SEQ ID NO: 470101 - RNA, 22 nt, Human
caggcagagaggagcauuuaau

SEQ ID NO: 470102 - RNA, 22 nt, Human
caaaagcaguucuaucugaguu

SEQ ID NO: 470103 - RNA, 22 nt, Human
gaagcccaggcuuccuuggcuu

SEQ ID NO: 470104 - RNA, 22 nt, Human
cagucccacuagugccaauacc

SEQ ID NO: 470105 - RNA, 22 nt, Human
aguauguauuuuauacuuacag

SEQ ID NO: 470106 - RNA, 22 nt, Human
acacauaagccuaaucaucucc

SEQ ID NO: 470107 - RNA, 22 nt, Human
uaaaggcuuuuacaggagugca

SEQ ID NO: 470108 - RNA, 22 nt, Human
ggcugcagcagagggacucacg

SEQ ID NO: 470109 - RNA, 22 nt, Human
cgaggcagggaagcugcaaaag

SEQ ID NO: 470110 - RNA, 21 nt, Human
ggcuguggagccaugacucac

SEQ ID NO: 470111 - RNA, 22 nt, Human
aaggagaguacaggaguuggua

SEQ ID NO: 470112 - RNA, 22 nt, Human
gaaggcuugcagcucuguggca

SEQ ID NO: 470113 - RNA, 22 nt, Human
gggcguggauggucagugcagg

SEQ ID NO: 470114 - RNA, 22 nt, Human
uaaggcacacaguugcugcaug

SEQ ID NO: 470115 - RNA, 22 nt, Human
ccucagagccuccagaaggaau

SEQ ID NO: 470116 - RNA, 22 nt, Human
auuauaaagaacaugugugugg

SEQ ID NO: 470117 - RNA, 18 nt, Human
aggugcagccucugaggc

SEQ ID NO: 470118 - RNA, 22 nt, Human
uucaaugagcccggggccauag

SEQ ID NO: 470119 - RNA, 22 nt, Human
cugggcuccuaaccauccaggu

SEQ ID NO: 470120 - RNA, 21 nt, Human
uagaaaucagcuggugccucu

SEQ ID NO: 470121 - RNA, 22 nt, Human
uggggacaggagacuuacagcu

SEQ ID NO: 470122 - RNA, 22 nt, Human
cagcugaacauguagagcaucu

SEQ ID NO: 470123 - RNA, 22 nt, Human
uauaauuuaucaugucacaguu

SEQ ID NO: 470124 - RNA, 19 nt, Human
aggcagucauuggaauaua

SEQ ID NO: 470125 - RNA, 20 nt, Human
ggggcccaagcccucuugcc

SEQ ID NO: 470126 - RNA, 22 nt, Human
acuuugaaggggaacauuuuaa

SEQ ID NO: 470127 - RNA, 22 nt, Human
uuauacuaaaacgcauugaauu

SEQ ID NO: 470128 - RNA, 22 nt, Human
ccaaagucuggagcagcagagc

SEQ ID NO: 470129 - RNA, 22 nt, Human
caguggccaugguggcaggggu

SEQ ID NO: 470130 - RNA, 22 nt, Human
gcuguuccugcuuagaggucgg

SEQ ID NO: 470131 - RNA, 22 nt, Human
aguguggguuuuauggagcccu

SEQ ID NO: 470132 - RNA, 22 nt, Human
uggagcagccaugaugacagag

SEQ ID NO: 470133 - RNA, 22 nt, Human
augugacaauauuuggucuuau

SEQ ID NO: 470134 - RNA, 22 nt, Human
ccagcccuugcugaaggguggc

SEQ ID NO: 470135 - RNA, 22 nt, Human
uguaugcagggcuuguaugcag

SEQ ID NO: 470136 - RNA, 22 nt, Human
cucaccacagagccuguccagc

SEQ ID NO: 470137 - RNA, 22 nt, Human
aaagucuuuauuuuguaucuuu

SEQ ID NO: 470138 - RNA, 22 nt, Human
ucagggcaggcgagcagcugcu

SEQ ID NO: 470139 - RNA, 23 nt, Human
cagaccuggcagucauccucaac

SEQ ID NO: 470140 - RNA, 22 nt, Human
cugcugcucgaccagucccagg

SEQ ID NO: 470141 - RNA, 21 nt, Human
agaaauguaucauucuuuucc

SEQ ID NO: 470142 - RNA, 22 nt, Human
ggcaaaaaguucccaucagugu

SEQ ID NO: 470143 - RNA, 22 nt, Human
auuucauugaaguuaauucuuc

SEQ ID NO: 470144 - RNA, 22 nt, Human
gaaauguguuguucauuucuaa

SEQ ID NO: 470145 - RNA, 22 nt, Human
cagcuuuauuucacguguuugu

SEQ ID NO: 470146 - RNA, 22 nt, Human
ugcccagcugucaaaguagaua

SEQ ID NO: 470147 - RNA, 22 nt, Human
uguaugcaccauuguauuaccu

SEQ ID NO: 470148 - RNA, 22 nt, Human
uggcagagcaaaaagauagaau

SEQ ID NO: 470149 - RNA, 22 nt, Human
aacaugaaguuuucuauaguga

SEQ ID NO: 470150 - RNA, 22 nt, Human
agggaagugaaugacagauauc

SEQ ID NO: 470151 - RNA, 22 nt, Human
uucuuuggggaauauucugguu

SEQ ID NO: 470152 - RNA, 21 nt, Human
agcagagugcuuugacuuugu

SEQ ID NO: 470153 - RNA, 22 nt, Human
aacagacaacuccuguggcuca

SEQ ID NO: 470154 - RNA, 22 nt, Human
ggaggccuugaggccaggagcu

SEQ ID NO: 470155 - RNA, 22 nt, Human
ugucucugcuuuccuugcaggg

SEQ ID NO: 470156 - RNA, 22 nt, Human
agccagugaugaagacucugga

SEQ ID NO: 470157 - RNA, 22 nt, Human
aaaaugaauaaguuaacccagg

SEQ ID NO: 470158 - RNA, 22 nt, Human
auuuaaauuuucugauggagag

SEQ ID NO: 470159 - RNA, 22 nt, Human
gcagggaccagggccagaucca

SEQ ID NO: 470160 - RNA, 22 nt, Human
gcucugcucuugacuuaccagg

SEQ ID NO: 470161 - RNA, 20 nt, Human
aggaaaaggguggugguaga

SEQ ID NO: 470162 - RNA, 22 nt, Human
acagcuuugggcaaugcuauga

SEQ ID NO: 470163 - RNA, 22 nt, Human
uggcugaggcacagcugccgcc

SEQ ID NO: 470164 - RNA, 17 nt, Human
gagugcugguggagcuc

SEQ ID NO: 470165 - RNA, 22 nt, Human
aaacuagagcaugugaguggga

SEQ ID NO: 470166 - RNA, 22 nt, Human
uugcauguguaauuuuucuaaa

SEQ ID NO: 470167 - RNA, 22 nt, Human
augcagguugggcaaguguggg

SEQ ID NO: 470168 - RNA, 22 nt, Human
agcuucucaggagucugaggca

SEQ ID NO: 470169 - RNA, 22 nt, Human
ucucagagagcuguguuuuccu

SEQ ID NO: 470170 - RNA, 22 nt, Human
ugcaucuguucagagcugucga

SEQ ID NO: 470171 - RNA, 22 nt, Human
cuuacauuaaguaagagauuga

SEQ ID NO: 470172 - RNA, 21 nt, Human
uguucacauggagcagaaugu

SEQ ID NO: 470173 - RNA, 22 nt, Human
gcaggcugauagaggauuccau

SEQ ID NO: 470174 - RNA, 22 nt, Human
uuuuuccuagcgauuugucagc

SEQ ID NO: 470175 - RNA, 22 nt, Human
cuggagccuucaccaggggaaa

SEQ ID NO: 470176 - RNA, 20 nt, Human
gaggcugcggacugcuggac

SEQ ID NO: 470177 - RNA, 22 nt, Human
gaagagcuguagccugcucuuu

SEQ ID NO: 470178 - RNA, 22 nt, Human
ccaggacucaguggggaaaggg

SEQ ID NO: 470179 - RNA, 22 nt, Human
ugacaaaacugcaauuacuuuu

SEQ ID NO: 470180 - RNA, 22 nt, Human
acaguguguuggaggagacugu

SEQ ID NO: 470181 - RNA, 22 nt, Human
aggacagugguguucuggagug

SEQ ID NO: 470182 - RNA, 22 nt, Human
gccucugcaucaucacuccagc

SEQ ID NO: 470183 - RNA, 22 nt, Human
guggugaagccccaucucugcu

SEQ ID NO: 470184 - RNA, 22 nt, Human
accaugaucugcucugguguuu

SEQ ID NO: 470185 - RNA, 22 nt, Human
uguuuaagcugaugagguaucg

SEQ ID NO: 470186 - RNA, 22 nt, Human
ucugccuuuucacugccacuaa

SEQ ID NO: 470187 - RNA, 22 nt, Human
aggggccauuguucugcccgcu

SEQ ID NO: 470188 - RNA, 21 nt, Human
uucuccccagcgaauccucgg

SEQ ID NO: 470189 - RNA, 22 nt, Human
ccugcuucagggaugauggcac

SEQ ID NO: 470190 - RNA, 22 nt, Human
gugcuuccugccuggugccuuu

SEQ ID NO: 470191 - RNA, 22 nt, Human
cucuuaaagcuuccaguuucaa

SEQ ID NO: 470192 - RNA, 22 nt, Human
cuuggcagcuuuuggaggagcc

SEQ ID NO: 470193 - RNA, 22 nt, Human
agggccuggcuucacuuucuca

SEQ ID NO: 470194 - RNA, 22 nt, Human
uucacagacauugcagacugaa

SEQ ID NO: 470195 - RNA, 22 nt, Human
gaagucuggcugacgagaguua

SEQ ID NO: 470196 - RNA, 22 nt, Human
gaagccacagagauuguggggg

SEQ ID NO: 470197 - RNA, 22 nt, Human
gguccccguggaggcuggagcg

SEQ ID NO: 470198 - RNA, 22 nt, Human
gagauggggucagcugggacau

SEQ ID NO: 470199 - RNA, 22 nt, Human
uuucuuaggcucuaaaaugacu

SEQ ID NO: 470200 - RNA, 22 nt, Human
aaguccaguuuuuccagguggu

SEQ ID NO: 470201 - RNA, 20 nt, Human
ugggccugagccugugggcu

SEQ ID NO: 470202 - RNA, 22 nt, Human
auggauaagucaaagaguaucc

SEQ ID NO: 470203 - RNA, 18 nt, Human
uggagcagguaggcauga

SEQ ID NO: 470204 - RNA, 22 nt, Human
aagcagaugggacuccaaggca

SEQ ID NO: 470205 - RNA, 22 nt, Human
cccagggaagggcuaccugagg

SEQ ID NO: 470206 - RNA, 22 nt, Human
ccagucccaucucugucgcuua

SEQ ID NO: 470207 - RNA, 22 nt, Human
cagcaguguacaaggugucaga

SEQ ID NO: 470208 - RNA, 22 nt, Human
gcuuccucgcugggcagaggca

SEQ ID NO: 470209 - RNA, 20 nt, Human
ccugucuggagacaaagaga

SEQ ID NO: 470210 - RNA, 22 nt, Human
caugaagcauguuuugucauga

SEQ ID NO: 470211 - RNA, 22 nt, Human
cauugcacuucugcuuuuccuc

SEQ ID NO: 470212 - RNA, 22 nt, Human
gagugcaguaugagaggcugcu

SEQ ID NO: 470213 - RNA, 22 nt, Human
aggaccugcuaaugugccaagu

SEQ ID NO: 470214 - RNA, 22 nt, Human
gugccuuccccgguggucuguu

SEQ ID NO: 470215 - RNA, 21 nt, Human
gcccucaggggaggauggccu

SEQ ID NO: 470216 - RNA, 22 nt, Human
accucugcaacccuggaauggg

SEQ ID NO: 470217 - RNA, 23 nt, Human
aggagacagggaagugccuggcu

SEQ ID NO: 470218 - RNA, 22 nt, Human
uuaaaguucauuaaaugagcca

SEQ ID NO: 470219 - RNA, 22 nt, Human
aaggugaaacuggaagcuggcc

SEQ ID NO: 470220 - RNA, 22 nt, Human
cuggcucagugccuucagaagu

SEQ ID NO: 470221 - RNA, 22 nt, Human
gggaggucagggugccugcugg

SEQ ID NO: 470222 - RNA, 22 nt, Human
uccaggcuccccugcgugcucc

SEQ ID NO: 470223 - RNA, 22 nt, Human
uauguacaucguugaauucaaa

SEQ ID NO: 470224 - RNA, 22 nt, Human
gccuggcugagguggggaggca

SEQ ID NO: 470225 - RNA, 21 nt, Human
ccaggcagagcugugaguucu

SEQ ID NO: 470226 - RNA, 22 nt, Human
acaaaguuugugguauuccaag

SEQ ID NO: 470227 - RNA, 22 nt, Human
gccugaaguuucaugccucuau

SEQ ID NO: 470228 - RNA, 22 nt, Human
gcagggcaguaagagcuagagu

SEQ ID NO: 470229 - RNA, 22 nt, Human
ccagagccugcugagccccauu

SEQ ID NO: 470230 - RNA, 22 nt, Human
uaaaggcuuuuagugaugguaa

SEQ ID NO: 470231 - RNA, 22 nt, Human
ugcaggcucacccuggagcuga

SEQ ID NO: 470232 - RNA, 22 nt, Human
gggcuggaggaccggccucgga

SEQ ID NO: 470233 - RNA, 22 nt, Human
uauuaggguuuugaagguuugu

SEQ ID NO: 470234 - RNA, 22 nt, Human
ugagcuggucacuccuucugaa

SEQ ID NO: 470235 - RNA, 22 nt, Human
agacagcugcucgcagagcuau

SEQ ID NO: 470236 - RNA, 22 nt, Human
gagccagccuucuucugagguc

SEQ ID NO: 470237 - RNA, 22 nt, Human
uuuuuauaugaaggauagugcg

SEQ ID NO: 470238 - RNA, 22 nt, Human
cuguccauuuucgugccuccuu

SEQ ID NO: 470239 - RNA, 22 nt, Human
gucagcaggguccccuugagug

SEQ ID NO: 470240 - RNA, 22 nt, Human
ccagcccuugagauggaaggga

SEQ ID NO: 470241 - RNA, 22 nt, Human
augcagcugugggcaagaaaug

SEQ ID NO: 470242 - RNA, 22 nt, Human
agcugguucagaaauuagaugg

SEQ ID NO: 470243 - RNA, 22 nt, Human
gcuguauuuauuuucuaggguu

SEQ ID NO: 470244 - RNA, 22 nt, Human
acaggccuuggcaggcauguga

SEQ ID NO: 470245 - RNA, 22 nt, Human
auuuucucucaaaccuuaaaau

SEQ ID NO: 470246 - RNA, 23 nt, Human
uggaccugaaccagugccucugu

SEQ ID NO: 470247 - RNA, 22 nt, Human
caagaaauguuuacugagcauc

SEQ ID NO: 470248 - RNA, 22 nt, Human
acugccuugucucuugccuguu

SEQ ID NO: 470249 - RNA, 22 nt, Human
agccaagcacucaacuccugga

SEQ ID NO: 470250 - RNA, 22 nt, Human
ggcucagguuaccagucccucc

SEQ ID NO: 470251 - RNA, 22 nt, Human
ugcagggccuugggaugugucc

SEQ ID NO: 470252 - RNA, 22 nt, Human
uguuucagucccuguguucaau

SEQ ID NO: 470253 - RNA, 22 nt, Human
aagccaggcugcacuugcuggg

SEQ ID NO: 470254 - RNA, 22 nt, Human
guaacagaaagucaugcucauu

SEQ ID NO: 470255 - RNA, 22 nt, Human
cagcagccuacaaugcacagaa

SEQ ID NO: 470256 - RNA, 22 nt, Human
cugcaggcugagcgccugccgg

SEQ ID NO: 470257 - RNA, 22 nt, Human
gcuggagccaagcugcucuugg

SEQ ID NO: 470258 - RNA, 22 nt, Human
cuggcaggcagacuucugcaag

SEQ ID NO: 470259 - RNA, 22 nt, Human
cagagcuggcggugagaagaca

SEQ ID NO: 470260 - RNA, 22 nt, Human
aucaggaagccagucuaaugga

SEQ ID NO: 470261 - RNA, 22 nt, Human
uagcugccuagacagcuauagc

SEQ ID NO: 470262 - RNA, 22 nt, Human
caggcugggaacgccacccgcu

SEQ ID NO: 470263 - RNA, 22 nt, Human
uuagccauugucagcacauggc

SEQ ID NO: 470264 - RNA, 22 nt, Human
uggcucaguuuagcagcucagu

SEQ ID NO: 470265 - RNA, 22 nt, Human
ccuacacaucucaccucacagg

SEQ ID NO: 470266 - RNA, 22 nt, Human
aaagcaaucagauucagauguc

SEQ ID NO: 470267 - RNA, 22 nt, Human
caggaggaacaagagguucugg

SEQ ID NO: 470268 - RNA, 22 nt, Human
cuggccaggcuugggacagaca

SEQ ID NO: 470269 - RNA, 22 nt, Human
aaggcucuuggagugaaugcag

SEQ ID NO: 470270 - RNA, 22 nt, Human
cugcugugcaacauugcaccua

SEQ ID NO: 470271 - RNA, 22 nt, Human
ugcuuuaucugacuuggcgcug

SEQ ID NO: 470272 - RNA, 22 nt, Human
uccuucagaaaaccucagucuu

SEQ ID NO: 470273 - RNA, 22 nt, Human
ugucucaucucuuaaccccacu

SEQ ID NO: 470274 - RNA, 22 nt, Human
gcaaggaccuuugagcgugcca

SEQ ID NO: 470275 - RNA, 22 nt, Human
aaagccuugggauuugugauca

SEQ ID NO: 470276 - RNA, 22 nt, Human
agccaggcuacuccuugcugac

SEQ ID NO: 470277 - RNA, 22 nt, Human
augcuguguggucaaguuaauu

SEQ ID NO: 470278 - RNA, 22 nt, Human
aagggcugggucugguuaaccc

SEQ ID NO: 470279 - RNA, 22 nt, Human
ucaaaggcgguccaggaauaaa

SEQ ID NO: 470280 - RNA, 22 nt, Human
gcuggagguuucaccugaguuu

SEQ ID NO: 470281 - RNA, 22 nt, Human
aauaugugagguauguucagug

SEQ ID NO: 470282 - RNA, 22 nt, Human
ggccucugggguccugagccca

SEQ ID NO: 470283 - RNA, 22 nt, Human
gaggugaguggaucacgagguc

SEQ ID NO: 470284 - RNA, 22 nt, Human
agugaaauaaagcugccuaugg

SEQ ID NO: 470285 - RNA, 22 nt, Human
uggcucucaggccugcugcguu

SEQ ID NO: 470286 - RNA, 22 nt, Human
cagcuggcguggagugauugca

SEQ ID NO: 470287 - RNA, 22 nt, Human
acauuucuucccuuuagcagaa

SEQ ID NO: 470288 - RNA, 22 nt, Human
caacuuuaugauugguuuguca

SEQ ID NO: 470289 - RNA, 22 nt, Human
acacuucucccaucuccuguug

SEQ ID NO: 470290 - RNA, 22 nt, Human
ccagggcuccauugcucauccu

SEQ ID NO: 470291 - RNA, 22 nt, Human
gcagggcacagacagugccaag

SEQ ID NO: 470292 - RNA, 22 nt, Human
auaaggcaagcugucaguuugu

SEQ ID NO: 470293 - RNA, 19 nt, Human
guaagggcuaauggacuau

SEQ ID NO: 470294 - RNA, 22 nt, Human
acuuccuguguuggucuugcug

SEQ ID NO: 470295 - RNA, 22 nt, Human
cugucucucuaggacacugggg

SEQ ID NO: 470296 - RNA, 22 nt, Human
aaggagucugggccauucagag

SEQ ID NO: 470297 - RNA, 22 nt, Human
ugauuucauaguauauacauga

SEQ ID NO: 470298 - RNA, 22 nt, Human
aaggcagucugguuucaaagca

SEQ ID NO: 470299 - RNA, 22 nt, Human
aagauuucucuccuggaaagca

SEQ ID NO: 470300 - RNA, 22 nt, Human
caggagugaguuggggucuaca

SEQ ID NO: 470301 - RNA, 18 nt, Human
aggcacuggaauuaaggg

SEQ ID NO: 470302 - RNA, 22 nt, Human
aagcagcuuaaauuagagccug

SEQ ID NO: 470303 - RNA, 22 nt, Human
uuccuuccgggcaccaggcacu

SEQ ID NO: 470304 - RNA, 22 nt, Human
agggcagcagcggcccaggccu

SEQ ID NO: 470305 - RNA, 20 nt, Human
ugcccagcaagagugcaguu

SEQ ID NO: 470306 - RNA, 22 nt, Human
cugaaggaagcagaagcgaggu

SEQ ID NO: 470307 - RNA, 22 nt, Human
gugcauuuggugacucucaccc

SEQ ID NO: 470308 - RNA, 22 nt, Human
cuccagugcacccagaggauuu

SEQ ID NO: 470309 - RNA, 22 nt, Human
cugcaggcccccuuccuggagu

SEQ ID NO: 470310 - RNA, 22 nt, Human
augagcugggccauccagugau

SEQ ID NO: 470311 - RNA, 22 nt, Human
uccauuuuguagguaugcuaca

SEQ ID NO: 470312 - RNA, 22 nt, Human
ucagagcuaaggggagagcaaa

SEQ ID NO: 470313 - RNA, 22 nt, Human
cagaggcagaggucaucucugg

SEQ ID NO: 470314 - RNA, 22 nt, Human
gugcuuaauacaugucaauaac

SEQ ID NO: 470315 - RNA, 22 nt, Human
aagcuuuaagugucagucagcc

SEQ ID NO: 470316 - RNA, 22 nt, Human
ggcugcugaguuggccaggaga

SEQ ID NO: 470317 - RNA, 22 nt, Human
cagaggcaaaagagguggaggu

SEQ ID NO: 470318 - RNA, 19 nt, Human
ucugccucuggucaggcuc

SEQ ID NO: 470319 - RNA, 22 nt, Human
uucuuucccaguagaugugaaa

SEQ ID NO: 470320 - RNA, 22 nt, Human
uggccuggcucacagugagauu

SEQ ID NO: 470321 - RNA, 22 nt, Human
ucucccacugcaagcccaggcu

SEQ ID NO: 470322 - RNA, 22 nt, Human
ucccagaggcaguugguaacuu

SEQ ID NO: 470323 - RNA, 22 nt, Human
uagaaacacagaucugguguca

SEQ ID NO: 470324 - RNA, 22 nt, Human
ggugaagggugucauggcauuu

SEQ ID NO: 470325 - RNA, 22 nt, Human
gcuggagcuugagaggacaggg

SEQ ID NO: 470326 - RNA, 22 nt, Human
cugcagaggccucgccuccucu

SEQ ID NO: 470327 - RNA, 22 nt, Human
ugcugccuucuaggcgugcccu

SEQ ID NO: 470328 - RNA, 22 nt, Human
ucgggcucgcucuccuagcgga

SEQ ID NO: 470329 - RNA, 22 nt, Human
agggcagcuggaagguggcuuc

SEQ ID NO: 470330 - RNA, 22 nt, Human
accagagcagacuacuggaggu

SEQ ID NO: 470331 - RNA, 22 nt, Human
uguguuuuacaaauucucuuaa

SEQ ID NO: 470332 - RNA, 22 nt, Human
ugucacauguguggcauuuuuc

SEQ ID NO: 470333 - RNA, 22 nt, Human
uuugaaagcuacuuucggguca

SEQ ID NO: 470334 - RNA, 22 nt, Human
gggagggaaggaccuuaugaau

SEQ ID NO: 470335 - RNA, 22 nt, Human
uggccucaagucugagggccuu

SEQ ID NO: 470336 - RNA, 23 nt, Human
ucagaaugcacugaauuuacccu

SEQ ID NO: 470337 - RNA, 22 nt, Human
agcugggccugagcuggaagcu

SEQ ID NO: 470338 - RNA, 20 nt, Human
ggcagagggccugggagaag

SEQ ID NO: 470339 - RNA, 22 nt, Human
aaggugucaccagauuggcagg

SEQ ID NO: 470340 - RNA, 22 nt, Human
ugcacagcgggugucugucagg

SEQ ID NO: 470341 - RNA, 22 nt, Human
ggggauggaauguaguagugau

SEQ ID NO: 470342 - RNA, 22 nt, Human
gcaguggcaccgcuggcucugg

SEQ ID NO: 470343 - RNA, 22 nt, Human
acucaguacaucuggaguuggc

SEQ ID NO: 470344 - RNA, 22 nt, Human
augcaguauaaaucauuucugg

SEQ ID NO: 470345 - RNA, 22 nt, Human
aguggugcugcgcgcggagcuc

SEQ ID NO: 470346 - RNA, 22 nt, Human
acauuucuccuugcaggaguca

SEQ ID NO: 470347 - RNA, 22 nt, Human
uuucuacagcuggugcaacuuu

SEQ ID NO: 470348 - RNA, 16 nt, Human
agaggccuugaggaag

SEQ ID NO: 470349 - RNA, 22 nt, Human
ucuuauuauuguuguaaaagca

SEQ ID NO: 470350 - RNA, 22 nt, Human
ucugagaguacgggcugcgcgc

SEQ ID NO: 470351 - RNA, 22 nt, Human
gagcugaaauaugaagccaauu

SEQ ID NO: 470352 - RNA, 22 nt, Human
gcucucuguuauuaagaucuuu

SEQ ID NO: 470353 - RNA, 22 nt, Human
acaggugaccugcucauaugaa

SEQ ID NO: 470354 - RNA, 23 nt, Human
uggagcugggcucagacccuggg

SEQ ID NO: 470355 - RNA, 22 nt, Human
gcuguccagagcaugggagcaa

SEQ ID NO: 470356 - RNA, 22 nt, Human
cuggagccugcaguuuucacuu

SEQ ID NO: 470357 - RNA, 22 nt, Human
gccagagcaugcacugccugca

SEQ ID NO: 470358 - RNA, 22 nt, Human
ucaggagacuuaugucacagug

SEQ ID NO: 470359 - RNA, 17 nt, Human
gucugggcuuuagagac

SEQ ID NO: 470360 - RNA, 22 nt, Human
ugucucugugagaucugacgau

SEQ ID NO: 470361 - RNA, 22 nt, Human
gaggcagcaggcugaggaggau

SEQ ID NO: 470362 - RNA, 22 nt, Human
ugaaugauguauaauauugaga

SEQ ID NO: 470363 - RNA, 22 nt, Human
uggaaggcaugggaacuguucu

SEQ ID NO: 470364 - RNA, 22 nt, Human
gccuuggccuuccuaggccuga

SEQ ID NO: 470365 - RNA, 22 nt, Human
uuucuucucgacaccuuauccc

SEQ ID NO: 470366 - RNA, 22 nt, Human
ggcuuuauuauguggccaugug

SEQ ID NO: 470367 - RNA, 22 nt, Human
uggucagacaaaggagaauguu

SEQ ID NO: 470368 - RNA, 22 nt, Human
acaguucccgucuugcacagcu

SEQ ID NO: 470369 - RNA, 18 nt, Human
cagcugugcccuguuugg

SEQ ID NO: 470370 - RNA, 22 nt, Human
ucuuaaaaguaugccaauugga

SEQ ID NO: 470371 - RNA, 22 nt, Human
auaugcacauacauacauaggu

SEQ ID NO: 470372 - RNA, 22 nt, Human
ccugugugcugaugacgacaga

SEQ ID NO: 470373 - RNA, 22 nt, Human
uggcaggaaaguaacagagcac

SEQ ID NO: 470374 - RNA, 22 nt, Human
ccucaggaaaugaauaaauggc

SEQ ID NO: 470375 - RNA, 22 nt, Human
ucugccuggauuccauucucca

SEQ ID NO: 470376 - RNA, 22 nt, Human
aagcccagcugaaagcauuuuu

SEQ ID NO: 470377 - RNA, 22 nt, Human
cagcugcaugucuguggugguc

SEQ ID NO: 470378 - RNA, 22 nt, Human
gaaggaagucauuagugcagac

SEQ ID NO: 470379 - RNA, 22 nt, Human
agccaggcgggucuuugcuccu

SEQ ID NO: 470380 - RNA, 22 nt, Human
cccaucaggaacccaggagccc

SEQ ID NO: 470381 - RNA, 22 nt, Human
cugggcugucccaaccccaucc

SEQ ID NO: 470382 - RNA, 22 nt, Human
ccuggcagguggcgcccucggc

SEQ ID NO: 470383 - RNA, 22 nt, Human
gguggccucucaugcaagguag

SEQ ID NO: 470384 - RNA, 22 nt, Human
gggguugguuuaaaugcuugag

SEQ ID NO: 470385 - RNA, 21 nt, Human
acaggcucuggggaugcuggg

SEQ ID NO: 470386 - RNA, 22 nt, Human
cuggccaguuguccuggcuugg

SEQ ID NO: 470387 - RNA, 22 nt, Human
ucucaggguuuccugggggcug

SEQ ID NO: 470388 - RNA, 20 nt, Human
cuucaggacccauccucccc

SEQ ID NO: 470389 - RNA, 22 nt, Human
aggcucagagaugaguaagcac

SEQ ID NO: 470390 - RNA, 22 nt, Human
agugcagaguacauuuguggca

SEQ ID NO: 470391 - RNA, 22 nt, Human
uaacagaagaaaacauauugga

SEQ ID NO: 470392 - RNA, 22 nt, Human
cagacacagauaugcauauggc

SEQ ID NO: 470393 - RNA, 22 nt, Human
ucaccagggagcuuguccucug

SEQ ID NO: 470394 - RNA, 22 nt, Human
uguauuuuuagaccuuuagacc

SEQ ID NO: 470395 - RNA, 22 nt, Human
gaagcccauuuguacagcacau

SEQ ID NO: 470396 - RNA, 22 nt, Human
agccagggagguggagguugca

SEQ ID NO: 470397 - RNA, 20 nt, Human
ggcagccaaucagcgugccg

SEQ ID NO: 470398 - RNA, 22 nt, Human
gaggcacaguguuuggucagug

SEQ ID NO: 470399 - RNA, 22 nt, Human
ccugaagagcacucuagaguug

SEQ ID NO: 470400 - RNA, 21 nt, Human
aggugccaaggagaagcaggc

SEQ ID NO: 470401 - RNA, 22 nt, Human
agcaggagaacacuguggcucu

SEQ ID NO: 470402 - RNA, 22 nt, Human
auaauaaaccaggaugggucug

SEQ ID NO: 470403 - RNA, 22 nt, Human
gcucugcuugcaucaugacugc

SEQ ID NO: 470404 - RNA, 22 nt, Human
cagugauguuucugcaucagag

SEQ ID NO: 470405 - RNA, 22 nt, Human
ugcuggggucauggggcgcccg

SEQ ID NO: 470406 - RNA, 19 nt, Human
gccaggagggcucuggcug

SEQ ID NO: 470407 - RNA, 22 nt, Human
ggccaccuuccaguugccugca

SEQ ID NO: 470408 - RNA, 22 nt, Human
uccagccaugacucggacagug

SEQ ID NO: 470409 - RNA, 22 nt, Human
gccacucaugggaggugugcaa

SEQ ID NO: 470410 - RNA, 18 nt, Human
uacaugcauaaaugaagc

SEQ ID NO: 470411 - RNA, 22 nt, Human
ggccugagcucuggggaggcaa

SEQ ID NO: 470412 - RNA, 22 nt, Human
ucucuggccgagagucccuggg

SEQ ID NO: 470413 - RNA, 23 nt, Human
cccagcagagaugaggagggguc

SEQ ID NO: 470414 - RNA, 22 nt, Human
agcagcauagaugcuauccgag

SEQ ID NO: 470415 - RNA, 19 nt, Human
uggcagcauugguaccuug

SEQ ID NO: 470416 - RNA, 21 nt, Human
guggcucugccaggacugaaa

SEQ ID NO: 470417 - RNA, 22 nt, Human
gagggcaggggucuugcacggu

SEQ ID NO: 470418 - RNA, 22 nt, Human
agcauggggcuccgcaaugaac

SEQ ID NO: 470419 - RNA, 23 nt, Human
ugcucugugaauaguuggugacu

SEQ ID NO: 470420 - RNA, 22 nt, Human
cuccagggagcuguggagguuu

SEQ ID NO: 470421 - RNA, 22 nt, Human
gcucugaggcugggagcacucu

SEQ ID NO: 470422 - RNA, 21 nt, Human
uuuauuaacaacuguggacgu

SEQ ID NO: 470423 - RNA, 22 nt, Human
auugucugaauccaaagcucug

SEQ ID NO: 470424 - RNA, 22 nt, Human
ccagggcuggugggagaugcug

SEQ ID NO: 470425 - RNA, 22 nt, Human
gcaggagcucguuuccaggcug

SEQ ID NO: 470426 - RNA, 22 nt, Human
aaaguguaaggaauuuaaguaa

SEQ ID NO: 470427 - RNA, 22 nt, Human
uuuaccaagcuuuaauuacaua

SEQ ID NO: 470428 - RNA, 22 nt, Human
cagcaggaaagacaucugagca

SEQ ID NO: 470429 - RNA, 22 nt, Human
ugagcagagucgcuccagagug

SEQ ID NO: 470430 - RNA, 22 nt, Human
cauuugcaagagauaaauguuu

SEQ ID NO: 470431 - RNA, 21 nt, Human
gacaggggaagaagcaaggag

SEQ ID NO: 470432 - RNA, 22 nt, Human
gcugggcaccggagagacccca

SEQ ID NO: 470433 - RNA, 22 nt, Human
aaaucaguuaagaugaggccau

SEQ ID NO: 470434 - RNA, 22 nt, Human
aguaucaaggaucuccagcacc

SEQ ID NO: 470435 - RNA, 22 nt, Human
auuauuagugauguuguuacug

SEQ ID NO: 470436 - RNA, 22 nt, Human
agguuauaugucauacugaagu

SEQ ID NO: 470437 - RNA, 22 nt, Human
cccuggaggaccccaauguggc

SEQ ID NO: 470438 - RNA, 22 nt, Human
gcacugcaucuacuggcaagua

SEQ ID NO: 470439 - RNA, 22 nt, Human
cccugcagagagugcuuuugug

SEQ ID NO: 470440 - RNA, 18 nt, Human
acaggccucaguccugca

SEQ ID NO: 470441 - RNA, 22 nt, Human
ugcaauaacccaguaucuguga

SEQ ID NO: 470442 - RNA, 22 nt, Human
ggcagcuuuuaucccugacaga

SEQ ID NO: 470443 - RNA, 22 nt, Human
gugggugauguacuggaggcca

SEQ ID NO: 470444 - RNA, 22 nt, Human
ggaucauuaacacauccaucac

SEQ ID NO: 470445 - RNA, 22 nt, Human
gagggcucuaccaaguaacucu

SEQ ID NO: 470446 - RNA, 22 nt, Human
ucucuuucuauugcaccaugcu

SEQ ID NO: 470447 - RNA, 22 nt, Human
cauaucauaggucuuggauaau

SEQ ID NO: 470448 - RNA, 22 nt, Human
acaaaaauuagcugggcauggu

SEQ ID NO: 470449 - RNA, 22 nt, Human
uggcuucugggacuugugagca

SEQ ID NO: 470450 - RNA, 22 nt, Human
caggcagcugcgacaagagagc

SEQ ID NO: 470451 - RNA, 22 nt, Human
ggaggguuagcaaaggcacaga

SEQ ID NO: 470452 - RNA, 22 nt, Human
gggugggaacaggaugccagga

SEQ ID NO: 470453 - RNA, 22 nt, Human
ucuuaaaccacaaaauucagag

SEQ ID NO: 470454 - RNA, 22 nt, Human
cauucacagagggggaagcauc

SEQ ID NO: 470455 - RNA, 22 nt, Human
agcagccagaaauccagaggug

SEQ ID NO: 470456 - RNA, 22 nt, Human
gcagagccccauugcuggcggg

SEQ ID NO: 470457 - RNA, 22 nt, Human
ggagagcaggguccugagauac

SEQ ID NO: 470458 - RNA, 22 nt, Human
aguaaaaucuuaagcacagugg

SEQ ID NO: 470459 - RNA, 22 nt, Human
agggaaagguagugaggucaca

SEQ ID NO: 470460 - RNA, 19 nt, Human
gcgaggaagucacuguggu

SEQ ID NO: 470461 - RNA, 23 nt, Human
uucaaagcuuaagcucuuuccac

SEQ ID NO: 470462 - RNA, 22 nt, Human
gagggagagugauggaccauug

SEQ ID NO: 470463 - RNA, 22 nt, Human
cucaggauauugggcuggagca

SEQ ID NO: 470464 - RNA, 22 nt, Human
cuggacuuuggcccaucugcca

SEQ ID NO: 470465 - RNA, 22 nt, Human
uuuuccuacugauaaacaguua

SEQ ID NO: 470466 - RNA, 22 nt, Human
aaacagacugaagaguugaagc

SEQ ID NO: 470467 - RNA, 22 nt, Human
aaaaugugcaguuuuuaagcug

SEQ ID NO: 470468 - RNA, 21 nt, Human
aggcccagagucuugggggga

SEQ ID NO: 470469 - RNA, 22 nt, Human
uuggccuucccuaccugggcca

SEQ ID NO: 470470 - RNA, 22 nt, Human
ugaguccaucgcagggaagugg

SEQ ID NO: 470471 - RNA, 17 nt, Human
ugaaggccaugaccacg

SEQ ID NO: 470472 - RNA, 22 nt, Human
gugagcagaacagguggcuucu

SEQ ID NO: 470473 - RNA, 22 nt, Human
uugaagcaggaaaauuucuauu

SEQ ID NO: 470474 - RNA, 22 nt, Human
gagccagccgcaagagcuguga

SEQ ID NO: 470475 - RNA, 22 nt, Human
ggcagaggugaaguucacaagg

SEQ ID NO: 470476 - RNA, 22 nt, Human
ggaggaccccagcagcucccca

SEQ ID NO: 470477 - RNA, 22 nt, Human
ggcagcaggcgacuucccuauu

SEQ ID NO: 470478 - RNA, 22 nt, Human
cagcaguguggaagcugagggg

SEQ ID NO: 470479 - RNA, 22 nt, Human
cagugggugaugaguccugggg

SEQ ID NO: 470480 - RNA, 22 nt, Human
ccuggccucgugcucacggcuc

SEQ ID NO: 470481 - RNA, 22 nt, Human
aaagaugucauacacauuaaga

SEQ ID NO: 470482 - RNA, 22 nt, Human
gagggggcgugcaaggcuccgc

SEQ ID NO: 470483 - RNA, 22 nt, Human
aaauugcaaaaguacuuuuagg

SEQ ID NO: 470484 - RNA, 22 nt, Human
ucuuuccauggccacacagucu

SEQ ID NO: 470485 - RNA, 22 nt, Human
ggggcuggcucacuaagagacu

SEQ ID NO: 470486 - RNA, 22 nt, Human
cccaggcagccccagaagcuug

SEQ ID NO: 470487 - RNA, 22 nt, Human
gaggcagcaaaauauaucauaa

SEQ ID NO: 470488 - RNA, 22 nt, Human
gcagggcaaacccagguguuca

SEQ ID NO: 470489 - RNA, 22 nt, Human
cagcaggaggugagaugugacc

SEQ ID NO: 470490 - RNA, 22 nt, Human
cuggccugagcacagcggcugc

SEQ ID NO: 470491 - RNA, 22 nt, Human
uucaaugaggauagaacuggau

SEQ ID NO: 470492 - RNA, 22 nt, Human
gccagagcugagacacgagucc

SEQ ID NO: 470493 - RNA, 22 nt, Human
gcaggcucuucuuucugcccag

SEQ ID NO: 470494 - RNA, 22 nt, Human
uaggagcuaaaauauuuuauau

SEQ ID NO: 470495 - RNA, 22 nt, Human
cugccagcucucuggaggcucu

SEQ ID NO: 470496 - RNA, 22 nt, Human
aaauuucuguuguuuugagcca

SEQ ID NO: 470497 - RNA, 22 nt, Human
aucuggcuugacuuugcgacuu

SEQ ID NO: 470498 - RNA, 22 nt, Human
cuuccagagauagggccucaag

SEQ ID NO: 470499 - RNA, 22 nt, Human
ccuuccaggagucucugcaggu

SEQ ID NO: 470500 - RNA, 19 nt, Human
gggaugggcccucacccuc

SEQ ID NO: 470501 - RNA, 22 nt, Human
cugggcuguaauguggcacuga

SEQ ID NO: 470502 - RNA, 22 nt, Human
cccaggucuaugccagcucuga

SEQ ID NO: 470503 - RNA, 22 nt, Human
cacuuaagcaguuaauuuaucu

SEQ ID NO: 470504 - RNA, 18 nt, Human
aggaaagaaaggcaggug

SEQ ID NO: 470505 - RNA, 19 nt, Human
aguggcagaucuggaagua

SEQ ID NO: 470506 - RNA, 22 nt, Human
aggggcucaguuacuuuggcag

SEQ ID NO: 470507 - RNA, 22 nt, Human
cagccaggacagggaaacuagu

SEQ ID NO: 470508 - RNA, 22 nt, Human
uucugggacaucuggacaguuu

SEQ ID NO: 470509 - RNA, 22 nt, Human
ucgggguagacgccagcucgga

SEQ ID NO: 470510 - RNA, 22 nt, Human
ucagcagggcugugguguggcu

SEQ ID NO: 470511 - RNA, 23 nt, Human
uggccuggagagaaaagaugagu

SEQ ID NO: 470512 - RNA, 22 nt, Human
caguggcacccacgggcugggc

SEQ ID NO: 470513 - RNA, 22 nt, Human
uggcaggaaaaacauuggagau

SEQ ID NO: 470514 - RNA, 22 nt, Human
agagcugcaauuucauguggug

SEQ ID NO: 470515 - RNA, 22 nt, Human
cccagccugugacagccguccu

SEQ ID NO: 470516 - RNA, 22 nt, Human
gugcagugacccuggagagcug

SEQ ID NO: 470517 - RNA, 22 nt, Human
gagagcugggggacuguggaug

SEQ ID NO: 470518 - RNA, 22 nt, Human
uggcagagacaaggccgggccu

SEQ ID NO: 470519 - RNA, 22 nt, Human
accugagaccuaaucugacugu

SEQ ID NO: 470520 - RNA, 22 nt, Human
uccauuuucuugcucuagguaa

SEQ ID NO: 470521 - RNA, 19 nt, Human
ugaaggagggggauggcca

SEQ ID NO: 470522 - RNA, 22 nt, Human
aauagguagccagauauauaaa

SEQ ID NO: 470523 - RNA, 22 nt, Human
uggcagagacuccuccugggag

SEQ ID NO: 470524 - RNA, 22 nt, Human
agcuggagcuucaagcagguaa

SEQ ID NO: 470525 - RNA, 22 nt, Human
auauaaaguguuuagaaagcug

SEQ ID NO: 470526 - RNA, 22 nt, Human
caaagccucugauuucacuugu

SEQ ID NO: 470527 - RNA, 22 nt, Human
cuggcuccacucccugccugac

SEQ ID NO: 470528 - RNA, 22 nt, Human
uugcaccauuucacuuccauua

SEQ ID NO: 470529 - RNA, 22 nt, Human
auuaauuuuucugacagccaca

SEQ ID NO: 470530 - RNA, 22 nt, Human
ugggcucugcugcguaccaguu

SEQ ID NO: 470531 - RNA, 22 nt, Human
uucuuuugggaauuacguaugc

SEQ ID NO: 470532 - RNA, 22 nt, Human
ggcagcaacucggagagaagag

SEQ ID NO: 470533 - RNA, 22 nt, Human
uuucaguggguuuauuucaugu

SEQ ID NO: 470534 - RNA, 22 nt, Human
ucacuuuugaucccuaugcagu

SEQ ID NO: 470535 - RNA, 22 nt, Human
agagcaucuaacacauaagccu

SEQ ID NO: 470536 - RNA, 19 nt, Human
cagucccaaauucuuguca

SEQ ID NO: 470537 - RNA, 22 nt, Human
ucagaagacuacuaggacacau

SEQ ID NO: 470538 - RNA, 22 nt, Human
caaggccagggaauuuuucugg

SEQ ID NO: 470539 - RNA, 20 nt, Human
agugucugggccucaggccc

SEQ ID NO: 470540 - RNA, 18 nt, Human
cccucuccugcuaguggg

SEQ ID NO: 470541 - RNA, 17 nt, Human
acacagccagguucucc

SEQ ID NO: 470542 - RNA, 22 nt, Human
uauucacaggcuggagugaugu

SEQ ID NO: 470543 - RNA, 22 nt, Human
ugagccugcaauaagcacagcc

SEQ ID NO: 470544 - RNA, 22 nt, Human
ggcagcacgacaggaguggaag

SEQ ID NO: 470545 - RNA, 20 nt, Human
uuuuauauguaggguauaug

SEQ ID NO: 470546 - RNA, 22 nt, Human
aggccuggcaugagaccugaga

SEQ ID NO: 470547 - RNA, 22 nt, Human
ggguuggggcccagcagucugc

SEQ ID NO: 470548 - RNA, 22 nt, Human
uccagcagguccgagacaaguu

SEQ ID NO: 470549 - RNA, 22 nt, Human
acugaaaaugaauuagaaacag

SEQ ID NO: 470550 - RNA, 22 nt, Human
ccugggaggcuguuuccagccu

SEQ ID NO: 470551 - RNA, 22 nt, Human
gaaaguuucuucauuaagaugu

SEQ ID NO: 470552 - RNA, 22 nt, Human
aggcuucccagcugagcucagc

SEQ ID NO: 470553 - RNA, 22 nt, Human
agugucugccagcugccaggug

SEQ ID NO: 470554 - RNA, 22 nt, Human
agaaaguuuugugcuauauaug

SEQ ID NO: 470555 - RNA, 22 nt, Human
ggguccaggucuucaggcagag

SEQ ID NO: 470556 - RNA, 22 nt, Human
caggcagagcaacugguccaga

SEQ ID NO: 470557 - RNA, 22 nt, Human
augaccccuaaaauuuacuguc

SEQ ID NO: 470558 - RNA, 22 nt, Human
uuagucuucuuccuuauauguu

SEQ ID NO: 470559 - RNA, 22 nt, Human
cugugucggacgugggcagcag

SEQ ID NO: 470560 - RNA, 22 nt, Human
uuaaacaguguuucaugugggg

SEQ ID NO: 470561 - RNA, 18 nt, Human
ucaaagucuggcuccacu

SEQ ID NO: 470562 - RNA, 21 nt, Human
ucauuuuuauugcuaccuugc

SEQ ID NO: 470563 - RNA, 22 nt, Human
caaaguucucggcucaaguccu

SEQ ID NO: 470564 - RNA, 22 nt, Human
auagacuugguuaguaaauuug

SEQ ID NO: 470565 - RNA, 22 nt, Human
agguaaagacugcaaggagaau

SEQ ID NO: 470566 - RNA, 22 nt, Human
ccagggugagugucauggguua

SEQ ID NO: 470567 - RNA, 22 nt, Human
agggccuggcgcguggccgccg

SEQ ID NO: 470568 - RNA, 22 nt, Human
uaagacaugguugaucuagugu

SEQ ID NO: 470569 - RNA, 22 nt, Human
uguuaacaucuuggacucguga

SEQ ID NO: 470570 - RNA, 22 nt, Human
ccuggcugcuuucacuauggag

SEQ ID NO: 470571 - RNA, 22 nt, Human
uccuucagggggccgccugcac

SEQ ID NO: 470572 - RNA, 22 nt, Human
agaauuagguaaguucaucuga

SEQ ID NO: 470573 - RNA, 22 nt, Human
cugcagagaauuguggggcuuc

SEQ ID NO: 470574 - RNA, 22 nt, Human
aagagagaacucccuucgccag

SEQ ID NO: 470575 - RNA, 22 nt, Human
gaacuguauaggagcaguguuu

SEQ ID NO: 470576 - RNA, 22 nt, Human
auaauuaauuucaguaaucucc

SEQ ID NO: 470577 - RNA, 22 nt, Human
ucagggcaaaagggaaaccauu

SEQ ID NO: 470578 - RNA, 22 nt, Human
gcucccagcauugcuucccagg

SEQ ID NO: 470579 - RNA, 22 nt, Human
aggcagaauguuggaaaggaag

SEQ ID NO: 470580 - RNA, 22 nt, Human
aggagcugaaacuucucauaug

SEQ ID NO: 470581 - RNA, 22 nt, Human
uggccuggaaaaaugcagaugg

SEQ ID NO: 470582 - RNA, 22 nt, Human
uauaguacauggaaucuucaua

SEQ ID NO: 470583 - RNA, 22 nt, Human
ccaggaguuggagguugcagug

SEQ ID NO: 470584 - RNA, 22 nt, Human
ucccagcagcauagcucagaau

SEQ ID NO: 470585 - RNA, 22 nt, Human
aaggccauuauucugauauauu

SEQ ID NO: 470586 - RNA, 22 nt, Human
uacaguaaccuuauuugucauu

SEQ ID NO: 470587 - RNA, 20 nt, Human
gccuggaggcaaugggaaga

SEQ ID NO: 470588 - RNA, 22 nt, Human
gagccuggacaucucaggccca

SEQ ID NO: 470589 - RNA, 21 nt, Human
uaaauaauaaguugcugagau

SEQ ID NO: 470590 - RNA, 22 nt, Human
aaaguguggagauugaacuaaa

SEQ ID NO: 470591 - RNA, 22 nt, Human
gaggaggcuaagugggcucugg

SEQ ID NO: 470592 - RNA, 22 nt, Human
cauuacauuucaaaauguuucc

SEQ ID NO: 470593 - RNA, 22 nt, Human
ucaaagucucugcuucuguaac

SEQ ID NO: 470594 - RNA, 22 nt, Human
aagcagcugauuucacagcuca

SEQ ID NO: 470595 - RNA, 22 nt, Human
caauuucucuuuauaucucaca

SEQ ID NO: 470596 - RNA, 22 nt, Human
uauugucuguccgggucaaagc

SEQ ID NO: 470597 - RNA, 22 nt, Human
gcuggccugcaaagcccggcug

SEQ ID NO: 470598 - RNA, 22 nt, Human
ucaaggaggugcuuggcuucac

SEQ ID NO: 470599 - RNA, 22 nt, Human
aacacagcuaauuucugucaau

SEQ ID NO: 470600 - RNA, 22 nt, Human
uccagggccaagucauggaacc

SEQ ID NO: 470601 - RNA, 22 nt, Human
ccucuggucccagcucugcugc

SEQ ID NO: 470602 - RNA, 22 nt, Human
uugacaagaaucguugccuugg

SEQ ID NO: 470603 - RNA, 22 nt, Human
aaaucaguuagugguaggauug

SEQ ID NO: 470604 - RNA, 22 nt, Human
gggcucuggauggagccugcag

SEQ ID NO: 470605 - RNA, 22 nt, Human
ucaguguagcagacuuguagcc

SEQ ID NO: 470606 - RNA, 22 nt, Human
ggguaauuggggccuugcagug

SEQ ID NO: 470607 - RNA, 22 nt, Human
ucagaggaaagggaacauaguc

SEQ ID NO: 470608 - RNA, 22 nt, Human
uuuguuuagaaagagauuggug

SEQ ID NO: 470609 - RNA, 22 nt, Human
auugacaagugagcugggcugc

SEQ ID NO: 470610 - RNA, 22 nt, Human
aacucaguuacauauuagaaua

SEQ ID NO: 470611 - RNA, 22 nt, Human
gcugugcagucuuuggugugcc

SEQ ID NO: 470612 - RNA, 22 nt, Human
aggcacagagaaugcccuccau

SEQ ID NO: 470613 - RNA, 22 nt, Human
gguucacacuaagcuuaagugg

SEQ ID NO: 470614 - RNA, 22 nt, Human
uuucacauuuaggcgugaauug

SEQ ID NO: 470615 - RNA, 22 nt, Human
aagaggaaaugauugacuauau

SEQ ID NO: 470616 - RNA, 22 nt, Human
gcagaggagcaagcuggacacc

SEQ ID NO: 470617 - RNA, 22 nt, Human
gagagcacaugaacauggagga

SEQ ID NO: 470618 - RNA, 22 nt, Human
agcuguguagggaaucagagaa

SEQ ID NO: 470619 - RNA, 22 nt, Human
gcugucuuccuugcuccaaggg

SEQ ID NO: 470620 - RNA, 21 nt, Human
aucacauuggcuguuauuauu

SEQ ID NO: 470621 - RNA, 22 nt, Human
caguguccucagccagcagcua

SEQ ID NO: 470622 - RNA, 18 nt, Human
ucuggcucaggacugaac

SEQ ID NO: 470623 - RNA, 22 nt, Human
cccucagcuucucccugcagcu

SEQ ID NO: 470624 - RNA, 22 nt, Human
aauacagaggggucacaauuca

SEQ ID NO: 470625 - RNA, 22 nt, Human
cuccugggaauuuaguugugag

SEQ ID NO: 470626 - RNA, 22 nt, Human
uggcugcagacaccuauggcag

SEQ ID NO: 470627 - RNA, 22 nt, Human
gccacacugcuucuuugagccu

SEQ ID NO: 470628 - RNA, 22 nt, Human
uggcucucagcucccagcagcc

SEQ ID NO: 470629 - RNA, 22 nt, Human
uuacaaaguucugaguucaaac

SEQ ID NO: 470630 - RNA, 22 nt, Human
gggcugaggcuaccacuggucu

SEQ ID NO: 470631 - RNA, 22 nt, Human
agggcugaaacauaauccuucu

SEQ ID NO: 470632 - RNA, 22 nt, Human
gcuguggcugaagaugcaggga

SEQ ID NO: 470633 - RNA, 22 nt, Human
agcugcucccuauccuuuccuu

SEQ ID NO: 470634 - RNA, 17 nt, Human
acagagcacaucaagau

SEQ ID NO: 470635 - RNA, 22 nt, Human
agaggcaacauggggaacagau

SEQ ID NO: 470636 - RNA, 22 nt, Human
uuuaauuugaaaugaguaaccc

SEQ ID NO: 470637 - RNA, 22 nt, Human
cacagcugcccuacuccaugug

SEQ ID NO: 470638 - RNA, 22 nt, Human
cagagcugcagauugaaggcau

SEQ ID NO: 470639 - RNA, 21 nt, Human
ugcuccuuagcugccccugcc

SEQ ID NO: 470640 - RNA, 22 nt, Human
gcugugcacuaccuauacaucc

SEQ ID NO: 470641 - RNA, 22 nt, Human
uccuuucccuuuccauccuggc

SEQ ID NO: 470642 - RNA, 22 nt, Human
gcccucagaggacagcugacuu

SEQ ID NO: 470643 - RNA, 20 nt, Human
ugcuguaagauuagagagcu

SEQ ID NO: 470644 - RNA, 22 nt, Human
gugugcagggaugagugcaggu

SEQ ID NO: 470645 - RNA, 22 nt, Human
agggacuuguguccuauguaug

SEQ ID NO: 470646 - RNA, 22 nt, Human
uaaaugcagcaguuucuguucu

SEQ ID NO: 470647 - RNA, 22 nt, Human
gaggcuccccaugaggccccag

SEQ ID NO: 470648 - RNA, 22 nt, Human
agguacaguagacagacaguua

SEQ ID NO: 470649 - RNA, 22 nt, Human
ugcaguggaaagacucagacuu

SEQ ID NO: 470650 - RNA, 22 nt, Human
ugcagggccuuguugaugugcu

SEQ ID NO: 470651 - RNA, 22 nt, Human
gucaggaucaaauugaaguuau

SEQ ID NO: 470652 - RNA, 22 nt, Human
uauuagguaaaggacuugcagg

SEQ ID NO: 470653 - RNA, 22 nt, Human
uugaauaggacucagcagugau

SEQ ID NO: 470654 - RNA, 22 nt, Human
gagacugauggggcucccagaa

SEQ ID NO: 470655 - RNA, 22 nt, Human
ggcaaaguuuucaucucauaac

SEQ ID NO: 470656 - RNA, 20 nt, Human
gagauggacagaugaagggg

SEQ ID NO: 470657 - RNA, 22 nt, Human
cagcaggcccaggugcugguga

SEQ ID NO: 470658 - RNA, 22 nt, Human
cuguccuguggaccugaggacg

SEQ ID NO: 470659 - RNA, 22 nt, Human
ggagccugugggaugagaugug

SEQ ID NO: 470660 - RNA, 22 nt, Human
aauacagauauucagugguacu

SEQ ID NO: 470661 - RNA, 22 nt, Human
aaguguguugacugaauugggg

SEQ ID NO: 470662 - RNA, 22 nt, Human
ucucauucauacccuacaugcu

SEQ ID NO: 470663 - RNA, 22 nt, Human
ucugggagcacacgcagugauc

SEQ ID NO: 470664 - RNA, 23 nt, Human
cccuguagcccaggacaggcuuu

SEQ ID NO: 470665 - RNA, 22 nt, Human
gagcugccaagauuacaaucag

SEQ ID NO: 470666 - RNA, 22 nt, Human
caaauaucuuuggcaaagagaa

SEQ ID NO: 470667 - RNA, 17 nt, Human
agcuccugcccauggcu

SEQ ID NO: 470668 - RNA, 22 nt, Human
ggaggaugccaagcugugcaca

SEQ ID NO: 470669 - RNA, 22 nt, Human
gcucagaggaugcuccuuuaug

SEQ ID NO: 470670 - RNA, 22 nt, Human
aggcucagagagcuguguccau

SEQ ID NO: 470671 - RNA, 22 nt, Human
ugggggugugccagggaccucc

SEQ ID NO: 470672 - RNA, 22 nt, Human
cugagccagcuggcaugugcua

SEQ ID NO: 470673 - RNA, 22 nt, Human
uuuuccucaggaaugcuaagcu

SEQ ID NO: 470674 - RNA, 22 nt, Human
aggcucagugcaaaucauucug

SEQ ID NO: 470675 - RNA, 22 nt, Human
aucuggaacaaagcuuaggaau

SEQ ID NO: 470676 - RNA, 22 nt, Human
gaggcaggcacuguuaucagca

SEQ ID NO: 470677 - RNA, 22 nt, Human
cuugcuuuguccagaaauucag

SEQ ID NO: 470678 - RNA, 22 nt, Human
ucagagaguuagugucuuagcu

SEQ ID NO: 470679 - RNA, 22 nt, Human
aggaaagggguagguguggacg

SEQ ID NO: 470680 - RNA, 22 nt, Human
aucacuguguauguauaugcag

SEQ ID NO: 470681 - RNA, 22 nt, Human
ccccuuccuuccucagacagcc

SEQ ID NO: 470682 - RNA, 20 nt, Human
caggcagaggaugcugacca

SEQ ID NO: 470683 - RNA, 22 nt, Human
ucaaaggcccauugucccguug

SEQ ID NO: 470684 - RNA, 22 nt, Human
gccaggcagauaugugagcuua

SEQ ID NO: 470685 - RNA, 22 nt, Human
agaaauguggaucguuuuaaaa

SEQ ID NO: 470686 - RNA, 22 nt, Human
ucugucugacaggguaugaacu

SEQ ID NO: 470687 - RNA, 22 nt, Human
ggcggggguccaggagccugca

SEQ ID NO: 470688 - RNA, 22 nt, Human
cagaacugggcagggagcagag

SEQ ID NO: 470689 - RNA, 22 nt, Human
caagccucagaaucuucuccau

SEQ ID NO: 470690 - RNA, 22 nt, Human
ggcagaagauaggacagggaau

SEQ ID NO: 470691 - RNA, 22 nt, Human
uucuaguucccucuggaaugua

SEQ ID NO: 470692 - RNA, 22 nt, Human
gauggcagguaguggucucauc

SEQ ID NO: 470693 - RNA, 22 nt, Human
ccacccagaccagggaucuggg

SEQ ID NO: 470694 - RNA, 22 nt, Human
gagguacagaguguuccaaugu

SEQ ID NO: 470695 - RNA, 22 nt, Human
uugcugaaaucuaugacauccu

SEQ ID NO: 470696 - RNA, 22 nt, Human
aagcaaagaguuuaguggguga

SEQ ID NO: 470697 - RNA, 22 nt, Human
ggcagaggaggggugaauuugc

SEQ ID NO: 470698 - RNA, 22 nt, Human
cuuaggaacgcucugccuagug

SEQ ID NO: 470699 - RNA, 22 nt, Human
gggucagcugcugggggcugac

SEQ ID NO: 470700 - RNA, 22 nt, Human
agccauccuacuaccucagcau

SEQ ID NO: 470701 - RNA, 22 nt, Human
caggaaaggugugucaugaugg

SEQ ID NO: 470702 - RNA, 22 nt, Human
accaggcagcacuuuccuugca

SEQ ID NO: 470703 - RNA, 22 nt, Human
auuuccaaucucugcauauggg

SEQ ID NO: 470704 - RNA, 21 nt, Human
aggcccagcuuuccucuugcu

SEQ ID NO: 470705 - RNA, 20 nt, Human
uccugggguaagccaugguc

SEQ ID NO: 470706 - RNA, 22 nt, Human
uuacauuagacccacuuucaug

SEQ ID NO: 470707 - RNA, 22 nt, Human
gcagggcaucccugagcgggug

SEQ ID NO: 470708 - RNA, 22 nt, Human
ugcguugcgcuccugcagcagg

SEQ ID NO: 470709 - RNA, 22 nt, Human
cuccugguucagagagcugaga

SEQ ID NO: 470710 - RNA, 22 nt, Human
gggcugacucaaccuugcaaag

SEQ ID NO: 470711 - RNA, 22 nt, Human
agggaggucuggcugcccugag

SEQ ID NO: 470712 - RNA, 22 nt, Human
cugcagggaacugaggcccaga

SEQ ID NO: 470713 - RNA, 22 nt, Human
aaaguguugggaagaaagugca

SEQ ID NO: 470714 - RNA, 22 nt, Human
acugcagccuagggaccacagu

SEQ ID NO: 470715 - RNA, 22 nt, Human
ggcucaggacacagugguuuag

SEQ ID NO: 470716 - RNA, 22 nt, Human
cagcaggaaaaucaauucugug

SEQ ID NO: 470717 - RNA, 21 nt, Human
ucuguacaucauugagucccc

SEQ ID NO: 470718 - RNA, 18 nt, Human
aaguaacagaagagcaca

SEQ ID NO: 470719 - RNA, 22 nt, Human
caggcccugggcaggaucagcc

SEQ ID NO: 470720 - RNA, 22 nt, Human
uggcagcacuagguacugagcu

SEQ ID NO: 470721 - RNA, 22 nt, Human
ccucccacauccuagcucugcu

SEQ ID NO: 470722 - RNA, 22 nt, Human
ggacacaguggaagacagcuug

SEQ ID NO: 470723 - RNA, 22 nt, Human
ucuacagacagagcagguggga

SEQ ID NO: 470724 - RNA, 22 nt, Human
gaaggccucacucugcagcaua

SEQ ID NO: 470725 - RNA, 22 nt, Human
cacagugcaugaugggcagaag

SEQ ID NO: 470726 - RNA, 22 nt, Human
cuaggaggcgggggcugcagua

SEQ ID NO: 470727 - RNA, 18 nt, Human
aggccugggaagcugagg

SEQ ID NO: 470728 - RNA, 22 nt, Human
gaggccugggagccuguccucc

SEQ ID NO: 470729 - RNA, 22 nt, Human
cugaaaauguuacacaggaaga

SEQ ID NO: 470730 - RNA, 22 nt, Human
uagggaggcuacuucuuguagg

SEQ ID NO: 470731 - RNA, 22 nt, Human
cuccagcuuuuucccaguuggc

SEQ ID NO: 470732 - RNA, 18 nt, Human
cugagggcagccccuggg

SEQ ID NO: 470733 - RNA, 19 nt, Human
ugucuuaauuaacucagag

SEQ ID NO: 470734 - RNA, 20 nt, Human
ggccugagcauggcuggcag

SEQ ID NO: 470735 - RNA, 21 nt, Human
acagagccgggcacaaagcug

SEQ ID NO: 470736 - RNA, 22 nt, Human
uuuucauuagaaugacugagaa

SEQ ID NO: 470737 - RNA, 22 nt, Human
caauguaucaaccagaaaguuc

SEQ ID NO: 470738 - RNA, 22 nt, Human
guacauuuugagguuaaaacaa

SEQ ID NO: 470739 - RNA, 22 nt, Human
aggguauguuuuuaucuacugu

SEQ ID NO: 470740 - RNA, 22 nt, Human
gggucuccauguuaacaucacu

SEQ ID NO: 470741 - RNA, 21 nt, Human
ucccagagugcuugggacugc

SEQ ID NO: 470742 - RNA, 19 nt, Human
uccuuugaauaucaguuga

SEQ ID NO: 470743 - RNA, 22 nt, Human
uccaucaccauuucugcgagcu

SEQ ID NO: 470744 - RNA, 22 nt, Human
gcaaaucaccaccuagcuggau

SEQ ID NO: 470745 - RNA, 22 nt, Human
caagcuggaguuccucagagug

SEQ ID NO: 470746 - RNA, 22 nt, Human
uggcugggagcuggaacugggc

SEQ ID NO: 470747 - RNA, 23 nt, Human
gcugcagcuguggauguucucag

SEQ ID NO: 470748 - RNA, 22 nt, Human
auugaaaggcaaaguaggaagc

SEQ ID NO: 470749 - RNA, 22 nt, Human
uuacaguauuguuaaacucuuu

SEQ ID NO: 470750 - RNA, 22 nt, Human
ugggaccugaagcagguuggca

SEQ ID NO: 470751 - RNA, 21 nt, Human
aauuacagauggaauuacaga

SEQ ID NO: 470752 - RNA, 18 nt, Human
aaaugcuaggcuacauga

SEQ ID NO: 470753 - RNA, 22 nt, Human
uuuuccuaguaggccuauuaga

SEQ ID NO: 470754 - RNA, 22 nt, Human
ucagcaauccucccacaggugg

SEQ ID NO: 470755 - RNA, 22 nt, Human
uagauaaauuagaaaguuuacu

SEQ ID NO: 470756 - RNA, 22 nt, Human
uucagugucaauuuuuaaauau

SEQ ID NO: 470757 - RNA, 18 nt, Human
acagaaauagcugugccu

SEQ ID NO: 470758 - RNA, 22 nt, Human
augaagauaagaccaggcugga

SEQ ID NO: 470759 - RNA, 22 nt, Human
ugauuuccaauaaggagaaugu

SEQ ID NO: 470760 - RNA, 22 nt, Human
aagaaaguggguaauaugauuu

SEQ ID NO: 470761 - RNA, 22 nt, Human
gguucacauauugagaguauuc

SEQ ID NO: 470762 - RNA, 22 nt, Human
agagcugaauuuggguggugga

SEQ ID NO: 470763 - RNA, 22 nt, Human
aagaacuuccuaauauauuuuc

SEQ ID NO: 470764 - RNA, 21 nt, Human
ugggaccuauuucaacuggau

SEQ ID NO: 470765 - RNA, 22 nt, Human
caggccugagacaucugagaua

SEQ ID NO: 470766 - RNA, 22 nt, Human
gcaggggcugcugggaacucgg

SEQ ID NO: 470767 - RNA, 22 nt, Human
ccagagaccagaacauggggau

SEQ ID NO: 470768 - RNA, 22 nt, Human
gucccaggcuuauguggagcuu

SEQ ID NO: 470769 - RNA, 22 nt, Human
auccuugaaugacucugcccuc

SEQ ID NO: 470770 - RNA, 22 nt, Human
acacaguauuacaauaggugcu

SEQ ID NO: 470771 - RNA, 22 nt, Human
ucucaggaguagugggauccau

SEQ ID NO: 470772 - RNA, 22 nt, Human
gcagcauugugagguccugccc

SEQ ID NO: 470773 - RNA, 22 nt, Human
aacuagaacgucuaguugcugg

SEQ ID NO: 470774 - RNA, 22 nt, Human
cugcuuugauuagaagaguaca

SEQ ID NO: 470775 - RNA, 22 nt, Human
cuugccuucuuuuccuauagaa

SEQ ID NO: 470776 - RNA, 22 nt, Human
cauugaaaaacguugacugagu

SEQ ID NO: 470777 - RNA, 22 nt, Human
auugaaagguuuugagcagaua

SEQ ID NO: 470778 - RNA, 22 nt, Human
gcagaggaggacccaggaauua

SEQ ID NO: 470779 - RNA, 22 nt, Human
cauugacaguucuuuaaguugc

SEQ ID NO: 470780 - RNA, 22 nt, Human
aaagaacaaaugauauaugguu

SEQ ID NO: 470781 - RNA, 22 nt, Human
ugccucugguuaucugguaccu

SEQ ID NO: 470782 - RNA, 22 nt, Human
ugugcccauuccacuugaguac

SEQ ID NO: 470783 - RNA, 22 nt, Human
gugauuucagguuuuucauacu

SEQ ID NO: 470784 - RNA, 22 nt, Human
gggcaugagagggcagcuggca

SEQ ID NO: 470785 - RNA, 22 nt, Human
ggcaggguggcccuccagugag

SEQ ID NO: 470786 - RNA, 22 nt, Human
uagggcuccacucccagagauu

SEQ ID NO: 470787 - RNA, 22 nt, Human
cugcugugugcuuacuuggguu

SEQ ID NO: 470788 - RNA, 22 nt, Human
ggccuggaagaggacagagaaa

SEQ ID NO: 470789 - RNA, 22 nt, Human
acaguggaggccauaugguccu

SEQ ID NO: 470790 - RNA, 19 nt, Human
gaucagagugucagcuugu

SEQ ID NO: 470791 - RNA, 22 nt, Human
gccugccacgcaugcagaguca

SEQ ID NO: 470792 - RNA, 22 nt, Human
caggaggcccaaagggcgcaga

SEQ ID NO: 470793 - RNA, 22 nt, Human
ggccuugggcagacacgucaca

SEQ ID NO: 470794 - RNA, 22 nt, Human
gaaaacugugauuagaaugccu

SEQ ID NO: 470795 - RNA, 22 nt, Human
uuuuaauacugcuauuguagga

SEQ ID NO: 470796 - RNA, 22 nt, Human
gagcuucccucugcagucccug

SEQ ID NO: 470797 - RNA, 22 nt, Human
aagauuauggcagauaacaauu

SEQ ID NO: 470798 - RNA, 22 nt, Human
aagggugggcccuggcagccau

SEQ ID NO: 470799 - RNA, 22 nt, Human
cagggcagggccacacccccug

SEQ ID NO: 470800 - RNA, 22 nt, Human
gcucugagccgggggccugucc

SEQ ID NO: 470801 - RNA, 22 nt, Human
agggccagcugaugagaaugag

SEQ ID NO: 470802 - RNA, 21 nt, Human
agaggcaggcauuaaguacac

SEQ ID NO: 470803 - RNA, 22 nt, Human
ugacauuuaucaaagaaauggu

SEQ ID NO: 470804 - RNA, 22 nt, Human
agaggcuguuacacucccagau

SEQ ID NO: 470805 - RNA, 20 nt, Human
ggcagcucacuacuuucugu

SEQ ID NO: 470806 - RNA, 22 nt, Human
cuggccuggucuggccucucca

SEQ ID NO: 470807 - RNA, 22 nt, Human
ccaggcugcuguugguguccgc

SEQ ID NO: 470808 - RNA, 22 nt, Human
auagucuuagucuauaguuuug

SEQ ID NO: 470809 - RNA, 22 nt, Human
aguaauaauuuauauuagggag

SEQ ID NO: 470810 - RNA, 22 nt, Human
uccagucucuacucugagauaa

SEQ ID NO: 470811 - RNA, 22 nt, Human
agggcccuccccgcucagggca

SEQ ID NO: 470812 - RNA, 21 nt, Human
ucucugguuggaguugugcca

SEQ ID NO: 470813 - RNA, 22 nt, Human
gaagagcugacagugucauccu

SEQ ID NO: 470814 - RNA, 22 nt, Human
ucagggugaaccaggcaggaau

SEQ ID NO: 470815 - RNA, 22 nt, Human
caucacugacgcugagauucca

SEQ ID NO: 470816 - RNA, 20 nt, Human
guucucacugaucugcaggg

SEQ ID NO: 470817 - RNA, 22 nt, Human
gacaaaggaucagagguuggga

SEQ ID NO: 470818 - RNA, 22 nt, Human
acaaaggcaggauugacuuagu

SEQ ID NO: 470819 - RNA, 22 nt, Human
ccugggcucuauccugacccag

SEQ ID NO: 470820 - RNA, 22 nt, Human
cccuguacagucucuguggcac

SEQ ID NO: 470821 - RNA, 22 nt, Human
ucuguccauucagccauccauc

SEQ ID NO: 470822 - RNA, 18 nt, Human
gagcugggagaaggaagg

SEQ ID NO: 470823 - RNA, 22 nt, Human
aggguauaaagagcaagcagaa

SEQ ID NO: 470824 - RNA, 21 nt, Human
ucacacacguuuccaagggca

SEQ ID NO: 470825 - RNA, 22 nt, Human
aggcucagucuguucaugcacu

SEQ ID NO: 470826 - RNA, 22 nt, Human
ccugucuggccuuccacggggg

SEQ ID NO: 470827 - RNA, 22 nt, Human
uagaacacuugaccacugcucc

SEQ ID NO: 470828 - RNA, 22 nt, Human
uugaagaggacuuugcagcugu

SEQ ID NO: 470829 - RNA, 22 nt, Human
cagcaaaauuugaggauugccu

SEQ ID NO: 470830 - RNA, 22 nt, Human
caggaugugaggaggccauuug

SEQ ID NO: 470831 - RNA, 22 nt, Human
ccagggcaauuauuuggagggu

SEQ ID NO: 470832 - RNA, 22 nt, Human
uaacagaauccuguuauugcca

SEQ ID NO: 470833 - RNA, 22 nt, Human
agccuggaggccaggagacagu

SEQ ID NO: 470834 - RNA, 22 nt, Human
acacuguguggucucucucgga

SEQ ID NO: 470835 - RNA, 22 nt, Human
aggaggugacagccugcaucug

SEQ ID NO: 470836 - RNA, 22 nt, Human
aggcgcagaaggccaggggccu

SEQ ID NO: 470837 - RNA, 22 nt, Human
cugcccaggcugaaggaacauc

SEQ ID NO: 470838 - RNA, 22 nt, Human
cugggcugcaggaguggggcaa

SEQ ID NO: 470839 - RNA, 22 nt, Human
agcagcugccagagagaguucc

SEQ ID NO: 470840 - RNA, 22 nt, Human
gggccccuuguaucucuggcuc

SEQ ID NO: 470841 - RNA, 22 nt, Human
cuauuauuuccucaucuauaaa

SEQ ID NO: 470842 - RNA, 22 nt, Human
ccacagagacagagcccagggu

SEQ ID NO: 470843 - RNA, 22 nt, Human
aguggggaagagcaugggcccu

SEQ ID NO: 470844 - RNA, 22 nt, Human
aaucaagaaaaugaggauucuu

SEQ ID NO: 470845 - RNA, 22 nt, Human
acagcagcuaaccccugggcca

SEQ ID NO: 470846 - RNA, 22 nt, Human
uugggugcugucauggggcacg

SEQ ID NO: 470847 - RNA, 22 nt, Human
cccagcucaagcagagagcuaa

SEQ ID NO: 470848 - RNA, 22 nt, Human
uucaugugaauauauuugucuu

SEQ ID NO: 470849 - RNA, 22 nt, Human
agugucauuccagggacccucg

SEQ ID NO: 470850 - RNA, 22 nt, Human
gucuucuguaagaugagguccc

SEQ ID NO: 470851 - RNA, 19 nt, Human
cccucaggucugagcaguc

SEQ ID NO: 470852 - RNA, 22 nt, Human
agggacaguuacaucaucagac

SEQ ID NO: 470853 - RNA, 22 nt, Human
ugcugccagggcucugcccaca

SEQ ID NO: 470854 - RNA, 22 nt, Human
agguauagaauugaaaggguuu

SEQ ID NO: 470855 - RNA, 22 nt, Human
aaacaugagcaucucuucaagc

SEQ ID NO: 470856 - RNA, 22 nt, Human
cagcaauaaugucuacaaaucu

SEQ ID NO: 470857 - RNA, 22 nt, Human
cagcuuuauuaaugauugucuu

SEQ ID NO: 470858 - RNA, 22 nt, Human
ccagcuggaagagugcagaacu

SEQ ID NO: 470859 - RNA, 22 nt, Human
uguuccaucaguuuuugguuga

SEQ ID NO: 470860 - RNA, 22 nt, Human
gggcuguaggagcuggaauggg

SEQ ID NO: 470861 - RNA, 22 nt, Human
uagaaagugaagguuaauuaau

SEQ ID NO: 470862 - RNA, 22 nt, Human
gcagcauuaccaagacauggca

SEQ ID NO: 470863 - RNA, 22 nt, Human
agccaggcucaaggccugcucc

SEQ ID NO: 470864 - RNA, 22 nt, Human
gccuggagugguccugcugccc

SEQ ID NO: 470865 - RNA, 21 nt, Human
ugcugccaucaugcagagaug

SEQ ID NO: 470866 - RNA, 22 nt, Human
ggcucccacccauagggcgagu

SEQ ID NO: 470867 - RNA, 22 nt, Human
ggcacugacacuagcauggcac

SEQ ID NO: 470868 - RNA, 17 nt, Human
ucaggauguagcaguag

SEQ ID NO: 470869 - RNA, 22 nt, Human
ccucacugcuauguguuugcuc

SEQ ID NO: 470870 - RNA, 19 nt, Human
ggcucucccuugagagagc

SEQ ID NO: 470871 - RNA, 22 nt, Human
ucacagggcauuauggcuccag

SEQ ID NO: 470872 - RNA, 22 nt, Human
ucacauuuguuccucugcacuu

SEQ ID NO: 470873 - RNA, 22 nt, Human
ugcugccuuagcagccaggcaa

SEQ ID NO: 470874 - RNA, 21 nt, Human
ccugggagaucagcugccuuc

SEQ ID NO: 470875 - RNA, 22 nt, Human
uggagcugauacagcuggcuuu

SEQ ID NO: 470876 - RNA, 22 nt, Human
aaacacuagcaggaagcacuga

SEQ ID NO: 470877 - RNA, 22 nt, Human
gagguauguaugcuacauucuu

SEQ ID NO: 470878 - RNA, 23 nt, Human
ugccucugccucccuagucugca

SEQ ID NO: 470879 - RNA, 22 nt, Human
aaaggccaauaaagacaagcug

SEQ ID NO: 470880 - RNA, 22 nt, Human
agaaacauuuagauuauauguc

SEQ ID NO: 470881 - RNA, 22 nt, Human
gccaggccugcaagugcuggug

SEQ ID NO: 470882 - RNA, 22 nt, Human
aaagaauuuguacacccuacua

SEQ ID NO: 470883 - RNA, 22 nt, Human
ucuucauuccguagauauuuau

SEQ ID NO: 470884 - RNA, 22 nt, Human
cugccuggagcauucugaaggu

SEQ ID NO: 470885 - RNA, 22 nt, Human
cugggagucaccaggagcaagg

SEQ ID NO: 470886 - RNA, 22 nt, Human
gcacugaacuuuaaucauuucu

SEQ ID NO: 470887 - RNA, 22 nt, Human
uagauuucucauucauagauug

SEQ ID NO: 470888 - RNA, 22 nt, Human
acccaggacucucuuccaguag

SEQ ID NO: 470889 - RNA, 22 nt, Human
gcagcugcuggaaguuccugcc

SEQ ID NO: 470890 - RNA, 22 nt, Human
ugccugucagggggagugggaa

SEQ ID NO: 470891 - RNA, 22 nt, Human
uguggcaguauaagagcuagaa

SEQ ID NO: 470892 - RNA, 22 nt, Human
ccaaggagaaaugcugugcuuu

SEQ ID NO: 470893 - RNA, 22 nt, Human
cucacugugccuuuucccaaac

SEQ ID NO: 470894 - RNA, 22 nt, Human
uuggaaggugagucccuggguu

SEQ ID NO: 470895 - RNA, 22 nt, Human
ucucagagaugucaagagucua

SEQ ID NO: 470896 - RNA, 22 nt, Human
ugucuuccucuuggcuugagcu

SEQ ID NO: 470897 - RNA, 22 nt, Human
cagaaguaagauuacugugagu

SEQ ID NO: 470898 - RNA, 22 nt, Human
agaugaagauaucugcaggggc

SEQ ID NO: 470899 - RNA, 22 nt, Human
caggccucagagaguggcgggg

SEQ ID NO: 470900 - RNA, 22 nt, Human
ugcuggagaggaaggugggguc

SEQ ID NO: 470901 - RNA, 22 nt, Human
ugggccugggcuccuguccucu

SEQ ID NO: 470902 - RNA, 22 nt, Human
auggauaagaacaaauaucuga

SEQ ID NO: 470903 - RNA, 22 nt, Human
ucugugcaggaagucauuauga

SEQ ID NO: 470904 - RNA, 22 nt, Human
ucacacacauuugcugucugau

SEQ ID NO: 470905 - RNA, 22 nt, Human
gaagagcugcaguuuccugggc

SEQ ID NO: 470906 - RNA, 22 nt, Human
uugucuguccaggcaccccaag

SEQ ID NO: 470907 - RNA, 22 nt, Human
ugggcagaggcucugaagucca

SEQ ID NO: 470908 - RNA, 22 nt, Human
aaggaguuuggguagucauaca

SEQ ID NO: 470909 - RNA, 22 nt, Human
acaguaaugauucugagucucu

SEQ ID NO: 470910 - RNA, 22 nt, Human
ucucugucccuaggagccuugc

SEQ ID NO: 470911 - RNA, 22 nt, Human
auacaaauuuauagaugcauuu

SEQ ID NO: 470912 - RNA, 22 nt, Human
cugggcuucucccccuggcaga

SEQ ID NO: 470913 - RNA, 22 nt, Human
ggcagaggugacagugucuuuu

SEQ ID NO: 470914 - RNA, 22 nt, Human
cuguccuggagggcauaggacg

SEQ ID NO: 470915 - RNA, 22 nt, Human
ugggcuccguugccuggggcag

SEQ ID NO: 470916 - RNA, 22 nt, Human
caggggcucugggugaugugag

SEQ ID NO: 470917 - RNA, 22 nt, Human
agagccuugaagaucuggaaaa

SEQ ID NO: 470918 - RNA, 22 nt, Human
ugcauuaugcuugugcuguaua

SEQ ID NO: 470919 - RNA, 22 nt, Human
gugugcagugagcaaaagaucu

SEQ ID NO: 470920 - RNA, 22 nt, Human
uuguuuuuaugaacauccagga

SEQ ID NO: 470921 - RNA, 23 nt, Human
cuggcuccgaagacuccaggauc

SEQ ID NO: 470922 - RNA, 22 nt, Human
guggcccaggcuuggcgcuggc

SEQ ID NO: 470923 - RNA, 22 nt, Human
ccaggcaggcagcguucucagg

SEQ ID NO: 470924 - RNA, 22 nt, Human
uagcugugagcacccaggcugu

SEQ ID NO: 470925 - RNA, 19 nt, Human
aggugaugugacucuagaa

SEQ ID NO: 470926 - RNA, 22 nt, Human
gaggcuggcagaaaagcacagg

SEQ ID NO: 470927 - RNA, 22 nt, Human
uggagcaagcuggagagaacau

SEQ ID NO: 470928 - RNA, 22 nt, Human
ccuggagcgcgggucaagcugg

SEQ ID NO: 470929 - RNA, 22 nt, Human
gcacugcagguggguggagagg

SEQ ID NO: 470930 - RNA, 21 nt, Human
ccauaauuuuguuucagaagu

SEQ ID NO: 470931 - RNA, 22 nt, Human
agggcagcuaaggugcugacug

SEQ ID NO: 470932 - RNA, 22 nt, Human
gcuguccucugaucucuggagg

SEQ ID NO: 470933 - RNA, 22 nt, Human
aauuaugauuggucuaaaccag

SEQ ID NO: 470934 - RNA, 22 nt, Human
uccucugcuccaggcuggacuu

SEQ ID NO: 470935 - RNA, 22 nt, Human
agaguucugcucuucucaguga

SEQ ID NO: 470936 - RNA, 22 nt, Human
ggcagcucacugauuagcaauu

SEQ ID NO: 470937 - RNA, 22 nt, Human
acaaaguuauucuuucagagga

SEQ ID NO: 470938 - RNA, 22 nt, Human
uuugcauuccugccugcauuca

SEQ ID NO: 470939 - RNA, 22 nt, Human
cccagccucuguuugcuccucu

SEQ ID NO: 470940 - RNA, 22 nt, Human
gccaaaucacagggccaaaagc

SEQ ID NO: 470941 - RNA, 22 nt, Human
aacuuucuuucacagaaguauc

SEQ ID NO: 470942 - RNA, 22 nt, Human
gagggacagcuaaagagaaauu

SEQ ID NO: 470943 - RNA, 22 nt, Human
auaacagaugugaagugcuaau

SEQ ID NO: 470944 - RNA, 22 nt, Human
ccaaggagcaaguuuacaccug

SEQ ID NO: 470945 - RNA, 22 nt, Human
aagccaggccauucucugguuc

SEQ ID NO: 470946 - RNA, 22 nt, Human
ccuggcucuucagagguuccua

SEQ ID NO: 470947 - RNA, 22 nt, Human
ugaggcuugucucagauggggg

SEQ ID NO: 470948 - RNA, 22 nt, Human
gcuggccauauauuuugcuguu

SEQ ID NO: 470949 - RNA, 22 nt, Human
agcugccacagagccuggccag

SEQ ID NO: 470950 - RNA, 22 nt, Human
auggcagcaaaugucuggcugg

SEQ ID NO: 470951 - RNA, 22 nt, Human
ugaaggaaagagggaacauccc

SEQ ID NO: 470952 - RNA, 23 nt, Human
cgcccagccucagugaccugggc

SEQ ID NO: 470953 - RNA, 22 nt, Human
ggcuguggacacugagcucaga

SEQ ID NO: 470954 - RNA, 22 nt, Human
auguacacaugcaugcaugugc

SEQ ID NO: 470955 - RNA, 22 nt, Human
ugcagcuccucuggcugccuga

SEQ ID NO: 470956 - RNA, 22 nt, Human
ggcaggagaauggcgugaacuc

SEQ ID NO: 470957 - RNA, 22 nt, Human
cugagccaaggggacagugaca

SEQ ID NO: 470958 - RNA, 22 nt, Human
ucauugaacgaagagcuccauu

SEQ ID NO: 470959 - RNA, 22 nt, Human
aagccaggcaugcuuggacagu

SEQ ID NO: 470960 - RNA, 22 nt, Human
gaguucaguguuucuaguagug

SEQ ID NO: 470961 - RNA, 19 nt, Human
ggcccaaguacugagugcc

SEQ ID NO: 470962 - RNA, 22 nt, Human
aaggcugaguaaaacagagaac

SEQ ID NO: 470963 - RNA, 23 nt, Human
uccuucagagccucccuccaagc

SEQ ID NO: 470964 - RNA, 22 nt, Human
ccuaggcccuaggcuuccauca

SEQ ID NO: 470965 - RNA, 18 nt, Human
uugagggaggggcagagu

SEQ ID NO: 470966 - RNA, 19 nt, Human
ugcaggaggacugagcaga

SEQ ID NO: 470967 - RNA, 22 nt, Human
ggcugccucugaugugcagacg

SEQ ID NO: 470968 - RNA, 22 nt, Human
ugcagggcagcuagggagcuuu

SEQ ID NO: 470969 - RNA, 22 nt, Human
agagccugcagcugugaagaaa

SEQ ID NO: 470970 - RNA, 22 nt, Human
uguccuuuuggcugucuauggu

SEQ ID NO: 470971 - RNA, 22 nt, Human
acugucuccucaucaugccugg

SEQ ID NO: 470972 - RNA, 22 nt, Human
gaauuguagagggaacagaagc

SEQ ID NO: 470973 - RNA, 22 nt, Human
agcucauggugcuaucucaggg

SEQ ID NO: 470974 - RNA, 22 nt, Human
ugggcugcacccucagccucug

SEQ ID NO: 470975 - RNA, 22 nt, Human
cugggcugcagcgggagcgacg

SEQ ID NO: 470976 - RNA, 22 nt, Human
uguucaauccccagguccugaa

SEQ ID NO: 470977 - RNA, 22 nt, Human
uuuaauuuucugggcccagcag

SEQ ID NO: 470978 - RNA, 22 nt, Human
uguuccauaaguggugcuuugu

SEQ ID NO: 470979 - RNA, 20 nt, Human
gugcuucagaagccauugcu

SEQ ID NO: 470980 - RNA, 23 nt, Human
ucuguacaauugagaagagaaca

SEQ ID NO: 470981 - RNA, 22 nt, Human
ccuggcuccugccucugcaggg

SEQ ID NO: 470982 - RNA, 22 nt, Human
agagucagcuuaugacacaguc

SEQ ID NO: 470983 - RNA, 22 nt, Human
gccucugcggggcccgagcccg

SEQ ID NO: 470984 - RNA, 22 nt, Human
uacaaaguuugggguccucaaa

SEQ ID NO: 470985 - RNA, 22 nt, Human
gcugcucucucccuaaguuggg

SEQ ID NO: 470986 - RNA, 22 nt, Human
ggggacugccuuccacagacac

SEQ ID NO: 470987 - RNA, 22 nt, Human
gggcugagucugcugccuguca

SEQ ID NO: 470988 - RNA, 22 nt, Human
accagggcccgggagagcucuc

SEQ ID NO: 470989 - RNA, 22 nt, Human
ugaagcagcaccauuuuagagc

SEQ ID NO: 470990 - RNA, 22 nt, Human
gaguuauuaauggcugaguuug

SEQ ID NO: 470991 - RNA, 22 nt, Human
gagcugcugguugcuggugccu

SEQ ID NO: 470992 - RNA, 20 nt, Human
agggcagagggauuacaggc

SEQ ID NO: 470993 - RNA, 18 nt, Human
ggcaugugagugcugagg

SEQ ID NO: 470994 - RNA, 22 nt, Human
guaaacaucgacccaacagggg

SEQ ID NO: 470995 - RNA, 17 nt, Human
uguuccauuugaccacc

SEQ ID NO: 470996 - RNA, 22 nt, Human
aggcacugagaggcuguguugc

SEQ ID NO: 470997 - RNA, 22 nt, Human
gaaaaaugagcugaugucaggg

SEQ ID NO: 470998 - RNA, 22 nt, Human
guuaauaaagguauagaaucag

SEQ ID NO: 470999 - RNA, 22 nt, Human
gcucuggguagccacugccugg

SEQ ID NO: 471000 - RNA, 22 nt, Human
ucaaauaugugauagaagcuaa

SEQ ID NO: 471001 - RNA, 22 nt, Human
aggcaguggagcuggaauaggc

SEQ ID NO: 471002 - RNA, 22 nt, Human
auuauaggcuugagccaccgug

SEQ ID NO: 471003 - RNA, 22 nt, Human
agggcagagaucugagugggca

SEQ ID NO: 471004 - RNA, 22 nt, Human
cucuccuggggagcacacacac

SEQ ID NO: 471005 - RNA, 22 nt, Human
uccaguggcacuggagacuaga

SEQ ID NO: 471006 - RNA, 22 nt, Human
gauggguggucucagacuugcc

SEQ ID NO: 471007 - RNA, 19 nt, Human
cugggagguguucagagaa

SEQ ID NO: 471008 - RNA, 22 nt, Human
cugggcucagaugagaggaagg

SEQ ID NO: 471009 - RNA, 19 nt, Human
acagcagggauuuuuggag

SEQ ID NO: 471010 - RNA, 22 nt, Human
ggugggcaacauuuggccugag

SEQ ID NO: 471011 - RNA, 22 nt, Human
gaggcagagaccuucaggaccu

SEQ ID NO: 471012 - RNA, 22 nt, Human
acauuugacauuuaguaucagc

SEQ ID NO: 471013 - RNA, 22 nt, Human
ccacugggggcugcaggcacuc

SEQ ID NO: 471014 - RNA, 22 nt, Human
ugcauacacaagcauacaugua

SEQ ID NO: 471015 - RNA, 22 nt, Human
uguguguauaugcauuuaucua

SEQ ID NO: 471016 - RNA, 22 nt, Human
uggcucuguugugcugagccag

SEQ ID NO: 471017 - RNA, 22 nt, Human
aagccgggccugagaaaugaca

SEQ ID NO: 471018 - RNA, 22 nt, Human
gauuuauugucccuguccugcu

SEQ ID NO: 471019 - RNA, 22 nt, Human
uggcacugaccccaggccugug

SEQ ID NO: 471020 - RNA, 22 nt, Human
agauuguagaaacuguagcauu

SEQ ID NO: 471021 - RNA, 22 nt, Human
ugaggcagugugagauaauaaa

SEQ ID NO: 471022 - RNA, 20 nt, Human
acauguacuaaugaauacag

SEQ ID NO: 471023 - RNA, 21 nt, Human
ccuuuacaauuuugcauuccu

SEQ ID NO: 471024 - RNA, 22 nt, Human
gucccuggggaaucagcuggag

SEQ ID NO: 471025 - RNA, 22 nt, Human
cugcucuguucccccaucaucu

SEQ ID NO: 471026 - RNA, 22 nt, Human
aagggcaggaaaagauggaugu

SEQ ID NO: 471027 - RNA, 22 nt, Human
acuguaaccaguguggugagag

SEQ ID NO: 471028 - RNA, 22 nt, Human
cagggcacggagaagucacccc

SEQ ID NO: 471029 - RNA, 22 nt, Human
uggaagaaggcagagaggcauu

SEQ ID NO: 471030 - RNA, 22 nt, Human
cagggugggcacccagccucca

SEQ ID NO: 471031 - RNA, 22 nt, Human
cagcccagcagucuuagccugc

SEQ ID NO: 471032 - RNA, 22 nt, Human
uccucagggaagaugagccuca

SEQ ID NO: 471033 - RNA, 22 nt, Human
cccagcagaaucugaugagggc

SEQ ID NO: 471034 - RNA, 22 nt, Human
uauaauuuggggaaaguggugu

SEQ ID NO: 471035 - RNA, 22 nt, Human
auguccuuccauuuugaucugu

SEQ ID NO: 471036 - RNA, 20 nt, Human
cucuccucacccgugucagg

SEQ ID NO: 471037 - RNA, 22 nt, Human
cagugcaguugguggcaggggu

SEQ ID NO: 471038 - RNA, 22 nt, Human
cauuugcauaugaagaaguaag

SEQ ID NO: 471039 - RNA, 22 nt, Human
cccccaaggccaggcugagacc

SEQ ID NO: 471040 - RNA, 22 nt, Human
aagcuuuaugaucucucagcua

SEQ ID NO: 471041 - RNA, 22 nt, Human
uuacaaagagaaguuguagaau

SEQ ID NO: 471042 - RNA, 22 nt, Human
aagcagccuggcaugaugcuuu

SEQ ID NO: 471043 - RNA, 19 nt, Human
ggccccucucacaggaguu

SEQ ID NO: 471044 - RNA, 22 nt, Human
ggggaccuucccagagcaguug

SEQ ID NO: 471045 - RNA, 22 nt, Human
ugcauauuuguaugauguuuag

SEQ ID NO: 471046 - RNA, 22 nt, Human
agaaggcacucacacuggcacg

SEQ ID NO: 471047 - RNA, 19 nt, Human
gagcacagcggcauuuggu

SEQ ID NO: 471048 - RNA, 22 nt, Human
acuuccuggcugggugaccugg

SEQ ID NO: 471049 - RNA, 22 nt, Human
uaggcagggauuaggguugauu

SEQ ID NO: 471050 - RNA, 22 nt, Human
agaagccagaggcaguggguac

SEQ ID NO: 471051 - RNA, 22 nt, Human
uaaaugugggggccacgggcuu

SEQ ID NO: 471052 - RNA, 22 nt, Human
gcccucagaugggaaaggaggg

SEQ ID NO: 471053 - RNA, 22 nt, Human
aagcuuuaugacuuggagacag

SEQ ID NO: 471054 - RNA, 22 nt, Human
agaucaaagccaugagagauuu

SEQ ID NO: 471055 - RNA, 20 nt, Human
cagggcacacugcagccucg

SEQ ID NO: 471056 - RNA, 21 nt, Human
cccuguguuccacagcagaca

SEQ ID NO: 471057 - RNA, 22 nt, Human
acacagggauauuucagguggu

SEQ ID NO: 471058 - RNA, 22 nt, Human
cuugaaagcacuuaguaaauua

SEQ ID NO: 471059 - RNA, 22 nt, Human
ccucugagaccagcucugcacc

SEQ ID NO: 471060 - RNA, 22 nt, Human
ggagccugacagugcccagcau

SEQ ID NO: 471061 - RNA, 22 nt, Human
gcuuucucuucacugauguuca

SEQ ID NO: 471062 - RNA, 22 nt, Human
ccugggaguggcacucacagca

SEQ ID NO: 471063 - RNA, 22 nt, Human
aggagcccugcgggaggcagag

SEQ ID NO: 471064 - RNA, 22 nt, Human
caggccaggcugcauuugcccc

SEQ ID NO: 471065 - RNA, 22 nt, Human
cugggcugucaauggcccucug

SEQ ID NO: 471066 - RNA, 22 nt, Human
uggcagggugccaguugcgagu

SEQ ID NO: 471067 - RNA, 22 nt, Human
ccaaaggccaggcacugagguu

SEQ ID NO: 471068 - RNA, 22 nt, Human
gagccugggacugggggucaug

SEQ ID NO: 471069 - RNA, 22 nt, Human
ggugggcacauucagucucugu

SEQ ID NO: 471070 - RNA, 22 nt, Human
agaguggggaagguguugagaa

SEQ ID NO: 471071 - RNA, 22 nt, Human
gucauuguguggacauggagaa

SEQ ID NO: 471072 - RNA, 22 nt, Human
gaggacagcuuagggcuuccug

SEQ ID NO: 471073 - RNA, 22 nt, Human
aggcugcagaacagucaggugc

SEQ ID NO: 471074 - RNA, 22 nt, Human
agaauucuguucuucgggugug

SEQ ID NO: 471075 - RNA, 22 nt, Human
cacagaaguuucauagucucga

SEQ ID NO: 471076 - RNA, 22 nt, Human
uaaaugugcacuuuacuuuuca

SEQ ID NO: 471077 - RNA, 22 nt, Human
uuguguccugauuugacacaau

SEQ ID NO: 471078 - RNA, 22 nt, Human
ugggccacgugacccuuacccu

SEQ ID NO: 471079 - RNA, 22 nt, Human
aaguaugacauuuaagacaauu

SEQ ID NO: 471080 - RNA, 22 nt, Human
ggugaggcuaagugacacaggg

SEQ ID NO: 471081 - RNA, 22 nt, Human
cagggcagggagcuuagaauga

SEQ ID NO: 471082 - RNA, 22 nt, Human
gaguguucccacaccccaguug

SEQ ID NO: 471083 - RNA, 22 nt, Human
uggcucagucuggguugacuga

SEQ ID NO: 471084 - RNA, 22 nt, Human
gugcauuucucauacacuaaau

SEQ ID NO: 471085 - RNA, 22 nt, Human
uaaguucagaguucucauuugu

SEQ ID NO: 471086 - RNA, 22 nt, Human
uuggaaggcccugccuagcagg

SEQ ID NO: 471087 - RNA, 22 nt, Human
uuucacauguggaaugccaggu

SEQ ID NO: 471088 - RNA, 22 nt, Human
guuaaauucgaugauggauaaa

SEQ ID NO: 471089 - RNA, 22 nt, Human
gugcugcagagucucgugccgc

SEQ ID NO: 471090 - RNA, 22 nt, Human
caggaggcagagguugcaguga

SEQ ID NO: 471091 - RNA, 22 nt, Human
ccugucuguaucgguucagagu

SEQ ID NO: 471092 - RNA, 22 nt, Human
cuguacaggugaggagggggcu

SEQ ID NO: 471093 - RNA, 22 nt, Human
cagcucugaggaacacuccuuu

SEQ ID NO: 471094 - RNA, 22 nt, Human
caugggagcuaucuccaucacu

SEQ ID NO: 471095 - RNA, 22 nt, Human
augcagcuucaggauuaugaug

SEQ ID NO: 471096 - RNA, 22 nt, Human
caguacuuaguucucaugguuu

SEQ ID NO: 471097 - RNA, 22 nt, Human
acagccaggaauucuggagaag

SEQ ID NO: 471098 - RNA, 23 nt, Human
ugggccuggccucccaguccagc

SEQ ID NO: 471099 - RNA, 22 nt, Human
uggcugaauaauauucuguugu

SEQ ID NO: 471100 - RNA, 22 nt, Human
agauggagaaugacaauuaagg

SEQ ID NO: 471101 - RNA, 22 nt, Human
ggucccagguugacagggagac

SEQ ID NO: 471102 - RNA, 22 nt, Human
gaggaaaauauucagggagguu

SEQ ID NO: 471103 - RNA, 22 nt, Human
ccaggccuccugugaguggacc

SEQ ID NO: 471104 - RNA, 22 nt, Human
cuccaguaucuguaggaaaagg

SEQ ID NO: 471105 - RNA, 22 nt, Human
aaguuauugcagcaauccaagu

SEQ ID NO: 471106 - RNA, 22 nt, Human
uggccugccuucgcugagcuga

SEQ ID NO: 471107 - RNA, 22 nt, Human
uggcucuguucgccaucaggag

SEQ ID NO: 471108 - RNA, 22 nt, Human
aaguuauaucaucucauugacg

SEQ ID NO: 471109 - RNA, 22 nt, Human
agggcugcuccuccuucaggcc

SEQ ID NO: 471110 - RNA, 22 nt, Human
uccauuuacuauucucauaucg

SEQ ID NO: 471111 - RNA, 22 nt, Human
caagggcagaggcagggccccg

SEQ ID NO: 471112 - RNA, 22 nt, Human
cuuccccaaccccgacugugug

SEQ ID NO: 471113 - RNA, 21 nt, Human
gccugcaguuuugaagcccuu

SEQ ID NO: 471114 - RNA, 22 nt, Human
gccccagccaaggugacacgaa

SEQ ID NO: 471115 - RNA, 22 nt, Human
guacaguuuucaguguucacug

SEQ ID NO: 471116 - RNA, 22 nt, Human
gaaagcaguaaaugggucccau

SEQ ID NO: 471117 - RNA, 22 nt, Human
cccagggcuuuucucacuagac

SEQ ID NO: 471118 - RNA, 22 nt, Human
ccagcuccgggaguugcugcug

SEQ ID NO: 471119 - RNA, 22 nt, Human
uuaugacaggaaaaucacagaa

SEQ ID NO: 471120 - RNA, 22 nt, Human
aggcugagucaaguuaggguga

SEQ ID NO: 471121 - RNA, 22 nt, Human
gccaggcuguuuuuauuacugu

SEQ ID NO: 471122 - RNA, 22 nt, Human
cuguguggccucaagccagccu

SEQ ID NO: 471123 - RNA, 22 nt, Human
ggagcugucuguagggcacagg

SEQ ID NO: 471124 - RNA, 22 nt, Human
ccacugggcguuucuguccaau

SEQ ID NO: 471125 - RNA, 22 nt, Human
gcagcuuucugcaaugucaucc

SEQ ID NO: 471126 - RNA, 22 nt, Human
ccuggggagaagagcuuccccc

SEQ ID NO: 471127 - RNA, 22 nt, Human
uugugugguagcuucauugaac

SEQ ID NO: 471128 - RNA, 22 nt, Human
uugcaucuaccauaucaaagau

SEQ ID NO: 471129 - RNA, 22 nt, Human
aagagcuggaagugaagauaac

SEQ ID NO: 471130 - RNA, 22 nt, Human
uuauuuucagcuaggaaagcca

SEQ ID NO: 471131 - RNA, 22 nt, Human
uaaaauguuugcaagagaccag

SEQ ID NO: 471132 - RNA, 21 nt, Human
agcagccauggaugguaugua

SEQ ID NO: 471133 - RNA, 22 nt, Human
aacauaauguggccaaagucac

SEQ ID NO: 471134 - RNA, 22 nt, Human
aagaagguguggaaagaugcuc

SEQ ID NO: 471135 - RNA, 22 nt, Human
aacaugaaaguugcuaagugca

SEQ ID NO: 471136 - RNA, 22 nt, Human
gcagcauugcacuuuuguucuu

SEQ ID NO: 471137 - RNA, 22 nt, Human
ugagguguguccccagggaggu

SEQ ID NO: 471138 - RNA, 21 nt, Human
ugaaaguuggagucaaaugua

SEQ ID NO: 471139 - RNA, 22 nt, Human
uaaggcacccuucugaguagag

SEQ ID NO: 471140 - RNA, 22 nt, Human
uuuccucugacugcuccccugc

SEQ ID NO: 471141 - RNA, 22 nt, Human
uuggaaggagucaaccagcuga

SEQ ID NO: 471142 - RNA, 22 nt, Human
uacaugcaugucacagaaugaa

SEQ ID NO: 471143 - RNA, 22 nt, Human
gcagguggauuaucagaagugc

SEQ ID NO: 471144 - RNA, 22 nt, Human
uggagcagcuaagccucugaga

SEQ ID NO: 471145 - RNA, 22 nt, Human
uagacacauccguggaagcuuc

SEQ ID NO: 471146 - RNA, 22 nt, Human
aagaggucauaccagauaaggg

SEQ ID NO: 471147 - RNA, 22 nt, Human
caucacuguccucagcauucca

SEQ ID NO: 471148 - RNA, 22 nt, Human
uccagucaagcuugagaauuuc

SEQ ID NO: 471149 - RNA, 22 nt, Human
gaaucucaaggcuugugaggau

SEQ ID NO: 471150 - RNA, 22 nt, Human
ugagcccaggaguuggagaccg

SEQ ID NO: 471151 - RNA, 22 nt, Human
ggagccagugcccucuggugga

SEQ ID NO: 471152 - RNA, 22 nt, Human
agcugccacauggugucacugu

SEQ ID NO: 471153 - RNA, 22 nt, Human
ggcagcugaccuagcaccaucc

SEQ ID NO: 471154 - RNA, 19 nt, Human
ccucugcgcuguccugcuc

SEQ ID NO: 471155 - RNA, 22 nt, Human
aaaacuguaggaauugggugcc

SEQ ID NO: 471156 - RNA, 22 nt, Human
gagauuucuuuugaugccuguc

SEQ ID NO: 471157 - RNA, 22 nt, Human
aaucuguuuaguucugcguaug

SEQ ID NO: 471158 - RNA, 22 nt, Human
acauuuuuauucaucaaagcag

SEQ ID NO: 471159 - RNA, 22 nt, Human
gccugcagcaugcuaggucuug

SEQ ID NO: 471160 - RNA, 22 nt, Human
ugcuggggagugauugaccauc

SEQ ID NO: 471161 - RNA, 22 nt, Human
aaugcugcaagaggugaaaaga

SEQ ID NO: 471162 - RNA, 22 nt, Human
uggcagagucucuccuuuccag

SEQ ID NO: 471163 - RNA, 22 nt, Human
ucuagggaacaugggucaagcu

SEQ ID NO: 471164 - RNA, 22 nt, Human
cucugggcaggaccaguggacc

SEQ ID NO: 471165 - RNA, 22 nt, Human
ccugggaggcugugggucugcu

SEQ ID NO: 471166 - RNA, 21 nt, Human
gacaaagugaagcaggcagga

SEQ ID NO: 471167 - RNA, 22 nt, Human
ugcucugugguccaagauggcu

SEQ ID NO: 471168 - RNA, 19 nt, Human
guugaaaguaggugagggu

SEQ ID NO: 471169 - RNA, 22 nt, Human
uggccuuggcagugagaagagu

SEQ ID NO: 471170 - RNA, 22 nt, Human
ucugagggugggagaaggagcu

SEQ ID NO: 471171 - RNA, 22 nt, Human
agaaagaacguugguuaucuua

SEQ ID NO: 471172 - RNA, 22 nt, Human
cuguugucuccucucagauuau

SEQ ID NO: 471173 - RNA, 22 nt, Human
acagaaauauagaagguaggaa

SEQ ID NO: 471174 - RNA, 22 nt, Human
aaggcaguuugggccaccaucu

SEQ ID NO: 471175 - RNA, 22 nt, Human
ccuggccaggcauggagucaca

SEQ ID NO: 471176 - RNA, 22 nt, Human
ugguagggacacuaugcagaaa

SEQ ID NO: 471177 - RNA, 22 nt, Human
cccagagcuccgguccugccca

SEQ ID NO: 471178 - RNA, 21 nt, Human
agaagccaugugguggagaac

SEQ ID NO: 471179 - RNA, 22 nt, Human
agugaaauacugucguuuuuag

SEQ ID NO: 471180 - RNA, 22 nt, Human
accagccugucugagucguggg

SEQ ID NO: 471181 - RNA, 22 nt, Human
gcagagccaugggagguuuuug

SEQ ID NO: 471182 - RNA, 22 nt, Human
aaacucuuuccacgauuacuuu

SEQ ID NO: 471183 - RNA, 22 nt, Human
auacaguauuaccuguucagga

SEQ ID NO: 471184 - RNA, 22 nt, Human
gugaaaucugaggcccaugaug

SEQ ID NO: 471185 - RNA, 22 nt, Human
agccugagagccaagcugugca

SEQ ID NO: 471186 - RNA, 22 nt, Human
uggugcugacaguucugagugc

SEQ ID NO: 471187 - RNA, 22 nt, Human
cagcagggaagcugugcuguuu

SEQ ID NO: 471188 - RNA, 22 nt, Human
gguuucaaugagaagugcuugu

SEQ ID NO: 471189 - RNA, 22 nt, Human
agggagccagaguugggagcuc

SEQ ID NO: 471190 - RNA, 22 nt, Human
agccuucauaaucuugggcuuu

SEQ ID NO: 471191 - RNA, 22 nt, Human
agcugccugggcuuguacaccu

SEQ ID NO: 471192 - RNA, 20 nt, Human
uggcuccugcgguggaacca

SEQ ID NO: 471193 - RNA, 22 nt, Human
cucaggauucucgacacucaca

SEQ ID NO: 471194 - RNA, 22 nt, Human
ucacaggguaucugggauggau

SEQ ID NO: 471195 - RNA, 22 nt, Human
cuuuggaaaaauaccuggcaua

SEQ ID NO: 471196 - RNA, 22 nt, Human
ggcugccugaacuuuggggaaa

SEQ ID NO: 471197 - RNA, 22 nt, Human
uggcagagugcggcauccccug

SEQ ID NO: 471198 - RNA, 22 nt, Human
uggcagggucuugcuguguugc

SEQ ID NO: 471199 - RNA, 22 nt, Human
caaaugcagauucaggaguucu

SEQ ID NO: 471200 - RNA, 19 nt, Human
uggcauugguccagauaaa

SEQ ID NO: 471201 - RNA, 22 nt, Human
gaggaaccaaucugugauauuc

SEQ ID NO: 471202 - RNA, 22 nt, Human
agauuucacaugcugcucuauu

SEQ ID NO: 471203 - RNA, 20 nt, Human
uuaagaaaagcacauccugc

SEQ ID NO: 471204 - RNA, 22 nt, Human
uccaggcuaauuuugcauuguu

SEQ ID NO: 471205 - RNA, 23 nt, Human
ucuggcucuaugugacagcucuc

SEQ ID NO: 471206 - RNA, 21 nt, Human
ccuccaggugauuccgugcuc

SEQ ID NO: 471207 - RNA, 22 nt, Human
aaggcacuagcagaauuaguga

SEQ ID NO: 471208 - RNA, 22 nt, Human
ccagguggaaggucugugcucu

SEQ ID NO: 471209 - RNA, 22 nt, Human
cugugcaguaggucagggcugg

SEQ ID NO: 471210 - RNA, 22 nt, Human
caggauccuggcugcauggacg

SEQ ID NO: 471211 - RNA, 22 nt, Human
agugcauugcaucucugcuuca

SEQ ID NO: 471212 - RNA, 19 nt, Human
ccucuccgcccaccagccc

SEQ ID NO: 471213 - RNA, 22 nt, Human
gggugaggagcugccagucaug

SEQ ID NO: 471214 - RNA, 22 nt, Human
aagggcagaaagggacgcuuug

SEQ ID NO: 471215 - RNA, 22 nt, Human
cucugugggggagaggcagcug

SEQ ID NO: 471216 - RNA, 22 nt, Human
ugcuggcugggcugcuggagac

SEQ ID NO: 471217 - RNA, 22 nt, Human
aucuggcuuggguguggguagc

SEQ ID NO: 471218 - RNA, 22 nt, Human
guucaaguucauaucucuuaac

SEQ ID NO: 471219 - RNA, 18 nt, Human
gggcucugauccuucacc

SEQ ID NO: 471220 - RNA, 22 nt, Human
aaagaucagucugaagcaacau

SEQ ID NO: 471221 - RNA, 22 nt, Human
agggagcugcucugcuuccgug

SEQ ID NO: 471222 - RNA, 22 nt, Human
uuguuaaaaugcauauucuggu

SEQ ID NO: 471223 - RNA, 22 nt, Human
aaugaugguuaaacacuggagg

SEQ ID NO: 471224 - RNA, 22 nt, Human
guguacauauugagucugcuga

SEQ ID NO: 471225 - RNA, 22 nt, Human
ucucagagaucuuucugcaugu

SEQ ID NO: 471226 - RNA, 22 nt, Human
gcagacagcauguugggcuauu

SEQ ID NO: 471227 - RNA, 21 nt, Human
uggcugccuacaugcugcagg

SEQ ID NO: 471228 - RNA, 22 nt, Human
ugaucagucccaugaucuucca

SEQ ID NO: 471229 - RNA, 22 nt, Human
aagauuuccauuucuagcucau

SEQ ID NO: 471230 - RNA, 22 nt, Human
gcugccuuuuaaagccucgcuu

SEQ ID NO: 471231 - RNA, 22 nt, Human
agcagcugucccuuaacaucag

SEQ ID NO: 471232 - RNA, 22 nt, Human
ucucugggugauggcagggcac

SEQ ID NO: 471233 - RNA, 22 nt, Human
uccuggagggaggcggugcuac

SEQ ID NO: 471234 - RNA, 22 nt, Human
gcagggccagguacaagaagca

SEQ ID NO: 471235 - RNA, 22 nt, Human
uuuccucugcugccauugcccc

SEQ ID NO: 471236 - RNA, 22 nt, Human
cuccucuuuggggauuuacaca

SEQ ID NO: 471237 - RNA, 22 nt, Human
ucagggcacauucugcaguggc

SEQ ID NO: 471238 - RNA, 21 nt, Human
agugaaaugaaguguaugcuc

SEQ ID NO: 471239 - RNA, 22 nt, Human
cuguucaugcugauucuguaug

SEQ ID NO: 471240 - RNA, 22 nt, Human
ggcuuucuagaucuagcucugu

SEQ ID NO: 471241 - RNA, 22 nt, Human
ucccaggcuggcaggcagcagu

SEQ ID NO: 471242 - RNA, 22 nt, Human
ugccaggcauauggccucuuug

SEQ ID NO: 471243 - RNA, 22 nt, Human
ccaggcugggcuacaaguugag

SEQ ID NO: 471244 - RNA, 22 nt, Human
cugggcaguuuuacaucauugc

SEQ ID NO: 471245 - RNA, 22 nt, Human
cuugugcauuucauuccucagg

SEQ ID NO: 471246 - RNA, 22 nt, Human
cucugagagagcuggugagcac

SEQ ID NO: 471247 - RNA, 22 nt, Human
uacauguuugguaaaugauggc

SEQ ID NO: 471248 - RNA, 22 nt, Human
uuuuuaguagagguggguuuca

SEQ ID NO: 471249 - RNA, 22 nt, Human
uggcucagugacauuccuccca

SEQ ID NO: 471250 - RNA, 22 nt, Human
ggugcagaucuuucucuucagg

SEQ ID NO: 471251 - RNA, 22 nt, Human
uagcaggguaaauguagaugga

SEQ ID NO: 471252 - RNA, 22 nt, Human
cuggccacuggagguggcaccc

SEQ ID NO: 471253 - RNA, 22 nt, Human
caauaguaaauuacggaggaga

SEQ ID NO: 471254 - RNA, 22 nt, Human
uguacaaugccagggaacacca

SEQ ID NO: 471255 - RNA, 22 nt, Human
gcucuggacccuggaguggcug

SEQ ID NO: 471256 - RNA, 22 nt, Human
acagguggaggcuuuaggaggu

SEQ ID NO: 471257 - RNA, 22 nt, Human
cagagcugagaauguugaugcu

SEQ ID NO: 471258 - RNA, 22 nt, Human
uccucaggcggugaggaggggc

SEQ ID NO: 471259 - RNA, 22 nt, Human
ccucacugaagaggugacauuu

SEQ ID NO: 471260 - RNA, 22 nt, Human
cugccugggccggccacccucu

SEQ ID NO: 471261 - RNA, 22 nt, Human
agauuucccaaauacuuguuau

SEQ ID NO: 471262 - RNA, 22 nt, Human
ccagucccgcaugguccagaau

SEQ ID NO: 471263 - RNA, 22 nt, Human
agauuucccacuccauguauug

SEQ ID NO: 471264 - RNA, 22 nt, Human
uacuuuuagccuauuugauucu

SEQ ID NO: 471265 - RNA, 22 nt, Human
cucugggcuuguugaccugcac

SEQ ID NO: 471266 - RNA, 22 nt, Human
ugaggcagcaauugauuauuca

SEQ ID NO: 471267 - RNA, 22 nt, Human
gcaccugggcaaggauucagag

SEQ ID NO: 471268 - RNA, 23 nt, Human
uuucuguuggguauauauccaag

SEQ ID NO: 471269 - RNA, 22 nt, Human
ggggcuguuuuuggaauggcug

SEQ ID NO: 471270 - RNA, 22 nt, Human
cagccaucccagccugugguuc

SEQ ID NO: 471271 - RNA, 22 nt, Human
uaaauucuacaacuucaaagau

SEQ ID NO: 471272 - RNA, 22 nt, Human
auugaaagauaggcuacugugg

SEQ ID NO: 471273 - RNA, 22 nt, Human
uggggcuguggauucucacgaa

SEQ ID NO: 471274 - RNA, 22 nt, Human
caagggcauugcuugggaccuu

SEQ ID NO: 471275 - RNA, 22 nt, Human
guaacagaggguuugcagauau

SEQ ID NO: 471276 - RNA, 22 nt, Human
acagauuuuaaaugacacuccc

SEQ ID NO: 471277 - RNA, 22 nt, Human
cagcucccaguggcagcuccuu

SEQ ID NO: 471278 - RNA, 22 nt, Human
ggagacaguauggcuuguagcu

SEQ ID NO: 471279 - RNA, 22 nt, Human
ugaugaaacugagguuccaaga

SEQ ID NO: 471280 - RNA, 22 nt, Human
agccacagucugaugccugaga

SEQ ID NO: 471281 - RNA, 22 nt, Human
acacagggcugcgccugacccc

SEQ ID NO: 471282 - RNA, 22 nt, Human
ugcauugcauuugucaugaaga

SEQ ID NO: 471283 - RNA, 22 nt, Human
uucucacuauguauguagauug

SEQ ID NO: 471284 - RNA, 22 nt, Human
aggaagugcuaagagaacauca

SEQ ID NO: 471285 - RNA, 22 nt, Human
ugagccuggccugcagagacca

SEQ ID NO: 471286 - RNA, 22 nt, Human
uaccuugggguuuuguugcucu

SEQ ID NO: 471287 - RNA, 22 nt, Human
agcugcuguccuaggcacugua

SEQ ID NO: 471288 - RNA, 20 nt, Human
aguuuauuccaggagaacug

SEQ ID NO: 471289 - RNA, 22 nt, Human
ucaaagcaucagucaauuuagg

SEQ ID NO: 471290 - RNA, 23 nt, Human
caugccaguuugugcaggcagau

SEQ ID NO: 471291 - RNA, 22 nt, Human
uucagauguggcuuugucaggc

SEQ ID NO: 471292 - RNA, 22 nt, Human
ccaggagucaauaaaggaagcu

SEQ ID NO: 471293 - RNA, 22 nt, Human
ccuguguggaaaccgcaugacg

SEQ ID NO: 471294 - RNA, 22 nt, Human
agcugccaccucugccuuuggg

SEQ ID NO: 471295 - RNA, 22 nt, Human
aggggaggagcuuuucuugccu

SEQ ID NO: 471296 - RNA, 22 nt, Human
acaaagucacaauaauuaaccu

SEQ ID NO: 471297 - RNA, 22 nt, Human
gcucaggacuggaggagcgggg

SEQ ID NO: 471298 - RNA, 22 nt, Human
cagcaggguagguuguaucagu

SEQ ID NO: 471299 - RNA, 22 nt, Human
uugggacagaaaaggagaagau

SEQ ID NO: 471300 - RNA, 22 nt, Human
cacugcaggucugagauggggg

SEQ ID NO: 471301 - RNA, 22 nt, Human
uaaucacagaaacagacuguuu

SEQ ID NO: 471302 - RNA, 22 nt, Human
guccucugggagccuugagccu

SEQ ID NO: 471303 - RNA, 22 nt, Human
gcaggaugccagggcagcagcg

SEQ ID NO: 471304 - RNA, 22 nt, Human
uccugccuugccugggacauca

SEQ ID NO: 471305 - RNA, 22 nt, Human
uaacacugguauuucauuuagu

SEQ ID NO: 471306 - RNA, 22 nt, Human
cugucagcacucuacuacagau

SEQ ID NO: 471307 - RNA, 22 nt, Human
gcugaaggucucuggagagguc

SEQ ID NO: 471308 - RNA, 21 nt, Human
aagggagauaggaaucaggcc

SEQ ID NO: 471309 - RNA, 22 nt, Human
cccaagcagggugcagaggcau

SEQ ID NO: 471310 - RNA, 19 nt, Human
acccucucagugccugagg

SEQ ID NO: 471311 - RNA, 22 nt, Human
gccucccuguagaggccagccu

SEQ ID NO: 471312 - RNA, 22 nt, Human
ucaagagacaggacguguuuca

SEQ ID NO: 471313 - RNA, 22 nt, Human
agggcaugaagcaguggacagc

SEQ ID NO: 471314 - RNA, 22 nt, Human
uagaggcacccuggaggagacu

SEQ ID NO: 471315 - RNA, 22 nt, Human
cuuggcagagggcugggcucag

SEQ ID NO: 471316 - RNA, 22 nt, Human
acagagccaaaaggacauagua

SEQ ID NO: 471317 - RNA, 22 nt, Human
ugaggcagaguaagauacauga

SEQ ID NO: 471318 - RNA, 22 nt, Human
ugguccugccccgugcacagag

SEQ ID NO: 471319 - RNA, 17 nt, Human
uggcacagaggugcuau

SEQ ID NO: 471320 - RNA, 22 nt, Human
cugcucuguuucuuagcugggu

SEQ ID NO: 471321 - RNA, 21 nt, Human
aggaggaacccguggcugggc

SEQ ID NO: 471322 - RNA, 22 nt, Human
ccagcaggcagucauauccuuu

SEQ ID NO: 471323 - RNA, 22 nt, Human
ggcaaggccuugcccagcauuc

SEQ ID NO: 471324 - RNA, 22 nt, Human
ugaaaucuuagccauucugccu

SEQ ID NO: 471325 - RNA, 22 nt, Human
gaaaucugcuucuugcauagua

SEQ ID NO: 471326 - RNA, 22 nt, Human
accagagcuggcucugagcacc

SEQ ID NO: 471327 - RNA, 22 nt, Human
cagaagccugccucagaugcac

SEQ ID NO: 471328 - RNA, 22 nt, Human
uggccugaauuauggcagaucu

SEQ ID NO: 471329 - RNA, 22 nt, Human
ucccagccuuccagucugguuu

SEQ ID NO: 471330 - RNA, 22 nt, Human
ucacacagguuugcaaugauuu

SEQ ID NO: 471331 - RNA, 21 nt, Human
ucccugcuuucuggcccaguc

SEQ ID NO: 471332 - RNA, 22 nt, Human
gccuguuggguaacagaguuca

SEQ ID NO: 471333 - RNA, 22 nt, Human
accacccucagcagagcugaaa

SEQ ID NO: 471334 - RNA, 22 nt, Human
ucaggcugaaucauccuagcuu

SEQ ID NO: 471335 - RNA, 22 nt, Human
acagguggagugguuagcaggc

SEQ ID NO: 471336 - RNA, 22 nt, Human
aucaaaaugcuccagugauggu

SEQ ID NO: 471337 - RNA, 22 nt, Human
agaacagaagggaggaaggccu

SEQ ID NO: 471338 - RNA, 18 nt, Human
ccauuucaugauuauuac

SEQ ID NO: 471339 - RNA, 22 nt, Human
augccacugacauggacaauuu

SEQ ID NO: 471340 - RNA, 23 nt, Human
agaaaaguucauaccuuuuuaac

SEQ ID NO: 471341 - RNA, 22 nt, Human
gccacguugccacccgggugac

SEQ ID NO: 471342 - RNA, 23 nt, Human
gccuucagcucgggaaggcuccc

SEQ ID NO: 471343 - RNA, 22 nt, Human
gaagaggaugacaggagccggu

SEQ ID NO: 471344 - RNA, 22 nt, Human
gccaccuggacagcugugcccu

SEQ ID NO: 471345 - RNA, 22 nt, Human
caggaaagggaugggcugccac

SEQ ID NO: 471346 - RNA, 22 nt, Human
ucagaaauagucuuuaaaauga

SEQ ID NO: 471347 - RNA, 22 nt, Human
gggccugugcacaguucuguua

SEQ ID NO: 471348 - RNA, 22 nt, Human
ucccaaggauaagagagucuga

SEQ ID NO: 471349 - RNA, 22 nt, Human
uacagaaaaacuggcauugaag

SEQ ID NO: 471350 - RNA, 22 nt, Human
aacuguaaugaauuguucauga

SEQ ID NO: 471351 - RNA, 22 nt, Human
acagaacugggaaaugcacaua

SEQ ID NO: 471352 - RNA, 22 nt, Human
ggaagaggcucucauugagggc

SEQ ID NO: 471353 - RNA, 22 nt, Human
cacacacaguuuuguauucugu

SEQ ID NO: 471354 - RNA, 22 nt, Human
acuugguuggucucacccuguu

SEQ ID NO: 471355 - RNA, 22 nt, Human
acugcagccuuugggcucauaa

SEQ ID NO: 471356 - RNA, 21 nt, Human
uuuaauuugcauguaugacgc

SEQ ID NO: 471357 - RNA, 22 nt, Human
ccugcagcuguaggagaaggcg

SEQ ID NO: 471358 - RNA, 22 nt, Human
uauccuuguacuauaguauuua

SEQ ID NO: 471359 - RNA, 22 nt, Human
cuuugaaagcucccaggacuua

SEQ ID NO: 471360 - RNA, 22 nt, Human
accucaggauguggacacagaa

SEQ ID NO: 471361 - RNA, 22 nt, Human
gccgugcgugcgcaggugcugu

SEQ ID NO: 471362 - RNA, 22 nt, Human
aggcugaggaucccuguguucu

SEQ ID NO: 471363 - RNA, 22 nt, Human
ggcuuuauaggguagaggauca

SEQ ID NO: 471364 - RNA, 22 nt, Human
cucagaguccccacaucugggu

SEQ ID NO: 471365 - RNA, 23 nt, Human
gggggcugguugacucucugcag

SEQ ID NO: 471366 - RNA, 22 nt, Human
ugccagggcugcuacuggcuga

SEQ ID NO: 471367 - RNA, 22 nt, Human
cagaauuugaaguaauauucca

SEQ ID NO: 471368 - RNA, 22 nt, Human
augauucagcaauuuuauaucu

SEQ ID NO: 471369 - RNA, 22 nt, Human
ggcuguggggccggguacagug

SEQ ID NO: 471370 - RNA, 22 nt, Human
cacugcuuucacaguuuguucc

SEQ ID NO: 471371 - RNA, 22 nt, Human
ggagaagggacagacucagcuu

SEQ ID NO: 471372 - RNA, 22 nt, Human
uguguccuuuggaggaucagcg

SEQ ID NO: 471373 - RNA, 22 nt, Human
gcacaugguaggcauuugaugu

SEQ ID NO: 471374 - RNA, 22 nt, Human
gccaugcuugguaugcugugag

SEQ ID NO: 471375 - RNA, 22 nt, Human
ggcugaaacagauuucaagaca

SEQ ID NO: 471376 - RNA, 22 nt, Human
ccagaagagaucacaguucuug

SEQ ID NO: 471377 - RNA, 22 nt, Human
cugcccugaccugccucagagu

SEQ ID NO: 471378 - RNA, 22 nt, Human
acagagcuguacuacuuacuga

SEQ ID NO: 471379 - RNA, 22 nt, Human
gcagagccugacgggauuuuuc

SEQ ID NO: 471380 - RNA, 22 nt, Human
ugugccuggcauucugggcuuc

SEQ ID NO: 471381 - RNA, 22 nt, Human
gguucccggaucuccgaguccc

SEQ ID NO: 471382 - RNA, 22 nt, Human
ucagaagcaaacaucacucuag

SEQ ID NO: 471383 - RNA, 22 nt, Human
cucaagacugaucgcaguggaa

SEQ ID NO: 471384 - RNA, 22 nt, Human
agugugcugcuuaaacaguugu

SEQ ID NO: 471385 - RNA, 22 nt, Human
aagcuggcaauuaucaaaacug

SEQ ID NO: 471386 - RNA, 22 nt, Human
ggcagccauggacacuggcuag

SEQ ID NO: 471387 - RNA, 22 nt, Human
aaguccagacuccuuugcgugg

SEQ ID NO: 471388 - RNA, 20 nt, Human
gcagcugaaaguaugacacc

SEQ ID NO: 471389 - RNA, 22 nt, Human
cugaggucucuuuccauaguga

SEQ ID NO: 471390 - RNA, 22 nt, Human
uggagcaggugggaugucguga

SEQ ID NO: 471391 - RNA, 22 nt, Human
gccugcagccagggaguucucu

SEQ ID NO: 471392 - RNA, 22 nt, Human
cgcaccacugaauuccagccug

SEQ ID NO: 471393 - RNA, 22 nt, Human
uacauuugcuuugauuuucagc

SEQ ID NO: 471394 - RNA, 22 nt, Human
cuccaggcucguccaagaucga

SEQ ID NO: 471395 - RNA, 21 nt, Human
ugcaggcaggcagagaugcug

SEQ ID NO: 471396 - RNA, 22 nt, Human
aggcucaggugccucauucaca

SEQ ID NO: 471397 - RNA, 22 nt, Human
accauuugacucucuaaggaua

SEQ ID NO: 471398 - RNA, 22 nt, Human
cugaggcaugaaugugggcuuu

SEQ ID NO: 471399 - RNA, 18 nt, Human
ucacagugcucuugccua

SEQ ID NO: 471400 - RNA, 23 nt, Human
cagguggcuccacgagggguggg

SEQ ID NO: 471401 - RNA, 22 nt, Human
ugugcccaucccucuggagugu

SEQ ID NO: 471402 - RNA, 22 nt, Human
agagccaggcaggcaauguuga

SEQ ID NO: 471403 - RNA, 22 nt, Human
ggcauggcuggguucuggugag

SEQ ID NO: 471404 - RNA, 22 nt, Human
aaugggaagccagaagacaagg

SEQ ID NO: 471405 - RNA, 22 nt, Human
cccugcagagaccacugaccuu

SEQ ID NO: 471406 - RNA, 22 nt, Human
uugcauugaaugcacauuuuua

SEQ ID NO: 471407 - RNA, 18 nt, Human
gugugcaguugcaggggu

SEQ ID NO: 471408 - RNA, 19 nt, Human
uaaaaacugaaggaagcag

SEQ ID NO: 471409 - RNA, 22 nt, Human
gcugcagcccggcgcgccugag

SEQ ID NO: 471410 - RNA, 22 nt, Human
augccaggaacaaacaguggug

SEQ ID NO: 471411 - RNA, 22 nt, Human
cuagaaaugcucaagagaaagu

SEQ ID NO: 471412 - RNA, 22 nt, Human
ucuguaguagguuguaguucuu

SEQ ID NO: 471413 - RNA, 22 nt, Human
ucucagagcuucagaaagcacc

SEQ ID NO: 471414 - RNA, 22 nt, Human
uuucaagcauaacugggaagag

SEQ ID NO: 471415 - RNA, 22 nt, Human
cccaggcaucccauuaaggagc

SEQ ID NO: 471416 - RNA, 19 nt, Human
uuggaaggagccagagugg

SEQ ID NO: 471417 - RNA, 22 nt, Human
agcaguggccuggggcucugug

SEQ ID NO: 471418 - RNA, 23 nt, Human
agggcugaugccauugcagcucu

SEQ ID NO: 471419 - RNA, 23 nt, Human
ccugaagggucaggguccucagc

SEQ ID NO: 471420 - RNA, 22 nt, Human
acugaaggcuuucccaagguca

SEQ ID NO: 471421 - RNA, 22 nt, Human
ggcacugaaccaggacacaagc

SEQ ID NO: 471422 - RNA, 22 nt, Human
uuuccucuaaacgcauuugcuu

SEQ ID NO: 471423 - RNA, 22 nt, Human
uugugucccccuuugagagcca

SEQ ID NO: 471424 - RNA, 22 nt, Human
gcccugucccuuggcuucuagg

SEQ ID NO: 471425 - RNA, 22 nt, Human
aucaggaucugcaucauaagaa

SEQ ID NO: 471426 - RNA, 21 nt, Human
aguuugaugcaauuucugaga

SEQ ID NO: 471427 - RNA, 22 nt, Human
cuaauacucauuucuguaacuc

SEQ ID NO: 471428 - RNA, 22 nt, Human
cagaggcugggaccucaggcau

SEQ ID NO: 471429 - RNA, 22 nt, Human
ucagaagcaggagugugcacaa

SEQ ID NO: 471430 - RNA, 22 nt, Human
cuggccuucagacucggacuga

SEQ ID NO: 471431 - RNA, 22 nt, Human
ucccagggcacucacccucccu

SEQ ID NO: 471432 - RNA, 22 nt, Human
cugcagccuaggugcagcuggg

SEQ ID NO: 471433 - RNA, 22 nt, Human
cagccagguaugggcgugcggg

SEQ ID NO: 471434 - RNA, 20 nt, Human
acugagcugcauggagagga

SEQ ID NO: 471435 - RNA, 22 nt, Human
ucacagacacagggagaagcau

SEQ ID NO: 471436 - RNA, 21 nt, Human
acccuggguucuccauacccu

SEQ ID NO: 471437 - RNA, 22 nt, Human
agggaauguagcaagaugccaa

SEQ ID NO: 471438 - RNA, 20 nt, Human
gacaucauguacacauugcc

SEQ ID NO: 471439 - RNA, 22 nt, Human
agcugcucaggagagccagguc

SEQ ID NO: 471440 - RNA, 22 nt, Human
aggggcaggugcugcacuuaga

SEQ ID NO: 471441 - RNA, 22 nt, Human
ggcuuuauuugcagccauuguu

SEQ ID NO: 471442 - RNA, 22 nt, Human
guauuaggaaauaugaagaaag

SEQ ID NO: 471443 - RNA, 22 nt, Human
acagagcacauagauuggaguu

SEQ ID NO: 471444 - RNA, 22 nt, Human
ggcugccuggaccuccucuuuc

SEQ ID NO: 471445 - RNA, 22 nt, Human
agauuuagacugccuuaaucau

SEQ ID NO: 471446 - RNA, 20 nt, Human
cugagcgucuaagaggugag

SEQ ID NO: 471447 - RNA, 22 nt, Human
ucucagagcuucaguuauuuuc

SEQ ID NO: 471448 - RNA, 22 nt, Human
uuguccaaggucccacaguuag

SEQ ID NO: 471449 - RNA, 22 nt, Human
agcaggagcccuuaucaccagg

SEQ ID NO: 471450 - RNA, 22 nt, Human
agggcugcuauguugauucaga

SEQ ID NO: 471451 - RNA, 22 nt, Human
cuacuucuaaguacauggugau

SEQ ID NO: 471452 - RNA, 22 nt, Human
ggugaggggagagugaaagaaa

SEQ ID NO: 471453 - RNA, 22 nt, Human
aucaggauucaguaucuccagc

SEQ ID NO: 471454 - RNA, 22 nt, Human
agcuggaggauaacucacuucu

SEQ ID NO: 471455 - RNA, 22 nt, Human
auaauguagguauguguauuua

SEQ ID NO: 471456 - RNA, 21 nt, Human
auccauccaucuuggccuaac

SEQ ID NO: 471457 - RNA, 22 nt, Human
gaggcagcaucuauggugggaa

SEQ ID NO: 471458 - RNA, 22 nt, Human
uauguacauguuaaagggcaaa

SEQ ID NO: 471459 - RNA, 22 nt, Human
aggggcucaaagugugcaggga

SEQ ID NO: 471460 - RNA, 22 nt, Human
agccaugcaccuuacucuugcu

SEQ ID NO: 471461 - RNA, 22 nt, Human
guucacaagaguuacagacaga

SEQ ID NO: 471462 - RNA, 22 nt, Human
gggagaaggagcuaguucuuga

SEQ ID NO: 471463 - RNA, 22 nt, Human
gauggcagucaaccaggugagg

SEQ ID NO: 471464 - RNA, 22 nt, Human
agagcagguggcaacucuggga

SEQ ID NO: 471465 - RNA, 22 nt, Human
agggccagaaucccucagucua

SEQ ID NO: 471466 - RNA, 22 nt, Human
ugagcugggcugggcugagcug

SEQ ID NO: 471467 - RNA, 22 nt, Human
ucacauuuuuuacuggacuuaa

SEQ ID NO: 471468 - RNA, 22 nt, Human
uaucuuugcaaauaucucuaag

SEQ ID NO: 471469 - RNA, 22 nt, Human
acaguguguucugggaccucca

SEQ ID NO: 471470 - RNA, 22 nt, Human
uuuuucaagacaaccugcaugu

SEQ ID NO: 471471 - RNA, 22 nt, Human
ugggacugcucuugcugggguc

SEQ ID NO: 471472 - RNA, 22 nt, Human
cuacauuuggagaguauaggaa

SEQ ID NO: 471473 - RNA, 22 nt, Human
cauuuacuuaaaucuuuacaag

SEQ ID NO: 471474 - RNA, 22 nt, Human
acagauuuuauuauucagguau

SEQ ID NO: 471475 - RNA, 23 nt, Human
guuuucaacacaauaaauguaac

SEQ ID NO: 471476 - RNA, 20 nt, Human
cagagacccaggcuucagcu

SEQ ID NO: 471477 - RNA, 18 nt, Human
agucuucugauccauuuu

SEQ ID NO: 471478 - RNA, 22 nt, Human
uacaguuuguuacauuguuagu

SEQ ID NO: 471479 - RNA, 20 nt, Human
cuuccacacaagaagcacag

SEQ ID NO: 471480 - RNA, 22 nt, Human
gaaaugcauggaucuuggcaga

SEQ ID NO: 471481 - RNA, 22 nt, Human
aacacaaagaagcugcaggauc

SEQ ID NO: 471482 - RNA, 22 nt, Human
agggucagcuggcugucagggg

SEQ ID NO: 471483 - RNA, 22 nt, Human
cagaaggcuggcagauugagau

SEQ ID NO: 471484 - RNA, 22 nt, Human
ggcagcuggccuccucgcccac

SEQ ID NO: 471485 - RNA, 22 nt, Human
agguagagcuccaguagaaaau

SEQ ID NO: 471486 - RNA, 22 nt, Human
gaagccaacauuccaaguagaa

SEQ ID NO: 471487 - RNA, 22 nt, Human
gccaguuccuguggagucagag

SEQ ID NO: 471488 - RNA, 22 nt, Human
uauuuuaucugccagaguggag

SEQ ID NO: 471489 - RNA, 22 nt, Human
uaaagucaucuuuacaucuuug

SEQ ID NO: 471490 - RNA, 22 nt, Human
ccuccucugggaagauucagag

SEQ ID NO: 471491 - RNA, 23 nt, Human
aggauccugguacaggagcagag

SEQ ID NO: 471492 - RNA, 22 nt, Human
caggcugggcagccuccccggc

SEQ ID NO: 471493 - RNA, 19 nt, Human
ugugaaagcuaguguucuu

SEQ ID NO: 471494 - RNA, 22 nt, Human
agcucuccacacauaggacuag

SEQ ID NO: 471495 - RNA, 22 nt, Human
auaguauuuaauaguuagcuca

SEQ ID NO: 471496 - RNA, 22 nt, Human
aggggccuggacauggacgcgc

SEQ ID NO: 471497 - RNA, 22 nt, Human
gaagccacuauagauauucuaa

SEQ ID NO: 471498 - RNA, 22 nt, Human
gacagcauggugucuguucagg

SEQ ID NO: 471499 - RNA, 22 nt, Human
uuugggcaauucagugggaccu

SEQ ID NO: 471500 - RNA, 18 nt, Human
acauuucucucugcguga

SEQ ID NO: 471501 - RNA, 22 nt, Human
ucccuggacaacagacuucacu

SEQ ID NO: 471502 - RNA, 22 nt, Human
ccaaaguccacaguuuacauua

SEQ ID NO: 471503 - RNA, 22 nt, Human
cccagcagccuggauguucuuu

SEQ ID NO: 471504 - RNA, 19 nt, Human
aggguccagggagcggcuc

SEQ ID NO: 471505 - RNA, 22 nt, Human
agauuucccucuuguauuugca

SEQ ID NO: 471506 - RNA, 21 nt, Human
cacugcagccuugaccugggc

SEQ ID NO: 471507 - RNA, 22 nt, Human
ucucugauguauaucagagaac

SEQ ID NO: 471508 - RNA, 22 nt, Human
ugaaacagucuccagacuugga

SEQ ID NO: 471509 - RNA, 20 nt, Human
uagaaaucuuauaaaagacu

SEQ ID NO: 471510 - RNA, 22 nt, Human
ggcccacuugaaauggagcuca

SEQ ID NO: 471511 - RNA, 22 nt, Human
cuggagcccugaaugggcagga

SEQ ID NO: 471512 - RNA, 22 nt, Human
cugcugcugcuaucuacccagg

SEQ ID NO: 471513 - RNA, 23 nt, Human
ccuggaguacuaaggggauggaa

SEQ ID NO: 471514 - RNA, 20 nt, Human
cucaggauacugcaaaguug

SEQ ID NO: 471515 - RNA, 22 nt, Human
cuggguggcgucuggggccagu

SEQ ID NO: 471516 - RNA, 22 nt, Human
gucccucugugucccugcaguc

SEQ ID NO: 471517 - RNA, 22 nt, Human
agggcagcacaaggcauggacu

SEQ ID NO: 471518 - RNA, 22 nt, Human
augcaguggcagcuccuggugu

SEQ ID NO: 471519 - RNA, 22 nt, Human
gcugccuuuugcuccucccacc

SEQ ID NO: 471520 - RNA, 22 nt, Human
gcaagcaguuguggcuucugag

SEQ ID NO: 471521 - RNA, 22 nt, Human
ccagagccucuuaugaagaucg

SEQ ID NO: 471522 - RNA, 22 nt, Human
aauguuguuuuucugcaugucu

SEQ ID NO: 471523 - RNA, 22 nt, Human
uggcugcagaucaagggcaggc

SEQ ID NO: 471524 - RNA, 22 nt, Human
uacccagggcuuuucugaugca

SEQ ID NO: 471525 - RNA, 22 nt, Human
aaaaguguucaggaagaauaau

SEQ ID NO: 471526 - RNA, 21 nt, Human
uggcucuggguaggagagugc

SEQ ID NO: 471527 - RNA, 22 nt, Human
gcucccaccaggcagaccuacc

SEQ ID NO: 471528 - RNA, 22 nt, Human
gcucccagggaccgcagggcag

SEQ ID NO: 471529 - RNA, 22 nt, Human
caaaugugguuucucagcauuc

SEQ ID NO: 471530 - RNA, 22 nt, Human
ucccagcagucagagcuaugug

SEQ ID NO: 471531 - RNA, 22 nt, Human
cuggcagcuuccuuugcaucug

SEQ ID NO: 471532 - RNA, 22 nt, Human
ugggccaggauuucaagacccu

SEQ ID NO: 471533 - RNA, 22 nt, Human
cacacagaugguaagggaggga

SEQ ID NO: 471534 - RNA, 22 nt, Human
agcaggcuuguuaugucugaga

SEQ ID NO: 471535 - RNA, 22 nt, Human
ggcagagacuggguuggcagag

SEQ ID NO: 471536 - RNA, 22 nt, Human
cccauuuaaacacaagcuuuca

SEQ ID NO: 471537 - RNA, 22 nt, Human
gccugcagccccucugcaguag

SEQ ID NO: 471538 - RNA, 22 nt, Human
gaugcacuuucuuuucaacagu

SEQ ID NO: 471539 - RNA, 22 nt, Human
auguaacacccacuuuuauagc

SEQ ID NO: 471540 - RNA, 22 nt, Human
guggcucuccauugacauggaa

SEQ ID NO: 471541 - RNA, 22 nt, Human
caaaaugugagucccaccucaa

SEQ ID NO: 471542 - RNA, 22 nt, Human
gcucugggcugcccucuggaca

SEQ ID NO: 471543 - RNA, 22 nt, Human
ccuucccuaaagcgucgcuuag

SEQ ID NO: 471544 - RNA, 22 nt, Human
cagcauggugccagugagucca

SEQ ID NO: 471545 - RNA, 22 nt, Human
uacagucuuuggaaagagauag

SEQ ID NO: 471546 - RNA, 22 nt, Human
ugcaggaguccaaucaggagac

SEQ ID NO: 471547 - RNA, 23 nt, Human
gcagacagagcagacuaagacaa

SEQ ID NO: 471548 - RNA, 22 nt, Human
agcagggcucacauuaguggau

SEQ ID NO: 471549 - RNA, 22 nt, Human
ucuuccaguguagacaucugcc

SEQ ID NO: 471550 - RNA, 21 nt, Human
ucaggcaggcgcagagggaag

SEQ ID NO: 471551 - RNA, 22 nt, Human
aaggcacuuuuccugagaugau

SEQ ID NO: 471552 - RNA, 21 nt, Human
cucaggaucuuauauauuagu

SEQ ID NO: 471553 - RNA, 22 nt, Human
ccucuguccuggggaguggagc

SEQ ID NO: 471554 - RNA, 22 nt, Human
ggcagagcuuguuccuucuguu

SEQ ID NO: 471555 - RNA, 22 nt, Human
ccucuucugagugagacucccu

SEQ ID NO: 471556 - RNA, 22 nt, Human
ggcuggcauccagggaaaucca

SEQ ID NO: 471557 - RNA, 22 nt, Human
cucaggaugucggugacuauug

SEQ ID NO: 471558 - RNA, 22 nt, Human
aagggugggcaccgccagguca

SEQ ID NO: 471559 - RNA, 22 nt, Human
gcugucugucucugucccacca

SEQ ID NO: 471560 - RNA, 22 nt, Human
agcugccauccuguucagcacc

SEQ ID NO: 471561 - RNA, 21 nt, Human
gggcagaggggccuccugggu

SEQ ID NO: 471562 - RNA, 23 nt, Human
aucaaacuggugagaaugucagu

SEQ ID NO: 471563 - RNA, 22 nt, Human
auuguggugucaguuauaggca

SEQ ID NO: 471564 - RNA, 22 nt, Human
aaagacugguguguuacauaua

SEQ ID NO: 471565 - RNA, 22 nt, Human
cacauuugaaggaauuagcauu

SEQ ID NO: 471566 - RNA, 22 nt, Human
cagggugccucccgcucgccgg

SEQ ID NO: 471567 - RNA, 22 nt, Human
ccucucauagucuguauccuuu

SEQ ID NO: 471568 - RNA, 17 nt, Human
caggcagacauguaagc

SEQ ID NO: 471569 - RNA, 22 nt, Human
auaauuuaauuuucacaguggu

SEQ ID NO: 471570 - RNA, 22 nt, Human
aucagaagcuuguagucucucu

SEQ ID NO: 471571 - RNA, 22 nt, Human
uagggcugcugcagaugacagg

SEQ ID NO: 471572 - RNA, 22 nt, Human
cacuucaauuaacuucagcauu

SEQ ID NO: 471573 - RNA, 22 nt, Human
auucucaaacaagugguuugau

SEQ ID NO: 471574 - RNA, 22 nt, Human
ucaccaggcuggaaugcagugg

SEQ ID NO: 471575 - RNA, 22 nt, Human
ugcagggcaguuuguuucggca

SEQ ID NO: 471576 - RNA, 22 nt, Human
ccuggccucagacagagggugg

SEQ ID NO: 471577 - RNA, 22 nt, Human
gggcuacagacaugcucuaagc

SEQ ID NO: 471578 - RNA, 22 nt, Human
aggugagugugacugcaagaga

SEQ ID NO: 471579 - RNA, 22 nt, Human
gaaaugugggucaugacccauu

SEQ ID NO: 471580 - RNA, 22 nt, Human
ugucucaguacacuccgauguu

SEQ ID NO: 471581 - RNA, 22 nt, Human
uugauacauagcacaguuuagg

SEQ ID NO: 471582 - RNA, 22 nt, Human
uaaugcacauagaaguacuuag

SEQ ID NO: 471583 - RNA, 23 nt, Human
agaugaaagcuucccaucacagu

SEQ ID NO: 471584 - RNA, 22 nt, Human
agagccagguguagucucggag

SEQ ID NO: 471585 - RNA, 22 nt, Human
uccuggauucugcccugaaggc

SEQ ID NO: 471586 - RNA, 22 nt, Human
aaugaaugaaccacauauaaca

SEQ ID NO: 471587 - RNA, 22 nt, Human
uccaggagagguguggggacug

SEQ ID NO: 471588 - RNA, 22 nt, Human
cugaggucuagacaccccaggg

SEQ ID NO: 471589 - RNA, 20 nt, Human
agugggagagggcagacugc

SEQ ID NO: 471590 - RNA, 22 nt, Human
cagcugugcugauugcucagua

SEQ ID NO: 471591 - RNA, 22 nt, Human
cuggcugcgucugcucugacag

SEQ ID NO: 471592 - RNA, 22 nt, Human
caguggcgugaucucugcucac

SEQ ID NO: 471593 - RNA, 22 nt, Human
ccacagggccuuuccugcuggc

SEQ ID NO: 471594 - RNA, 22 nt, Human
ggcuucugaaaucucugugcgu

SEQ ID NO: 471595 - RNA, 21 nt, Human
ugcagagauaucugaagcaga

SEQ ID NO: 471596 - RNA, 22 nt, Human
ccugugugcacacgaggccaug

SEQ ID NO: 471597 - RNA, 19 nt, Human
gcaugcuugguggcuucug

SEQ ID NO: 471598 - RNA, 22 nt, Human
aggaagagcuggaccagaggac

SEQ ID NO: 471599 - RNA, 22 nt, Human
agcuggagaugcccagcaccgg

SEQ ID NO: 471600 - RNA, 22 nt, Human
gcagaggcucuuuaaugcuuag

SEQ ID NO: 471601 - RNA, 22 nt, Human
aggugcuuggcucgugcacaca

SEQ ID NO: 471602 - RNA, 22 nt, Human
accucugcuucccggguucaag

SEQ ID NO: 471603 - RNA, 22 nt, Human
cagagcagugaggaguugugua

SEQ ID NO: 471604 - RNA, 22 nt, Human
aauacaaucaaauucacuagca

SEQ ID NO: 471605 - RNA, 22 nt, Human
uuuaaauuuguguuuagagggu

SEQ ID NO: 471606 - RNA, 17 nt, Human
gauuuccugaaguucuu

SEQ ID NO: 471607 - RNA, 22 nt, Human
ccuggagggcgccgcacagucc

SEQ ID NO: 471608 - RNA, 22 nt, Human
ucaguuaagaggccacggcagu

SEQ ID NO: 471609 - RNA, 22 nt, Human
ugccucagagugggcuugcuau

SEQ ID NO: 471610 - RNA, 22 nt, Human
guccaagagucaagaagggggc

SEQ ID NO: 471611 - RNA, 22 nt, Human
aggagcuguuuuguucagcaaa

SEQ ID NO: 471612 - RNA, 22 nt, Human
ccugcagguccccggaugcgca

SEQ ID NO: 471613 - RNA, 22 nt, Human
ccaggugucaugcgugugaccc

SEQ ID NO: 471614 - RNA, 22 nt, Human
cuguaugaggaucagacuggac

SEQ ID NO: 471615 - RNA, 17 nt, Human
ucugccgacugccagcu

SEQ ID NO: 471616 - RNA, 22 nt, Human
ugggcaggagagaagcuaaaga

SEQ ID NO: 471617 - RNA, 22 nt, Human
acagaauuaucaggaaauguua

SEQ ID NO: 471618 - RNA, 22 nt, Human
gguuucaaauuaaagucuuaag

SEQ ID NO: 471619 - RNA, 22 nt, Human
aguguuccugcucucaggaagc

SEQ ID NO: 471620 - RNA, 22 nt, Human
gggcagcugccaagugcaucgc

SEQ ID NO: 471621 - RNA, 22 nt, Human
uuagaaaacauaagugguaaag

SEQ ID NO: 471622 - RNA, 22 nt, Human
cacauguacagaagcaggcugg

SEQ ID NO: 471623 - RNA, 22 nt, Human
agcacuuuccuggcaaaugugg

SEQ ID NO: 471624 - RNA, 22 nt, Human
acaguguucacuuaacaaugga

SEQ ID NO: 471625 - RNA, 22 nt, Human
aggucagaagugccagggaauu

SEQ ID NO: 471626 - RNA, 22 nt, Human
gccaggcagacaggucaucagg

SEQ ID NO: 471627 - RNA, 22 nt, Human
agcucccagcagagcuggccac

SEQ ID NO: 471628 - RNA, 22 nt, Human
ucugcaggaggcuggcugcagg

SEQ ID NO: 471629 - RNA, 22 nt, Human
cagcacugcuucgcagccaggg

SEQ ID NO: 471630 - RNA, 22 nt, Human
ccugaggacacacgcugcagga

SEQ ID NO: 471631 - RNA, 22 nt, Human
uggcagggaguugcaggauuuc

SEQ ID NO: 471632 - RNA, 22 nt, Human
caugaguucaucugcuucucuu

SEQ ID NO: 471633 - RNA, 22 nt, Human
cuggcagcugugugaagaacug

SEQ ID NO: 471634 - RNA, 22 nt, Human
caggaaauaucuccuggcagag

SEQ ID NO: 471635 - RNA, 23 nt, Human
cuccucguaacucuguggugggu

SEQ ID NO: 471636 - RNA, 20 nt, Human
gggcaguggcgcuaucucag

SEQ ID NO: 471637 - RNA, 22 nt, Human
uggggcuggcacagucucuauu

SEQ ID NO: 471638 - RNA, 22 nt, Human
gccucugcaacuccgccuuggu

SEQ ID NO: 471639 - RNA, 22 nt, Human
acagccugagaguggagcuggc

SEQ ID NO: 471640 - RNA, 22 nt, Human
cugugcuggagaugggccagag

SEQ ID NO: 471641 - RNA, 22 nt, Human
cacauuuaaagguugaagcuga

SEQ ID NO: 471642 - RNA, 22 nt, Human
agggcuguuuuuggcaccuggg

SEQ ID NO: 471643 - RNA, 22 nt, Human
cuuuauuagauguagacuuucu

SEQ ID NO: 471644 - RNA, 22 nt, Human
cccuggaguagcacugggucgc

SEQ ID NO: 471645 - RNA, 23 nt, Human
ggcagcucucaucugaugacuga

SEQ ID NO: 471646 - RNA, 22 nt, Human
aggagcugcagauucugccuug

SEQ ID NO: 471647 - RNA, 22 nt, Human
ucucagagauuuuguuucccuu

SEQ ID NO: 471648 - RNA, 22 nt, Human
cagguacacucccuugugcuga

SEQ ID NO: 471649 - RNA, 22 nt, Human
auuguaucuugucauuaugcau

SEQ ID NO: 471650 - RNA, 22 nt, Human
auauuagguuggugcaaaagua

SEQ ID NO: 471651 - RNA, 22 nt, Human
aguccagucucacucuuggcag

SEQ ID NO: 471652 - RNA, 22 nt, Human
ugaagguggcauaggagagaug

SEQ ID NO: 471653 - RNA, 22 nt, Human
uccuccaggucuaggguggcuu

SEQ ID NO: 471654 - RNA, 22 nt, Human
ugcagggauuguuggcauccau

SEQ ID NO: 471655 - RNA, 22 nt, Human
cccaguuguugccggcucugga

SEQ ID NO: 471656 - RNA, 22 nt, Human
ucagcuuucucucgccaucagg

SEQ ID NO: 471657 - RNA, 22 nt, Human
gccagagcacaggcugguagua

SEQ ID NO: 471658 - RNA, 22 nt, Human
auuaauuuccaggcacugugcu

SEQ ID NO: 471659 - RNA, 18 nt, Human
acccucuggcuucugagc

SEQ ID NO: 471660 - RNA, 22 nt, Human
uccaaacacccuccaugcugca

SEQ ID NO: 471661 - RNA, 22 nt, Human
guagggacuguucucaccugag

SEQ ID NO: 471662 - RNA, 22 nt, Human
caggccugugacaccgugucug

SEQ ID NO: 471663 - RNA, 22 nt, Human
cugcagggcagggccuccuggc

SEQ ID NO: 471664 - RNA, 19 nt, Human
cagcucaguuugauucucu

SEQ ID NO: 471665 - RNA, 22 nt, Human
ccugggcaacauagggagaccc

SEQ ID NO: 471666 - RNA, 22 nt, Human
cuuugaaaacuuaaauaacagc

SEQ ID NO: 471667 - RNA, 22 nt, Human
augggcaguguauuggaaggaa

SEQ ID NO: 471668 - RNA, 22 nt, Human
uuugacagacauuuacuacauu

SEQ ID NO: 471669 - RNA, 22 nt, Human
ggcacugauaauguccucucuc

SEQ ID NO: 471670 - RNA, 17 nt, Human
gcugccaccuuuggagc

SEQ ID NO: 471671 - RNA, 22 nt, Human
gccucugcaucuucgccgcacu

SEQ ID NO: 471672 - RNA, 22 nt, Human
aggcagggucuugcuauguugc

SEQ ID NO: 471673 - RNA, 22 nt, Human
gacaagacauugguaaagauau

SEQ ID NO: 471674 - RNA, 22 nt, Human
uuucauaaugucacagucaaaa

SEQ ID NO: 471675 - RNA, 22 nt, Human
gccaggcuccccggaucccugg

SEQ ID NO: 471676 - RNA, 18 nt, Human
acauuucuaugcuucugg

SEQ ID NO: 471677 - RNA, 22 nt, Human
uuuguuaauucuuauguuagag

SEQ ID NO: 471678 - RNA, 22 nt, Human
aaguucuacagcuucgcaggca

SEQ ID NO: 471679 - RNA, 19 nt, Human
ggcauccacgaaugcagag

SEQ ID NO: 471680 - RNA, 22 nt, Human
acccagaggugucuagcaagcu

SEQ ID NO: 471681 - RNA, 22 nt, Human
agccaggacguugcucagcucc

SEQ ID NO: 471682 - RNA, 22 nt, Human
ugaccugcguaggugguuucug

SEQ ID NO: 471683 - RNA, 22 nt, Human
agacccagaaagcagcugcauu

SEQ ID NO: 471684 - RNA, 22 nt, Human
caggauggagaguuguugguug

SEQ ID NO: 471685 - RNA, 22 nt, Human
agcagggcuggggcacgagcca

SEQ ID NO: 471686 - RNA, 22 nt, Human
ggaaacagagggcaccugagcc

SEQ ID NO: 471687 - RNA, 22 nt, Human
ggagugacucucggggccacua

SEQ ID NO: 471688 - RNA, 22 nt, Human
ggaggccacgguuuagcaccga

SEQ ID NO: 471689 - RNA, 22 nt, Human
uuugaaaggagcuuuauccaga

SEQ ID NO: 471690 - RNA, 22 nt, Human
ucccacugugaauccaaggccu

SEQ ID NO: 471691 - RNA, 22 nt, Human
cacagggcagugauuguccaca

SEQ ID NO: 471692 - RNA, 22 nt, Human
ccuccaggcugaauaucuagaa

SEQ ID NO: 471693 - RNA, 22 nt, Human
uggcucugucacugugagcuau

SEQ ID NO: 471694 - RNA, 22 nt, Human
uuguuuucacagcuuugcccgg

SEQ ID NO: 471695 - RNA, 22 nt, Human
ugggggagauuagagcuucuua

SEQ ID NO: 471696 - RNA, 22 nt, Human
cuagggaccucagcuccuggag

SEQ ID NO: 471697 - RNA, 22 nt, Human
gggagggauuaguucugccugg

SEQ ID NO: 471698 - RNA, 22 nt, Human
auccuucagcugcccuguuacc

SEQ ID NO: 471699 - RNA, 22 nt, Human
augaggcagguggaggcugcca

SEQ ID NO: 471700 - RNA, 22 nt, Human
uggaggaauaacagcaaccuua

SEQ ID NO: 471701 - RNA, 22 nt, Human
ugagaauuacaaaugagucaca

SEQ ID NO: 471702 - RNA, 22 nt, Human
uuauuuaauuuucucacucaga

SEQ ID NO: 471703 - RNA, 18 nt, Human
gggaagaggaucuggccc

SEQ ID NO: 471704 - RNA, 20 nt, Human
agucucuguagugccugaga

SEQ ID NO: 471705 - RNA, 22 nt, Human
ucugucuuuagaggccugugcu

SEQ ID NO: 471706 - RNA, 22 nt, Human
cugggaggcagucucucuagaa

SEQ ID NO: 471707 - RNA, 22 nt, Human
cccauuuagauaacaguucaaa

SEQ ID NO: 471708 - RNA, 22 nt, Human
uagagcaguuggcagcuguauu

SEQ ID NO: 471709 - RNA, 22 nt, Human
aaacauuguaauuuuagcaugg

SEQ ID NO: 471710 - RNA, 22 nt, Human
gcagccaggaaagcuggacccu

SEQ ID NO: 471711 - RNA, 23 nt, Human
ucacacagcuggucagguacaga

SEQ ID NO: 471712 - RNA, 23 nt, Human
cccuggagcuagucugagcagag

SEQ ID NO: 471713 - RNA, 22 nt, Human
ucugccuuccccauaaucugau

SEQ ID NO: 471714 - RNA, 22 nt, Human
gccuggagccucagcaaggagg

SEQ ID NO: 471715 - RNA, 22 nt, Human
gugucccacucuggaggugaag

SEQ ID NO: 471716 - RNA, 22 nt, Human
ccugucuggccaccagggcgau

SEQ ID NO: 471717 - RNA, 20 nt, Human
ccucaagcagacugacagcu

SEQ ID NO: 471718 - RNA, 22 nt, Human
ggggcagagagaaggaagcuug

SEQ ID NO: 471719 - RNA, 22 nt, Human
cccaguccuaaagcagacgcca

SEQ ID NO: 471720 - RNA, 22 nt, Human
aaugggaggauuuucucucuug

SEQ ID NO: 471721 - RNA, 22 nt, Human
cuguauuuguccucuauuuauu

SEQ ID NO: 471722 - RNA, 22 nt, Human
uggcccugcugggucagagcug

SEQ ID NO: 471723 - RNA, 22 nt, Human
aagacaugcaauuagcaaggaa

SEQ ID NO: 471724 - RNA, 19 nt, Human
aggacucuggaggcaugag

SEQ ID NO: 471725 - RNA, 22 nt, Human
cagggccagcgcccaggcccag

SEQ ID NO: 471726 - RNA, 22 nt, Human
uuuugagauggugucucgcucc

SEQ ID NO: 471727 - RNA, 22 nt, Human
auguuacagaaagcaaagauga

SEQ ID NO: 471728 - RNA, 22 nt, Human
cugugccuuuguagcugugccu

SEQ ID NO: 471729 - RNA, 22 nt, Human
gccuucccacccugcgaggcug

SEQ ID NO: 471730 - RNA, 22 nt, Human
cuuauguacacacauauauugu

SEQ ID NO: 471731 - RNA, 22 nt, Human
aaaggugacugcagcagcuauu

SEQ ID NO: 471732 - RNA, 22 nt, Human
uaaugcacagaauugacauggg

SEQ ID NO: 471733 - RNA, 22 nt, Human
ccugucuguauugguuugcuau

SEQ ID NO: 471734 - RNA, 22 nt, Human
ggcaguggugggaggcucgcuc

SEQ ID NO: 471735 - RNA, 20 nt, Human
cucaguguggccugaguguu

SEQ ID NO: 471736 - RNA, 22 nt, Human
ucaggaaaauacugcuuaucca

SEQ ID NO: 471737 - RNA, 22 nt, Human
uaccauuucauucuuuccucau

SEQ ID NO: 471738 - RNA, 22 nt, Human
gggcaguggguggcugcagccu

SEQ ID NO: 471739 - RNA, 22 nt, Human
ucugaggcuauguucaggcuaa

SEQ ID NO: 471740 - RNA, 22 nt, Human
acagaauugaaaguauaaucug

SEQ ID NO: 471741 - RNA, 22 nt, Human
uuuauguaguuacggacuauca

SEQ ID NO: 471742 - RNA, 22 nt, Human
gccuggagcuacuggacacuga

SEQ ID NO: 471743 - RNA, 19 nt, Human
ccugggaggcggagguugc

SEQ ID NO: 471744 - RNA, 22 nt, Human
gccuggaguucagccaaguccc

SEQ ID NO: 471745 - RNA, 22 nt, Human
cacugccuccccaggcuccaca

SEQ ID NO: 471746 - RNA, 20 nt, Human
uccaagggcagcagaaucag

SEQ ID NO: 471747 - RNA, 22 nt, Human
gggaccaggugggugcauuccg

SEQ ID NO: 471748 - RNA, 22 nt, Human
uugucugaaagaucauuacauu

SEQ ID NO: 471749 - RNA, 22 nt, Human
uguuaaucaaucaacaguauua

SEQ ID NO: 471750 - RNA, 22 nt, Human
agugcagugguuaggagccagg

SEQ ID NO: 471751 - RNA, 21 nt, Human
auuuucauuaauucagugugg

SEQ ID NO: 471752 - RNA, 22 nt, Human
ccugagagcgaguggccucaug

SEQ ID NO: 471753 - RNA, 22 nt, Human
ggccagaaguuggaaaagagcc

SEQ ID NO: 471754 - RNA, 22 nt, Human
agggauggaagcucgucugcaa

SEQ ID NO: 471755 - RNA, 22 nt, Human
accagugcuuccugcuggagcu

SEQ ID NO: 471756 - RNA, 22 nt, Human
uaacagcuggcguuauaggaau

SEQ ID NO: 471757 - RNA, 22 nt, Human
acuaagugauucuaagcaucuu

SEQ ID NO: 471758 - RNA, 22 nt, Human
uccagggacacagaguccuucu

SEQ ID NO: 471759 - RNA, 19 nt, Human
gguguccuagagauaagag

SEQ ID NO: 471760 - RNA, 22 nt, Human
aucagagauggcuccagugcuc

SEQ ID NO: 471761 - RNA, 22 nt, Human
cucuggacagcaggugcugugg

SEQ ID NO: 471762 - RNA, 22 nt, Human
gcucuggcuacuguggcuaccg

SEQ ID NO: 471763 - RNA, 17 nt, Human
aagacagaagccaugag

SEQ ID NO: 471764 - RNA, 22 nt, Human
cagaaagaccugggcucaagag

SEQ ID NO: 471765 - RNA, 22 nt, Human
gugauugcccagcaccauuguu

SEQ ID NO: 471766 - RNA, 22 nt, Human
guuagggaagcgcuguguucuu

SEQ ID NO: 471767 - RNA, 22 nt, Human
aaacaccagucccaguauacac

SEQ ID NO: 471768 - RNA, 22 nt, Human
ugcaccauuuugucaggcuacu

SEQ ID NO: 471769 - RNA, 17 nt, Human
aggugcagaggcagagc

SEQ ID NO: 471770 - RNA, 22 nt, Human
gcccucuggcagccuuggcugg

SEQ ID NO: 471771 - RNA, 22 nt, Human
ccagcucugcagggccuggggu

SEQ ID NO: 471772 - RNA, 22 nt, Human
guccagggcuaaaucagguucc

SEQ ID NO: 471773 - RNA, 22 nt, Human
gccagcagggcccaaaugcugg

SEQ ID NO: 471774 - RNA, 22 nt, Human
aaaucaguaaauguucauuaac

SEQ ID NO: 471775 - RNA, 22 nt, Human
agugggguccucaguaugguuc

SEQ ID NO: 471776 - RNA, 22 nt, Human
ucugccagaaguucugagagua

SEQ ID NO: 471777 - RNA, 22 nt, Human
cugccugcuucugagccagagg

SEQ ID NO: 471778 - RNA, 22 nt, Human
ugugugccugagccgugccugg

SEQ ID NO: 471779 - RNA, 22 nt, Human
cuucuggaggacacuggcccca

SEQ ID NO: 471780 - RNA, 22 nt, Human
gcucccugcagcugagaguucc

SEQ ID NO: 471781 - RNA, 20 nt, Human
agagugagacuccaucucag

SEQ ID NO: 471782 - RNA, 19 nt, Human
aggccugggguuuugcacu

SEQ ID NO: 471783 - RNA, 22 nt, Human
cugugcuggcagaccuggaguu

SEQ ID NO: 471784 - RNA, 22 nt, Human
aggugcagcugguggagucugg

SEQ ID NO: 471785 - RNA, 22 nt, Human
cacuguuuuauuccaacauagg

SEQ ID NO: 471786 - RNA, 22 nt, Human
ucauccaguuguggagagggaa

SEQ ID NO: 471787 - RNA, 21 nt, Human
gccuggcagguggaagggcuc

SEQ ID NO: 471788 - RNA, 22 nt, Human
acaguggaaaugugggagggga

SEQ ID NO: 471789 - RNA, 22 nt, Human
auguacaaaaugccacugaauu

SEQ ID NO: 471790 - RNA, 22 nt, Human
aauaauguugacgauagucuua

SEQ ID NO: 471791 - RNA, 22 nt, Human
cucccaggguagggagagacua

SEQ ID NO: 471792 - RNA, 22 nt, Human
acugggccuugccauggcagcc

SEQ ID NO: 471793 - RNA, 22 nt, Human
gaaggccuagggaugcucugcg

SEQ ID NO: 471794 - RNA, 22 nt, Human
uuccauaacugaccgaaugcau

SEQ ID NO: 471795 - RNA, 22 nt, Human
cuggagggggaaauguucauug

SEQ ID NO: 471796 - RNA, 22 nt, Human
uuuaguaaguucacugcaaagc

SEQ ID NO: 471797 - RNA, 22 nt, Human
auuuccuagccucucuugcagu

SEQ ID NO: 471798 - RNA, 22 nt, Human
ugggcacaggggaauggaugaa

SEQ ID NO: 471799 - RNA, 22 nt, Human
gcaggggaguggcaggcccgga

SEQ ID NO: 471800 - RNA, 21 nt, Human
aucuuuauuacgcagagaaga

SEQ ID NO: 471801 - RNA, 22 nt, Human
cagugccucuuaagugucaccc

SEQ ID NO: 471802 - RNA, 20 nt, Human
cucugcugcccgccggcugc

SEQ ID NO: 471803 - RNA, 22 nt, Human
cagcuggcuccaccucugggcu

SEQ ID NO: 471804 - RNA, 22 nt, Human
ugcagugccucggcagugcagc

SEQ ID NO: 471805 - RNA, 22 nt, Human
cagcuuguuaccgagggagggu

SEQ ID NO: 471806 - RNA, 21 nt, Human
uggccaaacuggagcauuuga

SEQ ID NO: 471807 - RNA, 22 nt, Human
cagagcagacguugagauuaag

SEQ ID NO: 471808 - RNA, 22 nt, Human
agccuggaguucccaggagaag

SEQ ID NO: 471809 - RNA, 22 nt, Human
auaaaaaugagggcgguagcua

SEQ ID NO: 471810 - RNA, 21 nt, Human
uauuucuuugacucucucccu

SEQ ID NO: 471811 - RNA, 22 nt, Human
cugugagcuggguggccaggac

SEQ ID NO: 471812 - RNA, 22 nt, Human
ccucagcucuucccugugcaca

SEQ ID NO: 471813 - RNA, 22 nt, Human
gaggcaggcagauugcuugagg

SEQ ID NO: 471814 - RNA, 22 nt, Human
gggaggaaagagaaguggucca

SEQ ID NO: 471815 - RNA, 19 nt, Human
ccuggcccugcugcgcggg

SEQ ID NO: 471816 - RNA, 22 nt, Human
gcugcucucagagcucaugcug

SEQ ID NO: 471817 - RNA, 22 nt, Human
agcugcaggccucuccugggga

SEQ ID NO: 471818 - RNA, 22 nt, Human
ggcaccuggauguagcagugaa

SEQ ID NO: 471819 - RNA, 22 nt, Human
augaggcaaggcuggccguguu

SEQ ID NO: 471820 - RNA, 20 nt, Human
acaugaaaggaaacaggaaa

SEQ ID NO: 471821 - RNA, 21 nt, Human
ucagcagcuuuugcagucccu

SEQ ID NO: 471822 - RNA, 22 nt, Human
ccagucccaggcagaaauccag

SEQ ID NO: 471823 - RNA, 22 nt, Human
agggagguaggagcuucuagcu

SEQ ID NO: 471824 - RNA, 22 nt, Human
uuuaaauaggacuccugggggu

SEQ ID NO: 471825 - RNA, 22 nt, Human
gagcugucucuauaugaaugcu

SEQ ID NO: 471826 - RNA, 17 nt, Human
uccaggcauaucuccua

SEQ ID NO: 471827 - RNA, 22 nt, Human
gcagaggggaagcugaggaauu

SEQ ID NO: 471828 - RNA, 21 nt, Human
augaagucuaugcuucugugu

SEQ ID NO: 471829 - RNA, 22 nt, Human
uacaugcucaguaacuuucagu

SEQ ID NO: 471830 - RNA, 22 nt, Human
ccuguacauuagcugugaauug

SEQ ID NO: 471831 - RNA, 22 nt, Human
agagcuggaaucagaccucagg

SEQ ID NO: 471832 - RNA, 22 nt, Human
gcagcaugagcuauacaaagua

SEQ ID NO: 471833 - RNA, 22 nt, Human
ucacagugagccaugucagaga

SEQ ID NO: 471834 - RNA, 22 nt, Human
uaaacagaaagcagauguacuu

SEQ ID NO: 471835 - RNA, 22 nt, Human
ucaucacuguaucauugauaga

SEQ ID NO: 471836 - RNA, 22 nt, Human
ugggggagccuucacaguagcu

SEQ ID NO: 471837 - RNA, 22 nt, Human
ugcuuccugaggccgucuucuc

SEQ ID NO: 471838 - RNA, 22 nt, Human
cccaggagauggagguugcagu

SEQ ID NO: 471839 - RNA, 22 nt, Human
uggggcugucccgguuuggcga

SEQ ID NO: 471840 - RNA, 22 nt, Human
acaguuugcccugacauucucc

SEQ ID NO: 471841 - RNA, 23 nt, Human
gcaguggaaugucucuguuugga

SEQ ID NO: 471842 - RNA, 22 nt, Human
ccagccagucccgcaugaccgc

SEQ ID NO: 471843 - RNA, 22 nt, Human
acacugugacaaaggcuguucu

SEQ ID NO: 471844 - RNA, 22 nt, Human
aggaggccgcugaugggcuccc

SEQ ID NO: 471845 - RNA, 22 nt, Human
cucccugggcagauguggcucu

SEQ ID NO: 471846 - RNA, 22 nt, Human
agccacagagagggagcugcaa

SEQ ID NO: 471847 - RNA, 22 nt, Human
gccaggcuggugucacaacucu

SEQ ID NO: 471848 - RNA, 22 nt, Human
acuuucuauucccacagagaua

SEQ ID NO: 471849 - RNA, 22 nt, Human
aaaaacuguaauuacuuuugca

SEQ ID NO: 471850 - RNA, 22 nt, Human
caguggaaacuaugcugcugga

SEQ ID NO: 471851 - RNA, 21 nt, Human
uggcugcuggcccucucucca

SEQ ID NO: 471852 - RNA, 21 nt, Human
ggccuuggcgggggccgaauu

SEQ ID NO: 471853 - RNA, 22 nt, Human
acagagcucccagccaucuccu

SEQ ID NO: 471854 - RNA, 22 nt, Human
acagcuuuaucucagggaucag

SEQ ID NO: 471855 - RNA, 22 nt, Human
cuguccuccggccaccuacagu

SEQ ID NO: 471856 - RNA, 22 nt, Human
auaucacaguaguuguuuaguu

SEQ ID NO: 471857 - RNA, 22 nt, Human
auguuaaaugguuuauuauuaa

SEQ ID NO: 471858 - RNA, 22 nt, Human
cacagggccuggggcagcugcu

SEQ ID NO: 471859 - RNA, 22 nt, Human
uggcuuccuccagagcaggagg

SEQ ID NO: 471860 - RNA, 22 nt, Human
uguuuuauuucuccaagaggga

SEQ ID NO: 471861 - RNA, 22 nt, Human
ugggcugcccugaugguccuca

SEQ ID NO: 471862 - RNA, 22 nt, Human
cccucccaagcacucugacaua

SEQ ID NO: 471863 - RNA, 22 nt, Human
auucauucugaccucaagagaa

SEQ ID NO: 471864 - RNA, 22 nt, Human
acagugugaugggccugccuga

SEQ ID NO: 471865 - RNA, 22 nt, Human
aaugaucuacucucauuaucuc

SEQ ID NO: 471866 - RNA, 20 nt, Human
ccagaagagaugaucaucca

SEQ ID NO: 471867 - RNA, 22 nt, Human
uagccgcuuaauuauuugguga

SEQ ID NO: 471868 - RNA, 22 nt, Human
guuucuuagguaaauucuuuga

SEQ ID NO: 471869 - RNA, 19 nt, Human
caggccagugucagggggc

SEQ ID NO: 471870 - RNA, 22 nt, Human
cacccacccacugcucauuggc

SEQ ID NO: 471871 - RNA, 20 nt, Human
ucaggaugugcugagugaag

SEQ ID NO: 471872 - RNA, 22 nt, Human
aggcugugagcaagaacaccua

SEQ ID NO: 471873 - RNA, 22 nt, Human
ucagaagguggagguugcagug

SEQ ID NO: 471874 - RNA, 22 nt, Human
cugggcaguuuauucaguucug

SEQ ID NO: 471875 - RNA, 22 nt, Human
uucuccucuguuggccuucccu

SEQ ID NO: 471876 - RNA, 22 nt, Human
gugggcugcccuugaggucagc

SEQ ID NO: 471877 - RNA, 22 nt, Human
gcacagagggcagugagccucu

SEQ ID NO: 471878 - RNA, 22 nt, Human
gcuuagucaauuauaaauaggc

SEQ ID NO: 471879 - RNA, 23 nt, Human
aggcagugggggccacuuugcuu

SEQ ID NO: 471880 - RNA, 22 nt, Human
uccuuggcagcagggagcauga

SEQ ID NO: 471881 - RNA, 22 nt, Human
ggcaggugcaccugagccaucu

SEQ ID NO: 471882 - RNA, 22 nt, Human
ugggcugaaaugcuguggacua

SEQ ID NO: 471883 - RNA, 22 nt, Human
guucaagguuuuacagagugua

SEQ ID NO: 471884 - RNA, 22 nt, Human
agcccucugcaaacaccugaua

SEQ ID NO: 471885 - RNA, 22 nt, Human
cugucuguucagauucauuacu

SEQ ID NO: 471886 - RNA, 22 nt, Human
aagaugcacaauguggcaauua

SEQ ID NO: 471887 - RNA, 22 nt, Human
agcagccaauuggaggaugaag

SEQ ID NO: 471888 - RNA, 22 nt, Human
gccaaagcagucuugccucugc

SEQ ID NO: 471889 - RNA, 22 nt, Human
cggcuggguucggcugcaggcc

SEQ ID NO: 471890 - RNA, 22 nt, Human
cugggacuuuacccuguggccc

SEQ ID NO: 471891 - RNA, 22 nt, Human
ccugugugucugucacugcaca

SEQ ID NO: 471892 - RNA, 22 nt, Human
auguuucagauacagaucaaau

SEQ ID NO: 471893 - RNA, 19 nt, Human
gagaggccugugcuugaag

SEQ ID NO: 471894 - RNA, 22 nt, Human
ugcagcugcuggcccaggugcu

SEQ ID NO: 471895 - RNA, 22 nt, Human
acagccuguguaccagcuggga

SEQ ID NO: 471896 - RNA, 22 nt, Human
cccaccccuggacaggugagug

SEQ ID NO: 471897 - RNA, 22 nt, Human
agccagacauggcuccugcucc

SEQ ID NO: 471898 - RNA, 22 nt, Human
ugccagcacuucuggcugucug

SEQ ID NO: 471899 - RNA, 22 nt, Human
cagcagcaugaauucgagccac

SEQ ID NO: 471900 - RNA, 22 nt, Human
acacauuucuaaauuuuuaccg

SEQ ID NO: 471901 - RNA, 22 nt, Human
acagguccuuauaagagcacuc

SEQ ID NO: 471902 - RNA, 22 nt, Human
agcagcaggagccgugggguga

SEQ ID NO: 471903 - RNA, 22 nt, Human
gcagguggcagaggugggaucu

SEQ ID NO: 471904 - RNA, 22 nt, Human
ucagaggauuggacuuuuaugu

SEQ ID NO: 471905 - RNA, 22 nt, Human
gggcugggaauggcuaaguaug

SEQ ID NO: 471906 - RNA, 22 nt, Human
aagagcuggaugaagaaaucaa

SEQ ID NO: 471907 - RNA, 22 nt, Human
uuccucugaaauggcuuggaaa

SEQ ID NO: 471908 - RNA, 22 nt, Human
cugcuguggguuaagacacugu

SEQ ID NO: 471909 - RNA, 22 nt, Human
agcagggcugcggccccaccac

SEQ ID NO: 471910 - RNA, 22 nt, Human
uacauuaacuuacguccacaug

SEQ ID NO: 471911 - RNA, 22 nt, Human
aggaccugagaguuggaaaucc

SEQ ID NO: 471912 - RNA, 22 nt, Human
ggcugagcccccucugcguagg

SEQ ID NO: 471913 - RNA, 22 nt, Human
cuggcucaccuccgcuccagca

SEQ ID NO: 471914 - RNA, 22 nt, Human
uacaaaugaguuguaugaacca

SEQ ID NO: 471915 - RNA, 22 nt, Human
aauauguucaaaauagaucacu

SEQ ID NO: 471916 - RNA, 22 nt, Human
ccugccugauuccaggauggcu

SEQ ID NO: 471917 - RNA, 22 nt, Human
aauuagggagagguagcuaggu

SEQ ID NO: 471918 - RNA, 22 nt, Human
ccuccuggcccugggccuggaa

SEQ ID NO: 471919 - RNA, 22 nt, Human
cucccagguuacaucugagccu

SEQ ID NO: 471920 - RNA, 22 nt, Human
gcaguccucucauuggccuccu

SEQ ID NO: 471921 - RNA, 22 nt, Human
cagucacauggaugauggauag

SEQ ID NO: 471922 - RNA, 22 nt, Human
gcccauggacacccaagugcca

SEQ ID NO: 471923 - RNA, 22 nt, Human
aaaggccaugguuggaguguuu

SEQ ID NO: 471924 - RNA, 22 nt, Human
gccaccagguuagauccagccu

SEQ ID NO: 471925 - RNA, 17 nt, Human
ccaggugggaggugggg

SEQ ID NO: 471926 - RNA, 22 nt, Human
agagcugagaauguggcuuccu

SEQ ID NO: 471927 - RNA, 22 nt, Human
uggcugcuuguuuuagugaggc

SEQ ID NO: 471928 - RNA, 22 nt, Human
ucaaggugcugugcugugcuag

SEQ ID NO: 471929 - RNA, 22 nt, Human
ucuuuuggguucuuaugauuua

SEQ ID NO: 471930 - RNA, 22 nt, Human
auguggaaugaacaaaggaggc

SEQ ID NO: 471931 - RNA, 22 nt, Human
aggccucacucucagagcuucu

SEQ ID NO: 471932 - RNA, 22 nt, Human
ugucccagacacaguaugcgcu

SEQ ID NO: 471933 - RNA, 22 nt, Human
cuggggcuucaaugcuucggug

SEQ ID NO: 471934 - RNA, 22 nt, Human
cauuuguaucugggcugcugug

SEQ ID NO: 471935 - RNA, 22 nt, Human
ugcaaacuauugguagagaugg

SEQ ID NO: 471936 - RNA, 22 nt, Human
caugagauaauuuuucuccagu

SEQ ID NO: 471937 - RNA, 22 nt, Human
ucucacuuuccagacuuuucaa

SEQ ID NO: 471938 - RNA, 22 nt, Human
gaauucuuuucuuucugaaagu

SEQ ID NO: 471939 - RNA, 22 nt, Human
ccuggcugcauuuugcuggaug

SEQ ID NO: 471940 - RNA, 22 nt, Human
agcuccugaaaagcgcuugcuu

SEQ ID NO: 471941 - RNA, 18 nt, Human
caggagcaggaguugaac

SEQ ID NO: 471942 - RNA, 22 nt, Human
guggagacuucuacuagagacc

SEQ ID NO: 471943 - RNA, 22 nt, Human
ccugcaguuuguugugaccccg

SEQ ID NO: 471944 - RNA, 22 nt, Human
gcucugugcaguucagggacac

SEQ ID NO: 471945 - RNA, 22 nt, Human
uuuuuuaguuaggucagaaugu

SEQ ID NO: 471946 - RNA, 22 nt, Human
uggugcugauaauggcaggauu

SEQ ID NO: 471947 - RNA, 22 nt, Human
aggugcaggagcugugcaggga

SEQ ID NO: 471948 - RNA, 22 nt, Human
acaaacuaccuacagauguuca

SEQ ID NO: 471949 - RNA, 22 nt, Human
cacagcuggugcacuagcucug

SEQ ID NO: 471950 - RNA, 22 nt, Human
acacugaauaauugagaguuga

SEQ ID NO: 471951 - RNA, 22 nt, Human
ggaggcugagaaguccaagauc

SEQ ID NO: 471952 - RNA, 22 nt, Human
gaacauuuaugaugcaauaccu

SEQ ID NO: 471953 - RNA, 17 nt, Human
ugaggccugcaucagug

SEQ ID NO: 471954 - RNA, 22 nt, Human
aggaggaggugggacacaguga

SEQ ID NO: 471955 - RNA, 20 nt, Human
gaagccagaggggaaaggag

SEQ ID NO: 471956 - RNA, 22 nt, Human
accaucagucacauguagagaa

SEQ ID NO: 471957 - RNA, 18 nt, Human
cagagcagagguggagcg

SEQ ID NO: 471958 - RNA, 22 nt, Human
gucagugucuuaacagagauua

SEQ ID NO: 471959 - RNA, 22 nt, Human
uuuccucugagugagcugggag

SEQ ID NO: 471960 - RNA, 20 nt, Human
gugggcagcaggcauacugg

SEQ ID NO: 471961 - RNA, 23 nt, Human
gcuguacaggaaccaguuuggag

SEQ ID NO: 471962 - RNA, 22 nt, Human
acccaggagcaggcugggcagu

SEQ ID NO: 471963 - RNA, 22 nt, Human
gaaggccaguuuugagauaggu

SEQ ID NO: 471964 - RNA, 22 nt, Human
agggucagguuaagggagucau

SEQ ID NO: 471965 - RNA, 22 nt, Human
aggaagcccuugucauuucugu

SEQ ID NO: 471966 - RNA, 22 nt, Human
gcugggcagccuggccgcugcc

SEQ ID NO: 471967 - RNA, 22 nt, Human
acacaucagaaauaugaaugag

SEQ ID NO: 471968 - RNA, 21 nt, Human
uagcuuuaauauucccacauu

SEQ ID NO: 471969 - RNA, 22 nt, Human
ugaacauauucaccucuaaaua

SEQ ID NO: 471970 - RNA, 22 nt, Human
uuugaaagucaaccuuccaguu

SEQ ID NO: 471971 - RNA, 22 nt, Human
uguuccuaaauaugaauggaga

SEQ ID NO: 471972 - RNA, 22 nt, Human
cacuggggugggccugguagag

SEQ ID NO: 471973 - RNA, 22 nt, Human
uugaucagguugcuguggugua

SEQ ID NO: 471974 - RNA, 22 nt, Human
acagaacugagaauucucuauc

SEQ ID NO: 471975 - RNA, 22 nt, Human
aggcucugguuggcaaguaaag

SEQ ID NO: 471976 - RNA, 22 nt, Human
aagaacauguuaaaagauucac

SEQ ID NO: 471977 - RNA, 22 nt, Human
gcagccugaggcccuuucuggc

SEQ ID NO: 471978 - RNA, 18 nt, Human
ggagagugagaucaaaca

SEQ ID NO: 471979 - RNA, 22 nt, Human
ugagccugcugucgcuggaccc

SEQ ID NO: 471980 - RNA, 22 nt, Human
ggcugccuacuuucccagaguu

SEQ ID NO: 471981 - RNA, 22 nt, Human
ugcagcuucuuguccugugauu

SEQ ID NO: 471982 - RNA, 22 nt, Human
uggcuucugcuuucaguggagg

SEQ ID NO: 471983 - RNA, 18 nt, Human
cugcugcaggcacucagg

SEQ ID NO: 471984 - RNA, 22 nt, Human
cugcuuccauggucuggagacu

SEQ ID NO: 471985 - RNA, 19 nt, Human
gcaggcaguggcauucgga

SEQ ID NO: 471986 - RNA, 22 nt, Human
gucucagauaacauguauucua

SEQ ID NO: 471987 - RNA, 21 nt, Human
ccuucucuugcuucagcuuca

SEQ ID NO: 471988 - RNA, 22 nt, Human
caguggagagacuuuuacucuu

SEQ ID NO: 471989 - RNA, 22 nt, Human
ucauccagccucaucaggagcu

SEQ ID NO: 471990 - RNA, 22 nt, Human
uaauuuuaacugugcuguuugg

SEQ ID NO: 471991 - RNA, 17 nt, Human
agcugccagggagugug

SEQ ID NO: 471992 - RNA, 22 nt, Human
gcucaggagcugacagccucaa

SEQ ID NO: 471993 - RNA, 21 nt, Human
aggcugcuggcucaggguccu

SEQ ID NO: 471994 - RNA, 18 nt, Human
uccagcgugcuccagggc

SEQ ID NO: 471995 - RNA, 22 nt, Human
agaugguguuuccccaggugga

SEQ ID NO: 471996 - RNA, 23 nt, Human
ccagcccuccaccagcucuaggc

SEQ ID NO: 471997 - RNA, 21 nt, Human
gagagggcauuauaggaagug

SEQ ID NO: 471998 - RNA, 22 nt, Human
gcccuggccuucaucucagaca

SEQ ID NO: 471999 - RNA, 21 nt, Human
cagggcacacagaggauggua

SEQ ID NO: 472000 - RNA, 22 nt, Human
gcagggcaaugaucccgagagg

SEQ ID NO: 472001 - RNA, 22 nt, Human
ggcuugcuucuuguccaggaau

SEQ ID NO: 472002 - RNA, 22 nt, Human
agcagagcuauucuugugcaau

SEQ ID NO: 472003 - RNA, 22 nt, Human
uccucaggagagcuccuaugcc

SEQ ID NO: 472004 - RNA, 22 nt, Human
agggcuagaguugagaugggga

SEQ ID NO: 472005 - RNA, 22 nt, Human
gggugggaucuguggagccuca

SEQ ID NO: 472006 - RNA, 22 nt, Human
auggacaggcugagcuuccuca

SEQ ID NO: 472007 - RNA, 22 nt, Human
acguuuucagccuuaauguaga

SEQ ID NO: 472008 - RNA, 22 nt, Human
ccccaggcagggccuaacagag

SEQ ID NO: 472009 - RNA, 22 nt, Human
aagcaucucuauguggagagug

SEQ ID NO: 472010 - RNA, 22 nt, Human
ggccaggcuggucucagacuuc

SEQ ID NO: 472011 - RNA, 22 nt, Human
aaguucaaggcucuagaguucc

SEQ ID NO: 472012 - RNA, 22 nt, Human
acagagaugcaaguguguauuu

SEQ ID NO: 472013 - RNA, 22 nt, Human
agcaggguauguuagagcugua

SEQ ID NO: 472014 - RNA, 22 nt, Human
agccuggauucgugcauccaca

SEQ ID NO: 472015 - RNA, 22 nt, Human
ucugccugccagucugguccuc

SEQ ID NO: 472016 - RNA, 22 nt, Human
agggucugacugaauggaaaag

SEQ ID NO: 472017 - RNA, 22 nt, Human
gcuccuggcuccaggcagccaa

SEQ ID NO: 472018 - RNA, 22 nt, Human
agcaccuucacaggcucucagg

SEQ ID NO: 472019 - RNA, 22 nt, Human
uauguacauggagagcaauuga

SEQ ID NO: 472020 - RNA, 22 nt, Human
ggcacugaauuucuuggcaucu

SEQ ID NO: 472021 - RNA, 22 nt, Human
guguggcugugggagauguuca

SEQ ID NO: 472022 - RNA, 22 nt, Human
caggcuugggagcagagccacu

SEQ ID NO: 472023 - RNA, 22 nt, Human
uaaguuuuaagcaaucugauaa

SEQ ID NO: 472024 - RNA, 22 nt, Human
cugaguccagggacagaggcgu

SEQ ID NO: 472025 - RNA, 22 nt, Human
aggcagcagugauaagauagga

SEQ ID NO: 472026 - RNA, 22 nt, Human
caggagcucucaucgucagggc

SEQ ID NO: 472027 - RNA, 22 nt, Human
ggcagcaguccauggcccaagg

SEQ ID NO: 472028 - RNA, 22 nt, Human
gggugcaggcagcccaggcagg

SEQ ID NO: 472029 - RNA, 22 nt, Human
aaggcaggaugggaaaagauuu

SEQ ID NO: 472030 - RNA, 22 nt, Human
acagccagaggagccaggcugg

SEQ ID NO: 472031 - RNA, 22 nt, Human
cugagcuggucuauggacuugg

SEQ ID NO: 472032 - RNA, 21 nt, Human
uaaaacuguaacuuuguccug

SEQ ID NO: 472033 - RNA, 22 nt, Human
gugcauguuaaugguguacaaa

SEQ ID NO: 472034 - RNA, 22 nt, Human
cagauuuagaguggggcuugga

SEQ ID NO: 472035 - RNA, 22 nt, Human
ccaaaauguuugaaugcaugug

SEQ ID NO: 472036 - RNA, 22 nt, Human
ugcagggaaaacccaggaugcu

SEQ ID NO: 472037 - RNA, 21 nt, Human
ccugucuuggacugaggcacc

SEQ ID NO: 472038 - RNA, 22 nt, Human
ggguacaaagauuucauaagau

SEQ ID NO: 472039 - RNA, 20 nt, Human
ucagagagagggugccacuu

SEQ ID NO: 472040 - RNA, 22 nt, Human
gcaaggcugugcacuuugcauu

SEQ ID NO: 472041 - RNA, 22 nt, Human
gcucccugaaaagaacaaaguc

SEQ ID NO: 472042 - RNA, 22 nt, Human
agcugcucuuugaaggacacuu

SEQ ID NO: 472043 - RNA, 22 nt, Human
aagaagaugguuaacuuucagu

SEQ ID NO: 472044 - RNA, 22 nt, Human
auuauguaacugugguucagca

SEQ ID NO: 472045 - RNA, 22 nt, Human
cuuacagagaagaaaauguagu

SEQ ID NO: 472046 - RNA, 22 nt, Human
agggcucugggguggcagagau

SEQ ID NO: 472047 - RNA, 22 nt, Human
caaugguggugucagaagagau

SEQ ID NO: 472048 - RNA, 22 nt, Human
ggagcugugcugggugaucagg

SEQ ID NO: 472049 - RNA, 22 nt, Human
aucagcaagacuaggggaauac

SEQ ID NO: 472050 - RNA, 22 nt, Human
ugcugcuccugccuggcuccca

SEQ ID NO: 472051 - RNA, 22 nt, Human
cuggagccaugucuugacugcu

SEQ ID NO: 472052 - RNA, 22 nt, Human
cuuccuggccauugccauggca

SEQ ID NO: 472053 - RNA, 22 nt, Human
uagauuuccucuuccucauucc

SEQ ID NO: 472054 - RNA, 22 nt, Human
gguggcagaauaauugaagguc

SEQ ID NO: 472055 - RNA, 22 nt, Human
cagccccucccucaggcaggug

SEQ ID NO: 472056 - RNA, 22 nt, Human
ggaggccaaggcgggcggauca

SEQ ID NO: 472057 - RNA, 22 nt, Human
ugaaugauuugggugcauucag

SEQ ID NO: 472058 - RNA, 22 nt, Human
ugaggcagguggauuacaaggu

SEQ ID NO: 472059 - RNA, 22 nt, Human
ucagcuuuuuggauugcccaag

SEQ ID NO: 472060 - RNA, 22 nt, Human
ccugagggaaggaugcuaccca

SEQ ID NO: 472061 - RNA, 22 nt, Human
gccugaugagcuuccagcugag

SEQ ID NO: 472062 - RNA, 22 nt, Human
aagagcauauuaauaguggaga

SEQ ID NO: 472063 - RNA, 22 nt, Human
agggauguaaauucuucuucuu

SEQ ID NO: 472064 - RNA, 22 nt, Human
ucuuucagccacuuaccugucu

SEQ ID NO: 472065 - RNA, 22 nt, Human
caguauuuguucccuaucaaug

SEQ ID NO: 472066 - RNA, 22 nt, Human
agcucugacauugauucucagc

SEQ ID NO: 472067 - RNA, 22 nt, Human
uaaaugcaagugcuccugggag

SEQ ID NO: 472068 - RNA, 22 nt, Human
uuuucauuuuuguagaugcaag

SEQ ID NO: 472069 - RNA, 22 nt, Human
gacacagagauaggccuguguu

SEQ ID NO: 472070 - RNA, 22 nt, Human
aaaauaucagcaaagggugaca

SEQ ID NO: 472071 - RNA, 22 nt, Human
uuaaagggccgauuuccaggcc

SEQ ID NO: 472072 - RNA, 22 nt, Human
gugaggcagcaggagccucugu

SEQ ID NO: 472073 - RNA, 22 nt, Human
aggaggaggcuggaguacaccc

SEQ ID NO: 472074 - RNA, 22 nt, Human
ucuuugcuccacacucuagaga

SEQ ID NO: 472075 - RNA, 22 nt, Human
agccacagcccacaggacucuu

SEQ ID NO: 472076 - RNA, 22 nt, Human
gcauacagagaggauguggcau

SEQ ID NO: 472077 - RNA, 18 nt, Human
cugcugugucgucugggc

SEQ ID NO: 472078 - RNA, 22 nt, Human
cuuucacagcacaagccugccu

SEQ ID NO: 472079 - RNA, 19 nt, Human
gucagcaccauggacaggg

SEQ ID NO: 472080 - RNA, 22 nt, Human
ugccucugugugcaggugagca

SEQ ID NO: 472081 - RNA, 22 nt, Human
ucagagugggagaaugugccaa

SEQ ID NO: 472082 - RNA, 22 nt, Human
ggcagugagcuggagggaagga

SEQ ID NO: 472083 - RNA, 22 nt, Human
gcagcuggcucagagagguggg

SEQ ID NO: 472084 - RNA, 22 nt, Human
uuugcaaauauguguuucuauu

SEQ ID NO: 472085 - RNA, 22 nt, Human
cagcaggaggugaguagcaggu

SEQ ID NO: 472086 - RNA, 22 nt, Human
gcucugagcacugugcggcugg

SEQ ID NO: 472087 - RNA, 22 nt, Human
uccagccuuucuacucacugag

SEQ ID NO: 472088 - RNA, 22 nt, Human
aggcacugacaauucuggacug

SEQ ID NO: 472089 - RNA, 19 nt, Human
aggacccuuauccuggcuu

SEQ ID NO: 472090 - RNA, 20 nt, Human
ccugucugcaauggagguca

SEQ ID NO: 472091 - RNA, 22 nt, Human
aagaugauaggacuugcuuaag

SEQ ID NO: 472092 - RNA, 20 nt, Human
cauuaugguugggcacagug

SEQ ID NO: 472093 - RNA, 22 nt, Human
aggcuucacgaugggugaggug

SEQ ID NO: 472094 - RNA, 22 nt, Human
uaaacaaggguuacugagcaug

SEQ ID NO: 472095 - RNA, 22 nt, Human
aaggugucggcagagccgcuuc

SEQ ID NO: 472096 - RNA, 22 nt, Human
ugggcuggcugaacuucaaccu

SEQ ID NO: 472097 - RNA, 22 nt, Human
auggcagccuguggacagucaa

SEQ ID NO: 472098 - RNA, 22 nt, Human
caagagcuuuagaaaugcucau

SEQ ID NO: 472099 - RNA, 20 nt, Human
ccugccugccucggcucauu

SEQ ID NO: 472100 - RNA, 22 nt, Human
gacaagacaccucucuccaucc

SEQ ID NO: 472101 - RNA, 22 nt, Human
gaaaggucuuccggucuuccag

SEQ ID NO: 472102 - RNA, 22 nt, Human
ucuggcucauacaagccugcaa

SEQ ID NO: 472103 - RNA, 22 nt, Human
cuggugcaggaaggagcuggca

SEQ ID NO: 472104 - RNA, 22 nt, Human
ucagggacagggugcugcugcg

SEQ ID NO: 472105 - RNA, 18 nt, Human
ugaauuaguuugugguuu

SEQ ID NO: 472106 - RNA, 22 nt, Human
gccagcagguugucaaggagcu

SEQ ID NO: 472107 - RNA, 22 nt, Human
ccguggaguugugcugaguaug

SEQ ID NO: 472108 - RNA, 22 nt, Human
uagcuuuaaaaaucaucaaagc

SEQ ID NO: 472109 - RNA, 22 nt, Human
gugucaugggagucagaaguga

SEQ ID NO: 472110 - RNA, 21 nt, Human
uggaaagauucaaagaccagg

SEQ ID NO: 472111 - RNA, 22 nt, Human
aguggcagagaccccagccagc

SEQ ID NO: 472112 - RNA, 22 nt, Human
uagaaaggauauugagaugaau

SEQ ID NO: 472113 - RNA, 22 nt, Human
ccugggcagugcuggaguugaa

SEQ ID NO: 472114 - RNA, 22 nt, Human
auccccagaaaauaggugccua

SEQ ID NO: 472115 - RNA, 22 nt, Human
ugaguccaauaggggccuggaa

SEQ ID NO: 472116 - RNA, 22 nt, Human
uaaaugugucuauggacccgcc

SEQ ID NO: 472117 - RNA, 22 nt, Human
ugcccacauggugccauggcca

SEQ ID NO: 472118 - RNA, 22 nt, Human
cuuucaaugugccugccuuggg

SEQ ID NO: 472119 - RNA, 22 nt, Human
acccagccuacaaagcucaccu

SEQ ID NO: 472120 - RNA, 18 nt, Human
uggaggcagaguucuggc

SEQ ID NO: 472121 - RNA, 20 nt, Human
gcaugaggaaucauugcagc

SEQ ID NO: 472122 - RNA, 21 nt, Human
gugguuauuuucauuagcauc

SEQ ID NO: 472123 - RNA, 22 nt, Human
ugcagggaagcaaggguggcuc

SEQ ID NO: 472124 - RNA, 21 nt, Human
ggcagcugaccgcgcggugca

SEQ ID NO: 472125 - RNA, 19 nt, Human
cuguggcugaccucuggcc

SEQ ID NO: 472126 - RNA, 22 nt, Human
aagacauuacuggaaucugacu

SEQ ID NO: 472127 - RNA, 22 nt, Human
ugcagaagacacaagguaacgu

SEQ ID NO: 472128 - RNA, 22 nt, Human
gcuguacaaggccucugccauc

SEQ ID NO: 472129 - RNA, 22 nt, Human
uaacagaauagcagaaacagaa

SEQ ID NO: 472130 - RNA, 22 nt, Human
agggagaaugaccaagguauau

SEQ ID NO: 472131 - RNA, 19 nt, Human
uggggcuguguuuugaccc

SEQ ID NO: 472132 - RNA, 20 nt, Human
aggagcugaauuagaggguu

SEQ ID NO: 472133 - RNA, 22 nt, Human
ugagcugggaguggugaugagg

SEQ ID NO: 472134 - RNA, 22 nt, Human
aggcacuggguaauuaguagcu

SEQ ID NO: 472135 - RNA, 22 nt, Human
ugggccugugaugcugggcuau

SEQ ID NO: 472136 - RNA, 22 nt, Human
caggcacugugcaagggucucg

SEQ ID NO: 472137 - RNA, 19 nt, Human
ugcagaagacacaguggug

SEQ ID NO: 472138 - RNA, 22 nt, Human
ucaaaugcggucauggcuuuua

SEQ ID NO: 472139 - RNA, 22 nt, Human
uagaaacucaggauacucuucc

SEQ ID NO: 472140 - RNA, 22 nt, Human
aggcacaggaaugucauccagu

SEQ ID NO: 472141 - RNA, 22 nt, Human
ucacugaauacuugucucaucc

SEQ ID NO: 472142 - RNA, 22 nt, Human
ugugugacccccagugaagccu

SEQ ID NO: 472143 - RNA, 22 nt, Human
cacugcauggaugauggcugua

SEQ ID NO: 472144 - RNA, 18 nt, Human
aucuuuccauagcauguu

SEQ ID NO: 472145 - RNA, 22 nt, Human
gcuuccuggagggagagagcug

SEQ ID NO: 472146 - RNA, 22 nt, Human
ggagucagccugucagagugua

SEQ ID NO: 472147 - RNA, 22 nt, Human
cagagcaugaauaaaaguuaca

SEQ ID NO: 472148 - RNA, 22 nt, Human
caugcuuucuguccaaauguua

SEQ ID NO: 472149 - RNA, 22 nt, Human
uugcuuccaguccaagucuguu

SEQ ID NO: 472150 - RNA, 20 nt, Human
cagagcuguuauggaugaug

SEQ ID NO: 472151 - RNA, 20 nt, Human
aauaaaagaagccuucaccc

SEQ ID NO: 472152 - RNA, 22 nt, Human
uucaggauggaguaccuuuuau

SEQ ID NO: 472153 - RNA, 22 nt, Human
ucccagccauuccuuuaggugu

SEQ ID NO: 472154 - RNA, 22 nt, Human
ucugugaacaucacauugacag

SEQ ID NO: 472155 - RNA, 22 nt, Human
ugggcagaggcagcagaaaccu

SEQ ID NO: 472156 - RNA, 22 nt, Human
uuuuaucuucauuccuaucuac

SEQ ID NO: 472157 - RNA, 22 nt, Human
aggaccagccuccaggucucuu

SEQ ID NO: 472158 - RNA, 21 nt, Human
gcagaggaaugguauacauaa

SEQ ID NO: 472159 - RNA, 22 nt, Human
caguagccacuagacacaugua

SEQ ID NO: 472160 - RNA, 22 nt, Human
agccauccucccaccucagccu

SEQ ID NO: 472161 - RNA, 22 nt, Human
gagcucaggagcaucagaagaa

SEQ ID NO: 472162 - RNA, 22 nt, Human
cccagcaguaaccaguggaaau

SEQ ID NO: 472163 - RNA, 22 nt, Human
accagggcacaggagucugaag

SEQ ID NO: 472164 - RNA, 22 nt, Human
cagugggcugugauggauucac

SEQ ID NO: 472165 - RNA, 22 nt, Human
aagaguuaagcaacagauacca

SEQ ID NO: 472166 - RNA, 23 nt, Human
cagaagcaccuguugacugcugc

SEQ ID NO: 472167 - RNA, 22 nt, Human
cccuggaguccggagcucaccu

SEQ ID NO: 472168 - RNA, 22 nt, Human
uuccauauguauauagcuguua

SEQ ID NO: 472169 - RNA, 18 nt, Human
uggagccagcucuaggau

SEQ ID NO: 472170 - RNA, 22 nt, Human
acauuucuaguuguucaucucc

SEQ ID NO: 472171 - RNA, 22 nt, Human
aggucccaggcauagcuggucu

SEQ ID NO: 472172 - RNA, 22 nt, Human
gcuguauuuaacaacuggcuca

SEQ ID NO: 472173 - RNA, 22 nt, Human
cuggagccauguauagccuaug

SEQ ID NO: 472174 - RNA, 22 nt, Human
ggcuucagugacuggugcccuc

SEQ ID NO: 472175 - RNA, 22 nt, Human
agagccaggaugucuucugggg

SEQ ID NO: 472176 - RNA, 22 nt, Human
ucucccaguccucugugcuuac

SEQ ID NO: 472177 - RNA, 22 nt, Human
gcuccucuucucccacugaaug

SEQ ID NO: 472178 - RNA, 19 nt, Human
cuccucagucccagagguc

SEQ ID NO: 472179 - RNA, 22 nt, Human
agagccagcaacucuagcccug

SEQ ID NO: 472180 - RNA, 22 nt, Human
gaagccacaacuuuuucuuagc

SEQ ID NO: 472181 - RNA, 22 nt, Human
cggcuggggcuguccccaugac

SEQ ID NO: 472182 - RNA, 22 nt, Human
uacauauagacaguuacucuag

SEQ ID NO: 472183 - RNA, 21 nt, Human
ucaggggcuguguuuuccauc

SEQ ID NO: 472184 - RNA, 18 nt, Human
cugaggcuuagagagguu

SEQ ID NO: 472185 - RNA, 22 nt, Human
agggcugagugggagagaguug

SEQ ID NO: 472186 - RNA, 18 nt, Human
ugacagaaccuggagccu

SEQ ID NO: 472187 - RNA, 22 nt, Human
caggcugucugaauggaggccc

SEQ ID NO: 472188 - RNA, 22 nt, Human
auaaauuuauaauuguuuccug

SEQ ID NO: 472189 - RNA, 19 nt, Human
guuucauuaagauaggaaa

SEQ ID NO: 472190 - RNA, 22 nt, Human
ugaguacucggagugcuuugga

SEQ ID NO: 472191 - RNA, 22 nt, Human
uguggcuuaagaaugccuuuaa

SEQ ID NO: 472192 - RNA, 22 nt, Human
uuucuacauuuguaaccagauu

SEQ ID NO: 472193 - RNA, 22 nt, Human
cugccagguuggcgcucgcucu

SEQ ID NO: 472194 - RNA, 22 nt, Human
gagagucacugucugcauuucc

SEQ ID NO: 472195 - RNA, 22 nt, Human
gaagagcuaaaggcacaggcuu

SEQ ID NO: 472196 - RNA, 22 nt, Human
uuucuacaugucaauccaaacc

SEQ ID NO: 472197 - RNA, 22 nt, Human
ucaggcagguuggcugcagguc

SEQ ID NO: 472198 - RNA, 22 nt, Human
auagaacagaaacagaugcaca

SEQ ID NO: 472199 - RNA, 22 nt, Human
gcuguggaaaugccuaacauga

SEQ ID NO: 472200 - RNA, 22 nt, Human
gcuggagauaguaggauccaua

SEQ ID NO: 472201 - RNA, 22 nt, Human
uaaauucccaacucugcucuuc

SEQ ID NO: 472202 - RNA, 22 nt, Human
uggagcugagaaguggagcucu

SEQ ID NO: 472203 - RNA, 22 nt, Human
auacauguucguguacauguuc

SEQ ID NO: 472204 - RNA, 22 nt, Human
gugggcaaggucccugccagcu

SEQ ID NO: 472205 - RNA, 22 nt, Human
ggccuuggugcucuguguugca

SEQ ID NO: 472206 - RNA, 22 nt, Human
gagaggaguagacacuuugguu

SEQ ID NO: 472207 - RNA, 22 nt, Human
augugaaagagguguucagugg

SEQ ID NO: 472208 - RNA, 22 nt, Human
gcugucccaugguugcaagaug

SEQ ID NO: 472209 - RNA, 22 nt, Human
agcuuuguggcuuugcaagacu

SEQ ID NO: 472210 - RNA, 23 nt, Human
gccaggcuccggucuguggccac

SEQ ID NO: 472211 - RNA, 22 nt, Human
augcaacaaaugcuacgaaucg

SEQ ID NO: 472212 - RNA, 22 nt, Human
gaggggcugcccuggugucagg

SEQ ID NO: 472213 - RNA, 22 nt, Human
ggagccugggcauuaguaauuu

SEQ ID NO: 472214 - RNA, 22 nt, Human
cucccucugucuuguccagaaa

SEQ ID NO: 472215 - RNA, 22 nt, Human
uucaagaugcacaguggcauuc

SEQ ID NO: 472216 - RNA, 22 nt, Human
aaugauugcaaacauugagaac

SEQ ID NO: 472217 - RNA, 22 nt, Human
cugugucccccucagccaggug

SEQ ID NO: 472218 - RNA, 22 nt, Human
gccccagguugccugucccagg

SEQ ID NO: 472219 - RNA, 22 nt, Human
uggcucuggggacaguaagucc

SEQ ID NO: 472220 - RNA, 22 nt, Human
agccucugucaagcuuuucaaa

SEQ ID NO: 472221 - RNA, 22 nt, Human
cccaguggaaggaguagaagac

SEQ ID NO: 472222 - RNA, 22 nt, Human
ugggcagacgcuguuggaaggc

SEQ ID NO: 472223 - RNA, 22 nt, Human
caaggcaguuccccagagggcu

SEQ ID NO: 472224 - RNA, 22 nt, Human
ccagcagaagcucccgcugggu

SEQ ID NO: 472225 - RNA, 22 nt, Human
gagggaggcaucaugaauccag

SEQ ID NO: 472226 - RNA, 22 nt, Human
ggcccuguccuggcugucuccg

SEQ ID NO: 472227 - RNA, 22 nt, Human
ggcuggagugggcuccagaguu

SEQ ID NO: 472228 - RNA, 22 nt, Human
gagcugcccugagcuuugcaug

SEQ ID NO: 472229 - RNA, 22 nt, Human
cugagaggugacagcgugcugg

SEQ ID NO: 472230 - RNA, 20 nt, Human
aggcucagauacccagggaa

SEQ ID NO: 472231 - RNA, 20 nt, Human
aggaaaaauggaaacuggag

SEQ ID NO: 472232 - RNA, 20 nt, Human
gcaaggcacagugaggaggg

SEQ ID NO: 472233 - RNA, 17 nt, Human
acucaggaucugggagu

SEQ ID NO: 472234 - RNA, 20 nt, Human
uggggccuguuucugugguu

SEQ ID NO: 472235 - RNA, 22 nt, Human
uagagcuauuuagagcauuuua

SEQ ID NO: 472236 - RNA, 22 nt, Human
acccagggaccccgcugacgcc

SEQ ID NO: 472237 - RNA, 23 nt, Human
gugauuucagggaacagaaucag

SEQ ID NO: 472238 - RNA, 22 nt, Human
uccuuggcaugccgucuucucc

SEQ ID NO: 472239 - RNA, 22 nt, Human
uagaaaagaauuuuauuugaua

SEQ ID NO: 472240 - RNA, 19 nt, Human
caaguucuggagauuaggg

SEQ ID NO: 472241 - RNA, 22 nt, Human
ucugucacucuagagauggcag

SEQ ID NO: 472242 - RNA, 20 nt, Human
cagcucugggaaagaggcca

SEQ ID NO: 472243 - RNA, 22 nt, Human
ugcuuuauuggaaccucauccu

SEQ ID NO: 472244 - RNA, 19 nt, Human
ucaaugcaugaaaucagcc

SEQ ID NO: 472245 - RNA, 22 nt, Human
cccaggcugaguuagagguguc

SEQ ID NO: 472246 - RNA, 22 nt, Human
agaagccauaguaucucagggu

SEQ ID NO: 472247 - RNA, 22 nt, Human
augggaggaucacuugaggcca

SEQ ID NO: 472248 - RNA, 22 nt, Human
uaaguucauaagcuuauucuua

SEQ ID NO: 472249 - RNA, 22 nt, Human
uuugcauuuugauaagaucacu

SEQ ID NO: 472250 - RNA, 22 nt, Human
cugagcacugggcacauagcug

SEQ ID NO: 472251 - RNA, 22 nt, Human
gacuuuggcaucuagacauugu

SEQ ID NO: 472252 - RNA, 22 nt, Human
gaguggagaucgugccacugca

SEQ ID NO: 472253 - RNA, 22 nt, Human
cuggcagcuuagcacucugguu

SEQ ID NO: 472254 - RNA, 22 nt, Human
ggccugugagcccuugcaugua

SEQ ID NO: 472255 - RNA, 22 nt, Human
cuacauuuuucaccgagccucu

SEQ ID NO: 472256 - RNA, 21 nt, Human
ugaggcucuguugugccugca

SEQ ID NO: 472257 - RNA, 22 nt, Human
aaggccagccugagagcuaaca

SEQ ID NO: 472258 - RNA, 22 nt, Human
caucagcacuaugauuaaagua

SEQ ID NO: 472259 - RNA, 22 nt, Human
cccugccucugaagcugcucag

SEQ ID NO: 472260 - RNA, 22 nt, Human
uguagaaauuaguaagaucaac

SEQ ID NO: 472261 - RNA, 22 nt, Human
ugggcugaguguggaacuaguu

SEQ ID NO: 472262 - RNA, 22 nt, Human
ugagcccaggaguuggaggcug

SEQ ID NO: 472263 - RNA, 22 nt, Human
ggcagucagugugguucauaaa

SEQ ID NO: 472264 - RNA, 22 nt, Human
acagagcaauucuuggguguuu

SEQ ID NO: 472265 - RNA, 22 nt, Human
aaaugcacaaaguaaguguaau

SEQ ID NO: 472266 - RNA, 23 nt, Human
gggagccaggaccucgcgcccca

SEQ ID NO: 472267 - RNA, 22 nt, Human
agggcagaaguacagacacuua

SEQ ID NO: 472268 - RNA, 22 nt, Human
agcagggcuugccgcuuguccu

SEQ ID NO: 472269 - RNA, 22 nt, Human
agggaaauuaaugugagcaaug

SEQ ID NO: 472270 - RNA, 22 nt, Human
cuguucucuggcgguggcuguu

SEQ ID NO: 472271 - RNA, 22 nt, Human
acagggcaugugcaagagacau

SEQ ID NO: 472272 - RNA, 22 nt, Human
agacagggucuugaucagagcu

SEQ ID NO: 472273 - RNA, 22 nt, Human
aaggcagcagugcacgacugau

SEQ ID NO: 472274 - RNA, 22 nt, Human
aggggugauuugggacaggaca

SEQ ID NO: 472275 - RNA, 22 nt, Human
caggcacucauucagagaggug

SEQ ID NO: 472276 - RNA, 22 nt, Human
cugcccagaaucacucacucga

SEQ ID NO: 472277 - RNA, 23 nt, Human
agugcugaauugaaagcuccagg

SEQ ID NO: 472278 - RNA, 22 nt, Human
cuguaauucacuagggucagcg

SEQ ID NO: 472279 - RNA, 22 nt, Human
ccccagcugcauacuugccaag

SEQ ID NO: 472280 - RNA, 22 nt, Human
ugggcagaaugugggauccaga

SEQ ID NO: 472281 - RNA, 18 nt, Human
ggcuuugcugggguuucu

SEQ ID NO: 472282 - RNA, 20 nt, Human
uccaguuuuggagacauucu

SEQ ID NO: 472283 - RNA, 22 nt, Human
ccugauggagcccugcugcaug

SEQ ID NO: 472284 - RNA, 22 nt, Human
ggcugcuucucacucauuugca

SEQ ID NO: 472285 - RNA, 22 nt, Human
cagcugccaagaaucuuuucua

SEQ ID NO: 472286 - RNA, 22 nt, Human
cagcuuuccagagaccugcccc

SEQ ID NO: 472287 - RNA, 22 nt, Human
aggcagugagugugacuucaca

SEQ ID NO: 472288 - RNA, 18 nt, Human
ggcagcaagaagggaggg

SEQ ID NO: 472289 - RNA, 22 nt, Human
ccaggccuagccccugagggua

SEQ ID NO: 472290 - RNA, 22 nt, Human
gcugccacgaucucugcuguag

SEQ ID NO: 472291 - RNA, 22 nt, Human
cuuguauuccccuaucucuaaa

SEQ ID NO: 472292 - RNA, 22 nt, Human
uaaguucauuagacuacagaua

SEQ ID NO: 472293 - RNA, 22 nt, Human
uuugggaacucuaucauggaaa

SEQ ID NO: 472294 - RNA, 22 nt, Human
aggaauucaagaccagcugggc

SEQ ID NO: 472295 - RNA, 22 nt, Human
gccccucccagucaggagcacu

SEQ ID NO: 472296 - RNA, 22 nt, Human
uggcugaggcuuuucuuaaaga

SEQ ID NO: 472297 - RNA, 22 nt, Human
ccuguauuagguagacaacuau

SEQ ID NO: 472298 - RNA, 22 nt, Human
cgggcagugcccagcggggcag

SEQ ID NO: 472299 - RNA, 22 nt, Human
aauuuagaauucgcuagcuaau

SEQ ID NO: 472300 - RNA, 22 nt, Human
agugaaaucagguuuugacugc

SEQ ID NO: 472301 - RNA, 22 nt, Human
cagggcagcuuccuuuguuagg

SEQ ID NO: 472302 - RNA, 23 nt, Human
ugggucagcugccuccaggacaa

SEQ ID NO: 472303 - RNA, 22 nt, Human
acagcuguggucuccuuagugu

SEQ ID NO: 472304 - RNA, 22 nt, Human
uggcugcaguucacaggagcaa

SEQ ID NO: 472305 - RNA, 20 nt, Human
aacagggggcugcagagggc

SEQ ID NO: 472306 - RNA, 22 nt, Human
cugggcucagcccaugcugucc

SEQ ID NO: 472307 - RNA, 22 nt, Human
caguguuugcuuaaguuauaug

SEQ ID NO: 472308 - RNA, 22 nt, Human
uuucacaaugcaauccuacuuc

SEQ ID NO: 472309 - RNA, 22 nt, Human
caaaugcaggucagcagguguc

SEQ ID NO: 472310 - RNA, 22 nt, Human
ccagccuucugagcugccugga

SEQ ID NO: 472311 - RNA, 22 nt, Human
gagugcaucguggccauuuuaa

SEQ ID NO: 472312 - RNA, 22 nt, Human
ucaagucuugaugagacaaacc

SEQ ID NO: 472313 - RNA, 22 nt, Human
aggcacuguucccaguuauccu

SEQ ID NO: 472314 - RNA, 23 nt, Human
cuuucauugugguuucacagagc

SEQ ID NO: 472315 - RNA, 22 nt, Human
gagccuggauagccuuguucca

SEQ ID NO: 472316 - RNA, 20 nt, Human
aggcacuguugucuguaucc

SEQ ID NO: 472317 - RNA, 22 nt, Human
gaagggugugugugagggacac

SEQ ID NO: 472318 - RNA, 22 nt, Human
aagcagugcgcucaucuaaggg

SEQ ID NO: 472319 - RNA, 22 nt, Human
caggugucaaaauacuaagugg

SEQ ID NO: 472320 - RNA, 22 nt, Human
uagcauuuggacauugucaccu

SEQ ID NO: 472321 - RNA, 21 nt, Human
gcucagaguauugcacuguuu

SEQ ID NO: 472322 - RNA, 22 nt, Human
gauuuauuggucuuucauuggu

SEQ ID NO: 472323 - RNA, 22 nt, Human
caggcagcugaggacuuugcua

SEQ ID NO: 472324 - RNA, 22 nt, Human
ugggcugcuguuacaggggcug

SEQ ID NO: 472325 - RNA, 22 nt, Human
aggccugggcaagaaggggcgu

SEQ ID NO: 472326 - RNA, 22 nt, Human
uuaaauuccagccucauaauag

SEQ ID NO: 472327 - RNA, 22 nt, Human
uccaugggaagauuuugagugg

SEQ ID NO: 472328 - RNA, 22 nt, Human
ggcuuuaugcacagcagauggu

SEQ ID NO: 472329 - RNA, 22 nt, Human
uggagcugggguuugaaucugg

SEQ ID NO: 472330 - RNA, 19 nt, Human
agggcugcucuggccuggg

SEQ ID NO: 472331 - RNA, 22 nt, Human
agggucugacaaugugacuuag

SEQ ID NO: 472332 - RNA, 22 nt, Human
auacuuuggggguuaguguaga

SEQ ID NO: 472333 - RNA, 22 nt, Human
agccaggccuuagggagaggca

SEQ ID NO: 472334 - RNA, 22 nt, Human
caggccuggggcuggcuuccag

SEQ ID NO: 472335 - RNA, 22 nt, Human
aagggcagccugacucacgguc

SEQ ID NO: 472336 - RNA, 22 nt, Human
ucaggcagcuccaggaauggua

SEQ ID NO: 472337 - RNA, 22 nt, Human
aaauguucuacuuugauaauua

SEQ ID NO: 472338 - RNA, 22 nt, Human
gcugccucaggcaccuccuggc

SEQ ID NO: 472339 - RNA, 19 nt, Human
acacagggaucagaggguu

SEQ ID NO: 472340 - RNA, 22 nt, Human
cagccaggcccccgagucguug

SEQ ID NO: 472341 - RNA, 22 nt, Human
guguuuuaucagacaaaguaua

SEQ ID NO: 472342 - RNA, 22 nt, Human
caggcacuggccagucagcaca

SEQ ID NO: 472343 - RNA, 22 nt, Human
gagggauggugugagaggcuca

SEQ ID NO: 472344 - RNA, 22 nt, Human
gagaggccaaaaucccugcccc

SEQ ID NO: 472345 - RNA, 22 nt, Human
gaagcagcucagauugacugaa

SEQ ID NO: 472346 - RNA, 22 nt, Human
gggaccugccauugcucacagg

SEQ ID NO: 472347 - RNA, 22 nt, Human
agaugcagaaaaacuaagugau

SEQ ID NO: 472348 - RNA, 22 nt, Human
acagaguagcucaagaagauug

SEQ ID NO: 472349 - RNA, 22 nt, Human
agggccagaggcaccuugcagc

SEQ ID NO: 472350 - RNA, 22 nt, Human
aaagauuucacaucccaagccu

SEQ ID NO: 472351 - RNA, 22 nt, Human
gccuggaggggccaggguggua

SEQ ID NO: 472352 - RNA, 22 nt, Human
uguucauuuggcccuuuuguau

SEQ ID NO: 472353 - RNA, 22 nt, Human
cugggcuacguguugacagcau

SEQ ID NO: 472354 - RNA, 22 nt, Human
gcagaagcuguucgaaggccgc

SEQ ID NO: 472355 - RNA, 22 nt, Human
cucaacagcucugccauacucc

SEQ ID NO: 472356 - RNA, 22 nt, Human
gggccccaaaaugccaggcucu

SEQ ID NO: 472357 - RNA, 22 nt, Human
aaguucaaggcagguccugagg

SEQ ID NO: 472358 - RNA, 22 nt, Human
gggucucucucggcuccacgcg

SEQ ID NO: 472359 - RNA, 19 nt, Human
ccugcagggaugagagguu

SEQ ID NO: 472360 - RNA, 22 nt, Human
ggauggcauguugggcucuguu

SEQ ID NO: 472361 - RNA, 22 nt, Human
ugcugugguucccagaguggau

SEQ ID NO: 472362 - RNA, 22 nt, Human
guuagggaucaggaacaagagc

SEQ ID NO: 472363 - RNA, 22 nt, Human
uccaggcauuggagagauaaug

SEQ ID NO: 472364 - RNA, 22 nt, Human
cugcugugcacccaggaaggcu

SEQ ID NO: 472365 - RNA, 22 nt, Human
agcaccugcuaugugucaggga

SEQ ID NO: 472366 - RNA, 22 nt, Human
caggcagcgcucguggccuggc

SEQ ID NO: 472367 - RNA, 22 nt, Human
uccagggaagagcagaggcuac

SEQ ID NO: 472368 - RNA, 22 nt, Human
aaggccaugaccacuugcugug

SEQ ID NO: 472369 - RNA, 22 nt, Human
aaguuugacagaaguuucuaau

SEQ ID NO: 472370 - RNA, 22 nt, Human
cugccuggguucaaguccuguu

SEQ ID NO: 472371 - RNA, 22 nt, Human
cuauugcauuugcaucuucauc

SEQ ID NO: 472372 - RNA, 22 nt, Human
auuuucuauucugcugguuuag

SEQ ID NO: 472373 - RNA, 22 nt, Human
uggcugagggggcaguucagga

SEQ ID NO: 472374 - RNA, 22 nt, Human
ugaguagcggcuauguguaacu

SEQ ID NO: 472375 - RNA, 22 nt, Human
agccacagcuccuugguggaga

SEQ ID NO: 472376 - RNA, 22 nt, Human
cacaggaggaggccagagcgua

SEQ ID NO: 472377 - RNA, 22 nt, Human
gacagccucaugaggagcaaaa

SEQ ID NO: 472378 - RNA, 22 nt, Human
uuauuuuguagcucugaucuuu

SEQ ID NO: 472379 - RNA, 22 nt, Human
ucagaguggugguuuugccuuc

SEQ ID NO: 472380 - RNA, 22 nt, Human
acaggcagguccugucccagcu

SEQ ID NO: 472381 - RNA, 22 nt, Human
auaagguaugaaaaguaaaugg

SEQ ID NO: 472382 - RNA, 22 nt, Human
ucugaaaguaucuggaucuuuu

SEQ ID NO: 472383 - RNA, 22 nt, Human
uaaggccaaguucauauacaac

SEQ ID NO: 472384 - RNA, 22 nt, Human
agcagagucugugugcacuuua

SEQ ID NO: 472385 - RNA, 22 nt, Human
aggggugaaagagggcccucaa

SEQ ID NO: 472386 - RNA, 22 nt, Human
cuguccuuacugcuucuggcuu

SEQ ID NO: 472387 - RNA, 20 nt, Human
cugugcuuuggaaccuggaa

SEQ ID NO: 472388 - RNA, 22 nt, Human
cauugcacuccaucuugggcaa

SEQ ID NO: 472389 - RNA, 19 nt, Human
ucauuguugguuugucggg

SEQ ID NO: 472390 - RNA, 22 nt, Human
acccuggguucccgcagcacca

SEQ ID NO: 472391 - RNA, 22 nt, Human
gccaaaucuggauuuagcaaga

SEQ ID NO: 472392 - RNA, 22 nt, Human
ggaggaccugcuggcccugcaa

SEQ ID NO: 472393 - RNA, 22 nt, Human
gaacagaagaggcuggugccac

SEQ ID NO: 472394 - RNA, 22 nt, Human
acaguaauuaaaauggaucugc

SEQ ID NO: 472395 - RNA, 22 nt, Human
caggcagcaggagcccugcucg

SEQ ID NO: 472396 - RNA, 22 nt, Human
uuacauuuugggguaaggauaa

SEQ ID NO: 472397 - RNA, 22 nt, Human
cuacuuuaauuuucugcagaga

SEQ ID NO: 472398 - RNA, 22 nt, Human
gcuuuaaaccucuacucugucc

SEQ ID NO: 472399 - RNA, 22 nt, Human
ccuccaggaacuugagagacac

SEQ ID NO: 472400 - RNA, 22 nt, Human
caggugcuguccugcacauguc

SEQ ID NO: 472401 - RNA, 22 nt, Human
ucuacugcacuggugucucauc

SEQ ID NO: 472402 - RNA, 21 nt, Human
uuugcauuuuacaugugggga

SEQ ID NO: 472403 - RNA, 16 nt, Human
gcacacacaucaauga

SEQ ID NO: 472404 - RNA, 22 nt, Human
ucucgacagccuggcacagugg

SEQ ID NO: 472405 - RNA, 22 nt, Human
cccucugcaggcuggaccugcc

SEQ ID NO: 472406 - RNA, 22 nt, Human
ugagcuucuuuauuuggccaga

SEQ ID NO: 472407 - RNA, 23 nt, Human
agagcuuagggaauucacaugag

SEQ ID NO: 472408 - RNA, 22 nt, Human
ugggcccugacuucaagcaucc

SEQ ID NO: 472409 - RNA, 22 nt, Human
uauagaagagacaugugcauag

SEQ ID NO: 472410 - RNA, 22 nt, Human
gucacaggccuggaugaggggc

SEQ ID NO: 472411 - RNA, 20 nt, Human
ggaagcagagaacuguuuuc

SEQ ID NO: 472412 - RNA, 19 nt, Human
ugggaguggggaagguccu

SEQ ID NO: 472413 - RNA, 22 nt, Human
uauuuccaagcugaauccaaug

SEQ ID NO: 472414 - RNA, 22 nt, Human
agaaguaggcagggcuguauca

SEQ ID NO: 472415 - RNA, 22 nt, Human
agugaccauuuucagcuagagg

SEQ ID NO: 472416 - RNA, 22 nt, Human
gcagaauguaggccuucagugu

SEQ ID NO: 472417 - RNA, 22 nt, Human
acacugaauauacaaugaauau

SEQ ID NO: 472418 - RNA, 22 nt, Human
acaccagggccuagccagggcg

SEQ ID NO: 472419 - RNA, 22 nt, Human
gcugucacaagcaucuggggca

SEQ ID NO: 472420 - RNA, 22 nt, Human
gcugggaggaauuuggggaaua

SEQ ID NO: 472421 - RNA, 23 nt, Human
cagggcugguagggaagagcgug

SEQ ID NO: 472422 - RNA, 22 nt, Human
ucaaugauaguacaaucagccu

SEQ ID NO: 472423 - RNA, 22 nt, Human
cagccugcagggcugccuguug

SEQ ID NO: 472424 - RNA, 22 nt, Human
ccagcucuagccccauguggcu

SEQ ID NO: 472425 - RNA, 22 nt, Human
acaaauuuauugaagggcauau

SEQ ID NO: 472426 - RNA, 23 nt, Human
uccaagggcuacaaacacagacc

SEQ ID NO: 472427 - RNA, 22 nt, Human
cagaccagcucuaugaacccaa

SEQ ID NO: 472428 - RNA, 22 nt, Human
ccuucugcuggucaucccagug

SEQ ID NO: 472429 - RNA, 22 nt, Human
gguuucaaaguggacaguuagu

SEQ ID NO: 472430 - RNA, 23 nt, Human
aaggucacagaacuuagcaagcc

SEQ ID NO: 472431 - RNA, 18 nt, Human
gcagugaagaaagagcuu

SEQ ID NO: 472432 - RNA, 22 nt, Human
gcccugagggguggugucugua

SEQ ID NO: 472433 - RNA, 22 nt, Human
cagggcucgcucuugcccuucg

SEQ ID NO: 472434 - RNA, 22 nt, Human
guaaaauugcaauuacuuuugc

SEQ ID NO: 472435 - RNA, 22 nt, Human
uuuaccauccucuuuuagaauu

SEQ ID NO: 472436 - RNA, 23 nt, Human
aggagaagagauuuccacaugca

SEQ ID NO: 472437 - RNA, 22 nt, Human
uuaauaaacaggugcagcugaa

SEQ ID NO: 472438 - RNA, 22 nt, Human
cagaaacuucuggugucaaaua

SEQ ID NO: 472439 - RNA, 22 nt, Human
gggcucucaaggcagggcccca

SEQ ID NO: 472440 - RNA, 22 nt, Human
gcugcaggcauuuuccugggca

SEQ ID NO: 472441 - RNA, 22 nt, Human
aguuuuuccugauuuuacagaa

SEQ ID NO: 472442 - RNA, 19 nt, Human
uggcaggcccaggauggac

SEQ ID NO: 472443 - RNA, 22 nt, Human
cugguucauccccuuccaggaa

SEQ ID NO: 472444 - RNA, 22 nt, Human
agcaugcugguguucauggcag

SEQ ID NO: 472445 - RNA, 22 nt, Human
auuuacagaugaugcuauuuga

SEQ ID NO: 472446 - RNA, 22 nt, Human
acaugcauucucuaaaagcaaa

SEQ ID NO: 472447 - RNA, 22 nt, Human
ugcaauaaggaguaauaguaaa

SEQ ID NO: 472448 - RNA, 22 nt, Human
agcaguggcuggauggugugcu

SEQ ID NO: 472449 - RNA, 22 nt, Human
cuguugucccugggagcucagc

SEQ ID NO: 472450 - RNA, 22 nt, Human
agguggguccuggcucugccau

SEQ ID NO: 472451 - RNA, 22 nt, Human
aaucacaauuacuuuugcacca

SEQ ID NO: 472452 - RNA, 22 nt, Human
gcugugugaaaacugggccugg

SEQ ID NO: 472453 - RNA, 21 nt, Human
uuuucccacugaaagcuccca

SEQ ID NO: 472454 - RNA, 22 nt, Human
aucaggauagucuguaaauugu

SEQ ID NO: 472455 - RNA, 22 nt, Human
uggguaaacugggucuggagag

SEQ ID NO: 472456 - RNA, 22 nt, Human
uccuggagccacggagcuuuca

SEQ ID NO: 472457 - RNA, 22 nt, Human
gggcagguggagggcccagcca

SEQ ID NO: 472458 - RNA, 21 nt, Human
gagcugggcgaggcuccgggg

SEQ ID NO: 472459 - RNA, 22 nt, Human
agcagggcuccauuucacugcc

SEQ ID NO: 472460 - RNA, 17 nt, Human
gcagcagagagacccuc

SEQ ID NO: 472461 - RNA, 22 nt, Human
uagcacauaacuuagaauaguu

SEQ ID NO: 472462 - RNA, 22 nt, Human
augggaggaagagaagaugucu

SEQ ID NO: 472463 - RNA, 22 nt, Human
gugcagguguuuuggcugccag

SEQ ID NO: 472464 - RNA, 22 nt, Human
ucccaggccauaaaacucagag

SEQ ID NO: 472465 - RNA, 23 nt, Human
gugcucugcggucugcuagucug

SEQ ID NO: 472466 - RNA, 23 nt, Human
ccacagagcugccaauuccugug

SEQ ID NO: 472467 - RNA, 22 nt, Human
cagcccuguccagcagagggug

SEQ ID NO: 472468 - RNA, 22 nt, Human
uuucucugaggcuggccucccu

SEQ ID NO: 472469 - RNA, 22 nt, Human
gggaaggacauucugggcucag

SEQ ID NO: 472470 - RNA, 22 nt, Human
gcuggccugucuagagccuuac

SEQ ID NO: 472471 - RNA, 22 nt, Human
uuagucaauagugaauauagag

SEQ ID NO: 472472 - RNA, 22 nt, Human
cucuucagauaaaagggauauu

SEQ ID NO: 472473 - RNA, 17 nt, Human
agaaagaggauccacag

SEQ ID NO: 472474 - RNA, 22 nt, Human
augcaucauggaaaacucaguu

SEQ ID NO: 472475 - RNA, 22 nt, Human
caaaguuaucaacugcaacauu

SEQ ID NO: 472476 - RNA, 20 nt, Human
gcccacucuaauccacuguc

SEQ ID NO: 472477 - RNA, 18 nt, Human
cagaagcaggcagugcag

SEQ ID NO: 472478 - RNA, 22 nt, Human
acuuuuuacaggguguauacca

SEQ ID NO: 472479 - RNA, 23 nt, Human
ccugucugugcuggguggacaca

SEQ ID NO: 472480 - RNA, 22 nt, Human
cugggcuggcgcauccgacacg

SEQ ID NO: 472481 - RNA, 22 nt, Human
auccuugagaaaauaaaugacc

SEQ ID NO: 472482 - RNA, 22 nt, Human
ggaaaaggccauuguuucucug

SEQ ID NO: 472483 - RNA, 22 nt, Human
acugggccuggauuggcguguc

SEQ ID NO: 472484 - RNA, 22 nt, Human
ucagggcauacucuucaagguc

SEQ ID NO: 472485 - RNA, 22 nt, Human
uguguuccuucgucuucccuuc

SEQ ID NO: 472486 - RNA, 22 nt, Human
aucuuccuucacuuucucccac

SEQ ID NO: 472487 - RNA, 22 nt, Human
gagagcugauagaugagcuacu

SEQ ID NO: 472488 - RNA, 22 nt, Human
cacuggggaaaacaggcuucuu

SEQ ID NO: 472489 - RNA, 22 nt, Human
aaaugcuagggagaaacucucc

SEQ ID NO: 472490 - RNA, 22 nt, Human
uccaaagggaagcgcuuucugu

SEQ ID NO: 472491 - RNA, 22 nt, Human
aaucagucauuagcucugaccu

SEQ ID NO: 472492 - RNA, 22 nt, Human
ugcucccagggacucuggcugg

SEQ ID NO: 472493 - RNA, 19 nt, Human
caaggguugggucugucau

SEQ ID NO: 472494 - RNA, 22 nt, Human
gaaacccaaacuaagacaguag

SEQ ID NO: 472495 - RNA, 22 nt, Human
aggaguggaauuacuggguucu

SEQ ID NO: 472496 - RNA, 22 nt, Human
ccuguacacggucuaugccucc

SEQ ID NO: 472497 - RNA, 22 nt, Human
cagggccucuccuccaggaacu

SEQ ID NO: 472498 - RNA, 22 nt, Human
ggauaagaaaauuguaauaacu

SEQ ID NO: 472499 - RNA, 22 nt, Human
ggcacagagcccagcuuccuag

SEQ ID NO: 472500 - RNA, 22 nt, Human
ucucugaguaagugacaguuca

SEQ ID NO: 472501 - RNA, 22 nt, Human
uuugcauuugcaaauaaugaaa

SEQ ID NO: 472502 - RNA, 23 nt, Human
cuguggcugaguccuguuggagu

SEQ ID NO: 472503 - RNA, 22 nt, Human
gugccucagcaccgccugcagc

SEQ ID NO: 472504 - RNA, 22 nt, Human
gaaucucaguggaagcaggaag

SEQ ID NO: 472505 - RNA, 18 nt, Human
ucagagguacagaaaagu

SEQ ID NO: 472506 - RNA, 22 nt, Human
cuggcagcguguuuaugaacau

SEQ ID NO: 472507 - RNA, 22 nt, Human
agucucagccacacagaccuau

SEQ ID NO: 472508 - RNA, 22 nt, Human
uggccagaaccugcaguaggcc

SEQ ID NO: 472509 - RNA, 20 nt, Human
aggcugagggugauuguguc

SEQ ID NO: 472510 - RNA, 22 nt, Human
cauaagaaauaaugaugaugac

SEQ ID NO: 472511 - RNA, 22 nt, Human
agcagcaucuucuaaguaaggc

SEQ ID NO: 472512 - RNA, 22 nt, Human
cagcuggaucccugcagaacuu

SEQ ID NO: 472513 - RNA, 22 nt, Human
ugggccuggaguuuguccagag

SEQ ID NO: 472514 - RNA, 22 nt, Human
ccagggcagaaaaagagggaau

SEQ ID NO: 472515 - RNA, 22 nt, Human
uggggacauagccagucuggcu

SEQ ID NO: 472516 - RNA, 22 nt, Human
gccauuuucugucuuguuuauu

SEQ ID NO: 472517 - RNA, 22 nt, Human
ggcuuuaugcagggauagaaau

SEQ ID NO: 472518 - RNA, 22 nt, Human
cccaggcagggacgugcucugg

SEQ ID NO: 472519 - RNA, 22 nt, Human
cccaggagguagagguugcagu

SEQ ID NO: 472520 - RNA, 22 nt, Human
gcagagccgugaauggauuuca

SEQ ID NO: 472521 - RNA, 19 nt, Human
uggcugagcuggacugagg

SEQ ID NO: 472522 - RNA, 22 nt, Human
ggaggccaaggcaggcggauca

SEQ ID NO: 472523 - RNA, 22 nt, Human
cagcugccacuugcucucggcu

SEQ ID NO: 472524 - RNA, 22 nt, Human
guggcugcagcccagcggcacg

SEQ ID NO: 472525 - RNA, 22 nt, Human
gagacagcagggccagggccug

SEQ ID NO: 472526 - RNA, 22 nt, Human
gaggugggaugugugugcuacu

SEQ ID NO: 472527 - RNA, 22 nt, Human
gagaaagacguaggcugggagg

SEQ ID NO: 472528 - RNA, 22 nt, Human
ugggcugcccaagguggccaug

SEQ ID NO: 472529 - RNA, 22 nt, Human
ugugggcacuaaugacaugcag

SEQ ID NO: 472530 - RNA, 22 nt, Human
caucccugcccucaugccuaua

SEQ ID NO: 472531 - RNA, 22 nt, Human
acagggcaaccucugggagacu

SEQ ID NO: 472532 - RNA, 22 nt, Human
uuacauuuuaguuaaccuguga

SEQ ID NO: 472533 - RNA, 22 nt, Human
gcacagaaguaaaauacaaguc

SEQ ID NO: 472534 - RNA, 22 nt, Human
uuaagucauuucugauuauaga

SEQ ID NO: 472535 - RNA, 20 nt, Human
cacaggccuugugagcagac

SEQ ID NO: 472536 - RNA, 22 nt, Human
cugagcaggauauucacagcag

SEQ ID NO: 472537 - RNA, 22 nt, Human
aggguggccaugagggagagau

SEQ ID NO: 472538 - RNA, 22 nt, Human
uagaggcauuaaugaauaaaca

SEQ ID NO: 472539 - RNA, 22 nt, Human
uggcagucggacuucuaucuca

SEQ ID NO: 472540 - RNA, 22 nt, Human
cuguccuguagcuccaucaguc

SEQ ID NO: 472541 - RNA, 22 nt, Human
ggcuccuguccuccuggagcuc

SEQ ID NO: 472542 - RNA, 22 nt, Human
gggagagagagcucauguugaa

SEQ ID NO: 472543 - RNA, 18 nt, Human
ucugucuguacaaguauc

SEQ ID NO: 472544 - RNA, 22 nt, Human
gaggcucacuaggcauccuggg

SEQ ID NO: 472545 - RNA, 22 nt, Human
uagcugccuuugggcuccugcu

SEQ ID NO: 472546 - RNA, 22 nt, Human
cauuagggacugaggaauaagg

SEQ ID NO: 472547 - RNA, 22 nt, Human
ugcauuugucuugucucaugaa

SEQ ID NO: 472548 - RNA, 22 nt, Human
augcuguagaucuuagccucua

SEQ ID NO: 472549 - RNA, 18 nt, Human
aggcacagagcauacaua

SEQ ID NO: 472550 - RNA, 18 nt, Human
uccucucuuuccccaggg

SEQ ID NO: 472551 - RNA, 19 nt, Human
ggccuggauuuagggcucc

SEQ ID NO: 472552 - RNA, 19 nt, Human
gccucugcuggggacaggc

SEQ ID NO: 472553 - RNA, 22 nt, Human
uaagcauucaaugcuuagcacu

SEQ ID NO: 472554 - RNA, 19 nt, Human
agcagcuggagguggagug

SEQ ID NO: 472555 - RNA, 22 nt, Human
uggcagagaacacggcugaucu

SEQ ID NO: 472556 - RNA, 22 nt, Human
aggcagguguuaacccucugag

SEQ ID NO: 472557 - RNA, 22 nt, Human
cccagcagaccgcugugauggc

SEQ ID NO: 472558 - RNA, 22 nt, Human
acuuccaaauaccaucacauug

SEQ ID NO: 472559 - RNA, 22 nt, Human
gguggcuggaggagcugaugga

SEQ ID NO: 472560 - RNA, 22 nt, Human
cucuggaguggguggccgggag

SEQ ID NO: 472561 - RNA, 22 nt, Human
gcugcucuacccaugcaucugu

SEQ ID NO: 472562 - RNA, 22 nt, Human
cucugcugcccaggccugcuag

SEQ ID NO: 472563 - RNA, 22 nt, Human
uuucugcugugcuuucuugcgu

SEQ ID NO: 472564 - RNA, 22 nt, Human
cuguagccaguuuggccucacc

SEQ ID NO: 472565 - RNA, 22 nt, Human
ugcugccaugcagagcaacaga

SEQ ID NO: 472566 - RNA, 22 nt, Human
gggcccuggauuuaagcaugga

SEQ ID NO: 472567 - RNA, 22 nt, Human
ugccuggcaaugccagaagcca

SEQ ID NO: 472568 - RNA, 22 nt, Human
ccuguacaagcucuuggugaca

SEQ ID NO: 472569 - RNA, 22 nt, Human
acugcuuuucuaagauucugug

SEQ ID NO: 472570 - RNA, 22 nt, Human
gaaaauguuuguccggagcuga

SEQ ID NO: 472571 - RNA, 22 nt, Human
ucagaggaggcauuuaaacaga

SEQ ID NO: 472572 - RNA, 22 nt, Human
cauuguauugaggauacuuaag

SEQ ID NO: 472573 - RNA, 22 nt, Human
aauaagaauuuacuugucaaga

SEQ ID NO: 472574 - RNA, 22 nt, Human
ggguggcacaggugcagagggu

SEQ ID NO: 472575 - RNA, 22 nt, Human
agucaacaaaaauguggagccu

SEQ ID NO: 472576 - RNA, 22 nt, Human
acagauuugacugguaccuggc

SEQ ID NO: 472577 - RNA, 22 nt, Human
ucauugcaagcucauuuaucug

SEQ ID NO: 472578 - RNA, 22 nt, Human
aggaaucccgcaccagcugcug

SEQ ID NO: 472579 - RNA, 22 nt, Human
ugguuuauuucucugaaagguu

SEQ ID NO: 472580 - RNA, 22 nt, Human
uuuauccauucaccaguugaac

SEQ ID NO: 472581 - RNA, 20 nt, Human
cucuccuugccgacuuggca

SEQ ID NO: 472582 - RNA, 22 nt, Human
aaaaguuaccucuguaauauaa

SEQ ID NO: 472583 - RNA, 22 nt, Human
gucuggaggaggaagaaggcac

SEQ ID NO: 472584 - RNA, 22 nt, Human
uccaugagacagauacuguaag

SEQ ID NO: 472585 - RNA, 22 nt, Human
uccugcagccauuagaggucaa

SEQ ID NO: 472586 - RNA, 22 nt, Human
agcugcugcgccucacccuggc

SEQ ID NO: 472587 - RNA, 22 nt, Human
augggaggcagacacuaaguuc

SEQ ID NO: 472588 - RNA, 22 nt, Human
gcaggugguccccguggagugg

SEQ ID NO: 472589 - RNA, 22 nt, Human
uuguauuagcuguaaauuuucu

SEQ ID NO: 472590 - RNA, 22 nt, Human
ccagcugguguuccuuaggacc

SEQ ID NO: 472591 - RNA, 22 nt, Human
agaugaaaagauaagcagcaau

SEQ ID NO: 472592 - RNA, 22 nt, Human
ccucucuguaagggucccuccc

SEQ ID NO: 472593 - RNA, 22 nt, Human
uccuucagaggacggcagccag

SEQ ID NO: 472594 - RNA, 22 nt, Human
ugcugagcgcauccggcggccg

SEQ ID NO: 472595 - RNA, 22 nt, Human
augcugugccuggaaagcggcu

SEQ ID NO: 472596 - RNA, 22 nt, Human
ucauugcauuuauucacuggca

SEQ ID NO: 472597 - RNA, 22 nt, Human
cuccagcugccaccagauguuu

SEQ ID NO: 472598 - RNA, 22 nt, Human
cagcugccugucuggaggcaau

SEQ ID NO: 472599 - RNA, 22 nt, Human
uuguggcagaccaugagucuaa

SEQ ID NO: 472600 - RNA, 18 nt, Human
ccuggcuuccaucuuggu

SEQ ID NO: 472601 - RNA, 22 nt, Human
ggguguguuccuaaggaaacca

SEQ ID NO: 472602 - RNA, 22 nt, Human
gccaccucuuugucucugccgc

SEQ ID NO: 472603 - RNA, 22 nt, Human
cucacuguuuaauagcuggauc

SEQ ID NO: 472604 - RNA, 22 nt, Human
ggguggcuccuaugggcauagc

SEQ ID NO: 472605 - RNA, 22 nt, Human
agaggggcucauauccugucau

SEQ ID NO: 472606 - RNA, 22 nt, Human
aaguccagcagugcuuguugau

SEQ ID NO: 472607 - RNA, 22 nt, Human
gggcuucucccuaaggacucug

SEQ ID NO: 472608 - RNA, 22 nt, Human
aaauccuaaaaguuugacuuaa

SEQ ID NO: 472609 - RNA, 22 nt, Human
uccuauugguagacauuucugu

SEQ ID NO: 472610 - RNA, 22 nt, Human
ugggcucugaagucagucugcu

SEQ ID NO: 472611 - RNA, 22 nt, Human
agucaguguucuccggagaggc

SEQ ID NO: 472612 - RNA, 22 nt, Human
ugccaggcuuagagcaggggcu

SEQ ID NO: 472613 - RNA, 22 nt, Human
cacagcauaaugaaauauacuu

SEQ ID NO: 472614 - RNA, 22 nt, Human
cccagguggguuggccucuguc

SEQ ID NO: 472615 - RNA, 22 nt, Human
aagaaaacguuuugaggaguuu

SEQ ID NO: 472616 - RNA, 22 nt, Human
cuggcucaggguggucuggguc

SEQ ID NO: 472617 - RNA, 22 nt, Human
acagcuuuucugauagauccug

SEQ ID NO: 472618 - RNA, 22 nt, Human
uuuauugcauacacaaauguca

SEQ ID NO: 472619 - RNA, 21 nt, Human
gagcauggcuuacaucagcag

SEQ ID NO: 472620 - RNA, 22 nt, Human
cugaggcauguuacaggacaua

SEQ ID NO: 472621 - RNA, 17 nt, Human
aggcagcucagaacauc

SEQ ID NO: 472622 - RNA, 22 nt, Human
gagcugccugugugccaugaug

SEQ ID NO: 472623 - RNA, 17 nt, Human
gagaguguauuggaugc

SEQ ID NO: 472624 - RNA, 21 nt, Human
ucugagaacuucugcugcagc

SEQ ID NO: 472625 - RNA, 22 nt, Human
gcugguuagaaaacagagcuca

SEQ ID NO: 472626 - RNA, 22 nt, Human
cauucauuuaugaaauaucuau

SEQ ID NO: 472627 - RNA, 22 nt, Human
ugcagcugguuuagaacuagau

SEQ ID NO: 472628 - RNA, 22 nt, Human
caaaggcuuccacugcauccuu

SEQ ID NO: 472629 - RNA, 22 nt, Human
gcucaggaccgaggggugggaa

SEQ ID NO: 472630 - RNA, 21 nt, Human
acaguucaugauaacuccauc

SEQ ID NO: 472631 - RNA, 19 nt, Human
aggcugcaagguggugggc

SEQ ID NO: 472632 - RNA, 22 nt, Human
uggaggcaucagagugcuuggc

SEQ ID NO: 472633 - RNA, 22 nt, Human
ccugagaccaaguugcagccau

SEQ ID NO: 472634 - RNA, 22 nt, Human
ggagacagugguagggccuaag

SEQ ID NO: 472635 - RNA, 22 nt, Human
agaggcuccuagccacuggcuu

SEQ ID NO: 472636 - RNA, 22 nt, Human
agacaaagacagcaucucaggu

SEQ ID NO: 472637 - RNA, 23 nt, Human
uggcagugaucaaaagcuuacau

SEQ ID NO: 472638 - RNA, 22 nt, Human
uaaguucaguuggucgaaguag

SEQ ID NO: 472639 - RNA, 22 nt, Human
uucaggagaauuccaagaagua

SEQ ID NO: 472640 - RNA, 22 nt, Human
gcugcugguccucagagcucau

SEQ ID NO: 472641 - RNA, 22 nt, Human
cagcagcugggaaggaggcuga

SEQ ID NO: 472642 - RNA, 19 nt, Human
gaagaagcuugagaaguag

SEQ ID NO: 472643 - RNA, 22 nt, Human
ucagugaucuaaggguauggcc

SEQ ID NO: 472644 - RNA, 21 nt, Human
gaaaggucuuaacuuacagag

SEQ ID NO: 472645 - RNA, 22 nt, Human
uuucuauucuggaucuguggca

SEQ ID NO: 472646 - RNA, 22 nt, Human
agaagccaccagcugaggaaga

SEQ ID NO: 472647 - RNA, 22 nt, Human
uacaaaaguaauuacgguuuuu

SEQ ID NO: 472648 - RNA, 22 nt, Human
gggcuggcaggaccugggcuga

SEQ ID NO: 472649 - RNA, 22 nt, Human
ucuaaaaaagucuguucacuug

SEQ ID NO: 472650 - RNA, 22 nt, Human
uggcucaguuugggggauugaa

SEQ ID NO: 472651 - RNA, 22 nt, Human
ugagcauggugggugcagagca

SEQ ID NO: 472652 - RNA, 22 nt, Human
agaguccaugaagacagcugag

SEQ ID NO: 472653 - RNA, 18 nt, Human
aggagccuuugcacugga

SEQ ID NO: 472654 - RNA, 22 nt, Human
gagaggccauggcugugcagug

SEQ ID NO: 472655 - RNA, 22 nt, Human
cacccagcuuuugcauccuccg

SEQ ID NO: 472656 - RNA, 22 nt, Human
aacagugagaagguggacagga

SEQ ID NO: 472657 - RNA, 22 nt, Human
gcagggcacaaggacgcacagg

SEQ ID NO: 472658 - RNA, 22 nt, Human
caugcacaaagguaagaugcgu

SEQ ID NO: 472659 - RNA, 19 nt, Human
gucacauuugucucccagg

SEQ ID NO: 472660 - RNA, 22 nt, Human
auuccaaaggcuggccuggagg

SEQ ID NO: 472661 - RNA, 22 nt, Human
aaaucagugcucauuugaaagg

SEQ ID NO: 472662 - RNA, 22 nt, Human
augucccagcugagagacaacu

SEQ ID NO: 472663 - RNA, 22 nt, Human
agccugguguggggcugcagag

SEQ ID NO: 472664 - RNA, 22 nt, Human
uacaaagcuguauagccugguc

SEQ ID NO: 472665 - RNA, 22 nt, Human
ucagcuuuccugcagcuaaggg

SEQ ID NO: 472666 - RNA, 22 nt, Human
gcuguacauucuguggguuugg

SEQ ID NO: 472667 - RNA, 22 nt, Human
aaguucaagagugacauauuag

SEQ ID NO: 472668 - RNA, 22 nt, Human
auuuccaagaaagcuuuaggau

SEQ ID NO: 472669 - RNA, 22 nt, Human
caaaugcauaguuuauaagaag

SEQ ID NO: 472670 - RNA, 22 nt, Human
ugcugccaaaugcgagcucugu

SEQ ID NO: 472671 - RNA, 22 nt, Human
uggcucaggcuugaaaauagau

SEQ ID NO: 472672 - RNA, 22 nt, Human
ccuugcaggggaacaggcagug

SEQ ID NO: 472673 - RNA, 22 nt, Human
ggacacaagcuccggggcugca

SEQ ID NO: 472674 - RNA, 22 nt, Human
agggaguuccgaucugugcacc

SEQ ID NO: 472675 - RNA, 22 nt, Human
acagugucuccugguacccagu

SEQ ID NO: 472676 - RNA, 18 nt, Human
agccuggaggguugaagu

SEQ ID NO: 472677 - RNA, 22 nt, Human
ugaagccacacuagcuuguccu

SEQ ID NO: 472678 - RNA, 22 nt, Human
cugggcagugcagcuauagaac

SEQ ID NO: 472679 - RNA, 22 nt, Human
cuggagagaaaugacaaagcua

SEQ ID NO: 472680 - RNA, 20 nt, Human
aggcugccaggucucacauc

SEQ ID NO: 472681 - RNA, 22 nt, Human
ggacacagcugcagccacaccc

SEQ ID NO: 472682 - RNA, 22 nt, Human
uccugccuucauacugcuguau

SEQ ID NO: 472683 - RNA, 22 nt, Human
aaugaacaaaauaugcuuugca

SEQ ID NO: 472684 - RNA, 22 nt, Human
aaauccuaccaagaaauucccu

SEQ ID NO: 472685 - RNA, 21 nt, Human
ccuggcugcacaguugcuggu

SEQ ID NO: 472686 - RNA, 22 nt, Human
gagggcaguagccucguacccu

SEQ ID NO: 472687 - RNA, 22 nt, Human
aaggcacugacugugcagggga

SEQ ID NO: 472688 - RNA, 22 nt, Human
aaggcccuaauagagcacauau

SEQ ID NO: 472689 - RNA, 22 nt, Human
uaaggcagaaauaugagcaggg

SEQ ID NO: 472690 - RNA, 22 nt, Human
acagcuuuguuuucccugcuga

SEQ ID NO: 472691 - RNA, 23 nt, Human
agggcugaaugcagagaagcaga

SEQ ID NO: 472692 - RNA, 22 nt, Human
cuggggcugcgguggaggagcc

SEQ ID NO: 472693 - RNA, 22 nt, Human
aaguggagccagggaaacugaa

SEQ ID NO: 472694 - RNA, 22 nt, Human
gccuuuuuuguugcucugucac

SEQ ID NO: 472695 - RNA, 22 nt, Human
cagcuuuguggccuugaccucg

SEQ ID NO: 472696 - RNA, 22 nt, Human
ucagagagcagaacuuuuuuac

SEQ ID NO: 472697 - RNA, 22 nt, Human
gauuucaaggaguuuucacagu

SEQ ID NO: 472698 - RNA, 22 nt, Human
gaaggcuguuucugguagugau

SEQ ID NO: 472699 - RNA, 22 nt, Human
aaaauuuugcccuauccuucau

SEQ ID NO: 472700 - RNA, 22 nt, Human
aggcuucuuagauuggcuggag

SEQ ID NO: 472701 - RNA, 22 nt, Human
acauuucuauagugcaucuguu

SEQ ID NO: 472702 - RNA, 19 nt, Human
ugccagcauuaggcugaag

SEQ ID NO: 472703 - RNA, 22 nt, Human
aucagagaccggucaagucaug

SEQ ID NO: 472704 - RNA, 22 nt, Human
cugggcagccucacacaauguu

SEQ ID NO: 472705 - RNA, 23 nt, Human
cuggcucuguagguggcauccuu

SEQ ID NO: 472706 - RNA, 22 nt, Human
uauuucuggcuuugagggugau

SEQ ID NO: 472707 - RNA, 22 nt, Human
acaggcucucagccaguuggca

SEQ ID NO: 472708 - RNA, 22 nt, Human
gugccuggcacacagaaggcaa

SEQ ID NO: 472709 - RNA, 22 nt, Human
acugccuugaaagauuguugag

SEQ ID NO: 472710 - RNA, 22 nt, Human
ugcacacacgcggcacaucugu

SEQ ID NO: 472711 - RNA, 22 nt, Human
uuuugauaucaugaugaacaga

SEQ ID NO: 472712 - RNA, 20 nt, Human
uuccuguauacaaagaguuc

SEQ ID NO: 472713 - RNA, 22 nt, Human
ucaguuuuuaagaguuaugcga

SEQ ID NO: 472714 - RNA, 22 nt, Human
uugcauugugauuacagaggug

SEQ ID NO: 472715 - RNA, 23 nt, Human
ggaaagagaggaguugugcauag

SEQ ID NO: 472716 - RNA, 22 nt, Human
aggccuggcuuugguuugcuga

SEQ ID NO: 472717 - RNA, 22 nt, Human
ccugccugaaggucagccaccc

SEQ ID NO: 472718 - RNA, 22 nt, Human
gaguuguucaacgugugugaaa

SEQ ID NO: 472719 - RNA, 22 nt, Human
cagaguggcagucccaggccca

SEQ ID NO: 472720 - RNA, 22 nt, Human
ucuguggccuguguccaagugc

SEQ ID NO: 472721 - RNA, 23 nt, Human
ugaaggccuggaggacgcguugu

SEQ ID NO: 472722 - RNA, 21 nt, Human
cucaaagaccaaaaguguaga

SEQ ID NO: 472723 - RNA, 22 nt, Human
ccagcagacacacaggcguggg

SEQ ID NO: 472724 - RNA, 22 nt, Human
aaguucaaguaguguuacaugg

SEQ ID NO: 472725 - RNA, 22 nt, Human
uggugcuguggaggggcagaag

SEQ ID NO: 472726 - RNA, 22 nt, Human
gacaggaggcagagcucaggug

SEQ ID NO: 472727 - RNA, 22 nt, Human
uccgcccgcacguauggagugg

SEQ ID NO: 472728 - RNA, 22 nt, Human
auguaacuucugugaaucugac

SEQ ID NO: 472729 - RNA, 22 nt, Human
cccauuuaucccaagguuacuc

SEQ ID NO: 472730 - RNA, 22 nt, Human
ucucagagggaaaggccaauuu

SEQ ID NO: 472731 - RNA, 22 nt, Human
auuugucugcuugcugccuucc

SEQ ID NO: 472732 - RNA, 22 nt, Human
uccuugaaaggggcugcagggc

SEQ ID NO: 472733 - RNA, 22 nt, Human
cagcagcugauggggaagugau

SEQ ID NO: 472734 - RNA, 22 nt, Human
caggcagaugcugacaagaguu

SEQ ID NO: 472735 - RNA, 22 nt, Human
cucagaguccauaguuuacagu

SEQ ID NO: 472736 - RNA, 22 nt, Human
gaggaagggcugccugccgggc

SEQ ID NO: 472737 - RNA, 22 nt, Human
ugugaaagcaagucuaguucuc

SEQ ID NO: 472738 - RNA, 22 nt, Human
ugcuuuauucgacaucugguag

SEQ ID NO: 472739 - RNA, 22 nt, Human
acaguaauauugaugcucguca

SEQ ID NO: 472740 - RNA, 22 nt, Human
ugcuuuauaaccauuucugugg

SEQ ID NO: 472741 - RNA, 20 nt, Human
gucaucgccggcagcaaaga

SEQ ID NO: 472742 - RNA, 22 nt, Human
cuggcaggcggcagagcccagg

SEQ ID NO: 472743 - RNA, 22 nt, Human
gccugguggugugcucaagugg

SEQ ID NO: 472744 - RNA, 22 nt, Human
aagagguugucugugaugaguu

SEQ ID NO: 472745 - RNA, 18 nt, Human
gucauugcaacauacugu

SEQ ID NO: 472746 - RNA, 15 nt, Human
aaucuggcggcaagu

SEQ ID NO: 472747 - RNA, 22 nt, Human
uuccugagggacuuuugagauu

SEQ ID NO: 472748 - RNA, 22 nt, Human
gagcagcugcagugcagacccu

SEQ ID NO: 472749 - RNA, 22 nt, Human
cagggucuuauaaggccaauuu

SEQ ID NO: 472750 - RNA, 22 nt, Human
gaagcagcuaggaucuucauuu

SEQ ID NO: 472751 - RNA, 22 nt, Human
uacuguacugucuuuuuugcug

SEQ ID NO: 472752 - RNA, 22 nt, Human
gggaagguauuuagcugcugaa

SEQ ID NO: 472753 - RNA, 20 nt, Human
cugagcccccagccugcagg

SEQ ID NO: 472754 - RNA, 22 nt, Human
uggaggcaguaacugagcaaca

SEQ ID NO: 472755 - RNA, 22 nt, Human
auaaacacuucuagggcacaca

SEQ ID NO: 472756 - RNA, 22 nt, Human
gcacagccagcaucugagggau

SEQ ID NO: 472757 - RNA, 22 nt, Human
agcaggaaggggaugaugggca

SEQ ID NO: 472758 - RNA, 22 nt, Human
ucuuucucucuaaucaagcaca

SEQ ID NO: 472759 - RNA, 22 nt, Human
gaggccaggguaccaucaacau

SEQ ID NO: 472760 - RNA, 22 nt, Human
aggcuucagguuugcuuugcag

SEQ ID NO: 472761 - RNA, 22 nt, Human
gguccagggaacuuugaaggau

SEQ ID NO: 472762 - RNA, 22 nt, Human
uccucagacacccugcuggcuu

SEQ ID NO: 472763 - RNA, 22 nt, Human
cuuaauuucaaacugcuaguga

SEQ ID NO: 472764 - RNA, 22 nt, Human
ugcaguggugguaaagaugcuc

SEQ ID NO: 472765 - RNA, 22 nt, Human
uacaugaacaaaauagcagaaa

SEQ ID NO: 472766 - RNA, 22 nt, Human
uucacauuagugguucuauaua

SEQ ID NO: 472767 - RNA, 22 nt, Human
gcagcagaggcccuacucuuug

SEQ ID NO: 472768 - RNA, 22 nt, Human
gaaggccuaggaaggaagccuu

SEQ ID NO: 472769 - RNA, 22 nt, Human
agcucccaauugacuugaacua

SEQ ID NO: 472770 - RNA, 22 nt, Human
uaguggaguagaaaccaaagaa

SEQ ID NO: 472771 - RNA, 22 nt, Human
ucacuccucauugcugcccauu

SEQ ID NO: 472772 - RNA, 22 nt, Human
agcuuaggaggaugaugaacau

SEQ ID NO: 472773 - RNA, 22 nt, Human
augaaggcaguuaaacgucauc

SEQ ID NO: 472774 - RNA, 22 nt, Human
gccugagagacccauggggcaa

SEQ ID NO: 472775 - RNA, 22 nt, Human
gcagcagagaacacaaugaugg

SEQ ID NO: 472776 - RNA, 22 nt, Human
cagcaguggcugcaggcagcug

SEQ ID NO: 472777 - RNA, 22 nt, Human
uccucugcucagcauuccucac

SEQ ID NO: 472778 - RNA, 22 nt, Human
uguggaaaagaauaagggagau

SEQ ID NO: 472779 - RNA, 22 nt, Human
uggcugaggcuggagugcagug

SEQ ID NO: 472780 - RNA, 22 nt, Human
uuguuucaugaguguaaaggga

SEQ ID NO: 472781 - RNA, 22 nt, Human
uuuguaaagucuguucugaguu

SEQ ID NO: 472782 - RNA, 22 nt, Human
ugcagaagauggucugagcacc

SEQ ID NO: 472783 - RNA, 22 nt, Human
aucuagaaguggcaugaauuac

SEQ ID NO: 472784 - RNA, 22 nt, Human
gcugcagcagcugcaggguugu

SEQ ID NO: 472785 - RNA, 17 nt, Human
uuccucucacauuuuuu

SEQ ID NO: 472786 - RNA, 18 nt, Human
cagaugagaugcaaucuc

SEQ ID NO: 472787 - RNA, 22 nt, Human
ccugccuggcuuccagaagaga

SEQ ID NO: 472788 - RNA, 22 nt, Human
gcugccuguggcccuucugggu

SEQ ID NO: 472789 - RNA, 22 nt, Human
gcagggcugcugaaacuuguuu

SEQ ID NO: 472790 - RNA, 22 nt, Human
accauguuggccaagcuggucu

SEQ ID NO: 472791 - RNA, 22 nt, Human
gccaggcuguggggaacuugaa

SEQ ID NO: 472792 - RNA, 22 nt, Human
ccagagaggggaagggcuugcc

SEQ ID NO: 472793 - RNA, 22 nt, Human
augggcaguaacaguggcaguc

SEQ ID NO: 472794 - RNA, 22 nt, Human
cagaggaaaguauuucuggaag

SEQ ID NO: 472795 - RNA, 22 nt, Human
gugcuaggauuacaggcauggg

SEQ ID NO: 472796 - RNA, 22 nt, Human
ugaaaucuccucuuuauauauc

SEQ ID NO: 472797 - RNA, 18 nt, Human
uccugcagcuucuaugua

SEQ ID NO: 472798 - RNA, 22 nt, Human
cuuaauuuuuguaguagaugga

SEQ ID NO: 472799 - RNA, 22 nt, Human
cagcacaguacaaggcacggau

SEQ ID NO: 472800 - RNA, 22 nt, Human
aaaagucagucucuccuagcuc

SEQ ID NO: 472801 - RNA, 22 nt, Human
agggccugcucuaucacucuca

SEQ ID NO: 472802 - RNA, 22 nt, Human
uauucacaguugauuuacaguu

SEQ ID NO: 472803 - RNA, 22 nt, Human
cugggagggguagccaauccua

SEQ ID NO: 472804 - RNA, 22 nt, Human
acagcagcaauagcagugacau

SEQ ID NO: 472805 - RNA, 23 nt, Human
uccaggcaugagcucuggaugga

SEQ ID NO: 472806 - RNA, 22 nt, Human
gcucaggaucagccaccucuuu

SEQ ID NO: 472807 - RNA, 22 nt, Human
ccuaggccuuacuuuccugugc

SEQ ID NO: 472808 - RNA, 22 nt, Human
caugucuggguauaugcauaug

SEQ ID NO: 472809 - RNA, 22 nt, Human
ugccacagaggugaagcccacu

SEQ ID NO: 472810 - RNA, 22 nt, Human
uaugcacacauuagcacagggu

SEQ ID NO: 472811 - RNA, 22 nt, Human
cacaucuucuuaacuccaaagu

SEQ ID NO: 472812 - RNA, 22 nt, Human
ggagcuguucaggacugcuuca

SEQ ID NO: 472813 - RNA, 22 nt, Human
guugggaaggcaagaaguagaa

SEQ ID NO: 472814 - RNA, 22 nt, Human
agugacucacuagcucucagug

SEQ ID NO: 472815 - RNA, 22 nt, Human
aaggcacugcuuugcugcgccc

SEQ ID NO: 472816 - RNA, 22 nt, Human
ucaggaggccaccaggaccugu

SEQ ID NO: 472817 - RNA, 22 nt, Human
guccucugcuucaugcccugau

SEQ ID NO: 472818 - RNA, 19 nt, Human
ggugugaagugaggaguua

SEQ ID NO: 472819 - RNA, 22 nt, Human
gaggaagaagggauuagaacuc

SEQ ID NO: 472820 - RNA, 22 nt, Human
aggcuggagggcaauggcaaga

SEQ ID NO: 472821 - RNA, 19 nt, Human
ugcuuccucaccaucuccc

SEQ ID NO: 472822 - RNA, 22 nt, Human
gcuugggauaugcugauguaaa

SEQ ID NO: 472823 - RNA, 22 nt, Human
cucugggcacauuuuccaggac

SEQ ID NO: 472824 - RNA, 22 nt, Human
aagaugcagcuuuacaauaagg

SEQ ID NO: 472825 - RNA, 22 nt, Human
caagggaguuacugagggcggg

SEQ ID NO: 472826 - RNA, 22 nt, Human
aucuggcucauucagggaacgg

SEQ ID NO: 472827 - RNA, 22 nt, Human
ccugccaggcuuugggcuucug

SEQ ID NO: 472828 - RNA, 22 nt, Human
gcaaaugcucuccuuggucagg

SEQ ID NO: 472829 - RNA, 18 nt, Human
aaauguacuguccauggc

SEQ ID NO: 472830 - RNA, 22 nt, Human
agagccugaggaugucccagcu

SEQ ID NO: 472831 - RNA, 22 nt, Human
aagaauguucauuaaacuguug

SEQ ID NO: 472832 - RNA, 22 nt, Human
cagccccucacagagcuguccu

SEQ ID NO: 472833 - RNA, 22 nt, Human
ggcugccaggagaagcucagug

SEQ ID NO: 472834 - RNA, 22 nt, Human
ccuggcuggcaagaucgugaag

SEQ ID NO: 472835 - RNA, 22 nt, Human
ggccugcuauuggugggcagac

SEQ ID NO: 472836 - RNA, 22 nt, Human
ggcgugggaaguggggcuucug

SEQ ID NO: 472837 - RNA, 23 nt, Human
ugcauuauccucucugaagacca

SEQ ID NO: 472838 - RNA, 23 nt, Human
ucagggacaugaugugucauauc

SEQ ID NO: 472839 - RNA, 22 nt, Human
ucuguaucuaauuuuacaguag

SEQ ID NO: 472840 - RNA, 22 nt, Human
cucaggauggaagccuacagga

SEQ ID NO: 472841 - RNA, 21 nt, Human
ugugucacuaacuagaggcua

SEQ ID NO: 472842 - RNA, 22 nt, Human
guauuaggaggaacacaggccu

SEQ ID NO: 472843 - RNA, 22 nt, Human
uagggcucagaguccaguuucu

SEQ ID NO: 472844 - RNA, 22 nt, Human
guggccugucagaagccguggg

SEQ ID NO: 472845 - RNA, 22 nt, Human
uggggugggcaugcgcuguccu

SEQ ID NO: 472846 - RNA, 22 nt, Human
ggaggcagaacuucccgucagu

SEQ ID NO: 472847 - RNA, 22 nt, Human
cauguacaaaaggcaaaugccu

SEQ ID NO: 472848 - RNA, 22 nt, Human
agggcagcucucaccucuggcc

SEQ ID NO: 472849 - RNA, 22 nt, Human
ggcaggcagaggcugagacagg

SEQ ID NO: 472850 - RNA, 22 nt, Human
cagcuuggaggaggaucuaaga

SEQ ID NO: 472851 - RNA, 22 nt, Human
gcaggcaguuauuuaguagaau

SEQ ID NO: 472852 - RNA, 19 nt, Human
ccaggccuccugggagguc

SEQ ID NO: 472853 - RNA, 22 nt, Human
ugucucagaggcaggaagagcc

SEQ ID NO: 472854 - RNA, 22 nt, Human
uuuauccauaucauuaaaaucu

SEQ ID NO: 472855 - RNA, 22 nt, Human
augcacagacccaaaggccauc

SEQ ID NO: 472856 - RNA, 22 nt, Human
ccaaaugcuccacugacuuugg

SEQ ID NO: 472857 - RNA, 22 nt, Human
gagggguguggagccaucaguu

SEQ ID NO: 472858 - RNA, 22 nt, Human
ugacuucaaaggcucuacuccu

SEQ ID NO: 472859 - RNA, 22 nt, Human
ggagggcugccagguggagcgg

SEQ ID NO: 472860 - RNA, 22 nt, Human
ugaugaauaaacuugagaguca

SEQ ID NO: 472861 - RNA, 22 nt, Human
accccaagacaguagaagagaa

SEQ ID NO: 472862 - RNA, 22 nt, Human
aucaaaguucguaacugauaac

SEQ ID NO: 472863 - RNA, 22 nt, Human
agugcugucuccuucccccggg

SEQ ID NO: 472864 - RNA, 22 nt, Human
aggcugugacagggucauggag

SEQ ID NO: 472865 - RNA, 22 nt, Human
ucucaagagggaggcaaucaug

SEQ ID NO: 472866 - RNA, 22 nt, Human
cugcagcuccccugagaucaag

SEQ ID NO: 472867 - RNA, 22 nt, Human
uuaaugcagaaaucaaacugac

SEQ ID NO: 472868 - RNA, 20 nt, Human
gggagucuggaugaaagaug

SEQ ID NO: 472869 - RNA, 22 nt, Human
cagcagcuggugagacacagcc

SEQ ID NO: 472870 - RNA, 22 nt, Human
agaaaacauuacauaggugugu

SEQ ID NO: 472871 - RNA, 23 nt, Human
aguacauucgaaaaauucuguga

SEQ ID NO: 472872 - RNA, 22 nt, Human
gagugcaguuggggugagggga

SEQ ID NO: 472873 - RNA, 21 nt, Human
acaugcauagagagauuucug

SEQ ID NO: 472874 - RNA, 22 nt, Human
uggcagcuuccugcucauagga

SEQ ID NO: 472875 - RNA, 22 nt, Human
gccuaauaacuagcuguguaac

SEQ ID NO: 472876 - RNA, 22 nt, Human
ucagagugguagccuauuuucu

SEQ ID NO: 472877 - RNA, 22 nt, Human
uggaaggagcuaaggaccuggg

SEQ ID NO: 472878 - RNA, 22 nt, Human
uuccaaaggaauggggagcuau

SEQ ID NO: 472879 - RNA, 22 nt, Human
ggcaggugaccuggccucccag

SEQ ID NO: 472880 - RNA, 22 nt, Human
ccaggcagccaagugugugugu

SEQ ID NO: 472881 - RNA, 22 nt, Human
guaauugacucagcucuguuca

SEQ ID NO: 472882 - RNA, 22 nt, Human
guuuuccacuggauuguuugga

SEQ ID NO: 472883 - RNA, 16 nt, Human
uggcagagguucagcc

SEQ ID NO: 472884 - RNA, 22 nt, Human
auacuaaaguauagaacuuagu

SEQ ID NO: 472885 - RNA, 21 nt, Human
ucaggcagugcaaauacaugg

SEQ ID NO: 472886 - RNA, 22 nt, Human
gcggcaggaagagcgcagcccc

SEQ ID NO: 472887 - RNA, 22 nt, Human
cauguacauucuguagauggag

SEQ ID NO: 472888 - RNA, 22 nt, Human
auaaggcauauagucacuuuuu

SEQ ID NO: 472889 - RNA, 22 nt, Human
cagagguaccagcagccucugg

SEQ ID NO: 472890 - RNA, 22 nt, Human
agugaaauggaugcugcuacug

SEQ ID NO: 472891 - RNA, 22 nt, Human
aaugccucuuggaagaagacuu

SEQ ID NO: 472892 - RNA, 22 nt, Human
agguggggugagcugcagacua

SEQ ID NO: 472893 - RNA, 22 nt, Human
gcugucacucuccggccuuccc

SEQ ID NO: 472894 - RNA, 22 nt, Human
ugccugagugauguggcagcca

SEQ ID NO: 472895 - RNA, 22 nt, Human
uggggguguccuggugcacaca

SEQ ID NO: 472896 - RNA, 22 nt, Human
gggcagccucggugccugcugc

SEQ ID NO: 472897 - RNA, 22 nt, Human
ucaaugauagacaagaucuaag

SEQ ID NO: 472898 - RNA, 22 nt, Human
uguauguaaaguuuguaauaga

SEQ ID NO: 472899 - RNA, 22 nt, Human
gaaagagaaccugggccuagau

SEQ ID NO: 472900 - RNA, 22 nt, Human
uccugcagguggaugauucucu

SEQ ID NO: 472901 - RNA, 22 nt, Human
gcagcuuggugaaaggugaugg

SEQ ID NO: 472902 - RNA, 22 nt, Human
aagcacagaaaaggagcaugga

SEQ ID NO: 472903 - RNA, 22 nt, Human
cagagacagaaaauggaucuag

SEQ ID NO: 472904 - RNA, 22 nt, Human
gcagcugaagcugcaguuccag

SEQ ID NO: 472905 - RNA, 22 nt, Human
auggcagaauuaggauuucaag

SEQ ID NO: 472906 - RNA, 22 nt, Human
gcugggagccccgagccagcgc

SEQ ID NO: 472907 - RNA, 22 nt, Human
aggcugcucugcgaagucagcu

SEQ ID NO: 472908 - RNA, 22 nt, Human
cugggagagaagcgaagcuggg

SEQ ID NO: 472909 - RNA, 22 nt, Human
uccuuuggagcuugacugguag

SEQ ID NO: 472910 - RNA, 22 nt, Human
gaguucaguaguuauagucuag

SEQ ID NO: 472911 - RNA, 22 nt, Human
gaaaucugaaucuucuguuggu

SEQ ID NO: 472912 - RNA, 22 nt, Human
uggcagcagccauggaaggccc

SEQ ID NO: 472913 - RNA, 22 nt, Human
cagaagaaaguggggagacaag

SEQ ID NO: 472914 - RNA, 22 nt, Human
cuggcucccucgcugaggugcu

SEQ ID NO: 472915 - RNA, 22 nt, Human
uaccuuuugcuuauuaugacac

SEQ ID NO: 472916 - RNA, 19 nt, Human
agagaggcugugugaggga

SEQ ID NO: 472917 - RNA, 22 nt, Human
uguggcucucaugcacucccag

SEQ ID NO: 472918 - RNA, 22 nt, Human
auguccagaguguccuggaaag

SEQ ID NO: 472919 - RNA, 22 nt, Human
cagaaggcaaacaaaaggauuu

SEQ ID NO: 472920 - RNA, 22 nt, Human
cagggagaaaucuccaggaggu

SEQ ID NO: 472921 - RNA, 22 nt, Human
aaaguuuccugcuaagugcuau

SEQ ID NO: 472922 - RNA, 22 nt, Human
gagagggccgggggccagcucc

SEQ ID NO: 472923 - RNA, 22 nt, Human
ggcagccaugcacgcugccugg

SEQ ID NO: 472924 - RNA, 22 nt, Human
caggagccgccaggcacguugg

SEQ ID NO: 472925 - RNA, 15 nt, Human
ugggcagaucacuug

SEQ ID NO: 472926 - RNA, 22 nt, Human
ggccaggaagggaagaucagca

SEQ ID NO: 472927 - RNA, 22 nt, Human
ugccagggugucaggagagcua

SEQ ID NO: 472928 - RNA, 22 nt, Human
cuguacaucucugaggacagua

SEQ ID NO: 472929 - RNA, 22 nt, Human
ugaugguuuuauuaauaggacc

SEQ ID NO: 472930 - RNA, 22 nt, Human
cugcugagguccuugcucagac

SEQ ID NO: 472931 - RNA, 22 nt, Human
accugcaguggccacuccuaau

SEQ ID NO: 472932 - RNA, 22 nt, Human
cagaggccuuucuacagugaua

SEQ ID NO: 472933 - RNA, 18 nt, Human
gcccugguggagcuggug

SEQ ID NO: 472934 - RNA, 22 nt, Human
ugaaagguuauuuaggucugcu

SEQ ID NO: 472935 - RNA, 22 nt, Human
aaaaguuuaagacucauucuag

SEQ ID NO: 472936 - RNA, 22 nt, Human
cccacaggcuagggguagggca

SEQ ID NO: 472937 - RNA, 22 nt, Human
uuugcauuaguuuagauuucaa

SEQ ID NO: 472938 - RNA, 22 nt, Human
cuggaauguagagacagcuuag

SEQ ID NO: 472939 - RNA, 21 nt, Human
aaguggagaagaaaagcugga

SEQ ID NO: 472940 - RNA, 22 nt, Human
ugaggcucacaaaucugcauuu

SEQ ID NO: 472941 - RNA, 22 nt, Human
ggcugcuguuucagagacuguu

SEQ ID NO: 472942 - RNA, 22 nt, Human
uggcucaggguccccaaauggu

SEQ ID NO: 472943 - RNA, 22 nt, Human
uuugaguugcuuauuuaauagg

SEQ ID NO: 472944 - RNA, 22 nt, Human
cagcaggcugcgauugcucauu

SEQ ID NO: 472945 - RNA, 22 nt, Human
ggaggaguguggggcacucugc

SEQ ID NO: 472946 - RNA, 22 nt, Human
uuaauuuuuauguauagugugu

SEQ ID NO: 472947 - RNA, 22 nt, Human
cuugcugggguaagucugugcu

SEQ ID NO: 472948 - RNA, 22 nt, Human
caguuucuuggaugccaauuuc

SEQ ID NO: 472949 - RNA, 17 nt, Human
ugagacagggcaggccc

SEQ ID NO: 472950 - RNA, 22 nt, Human
ucccagggcagcuguccagaag

SEQ ID NO: 472951 - RNA, 22 nt, Human
cuggcuuccucaggagcagugg

SEQ ID NO: 472952 - RNA, 22 nt, Human
ccagaaaaugcagaacauagaa

SEQ ID NO: 472953 - RNA, 22 nt, Human
ugguacuuggaggcagaaaaau

SEQ ID NO: 472954 - RNA, 22 nt, Human
acuuuguauaagacaauaaaga

SEQ ID NO: 472955 - RNA, 20 nt, Human
guguuucaugugauacaaug

SEQ ID NO: 472956 - RNA, 22 nt, Human
ucugcuggccuuagcaggucua

SEQ ID NO: 472957 - RNA, 22 nt, Human
ugucucugagaugacucccacc

SEQ ID NO: 472958 - RNA, 22 nt, Human
ggcugcucugccuuccagcugg

SEQ ID NO: 472959 - RNA, 22 nt, Human
agaauucugacaauagaauugg

SEQ ID NO: 472960 - RNA, 22 nt, Human
ucuaccacuuauuagcucugug

SEQ ID NO: 472961 - RNA, 22 nt, Human
cuuagggagaaugccucugcag

SEQ ID NO: 472962 - RNA, 22 nt, Human
cuggcaggaagaggaaagguca

SEQ ID NO: 472963 - RNA, 22 nt, Human
uacuuucuagcucuccccaguu

SEQ ID NO: 472964 - RNA, 22 nt, Human
auguguaggugaaucgaggcug

SEQ ID NO: 472965 - RNA, 22 nt, Human
ccagcuuuauagcuucaaagga

SEQ ID NO: 472966 - RNA, 22 nt, Human
gcaggagcuggaaagugauguu

SEQ ID NO: 472967 - RNA, 22 nt, Human
uaaggaaacaacuuguauuuuu

SEQ ID NO: 472968 - RNA, 22 nt, Human
ugcuccauucucuagccagugc

SEQ ID NO: 472969 - RNA, 22 nt, Human
ucacaggguuuggaagccuccu

SEQ ID NO: 472970 - RNA, 22 nt, Human
uugaaaggguuaaagugguaaa

SEQ ID NO: 472971 - RNA, 22 nt, Human
agcugucucugguauuauguga

SEQ ID NO: 472972 - RNA, 18 nt, Human
aagaggaggagcagguug

SEQ ID NO: 472973 - RNA, 22 nt, Human
cagacccucgggugaguuggcc

SEQ ID NO: 472974 - RNA, 20 nt, Human
ugcagggcugccucccagcu

SEQ ID NO: 472975 - RNA, 22 nt, Human
cugggcacuuuggggagccuac

SEQ ID NO: 472976 - RNA, 18 nt, Human
aaagaaggauuggagagc

SEQ ID NO: 472977 - RNA, 22 nt, Human
uggagccuguguuucugcccag

SEQ ID NO: 472978 - RNA, 22 nt, Human
aggcucaggaggagcugccgga

SEQ ID NO: 472979 - RNA, 22 nt, Human
ugaaagcuguccacuaggcugu

SEQ ID NO: 472980 - RNA, 22 nt, Human
aguaaaaauugaggugcaaaau

SEQ ID NO: 472981 - RNA, 22 nt, Human
ugggcucuccuggaggacaaca

SEQ ID NO: 472982 - RNA, 22 nt, Human
cuggagcucuccagagccccgu

SEQ ID NO: 472983 - RNA, 22 nt, Human
ucugucacccgagcaggcgaga

SEQ ID NO: 472984 - RNA, 22 nt, Human
gugugcaguagagaaagagcag

SEQ ID NO: 472985 - RNA, 22 nt, Human
aacaucagaauauccauguugg

SEQ ID NO: 472986 - RNA, 22 nt, Human
agguguguauaaacauacauau

SEQ ID NO: 472987 - RNA, 22 nt, Human
uaacagaaacagauaaguguaa

SEQ ID NO: 472988 - RNA, 22 nt, Human
ucugggugcccuuugcucuguu

SEQ ID NO: 472989 - RNA, 22 nt, Human
uuccagcuaacucacaucccuu

SEQ ID NO: 472990 - RNA, 22 nt, Human
caggagcucuuaaggaugugau

SEQ ID NO: 472991 - RNA, 22 nt, Human
gcuuuauuuugugagggauuac

SEQ ID NO: 472992 - RNA, 22 nt, Human
augucccaagauacagcuagag

SEQ ID NO: 472993 - RNA, 22 nt, Human
augcaguaaaauaggagguaau

SEQ ID NO: 472994 - RNA, 22 nt, Human
aggcacugauucuguuuuccau

SEQ ID NO: 472995 - RNA, 22 nt, Human
auguguacaaccaagcacuaaa

SEQ ID NO: 472996 - RNA, 20 nt, Human
ggcaccaggcuaggauugga

SEQ ID NO: 472997 - RNA, 22 nt, Human
aaaacauguccauacagaaacu

SEQ ID NO: 472998 - RNA, 22 nt, Human
ucagagaacacagaggugaugu

SEQ ID NO: 472999 - RNA, 19 nt, Human
ccaggccuggcgucuccgc

SEQ ID NO: 473000 - RNA, 22 nt, Human
aggcaugugacccuggacucag

SEQ ID NO: 473001 - RNA, 22 nt, Human
caucaucaaaagugacagagaa

SEQ ID NO: 473002 - RNA, 21 nt, Human
uccuguaagcuuggguggcuc

SEQ ID NO: 473003 - RNA, 21 nt, Human
ugggagagggcucagcuaccc

SEQ ID NO: 473004 - RNA, 20 nt, Human
cccucugcacauggcugugg

SEQ ID NO: 473005 - RNA, 22 nt, Human
ccagaagaccccguccaccucc

SEQ ID NO: 473006 - RNA, 22 nt, Human
guuccauaucacagcagacgaa

SEQ ID NO: 473007 - RNA, 22 nt, Human
cuggagccagccagggcccucu

SEQ ID NO: 473008 - RNA, 22 nt, Human
gcuuggaaguaggauugggaga

SEQ ID NO: 473009 - RNA, 21 nt, Human
aagaacuauugagguacacag

SEQ ID NO: 473010 - RNA, 21 nt, Human
aggcucagagaucaaacagua

SEQ ID NO: 473011 - RNA, 22 nt, Human
cugucucuguugccuguaggug

SEQ ID NO: 473012 - RNA, 22 nt, Human
gcugccugucccaggaugagga

SEQ ID NO: 473013 - RNA, 22 nt, Human
gggcugugggacccggcacuuu

SEQ ID NO: 473014 - RNA, 22 nt, Human
uggcacugccaaccugcuaggu

SEQ ID NO: 473015 - RNA, 22 nt, Human
ucagaggucacacagcaaguuu

SEQ ID NO: 473016 - RNA, 22 nt, Human
gagacacagagaggcuguguga

SEQ ID NO: 473017 - RNA, 20 nt, Human
gcugggggugugcugaguga

SEQ ID NO: 473018 - RNA, 22 nt, Human
cagauaaaggcuuacuaguagu

SEQ ID NO: 473019 - RNA, 22 nt, Human
ugugcuucagguugucgccacg

SEQ ID NO: 473020 - RNA, 22 nt, Human
aggcagugcagaguccucuucu

SEQ ID NO: 473021 - RNA, 22 nt, Human
ugcaccauuaauuuaugugaga

SEQ ID NO: 473022 - RNA, 22 nt, Human
agagccagagaccuggguucac

SEQ ID NO: 473023 - RNA, 22 nt, Human
gggcucuguccauuccuucaua

SEQ ID NO: 473024 - RNA, 23 nt, Human
gcagagcugcccuauugccuugg

SEQ ID NO: 473025 - RNA, 21 nt, Human
gcugcaucaaucuacccaggg

SEQ ID NO: 473026 - RNA, 22 nt, Human
ccagggugagaaaaggcuggau

SEQ ID NO: 473027 - RNA, 22 nt, Human
cucagcagcagggaagagguca

SEQ ID NO: 473028 - RNA, 22 nt, Human
cagcaguggccaucuguguggu

SEQ ID NO: 473029 - RNA, 18 nt, Human
gcagcugacacuggaguu

SEQ ID NO: 473030 - RNA, 22 nt, Human
uaaaucaguuucucuuauuggu

SEQ ID NO: 473031 - RNA, 19 nt, Human
ucaguggagaaaggggaag

SEQ ID NO: 473032 - RNA, 22 nt, Human
aagcugccugccacgcuagaua

SEQ ID NO: 473033 - RNA, 22 nt, Human
cuggagcauccaugcccagggu

SEQ ID NO: 473034 - RNA, 22 nt, Human
gucagaggaggcugaguaggaa

SEQ ID NO: 473035 - RNA, 22 nt, Human
uccuugaagagugggcggucga

SEQ ID NO: 473036 - RNA, 22 nt, Human
acagccugcagccccaggucgc

SEQ ID NO: 473037 - RNA, 22 nt, Human
ugggccugauucuugaauccug

SEQ ID NO: 473038 - RNA, 22 nt, Human
aagcacaaugaacaucuuagau

SEQ ID NO: 473039 - RNA, 22 nt, Human
acagcuugcaauggcuuucaac

SEQ ID NO: 473040 - RNA, 22 nt, Human
ccagccacagcuuccagcuccu

SEQ ID NO: 473041 - RNA, 22 nt, Human
acagagccacuuuggugccuac

SEQ ID NO: 473042 - RNA, 22 nt, Human
ucuuuccuaggugauaugcaau

SEQ ID NO: 473043 - RNA, 21 nt, Human
ccuggccaaucugauaggguu

SEQ ID NO: 473044 - RNA, 18 nt, Human
ggagccagucugucucug

SEQ ID NO: 473045 - RNA, 22 nt, Human
acuuugugcccaacagaaagaa

SEQ ID NO: 473046 - RNA, 22 nt, Human
agagccugaggccaggaaaaug

SEQ ID NO: 473047 - RNA, 22 nt, Human
acaguaauaaguguuggugagg

SEQ ID NO: 473048 - RNA, 22 nt, Human
ccaaagucugcauuuuaacaug

SEQ ID NO: 473049 - RNA, 22 nt, Human
caggcugcagugcaguggcuau

SEQ ID NO: 473050 - RNA, 19 nt, Human
cugaggugcaguaagaggc

SEQ ID NO: 473051 - RNA, 22 nt, Human
aaggugucacugggacaggaaa

SEQ ID NO: 473052 - RNA, 22 nt, Human
aggcacugcuucuaaguaggaa

SEQ ID NO: 473053 - RNA, 22 nt, Human
aggggcaguuccaaguuuugug

SEQ ID NO: 473054 - RNA, 22 nt, Human
agaggccagggacacugcucaa

SEQ ID NO: 473055 - RNA, 22 nt, Human
uugcauugaaaauauauuuuaa

SEQ ID NO: 473056 - RNA, 22 nt, Human
aagugguaggaagagagcacug

SEQ ID NO: 473057 - RNA, 22 nt, Human
gggcugaccccaccccucacuc

SEQ ID NO: 473058 - RNA, 22 nt, Human
uggcuuccugcauggauccucu

SEQ ID NO: 473059 - RNA, 22 nt, Human
ucugcucuaguugcuuccugcc

SEQ ID NO: 473060 - RNA, 22 nt, Human
aggccagcaagaaagagagucu

SEQ ID NO: 473061 - RNA, 22 nt, Human
ggacuggccggcgcugaggccc

SEQ ID NO: 473062 - RNA, 22 nt, Human
gggaguggagagcaauggauga

SEQ ID NO: 473063 - RNA, 22 nt, Human
gagaaggcugauccuuggaguu

SEQ ID NO: 473064 - RNA, 22 nt, Human
cacccaggacaggccagaugug

SEQ ID NO: 473065 - RNA, 22 nt, Human
cauuuacagugagaguuuuuac

SEQ ID NO: 473066 - RNA, 22 nt, Human
ggaaagaccugagauaggaaua

SEQ ID NO: 473067 - RNA, 22 nt, Human
gcacacagccagcugagggcua

SEQ ID NO: 473068 - RNA, 22 nt, Human
ggaggcuccuaagcugacuuga

SEQ ID NO: 473069 - RNA, 22 nt, Human
uggcuuccacugugugcccccu

SEQ ID NO: 473070 - RNA, 22 nt, Human
cugcagagcuaggcugagugaa

SEQ ID NO: 473071 - RNA, 22 nt, Human
uguccacaucacucacuuguca

SEQ ID NO: 473072 - RNA, 22 nt, Human
acuuugaaacuaaaauucauua

SEQ ID NO: 473073 - RNA, 22 nt, Human
cucaggaggugguagaggcccu

SEQ ID NO: 473074 - RNA, 22 nt, Human
uuauguaccugaauuaguaaag

SEQ ID NO: 473075 - RNA, 22 nt, Human
cggggcugcucguccuccugug

SEQ ID NO: 473076 - RNA, 20 nt, Human
aaagucuguuuaucucugga

SEQ ID NO: 473077 - RNA, 22 nt, Human
aggcagcagacuguuaaucaga

SEQ ID NO: 473078 - RNA, 22 nt, Human
ccuggcuuccuggagcucacaa

SEQ ID NO: 473079 - RNA, 18 nt, Human
gguggcucagucaugggg

SEQ ID NO: 473080 - RNA, 18 nt, Human
uggcagccagcugcuccu

SEQ ID NO: 473081 - RNA, 22 nt, Human
ugcuggaggcaguggaggugcc

SEQ ID NO: 473082 - RNA, 22 nt, Human
ggcacugaaguggguguugggu

SEQ ID NO: 473083 - RNA, 22 nt, Human
ggcugccugaggcagugagaga

SEQ ID NO: 473084 - RNA, 22 nt, Human
uauuucugggaguucagaaauu

SEQ ID NO: 473085 - RNA, 22 nt, Human
ucuccacucugagugccuuuca

SEQ ID NO: 473086 - RNA, 22 nt, Human
ucucugagcccagugucccccu

SEQ ID NO: 473087 - RNA, 22 nt, Human
cauugcacgggcgucugucugu

SEQ ID NO: 473088 - RNA, 22 nt, Human
gcagcuuugaagacuuauuugc

SEQ ID NO: 473089 - RNA, 22 nt, Human
agggcaaguugagugugcgugg

SEQ ID NO: 473090 - RNA, 20 nt, Human
ggcagggcaucaacagcucu

SEQ ID NO: 473091 - RNA, 22 nt, Human
uccaucuguuuacuauaaagau

SEQ ID NO: 473092 - RNA, 22 nt, Human
cuuccucccccacacacucacu

SEQ ID NO: 473093 - RNA, 22 nt, Human
agagccuggcucccagcuaccg

SEQ ID NO: 473094 - RNA, 22 nt, Human
cugcuuuagacaacugcuggga

SEQ ID NO: 473095 - RNA, 22 nt, Human
ucaccccuacauuucccuugcu

SEQ ID NO: 473096 - RNA, 21 nt, Human
gauuucacuuaccuucauuua

SEQ ID NO: 473097 - RNA, 20 nt, Human
cugcucugcuuugcaggugg

SEQ ID NO: 473098 - RNA, 22 nt, Human
ugaagccacagagcaucugccu

SEQ ID NO: 473099 - RNA, 22 nt, Human
augaagcugaccuugucuugcu

SEQ ID NO: 473100 - RNA, 22 nt, Human
aucagcaagauguaauuucuau

SEQ ID NO: 473101 - RNA, 22 nt, Human
uuuucucuacaaaauaaccagc

SEQ ID NO: 473102 - RNA, 22 nt, Human
ugcugccaccccucaccagagc

SEQ ID NO: 473103 - RNA, 22 nt, Human
caggcagccuucucgucucaca

SEQ ID NO: 473104 - RNA, 22 nt, Human
accaggcacuccugaggucuga

SEQ ID NO: 473105 - RNA, 22 nt, Human
aguggcagagcugugucuugaa

SEQ ID NO: 473106 - RNA, 22 nt, Human
acccugggucauauacagugug

SEQ ID NO: 473107 - RNA, 22 nt, Human
uaaaugugucuuuuuaaggccu

SEQ ID NO: 473108 - RNA, 22 nt, Human
ggcagcuggguuggccagaaac

SEQ ID NO: 473109 - RNA, 22 nt, Human
gagcuuccugaugccgaccagu

SEQ ID NO: 473110 - RNA, 22 nt, Human
auaaaacuuauuagaauugugu

SEQ ID NO: 473111 - RNA, 18 nt, Human
cucaccauucugcccaau

SEQ ID NO: 473112 - RNA, 18 nt, Human
uggugaaggguggaggag

SEQ ID NO: 473113 - RNA, 20 nt, Human
gccaggcacuguucucaaua

SEQ ID NO: 473114 - RNA, 22 nt, Human
ggcucagguuuccuucccagcu

SEQ ID NO: 473115 - RNA, 22 nt, Human
gggagcugagcuggaagagaau

SEQ ID NO: 473116 - RNA, 22 nt, Human
ucugcuguaaagaauuucugcc

SEQ ID NO: 473117 - RNA, 22 nt, Human
caccagggacaaugcuaggggu

SEQ ID NO: 473118 - RNA, 22 nt, Human
ugggcaagucacuucugucuuu

SEQ ID NO: 473119 - RNA, 22 nt, Human
agggaagaagcugguaguaggu

SEQ ID NO: 473120 - RNA, 22 nt, Human
ucaguuuucauuucaugagcag

SEQ ID NO: 473121 - RNA, 22 nt, Human
gccaggcugcuggcugcugucc

SEQ ID NO: 473122 - RNA, 22 nt, Human
gaggaagcagggcuuggcugag

SEQ ID NO: 473123 - RNA, 22 nt, Human
aacaguaucuuuuaucagaaau

SEQ ID NO: 473124 - RNA, 22 nt, Human
gucugaggaagaugcaggggga

SEQ ID NO: 473125 - RNA, 22 nt, Human
gggaccugggccagaggacagu

SEQ ID NO: 473126 - RNA, 22 nt, Human
ugcagcucauugguguccuggu

SEQ ID NO: 473127 - RNA, 22 nt, Human
ucaggcagaggauggggagcgu

SEQ ID NO: 473128 - RNA, 22 nt, Human
gcccucugcacagcucugagca

SEQ ID NO: 473129 - RNA, 22 nt, Human
aacuuucaggcaaugaauauuu

SEQ ID NO: 473130 - RNA, 22 nt, Human
gcagcuggaagugacacucugu

SEQ ID NO: 473131 - RNA, 22 nt, Human
ugagaaccaugaaaagcuguca

SEQ ID NO: 473132 - RNA, 22 nt, Human
ugugucaauuuucauuccuacu

SEQ ID NO: 473133 - RNA, 23 nt, Human
cugcuguguuggucucgauggga

SEQ ID NO: 473134 - RNA, 22 nt, Human
uggccuggggaagaccaugggc

SEQ ID NO: 473135 - RNA, 22 nt, Human
augaggcaucuaacauugcaaa

SEQ ID NO: 473136 - RNA, 22 nt, Human
uggcugggugcuauccaguacu

SEQ ID NO: 473137 - RNA, 22 nt, Human
uggagggcaucuguggucaggc

SEQ ID NO: 473138 - RNA, 22 nt, Human
ugaaggaaaugacggcagaaga

SEQ ID NO: 473139 - RNA, 22 nt, Human
cugagaggcggagcuugcagug

SEQ ID NO: 473140 - RNA, 22 nt, Human
aaaauuuccaccaucuuugugu

SEQ ID NO: 473141 - RNA, 22 nt, Human
cccagcccugaccuauuggaaa

SEQ ID NO: 473142 - RNA, 17 nt, Human
auuuccucagggcugag

SEQ ID NO: 473143 - RNA, 22 nt, Human
cugcucugacccuuucaccuuc

SEQ ID NO: 473144 - RNA, 22 nt, Human
cagggccagcgucucgggcuau

SEQ ID NO: 473145 - RNA, 22 nt, Human
agagcuggguggacuuguaguu

SEQ ID NO: 473146 - RNA, 22 nt, Human
aguuuuucugcuggucucacua

SEQ ID NO: 473147 - RNA, 22 nt, Human
gagaaagggaacuuacagagug

SEQ ID NO: 473148 - RNA, 22 nt, Human
gagugcagaugaacagaagauu

SEQ ID NO: 473149 - RNA, 22 nt, Human
aggcucagauucacauuugguu

SEQ ID NO: 473150 - RNA, 22 nt, Human
cucugagaggugagaagcagca

SEQ ID NO: 473151 - RNA, 20 nt, Human
gccuggcacccggggcuggc

SEQ ID NO: 473152 - RNA, 22 nt, Human
uagcugccagaccauucuuacu

SEQ ID NO: 473153 - RNA, 22 nt, Human
ugcucagggacaauggagaggg

SEQ ID NO: 473154 - RNA, 22 nt, Human
ccugcagacacuuguccagcaa

SEQ ID NO: 473155 - RNA, 22 nt, Human
agccaagcaccacuggcacucg

SEQ ID NO: 473156 - RNA, 22 nt, Human
cugaagcaaaugaaacagcucu

SEQ ID NO: 473157 - RNA, 22 nt, Human
uagaaaucagcaggcauaugua

SEQ ID NO: 473158 - RNA, 22 nt, Human
aaaaguucccugguuagaaaag

SEQ ID NO: 473159 - RNA, 22 nt, Human
ugcuugagacacauaugaauuu

SEQ ID NO: 473160 - RNA, 22 nt, Human
ucagaacauugacauucuuauu

SEQ ID NO: 473161 - RNA, 21 nt, Human
aauuagggugccucuuauaau

SEQ ID NO: 473162 - RNA, 22 nt, Human
augcugugucaccuuaggauuu

SEQ ID NO: 473163 - RNA, 22 nt, Human
accaaggaguuugguauuuuag

SEQ ID NO: 473164 - RNA, 22 nt, Human
cuuuauguccaccagacugcaa

SEQ ID NO: 473165 - RNA, 22 nt, Human
ccauaaggagccagacauucca

SEQ ID NO: 473166 - RNA, 22 nt, Human
gcuggcagacugggggcagaac

SEQ ID NO: 473167 - RNA, 22 nt, Human
gccaggcucagcagucaaccug

SEQ ID NO: 473168 - RNA, 22 nt, Human
ggaaccaggaguuacacgaguu

SEQ ID NO: 473169 - RNA, 22 nt, Human
gugugcagucugcuaggcaggg

SEQ ID NO: 473170 - RNA, 22 nt, Human
cauuagggccaccauaacaaaa

SEQ ID NO: 473171 - RNA, 22 nt, Human
gaacccaguccaggugcagccu

SEQ ID NO: 473172 - RNA, 22 nt, Human
cuggccagguuuugaacaguug

SEQ ID NO: 473173 - RNA, 22 nt, Human
cuuagaaaucgaacucagguua

SEQ ID NO: 473174 - RNA, 22 nt, Human
uuaaagaguaaucauaggucaa

SEQ ID NO: 473175 - RNA, 18 nt, Human
cagaaguccuucaaggcc

SEQ ID NO: 473176 - RNA, 20 nt, Human
ccaggccugggccugcucua

SEQ ID NO: 473177 - RNA, 22 nt, Human
uuccaguucccaugaggauuaa

SEQ ID NO: 473178 - RNA, 22 nt, Human
agggccagcuagagcccucgcc

SEQ ID NO: 473179 - RNA, 22 nt, Human
gggagcuguaagggacagguag

SEQ ID NO: 473180 - RNA, 22 nt, Human
guucagggagggacagaugaag

SEQ ID NO: 473181 - RNA, 22 nt, Human
cuucccugauaagagccucaga

SEQ ID NO: 473182 - RNA, 22 nt, Human
augaaaacggaccagagcuauu

SEQ ID NO: 473183 - RNA, 22 nt, Human
cagaggccucacuuccagccag

SEQ ID NO: 473184 - RNA, 22 nt, Human
cauccagggcagccauggccug

SEQ ID NO: 473185 - RNA, 19 nt, Human
agccagggugagaaggagc

SEQ ID NO: 473186 - RNA, 22 nt, Human
aucuggcuuaccuagggugccu

SEQ ID NO: 473187 - RNA, 22 nt, Human
cggcugugucuucacaggagcc

SEQ ID NO: 473188 - RNA, 22 nt, Human
gcagugaagccagaucugaaau

SEQ ID NO: 473189 - RNA, 22 nt, Human
agagccugggcagcuccucugg

SEQ ID NO: 473190 - RNA, 22 nt, Human
cugccuggggaaugugaggauu

SEQ ID NO: 473191 - RNA, 22 nt, Human
gaggcacaucacuuggugcauu

SEQ ID NO: 473192 - RNA, 22 nt, Human
gggcccagcgugguuccaucug

SEQ ID NO: 473193 - RNA, 22 nt, Human
ugguuacacagcauguggacuu

SEQ ID NO: 473194 - RNA, 22 nt, Human
uuuauuccaugugucuaugacc

SEQ ID NO: 473195 - RNA, 22 nt, Human
gcagcugauggaaguccuauug

SEQ ID NO: 473196 - RNA, 22 nt, Human
gccuggcaggggccugggagug

SEQ ID NO: 473197 - RNA, 22 nt, Human
agcagagcggggccuccggaag

SEQ ID NO: 473198 - RNA, 18 nt, Human
ugagaggcagguagagga

SEQ ID NO: 473199 - RNA, 22 nt, Human
aguaggaggcgggagcaugaag

SEQ ID NO: 473200 - RNA, 22 nt, Human
ggccucaguuucuucaacugua

SEQ ID NO: 473201 - RNA, 22 nt, Human
agcugggagcagagccacagcc

SEQ ID NO: 473202 - RNA, 22 nt, Human
aguguggcugcguagggcucuc

SEQ ID NO: 473203 - RNA, 22 nt, Human
ccugcaggggagagacuucuag

SEQ ID NO: 473204 - RNA, 16 nt, Human
gaggcuggcagauguc

SEQ ID NO: 473205 - RNA, 22 nt, Human
ggaugcaggacggcauggaugu

SEQ ID NO: 473206 - RNA, 22 nt, Human
ccugagaggcccucucacuguc

SEQ ID NO: 473207 - RNA, 22 nt, Human
ucaaaguuuguggcaauuuauu

SEQ ID NO: 473208 - RNA, 23 nt, Human
uggauaaagcugugcugcauagg

SEQ ID NO: 473209 - RNA, 20 nt, Human
uagggcucauuaugaucucc

SEQ ID NO: 473210 - RNA, 22 nt, Human
augaggcagcugcuggagaacg

SEQ ID NO: 473211 - RNA, 22 nt, Human
caagaugaaacuacagggagga

SEQ ID NO: 473212 - RNA, 22 nt, Human
gcacacacuguuuuccucacau

SEQ ID NO: 473213 - RNA, 22 nt, Human
ugggcagggaucucuuuugcaa

SEQ ID NO: 473214 - RNA, 19 nt, Human
uagcugccuguuaccucca

SEQ ID NO: 473215 - RNA, 22 nt, Human
acagcuggcaggggggcaugaa

SEQ ID NO: 473216 - RNA, 22 nt, Human
gggggaagacugggcuagugau

SEQ ID NO: 473217 - RNA, 22 nt, Human
agccccucuguggcucugccuc

SEQ ID NO: 473218 - RNA, 22 nt, Human
ggaggccaaggcagguggaucg

SEQ ID NO: 473219 - RNA, 22 nt, Human
ggcaggagggcggacaaugacc

SEQ ID NO: 473220 - RNA, 22 nt, Human
gcagcuuuguaaaguaugaagc

SEQ ID NO: 473221 - RNA, 22 nt, Human
ccagagaggccuuggcaagaca

SEQ ID NO: 473222 - RNA, 22 nt, Human
cacaagagagugcgcguugcaa

SEQ ID NO: 473223 - RNA, 22 nt, Human
cagggcucaggcucugggauuc

SEQ ID NO: 473224 - RNA, 21 nt, Human
guuugcaugaacaagucagcc

SEQ ID NO: 473225 - RNA, 22 nt, Human
aagggcugcaauccaaaacacu

SEQ ID NO: 473226 - RNA, 22 nt, Human
agccucucuuuauucccagcua

SEQ ID NO: 473227 - RNA, 22 nt, Human
ugcccaggaucuggcgaugcuc

SEQ ID NO: 473228 - RNA, 22 nt, Human
caauuucugggccucacacaag

SEQ ID NO: 473229 - RNA, 22 nt, Human
agagggaaugugauugcaccau

SEQ ID NO: 473230 - RNA, 22 nt, Human
aggcucagcugguggugaucgc

SEQ ID NO: 473231 - RNA, 22 nt, Human
augcucugggcaggagcccugg

SEQ ID NO: 473232 - RNA, 22 nt, Human
cccagccucuggauucugcccu

SEQ ID NO: 473233 - RNA, 22 nt, Human
uugggcugaaguagagggcaga

SEQ ID NO: 473234 - RNA, 22 nt, Human
uguugauuaguguuuagacuua

SEQ ID NO: 473235 - RNA, 22 nt, Human
uccaggcugggcugaagggugc

SEQ ID NO: 473236 - RNA, 22 nt, Human
ccagggucuuggagaggagugc

SEQ ID NO: 473237 - RNA, 22 nt, Human
cacccagggcugugccugccca

SEQ ID NO: 473238 - RNA, 22 nt, Human
gacccuggaguuaguccugugu

SEQ ID NO: 473239 - RNA, 22 nt, Human
guggagacgggacagaagcuaa

SEQ ID NO: 473240 - RNA, 22 nt, Human
ggaagaagggucauuggcagcc

SEQ ID NO: 473241 - RNA, 22 nt, Human
aaggcagccucugccagccggg

SEQ ID NO: 473242 - RNA, 21 nt, Human
ugggcacugagggugcugcuc

SEQ ID NO: 473243 - RNA, 22 nt, Human
ugugaaggagaugaagggagug

SEQ ID NO: 473244 - RNA, 22 nt, Human
aaugaucuggcucaggauauca

SEQ ID NO: 473245 - RNA, 22 nt, Human
gccuugcuuugcuucuggacag

SEQ ID NO: 473246 - RNA, 22 nt, Human
cauguuaaugaauuuuugcagu

SEQ ID NO: 473247 - RNA, 20 nt, Human
uggagccaaggugugucugg

SEQ ID NO: 473248 - RNA, 22 nt, Human
acauuucuggaguuucucaaca

SEQ ID NO: 473249 - RNA, 22 nt, Human
cagcagagcauuugguaggagg

SEQ ID NO: 473250 - RNA, 20 nt, Human
gucagaggacccuagagcga

SEQ ID NO: 473251 - RNA, 22 nt, Human
gcuggcuccucuguccucacgg

SEQ ID NO: 473252 - RNA, 22 nt, Human
agaaaugggccuugggacacaa

SEQ ID NO: 473253 - RNA, 22 nt, Human
ugagcagaacacgggauccaug

SEQ ID NO: 473254 - RNA, 22 nt, Human
uggcccugcuggccaaaggcua

SEQ ID NO: 473255 - RNA, 22 nt, Human
aaaaccaggcguuuccuauuau

SEQ ID NO: 473256 - RNA, 22 nt, Human
uucugugcccauuuuaaaaugg

SEQ ID NO: 473257 - RNA, 22 nt, Human
uggguagagcaggcuggggcuu

SEQ ID NO: 473258 - RNA, 22 nt, Human
uggaggaaguggcuggccagaa

SEQ ID NO: 473259 - RNA, 22 nt, Human
ccugccugucccucaguccaca

SEQ ID NO: 473260 - RNA, 22 nt, Human
ucucugagcugcuucuugcaua

SEQ ID NO: 473261 - RNA, 22 nt, Human
ggaggcccagagaggugaagug

SEQ ID NO: 473262 - RNA, 22 nt, Human
guaucacuuuugagagugagaa

SEQ ID NO: 473263 - RNA, 22 nt, Human
gcuguggaugcuauggaucauc

SEQ ID NO: 473264 - RNA, 17 nt, Human
agcagcuggguugaucu

SEQ ID NO: 473265 - RNA, 17 nt, Human
ccugggaggaguuauga

SEQ ID NO: 473266 - RNA, 22 nt, Human
gcagagcaccaaagugaaagau

SEQ ID NO: 473267 - RNA, 22 nt, Human
auguacauuuagaucauuucug

SEQ ID NO: 473268 - RNA, 22 nt, Human
acugucugcuggccccugguua

SEQ ID NO: 473269 - RNA, 22 nt, Human
ucugagcuuuuauuaucaaccu

SEQ ID NO: 473270 - RNA, 22 nt, Human
uggggacacagagccaaacuau

SEQ ID NO: 473271 - RNA, 22 nt, Human
cauguacaguuuuucuguccug

SEQ ID NO: 473272 - RNA, 22 nt, Human
guggcugguuuccugcaugcaa

SEQ ID NO: 473273 - RNA, 22 nt, Human
cccuguccuggaugggagcacu

SEQ ID NO: 473274 - RNA, 22 nt, Human
gcucuguacgcaggaugagggg

SEQ ID NO: 473275 - RNA, 22 nt, Human
cugggcaggagggcucuaugga

SEQ ID NO: 473276 - RNA, 22 nt, Human
cccuggcaaaacacucucuuga

SEQ ID NO: 473277 - RNA, 18 nt, Human
ggcugugcguggaggcug

SEQ ID NO: 473278 - RNA, 22 nt, Human
uguaucaaggguuuauguaagc

SEQ ID NO: 473279 - RNA, 22 nt, Human
ggcagcugauuagcaucaagga

SEQ ID NO: 473280 - RNA, 22 nt, Human
uccagggaaggugugaggcugg

SEQ ID NO: 473281 - RNA, 22 nt, Human
uacuuccuguuuccaugucugu

SEQ ID NO: 473282 - RNA, 23 nt, Human
ugggggugcacgggccacaucuu

SEQ ID NO: 473283 - RNA, 22 nt, Human
cagucucugugccagauccugg

SEQ ID NO: 473284 - RNA, 22 nt, Human
agagauaugaguaguugugaca

SEQ ID NO: 473285 - RNA, 22 nt, Human
cugggugguuuugaugugaauu

SEQ ID NO: 473286 - RNA, 22 nt, Human
agcaggaguguccccuggcugu

SEQ ID NO: 473287 - RNA, 22 nt, Human
agguggggaaaccagcgauccc

SEQ ID NO: 473288 - RNA, 22 nt, Human
ucucuuaaaagauuuuaaugac

SEQ ID NO: 473289 - RNA, 19 nt, Human
uggccagguacugucugcu

SEQ ID NO: 473290 - RNA, 21 nt, Human
uguuuauggaaaagagacaaa

SEQ ID NO: 473291 - RNA, 22 nt, Human
augagacuaccuguaauguggc

SEQ ID NO: 473292 - RNA, 22 nt, Human
ccugccagugaagcugacgggc

SEQ ID NO: 473293 - RNA, 22 nt, Human
agccaggaauuggacaacacau

SEQ ID NO: 473294 - RNA, 22 nt, Human
gcucaagggaugggagugggug

SEQ ID NO: 473295 - RNA, 22 nt, Human
cauuuguacagaacagcuuuau

SEQ ID NO: 473296 - RNA, 17 nt, Human
gggcagggacuccuggg

SEQ ID NO: 473297 - RNA, 22 nt, Human
acugucacuccaacugagucgu

SEQ ID NO: 473298 - RNA, 21 nt, Human
aggggacagaguagcuccagg

SEQ ID NO: 473299 - RNA, 22 nt, Human
ucaaaugcucuuugcagagagg

SEQ ID NO: 473300 - RNA, 22 nt, Human
ccagucacuggaaaaugggaau

SEQ ID NO: 473301 - RNA, 22 nt, Human
aggaagugaaagggaaggaguu

SEQ ID NO: 473302 - RNA, 22 nt, Human
gcugcagcucgccuuccggccu

SEQ ID NO: 473303 - RNA, 22 nt, Human
ugccaggcccagcagggcggcc

SEQ ID NO: 473304 - RNA, 23 nt, Human
aguguuccaguugguugagagug

SEQ ID NO: 473305 - RNA, 22 nt, Human
ggcucuggugugaagcagccuc

SEQ ID NO: 473306 - RNA, 22 nt, Human
gagggcugauaaaugcgcaugg

SEQ ID NO: 473307 - RNA, 22 nt, Human
ugcacuccaggcugggugacag

SEQ ID NO: 473308 - RNA, 22 nt, Human
ccagagcagauguggccuuggu

SEQ ID NO: 473309 - RNA, 22 nt, Human
cagcccagcagggucuggcccu

SEQ ID NO: 473310 - RNA, 22 nt, Human
augcuguguuugagaaccuagg

SEQ ID NO: 473311 - RNA, 22 nt, Human
ucccagggacugggcuaggcuu

SEQ ID NO: 473312 - RNA, 22 nt, Human
guucacauccuugugaggauuu

SEQ ID NO: 473313 - RNA, 22 nt, Human
ucagcauaucuugagcuucaug

SEQ ID NO: 473314 - RNA, 22 nt, Human
ugugugcauucacaugcaugcc

SEQ ID NO: 473315 - RNA, 22 nt, Human
gaaggagacccugaagaugcug

SEQ ID NO: 473316 - RNA, 23 nt, Human
gggcugcuccaggccaaggcugg

SEQ ID NO: 473317 - RNA, 22 nt, Human
gcagcugccccgacugugaguc

SEQ ID NO: 473318 - RNA, 22 nt, Human
ucagccugcuccaagugcugcc

SEQ ID NO: 473319 - RNA, 22 nt, Human
caaugauucugcaacugugugc

SEQ ID NO: 473320 - RNA, 20 nt, Human
agucccuuuggucagguauu

SEQ ID NO: 473321 - RNA, 22 nt, Human
aggcugagucgggaggaucacu

SEQ ID NO: 473322 - RNA, 23 nt, Human
gccugggacucaggaggagcuca

SEQ ID NO: 473323 - RNA, 22 nt, Human
cggcagagcggcgagccccucc

SEQ ID NO: 473324 - RNA, 22 nt, Human
uagagcuggccgggacagcugg

SEQ ID NO: 473325 - RNA, 22 nt, Human
augcucuggaguacgugaaauu

SEQ ID NO: 473326 - RNA, 22 nt, Human
uuguuacaucuuauguaagugg

SEQ ID NO: 473327 - RNA, 22 nt, Human
uggcacugggacagaugcucuc

SEQ ID NO: 473328 - RNA, 19 nt, Human
ugagagugaggaaggcuuc

SEQ ID NO: 473329 - RNA, 22 nt, Human
ugccugaggagucagggcaggu

SEQ ID NO: 473330 - RNA, 22 nt, Human
ggugaaggcacaagagggcaag

SEQ ID NO: 473331 - RNA, 22 nt, Human
acuggcagccacaacuggcagg

SEQ ID NO: 473332 - RNA, 22 nt, Human
ggagucaggagcaggcugggcu

SEQ ID NO: 473333 - RNA, 22 nt, Human
acaaagguggaccauguggcuu

SEQ ID NO: 473334 - RNA, 22 nt, Human
augauacaucuucaugucagug

SEQ ID NO: 473335 - RNA, 20 nt, Human
uccaggcagacagcuauggg

SEQ ID NO: 473336 - RNA, 22 nt, Human
ugggaaugugagcauucauuca

SEQ ID NO: 473337 - RNA, 22 nt, Human
ugagcuggucuugaguguagcu

SEQ ID NO: 473338 - RNA, 22 nt, Human
cagagcaguaaaucuggggcac

SEQ ID NO: 473339 - RNA, 22 nt, Human
ggcucagguugggucacaugac

SEQ ID NO: 473340 - RNA, 22 nt, Human
accugccuucucaaggacauga

SEQ ID NO: 473341 - RNA, 22 nt, Human
acaaguggguccuacauaaagc

SEQ ID NO: 473342 - RNA, 22 nt, Human
ccuguggcugccacuuggguga

SEQ ID NO: 473343 - RNA, 22 nt, Human
ugauuuuuagcuauucugaaga

SEQ ID NO: 473344 - RNA, 22 nt, Human
ccugugcccucagccuggcucu

SEQ ID NO: 473345 - RNA, 22 nt, Human
gggagggaaagcuugaucuguc

SEQ ID NO: 473346 - RNA, 22 nt, Human
uguuuguucccucucuuuccug

SEQ ID NO: 473347 - RNA, 22 nt, Human
aguuuucuguucuacaauuuga

SEQ ID NO: 473348 - RNA, 22 nt, Human
cuuuuuccagcuucaggguggg

SEQ ID NO: 473349 - RNA, 22 nt, Human
gggaguggguuuggccuaggcc

SEQ ID NO: 473350 - RNA, 22 nt, Human
acuuugcacuaaguuacucauu

SEQ ID NO: 473351 - RNA, 22 nt, Human
cugucccagauguucucagcac

SEQ ID NO: 473352 - RNA, 22 nt, Human
uucacaggauauaugugcaggg

SEQ ID NO: 473353 - RNA, 22 nt, Human
ggcaguggguuccccaaggcac

SEQ ID NO: 473354 - RNA, 22 nt, Human
ucaguggaguauggaugaaguc

SEQ ID NO: 473355 - RNA, 22 nt, Human
ugcaggcaggggaugagcagcc

SEQ ID NO: 473356 - RNA, 22 nt, Human
ucagagcuuaucucuugcugga

SEQ ID NO: 473357 - RNA, 22 nt, Human
gagucacaaagccuuucuuauu

SEQ ID NO: 473358 - RNA, 22 nt, Human
gcagacuggucuucagccuugg

SEQ ID NO: 473359 - RNA, 22 nt, Human
gacauaauccuccucaccuacu

SEQ ID NO: 473360 - RNA, 22 nt, Human
cugaagcaaaggaucgagcuaa

SEQ ID NO: 473361 - RNA, 20 nt, Human
cugcugugauucccuccucc

SEQ ID NO: 473362 - RNA, 22 nt, Human
cauacuuugggauaagagugga

SEQ ID NO: 473363 - RNA, 22 nt, Human
ccaguggacaauuucugaggaa

SEQ ID NO: 473364 - RNA, 23 nt, Human
uaaagacagccuucaggauucug

SEQ ID NO: 473365 - RNA, 21 nt, Human
gccacugcacuccagccuggg

SEQ ID NO: 473366 - RNA, 22 nt, Human
aggaccagaggccagagucagc

SEQ ID NO: 473367 - RNA, 20 nt, Human
acccagcucugugcccuggg

SEQ ID NO: 473368 - RNA, 22 nt, Human
agggcccuagggaaugagacau

SEQ ID NO: 473369 - RNA, 21 nt, Human
aggaaaggccagcacguaggg

SEQ ID NO: 473370 - RNA, 22 nt, Human
gcugagcugcuguucauccugc

SEQ ID NO: 473371 - RNA, 22 nt, Human
uaguccauuuucacacugcuga

SEQ ID NO: 473372 - RNA, 22 nt, Human
uggcuuccaaaggaaugggccu

SEQ ID NO: 473373 - RNA, 18 nt, Human
ggcugagguugacuagaa

SEQ ID NO: 473374 - RNA, 22 nt, Human
guggcagcggcccaggccgucu

SEQ ID NO: 473375 - RNA, 21 nt, Human
cgcagagcgaacuugcggcgc

SEQ ID NO: 473376 - RNA, 22 nt, Human
cauuuagacauuugauuugggg

SEQ ID NO: 473377 - RNA, 22 nt, Human
cuggcagguuuggugucuggug

SEQ ID NO: 473378 - RNA, 22 nt, Human
cagagccauuauggagacuugc

SEQ ID NO: 473379 - RNA, 22 nt, Human
agugccuggaccccaugacaua

SEQ ID NO: 473380 - RNA, 22 nt, Human
uuggcuuccaggaucucagcag

SEQ ID NO: 473381 - RNA, 22 nt, Human
gggacuggaguagaggccggug

SEQ ID NO: 473382 - RNA, 22 nt, Human
ugggcagagaucuggaucaaac

SEQ ID NO: 473383 - RNA, 22 nt, Human
ccucuuccacugggccccaucc

SEQ ID NO: 473384 - RNA, 22 nt, Human
caagagcauuuaguuagcuggu

SEQ ID NO: 473385 - RNA, 22 nt, Human
gcguggugcugcccugcacaca

SEQ ID NO: 473386 - RNA, 22 nt, Human
agccucugauggcucccaagga

SEQ ID NO: 473387 - RNA, 18 nt, Human
gagcccugagucugcaca

SEQ ID NO: 473388 - RNA, 22 nt, Human
ccugaggggcugcaggccagcu

SEQ ID NO: 473389 - RNA, 22 nt, Human
agccaggcagggcucucgcucu

SEQ ID NO: 473390 - RNA, 22 nt, Human
cagcccagcacuaaguagauuu

SEQ ID NO: 473391 - RNA, 22 nt, Human
aaacauugcuaaauaaugcugc

SEQ ID NO: 473392 - RNA, 22 nt, Human
gccucugcggagcuguacauca

SEQ ID NO: 473393 - RNA, 21 nt, Human
gcagacugcccugcugucccc

SEQ ID NO: 473394 - RNA, 20 nt, Human
aggcugaguucuaugcacuu

SEQ ID NO: 473395 - RNA, 22 nt, Human
uuuaauuuuccugguaggccug

SEQ ID NO: 473396 - RNA, 19 nt, Human
acaaacugaguacacuugu

SEQ ID NO: 473397 - RNA, 22 nt, Human
ucagggacuaggugcugccuga

SEQ ID NO: 473398 - RNA, 22 nt, Human
cacaagucuguggucuccaaca

SEQ ID NO: 473399 - RNA, 22 nt, Human
aucccaugagaccacguuggcu

SEQ ID NO: 473400 - RNA, 22 nt, Human
uuucagaugcaauuaauuuuca

SEQ ID NO: 473401 - RNA, 22 nt, Human
agggccugacacccuugccagc

SEQ ID NO: 473402 - RNA, 22 nt, Human
ggaggugggagacauaggcggc

SEQ ID NO: 473403 - RNA, 22 nt, Human
uacaugcuccacuuucuccugu

SEQ ID NO: 473404 - RNA, 22 nt, Human
acauuucucauucuccccuaac

SEQ ID NO: 473405 - RNA, 22 nt, Human
augaaaaguucgaucuagaagg

SEQ ID NO: 473406 - RNA, 22 nt, Human
cacagggcagguacucucagag

SEQ ID NO: 473407 - RNA, 22 nt, Human
agagcccucucauuggcuuauu

SEQ ID NO: 473408 - RNA, 22 nt, Human
guggcagguuauaagcaucuca

SEQ ID NO: 473409 - RNA, 22 nt, Human
ugccugggaaccaauccuggcu

SEQ ID NO: 473410 - RNA, 22 nt, Human
cagagccaggccugcccucuuu

SEQ ID NO: 473411 - RNA, 22 nt, Human
aaagauucgagcgauguauaaa

SEQ ID NO: 473412 - RNA, 22 nt, Human
ggcaggaggaagaguuagcacc

SEQ ID NO: 473413 - RNA, 20 nt, Human
caccaggcgcucugagaaca

SEQ ID NO: 473414 - RNA, 22 nt, Human
cccagccuuugcuuccugguuc

SEQ ID NO: 473415 - RNA, 22 nt, Human
gaaaugugugacaaguuucaau

SEQ ID NO: 473416 - RNA, 23 nt, Human
uccucccaaauuucagccucauu

SEQ ID NO: 473417 - RNA, 22 nt, Human
cugugcaguggcagcguguggg

SEQ ID NO: 473418 - RNA, 22 nt, Human
acacuguaaauugagugcguga

SEQ ID NO: 473419 - RNA, 21 nt, Human
aaacugaagagacaggaacuu

SEQ ID NO: 473420 - RNA, 22 nt, Human
auuucuacaguacacaugcauu

SEQ ID NO: 473421 - RNA, 22 nt, Human
uaguuacagcaggcaggauaua

SEQ ID NO: 473422 - RNA, 22 nt, Human
gcagauggcugagccugcagau

SEQ ID NO: 473423 - RNA, 22 nt, Human
auacaucucauguaagagauaa

SEQ ID NO: 473424 - RNA, 18 nt, Human
auccuugaugagaggucu

SEQ ID NO: 473425 - RNA, 22 nt, Human
gcagcugggccccagccucucc

SEQ ID NO: 473426 - RNA, 20 nt, Human
cucugcagcaaggccugggu

SEQ ID NO: 473427 - RNA, 22 nt, Human
gcucccagcaauugaggcagcc

SEQ ID NO: 473428 - RNA, 22 nt, Human
ucugucacaauuugcuuacucu

SEQ ID NO: 473429 - RNA, 22 nt, Human
gcagagccuugcgucaugugcc

SEQ ID NO: 473430 - RNA, 22 nt, Human
uucaagguaugguagcugguca

SEQ ID NO: 473431 - RNA, 22 nt, Human
aaagccacugcauguguaguau

SEQ ID NO: 473432 - RNA, 17 nt, Human
cauguguaugugggagu

SEQ ID NO: 473433 - RNA, 22 nt, Human
uuccuucucagcccucgaggau

SEQ ID NO: 473434 - RNA, 22 nt, Human
uugugaaauguuucaaaauagu

SEQ ID NO: 473435 - RNA, 21 nt, Human
cagagcugaaggguguagugu

SEQ ID NO: 473436 - RNA, 23 nt, Human
uucauuugucuacuucacuuguu

SEQ ID NO: 473437 - RNA, 21 nt, Human
ugauuuccaucuuaaaauaaa

SEQ ID NO: 473438 - RNA, 22 nt, Human
gggaugucacugugccuggcac

SEQ ID NO: 473439 - RNA, 22 nt, Human
gccuggagggcucuagagaggc

SEQ ID NO: 473440 - RNA, 22 nt, Human
ucugggcuuuacacugugcuua

SEQ ID NO: 473441 - RNA, 19 nt, Human
cacagggcaggucucaugu

SEQ ID NO: 473442 - RNA, 22 nt, Human
accugcagguguuuccacacuu

SEQ ID NO: 473443 - RNA, 22 nt, Human
aggagccaggaaaccugcucug

SEQ ID NO: 473444 - RNA, 22 nt, Human
ccugcucagagcgucuugugug

SEQ ID NO: 473445 - RNA, 22 nt, Human
gagggaccuuuacacagacauu

SEQ ID NO: 473446 - RNA, 19 nt, Human
gcuucccaccagccagccc

SEQ ID NO: 473447 - RNA, 22 nt, Human
uggccugcuuucauuugaugcu

SEQ ID NO: 473448 - RNA, 22 nt, Human
cugggguggauggguccaaguu

SEQ ID NO: 473449 - RNA, 17 nt, Human
ggcugcugugcuggugc

SEQ ID NO: 473450 - RNA, 19 nt, Human
ugaaacaaacuuaaaagga

SEQ ID NO: 473451 - RNA, 22 nt, Human
ugagguaggugguaagagauac

SEQ ID NO: 473452 - RNA, 22 nt, Human
acuguacacagugguguacugu

SEQ ID NO: 473453 - RNA, 22 nt, Human
uaguuuuuucaacaaauggugc

SEQ ID NO: 473454 - RNA, 22 nt, Human
gggagggaucugcuaggcaaug

SEQ ID NO: 473455 - RNA, 22 nt, Human
ggcuuuauuaacucauccguaa

SEQ ID NO: 473456 - RNA, 22 nt, Human
cccaguggagauaggagugugg

SEQ ID NO: 473457 - RNA, 21 nt, Human
uccugcaggaggccugagagg

SEQ ID NO: 473458 - RNA, 22 nt, Human
auuauucuuaugucaucauggc

SEQ ID NO: 473459 - RNA, 22 nt, Human
uuucacauaaauauuaugccua

SEQ ID NO: 473460 - RNA, 22 nt, Human
ucaggauaaaauguaauggcaa

SEQ ID NO: 473461 - RNA, 22 nt, Human
gcagugguggagcuuacauauc

SEQ ID NO: 473462 - RNA, 22 nt, Human
ccugccagcauggcuuaucucc

SEQ ID NO: 473463 - RNA, 22 nt, Human
uggccugauuuugcuaagagaa

SEQ ID NO: 473464 - RNA, 22 nt, Human
gcugaguugaaagcagaggaua

SEQ ID NO: 473465 - RNA, 22 nt, Human
ccuggaaggugaugguacagca

SEQ ID NO: 473466 - RNA, 22 nt, Human
ggcccaucucuugcucuggguu

SEQ ID NO: 473467 - RNA, 22 nt, Human
gggugggagucuggcccucaaa

SEQ ID NO: 473468 - RNA, 18 nt, Human
agggucagugucacuggc

SEQ ID NO: 473469 - RNA, 22 nt, Human
caggagccccaggcugacaaua

SEQ ID NO: 473470 - RNA, 22 nt, Human
cuguccccgcgaguccagagcu

SEQ ID NO: 473471 - RNA, 22 nt, Human
gcugcccaguucugcugcugcc

SEQ ID NO: 473472 - RNA, 22 nt, Human
aaggaagaagacucuuuacucc

SEQ ID NO: 473473 - RNA, 22 nt, Human
uguaugugcuugagaagguggg

SEQ ID NO: 473474 - RNA, 19 nt, Human
aguguguacugaaagcacu

SEQ ID NO: 473475 - RNA, 18 nt, Human
agagcagcggcaucacac

SEQ ID NO: 473476 - RNA, 22 nt, Human
caggaguggugugagggacucc

SEQ ID NO: 473477 - RNA, 22 nt, Human
aacaggcaggagaauucugccu

SEQ ID NO: 473478 - RNA, 17 nt, Human
ucaugcccaacuauuac

SEQ ID NO: 473479 - RNA, 22 nt, Human
cuggugccuccucccugugcuu

SEQ ID NO: 473480 - RNA, 22 nt, Human
gagcuuuacuucugacuggugc

SEQ ID NO: 473481 - RNA, 20 nt, Human
aaggcacuaugucugcuagc

SEQ ID NO: 473482 - RNA, 22 nt, Human
acaugcuuucuagguccuucug

SEQ ID NO: 473483 - RNA, 22 nt, Human
gucuccugagacugcagucacc

SEQ ID NO: 473484 - RNA, 22 nt, Human
agaggaaguaaucaggaccugc

SEQ ID NO: 473485 - RNA, 22 nt, Human
uucaagaugccagggacgcggc

SEQ ID NO: 473486 - RNA, 22 nt, Human
caguggaggcucaagugugcuu

SEQ ID NO: 473487 - RNA, 22 nt, Human
cagcugcaggaacaaaaaugug

SEQ ID NO: 473488 - RNA, 22 nt, Human
cugccucucaggucccugagau

SEQ ID NO: 473489 - RNA, 22 nt, Human
ucagagaggauuuuaauaagug

SEQ ID NO: 473490 - RNA, 22 nt, Human
gcagccacagaggagggaugca

SEQ ID NO: 473491 - RNA, 19 nt, Human
uugaaauuguuugauaugg

SEQ ID NO: 473492 - RNA, 22 nt, Human
uggccuugggcagguggccugc

SEQ ID NO: 473493 - RNA, 22 nt, Human
caggaggcagaggaugcccagu

SEQ ID NO: 473494 - RNA, 22 nt, Human
ccucuugccaaucagcuacaga

SEQ ID NO: 473495 - RNA, 22 nt, Human
agccucucugaugugacagcua

SEQ ID NO: 473496 - RNA, 22 nt, Human
ccaaggagcugcaggcacuugu

SEQ ID NO: 473497 - RNA, 22 nt, Human
cagggcuguaaauuagugcuga

SEQ ID NO: 473498 - RNA, 22 nt, Human
acagcuguggccacuugcaucc

SEQ ID NO: 473499 - RNA, 22 nt, Human
ucuggagcgaggucccugucug

SEQ ID NO: 473500 - RNA, 19 nt, Human
agacacacuugauaugugu

SEQ ID NO: 473501 - RNA, 22 nt, Human
augcagaaggagccaugcuugc

SEQ ID NO: 473502 - RNA, 21 nt, Human
agcaacucugacuagaugagg

SEQ ID NO: 473503 - RNA, 22 nt, Human
ucuggcuccaccuccuuuacua

SEQ ID NO: 473504 - RNA, 22 nt, Human
gcuggccucuggagaagggcuu

SEQ ID NO: 473505 - RNA, 22 nt, Human
agcucccagucuccucuccaug

SEQ ID NO: 473506 - RNA, 21 nt, Human
gagugucuaauccaggcuguc

SEQ ID NO: 473507 - RNA, 22 nt, Human
aggagucagauaugggaaaguu

SEQ ID NO: 473508 - RNA, 21 nt, Human
ugcagcugacacugguaugcc

SEQ ID NO: 473509 - RNA, 22 nt, Human
gaggaccacagaugagccugca

SEQ ID NO: 473510 - RNA, 20 nt, Human
gcucccagccugcagucccc

SEQ ID NO: 473511 - RNA, 22 nt, Human
agagaagacuuacagccacagu

SEQ ID NO: 473512 - RNA, 22 nt, Human
ucaacacucuuuggcacaguua

SEQ ID NO: 473513 - RNA, 22 nt, Human
uagggcaguuauaacauuagug

SEQ ID NO: 473514 - RNA, 22 nt, Human
caggggcucccugggugccagu

SEQ ID NO: 473515 - RNA, 22 nt, Human
uuguaaaugaccuuuucuaauu

SEQ ID NO: 473516 - RNA, 22 nt, Human
ccagggugugggcgucggcacg

SEQ ID NO: 473517 - RNA, 22 nt, Human
uagcagugccaggauuuugcug

SEQ ID NO: 473518 - RNA, 22 nt, Human
caaugugguggcagaugucagu

SEQ ID NO: 473519 - RNA, 22 nt, Human
cuggccugggagcugcuagcgu

SEQ ID NO: 473520 - RNA, 22 nt, Human
ugcagaaggaggaggaaaucca

SEQ ID NO: 473521 - RNA, 18 nt, Human
gugcugugggcaguggcc

SEQ ID NO: 473522 - RNA, 22 nt, Human
uaucuguuccaggcacucagcu

SEQ ID NO: 473523 - RNA, 22 nt, Human
caaugugucaggaaaagggcca

SEQ ID NO: 473524 - RNA, 22 nt, Human
uuccucuccucacaugagucac

SEQ ID NO: 473525 - RNA, 22 nt, Human
agcugcccuuaauaggcauuca

SEQ ID NO: 473526 - RNA, 22 nt, Human
gacagagugcagggcuagaaga

SEQ ID NO: 473527 - RNA, 22 nt, Human
caguggucugugcuucuguaca

SEQ ID NO: 473528 - RNA, 22 nt, Human
gagggcagaaaauuaugcggug

SEQ ID NO: 473529 - RNA, 22 nt, Human
ucucugguggcuccaucaguag

SEQ ID NO: 473530 - RNA, 22 nt, Human
agagcugcccacacagcagauu

SEQ ID NO: 473531 - RNA, 22 nt, Human
cucagagucccuucccucgugg

SEQ ID NO: 473532 - RNA, 22 nt, Human
gacagcaggagaucaugauaga

SEQ ID NO: 473533 - RNA, 22 nt, Human
acagugugguuugagcacuggg

SEQ ID NO: 473534 - RNA, 22 nt, Human
cagcaggaaacuuaaagguaau

SEQ ID NO: 473535 - RNA, 22 nt, Human
uaaagguaguuuuaaaggugcu

SEQ ID NO: 473536 - RNA, 22 nt, Human
ugccaggcgauugcuaucagca

SEQ ID NO: 473537 - RNA, 22 nt, Human
ugcuuuauguuaucagaagggu

SEQ ID NO: 473538 - RNA, 22 nt, Human
ggagagcugguagcuggcucca

SEQ ID NO: 473539 - RNA, 22 nt, Human
uggcucagcgcggccuggucuu

SEQ ID NO: 473540 - RNA, 21 nt, Human
gaggccacuaauaggggcaga

SEQ ID NO: 473541 - RNA, 22 nt, Human
ugggcagaaggaagagccaccu

SEQ ID NO: 473542 - RNA, 22 nt, Human
cugaggugagcuucccugggcu

SEQ ID NO: 473543 - RNA, 22 nt, Human
gcugucugcaucucuagagcuu

SEQ ID NO: 473544 - RNA, 22 nt, Human
gucucagggacugcuucugggg

SEQ ID NO: 473545 - RNA, 22 nt, Human
ccagcagggaaaaacccaccaa

SEQ ID NO: 473546 - RNA, 22 nt, Human
gcagcuuuaaacauuggaaaua

SEQ ID NO: 473547 - RNA, 22 nt, Human
agacuguaauugacaugucagc

SEQ ID NO: 473548 - RNA, 17 nt, Human
acaagcaguggccaugg

SEQ ID NO: 473549 - RNA, 22 nt, Human
uggccgggccgggcgccuccac

SEQ ID NO: 473550 - RNA, 22 nt, Human
aaucaguuaggguguuaaugag

SEQ ID NO: 473551 - RNA, 22 nt, Human
gccucugcccauccaccaucag

SEQ ID NO: 473552 - RNA, 22 nt, Human
aagagaaggauucugagccugg

SEQ ID NO: 473553 - RNA, 22 nt, Human
gggagccagcagggcauggagc

SEQ ID NO: 473554 - RNA, 22 nt, Human
cgccucagccguggucaucuuc

SEQ ID NO: 473555 - RNA, 22 nt, Human
ugcugucccuaagucucuucaa

SEQ ID NO: 473556 - RNA, 22 nt, Human
ucugaggcccugcaggcagugu

SEQ ID NO: 473557 - RNA, 20 nt, Human
agcagcauuguucuagagca

SEQ ID NO: 473558 - RNA, 22 nt, Human
gagucugaugucccccaggcca

SEQ ID NO: 473559 - RNA, 22 nt, Human
cugaagcacagcauauaaauaa

SEQ ID NO: 473560 - RNA, 22 nt, Human
ggcagccauacucagaccuggg

SEQ ID NO: 473561 - RNA, 22 nt, Human
ugugcccauuacacagaggcau

SEQ ID NO: 473562 - RNA, 22 nt, Human
aacauugccaugguuaauuuua

SEQ ID NO: 473563 - RNA, 22 nt, Human
uggcugcugcuuggucuucuuc

SEQ ID NO: 473564 - RNA, 22 nt, Human
acacacaacucauuguguaaua

SEQ ID NO: 473565 - RNA, 22 nt, Human
ccaggagucuggaugagguguc

SEQ ID NO: 473566 - RNA, 22 nt, Human
acagagccuccaggagugcugg

SEQ ID NO: 473567 - RNA, 22 nt, Human
aauuuguuacacagcaauauaa

SEQ ID NO: 473568 - RNA, 22 nt, Human
ucagcaguggcucucaugcagu

SEQ ID NO: 473569 - RNA, 22 nt, Human
gcagcuuucuaagcuuuauugc

SEQ ID NO: 473570 - RNA, 22 nt, Human
ugggccugaaggagcugcgccc

SEQ ID NO: 473571 - RNA, 22 nt, Human
guccugucccccaaggcugugg

SEQ ID NO: 473572 - RNA, 19 nt, Human
cagaguacaccagauagga

SEQ ID NO: 473573 - RNA, 22 nt, Human
gccuguccacuaaacagccaag

SEQ ID NO: 473574 - RNA, 22 nt, Human
gcuggcuuugcacugggugcau

SEQ ID NO: 473575 - RNA, 22 nt, Human
aaacuguauauuuauggcaugu

SEQ ID NO: 473576 - RNA, 19 nt, Human
uacuuuuucaggacagagu

SEQ ID NO: 473577 - RNA, 22 nt, Human
cugagaggaugcugcaguggag

SEQ ID NO: 473578 - RNA, 22 nt, Human
cuuuauguccuugaagaguugu

SEQ ID NO: 473579 - RNA, 22 nt, Human
uucagucagugacuaagcaguu

SEQ ID NO: 473580 - RNA, 22 nt, Human
aaauguguuucgaaaacuggug

SEQ ID NO: 473581 - RNA, 22 nt, Human
uugaaaguuuauggagucugca

SEQ ID NO: 473582 - RNA, 22 nt, Human
cagucccagacauaguaaggga

SEQ ID NO: 473583 - RNA, 22 nt, Human
gcacugaaugccaaaguguagg

SEQ ID NO: 473584 - RNA, 22 nt, Human
cauaauaucuccgauuacuugc

SEQ ID NO: 473585 - RNA, 22 nt, Human
gcccugagacugagcauggguu

SEQ ID NO: 473586 - RNA, 22 nt, Human
ugaggcagauauuuauuggguu

SEQ ID NO: 473587 - RNA, 22 nt, Human
agggcagcacagcugugcuccu

SEQ ID NO: 473588 - RNA, 22 nt, Human
uaggggaacuggcacagggcag

SEQ ID NO: 473589 - RNA, 22 nt, Human
gcagaggcaaucagguaugugg

SEQ ID NO: 473590 - RNA, 22 nt, Human
ggcucuggagacauguggagag

SEQ ID NO: 473591 - RNA, 22 nt, Human
uuaugcaacaggugagcagaca

SEQ ID NO: 473592 - RNA, 22 nt, Human
aggccaggaccauuagcccaga

SEQ ID NO: 473593 - RNA, 22 nt, Human
uccugcagagccgcccucaggu

SEQ ID NO: 473594 - RNA, 22 nt, Human
acuccuggggauccauuccuuu

SEQ ID NO: 473595 - RNA, 22 nt, Human
auccugggcagugugucacucu

SEQ ID NO: 473596 - RNA, 22 nt, Human
agccaccaccacugaaagguua

SEQ ID NO: 473597 - RNA, 22 nt, Human
agagcagccugugaugaugcac

SEQ ID NO: 473598 - RNA, 22 nt, Human
cggggcuguagcacagcugagc

SEQ ID NO: 473599 - RNA, 22 nt, Human
cugggaugucuauagaacacuu

SEQ ID NO: 473600 - RNA, 22 nt, Human
acaugggaucaaugaggcaggc

SEQ ID NO: 473601 - RNA, 22 nt, Human
aaggccaugcacauccuaggca

SEQ ID NO: 473602 - RNA, 22 nt, Human
aguuaaagucugaaauagagaa

SEQ ID NO: 473603 - RNA, 22 nt, Human
uguauguguauguacauaugca

SEQ ID NO: 473604 - RNA, 22 nt, Human
aggcugggaaauguagucuucc

SEQ ID NO: 473605 - RNA, 22 nt, Human
agugcacagcgugauguauugg

SEQ ID NO: 473606 - RNA, 22 nt, Human
aagagcaucgguggagccccca

SEQ ID NO: 473607 - RNA, 22 nt, Human
gagaaggacuacacaucuggcc

SEQ ID NO: 473608 - RNA, 22 nt, Human
ugcuuaaacauacuauuuauau

SEQ ID NO: 473609 - RNA, 22 nt, Human
cuucuccucugaguccugggag

SEQ ID NO: 473610 - RNA, 22 nt, Human
cugccaggggccucacaggcca

SEQ ID NO: 473611 - RNA, 22 nt, Human
uauguacacacacaugcaugua

SEQ ID NO: 473612 - RNA, 22 nt, Human
uucacagaauggcaaguuaugg

SEQ ID NO: 473613 - RNA, 22 nt, Human
ccuggcacgaagggcugagguu

SEQ ID NO: 473614 - RNA, 22 nt, Human
gggcagcugcagggauggugac

SEQ ID NO: 473615 - RNA, 18 nt, Human
guuaauuuugaaguucau

SEQ ID NO: 473616 - RNA, 18 nt, Human
gcucugcccaggcugccc

SEQ ID NO: 473617 - RNA, 22 nt, Human
ccaggagccugggccaggcugg

SEQ ID NO: 473618 - RNA, 21 nt, Human
uccagaccucccucuccuagc

SEQ ID NO: 473619 - RNA, 22 nt, Human
gggcugagauuggugcccuguc

SEQ ID NO: 473620 - RNA, 22 nt, Human
ugggcagggagcuggaaccaca

SEQ ID NO: 473621 - RNA, 22 nt, Human
gcugcccaggguggagccggcu

SEQ ID NO: 473622 - RNA, 18 nt, Human
acagcagguuucauucuu

SEQ ID NO: 473623 - RNA, 22 nt, Human
uuucacaugguacugccuguuu

SEQ ID NO: 473624 - RNA, 22 nt, Human
gcaggaugaaggcagaggcuga

SEQ ID NO: 473625 - RNA, 22 nt, Human
uccugagaugagacagugcugc

SEQ ID NO: 473626 - RNA, 22 nt, Human
uucccaguauuaccuucaggaa

SEQ ID NO: 473627 - RNA, 22 nt, Human
auucuccagcucacuguccaua

SEQ ID NO: 473628 - RNA, 22 nt, Human
aaguuugagaagcuuauagaua

SEQ ID NO: 473629 - RNA, 22 nt, Human
gaugagggccugguggcugugc

SEQ ID NO: 473630 - RNA, 22 nt, Human
gaugccuccaaaugagggcaga

SEQ ID NO: 473631 - RNA, 22 nt, Human
uggccagguugggcuuugcagc

SEQ ID NO: 473632 - RNA, 21 nt, Human
aagcuucccugcucuccaggg

SEQ ID NO: 473633 - RNA, 22 nt, Human
cucuuuccaggguaccccaggu

SEQ ID NO: 473634 - RNA, 22 nt, Human
caguccuguguuaaacaagagc

SEQ ID NO: 473635 - RNA, 22 nt, Human
gaaggaaaacagaucugccuga

SEQ ID NO: 473636 - RNA, 22 nt, Human
ugaguccaagagccagugggaa

SEQ ID NO: 473637 - RNA, 20 nt, Human
agauggugaaggccagggag

SEQ ID NO: 473638 - RNA, 18 nt, Human
ccucagggagagagacgc

SEQ ID NO: 473639 - RNA, 22 nt, Human
gcugcuuccuuuccugcugacc

SEQ ID NO: 473640 - RNA, 22 nt, Human
cccagcuccuuggaugggcagg

SEQ ID NO: 473641 - RNA, 22 nt, Human
cagagcugucauuugccaguga

SEQ ID NO: 473642 - RNA, 22 nt, Human
ugagugccugaacauagaguag

SEQ ID NO: 473643 - RNA, 22 nt, Human
uuccagggcuaauuccugugga

SEQ ID NO: 473644 - RNA, 22 nt, Human
gcuggccauggggagugaggag

SEQ ID NO: 473645 - RNA, 20 nt, Human
aggagaaauucgggacaccu

SEQ ID NO: 473646 - RNA, 22 nt, Human
agaggucagaacaggaaagugu

SEQ ID NO: 473647 - RNA, 22 nt, Human
gccagagcagaauagaguggcc

SEQ ID NO: 473648 - RNA, 22 nt, Human
aaugucugagucucuguauccc

SEQ ID NO: 473649 - RNA, 22 nt, Human
gcccaggccggagagcagugcu

SEQ ID NO: 473650 - RNA, 22 nt, Human
aggcagcagucaugaggaaaga

SEQ ID NO: 473651 - RNA, 22 nt, Human
agcccagcagaaaguccagccu

SEQ ID NO: 473652 - RNA, 22 nt, Human
aggaaaaagaguugcugccuuc

SEQ ID NO: 473653 - RNA, 22 nt, Human
caggguggcccuguggucucau

SEQ ID NO: 473654 - RNA, 18 nt, Human
ugggauggagaguaacug

SEQ ID NO: 473655 - RNA, 22 nt, Human
uuuuccucugcagagcaguuag

SEQ ID NO: 473656 - RNA, 22 nt, Human
auggaaagcuaagccauuuacc

SEQ ID NO: 473657 - RNA, 22 nt, Human
gcccagcaccucucucaggguu

SEQ ID NO: 473658 - RNA, 22 nt, Human
ucuuccucucuaauugaucaga

SEQ ID NO: 473659 - RNA, 22 nt, Human
cugggcacauuuugacuagugu

SEQ ID NO: 473660 - RNA, 22 nt, Human
augccuguaaucccagugcuuu

SEQ ID NO: 473661 - RNA, 23 nt, Human
auuugagaaaguauuuuuaagac

SEQ ID NO: 473662 - RNA, 22 nt, Human
ugccaggcacgugagaguggcc

SEQ ID NO: 473663 - RNA, 21 nt, Human
uggaccuguccuucucgcugu

SEQ ID NO: 473664 - RNA, 22 nt, Human
guugacagcuggugagcugcua

SEQ ID NO: 473665 - RNA, 22 nt, Human
aucaguuucugugaagaacaca

SEQ ID NO: 473666 - RNA, 22 nt, Human
gucaaacaaauuaacauaucca

SEQ ID NO: 473667 - RNA, 22 nt, Human
ugaagaauguugcagugagcau

SEQ ID NO: 473668 - RNA, 22 nt, Human
ucuggccaggauggcaagacca

SEQ ID NO: 473669 - RNA, 22 nt, Human
gaaaggucaguuccacuuccau

SEQ ID NO: 473670 - RNA, 22 nt, Human
gagauucuguagucaggcaucu

SEQ ID NO: 473671 - RNA, 22 nt, Human
ucaguuuuuaaaugauauaauu

SEQ ID NO: 473672 - RNA, 22 nt, Human
uagggacccucccugcucuaac

SEQ ID NO: 473673 - RNA, 22 nt, Human
aguguuucucagaagggccuau

SEQ ID NO: 473674 - RNA, 22 nt, Human
gcaggcagagguggaggagaca

SEQ ID NO: 473675 - RNA, 22 nt, Human
ccccagccuuccaugggaauug

SEQ ID NO: 473676 - RNA, 21 nt, Human
uuucugucucugccacuaguu

SEQ ID NO: 473677 - RNA, 22 nt, Human
ucccagagauuuccucuccuuc

SEQ ID NO: 473678 - RNA, 22 nt, Human
cccugagagugagugccaccuu

SEQ ID NO: 473679 - RNA, 22 nt, Human
uuguuuuggagaugagcuaaaa

SEQ ID NO: 473680 - RNA, 22 nt, Human
uggcagaggagaauuaagauua

SEQ ID NO: 473681 - RNA, 22 nt, Human
gcaggcagguggcaucuuguga

SEQ ID NO: 473682 - RNA, 22 nt, Human
ccaguggaaauguggucaggau

SEQ ID NO: 473683 - RNA, 22 nt, Human
ugcugcacgauaaauaauuucu

SEQ ID NO: 473684 - RNA, 21 nt, Human
auacuuugaauuacagccuug

SEQ ID NO: 473685 - RNA, 22 nt, Human
acauuucucagggaguuuugcu

SEQ ID NO: 473686 - RNA, 21 nt, Human
guauugcagaguuaugugcuc

SEQ ID NO: 473687 - RNA, 22 nt, Human
ccuccagguguuacauaugacu

SEQ ID NO: 473688 - RNA, 22 nt, Human
ugauugacuuuagaauagcacu

SEQ ID NO: 473689 - RNA, 22 nt, Human
ugcugaggucaccuugcugcua

SEQ ID NO: 473690 - RNA, 22 nt, Human
gcugcccagcaggccccagggg

SEQ ID NO: 473691 - RNA, 22 nt, Human
gggcuggggcucaauaauuugu

SEQ ID NO: 473692 - RNA, 22 nt, Human
aguggcaggaaaguggaagaga

SEQ ID NO: 473693 - RNA, 22 nt, Human
auugaauagaugcauuauacua

SEQ ID NO: 473694 - RNA, 22 nt, Human
ggcagcugagcauggcuaccuu

SEQ ID NO: 473695 - RNA, 22 nt, Human
agagccugcuaccucauuccag

SEQ ID NO: 473696 - RNA, 22 nt, Human
uccuucaguuaaagaucucaca

SEQ ID NO: 473697 - RNA, 22 nt, Human
caggaacauuuaaccacagggu

SEQ ID NO: 473698 - RNA, 22 nt, Human
cugcccugggauggucugugcg

SEQ ID NO: 473699 - RNA, 22 nt, Human
ucagucuccuuuccucuagaca

SEQ ID NO: 473700 - RNA, 23 nt, Human
uggcaccaggcauucuaggggua

SEQ ID NO: 473701 - RNA, 22 nt, Human
uggccuggcagagcaaggccug

SEQ ID NO: 473702 - RNA, 22 nt, Human
gggaccugcgccacucacuguc

SEQ ID NO: 473703 - RNA, 22 nt, Human
cugucaguucuuccagauagag

SEQ ID NO: 473704 - RNA, 22 nt, Human
gcugccucuguagcuuuggacc

SEQ ID NO: 473705 - RNA, 22 nt, Human
cagugcagguuuagggcugggg

SEQ ID NO: 473706 - RNA, 22 nt, Human
gacaaaacacauuaguuuaaaa

SEQ ID NO: 473707 - RNA, 22 nt, Human
ccaggagcagggcuggcugcac

SEQ ID NO: 473708 - RNA, 22 nt, Human
ugccaggccaaugaaggcaggg

SEQ ID NO: 473709 - RNA, 22 nt, Human
uggcagggccugcucaucaucc

SEQ ID NO: 473710 - RNA, 22 nt, Human
gucacacuagggccaaguggag

SEQ ID NO: 473711 - RNA, 22 nt, Human
aguauguagugcaaucagucag

SEQ ID NO: 473712 - RNA, 21 nt, Human
uaaaugugagcagggcugggc

SEQ ID NO: 473713 - RNA, 22 nt, Human
uucaggagcuggcugcgaagga

SEQ ID NO: 473714 - RNA, 22 nt, Human
cugggaggcacuauucaggagg

SEQ ID NO: 473715 - RNA, 22 nt, Human
aucuggcuauuucuggucgggg

SEQ ID NO: 473716 - RNA, 20 nt, Human
auucuacaagaauaagcaug

SEQ ID NO: 473717 - RNA, 22 nt, Human
cugugcaagacuuacuuuaaua

SEQ ID NO: 473718 - RNA, 20 nt, Human
agugacagagacuguguggc

SEQ ID NO: 473719 - RNA, 22 nt, Human
uuucacauaugguuguugauug

SEQ ID NO: 473720 - RNA, 22 nt, Human
gcagaaggucuggcacuucagg

SEQ ID NO: 473721 - RNA, 22 nt, Human
aggagcagcccacuccuguccu

SEQ ID NO: 473722 - RNA, 22 nt, Human
uaaaacugaauacauacugagg

SEQ ID NO: 473723 - RNA, 22 nt, Human
ucaggcugcuguacugugaaug

SEQ ID NO: 473724 - RNA, 22 nt, Human
ggcaguggaggacccugugucu

SEQ ID NO: 473725 - RNA, 22 nt, Human
ucagcuuugcaaguuagaaaau

SEQ ID NO: 473726 - RNA, 22 nt, Human
ugugccagaaaauaugcugagg

SEQ ID NO: 473727 - RNA, 22 nt, Human
gcagggcacacaagaaugauaa

SEQ ID NO: 473728 - RNA, 22 nt, Human
cagaguguggcaucuuccaacu

SEQ ID NO: 473729 - RNA, 17 nt, Human
uucucuuccuggauagu

SEQ ID NO: 473730 - RNA, 22 nt, Human
gccaccagccccaugcgcugug

SEQ ID NO: 473731 - RNA, 22 nt, Human
cugaggaguuuggguuguucaa

SEQ ID NO: 473732 - RNA, 17 nt, Human
cucacggaggaugaauc

SEQ ID NO: 473733 - RNA, 22 nt, Human
aggccaaguagcuagcauugaa

SEQ ID NO: 473734 - RNA, 22 nt, Human
cucuggaggccuaaggaagugg

SEQ ID NO: 473735 - RNA, 22 nt, Human
ccagguguaggacaccaaggga

SEQ ID NO: 473736 - RNA, 21 nt, Human
aagccucaagcagaagacaga

SEQ ID NO: 473737 - RNA, 22 nt, Human
ugcuggcccaugaagacgcagu

SEQ ID NO: 473738 - RNA, 22 nt, Human
ccugucagaugaaguaauugug

SEQ ID NO: 473739 - RNA, 22 nt, Human
acagcuguauccccagagcuca

SEQ ID NO: 473740 - RNA, 22 nt, Human
ucuucaaacugaaaauuuagaa

SEQ ID NO: 473741 - RNA, 22 nt, Human
ucagcuggauguggaagugcua

SEQ ID NO: 473742 - RNA, 22 nt, Human
acagacaaguaguucagacaag

SEQ ID NO: 473743 - RNA, 22 nt, Human
cagaggccauauuucuucacuc

SEQ ID NO: 473744 - RNA, 23 nt, Human
aagcuuccuucacgucuccuggg

SEQ ID NO: 473745 - RNA, 22 nt, Human
ggcagggaaacagcugauccca

SEQ ID NO: 473746 - RNA, 21 nt, Human
aguguccuugaucuugccuug

SEQ ID NO: 473747 - RNA, 22 nt, Human
uuuugaaagaguccugcuacag

SEQ ID NO: 473748 - RNA, 22 nt, Human
ggaagccaugagggacaguucu

SEQ ID NO: 473749 - RNA, 22 nt, Human
cagggccagagagggcuggcug

SEQ ID NO: 473750 - RNA, 22 nt, Human
augcugaggacaaagagaucaa

SEQ ID NO: 473751 - RNA, 22 nt, Human
gaggcagaaguugcagugagca

SEQ ID NO: 473752 - RNA, 22 nt, Human
cuccagucuaguagagccugcu

SEQ ID NO: 473753 - RNA, 22 nt, Human
cguggccuuugagugagcuccc

SEQ ID NO: 473754 - RNA, 22 nt, Human
guucaaggaagggaggaaagcc

SEQ ID NO: 473755 - RNA, 22 nt, Human
ggagcagggaauuacagcgcag

SEQ ID NO: 473756 - RNA, 21 nt, Human
cccaagggaggcaggauaagg

SEQ ID NO: 473757 - RNA, 22 nt, Human
gcagagacuccacugucuugug

SEQ ID NO: 473758 - RNA, 22 nt, Human
ugccagcaguagcaguaggcca

SEQ ID NO: 473759 - RNA, 22 nt, Human
uugcauaaagauuuuauugcau

SEQ ID NO: 473760 - RNA, 22 nt, Human
ugcagcucauugcuggggucug

SEQ ID NO: 473761 - RNA, 22 nt, Human
acauguguauagccuguauaga

SEQ ID NO: 473762 - RNA, 21 nt, Human
cuguuucuugugaagugacac

SEQ ID NO: 473763 - RNA, 21 nt, Human
uucaaagagugggcauuguca

SEQ ID NO: 473764 - RNA, 22 nt, Human
ccaggagcaggagcuggacaga

SEQ ID NO: 473765 - RNA, 23 nt, Human
ugagaagccauuagagcaggugg

SEQ ID NO: 473766 - RNA, 20 nt, Human
uucuuucaucuacacguugu

SEQ ID NO: 473767 - RNA, 22 nt, Human
aggaaaugcugaugcuccugga

SEQ ID NO: 473768 - RNA, 16 nt, Human
ggagagugucugcaaa

SEQ ID NO: 473769 - RNA, 21 nt, Human
ugaggcuguuguaccagggag

SEQ ID NO: 473770 - RNA, 22 nt, Human
ggccagaaaguuaagcuguggc

SEQ ID NO: 473771 - RNA, 22 nt, Human
guggcuugaccaucccugcuac

SEQ ID NO: 473772 - RNA, 22 nt, Human
uggggcagaguaggauuuuggc

SEQ ID NO: 473773 - RNA, 22 nt, Human
gcugcagccaaauucauuguca

SEQ ID NO: 473774 - RNA, 22 nt, Human
cgagcaugaugacggcuguggc

SEQ ID NO: 473775 - RNA, 22 nt, Human
augugaggaagaaagagguaag

SEQ ID NO: 473776 - RNA, 22 nt, Human
caggggccaggcugucugcugu

SEQ ID NO: 473777 - RNA, 22 nt, Human
aagaacaguugggaggugagcc

SEQ ID NO: 473778 - RNA, 22 nt, Human
ggcugcuggcauugagguaggu

SEQ ID NO: 473779 - RNA, 22 nt, Human
ggcccagcacagugcuuggggg

SEQ ID NO: 473780 - RNA, 22 nt, Human
acaugauauuaaugucuuauuu

SEQ ID NO: 473781 - RNA, 22 nt, Human
cuuuauguuggggugucuuagu

SEQ ID NO: 473782 - RNA, 22 nt, Human
gcugccaauccagcugugggag

SEQ ID NO: 473783 - RNA, 22 nt, Human
uggcagggugggcuucagcccc

SEQ ID NO: 473784 - RNA, 22 nt, Human
auugaaaaauucacaauucugg

SEQ ID NO: 473785 - RNA, 22 nt, Human
gccugggagggcagcagugugg

SEQ ID NO: 473786 - RNA, 22 nt, Human
cagggcugaacugagcuuguga

SEQ ID NO: 473787 - RNA, 22 nt, Human
ugaaggaauggaggaucagagc

SEQ ID NO: 473788 - RNA, 22 nt, Human
agaaaugugagccccuuaucaa

SEQ ID NO: 473789 - RNA, 22 nt, Human
ccuagaugggauggcggccggg

SEQ ID NO: 473790 - RNA, 22 nt, Human
ggcugcugguggaaugguaggc

SEQ ID NO: 473791 - RNA, 22 nt, Human
uccauuuuagagaugaagaaac

SEQ ID NO: 473792 - RNA, 22 nt, Human
accucugcaaugcaaugucaug

SEQ ID NO: 473793 - RNA, 22 nt, Human
auauuucaugggguuccauacu

SEQ ID NO: 473794 - RNA, 22 nt, Human
ccagacccugcucuggggcucu

SEQ ID NO: 473795 - RNA, 22 nt, Human
gggcugggcaugguguucccuc

SEQ ID NO: 473796 - RNA, 22 nt, Human
ucagggcacaggccuguggguu

SEQ ID NO: 473797 - RNA, 22 nt, Human
ucauugcaccccagucccagcu

SEQ ID NO: 473798 - RNA, 22 nt, Human
aaauguauugcauaggauauuu

SEQ ID NO: 473799 - RNA, 21 nt, Human
agcagaacagucgagcacugc

SEQ ID NO: 473800 - RNA, 22 nt, Human
auuauauugaguauaaccagag

SEQ ID NO: 473801 - RNA, 22 nt, Human
uugcucugauuagguggaaaca

SEQ ID NO: 473802 - RNA, 22 nt, Human
aaugugguuaacccauuuaaga

SEQ ID NO: 473803 - RNA, 22 nt, Human
gguucacacuuucaugauuuca

SEQ ID NO: 473804 - RNA, 22 nt, Human
ggcugcaggaugcccagccgug

SEQ ID NO: 473805 - RNA, 22 nt, Human
uggggcaguuaauaaacauucu

SEQ ID NO: 473806 - RNA, 22 nt, Human
cugaggcuuugugugcaugccu

SEQ ID NO: 473807 - RNA, 22 nt, Human
ugcaggggcuugucugggccug

SEQ ID NO: 473808 - RNA, 20 nt, Human
caccacagaauuggggacag

SEQ ID NO: 473809 - RNA, 22 nt, Human
cagcaggauuugaaaggaagag

SEQ ID NO: 473810 - RNA, 22 nt, Human
cagccagccucucaaccaugca

SEQ ID NO: 473811 - RNA, 20 nt, Human
agaaggcuccuuuugccaag

SEQ ID NO: 473812 - RNA, 22 nt, Human
accuuucauuaaagucuguagu

SEQ ID NO: 473813 - RNA, 22 nt, Human
cagcugugggccugacguggca

SEQ ID NO: 473814 - RNA, 22 nt, Human
ugagaggccccagcucuuggcc

SEQ ID NO: 473815 - RNA, 22 nt, Human
augaggcuaugaauggggagau

SEQ ID NO: 473816 - RNA, 22 nt, Human
acugggaguucuccaugucccu

SEQ ID NO: 473817 - RNA, 22 nt, Human
acucugccaucccaggugcugu

SEQ ID NO: 473818 - RNA, 22 nt, Human
cucagagcccaggguacacccg

SEQ ID NO: 473819 - RNA, 22 nt, Human
ccaaggcuggagugcaguggcg

SEQ ID NO: 473820 - RNA, 22 nt, Human
aaacucuuccuuucuuuaaagu

SEQ ID NO: 473821 - RNA, 22 nt, Human
aaaaaucuaugacugcuucucc

SEQ ID NO: 473822 - RNA, 22 nt, Human
ucaggcaggacaauuauuuagg

SEQ ID NO: 473823 - RNA, 22 nt, Human
cuggcuccauccuugagcucug

SEQ ID NO: 473824 - RNA, 22 nt, Human
cugagauggaguuuugcucuug

SEQ ID NO: 473825 - RNA, 23 nt, Human
uccaggcacgcauuucuucuagc

SEQ ID NO: 473826 - RNA, 20 nt, Human
gggaguggugguagccugug

SEQ ID NO: 473827 - RNA, 22 nt, Human
cagagccugccucuggcugugg

SEQ ID NO: 473828 - RNA, 22 nt, Human
ccagcuuucucagaggcuucua

SEQ ID NO: 473829 - RNA, 22 nt, Human
ggcucugcaugugagugggugg

SEQ ID NO: 473830 - RNA, 22 nt, Human
gaagggagaagguugggugacg

SEQ ID NO: 473831 - RNA, 22 nt, Human
acacugugcagauucccuguga

SEQ ID NO: 473832 - RNA, 22 nt, Human
caugcuuugggucagaaaugcc

SEQ ID NO: 473833 - RNA, 22 nt, Human
agccaggaaugcaugcucugcu

SEQ ID NO: 473834 - RNA, 22 nt, Human
gaggccuggcucugcccuccug

SEQ ID NO: 473835 - RNA, 22 nt, Human
ggcaggagaaaggucucuucuu

SEQ ID NO: 473836 - RNA, 21 nt, Human
agaauucuuaaguauucuaau

SEQ ID NO: 473837 - RNA, 22 nt, Human
cacagcagagggagccauugaa

SEQ ID NO: 473838 - RNA, 22 nt, Human
ucccccacucuaaaggagccuu

SEQ ID NO: 473839 - RNA, 22 nt, Human
gagcugccuguugcauagcaac

SEQ ID NO: 473840 - RNA, 22 nt, Human
uacaaagccugguagauaucug

SEQ ID NO: 473841 - RNA, 22 nt, Human
gcagugaaucuggcaagaauuu

SEQ ID NO: 473842 - RNA, 22 nt, Human
caacauauaauauuugaguucu

SEQ ID NO: 473843 - RNA, 22 nt, Human
gggcaugagaggcaggcaagug

SEQ ID NO: 473844 - RNA, 22 nt, Human
aauguguauaugaacauacagg

SEQ ID NO: 473845 - RNA, 22 nt, Human
agguuuucagcuguauccugag

SEQ ID NO: 473846 - RNA, 23 nt, Human
uuucacaaugagcauuacagaau

SEQ ID NO: 473847 - RNA, 22 nt, Human
agcagaaccugcagaccugucu

SEQ ID NO: 473848 - RNA, 22 nt, Human
cagcugccccgcuggcugacca

SEQ ID NO: 473849 - RNA, 22 nt, Human
ucacacagauugguagagcuga

SEQ ID NO: 473850 - RNA, 22 nt, Human
aggcugagagcaacgugucaga

SEQ ID NO: 473851 - RNA, 22 nt, Human
ggggcagaguagcuggggugug

SEQ ID NO: 473852 - RNA, 22 nt, Human
uccugagagcagaguccaggug

SEQ ID NO: 473853 - RNA, 22 nt, Human
gaguccaguucuuuccagcagu

SEQ ID NO: 473854 - RNA, 22 nt, Human
gccucugcucucagguagccuc

SEQ ID NO: 473855 - RNA, 22 nt, Human
uuauuuaggagaaggaacccug

SEQ ID NO: 473856 - RNA, 23 nt, Human
uggcucuguggaucccucaggag

SEQ ID NO: 473857 - RNA, 22 nt, Human
auuauguagguuaggugguugu

SEQ ID NO: 473858 - RNA, 22 nt, Human
ggagcugggacccugucaucug

SEQ ID NO: 473859 - RNA, 22 nt, Human
cagaggaaggcucugggaaugu

SEQ ID NO: 473860 - RNA, 22 nt, Human
uucacagacuuuccauagauug

SEQ ID NO: 473861 - RNA, 22 nt, Human
gucccaggugggcuccaccucu

SEQ ID NO: 473862 - RNA, 23 nt, Human
cuggggcuuucaaaucugggcag

SEQ ID NO: 473863 - RNA, 22 nt, Human
caagcagacaguaggccuagaa

SEQ ID NO: 473864 - RNA, 22 nt, Human
cagcucugugcaggccugggga

SEQ ID NO: 473865 - RNA, 22 nt, Human
aacaaauggggccuuguaugaa

SEQ ID NO: 473866 - RNA, 22 nt, Human
caggugccgggaaugcagcaau

SEQ ID NO: 473867 - RNA, 22 nt, Human
auccucaguguuucugacaucu

SEQ ID NO: 473868 - RNA, 22 nt, Human
cccaggacucuucacugcagcc

SEQ ID NO: 473869 - RNA, 22 nt, Human
ccuguccuccaagagcacaucu

SEQ ID NO: 473870 - RNA, 22 nt, Human
cagaaugagauaacccagauug

SEQ ID NO: 473871 - RNA, 22 nt, Human
aauauguuccacuuaaagcugg

SEQ ID NO: 473872 - RNA, 22 nt, Human
agauggggcugaaaguuccaau

SEQ ID NO: 473873 - RNA, 22 nt, Human
cgcauacauagaaacacacaga

SEQ ID NO: 473874 - RNA, 22 nt, Human
uccagcagggaauuaguagucu

SEQ ID NO: 473875 - RNA, 22 nt, Human
cuuucucuguguuucacaugcu

SEQ ID NO: 473876 - RNA, 22 nt, Human
gccuucccaagacgccugaguu

SEQ ID NO: 473877 - RNA, 22 nt, Human
ugacagggcuagaggcaaugca

SEQ ID NO: 473878 - RNA, 22 nt, Human
acaaagucucuaauaaucuucu

SEQ ID NO: 473879 - RNA, 22 nt, Human
ugaggcaggaugcuugcacagg

SEQ ID NO: 473880 - RNA, 23 nt, Human
cacaccaggagccgucugggcca

SEQ ID NO: 473881 - RNA, 22 nt, Human
ucucugagcgcauuccuccggc

SEQ ID NO: 473882 - RNA, 22 nt, Human
ucagggcagaauccaaagaauu

SEQ ID NO: 473883 - RNA, 17 nt, Human
ggcagcugccacuuuuu

SEQ ID NO: 473884 - RNA, 22 nt, Human
caugcacaacauacucaagagg

SEQ ID NO: 473885 - RNA, 22 nt, Human
agcaguccaacugagguggcau

SEQ ID NO: 473886 - RNA, 22 nt, Human
ucaggcagguggcuggcuaugg

SEQ ID NO: 473887 - RNA, 22 nt, Human
aaaugcacagaggccagagagg

SEQ ID NO: 473888 - RNA, 22 nt, Human
aucuggcucccuuggaauccgu

SEQ ID NO: 473889 - RNA, 22 nt, Human
aagaaacugaaaguggcuucau

SEQ ID NO: 473890 - RNA, 22 nt, Human
aaagccaguucuuagagaaagc

SEQ ID NO: 473891 - RNA, 22 nt, Human
uuuuaagaugcuaguauuucag

SEQ ID NO: 473892 - RNA, 18 nt, Human
ccucacagacuuccaugu

SEQ ID NO: 473893 - RNA, 22 nt, Human
cacagccuugagcgaggacaag

SEQ ID NO: 473894 - RNA, 22 nt, Human
ugaaguccuagaacuccuggua

SEQ ID NO: 473895 - RNA, 22 nt, Human
aagccaguguccagaaugggca

SEQ ID NO: 473896 - RNA, 22 nt, Human
aaggagcuuguucgccuuccuc

SEQ ID NO: 473897 - RNA, 22 nt, Human
ggcuugggagcaggcaugugac

SEQ ID NO: 473898 - RNA, 22 nt, Human
ucugaaaauguugacuuuguuu

SEQ ID NO: 473899 - RNA, 22 nt, Human
gugcuuucugcugcauuccucu

SEQ ID NO: 473900 - RNA, 22 nt, Human
ucccacuggacgucugugcugg

SEQ ID NO: 473901 - RNA, 22 nt, Human
cugcagggugacguugcccacc

SEQ ID NO: 473902 - RNA, 20 nt, Human
ccaccuggccaaggcugugc

SEQ ID NO: 473903 - RNA, 22 nt, Human
uguuucaggaccuaucuuuuag

SEQ ID NO: 473904 - RNA, 22 nt, Human
cugagauggaguuucgcucuuc

SEQ ID NO: 473905 - RNA, 22 nt, Human
aggggaaggccagccuguagag

SEQ ID NO: 473906 - RNA, 22 nt, Human
cacaggcuccggccuugcagcc

SEQ ID NO: 473907 - RNA, 22 nt, Human
uggccuggccacauccagcagg

SEQ ID NO: 473908 - RNA, 22 nt, Human
ugaggggagaagcagcagccug

SEQ ID NO: 473909 - RNA, 22 nt, Human
aaggcacucagccuugggacag

SEQ ID NO: 473910 - RNA, 23 nt, Human
gccauggcugccccacaggccuc

SEQ ID NO: 473911 - RNA, 21 nt, Human
ucucugggaggacuugugaga

SEQ ID NO: 473912 - RNA, 22 nt, Human
ucagcuuggacagcuugguuga

SEQ ID NO: 473913 - RNA, 20 nt, Human
ugcucaggauggagaggugu

SEQ ID NO: 473914 - RNA, 22 nt, Human
agaaauaugcugauuagaugaa

SEQ ID NO: 473915 - RNA, 22 nt, Human
caaggccacguucugcaugcgg

SEQ ID NO: 473916 - RNA, 20 nt, Human
gagggcucguggauggauaa

SEQ ID NO: 473917 - RNA, 22 nt, Human
auucuuggagcagucaaagaag

SEQ ID NO: 473918 - RNA, 22 nt, Human
uugcaacaucugaacauuuauc

SEQ ID NO: 473919 - RNA, 22 nt, Human
caaaugcauagaaagaugaaac

SEQ ID NO: 473920 - RNA, 22 nt, Human
cccuggccagcucaugucugag

SEQ ID NO: 473921 - RNA, 19 nt, Human
ggccaccucucuucccagg

SEQ ID NO: 473922 - RNA, 23 nt, Human
acacauuuuucccguucugaggu

SEQ ID NO: 473923 - RNA, 22 nt, Human
aaaugcagguaguauuuauuuu

SEQ ID NO: 473924 - RNA, 21 nt, Human
uuucacaaaaguaugugacaa

SEQ ID NO: 473925 - RNA, 22 nt, Human
agagcagauggccagggggccu

SEQ ID NO: 473926 - RNA, 22 nt, Human
ccucugccugcacaucauccug

SEQ ID NO: 473927 - RNA, 22 nt, Human
ggggccagcaauguugaggaau

SEQ ID NO: 473928 - RNA, 22 nt, Human
uccuucagccaugggcucucca

SEQ ID NO: 473929 - RNA, 22 nt, Human
agugcccuggcccagcuggacc

SEQ ID NO: 473930 - RNA, 22 nt, Human
uccugucugcucacagagcugg

SEQ ID NO: 473931 - RNA, 22 nt, Human
uuuacaaccucauauucugaug

SEQ ID NO: 473932 - RNA, 22 nt, Human
ugccuggcaacuguggugggcu

SEQ ID NO: 473933 - RNA, 22 nt, Human
uuugggcaguagauguaucacu

SEQ ID NO: 473934 - RNA, 22 nt, Human
agggcugcugcuccgggcccag

SEQ ID NO: 473935 - RNA, 22 nt, Human
cuggccuuggaagggagcccgu

SEQ ID NO: 473936 - RNA, 23 nt, Human
agggguggucaguacccgcagug

SEQ ID NO: 473937 - RNA, 22 nt, Human
uggcagccacaucucguggauu

SEQ ID NO: 473938 - RNA, 22 nt, Human
cacagaaucugugacuccaaga

SEQ ID NO: 473939 - RNA, 22 nt, Human
uaucuuuagaggaagagaaucu

SEQ ID NO: 473940 - RNA, 22 nt, Human
acaaaaguguaggaauuccuua

SEQ ID NO: 473941 - RNA, 22 nt, Human
agcagccagagucugaacauua

SEQ ID NO: 473942 - RNA, 22 nt, Human
cggcugagcagugcugauggaa

SEQ ID NO: 473943 - RNA, 22 nt, Human
uggccucucuaccaggcagccu

SEQ ID NO: 473944 - RNA, 19 nt, Human
cugugcuuuaaacuccuau

SEQ ID NO: 473945 - RNA, 22 nt, Human
ccugaggcuuaaucugucccaa

SEQ ID NO: 473946 - RNA, 22 nt, Human
aagcagcacaguaauauuggug

SEQ ID NO: 473947 - RNA, 22 nt, Human
uguacaauagcuauuaucucca

SEQ ID NO: 473948 - RNA, 22 nt, Human
agcuguggggcaggcagcgagg

SEQ ID NO: 473949 - RNA, 17 nt, Human
uuccccugaccaagccu

SEQ ID NO: 473950 - RNA, 22 nt, Human
aggccugaggaccuucuggagg

SEQ ID NO: 473951 - RNA, 21 nt, Human
uuucccagcugaaaauaaaug

SEQ ID NO: 473952 - RNA, 22 nt, Human
aggcccagagcaggaaaggguu

SEQ ID NO: 473953 - RNA, 22 nt, Human
uuuuucauauuccccucucugg

SEQ ID NO: 473954 - RNA, 22 nt, Human
gggcugcuuauacugaugauaa

SEQ ID NO: 473955 - RNA, 22 nt, Human
cucucuucccgugaguguugca

SEQ ID NO: 473956 - RNA, 22 nt, Human
gaggaaacauuguagaagcagu

SEQ ID NO: 473957 - RNA, 22 nt, Human
aacuuuauuguuaggggcuaaa

SEQ ID NO: 473958 - RNA, 22 nt, Human
accccagcucugagccacacca

SEQ ID NO: 473959 - RNA, 22 nt, Human
agggagaaaauuggaugcacaa

SEQ ID NO: 473960 - RNA, 22 nt, Human
aagccagggauuccugagggag

SEQ ID NO: 473961 - RNA, 22 nt, Human
agccuggcccugcugaacucug

SEQ ID NO: 473962 - RNA, 20 nt, Human
cacugaagacuucuugcuca

SEQ ID NO: 473963 - RNA, 22 nt, Human
ucaaaagucugcauucuucaca

SEQ ID NO: 473964 - RNA, 22 nt, Human
cagcugccuguauuguccucau

SEQ ID NO: 473965 - RNA, 22 nt, Human
uccuuugacuucuugcagucca

SEQ ID NO: 473966 - RNA, 22 nt, Human
guccuggcccacuggcaggcug

SEQ ID NO: 473967 - RNA, 22 nt, Human
guuugcauauuugcacaggaau

SEQ ID NO: 473968 - RNA, 22 nt, Human
uggcccugucccuggagccugg

SEQ ID NO: 473969 - RNA, 22 nt, Human
guuguauucuucaauaucagag

SEQ ID NO: 473970 - RNA, 22 nt, Human
gccagggagucugggccacaga

SEQ ID NO: 473971 - RNA, 22 nt, Human
ggcuuuauuucacuguaccaua

SEQ ID NO: 473972 - RNA, 22 nt, Human
gcucucugggugugucuagaua

SEQ ID NO: 473973 - RNA, 22 nt, Human
aaguggacuaauacaaggacua

SEQ ID NO: 473974 - RNA, 22 nt, Human
ugcugggcuaggguggagcucu

SEQ ID NO: 473975 - RNA, 22 nt, Human
gcuguguccucacacagccuuu

SEQ ID NO: 473976 - RNA, 22 nt, Human
ccuggcagcuguuuggcuuggc

SEQ ID NO: 473977 - RNA, 22 nt, Human
gcucugagucucagcuaccaca

SEQ ID NO: 473978 - RNA, 22 nt, Human
agggcagauggaacuuccccga

SEQ ID NO: 473979 - RNA, 22 nt, Human
ugcauuguaggauguuuagcag

SEQ ID NO: 473980 - RNA, 22 nt, Human
agggcuggccacaugauuuggu

SEQ ID NO: 473981 - RNA, 20 nt, Human
gccugcagguuggaugggau

SEQ ID NO: 473982 - RNA, 22 nt, Human
gggcaguuuauucuagaugguu

SEQ ID NO: 473983 - RNA, 22 nt, Human
uuaucacuuaugagcuuuuugc

SEQ ID NO: 473984 - RNA, 22 nt, Human
uaggaaaagcacaggauguucu

SEQ ID NO: 473985 - RNA, 20 nt, Human
auaaaauaacugccacaaga

SEQ ID NO: 473986 - RNA, 22 nt, Human
cugcccugucuuuuucugauga

SEQ ID NO: 473987 - RNA, 22 nt, Human
ugcuuuauagacaaggaaguag

SEQ ID NO: 473988 - RNA, 22 nt, Human
ggacacagauaaucacacagau

SEQ ID NO: 473989 - RNA, 16 nt, Human
ccaccugcagcucuca

SEQ ID NO: 473990 - RNA, 22 nt, Human
cuggccuuggugcuugcagaca

SEQ ID NO: 473991 - RNA, 22 nt, Human
ggggcucaguucggacagccug

SEQ ID NO: 473992 - RNA, 22 nt, Human
aggaccugacauuguguuuucu

SEQ ID NO: 473993 - RNA, 22 nt, Human
acaggcagcacuaaucucuggu

SEQ ID NO: 473994 - RNA, 22 nt, Human
cagcuucugagcaagccagggg

SEQ ID NO: 473995 - RNA, 22 nt, Human
gccuggagagcacugugcgcuu

SEQ ID NO: 473996 - RNA, 22 nt, Human
agauggaguuaguaccagaguc

SEQ ID NO: 473997 - RNA, 22 nt, Human
auucuggauuaucaguccacca

SEQ ID NO: 473998 - RNA, 22 nt, Human
aggggcugacuggaaagugcca

SEQ ID NO: 473999 - RNA, 22 nt, Human
auugagaauccauuugagauga

SEQ ID NO: 474000 - RNA, 23 nt, Human
ccaggcaguagcuauugaaguga

SEQ ID NO: 474001 - RNA, 20 nt, Human
ccagcauguacacaugugga

SEQ ID NO: 474002 - RNA, 22 nt, Human
uaacagaagaugaaacuucuuu

SEQ ID NO: 474003 - RNA, 22 nt, Human
auuuugaaaagcauuugaguaa

SEQ ID NO: 474004 - RNA, 22 nt, Human
ugggcagaguugugaugaacug

SEQ ID NO: 474005 - RNA, 23 nt, Human
ugcaggggaggcuuaaagcaggu

SEQ ID NO: 474006 - RNA, 22 nt, Human
gcuguggccgucagggaaaugg

SEQ ID NO: 474007 - RNA, 20 nt, Human
aacauugcuucaauguaacc

SEQ ID NO: 474008 - RNA, 22 nt, Human
gaaugaauucagcacauggaau

SEQ ID NO: 474009 - RNA, 22 nt, Human
ucaagaaagggcuucaccagga

SEQ ID NO: 474010 - RNA, 22 nt, Human
acaaaguccugguguauggcca

SEQ ID NO: 474011 - RNA, 22 nt, Human
ugaaggcauugaugaaggaauc

SEQ ID NO: 474012 - RNA, 22 nt, Human
acuguaaauuuugguugcaggu

SEQ ID NO: 474013 - RNA, 22 nt, Human
aucagagaaguuucacuggcau

SEQ ID NO: 474014 - RNA, 22 nt, Human
aucauuccacauguaccacuag

SEQ ID NO: 474015 - RNA, 22 nt, Human
acuguauaaggcauagguaagc

SEQ ID NO: 474016 - RNA, 22 nt, Human
ugccucugaggaagauuguguu

SEQ ID NO: 474017 - RNA, 22 nt, Human
ucaugccacuuacaaaauaaug

SEQ ID NO: 474018 - RNA, 22 nt, Human
uccuugaagaaugauucuugga

SEQ ID NO: 474019 - RNA, 22 nt, Human
ucccuccuggugagcaggggcu

SEQ ID NO: 474020 - RNA, 22 nt, Human
caagaaaugggauuugacugcc

SEQ ID NO: 474021 - RNA, 22 nt, Human
agucucugucguagaucagcgu

SEQ ID NO: 474022 - RNA, 22 nt, Human
uccuggccugucuggaguagcu

SEQ ID NO: 474023 - RNA, 22 nt, Human
agggccugggguagcuuacugc

SEQ ID NO: 474024 - RNA, 22 nt, Human
cagagugaaauaggggaucaag

SEQ ID NO: 474025 - RNA, 22 nt, Human
ugauuuccccagucuugcugcu

SEQ ID NO: 474026 - RNA, 22 nt, Human
ucucucagcuuugagaccugcu

SEQ ID NO: 474027 - RNA, 22 nt, Human
agcagcuucuuucacuccugga

SEQ ID NO: 474028 - RNA, 22 nt, Human
caaagaugcugauguuggauca

SEQ ID NO: 474029 - RNA, 22 nt, Human
ugauuaacugucuauuaaucau

SEQ ID NO: 474030 - RNA, 22 nt, Human
aaauccuaauaaugcacuagug

SEQ ID NO: 474031 - RNA, 22 nt, Human
ggcugccugcucaggugcggcg

SEQ ID NO: 474032 - RNA, 22 nt, Human
gccuggagaaaggaagguggga

SEQ ID NO: 474033 - RNA, 22 nt, Human
gucuggggaagucagggcauca

SEQ ID NO: 474034 - RNA, 23 nt, Human
ugaugggaaggaacgacuaccac

SEQ ID NO: 474035 - RNA, 22 nt, Human
uuucuaguucucugccaaaaaa

SEQ ID NO: 474036 - RNA, 22 nt, Human
auaugugugaugcauggacuaa

SEQ ID NO: 474037 - RNA, 22 nt, Human
cucuuccuacagucugcuaugc

SEQ ID NO: 474038 - RNA, 21 nt, Human
gaaaagcaagggaguagaaca

SEQ ID NO: 474039 - RNA, 22 nt, Human
ucugagagucucugaggcagau

SEQ ID NO: 474040 - RNA, 22 nt, Human
aagucacagcuaaauagcuaag

SEQ ID NO: 474041 - RNA, 22 nt, Human
uccauauuaacuaaaacuagaa

SEQ ID NO: 474042 - RNA, 18 nt, Human
ugggcugccuggccucug

SEQ ID NO: 474043 - RNA, 19 nt, Human
uagcagcugccaaaggaga

SEQ ID NO: 474044 - RNA, 22 nt, Human
ucugccugcaguguggcagggc

SEQ ID NO: 474045 - RNA, 22 nt, Human
uaaauguguuguggaugaaguu

SEQ ID NO: 474046 - RNA, 22 nt, Human
auacaagacucagcacagacgg

SEQ ID NO: 474047 - RNA, 22 nt, Human
gcucugagaggugcagcaguaa

SEQ ID NO: 474048 - RNA, 22 nt, Human
uaugcauauagaugcacacaca

SEQ ID NO: 474049 - RNA, 22 nt, Human
caggaggcuuugggauccaagu

SEQ ID NO: 474050 - RNA, 18 nt, Human
gguggccuugacuucucu

SEQ ID NO: 474051 - RNA, 22 nt, Human
aaguuucauguggagguagacu

SEQ ID NO: 474052 - RNA, 22 nt, Human
gcucagagaugucugcugccuu

SEQ ID NO: 474053 - RNA, 22 nt, Human
guccucugcccaggucaagguu

SEQ ID NO: 474054 - RNA, 22 nt, Human
uaagaacaagauguuccuguuu

SEQ ID NO: 474055 - RNA, 22 nt, Human
guuagggagucagguggcucuu

SEQ ID NO: 474056 - RNA, 22 nt, Human
cagcuccagcccaggcagcucc

SEQ ID NO: 474057 - RNA, 22 nt, Human
ugccugucuuuccucccucgua

SEQ ID NO: 474058 - RNA, 22 nt, Human
gccaggcagcagcgaggauggu

SEQ ID NO: 474059 - RNA, 22 nt, Human
gcacccagaauaaggacaggac

SEQ ID NO: 474060 - RNA, 17 nt, Human
agccugcugaucucaca

SEQ ID NO: 474061 - RNA, 22 nt, Human
cagggcucaggaaaucagacgu

SEQ ID NO: 474062 - RNA, 22 nt, Human
ggcagcacugcagcuuguuggg

SEQ ID NO: 474063 - RNA, 22 nt, Human
uggcuuccugcacagugucugc

SEQ ID NO: 474064 - RNA, 22 nt, Human
cagagcuggcucugcauguaca

SEQ ID NO: 474065 - RNA, 22 nt, Human
ggagcugugcagugacuacaga

SEQ ID NO: 474066 - RNA, 22 nt, Human
uggcucaguagcagugugguca

SEQ ID NO: 474067 - RNA, 22 nt, Human
ggucucuguugccuccaucaag

SEQ ID NO: 474068 - RNA, 22 nt, Human
aggagucagauuguuugaaugu

SEQ ID NO: 474069 - RNA, 22 nt, Human
aggcaagaacagacaugggagu

SEQ ID NO: 474070 - RNA, 22 nt, Human
gaugcagaaaguagacaccauc

SEQ ID NO: 474071 - RNA, 22 nt, Human
uucuuacagcccuauuacuaaa

SEQ ID NO: 474072 - RNA, 22 nt, Human
aaaugcagauugucauucagga

SEQ ID NO: 474073 - RNA, 22 nt, Human
gugugggcugcagaggcacagc

SEQ ID NO: 474074 - RNA, 22 nt, Human
gcagcguggggcugagucagcu

SEQ ID NO: 474075 - RNA, 22 nt, Human
ucugaggccccugggcaggaug

SEQ ID NO: 474076 - RNA, 22 nt, Human
uugaagagugccuuccagacau

SEQ ID NO: 474077 - RNA, 22 nt, Human
cagggccauaucuugugcacca

SEQ ID NO: 474078 - RNA, 22 nt, Human
ccagcauggcaccugagaugag

SEQ ID NO: 474079 - RNA, 22 nt, Human
gcagacagccagacugcacugg

SEQ ID NO: 474080 - RNA, 22 nt, Human
gugggccucuugaggguggcua

SEQ ID NO: 474081 - RNA, 19 nt, Human
ggugaccaccuggucagug

SEQ ID NO: 474082 - RNA, 22 nt, Human
agcaauauuucagcuagcaggu

SEQ ID NO: 474083 - RNA, 22 nt, Human
ggagauuuauagcacacuucag

SEQ ID NO: 474084 - RNA, 22 nt, Human
agccaggcuaaaugagccauga

SEQ ID NO: 474085 - RNA, 22 nt, Human
uggagcaggugcucaggguaau

SEQ ID NO: 474086 - RNA, 22 nt, Human
acaaagucaaauugcagccgcc

SEQ ID NO: 474087 - RNA, 18 nt, Human
caugucugcgccacaagg

SEQ ID NO: 474088 - RNA, 21 nt, Human
aucaccagcagaagcugcaga

SEQ ID NO: 474089 - RNA, 22 nt, Human
aaggcugaauucaaggguaggc

SEQ ID NO: 474090 - RNA, 23 nt, Human
ggcugagacuacaggcgcuugcc

SEQ ID NO: 474091 - RNA, 20 nt, Human
agaggcuuccuugggaggag

SEQ ID NO: 474092 - RNA, 22 nt, Human
ucaggcaggcucagaggaaaac

SEQ ID NO: 474093 - RNA, 22 nt, Human
agugaaauaugcccauugcugu

SEQ ID NO: 474094 - RNA, 22 nt, Human
ucaggagcugcacugggcccac

SEQ ID NO: 474095 - RNA, 22 nt, Human
uucugucuucccacugaggagc

SEQ ID NO: 474096 - RNA, 22 nt, Human
cuguuuauuacacuggauagca

SEQ ID NO: 474097 - RNA, 22 nt, Human
uggcuggggccacaguuuuccu

SEQ ID NO: 474098 - RNA, 22 nt, Human
acaugauuuuuaaagagauaau

SEQ ID NO: 474099 - RNA, 22 nt, Human
aagcaauauacugauaugauua

SEQ ID NO: 474100 - RNA, 19 nt, Human
agcuguggggccuagcacc

SEQ ID NO: 474101 - RNA, 22 nt, Human
aacuagaaccacuuguauuucc

SEQ ID NO: 474102 - RNA, 22 nt, Human
gggcagcagcaggaggucucug

SEQ ID NO: 474103 - RNA, 22 nt, Human
ucacuuauugcucaucucaugc

SEQ ID NO: 474104 - RNA, 22 nt, Human
gaaaauguuagcuucauaguca

SEQ ID NO: 474105 - RNA, 22 nt, Human
cggcagcaaaggaagccagguc

SEQ ID NO: 474106 - RNA, 22 nt, Human
uggcugaguuccuggcacacgg

SEQ ID NO: 474107 - RNA, 20 nt, Human
gugcaauggcgcaaucucgg

SEQ ID NO: 474108 - RNA, 17 nt, Human
cucuccuuccucugagg

SEQ ID NO: 474109 - RNA, 22 nt, Human
gccuggagacaaggacaaaggg

SEQ ID NO: 474110 - RNA, 20 nt, Human
gcacugaaauucaauguuug

SEQ ID NO: 474111 - RNA, 22 nt, Human
gccugccuguuggcugaggugc

SEQ ID NO: 474112 - RNA, 22 nt, Human
acauuucuaucauccuguaaug

SEQ ID NO: 474113 - RNA, 22 nt, Human
gaagagcuauguccagggagca

SEQ ID NO: 474114 - RNA, 22 nt, Human
ugugcagcucuagagccaagcc

SEQ ID NO: 474115 - RNA, 22 nt, Human
ccagagaguaggaggcauuauu

SEQ ID NO: 474116 - RNA, 22 nt, Human
cugcugugugaccauggacagg

SEQ ID NO: 474117 - RNA, 22 nt, Human
uccaggcacgaggcccugugca

SEQ ID NO: 474118 - RNA, 22 nt, Human
ccagcuuuaucaagucugagcu

SEQ ID NO: 474119 - RNA, 22 nt, Human
guuugcauaucugugaaaugga

SEQ ID NO: 474120 - RNA, 22 nt, Human
cuuucauucuuagauauuagug

SEQ ID NO: 474121 - RNA, 22 nt, Human
acaacugucaguaaagaauauu

SEQ ID NO: 474122 - RNA, 21 nt, Human
ugggggagaauugguugcuuu

SEQ ID NO: 474123 - RNA, 22 nt, Human
cucacagguaccagcacccucc

SEQ ID NO: 474124 - RNA, 22 nt, Human
cugcucugcagcuuggacuccc

SEQ ID NO: 474125 - RNA, 22 nt, Human
cacauuuaauccuuuauaagua

SEQ ID NO: 474126 - RNA, 22 nt, Human
gugcugagcugcagaugcgcuc

SEQ ID NO: 474127 - RNA, 22 nt, Human
caauaauauccugugcuguuug

SEQ ID NO: 474128 - RNA, 22 nt, Human
agggccaggaucacagccaaga

SEQ ID NO: 474129 - RNA, 23 nt, Human
uucaagauacgguuuccaggcug

SEQ ID NO: 474130 - RNA, 22 nt, Human
augggaggcagcagagcccagc

SEQ ID NO: 474131 - RNA, 22 nt, Human
ucaccacugaacagaccuuugg

SEQ ID NO: 474132 - RNA, 22 nt, Human
gaggccuggcugucagucccca

SEQ ID NO: 474133 - RNA, 22 nt, Human
agcagggccugagugaccuaac

SEQ ID NO: 474134 - RNA, 20 nt, Human
uguucacaguaguugcugcu

SEQ ID NO: 474135 - RNA, 22 nt, Human
cucugcaugccuugcucagaca

SEQ ID NO: 474136 - RNA, 22 nt, Human
guggccugccagcagauggcgc

SEQ ID NO: 474137 - RNA, 22 nt, Human
ugcuggaggaguuuacuguggc

SEQ ID NO: 474138 - RNA, 22 nt, Human
ccagagcaauucucacagaacu

SEQ ID NO: 474139 - RNA, 22 nt, Human
caggcagaguuagugauuuagg

SEQ ID NO: 474140 - RNA, 22 nt, Human
gcucuugucaaaaauuaguuga

SEQ ID NO: 474141 - RNA, 22 nt, Human
uggaccugggguggccuccucu

SEQ ID NO: 474142 - RNA, 23 nt, Human
ccucccaggcugcgagucccgag

SEQ ID NO: 474143 - RNA, 22 nt, Human
aggcacuguggaagacaugguu

SEQ ID NO: 474144 - RNA, 22 nt, Human
uggaggcagucaaaugacugac

SEQ ID NO: 474145 - RNA, 22 nt, Human
agcaaaguagcugcuguucuua

SEQ ID NO: 474146 - RNA, 22 nt, Human
uaucuugagagacaacacagca

SEQ ID NO: 474147 - RNA, 22 nt, Human
uggcugaacuaaugugcuguuu

SEQ ID NO: 474148 - RNA, 18 nt, Human
cagcagagacauucaaaa

SEQ ID NO: 474149 - RNA, 22 nt, Human
ugaagugaccuggggcagugua

SEQ ID NO: 474150 - RNA, 22 nt, Human
agcucccagcuccuuugagaga

SEQ ID NO: 474151 - RNA, 22 nt, Human
agcugguuagcaaucuaaguga

SEQ ID NO: 474152 - RNA, 22 nt, Human
cauagagugauguaagguaugu

SEQ ID NO: 474153 - RNA, 22 nt, Human
ugcauuaucuuuaauguucuca

SEQ ID NO: 474154 - RNA, 21 nt, Human
cucacaggaugcaguguuacu

SEQ ID NO: 474155 - RNA, 22 nt, Human
uggaagaauaggauagaagaac

SEQ ID NO: 474156 - RNA, 19 nt, Human
ccagagcccgccagauggg

SEQ ID NO: 474157 - RNA, 22 nt, Human
auguacauuuuccuaauguuuu

SEQ ID NO: 474158 - RNA, 22 nt, Human
ccagagagagaggucaauggca

SEQ ID NO: 474159 - RNA, 22 nt, Human
acccacgaagaugagcggcaug

SEQ ID NO: 474160 - RNA, 22 nt, Human
gucaccagucccagcuccugaa

SEQ ID NO: 474161 - RNA, 22 nt, Human
cgggcagauugggaagguucau

SEQ ID NO: 474162 - RNA, 23 nt, Human
uggcucagggucucuuaugaagu

SEQ ID NO: 474163 - RNA, 22 nt, Human
cuccauugaacauccucucaga

SEQ ID NO: 474164 - RNA, 22 nt, Human
cuagucacucagcacugacaaa

SEQ ID NO: 474165 - RNA, 22 nt, Human
gcugucuucacuuccugguuuc

SEQ ID NO: 474166 - RNA, 22 nt, Human
acagccagaggugguccugggu

SEQ ID NO: 474167 - RNA, 22 nt, Human
aagucagcacuccaggaagcca

SEQ ID NO: 474168 - RNA, 22 nt, Human
acacaggagauauguaauggcu

SEQ ID NO: 474169 - RNA, 22 nt, Human
uccuucagggcugaccacaggc

SEQ ID NO: 474170 - RNA, 22 nt, Human
acacacacaagcagguugugga

SEQ ID NO: 474171 - RNA, 22 nt, Human
aggcaguuucugggacagcaua

SEQ ID NO: 474172 - RNA, 22 nt, Human
cauucacucagcgaugccagua

SEQ ID NO: 474173 - RNA, 22 nt, Human
ccuggcugaaccaaugaagugg

SEQ ID NO: 474174 - RNA, 19 nt, Human
uggaagaggaagggaaaua

SEQ ID NO: 474175 - RNA, 22 nt, Human
cuuauuuugcugaugacccagg

SEQ ID NO: 474176 - RNA, 22 nt, Human
cccugcagugugaccucaccua

SEQ ID NO: 474177 - RNA, 22 nt, Human
cagggagcuggcuggcgugagu

SEQ ID NO: 474178 - RNA, 22 nt, Human
ggucuuccgagaggccugugcu

SEQ ID NO: 474179 - RNA, 22 nt, Human
acagaggccgccucucucacgg

SEQ ID NO: 474180 - RNA, 19 nt, Human
uguuggugcggauguggag

SEQ ID NO: 474181 - RNA, 22 nt, Human
gaaauucaggacaaagacucuu

SEQ ID NO: 474182 - RNA, 22 nt, Human
uggucucugacucugaagaccc

SEQ ID NO: 474183 - RNA, 22 nt, Human
ugucugucugcaagccagaaag

SEQ ID NO: 474184 - RNA, 22 nt, Human
ucaguggauuggaugagaucug

SEQ ID NO: 474185 - RNA, 22 nt, Human
cagaaggcuuuguggaguagac

SEQ ID NO: 474186 - RNA, 22 nt, Human
uccuguggaagacaguguuggg

SEQ ID NO: 474187 - RNA, 22 nt, Human
ccuccaguacuccaguccagcg

SEQ ID NO: 474188 - RNA, 22 nt, Human
ggucauuguucuuuucugugau

SEQ ID NO: 474189 - RNA, 23 nt, Human
cuuuccuuucuuugacacccagc

SEQ ID NO: 474190 - RNA, 22 nt, Human
aggugucuuugcggcccgccgc

SEQ ID NO: 474191 - RNA, 18 nt, Human
gggcucacacaggucauc

SEQ ID NO: 474192 - RNA, 22 nt, Human
agaaugcauuuuguguagcuau

SEQ ID NO: 474193 - RNA, 22 nt, Human
cuggccacaacuagcccaggac

SEQ ID NO: 474194 - RNA, 22 nt, Human
aagcugccuagaguugaauguc

SEQ ID NO: 474195 - RNA, 22 nt, Human
ucucugagcccaauguagcaau

SEQ ID NO: 474196 - RNA, 22 nt, Human
cagucccaucucccagguggcu

SEQ ID NO: 474197 - RNA, 22 nt, Human
ugugucagagguagagauggca

SEQ ID NO: 474198 - RNA, 22 nt, Human
auguaguauuuggaaauguaaa

SEQ ID NO: 474199 - RNA, 22 nt, Human
acuguccauucacucauauuca

SEQ ID NO: 474200 - RNA, 22 nt, Human
cagucacauugcccugcauuua

SEQ ID NO: 474201 - RNA, 22 nt, Human
uacaggaggauuaucaaaggau

SEQ ID NO: 474202 - RNA, 22 nt, Human
ucugggcccuaaaccagcucua

SEQ ID NO: 474203 - RNA, 19 nt, Human
cucuuaaauugucucuugc

SEQ ID NO: 474204 - RNA, 22 nt, Human
agaagaaaugugaaggccacug

SEQ ID NO: 474205 - RNA, 22 nt, Human
ggaugcaggaguugaagaagga

SEQ ID NO: 474206 - RNA, 22 nt, Human
uuagcaucugcuguaagcuuau

SEQ ID NO: 474207 - RNA, 22 nt, Human
cccugccuucuuggccuuuaaa

SEQ ID NO: 474208 - RNA, 22 nt, Human
cuucccacuaguaucacagagc

SEQ ID NO: 474209 - RNA, 22 nt, Human
cucagaguccccaguggguuug

SEQ ID NO: 474210 - RNA, 22 nt, Human
ucugggcuugguuagggcuguu

SEQ ID NO: 474211 - RNA, 20 nt, Human
cuuguacaugauaaagauuu

SEQ ID NO: 474212 - RNA, 22 nt, Human
ggggccuguagagcuucaggga

SEQ ID NO: 474213 - RNA, 22 nt, Human
acauuaucccuggcacaacugc

SEQ ID NO: 474214 - RNA, 22 nt, Human
ggccucuguuuggagccaggau

SEQ ID NO: 474215 - RNA, 22 nt, Human
uaugcacauucacacaaaaaug

SEQ ID NO: 474216 - RNA, 22 nt, Human
agaaggaguguacaggucaugc

SEQ ID NO: 474217 - RNA, 22 nt, Human
gaggaaggcuaaggggcuuaga

SEQ ID NO: 474218 - RNA, 20 nt, Human
ugucauuguuucuaggaccu

SEQ ID NO: 474219 - RNA, 22 nt, Human
uuuccuucaucaucugagagcu

SEQ ID NO: 474220 - RNA, 22 nt, Human
uggcuucuuagaccaguggccu

SEQ ID NO: 474221 - RNA, 22 nt, Human
acagguggccccgagggagugg

SEQ ID NO: 474222 - RNA, 22 nt, Human
gcccaugcucucaggcgggccu

SEQ ID NO: 474223 - RNA, 22 nt, Human
ugcuuccagcucucuguaaggu

SEQ ID NO: 474224 - RNA, 22 nt, Human
aaguugaagcaugaaccaaggu

SEQ ID NO: 474225 - RNA, 22 nt, Human
gggucuggcaugcugagaugga

SEQ ID NO: 474226 - RNA, 22 nt, Human
uauucacagcugccgcacucag

SEQ ID NO: 474227 - RNA, 22 nt, Human
aggccugucuggggcucagcca

SEQ ID NO: 474228 - RNA, 22 nt, Human
uccugucugucuuuggucccuu

SEQ ID NO: 474229 - RNA, 22 nt, Human
uucuaacucuguuauguguuuc

SEQ ID NO: 474230 - RNA, 22 nt, Human
aggaccuggaucacagagaucu

SEQ ID NO: 474231 - RNA, 22 nt, Human
gaagucugacucuuuguaagcu

SEQ ID NO: 474232 - RNA, 22 nt, Human
cccaggcagugcugaucccuca

SEQ ID NO: 474233 - RNA, 22 nt, Human
uggcucuguuuguuaacuagac

SEQ ID NO: 474234 - RNA, 22 nt, Human
ugugcaguuucuauguugucca

SEQ ID NO: 474235 - RNA, 17 nt, Human
ccucccacaccgcccug

SEQ ID NO: 474236 - RNA, 22 nt, Human
caguugaugggacucauguggg

SEQ ID NO: 474237 - RNA, 22 nt, Human
cagauuuaccuaacuccaaguu

SEQ ID NO: 474238 - RNA, 21 nt, Human
uggagcugccacuuguccucc

SEQ ID NO: 474239 - RNA, 22 nt, Human
auaagagcuagucuuuuccuug

SEQ ID NO: 474240 - RNA, 22 nt, Human
gauucugagcugguguuuuacg

SEQ ID NO: 474241 - RNA, 22 nt, Human
cugagucucccggcaguggagg

SEQ ID NO: 474242 - RNA, 22 nt, Human
auugaaagcauggauuuggauu

SEQ ID NO: 474243 - RNA, 22 nt, Human
gcauuccuacaggcugcuauga

SEQ ID NO: 474244 - RNA, 22 nt, Human
cauucugcauuuggaaggggca

SEQ ID NO: 474245 - RNA, 22 nt, Human
gggcugagcacauacugacagc

SEQ ID NO: 474246 - RNA, 21 nt, Human
uggcagggguaguaguacagc

SEQ ID NO: 474247 - RNA, 22 nt, Human
aagggcagcugacagaugcuua

SEQ ID NO: 474248 - RNA, 22 nt, Human
gcucugcugucuucuugcaggc

SEQ ID NO: 474249 - RNA, 22 nt, Human
ccugcuuaacauugccaugaca

SEQ ID NO: 474250 - RNA, 22 nt, Human
aaguucaaggugauaguggcag

SEQ ID NO: 474251 - RNA, 22 nt, Human
uuccuuguuuguagcucuggga

SEQ ID NO: 474252 - RNA, 23 nt, Human
uggacgccgacuuuggaggcgcu

SEQ ID NO: 474253 - RNA, 17 nt, Human
gcuggcugacccaugcc

SEQ ID NO: 474254 - RNA, 22 nt, Human
ggccugucucacccccgggugc

SEQ ID NO: 474255 - RNA, 22 nt, Human
uggagcuggaauuugagcugga

SEQ ID NO: 474256 - RNA, 22 nt, Human
ucuauacaugugcacacacauc

SEQ ID NO: 474257 - RNA, 22 nt, Human
acagggcagguggcuacugguc

SEQ ID NO: 474258 - RNA, 22 nt, Human
ugcuggccaauggcagaggcgg

SEQ ID NO: 474259 - RNA, 22 nt, Human
uaaagguaugucuuaaucaaac

SEQ ID NO: 474260 - RNA, 22 nt, Human
uuugaaaggugucgagaugugu

SEQ ID NO: 474261 - RNA, 17 nt, Human
gccaaaggguuccaauc

SEQ ID NO: 474262 - RNA, 19 nt, Human
cucucacucgccacauccu

SEQ ID NO: 474263 - RNA, 22 nt, Human
ucaguuuugauuccugguucuc

SEQ ID NO: 474264 - RNA, 22 nt, Human
ggccucucuccagucagugcag

SEQ ID NO: 474265 - RNA, 22 nt, Human
guggaggguuugcaaugugcag

SEQ ID NO: 474266 - RNA, 22 nt, Human
agaagccaauccuugucucucu

SEQ ID NO: 474267 - RNA, 19 nt, Human
gccugggaugggcagaacu

SEQ ID NO: 474268 - RNA, 22 nt, Human
cagagcuggggacuguuggaug

SEQ ID NO: 474269 - RNA, 22 nt, Human
aaugauggauuuagacaagcug

SEQ ID NO: 474270 - RNA, 22 nt, Human
uuuuauucucaagacaauggga

SEQ ID NO: 474271 - RNA, 22 nt, Human
cugcucugagaggcucuuccua

SEQ ID NO: 474272 - RNA, 19 nt, Human
gccugcagaaaaggcaggg

SEQ ID NO: 474273 - RNA, 16 nt, Human
uguuagcugugcauua

SEQ ID NO: 474274 - RNA, 22 nt, Human
auguaguguagagauuagucuc

SEQ ID NO: 474275 - RNA, 22 nt, Human
cccagcagauggcuaugugcua

SEQ ID NO: 474276 - RNA, 22 nt, Human
ucaaugauuagaguuuagugug

SEQ ID NO: 474277 - RNA, 22 nt, Human
gaagaacaccugcugcccagug

SEQ ID NO: 474278 - RNA, 22 nt, Human
cccugcagagccagcccugacc

SEQ ID NO: 474279 - RNA, 22 nt, Human
aggacccagaggcagaggacgu

SEQ ID NO: 474280 - RNA, 19 nt, Human
agcagagcccugaagaucc

SEQ ID NO: 474281 - RNA, 22 nt, Human
agaguguuucagucuuccuaga

SEQ ID NO: 474282 - RNA, 22 nt, Human
uggagugaaguaaagaggacaa

SEQ ID NO: 474283 - RNA, 22 nt, Human
guaagagcacugucuccugcug

SEQ ID NO: 474284 - RNA, 22 nt, Human
cagcaucaccgccauuucugau

SEQ ID NO: 474285 - RNA, 23 nt, Human
auuuccuacuauaaaagagguaa

SEQ ID NO: 474286 - RNA, 22 nt, Human
uacuuuggauccuuacaauagc

SEQ ID NO: 474287 - RNA, 22 nt, Human
gagagugaggccugggaaucua

SEQ ID NO: 474288 - RNA, 22 nt, Human
ugcucuguauucuauggcaguu

SEQ ID NO: 474289 - RNA, 20 nt, Human
agacccuguguccuguggcc

SEQ ID NO: 474290 - RNA, 22 nt, Human
cugaggcacagugaacuucucc

SEQ ID NO: 474291 - RNA, 22 nt, Human
cacugcuuuuuuggcuauguac

SEQ ID NO: 474292 - RNA, 22 nt, Human
ugaaacaaaccaguaauuuugu

SEQ ID NO: 474293 - RNA, 22 nt, Human
gagguagccacagauagagacu

SEQ ID NO: 474294 - RNA, 22 nt, Human
ugaaaucugucccacuuuagcu

SEQ ID NO: 474295 - RNA, 22 nt, Human
ggaggggccggcugccugccac

SEQ ID NO: 474296 - RNA, 22 nt, Human
cauuuauucucagauccuuguc

SEQ ID NO: 474297 - RNA, 22 nt, Human
ggaccugcucucccaguucucu

SEQ ID NO: 474298 - RNA, 23 nt, Human
gggaccagcuagggcugugaccu

SEQ ID NO: 474299 - RNA, 22 nt, Human
gcaggggaguccacucuaugca

SEQ ID NO: 474300 - RNA, 22 nt, Human
auagauacauuagguaacuugu

SEQ ID NO: 474301 - RNA, 22 nt, Human
cugcucuggcguacucggcauc

SEQ ID NO: 474302 - RNA, 22 nt, Human
cuggggcucacuuuggucaggc

SEQ ID NO: 474303 - RNA, 22 nt, Human
ggaggcaggaaagacagguuca

SEQ ID NO: 474304 - RNA, 22 nt, Human
gccuccuggccuuugcuccuca

SEQ ID NO: 474305 - RNA, 18 nt, Human
cugugcagcaaacugagc

SEQ ID NO: 474306 - RNA, 22 nt, Human
cacaguggauugggugaugccc

SEQ ID NO: 474307 - RNA, 22 nt, Human
agcagaagaaagccacaugacu

SEQ ID NO: 474308 - RNA, 22 nt, Human
gaggcugguucugaaguacugu

SEQ ID NO: 474309 - RNA, 22 nt, Human
cuggcaggagcauucacagagg

SEQ ID NO: 474310 - RNA, 22 nt, Human
ggcucccaggagggccuggagg

SEQ ID NO: 474311 - RNA, 22 nt, Human
aucucagacauguuguccauga

SEQ ID NO: 474312 - RNA, 22 nt, Human
ucaaaggcugcuugucuucugg

SEQ ID NO: 474313 - RNA, 22 nt, Human
ccuccaggauaagucagggccu

SEQ ID NO: 474314 - RNA, 22 nt, Human
caggacagagcccagacugugu

SEQ ID NO: 474315 - RNA, 22 nt, Human
ccuggagcacauggcaggaggc

SEQ ID NO: 474316 - RNA, 22 nt, Human
aaauguucccaauaugaagcug

SEQ ID NO: 474317 - RNA, 22 nt, Human
ugucccaggcugaaguacagug

SEQ ID NO: 474318 - RNA, 22 nt, Human
aaacaguauuaucaauauauuu

SEQ ID NO: 474319 - RNA, 23 nt, Human
ucagcugcuuccuccugccugcc

SEQ ID NO: 474320 - RNA, 22 nt, Human
uuuauuauguacaggcacuaua

SEQ ID NO: 474321 - RNA, 22 nt, Human
ucaaaugcaggucuggucuugg

SEQ ID NO: 474322 - RNA, 22 nt, Human
cugcagggcccgccugagcccu

SEQ ID NO: 474323 - RNA, 22 nt, Human
cuggagccuagguugaccuggg

SEQ ID NO: 474324 - RNA, 22 nt, Human
ucagagguaagggcugagagga

SEQ ID NO: 474325 - RNA, 22 nt, Human
agcugguucauucauucauggu

SEQ ID NO: 474326 - RNA, 22 nt, Human
ugucauguguucuuaaauacau

SEQ ID NO: 474327 - RNA, 22 nt, Human
ucagggcaagucucagaagguu

SEQ ID NO: 474328 - RNA, 22 nt, Human
cagaagcaaaugccuugcugag

SEQ ID NO: 474329 - RNA, 22 nt, Human
cucacaggagaaagucaugguc

SEQ ID NO: 474330 - RNA, 22 nt, Human
uggaggcaguuuaagucugaga

SEQ ID NO: 474331 - RNA, 22 nt, Human
auagaaauggcagcuggugcua

SEQ ID NO: 474332 - RNA, 22 nt, Human
uacuuucuguccuucuguuaaa

SEQ ID NO: 474333 - RNA, 22 nt, Human
gguggccucugcaggccucgac

SEQ ID NO: 474334 - RNA, 22 nt, Human
uggcucagcauucacuggucuu

SEQ ID NO: 474335 - RNA, 22 nt, Human
cucagaaucugccaaguucagg

SEQ ID NO: 474336 - RNA, 19 nt, Human
gcuccugggccucacucau

SEQ ID NO: 474337 - RNA, 22 nt, Human
auuacaguaacagcuacaaugc

SEQ ID NO: 474338 - RNA, 22 nt, Human
ggcagcucugaugaugcucugg

SEQ ID NO: 474339 - RNA, 22 nt, Human
uuucugaagggcagcagacucu

SEQ ID NO: 474340 - RNA, 22 nt, Human
ggagcuguugcgcaugcgcucg

SEQ ID NO: 474341 - RNA, 22 nt, Human
aagcugccagcugagcugaggc

SEQ ID NO: 474342 - RNA, 22 nt, Human
cucgcaggacagugcuaggacu

SEQ ID NO: 474343 - RNA, 22 nt, Human
agggucaguucugugagguguu

SEQ ID NO: 474344 - RNA, 22 nt, Human
ucuccuuuaagauuuccucagg

SEQ ID NO: 474345 - RNA, 22 nt, Human
auguaucaauuaucugucugca

SEQ ID NO: 474346 - RNA, 19 nt, Human
uucaggauugacccuacug

SEQ ID NO: 474347 - RNA, 22 nt, Human
cccagccuggugcacugugggg

SEQ ID NO: 474348 - RNA, 22 nt, Human
gggucccaggaaggagcagugu

SEQ ID NO: 474349 - RNA, 18 nt, Human
gcagcuuuugauucaccc

SEQ ID NO: 474350 - RNA, 22 nt, Human
agggaaaguaagcauuucauua

SEQ ID NO: 474351 - RNA, 22 nt, Human
aaugggagagaacacaaagucc

SEQ ID NO: 474352 - RNA, 17 nt, Human
uccuucagugccucugc

SEQ ID NO: 474353 - RNA, 22 nt, Human
ucccaaagcuacucuucugacu

SEQ ID NO: 474354 - RNA, 22 nt, Human
auugaaaauauaauucuaggag

SEQ ID NO: 474355 - RNA, 22 nt, Human
agaggcccucucucuccugaug

SEQ ID NO: 474356 - RNA, 22 nt, Human
agccauggcgccacuagaggga

SEQ ID NO: 474357 - RNA, 22 nt, Human
uucuuuaaaauagugagaaaga

SEQ ID NO: 474358 - RNA, 19 nt, Human
cuugguuaugguaugaugc

SEQ ID NO: 474359 - RNA, 22 nt, Human
aaaggugacacucugccagcug

SEQ ID NO: 474360 - RNA, 22 nt, Human
uagugcacacgcauguagcagu

SEQ ID NO: 474361 - RNA, 22 nt, Human
ucccagccacagguguagcccu

SEQ ID NO: 474362 - RNA, 22 nt, Human
aagugacaaaaggguauccaaa

SEQ ID NO: 474363 - RNA, 22 nt, Human
uucagcagugcagacacccagu

SEQ ID NO: 474364 - RNA, 20 nt, Human
ugaaaggugggaauuguggg

SEQ ID NO: 474365 - RNA, 22 nt, Human
cuggcucccagcuuucagggag

SEQ ID NO: 474366 - RNA, 22 nt, Human
uggaccugcguaggugcugggc

SEQ ID NO: 474367 - RNA, 22 nt, Human
ugaaaaaacaaguuggcccauu

SEQ ID NO: 474368 - RNA, 22 nt, Human
cugagcgcaugguugcugggga

SEQ ID NO: 474369 - RNA, 22 nt, Human
ccaccagcagugugcaaggauu

SEQ ID NO: 474370 - RNA, 21 nt, Human
cacaggugggucagugaggcc

SEQ ID NO: 474371 - RNA, 22 nt, Human
gggcacagagggucuugaagaa

SEQ ID NO: 474372 - RNA, 22 nt, Human
uccagggauguccuguagcacu

SEQ ID NO: 474373 - RNA, 22 nt, Human
cagggcuggcuguggcaaucuc

SEQ ID NO: 474374 - RNA, 22 nt, Human
cagcuguguagaugcaggguca

SEQ ID NO: 474375 - RNA, 22 nt, Human
auauuucuugagcaccugguau

SEQ ID NO: 474376 - RNA, 22 nt, Human
gagggcugcuggaaaaaugcag

SEQ ID NO: 474377 - RNA, 22 nt, Human
uuuguuuagaugguaaaucagu

SEQ ID NO: 474378 - RNA, 22 nt, Human
cagugaggugcccagccugccc

SEQ ID NO: 474379 - RNA, 22 nt, Human
uucaggaucaaguugccaguag

SEQ ID NO: 474380 - RNA, 22 nt, Human
uacaaaguauauuucuagcugu

SEQ ID NO: 474381 - RNA, 22 nt, Human
ucuccucucuuaccugguacaa

SEQ ID NO: 474382 - RNA, 22 nt, Human
auuugucuucaguagguucuuc

SEQ ID NO: 474383 - RNA, 22 nt, Human
uuggccuuguuaaggaggcccu

SEQ ID NO: 474384 - RNA, 22 nt, Human
uuuaaauucugucugccgcuua

SEQ ID NO: 474385 - RNA, 22 nt, Human
cacugaagcuuucauucucuug

SEQ ID NO: 474386 - RNA, 22 nt, Human
gagagggcugccuggugugagg

SEQ ID NO: 474387 - RNA, 22 nt, Human
uuagaaagcuuuccauagucaa

SEQ ID NO: 474388 - RNA, 22 nt, Human
gagcaggccagcaauggaaggg

SEQ ID NO: 474389 - RNA, 22 nt, Human
uuguugucauuguagaggauuu

SEQ ID NO: 474390 - RNA, 22 nt, Human
cagcaagauuuuuaaagcaagg

SEQ ID NO: 474391 - RNA, 22 nt, Human
gacccagcuuaagucacauguu

SEQ ID NO: 474392 - RNA, 22 nt, Human
uccaggaggugaggggaccaaa

SEQ ID NO: 474393 - RNA, 20 nt, Human
ucccaaggaugccugggugu

SEQ ID NO: 474394 - RNA, 22 nt, Human
cugguccuugacgcgugggagg

SEQ ID NO: 474395 - RNA, 22 nt, Human
ugaguccauguggaggggaggu

SEQ ID NO: 474396 - RNA, 21 nt, Human
ggacaccagucacacuggauu

SEQ ID NO: 474397 - RNA, 22 nt, Human
aaauguguuucuuugugaaugg

SEQ ID NO: 474398 - RNA, 22 nt, Human
uaugcauacaaugagauauucc

SEQ ID NO: 474399 - RNA, 22 nt, Human
acagagagguaaaauauauagu

SEQ ID NO: 474400 - RNA, 22 nt, Human
uacaggaagcacucaagaaaug

SEQ ID NO: 474401 - RNA, 22 nt, Human
auaaggcagaaaugauucuagu

SEQ ID NO: 474402 - RNA, 22 nt, Human
uccuggccgccgcguggggccg

SEQ ID NO: 474403 - RNA, 22 nt, Human
cauugcucaggcccagcaggaa

SEQ ID NO: 474404 - RNA, 22 nt, Human
gaugguuugguaaaaguauguu

SEQ ID NO: 474405 - RNA, 22 nt, Human
gaugauggacaaagcauuggug

SEQ ID NO: 474406 - RNA, 22 nt, Human
cagcuuccaucuccacugcccu

SEQ ID NO: 474407 - RNA, 22 nt, Human
aggaggccccuccuggguugcu

SEQ ID NO: 474408 - RNA, 22 nt, Human
agccuggcuguaaccucauggu

SEQ ID NO: 474409 - RNA, 22 nt, Human
uugcagcagggugaauucacuc

SEQ ID NO: 474410 - RNA, 22 nt, Human
ggagggagucagcugauuagaa

SEQ ID NO: 474411 - RNA, 22 nt, Human
cuacagaaaaucagccacaggc

SEQ ID NO: 474412 - RNA, 22 nt, Human
uucauuaguucugaagaugucu

SEQ ID NO: 474413 - RNA, 22 nt, Human
cagugucuuauuuguagcucag

SEQ ID NO: 474414 - RNA, 22 nt, Human
cuguuuaucccuuuggucagca

SEQ ID NO: 474415 - RNA, 22 nt, Human
cucuguccuaugcuugauagaa

SEQ ID NO: 474416 - RNA, 22 nt, Human
ugcagggcccuugggguugaac

SEQ ID NO: 474417 - RNA, 22 nt, Human
uucaggaugcagagguuguagu

SEQ ID NO: 474418 - RNA, 22 nt, Human
caguccaggccuggaggagcca

SEQ ID NO: 474419 - RNA, 22 nt, Human
uggcuggggccugaauccugca

SEQ ID NO: 474420 - RNA, 22 nt, Human
uuagauaauguagagauaugag

SEQ ID NO: 474421 - RNA, 22 nt, Human
acugaaagauaaaucaguuagc

SEQ ID NO: 474422 - RNA, 22 nt, Human
auuauguauuugguauaguuug

SEQ ID NO: 474423 - RNA, 22 nt, Human
agguggcucugacagcucuggu

SEQ ID NO: 474424 - RNA, 22 nt, Human
caggggcuuuuccucuauaagg

SEQ ID NO: 474425 - RNA, 23 nt, Human
ccugggcauuggcugcagcuucu

SEQ ID NO: 474426 - RNA, 22 nt, Human
ucucaggaucuaauacauggua

SEQ ID NO: 474427 - RNA, 22 nt, Human
aaaaaccuuucccauacuaaga

SEQ ID NO: 474428 - RNA, 22 nt, Human
ccuggccucagccuagggcuga

SEQ ID NO: 474429 - RNA, 22 nt, Human
ggcuucuccccuuugagucuuc

SEQ ID NO: 474430 - RNA, 18 nt, Human
gccugccuagagcuugcc

SEQ ID NO: 474431 - RNA, 22 nt, Human
accauguguuuuacacauggua

SEQ ID NO: 474432 - RNA, 22 nt, Human
aucuacagcugucugcacagua

SEQ ID NO: 474433 - RNA, 22 nt, Human
gggccuggggacaccaccauga

SEQ ID NO: 474434 - RNA, 22 nt, Human
ucccacugcuuugcucugcuca

SEQ ID NO: 474435 - RNA, 22 nt, Human
ggcucaguguuuguggaacaua

SEQ ID NO: 474436 - RNA, 22 nt, Human
cugguccuccuugccuucagau

SEQ ID NO: 474437 - RNA, 16 nt, Human
cagaguguaaacagga

SEQ ID NO: 474438 - RNA, 18 nt, Human
uggcucagauggcuuuaa

SEQ ID NO: 474439 - RNA, 22 nt, Human
ucauuacaguguuuauaugucu

SEQ ID NO: 474440 - RNA, 22 nt, Human
accaggcaaaaccacaggagca

SEQ ID NO: 474441 - RNA, 19 nt, Human
uuuacucuccaaggugagu

SEQ ID NO: 474442 - RNA, 22 nt, Human
agugcaugccuuccuguggaug

SEQ ID NO: 474443 - RNA, 22 nt, Human
agaggcugagaaacccucuucu

SEQ ID NO: 474444 - RNA, 23 nt, Human
aggaacugaggccuagggaggua

SEQ ID NO: 474445 - RNA, 22 nt, Human
gcagcugggacacugaggccag

SEQ ID NO: 474446 - RNA, 22 nt, Human
aggagaguaccauugggccgca

SEQ ID NO: 474447 - RNA, 22 nt, Human
gggagggaggugcugguucacg

SEQ ID NO: 474448 - RNA, 21 nt, Human
uuugaaagcccuauguuuuca

SEQ ID NO: 474449 - RNA, 22 nt, Human
ugcagccaggaaauauuugcug

SEQ ID NO: 474450 - RNA, 22 nt, Human
gagcacagcuggagguagcauu

SEQ ID NO: 474451 - RNA, 23 nt, Human
agcuggguggccugcgugaagcu

SEQ ID NO: 474452 - RNA, 22 nt, Human
uccagcuuauagguagauuuaa

SEQ ID NO: 474453 - RNA, 22 nt, Human
agacaaguucugugggucaccu

SEQ ID NO: 474454 - RNA, 22 nt, Human
cagaagcauugacuccuugcuc

SEQ ID NO: 474455 - RNA, 22 nt, Human
cucaguuucugacauuaaaauc

SEQ ID NO: 474456 - RNA, 22 nt, Human
ucauugcaguagggagagaccc

SEQ ID NO: 474457 - RNA, 22 nt, Human
auaauauaauccuacuucccau

SEQ ID NO: 474458 - RNA, 22 nt, Human
gcaucuaaauaaacgugggagu

SEQ ID NO: 474459 - RNA, 22 nt, Human
uccuucagucuucugagccaua

SEQ ID NO: 474460 - RNA, 22 nt, Human
uccuggccucacaguccugggu

SEQ ID NO: 474461 - RNA, 22 nt, Human
uaacacugauuuguucucaggg

SEQ ID NO: 474462 - RNA, 22 nt, Human
agggccagggaagcuguauuuu

SEQ ID NO: 474463 - RNA, 22 nt, Human
cagcugggagcuccauuagaua

SEQ ID NO: 474464 - RNA, 22 nt, Human
cuggaaggcucugcugccuguc

SEQ ID NO: 474465 - RNA, 22 nt, Human
uccuggagcuuccuucauggua

SEQ ID NO: 474466 - RNA, 22 nt, Human
uggccugggugcugcugacauc

SEQ ID NO: 474467 - RNA, 20 nt, Human
agccagaagaaggcuggaga

SEQ ID NO: 474468 - RNA, 22 nt, Human
ugcuggccaacaaggcuccaag

SEQ ID NO: 474469 - RNA, 22 nt, Human
guuugcauaaaguggaugcagg

SEQ ID NO: 474470 - RNA, 20 nt, Human
ggccuuggccucuuugcagc

SEQ ID NO: 474471 - RNA, 21 nt, Human
gcaggcuggucaaaccucagu

SEQ ID NO: 474472 - RNA, 23 nt, Human
uaagaacagacaagcauuuacau

SEQ ID NO: 474473 - RNA, 22 nt, Human
accuggcaugaagcaugccuua

SEQ ID NO: 474474 - RNA, 22 nt, Human
gcccuuccaacccagagggcaa

SEQ ID NO: 474475 - RNA, 22 nt, Human
aguggcaggcagaagcuucuca

SEQ ID NO: 474476 - RNA, 18 nt, Human
ccgggcuuuggugacaca

SEQ ID NO: 474477 - RNA, 22 nt, Human
gcugugcuggaaggggaccugc

SEQ ID NO: 474478 - RNA, 22 nt, Human
cacagcuuguuuagugacucac

SEQ ID NO: 474479 - RNA, 22 nt, Human
ucucuucugaaaccugucuuua

SEQ ID NO: 474480 - RNA, 22 nt, Human
ccagccugguucagaauuggcu

SEQ ID NO: 474481 - RNA, 22 nt, Human
ccucugcucccuggugucugag

SEQ ID NO: 474482 - RNA, 22 nt, Human
gaacccaggcuuuugaggcugu

SEQ ID NO: 474483 - RNA, 22 nt, Human
gcugccuguccugaggaguccg

SEQ ID NO: 474484 - RNA, 22 nt, Human
cccuggagggcagacagaugcc

SEQ ID NO: 474485 - RNA, 20 nt, Human
cccugagacaaaggaggggc

SEQ ID NO: 474486 - RNA, 22 nt, Human
guagaagugaugucauguuaua

SEQ ID NO: 474487 - RNA, 20 nt, Human
cucaggauugucuagccccu

SEQ ID NO: 474488 - RNA, 22 nt, Human
gcuguacaaauuccacaagaga

SEQ ID NO: 474489 - RNA, 22 nt, Human
gggccuggcaugcagccccguu

SEQ ID NO: 474490 - RNA, 22 nt, Human
cccaggcagccugcagggaagg

SEQ ID NO: 474491 - RNA, 22 nt, Human
uuggaggcaaugggaaggaggc

SEQ ID NO: 474492 - RNA, 22 nt, Human
uggaggcauaggccugggcccu

SEQ ID NO: 474493 - RNA, 22 nt, Human
aggccugagguuccugugcuca

SEQ ID NO: 474494 - RNA, 22 nt, Human
uagcagcuuaaguaauuagaau

SEQ ID NO: 474495 - RNA, 20 nt, Human
cguaaggcaagugcugcauc

SEQ ID NO: 474496 - RNA, 22 nt, Human
aggaugggccugggauaugcuu

SEQ ID NO: 474497 - RNA, 22 nt, Human
cuuacaaaggagaggagauagg

SEQ ID NO: 474498 - RNA, 22 nt, Human
uugcaaaagccgaggcacucca

SEQ ID NO: 474499 - RNA, 22 nt, Human
gacagcagacagaacuaccugc

SEQ ID NO: 474500 - RNA, 22 nt, Human
gugauuucuaaucaucugaaug

SEQ ID NO: 474501 - RNA, 22 nt, Human
gaagagcuuagacagaaucaaa

SEQ ID NO: 474502 - RNA, 22 nt, Human
uguguacaggccuugcuagacu

SEQ ID NO: 474503 - RNA, 22 nt, Human
acagagcauauaaagugcuuug

SEQ ID NO: 474504 - RNA, 21 nt, Human
agcagcagaucuggugagggc

SEQ ID NO: 474505 - RNA, 22 nt, Human
aggcuccuaucgcuuucagcaa

SEQ ID NO: 474506 - RNA, 18 nt, Human
gcaggugccacugcuguu

SEQ ID NO: 474507 - RNA, 22 nt, Human
ugaaagguguccaauauuucuc

SEQ ID NO: 474508 - RNA, 22 nt, Human
ucugggcucuuaguguacccuc

SEQ ID NO: 474509 - RNA, 22 nt, Human
uuagccaugugggaaaaacagc

SEQ ID NO: 474510 - RNA, 20 nt, Human
gcagagcuguucugugggga

SEQ ID NO: 474511 - RNA, 22 nt, Human
ugaggcuccagccaggccagca

SEQ ID NO: 474512 - RNA, 22 nt, Human
uuauuuaaaagugguaagauuc

SEQ ID NO: 474513 - RNA, 22 nt, Human
auaugugugccauuucagcagu

SEQ ID NO: 474514 - RNA, 22 nt, Human
auugacaagcaguaugucuuag

SEQ ID NO: 474515 - RNA, 22 nt, Human
guuauuuuaacuucucaguaau

SEQ ID NO: 474516 - RNA, 22 nt, Human
gugucaugggguuuguuauaca

SEQ ID NO: 474517 - RNA, 22 nt, Human
uccaggcagggcagccaucaag

SEQ ID NO: 474518 - RNA, 23 nt, Human
gagguacagcaccagugaauagg

SEQ ID NO: 474519 - RNA, 22 nt, Human
aaggggaaaaaguguuaggagu

SEQ ID NO: 474520 - RNA, 22 nt, Human
aggugcuggagucugggcagga

SEQ ID NO: 474521 - RNA, 22 nt, Human
cccagcaggcauguugggagga

SEQ ID NO: 474522 - RNA, 23 nt, Human
gugugccaagcacugugccagga

SEQ ID NO: 474523 - RNA, 22 nt, Human
cagcucucacacccuccuccca

SEQ ID NO: 474524 - RNA, 21 nt, Human
uggcagaguugaguaguuaug

SEQ ID NO: 474525 - RNA, 22 nt, Human
uagggcucagagaaguggggcc

SEQ ID NO: 474526 - RNA, 22 nt, Human
caguacuuugaagauauuuuag

SEQ ID NO: 474527 - RNA, 22 nt, Human
agcugggaugauaaccucaguc

SEQ ID NO: 474528 - RNA, 22 nt, Human
augcugaagagugcacaggcua

SEQ ID NO: 474529 - RNA, 22 nt, Human
guacauuucucuuguucuuauu

SEQ ID NO: 474530 - RNA, 22 nt, Human
ccucugggagacugcuacugag

SEQ ID NO: 474531 - RNA, 22 nt, Human
cuuccugcauugugccagaguu

SEQ ID NO: 474532 - RNA, 22 nt, Human
aguggcagagguugacugcagu

SEQ ID NO: 474533 - RNA, 22 nt, Human
ucacacgugagguucuauccug

SEQ ID NO: 474534 - RNA, 22 nt, Human
ucauugucuugauaugauuguc

SEQ ID NO: 474535 - RNA, 22 nt, Human
gcagugacagggcugcugccuu

SEQ ID NO: 474536 - RNA, 22 nt, Human
auggacaggaacucccuuggca

SEQ ID NO: 474537 - RNA, 22 nt, Human
ugcacccucaucagucaaaugg

SEQ ID NO: 474538 - RNA, 22 nt, Human
ccugucugcagauaucucaggu

SEQ ID NO: 474539 - RNA, 22 nt, Human
gccugccuuuguaugacccuga

SEQ ID NO: 474540 - RNA, 22 nt, Human
aacaggcaaacugugggauccc

SEQ ID NO: 474541 - RNA, 22 nt, Human
cuggccuagcucucugcuugaa

SEQ ID NO: 474542 - RNA, 22 nt, Human
ggagccagagggaugcaguuga

SEQ ID NO: 474543 - RNA, 22 nt, Human
aaauuaguacauugcaaagucc

SEQ ID NO: 474544 - RNA, 21 nt, Human
gcagccagacgggauucaguu

SEQ ID NO: 474545 - RNA, 22 nt, Human
cagcagcaguggcugcagaaca

SEQ ID NO: 474546 - RNA, 22 nt, Human
ugcuggcucaguuugcagacuc

SEQ ID NO: 474547 - RNA, 22 nt, Human
aggauccuuuuucugcuguuug

SEQ ID NO: 474548 - RNA, 22 nt, Human
ccugcagguugcagaggcggaa

SEQ ID NO: 474549 - RNA, 22 nt, Human
agccacgucccugucaggguca

SEQ ID NO: 474550 - RNA, 22 nt, Human
uagcagcuuccagagagggcag

SEQ ID NO: 474551 - RNA, 22 nt, Human
ugaggcagaaaauagcaguuca

SEQ ID NO: 474552 - RNA, 22 nt, Human
acaaugcaccagcaucuucacc

SEQ ID NO: 474553 - RNA, 22 nt, Human
accagguggccccagcgugguu

SEQ ID NO: 474554 - RNA, 22 nt, Human
ugugccagccucuggcuguguc

SEQ ID NO: 474555 - RNA, 22 nt, Human
gauccuugcacuugacuuggca

SEQ ID NO: 474556 - RNA, 22 nt, Human
ucaggcagaauuaucaaaagau

SEQ ID NO: 474557 - RNA, 22 nt, Human
cuggcucacuagcccugcccug

SEQ ID NO: 474558 - RNA, 20 nt, Human
ucucagcauaagaacccuuc

SEQ ID NO: 474559 - RNA, 22 nt, Human
gggggcuguccugugcauugua

SEQ ID NO: 474560 - RNA, 22 nt, Human
auuagggcuggaugcaaggaaa

SEQ ID NO: 474561 - RNA, 21 nt, Human
uggcacugcuuagcagguucc

SEQ ID NO: 474562 - RNA, 22 nt, Human
gagccuguguuuccuguagcca

SEQ ID NO: 474563 - RNA, 22 nt, Human
auuccaaagacagaagcagcug

SEQ ID NO: 474564 - RNA, 20 nt, Human
ugugcccaauguccagguuc

SEQ ID NO: 474565 - RNA, 22 nt, Human
aggcaggcaaccaccugggaag

SEQ ID NO: 474566 - RNA, 22 nt, Human
aaggccugaacaugaggagaug

SEQ ID NO: 474567 - RNA, 22 nt, Human
gagcagcucgagaaggaagcag

SEQ ID NO: 474568 - RNA, 22 nt, Human
gcuccagaugaaaggccagagg

SEQ ID NO: 474569 - RNA, 22 nt, Human
cauggcccucuucuggagcaau

SEQ ID NO: 474570 - RNA, 22 nt, Human
ugaggcagguaagcaaguuuug

SEQ ID NO: 474571 - RNA, 23 nt, Human
aagaauaaaugacauuaaaggug

SEQ ID NO: 474572 - RNA, 22 nt, Human
gcugcugcgcuugucuacuguu

SEQ ID NO: 474573 - RNA, 22 nt, Human
uggcugaggagggucuucuggu

SEQ ID NO: 474574 - RNA, 22 nt, Human
aauggccagcugggagaguuga

SEQ ID NO: 474575 - RNA, 22 nt, Human
cuuugcauacaauuuuuagaaa

SEQ ID NO: 474576 - RNA, 22 nt, Human
agccugccuugggcugcuugag

SEQ ID NO: 474577 - RNA, 22 nt, Human
ucucuccuuaucauuguguuua

SEQ ID NO: 474578 - RNA, 22 nt, Human
ucuggcuccacuuucuucauuu

SEQ ID NO: 474579 - RNA, 22 nt, Human
aaugggaagucacuacuguuac

SEQ ID NO: 474580 - RNA, 22 nt, Human
uaaaugcaguuaguacuugcca

SEQ ID NO: 474581 - RNA, 22 nt, Human
uggcucagugcauucacaguaa

SEQ ID NO: 474582 - RNA, 22 nt, Human
agaagaaacugucggggauauu

SEQ ID NO: 474583 - RNA, 22 nt, Human
ucaguggagcuaagcaugagau

SEQ ID NO: 474584 - RNA, 22 nt, Human
gagggcagugaauuuugaagcu

SEQ ID NO: 474585 - RNA, 23 nt, Human
ucuggcuccauccuuggggaucc

SEQ ID NO: 474586 - RNA, 22 nt, Human
aggucaccauggcaugcuccac

SEQ ID NO: 474587 - RNA, 22 nt, Human
ucagcugccuuucccaugcuag

SEQ ID NO: 474588 - RNA, 22 nt, Human
ggcaugggagugagcaaccuua

SEQ ID NO: 474589 - RNA, 22 nt, Human
uccagcagcccgaaggcccauc

SEQ ID NO: 474590 - RNA, 22 nt, Human
acagcagcacuauugacauuuu

SEQ ID NO: 474591 - RNA, 22 nt, Human
ggauggagguucucagaugcuc

SEQ ID NO: 474592 - RNA, 22 nt, Human
uccuggagaauccugccaccug

SEQ ID NO: 474593 - RNA, 22 nt, Human
gggagagguuacccgagcaacu

SEQ ID NO: 474594 - RNA, 22 nt, Human
agcuuccugaugcaagagggcu

SEQ ID NO: 474595 - RNA, 22 nt, Human
ucaugucaguuucuucuauaaa

SEQ ID NO: 474596 - RNA, 22 nt, Human
auccuugagccaaugacugauu

SEQ ID NO: 474597 - RNA, 22 nt, Human
cccaggaggccaagguugcagu

SEQ ID NO: 474598 - RNA, 22 nt, Human
gaggcucagagggacuuucaag

SEQ ID NO: 474599 - RNA, 22 nt, Human
acuuucucaaaucagacuuuaa

SEQ ID NO: 474600 - RNA, 21 nt, Human
aaaugaaugugguagugcaag

SEQ ID NO: 474601 - RNA, 22 nt, Human
uggagagcgugcuuagcacucu

SEQ ID NO: 474602 - RNA, 22 nt, Human
aaauuucuaagcagccacuucc

SEQ ID NO: 474603 - RNA, 20 nt, Human
cauuuguuagcuuucuacug

SEQ ID NO: 474604 - RNA, 22 nt, Human
uagcagggccaggcugggaacc

SEQ ID NO: 474605 - RNA, 22 nt, Human
cuggcucaugugaugagggcaa

SEQ ID NO: 474606 - RNA, 22 nt, Human
aggagucaggaccaaauggaaa

SEQ ID NO: 474607 - RNA, 22 nt, Human
gcugaagcccacguggcuugua

SEQ ID NO: 474608 - RNA, 22 nt, Human
agugaaauugcuguaagaggaa

SEQ ID NO: 474609 - RNA, 22 nt, Human
auuuuuuagaaccuggccugau

SEQ ID NO: 474610 - RNA, 22 nt, Human
ucccagagcucugacaccagcu

SEQ ID NO: 474611 - RNA, 22 nt, Human
ggccucgcggcuucugguggcu

SEQ ID NO: 474612 - RNA, 19 nt, Human
cuguccuuggcugcacugu

SEQ ID NO: 474613 - RNA, 22 nt, Human
cccuggagucagguuggccugg

SEQ ID NO: 474614 - RNA, 22 nt, Human
agaagccagcuucagcugcccg

SEQ ID NO: 474615 - RNA, 22 nt, Human
cagagagcuuagugugcugcau

SEQ ID NO: 474616 - RNA, 22 nt, Human
gauuucaaaaguagauccauca

SEQ ID NO: 474617 - RNA, 22 nt, Human
cccuggcagaaugucucugggc

SEQ ID NO: 474618 - RNA, 22 nt, Human
uucuaguuuagggcucuucaac

SEQ ID NO: 474619 - RNA, 17 nt, Human
cuggagccaagagggcc

SEQ ID NO: 474620 - RNA, 22 nt, Human
gcagugccuugcuucucugucu

SEQ ID NO: 474621 - RNA, 22 nt, Human
cacugcucgcugcagcauggcc

SEQ ID NO: 474622 - RNA, 22 nt, Human
uuaaacagagucugaaauguaa

SEQ ID NO: 474623 - RNA, 22 nt, Human
gcagaagggaauaaggagcuuu

SEQ ID NO: 474624 - RNA, 22 nt, Human
ccagcccugucaccaacuggag

SEQ ID NO: 474625 - RNA, 22 nt, Human
gucucagaguccuacuuauucc

SEQ ID NO: 474626 - RNA, 22 nt, Human
guccucagggaauguggcgggu

SEQ ID NO: 474627 - RNA, 22 nt, Human
gagcuuugcuggaagccugggg

SEQ ID NO: 474628 - RNA, 17 nt, Human
cccagagaugcugccuu

SEQ ID NO: 474629 - RNA, 19 nt, Human
agguggucuaggcuggaga

SEQ ID NO: 474630 - RNA, 23 nt, Human
agcagccagagauccucggcccu

SEQ ID NO: 474631 - RNA, 19 nt, Human
cagaccuguccagccugug

SEQ ID NO: 474632 - RNA, 22 nt, Human
agcagccauccuuagagaaaga

SEQ ID NO: 474633 - RNA, 22 nt, Human
gcugccugauguccagcaggac

SEQ ID NO: 474634 - RNA, 22 nt, Human
ucucacagugcaggucugucuc

SEQ ID NO: 474635 - RNA, 22 nt, Human
uccaggcagcccuuccugacuc

SEQ ID NO: 474636 - RNA, 22 nt, Human
ccucaugguacuuacuguagcu

SEQ ID NO: 474637 - RNA, 18 nt, Human
ucuuggaguaaugaucaa

SEQ ID NO: 474638 - RNA, 22 nt, Human
cauaucccauuggccaggacau

SEQ ID NO: 474639 - RNA, 22 nt, Human
acacagccaggguaguaaggcu

SEQ ID NO: 474640 - RNA, 22 nt, Human
ugcuuuauguggcugauacuca

SEQ ID NO: 474641 - RNA, 22 nt, Human
ggagccaguauuuaguggucuu

SEQ ID NO: 474642 - RNA, 22 nt, Human
auccaaagcccuaaguuaacug

SEQ ID NO: 474643 - RNA, 22 nt, Human
ucugagaguagagcugccucuu

SEQ ID NO: 474644 - RNA, 22 nt, Human
agccuggagaggcgccauacac

SEQ ID NO: 474645 - RNA, 22 nt, Human
acauuucuuuucaucucuauau

SEQ ID NO: 474646 - RNA, 22 nt, Human
ccucuggguaucuguggaagua

SEQ ID NO: 474647 - RNA, 22 nt, Human
aacaaagucguugccuagaaga

SEQ ID NO: 474648 - RNA, 21 nt, Human
gggugcuguggucaugcagga

SEQ ID NO: 474649 - RNA, 21 nt, Human
ggacuuacauagguaaggggu

SEQ ID NO: 474650 - RNA, 22 nt, Human
gggaucagcaagccacugcacc

SEQ ID NO: 474651 - RNA, 22 nt, Human
uuccuguauuuugcgaauuuuc

SEQ ID NO: 474652 - RNA, 22 nt, Human
ccaggccuggccaggggaugcc

SEQ ID NO: 474653 - RNA, 22 nt, Human
acagagcuaaauuucaauccca

SEQ ID NO: 474654 - RNA, 22 nt, Human
cagcaugguggagcugcucuuu

SEQ ID NO: 474655 - RNA, 21 nt, Human
agagacugucacugcaguacc

SEQ ID NO: 474656 - RNA, 22 nt, Human
cuuauuuuaagucaguuugggu

SEQ ID NO: 474657 - RNA, 22 nt, Human
ggucagccuuggauuugguagc

SEQ ID NO: 474658 - RNA, 22 nt, Human
cagauccacccuuguagugaca

SEQ ID NO: 474659 - RNA, 22 nt, Human
agucccagaugacccagcuacu

SEQ ID NO: 474660 - RNA, 22 nt, Human
ggccuuggugccauggccaguu

SEQ ID NO: 474661 - RNA, 17 nt, Human
guccugggaggagagag

SEQ ID NO: 474662 - RNA, 22 nt, Human
gggugacauuucccaaugagcc

SEQ ID NO: 474663 - RNA, 17 nt, Human
aggugcuggagcaucag

SEQ ID NO: 474664 - RNA, 22 nt, Human
cccccuggcaggcuggccucuc

SEQ ID NO: 474665 - RNA, 22 nt, Human
agguggggaggagugucucuuu

SEQ ID NO: 474666 - RNA, 22 nt, Human
acaggacauguaccaggugguc

SEQ ID NO: 474667 - RNA, 22 nt, Human
ccagcuccaggacugggagcug

SEQ ID NO: 474668 - RNA, 22 nt, Human
uguagcucuccagccagcaagg

SEQ ID NO: 474669 - RNA, 22 nt, Human
uuccauaauaaccugagagaaa

SEQ ID NO: 474670 - RNA, 22 nt, Human
aaaggcuccuucucccaugacc

SEQ ID NO: 474671 - RNA, 22 nt, Human
ggacaggguaaguacuagugug

SEQ ID NO: 474672 - RNA, 22 nt, Human
ggccucucuccuuggcuugcag

SEQ ID NO: 474673 - RNA, 22 nt, Human
uugagaagaggcuuuguaggaa

SEQ ID NO: 474674 - RNA, 20 nt, Human
gucucaaguaucucacaguc

SEQ ID NO: 474675 - RNA, 22 nt, Human
uucaggaggugagcaagaaggg

SEQ ID NO: 474676 - RNA, 22 nt, Human
aaaguguugggauuacaggugu

SEQ ID NO: 474677 - RNA, 22 nt, Human
aaauaauuauagcgagucuauc

SEQ ID NO: 474678 - RNA, 17 nt, Human
ucuguccagggagugug

SEQ ID NO: 474679 - RNA, 22 nt, Human
aggacccugaggucuccuguga

SEQ ID NO: 474680 - RNA, 22 nt, Human
gcuucccacagcuggacugggg

SEQ ID NO: 474681 - RNA, 22 nt, Human
cagcucuggcgucagggagcga

SEQ ID NO: 474682 - RNA, 22 nt, Human
cucuggagcaccgggcuaucca

SEQ ID NO: 474683 - RNA, 17 nt, Human
uccaggcagcaacugag

SEQ ID NO: 474684 - RNA, 22 nt, Human
gccucccuggcccacagcagcg

SEQ ID NO: 474685 - RNA, 22 nt, Human
ccaaggagcucauauucuuguu

SEQ ID NO: 474686 - RNA, 22 nt, Human
cagcuucccuuggcugagcaga

SEQ ID NO: 474687 - RNA, 22 nt, Human
gaccucagugaauggucaugua

SEQ ID NO: 474688 - RNA, 22 nt, Human
ggccuggccuccagaugugggc

SEQ ID NO: 474689 - RNA, 22 nt, Human
auaugccauuagcuagaaauaa

SEQ ID NO: 474690 - RNA, 22 nt, Human
uucaggauucugugucugacaa

SEQ ID NO: 474691 - RNA, 22 nt, Human
acagauuuauugaagcugcugc

SEQ ID NO: 474692 - RNA, 22 nt, Human
agcauuuaauuacaguuuaauu

SEQ ID NO: 474693 - RNA, 22 nt, Human
cucucccccacagcagccuucu

SEQ ID NO: 474694 - RNA, 22 nt, Human
uauugaggaucuccugcuaauu

SEQ ID NO: 474695 - RNA, 22 nt, Human
agaagugagugugacucagcag

SEQ ID NO: 474696 - RNA, 22 nt, Human
gccugcagcugcuuccacacac

SEQ ID NO: 474697 - RNA, 22 nt, Human
gugcuuccaucuagagggucac

SEQ ID NO: 474698 - RNA, 22 nt, Human
gccaggcaauguguuagaagcg

SEQ ID NO: 474699 - RNA, 22 nt, Human
auuuucaucauggguuuaacau

SEQ ID NO: 474700 - RNA, 22 nt, Human
ucacaucucccuggaggacaca

SEQ ID NO: 474701 - RNA, 22 nt, Human
ucagggcaaagggcagaguuug

SEQ ID NO: 474702 - RNA, 22 nt, Human
cugagggcccugaagcuuggca

SEQ ID NO: 474703 - RNA, 22 nt, Human
ugcugccuuugggaccuggccu

SEQ ID NO: 474704 - RNA, 22 nt, Human
caggugcucccagagaagugcu

SEQ ID NO: 474705 - RNA, 22 nt, Human
caaaugcuaacuucuuuccaaa

SEQ ID NO: 474706 - RNA, 22 nt, Human
auguaucaugcaggguccauga

SEQ ID NO: 474707 - RNA, 22 nt, Human
gguuucaacuucaaccucucca

SEQ ID NO: 474708 - RNA, 22 nt, Human
agagccaggaaguggcgugggg

SEQ ID NO: 474709 - RNA, 22 nt, Human
uaagaauuguguugaauagagu

SEQ ID NO: 474710 - RNA, 22 nt, Human
uugcaggggaaggagcagagcu

SEQ ID NO: 474711 - RNA, 22 nt, Human
gccagcaguccugcugugugcc

SEQ ID NO: 474712 - RNA, 22 nt, Human
cugcugagcccuggcacaggug

SEQ ID NO: 474713 - RNA, 22 nt, Human
gggcugcuuuuuucuuagcaga

SEQ ID NO: 474714 - RNA, 22 nt, Human
ucaggccacuucacaggugauu

SEQ ID NO: 474715 - RNA, 22 nt, Human
gcugcaggagcuggagcugugg

SEQ ID NO: 474716 - RNA, 22 nt, Human
ccaggcagggcucaaggaaccu

SEQ ID NO: 474717 - RNA, 23 nt, Human
auaaggcauaaagguacauugga

SEQ ID NO: 474718 - RNA, 22 nt, Human
ccaggcagagugcuccagaaag

SEQ ID NO: 474719 - RNA, 18 nt, Human
cagucccaaaccuuagga

SEQ ID NO: 474720 - RNA, 22 nt, Human
aggagggagcuuaagccaggca

SEQ ID NO: 474721 - RNA, 22 nt, Human
caggcugcggucggcucugguc

SEQ ID NO: 474722 - RNA, 22 nt, Human
gaugugggguugagggaccagc

SEQ ID NO: 474723 - RNA, 22 nt, Human
cccugcagaaccacagacaaac

SEQ ID NO: 474724 - RNA, 21 nt, Human
caggaaaagcggaagucuagc

SEQ ID NO: 474725 - RNA, 22 nt, Human
ccagugcccagcugcccaggca

SEQ ID NO: 474726 - RNA, 22 nt, Human
gcaaggcugagcacauuugcau

SEQ ID NO: 474727 - RNA, 22 nt, Human
gccuggaguuguggugaagcca

SEQ ID NO: 474728 - RNA, 20 nt, Human
aggcacuggauuucuuauau

SEQ ID NO: 474729 - RNA, 22 nt, Human
agggucccgaaggagacagcaa

SEQ ID NO: 474730 - RNA, 22 nt, Human
caauagcagcuucugaaugcaa

SEQ ID NO: 474731 - RNA, 22 nt, Human
ccugagugcuuccagagucaug

SEQ ID NO: 474732 - RNA, 22 nt, Human
agccacagcaacaagugcaauu

SEQ ID NO: 474733 - RNA, 22 nt, Human
uugacagcaaagauugugccua

SEQ ID NO: 474734 - RNA, 20 nt, Human
ggcucugcuugugagcagcc

SEQ ID NO: 474735 - RNA, 22 nt, Human
caaaggcugccacuguggcugu

SEQ ID NO: 474736 - RNA, 22 nt, Human
gacagccaugcacuucugcugu

SEQ ID NO: 474737 - RNA, 20 nt, Human
gccagcacagggagcaguuc

SEQ ID NO: 474738 - RNA, 22 nt, Human
aggaagccugcaggugacugcu

SEQ ID NO: 474739 - RNA, 22 nt, Human
uccaggcagucauuaaucucua

SEQ ID NO: 474740 - RNA, 22 nt, Human
gucuggagccacccuaagcauu

SEQ ID NO: 474741 - RNA, 22 nt, Human
uuucuuucaauucuccuaaugc

SEQ ID NO: 474742 - RNA, 22 nt, Human
acagggcaccugagguaggaag

SEQ ID NO: 474743 - RNA, 19 nt, Human
gcuuuuuguugucaaaggu

SEQ ID NO: 474744 - RNA, 22 nt, Human
gaagcagcgaaguggaagggac

SEQ ID NO: 474745 - RNA, 22 nt, Human
augugcaaauccaaugugaaug

SEQ ID NO: 474746 - RNA, 22 nt, Human
agucaguuaaccucacagcauc

SEQ ID NO: 474747 - RNA, 22 nt, Human
agaugcugcuccacaggccagg

SEQ ID NO: 474748 - RNA, 22 nt, Human
ugcauuguuugauaggugaauu

SEQ ID NO: 474749 - RNA, 22 nt, Human
caaagguauucucauuuuggaa

SEQ ID NO: 474750 - RNA, 22 nt, Human
cagcaggcagccauuucacugu

SEQ ID NO: 474751 - RNA, 22 nt, Human
gcccagcacagcuggaagaguc

SEQ ID NO: 474752 - RNA, 22 nt, Human
ugcugucccccgugucugggcu

SEQ ID NO: 474753 - RNA, 22 nt, Human
ugaaggccuaacuuccagugcu

SEQ ID NO: 474754 - RNA, 22 nt, Human
ugcucuggaguggcuugugcac

SEQ ID NO: 474755 - RNA, 22 nt, Human
gagcugccagacaugggaauga

SEQ ID NO: 474756 - RNA, 22 nt, Human
gagcucccuggagguucagaua

SEQ ID NO: 474757 - RNA, 22 nt, Human
ccaggauggggagcagauagaa

SEQ ID NO: 474758 - RNA, 23 nt, Human
agaugaggcuucuccauguuggu

SEQ ID NO: 474759 - RNA, 22 nt, Human
gagcccaggcagagguugcagu

SEQ ID NO: 474760 - RNA, 22 nt, Human
gugcagcugugugagagcucca

SEQ ID NO: 474761 - RNA, 22 nt, Human
agccuauuccaggaugagcuca

SEQ ID NO: 474762 - RNA, 19 nt, Human
guggccucggagcgcgcgg

SEQ ID NO: 474763 - RNA, 22 nt, Human
agcugucuaccugcagaguccu

SEQ ID NO: 474764 - RNA, 22 nt, Human
uggagcaggacugcugcccuca

SEQ ID NO: 474765 - RNA, 22 nt, Human
agcagggggaguuagacuagau

SEQ ID NO: 474766 - RNA, 22 nt, Human
agguggccggugccagccgggc

SEQ ID NO: 474767 - RNA, 22 nt, Human
gacaagacuauguagaaaguau

SEQ ID NO: 474768 - RNA, 22 nt, Human
uacauggguagguuaagucaua

SEQ ID NO: 474769 - RNA, 22 nt, Human
cagaccagaaggaagccgacaa

SEQ ID NO: 474770 - RNA, 22 nt, Human
caggccucccggugcacacuga

SEQ ID NO: 474771 - RNA, 22 nt, Human
ucugccugagggagcugaggaa

SEQ ID NO: 474772 - RNA, 22 nt, Human
acguguucaauuuccaucugac

SEQ ID NO: 474773 - RNA, 22 nt, Human
cucugagcuccuggaagcgugc

SEQ ID NO: 474774 - RNA, 22 nt, Human
agagacaccgcgcaucauggcu

SEQ ID NO: 474775 - RNA, 22 nt, Human
agcccagaggcugggcgugcau

SEQ ID NO: 474776 - RNA, 22 nt, Human
ggguccagcuacaucagggugg

SEQ ID NO: 474777 - RNA, 22 nt, Human
acagaauucuaguauguggcuu

SEQ ID NO: 474778 - RNA, 22 nt, Human
aggccucacauugggcuucaag

SEQ ID NO: 474779 - RNA, 22 nt, Human
cugcuuccaugcaauggcaguc

SEQ ID NO: 474780 - RNA, 22 nt, Human
gucacuguauccagguuccagc

SEQ ID NO: 474781 - RNA, 22 nt, Human
gcucaggagcucuugguggcgc

SEQ ID NO: 474782 - RNA, 22 nt, Human
ggccgggcaggucucagccagc

SEQ ID NO: 474783 - RNA, 22 nt, Human
aggcgugggaggaucugaggcc

SEQ ID NO: 474784 - RNA, 20 nt, Human
ucugcccaccccggcuccca

SEQ ID NO: 474785 - RNA, 22 nt, Human
agcugucugucuccugaggaga

SEQ ID NO: 474786 - RNA, 22 nt, Human
gcuccucugucaaaugagagug

SEQ ID NO: 474787 - RNA, 22 nt, Human
caggucccgccccgggcugacc

SEQ ID NO: 474788 - RNA, 18 nt, Human
gggcauggaugcagcauc

SEQ ID NO: 474789 - RNA, 22 nt, Human
aggcagcaagauuauuuaaucc

SEQ ID NO: 474790 - RNA, 22 nt, Human
gagcucagauucuggugucaga

SEQ ID NO: 474791 - RNA, 22 nt, Human
aagcuggaacaucuugaggaag

SEQ ID NO: 474792 - RNA, 22 nt, Human
gucccuggaucugggacagcug

SEQ ID NO: 474793 - RNA, 22 nt, Human
ugcuggccgugagcucucggga

SEQ ID NO: 474794 - RNA, 22 nt, Human
caggaugaagggcaaaggcaag

SEQ ID NO: 474795 - RNA, 22 nt, Human
uuauuucauguaaaauuuaugu

SEQ ID NO: 474796 - RNA, 22 nt, Human
uuguuuugcuaaagggucauca

SEQ ID NO: 474797 - RNA, 22 nt, Human
ucaguuuucucaucuguaauuu

SEQ ID NO: 474798 - RNA, 22 nt, Human
aggcucaguauagcuggcaagu

SEQ ID NO: 474799 - RNA, 22 nt, Human
aggaccuguguuuuccuugaau

SEQ ID NO: 474800 - RNA, 22 nt, Human
ugcuggcuguauaugugagagu

SEQ ID NO: 474801 - RNA, 22 nt, Human
ugggugcuucgucagcucugag

SEQ ID NO: 474802 - RNA, 18 nt, Human
cuuguucuucucuuggcg

SEQ ID NO: 474803 - RNA, 22 nt, Human
acagcuuuuuacuaauagauug

SEQ ID NO: 474804 - RNA, 22 nt, Human
gccugggugucgaucacuagug

SEQ ID NO: 474805 - RNA, 22 nt, Human
ggcuccuguggcaagacagcuu

SEQ ID NO: 474806 - RNA, 18 nt, Human
cuuuaugugcagagcuuu

SEQ ID NO: 474807 - RNA, 22 nt, Human
cagguggagcugacugagggca

SEQ ID NO: 474808 - RNA, 22 nt, Human
aggcagcccacaggacacagga

SEQ ID NO: 474809 - RNA, 22 nt, Human
uggccugccucccggcuucuuu

SEQ ID NO: 474810 - RNA, 23 nt, Human
cccagagcacagccuccagaugc

SEQ ID NO: 474811 - RNA, 23 nt, Human
cucccuggaguuucuggaagaug

SEQ ID NO: 474812 - RNA, 22 nt, Human
aauuugauuuucuuaaaccaua

SEQ ID NO: 474813 - RNA, 22 nt, Human
caaaguuuaaaguagauuucag

SEQ ID NO: 474814 - RNA, 22 nt, Human
ccucgcggcacucgggccggau

SEQ ID NO: 474815 - RNA, 22 nt, Human
cacuguacugugaauaaggagg

SEQ ID NO: 474816 - RNA, 22 nt, Human
ugcuguggcaguuuauguauag

SEQ ID NO: 474817 - RNA, 22 nt, Human
cccuggaggcaaagguugcagu

SEQ ID NO: 474818 - RNA, 18 nt, Human
cucagagaugcccuuauu

SEQ ID NO: 474819 - RNA, 22 nt, Human
cucuguccuugcacaguuccua

SEQ ID NO: 474820 - RNA, 22 nt, Human
caaaugaagggagcugaagucu

SEQ ID NO: 474821 - RNA, 18 nt, Human
uguuccaaggaaggaauc

SEQ ID NO: 474822 - RNA, 22 nt, Human
ucaggugggaccugcuaggaca

SEQ ID NO: 474823 - RNA, 22 nt, Human
uccuggaggcaaaugaagacuc

SEQ ID NO: 474824 - RNA, 22 nt, Human
ccuucauugcaucuuuaagaga

SEQ ID NO: 474825 - RNA, 22 nt, Human
gcuggcaggguucucacugaaa

SEQ ID NO: 474826 - RNA, 16 nt, Human
agcagggcgggaagga

SEQ ID NO: 474827 - RNA, 22 nt, Human
cagaaggcauagaugaaggccu

SEQ ID NO: 474828 - RNA, 20 nt, Human
uggcccuguuuucuccaggc

SEQ ID NO: 474829 - RNA, 23 nt, Human
uccagcagagccuuccaggaggg

SEQ ID NO: 474830 - RNA, 22 nt, Human
auugaaagagaauguagcucuu

SEQ ID NO: 474831 - RNA, 22 nt, Human
uuccucaguuagugccugaggc

SEQ ID NO: 474832 - RNA, 22 nt, Human
uguuccaugucuuuguaggacu

SEQ ID NO: 474833 - RNA, 22 nt, Human
gcacccaggcuugggcagcaac

SEQ ID NO: 474834 - RNA, 22 nt, Human
cagggacagccuugggguggcg

SEQ ID NO: 474835 - RNA, 22 nt, Human
cagccagcuucagauccaagcc

SEQ ID NO: 474836 - RNA, 22 nt, Human
cagcuggguuuaguggggugug

SEQ ID NO: 474837 - RNA, 22 nt, Human
gacugccagaaugugaggccug

SEQ ID NO: 474838 - RNA, 22 nt, Human
ggagccuggccuggcucugugu

SEQ ID NO: 474839 - RNA, 22 nt, Human
aaacugaaacaucaucauguug

SEQ ID NO: 474840 - RNA, 22 nt, Human
cagauggaacacagaaaggaga

SEQ ID NO: 474841 - RNA, 22 nt, Human
ggaaagagcccagcagugcuug

SEQ ID NO: 474842 - RNA, 22 nt, Human
ccuucucuacuccugaugcaug

SEQ ID NO: 474843 - RNA, 22 nt, Human
aucaaaguaggcauauguuuuu

SEQ ID NO: 474844 - RNA, 22 nt, Human
aaggcugagagucacaguccua

SEQ ID NO: 474845 - RNA, 22 nt, Human
uaaggcaccuguccaggcuggg

SEQ ID NO: 474846 - RNA, 22 nt, Human
aggcccuguccauggugcugaa

SEQ ID NO: 474847 - RNA, 22 nt, Human
cucugagcugaaacaugagcau

SEQ ID NO: 474848 - RNA, 22 nt, Human
uauuuugacgauuuuaugcaaa

SEQ ID NO: 474849 - RNA, 22 nt, Human
uggacaggaucugagacugaga

SEQ ID NO: 474850 - RNA, 22 nt, Human
caggaaaaaugccaggagucag

SEQ ID NO: 474851 - RNA, 23 nt, Human
acucacaaagcaggaucauguug

SEQ ID NO: 474852 - RNA, 22 nt, Human
uccaugccaggcagucgaugca

SEQ ID NO: 474853 - RNA, 22 nt, Human
agcugccaaguuggaguagcaa

SEQ ID NO: 474854 - RNA, 22 nt, Human
acaaaguuaacaguuggauagu

SEQ ID NO: 474855 - RNA, 22 nt, Human
caccagguggaaaugucacagc

SEQ ID NO: 474856 - RNA, 22 nt, Human
ugcugcauuuaucuucucaaac

SEQ ID NO: 474857 - RNA, 22 nt, Human
cacucaggguacaauggagggc

SEQ ID NO: 474858 - RNA, 22 nt, Human
uccuggaggggacagcaugggc

SEQ ID NO: 474859 - RNA, 22 nt, Human
gaggagcuggcagcgucuccgc

SEQ ID NO: 474860 - RNA, 22 nt, Human
ugccaggccaauucuauuugac

SEQ ID NO: 474861 - RNA, 19 nt, Human
aucuuacagagcagaguac

SEQ ID NO: 474862 - RNA, 22 nt, Human
uccaggcauaaugcccaguggu

SEQ ID NO: 474863 - RNA, 22 nt, Human
ccaggugcucuugccagggcug

SEQ ID NO: 474864 - RNA, 22 nt, Human
ucaggaucaggggccuuuccuu

SEQ ID NO: 474865 - RNA, 22 nt, Human
uaaggccaauuacauauguuca

SEQ ID NO: 474866 - RNA, 18 nt, Human
cauuguacaaugcuuuau

SEQ ID NO: 474867 - RNA, 22 nt, Human
uucaggauuauacucucuuccc

SEQ ID NO: 474868 - RNA, 23 nt, Human
aggcccugccugucccucuuuuu

SEQ ID NO: 474869 - RNA, 18 nt, Human
gcuggcugcacuucugcu

SEQ ID NO: 474870 - RNA, 22 nt, Human
ggccccuggcaccaggcugauu

SEQ ID NO: 474871 - RNA, 22 nt, Human
uucucuuaucuggcauuauugg

SEQ ID NO: 474872 - RNA, 22 nt, Human
uuugaaaauuagacacaggcua

SEQ ID NO: 474873 - RNA, 21 nt, Human
acagagcauaaugguguggca

SEQ ID NO: 474874 - RNA, 22 nt, Human
ucaaaguuuuugagaauuacau

SEQ ID NO: 474875 - RNA, 21 nt, Human
ccuucuccacagggucuccgg

SEQ ID NO: 474876 - RNA, 22 nt, Human
aggcugagccacggggcuggcu

SEQ ID NO: 474877 - RNA, 22 nt, Human
cuuucacauaauugaccuugaa

SEQ ID NO: 474878 - RNA, 22 nt, Human
ucagaaauacuaucagcuuuug

SEQ ID NO: 474879 - RNA, 22 nt, Human
cuggcagcaguuaugaaacaau

SEQ ID NO: 474880 - RNA, 19 nt, Human
cgcaggagccgaggugacc

SEQ ID NO: 474881 - RNA, 22 nt, Human
agccaggaagaaggucacacca

SEQ ID NO: 474882 - RNA, 22 nt, Human
aaggcucucugauggcagcagu

SEQ ID NO: 474883 - RNA, 22 nt, Human
uggcucagaugcucuuccagug

SEQ ID NO: 474884 - RNA, 19 nt, Human
gagcccucuccauggccac

SEQ ID NO: 474885 - RNA, 22 nt, Human
gaggaaaauaacaacuaagggc

SEQ ID NO: 474886 - RNA, 22 nt, Human
ugggccuguugccugaguccau

SEQ ID NO: 474887 - RNA, 22 nt, Human
agggccuggaacugugggcagg

SEQ ID NO: 474888 - RNA, 22 nt, Human
ccuuuccuuuuuagugugggag

SEQ ID NO: 474889 - RNA, 22 nt, Human
gcccucucuucugcagccucca

SEQ ID NO: 474890 - RNA, 22 nt, Human
caggagaaacauaauuuucugg

SEQ ID NO: 474891 - RNA, 22 nt, Human
ugcuuaaaauaguucauuuuug

SEQ ID NO: 474892 - RNA, 22 nt, Human
uucaggaugacaccauguccag

SEQ ID NO: 474893 - RNA, 22 nt, Human
aagggcagcuauuaucgucauc

SEQ ID NO: 474894 - RNA, 22 nt, Human
gggcccacuggcugucugaccc

SEQ ID NO: 474895 - RNA, 22 nt, Human
cagggcugugcccaucuucccc

SEQ ID NO: 474896 - RNA, 22 nt, Human
ccagagaggccaaggucguggu

SEQ ID NO: 474897 - RNA, 22 nt, Human
cuggcagcuucaggacacucgg

SEQ ID NO: 474898 - RNA, 22 nt, Human
ggcagcaguaggagcuaaucuu

SEQ ID NO: 474899 - RNA, 22 nt, Human
ucaguuuuaagguuugagaauu

SEQ ID NO: 474900 - RNA, 19 nt, Human
augagcuggcauuucaggu

SEQ ID NO: 474901 - RNA, 20 nt, Human
acagccagaggaggcagaca

SEQ ID NO: 474902 - RNA, 22 nt, Human
ggccugcuccgggggcugagcu

SEQ ID NO: 474903 - RNA, 22 nt, Human
agggugggcuagacucuucccc

SEQ ID NO: 474904 - RNA, 19 nt, Human
ggucacagggguuacaagg

SEQ ID NO: 474905 - RNA, 21 nt, Human
agauuguauggaggugagagg

SEQ ID NO: 474906 - RNA, 19 nt, Human
gcccugcaggagguggggc

SEQ ID NO: 474907 - RNA, 22 nt, Human
gcagggacugugaucucacaga

SEQ ID NO: 474908 - RNA, 22 nt, Human
ccugggcagggcuggacucuca

SEQ ID NO: 474909 - RNA, 22 nt, Human
aguccaaagcagaugagggcca

SEQ ID NO: 474910 - RNA, 22 nt, Human
agucucagaguaccugagggac

SEQ ID NO: 474911 - RNA, 22 nt, Human
ugcuuuauucagucucugccau

SEQ ID NO: 474912 - RNA, 22 nt, Human
cggcagagcccugagucagccu

SEQ ID NO: 474913 - RNA, 22 nt, Human
ggcugcugguagggguaggaag

SEQ ID NO: 474914 - RNA, 22 nt, Human
caaggccaguccauuuuggaag

SEQ ID NO: 474915 - RNA, 23 nt, Human
ucuuuccucagcacacaccaaga

SEQ ID NO: 474916 - RNA, 22 nt, Human
caaacugagcaucagaaaguuu

SEQ ID NO: 474917 - RNA, 22 nt, Human
gccuggugugcgccgcgcagcu

SEQ ID NO: 474918 - RNA, 22 nt, Human
gugucccaauguucaggacggc

SEQ ID NO: 474919 - RNA, 19 nt, Human
uucacauuggaagaaguag

SEQ ID NO: 474920 - RNA, 19 nt, Human
ccugucugucuucagcuag

SEQ ID NO: 474921 - RNA, 22 nt, Human
aaugaacacagcccucuacuuu

SEQ ID NO: 474922 - RNA, 22 nt, Human
agcuuccuuggcgcugaggccu

SEQ ID NO: 474923 - RNA, 22 nt, Human
aaugggaaagagacuagaugcu

SEQ ID NO: 474924 - RNA, 22 nt, Human
cuuauuagugucugucugaguu

SEQ ID NO: 474925 - RNA, 22 nt, Human
ugaaaguuacaggaaaacagau

SEQ ID NO: 474926 - RNA, 22 nt, Human
agugugaccuuauuuggaaaca

SEQ ID NO: 474927 - RNA, 22 nt, Human
ugggagcaccuugagggcagaa

SEQ ID NO: 474928 - RNA, 22 nt, Human
uuuagggaauagaagaucugaa

SEQ ID NO: 474929 - RNA, 22 nt, Human
ugggaccaagucauuucuuuag

SEQ ID NO: 474930 - RNA, 22 nt, Human
gcacaggcacagagggccacug

SEQ ID NO: 474931 - RNA, 22 nt, Human
cacugaagccacuggaagagga

SEQ ID NO: 474932 - RNA, 22 nt, Human
agcagaacugaugagacuugag

SEQ ID NO: 474933 - RNA, 22 nt, Human
agccuggaagaaccugaagucu

SEQ ID NO: 474934 - RNA, 22 nt, Human
acaaaugcuuaguucaccaaaa

SEQ ID NO: 474935 - RNA, 22 nt, Human
guggccuuuccugaagaaauga

SEQ ID NO: 474936 - RNA, 22 nt, Human
cagggccuccuaaggcaucuaa

SEQ ID NO: 474937 - RNA, 22 nt, Human
guuugcauguguacuuaauugg

SEQ ID NO: 474938 - RNA, 22 nt, Human
uggcucugucaaacugcacaca

SEQ ID NO: 474939 - RNA, 22 nt, Human
ucacaggcuccagggccuggau

SEQ ID NO: 474940 - RNA, 22 nt, Human
ccagcagcgauagggugagugc

SEQ ID NO: 474941 - RNA, 20 nt, Human
acaguggaaauugaugucug

SEQ ID NO: 474942 - RNA, 22 nt, Human
cuuucacacacauacauuugga

SEQ ID NO: 474943 - RNA, 22 nt, Human
aagccagccagugccagucuua

SEQ ID NO: 474944 - RNA, 22 nt, Human
ccuccagcugccucagucucuu

SEQ ID NO: 474945 - RNA, 22 nt, Human
agggcugccugcucugcauuga

SEQ ID NO: 474946 - RNA, 22 nt, Human
ggcagggaguggagacucccua

SEQ ID NO: 474947 - RNA, 22 nt, Human
acagaguuaauggauaggcagg

SEQ ID NO: 474948 - RNA, 22 nt, Human
gccucugcucggacuuugccuc

SEQ ID NO: 474949 - RNA, 22 nt, Human
acuguucauuuggauuucucug

SEQ ID NO: 474950 - RNA, 22 nt, Human
ugggaggcuuccagaccuugcu

SEQ ID NO: 474951 - RNA, 22 nt, Human
guuacacaggaaaacauuagca

SEQ ID NO: 474952 - RNA, 22 nt, Human
gccugagaguugaaguucagug

SEQ ID NO: 474953 - RNA, 22 nt, Human
aaaauguaaagcuugaguguag

SEQ ID NO: 474954 - RNA, 19 nt, Human
cccuggcaggcaagccugg

SEQ ID NO: 474955 - RNA, 22 nt, Human
uucuguguggguagcuccuguu

SEQ ID NO: 474956 - RNA, 22 nt, Human
acagagcuguacaugugccaug

SEQ ID NO: 474957 - RNA, 22 nt, Human
gcaccugguuuauauaaucaua

SEQ ID NO: 474958 - RNA, 22 nt, Human
ggccagagaauaugccuuacgu

SEQ ID NO: 474959 - RNA, 20 nt, Human
cugagcugagcuccaugggu

SEQ ID NO: 474960 - RNA, 21 nt, Human
ccccugggagcccugucagua

SEQ ID NO: 474961 - RNA, 23 nt, Human
agcagcaaaaauuuaucuuucug

SEQ ID NO: 474962 - RNA, 22 nt, Human
gggcugagggguaucucauggg

SEQ ID NO: 474963 - RNA, 22 nt, Human
uugaaaguuaucuagauucuga

SEQ ID NO: 474964 - RNA, 22 nt, Human
ccaggaagcggugagggcugcc

SEQ ID NO: 474965 - RNA, 22 nt, Human
uuugcuauuuuucugugcagcu

SEQ ID NO: 474966 - RNA, 22 nt, Human
cagagagaggccacugcuauua

SEQ ID NO: 474967 - RNA, 22 nt, Human
cgggcagcggcguggccauggu

SEQ ID NO: 474968 - RNA, 22 nt, Human
uuugcauuaucucacuuauaua

SEQ ID NO: 474969 - RNA, 22 nt, Human
uucagagagaccaaguggcgug

SEQ ID NO: 474970 - RNA, 22 nt, Human
gcaaagucucaagacccaagug

SEQ ID NO: 474971 - RNA, 22 nt, Human
cuuaagaauauugaaguugugg

SEQ ID NO: 474972 - RNA, 19 nt, Human
gaggaggcuucagcuuucu

SEQ ID NO: 474973 - RNA, 22 nt, Human
cagguggggcagcugugggagc

SEQ ID NO: 474974 - RNA, 17 nt, Human
uuaaaggaugcucucuc

SEQ ID NO: 474975 - RNA, 22 nt, Human
ugggcagauuaaugcaguggcu

SEQ ID NO: 474976 - RNA, 22 nt, Human
ugccaggccacguagcuucaag

SEQ ID NO: 474977 - RNA, 18 nt, Human
ugaccugcgcuucacggu

SEQ ID NO: 474978 - RNA, 22 nt, Human
uacauuguucaugcaugagaaa

SEQ ID NO: 474979 - RNA, 22 nt, Human
gcucugagagugggugauucug

SEQ ID NO: 474980 - RNA, 22 nt, Human
gcagggucgcucuaggagauca

SEQ ID NO: 474981 - RNA, 22 nt, Human
aggccagaugucgggcuagaag

SEQ ID NO: 474982 - RNA, 22 nt, Human
cacagggcuaaaugaaggguug

SEQ ID NO: 474983 - RNA, 22 nt, Human
uaguggaggccuguugugugca

SEQ ID NO: 474984 - RNA, 20 nt, Human
uccaggagaacugggagccg

SEQ ID NO: 474985 - RNA, 22 nt, Human
agcagcucugagaggccagcac

SEQ ID NO: 474986 - RNA, 22 nt, Human
agcuggugcugaagcucuugag

SEQ ID NO: 474987 - RNA, 22 nt, Human
cacaucagggcugcuugggggu

SEQ ID NO: 474988 - RNA, 22 nt, Human
ggagccuguggccgucacgacu

SEQ ID NO: 474989 - RNA, 22 nt, Human
ccacugaaggucaacauagagc

SEQ ID NO: 474990 - RNA, 22 nt, Human
gacauaaaccuugagauauuaa

SEQ ID NO: 474991 - RNA, 22 nt, Human
uacuguacugcaguucugcaaa

SEQ ID NO: 474992 - RNA, 22 nt, Human
cuggcucacaggugagaugcau

SEQ ID NO: 474993 - RNA, 22 nt, Human
gcucccagacugaccagaggug

SEQ ID NO: 474994 - RNA, 22 nt, Human
ggaggaagugcaguucuacuac

SEQ ID NO: 474995 - RNA, 20 nt, Human
uccuggccuucucgggcagu

SEQ ID NO: 474996 - RNA, 22 nt, Human
cccuggagugugacgaggcauu

SEQ ID NO: 474997 - RNA, 21 nt, Human
ggggcagagcuaggcccugca

SEQ ID NO: 474998 - RNA, 22 nt, Human
guggccugaugccagcccugug

SEQ ID NO: 474999 - RNA, 22 nt, Human
caguaugucuacuggacaaagu

SEQ ID NO: 475000 - RNA, 22 nt, Human
gaaugcagauggcugguguaug

SEQ ID NO: 475001 - RNA, 22 nt, Human
agcagcaacuuauuuuucuuau

SEQ ID NO: 475002 - RNA, 22 nt, Human
gaccauuucuaggaaucagacu

SEQ ID NO: 475003 - RNA, 15 nt, Human
ugauuuccuacuaac

SEQ ID NO: 475004 - RNA, 22 nt, Human
aggacccugagcgggcaugccg

SEQ ID NO: 475005 - RNA, 22 nt, Human
ucuuggagaauggcagagaagc

SEQ ID NO: 475006 - RNA, 22 nt, Human
ggccuugggcuggcugcaguau

SEQ ID NO: 475007 - RNA, 20 nt, Human
ugacucugcaaccgucucuc

SEQ ID NO: 475008 - RNA, 22 nt, Human
uccuucaguucaauuaguccgu

SEQ ID NO: 475009 - RNA, 22 nt, Human
ccagggugcucuguggcgucgc

SEQ ID NO: 475010 - RNA, 22 nt, Human
caaggccauaagagauacaaaa

SEQ ID NO: 475011 - RNA, 22 nt, Human
agcugggaggugggcagugaga

SEQ ID NO: 475012 - RNA, 22 nt, Human
gagacguggccuuugccugagc

SEQ ID NO: 475013 - RNA, 22 nt, Human
ggucaggguauaaucaagugag

SEQ ID NO: 475014 - RNA, 17 nt, Human
ucagcaaagacaaagga

SEQ ID NO: 475015 - RNA, 22 nt, Human
acugccaggauggcacuagagg

SEQ ID NO: 475016 - RNA, 22 nt, Human
agcuugccucuuaaucaccuca

SEQ ID NO: 475017 - RNA, 18 nt, Human
cccacggugcuguagggc

SEQ ID NO: 475018 - RNA, 22 nt, Human
aaaugcaugagaaaguauucug

SEQ ID NO: 475019 - RNA, 22 nt, Human
cucugggcaccaaagagcagcu

SEQ ID NO: 475020 - RNA, 22 nt, Human
ccugccugcuuucugcuuugca

SEQ ID NO: 475021 - RNA, 22 nt, Human
agucucuuuaaucacagugucu

SEQ ID NO: 475022 - RNA, 22 nt, Human
gaaggcugucagagaggagggc

SEQ ID NO: 475023 - RNA, 19 nt, Human
uggcuccugccugccuucu

SEQ ID NO: 475024 - RNA, 22 nt, Human
gcauguuuugcaacaagugacc

SEQ ID NO: 475025 - RNA, 23 nt, Human
ugcucugggaggcccuggagagc

SEQ ID NO: 475026 - RNA, 22 nt, Human
cugugaccuccaggaaggggug

SEQ ID NO: 475027 - RNA, 22 nt, Human
uccucaggucaaagcaggagaa

SEQ ID NO: 475028 - RNA, 22 nt, Human
aaguccagguccucauuccauc

SEQ ID NO: 475029 - RNA, 22 nt, Human
uaaaguucuggugagagguaag

SEQ ID NO: 475030 - RNA, 20 nt, Human
uccagcugggaacagcugau

SEQ ID NO: 475031 - RNA, 22 nt, Human
aggagaaggaagugcaucacua

SEQ ID NO: 475032 - RNA, 22 nt, Human
aaaugguauuuacucuguauua

SEQ ID NO: 475033 - RNA, 22 nt, Human
ucagagaguuggaaagaauuaa

SEQ ID NO: 475034 - RNA, 22 nt, Human
cuauugaauagcccaaaucauu

SEQ ID NO: 475035 - RNA, 22 nt, Human
cagacuugacggcagcugcuuu

SEQ ID NO: 475036 - RNA, 22 nt, Human
gucccagagagcacuaguccau

SEQ ID NO: 475037 - RNA, 22 nt, Human
acccaggguagagugcaguggc

SEQ ID NO: 475038 - RNA, 22 nt, Human
gggagcaggagccugccugcca

SEQ ID NO: 475039 - RNA, 22 nt, Human
ucaaaccaccuuguuacugggg

SEQ ID NO: 475040 - RNA, 22 nt, Human
ugcccuguuccugccuccagcu

SEQ ID NO: 475041 - RNA, 22 nt, Human
ggcugagccaugggcacugcag

SEQ ID NO: 475042 - RNA, 22 nt, Human
ucucugagacaguagccucugc

SEQ ID NO: 475043 - RNA, 22 nt, Human
uuuauucugugcuacaugaaga

SEQ ID NO: 475044 - RNA, 22 nt, Human
ucuuagaaaugaaguucuuucu

SEQ ID NO: 475045 - RNA, 19 nt, Human
gcauaaaaugucaaugugu

SEQ ID NO: 475046 - RNA, 22 nt, Human
cugagggccuuggcuccugccc

SEQ ID NO: 475047 - RNA, 22 nt, Human
aaauguguguauguacauauau

SEQ ID NO: 475048 - RNA, 22 nt, Human
cucaaguaagaaacagaauugg

SEQ ID NO: 475049 - RNA, 22 nt, Human
cccagcccccgagugucuggaa

SEQ ID NO: 475050 - RNA, 22 nt, Human
uggaggaaucagggcuuaggcu

SEQ ID NO: 475051 - RNA, 22 nt, Human
ccagggccucguguucugagug

SEQ ID NO: 475052 - RNA, 21 nt, Human
ugguggagugugcugagcaug

SEQ ID NO: 475053 - RNA, 22 nt, Human
aaggccugggaguacugggaca

SEQ ID NO: 475054 - RNA, 22 nt, Human
uucucuucaucucaguaaaugu

SEQ ID NO: 475055 - RNA, 22 nt, Human
uggcagcaaguucuugggaggu

SEQ ID NO: 475056 - RNA, 22 nt, Human
cuacauggagaagaaaauucuu

SEQ ID NO: 475057 - RNA, 20 nt, Human
ucucugcuguccacauuugc

SEQ ID NO: 475058 - RNA, 22 nt, Human
caagucaaagacuagaacuagu

SEQ ID NO: 475059 - RNA, 22 nt, Human
ucccagagacaucauuucuccg

SEQ ID NO: 475060 - RNA, 22 nt, Human
uuccucucgcucuccggggccc

SEQ ID NO: 475061 - RNA, 19 nt, Human
acagaaauuaguuauuuuc

SEQ ID NO: 475062 - RNA, 22 nt, Human
cgggcagaucacacagggcuug

SEQ ID NO: 475063 - RNA, 22 nt, Human
gccugucugcagggcugucauu

SEQ ID NO: 475064 - RNA, 22 nt, Human
cagcugaggucaaagaagcagg

SEQ ID NO: 475065 - RNA, 21 nt, Human
aggcucagagagaaacucuug

SEQ ID NO: 475066 - RNA, 22 nt, Human
agucccagugagaugagccacg

SEQ ID NO: 475067 - RNA, 22 nt, Human
cucucugggcccaguuggcacc

SEQ ID NO: 475068 - RNA, 22 nt, Human
acuguacauguaaacauuguca

SEQ ID NO: 475069 - RNA, 22 nt, Human
augguacaaaauguauaaaguc

SEQ ID NO: 475070 - RNA, 20 nt, Human
cccaggugucugaagcucug

SEQ ID NO: 475071 - RNA, 22 nt, Human
ugggcucucuggcaggaaggcu

SEQ ID NO: 475072 - RNA, 22 nt, Human
cugccgagugggucaugaggca

SEQ ID NO: 475073 - RNA, 22 nt, Human
uuggaugaagucuagcuuuagu

SEQ ID NO: 475074 - RNA, 22 nt, Human
uuccucagagggcgcuggggaa

SEQ ID NO: 475075 - RNA, 22 nt, Human
aagacaagcaucaaaucaggca

SEQ ID NO: 475076 - RNA, 22 nt, Human
aagcaauaagccagauuuggau

SEQ ID NO: 475077 - RNA, 22 nt, Human
caaggccugccucuggcagaaa

SEQ ID NO: 475078 - RNA, 22 nt, Human
agggucagagaucggccaugug

SEQ ID NO: 475079 - RNA, 22 nt, Human
aagcugaggcccauggcaaggu

SEQ ID NO: 475080 - RNA, 22 nt, Human
ccaggccucccuuuuccagcca

SEQ ID NO: 475081 - RNA, 22 nt, Human
gaugcugagagguggagggaac

SEQ ID NO: 475082 - RNA, 23 nt, Human
ugggcagcuucugcaugcccacc

SEQ ID NO: 475083 - RNA, 22 nt, Human
gggcagagaaauggacaguugg

SEQ ID NO: 475084 - RNA, 22 nt, Human
gucuuucuuaauucaagugcuu

SEQ ID NO: 475085 - RNA, 22 nt, Human
uguuacacagcagaauagcaag

SEQ ID NO: 475086 - RNA, 22 nt, Human
ucuuugcauggacauguguuuu

SEQ ID NO: 475087 - RNA, 22 nt, Human
uuuucacacaaggugauaaguu

SEQ ID NO: 475088 - RNA, 22 nt, Human
cucugaauggacacuccagugu

SEQ ID NO: 475089 - RNA, 22 nt, Human
ggccacuccgcugcuacuggaa

SEQ ID NO: 475090 - RNA, 22 nt, Human
uccagucauuuccauuguuccc

SEQ ID NO: 475091 - RNA, 21 nt, Human
aagagcuggaucaaggauaag

SEQ ID NO: 475092 - RNA, 19 nt, Human
ugucucugaaagaugagcu

SEQ ID NO: 475093 - RNA, 22 nt, Human
caggcugccgugaagcaggccu

SEQ ID NO: 475094 - RNA, 19 nt, Human
uuagaaacuguugacacug

SEQ ID NO: 475095 - RNA, 22 nt, Human
gccuucagcccugacuggccag

SEQ ID NO: 475096 - RNA, 22 nt, Human
agggugcagaaggagccuagga

SEQ ID NO: 475097 - RNA, 21 nt, Human
aggcagcaggauccagggaca

SEQ ID NO: 475098 - RNA, 22 nt, Human
uuucauaaccucaagcuacagu

SEQ ID NO: 475099 - RNA, 22 nt, Human
uuucuaaaugguggcugcauug

SEQ ID NO: 475100 - RNA, 22 nt, Human
uagauuuuacuucugucauuac

SEQ ID NO: 475101 - RNA, 22 nt, Human
auagucuuagaucagauaaagu

SEQ ID NO: 475102 - RNA, 20 nt, Human
gugccuggagaagaggcugu

SEQ ID NO: 475103 - RNA, 22 nt, Human
gcuucucucucagacugcaagc

SEQ ID NO: 475104 - RNA, 22 nt, Human
cugggaggugcagcaaaaauca

SEQ ID NO: 475105 - RNA, 22 nt, Human
acauguggucaaucuguguagg

SEQ ID NO: 475106 - RNA, 20 nt, Human
ccuccuggucaggugugcag

SEQ ID NO: 475107 - RNA, 22 nt, Human
ggugaaggucuacugugugcca

SEQ ID NO: 475108 - RNA, 22 nt, Human
cccugccuacaggguuuucuuu

SEQ ID NO: 475109 - RNA, 22 nt, Human
ucucagagauucagggagaagu

SEQ ID NO: 475110 - RNA, 22 nt, Human
agggucaggagacacuggcaac

SEQ ID NO: 475111 - RNA, 22 nt, Human
agcugccaucugaagaacugca

SEQ ID NO: 475112 - RNA, 22 nt, Human
ugagcccaggaguaugaggcug

SEQ ID NO: 475113 - RNA, 22 nt, Human
agucccagaucuccauucgguc

SEQ ID NO: 475114 - RNA, 22 nt, Human
agcagggcuucugugccugugc

SEQ ID NO: 475115 - RNA, 22 nt, Human
agcagccaggaaucugcagagc

SEQ ID NO: 475116 - RNA, 22 nt, Human
ugugcauguauugauuuguacc

SEQ ID NO: 475117 - RNA, 22 nt, Human
aucaguuuauacuuauaaaucu

SEQ ID NO: 475118 - RNA, 17 nt, Human
ucaggcugugccuggua

SEQ ID NO: 475119 - RNA, 22 nt, Human
ggaggccaucuggcuggaggcu

SEQ ID NO: 475120 - RNA, 22 nt, Human
uggagccauaacccuuucguac

SEQ ID NO: 475121 - RNA, 17 nt, Human
ugaagaugcauggcagc

SEQ ID NO: 475122 - RNA, 19 nt, Human
caggagagcaugcacuuug

SEQ ID NO: 475123 - RNA, 22 nt, Human
gaggcugcuguuagcccugggc

SEQ ID NO: 475124 - RNA, 18 nt, Human
gccugcaggcacgggggu

SEQ ID NO: 475125 - RNA, 22 nt, Human
uuuucucaggugcuuaucuaag

SEQ ID NO: 475126 - RNA, 22 nt, Human
ggaaaaggccacagggacacau

SEQ ID NO: 475127 - RNA, 22 nt, Human
uuuaaaaucagaugggaguugg

SEQ ID NO: 475128 - RNA, 22 nt, Human
gccagguguccucacagugagg

SEQ ID NO: 475129 - RNA, 19 nt, Human
uggagacugagagugagca

SEQ ID NO: 475130 - RNA, 22 nt, Human
cagcuggaggagcagcuuccag

SEQ ID NO: 475131 - RNA, 22 nt, Human
ucaaaugcacguagagaaaaua

SEQ ID NO: 475132 - RNA, 22 nt, Human
uugauacagcagccugugaucc

SEQ ID NO: 475133 - RNA, 22 nt, Human
cgcugggcgccgaccugcuggc

SEQ ID NO: 475134 - RNA, 22 nt, Human
uagcuuuagaaauauucucaga

SEQ ID NO: 475135 - RNA, 22 nt, Human
acuuucuaggucucaguccuuu

SEQ ID NO: 475136 - RNA, 22 nt, Human
caugucuuuguuaugcucacca

SEQ ID NO: 475137 - RNA, 18 nt, Human
uggcagagugucuguucu

SEQ ID NO: 475138 - RNA, 22 nt, Human
gccucacugcagccccaggaag

SEQ ID NO: 475139 - RNA, 22 nt, Human
ccaggugugauuuggcaguguc

SEQ ID NO: 475140 - RNA, 23 nt, Human
gcagauggccccagagugcugcc

SEQ ID NO: 475141 - RNA, 22 nt, Human
gagacacaaacauuuauuccac

SEQ ID NO: 475142 - RNA, 22 nt, Human
agagcugggacuuggacucaau

SEQ ID NO: 475143 - RNA, 22 nt, Human
gcaguggggcgcugggaguugg

SEQ ID NO: 475144 - RNA, 22 nt, Human
accaggagccacaggaggagcc

SEQ ID NO: 475145 - RNA, 22 nt, Human
acauugaugaaaagguaucauu

SEQ ID NO: 475146 - RNA, 22 nt, Human
cugccaggccuccgcugucccc

SEQ ID NO: 475147 - RNA, 22 nt, Human
agcugcagauucuaucuagaag

SEQ ID NO: 475148 - RNA, 18 nt, Human
ugagagugugugcucuug

SEQ ID NO: 475149 - RNA, 22 nt, Human
guagggacccacagucuauauu

SEQ ID NO: 475150 - RNA, 22 nt, Human
gcugagagcaguguggccuuaa

SEQ ID NO: 475151 - RNA, 22 nt, Human
aagacagaccacgugacagggc

SEQ ID NO: 475152 - RNA, 22 nt, Human
agugggcagcccaggaggucuu

SEQ ID NO: 475153 - RNA, 22 nt, Human
gagggcugaagauuguggcccc

SEQ ID NO: 475154 - RNA, 22 nt, Human
gaaugcacacgugugugcaugc

SEQ ID NO: 475155 - RNA, 22 nt, Human
uuuagggaaauugaggguuaag

SEQ ID NO: 475156 - RNA, 22 nt, Human
uauguuaaauguuugauguuua

SEQ ID NO: 475157 - RNA, 22 nt, Human
gacagggcauggugcagaguuc

SEQ ID NO: 475158 - RNA, 22 nt, Human
acuuaaaaagaaucuuuucacg

SEQ ID NO: 475159 - RNA, 22 nt, Human
aagggcugcauuugauguguca

SEQ ID NO: 475160 - RNA, 22 nt, Human
ggcugcagguugguuggcagcu

SEQ ID NO: 475161 - RNA, 22 nt, Human
agucucagcaagcauggcuagu

SEQ ID NO: 475162 - RNA, 22 nt, Human
ugcacagagagaugagacacgu

SEQ ID NO: 475163 - RNA, 22 nt, Human
acauuugagaugccuuuuaggu

SEQ ID NO: 475164 - RNA, 22 nt, Human
cuguggaccugcucuuagagac

SEQ ID NO: 475165 - RNA, 22 nt, Human
gguggggcccuggcacugguau

SEQ ID NO: 475166 - RNA, 22 nt, Human
ccagggcucaggcucccagugg

SEQ ID NO: 475167 - RNA, 22 nt, Human
ugcucucucaggccuggcccac

SEQ ID NO: 475168 - RNA, 22 nt, Human
cuggccugcugggugagguccu

SEQ ID NO: 475169 - RNA, 22 nt, Human
accaggcugugaagugagacua

SEQ ID NO: 475170 - RNA, 22 nt, Human
agggcuggcuccguuaccuuga

SEQ ID NO: 475171 - RNA, 23 nt, Human
ugggaguguugggaucucugcuc

SEQ ID NO: 475172 - RNA, 22 nt, Human
ugcccugucuaagcugucagua

SEQ ID NO: 475173 - RNA, 22 nt, Human
uagauuucaggcuggcuugcgg

SEQ ID NO: 475174 - RNA, 22 nt, Human
agguauauauucugguccuuau

SEQ ID NO: 475175 - RNA, 22 nt, Human
gggcucuggaaggugcaccaug

SEQ ID NO: 475176 - RNA, 18 nt, Human
aggaagcaggaggaaggc

SEQ ID NO: 475177 - RNA, 22 nt, Human
gaagagcuuaguuguccuagaa

SEQ ID NO: 475178 - RNA, 22 nt, Human
uuauugccugauugaggucauu

SEQ ID NO: 475179 - RNA, 22 nt, Human
aggucaggguauucacgucugu

SEQ ID NO: 475180 - RNA, 22 nt, Human
aaccauuugcaguuacugagac

SEQ ID NO: 475181 - RNA, 22 nt, Human
ugucaaauuuuuauugcaguau

SEQ ID NO: 475182 - RNA, 22 nt, Human
ggaggccauaguuugggaguca

SEQ ID NO: 475183 - RNA, 22 nt, Human
ccugggaggcggagguugcagg

SEQ ID NO: 475184 - RNA, 17 nt, Human
ccuuucucuuucaucuc

SEQ ID NO: 475185 - RNA, 22 nt, Human
ucugcaucauuuuucagagccg

SEQ ID NO: 475186 - RNA, 22 nt, Human
ucaaaugcuguauuguaguaau

SEQ ID NO: 475187 - RNA, 21 nt, Human
ugccagcauguaggcuaguug

SEQ ID NO: 475188 - RNA, 22 nt, Human
aggcugugcacagggcaccugc

SEQ ID NO: 475189 - RNA, 23 nt, Human
ggcacugaagcuacaauggugag

SEQ ID NO: 475190 - RNA, 22 nt, Human
uuuugucuaagaacuuugcaaa

SEQ ID NO: 475191 - RNA, 22 nt, Human
uggcacuggaaucguagccuug

SEQ ID NO: 475192 - RNA, 21 nt, Human
acuuugggcacuuuccugccc

SEQ ID NO: 475193 - RNA, 22 nt, Human
agguggagaagagaugggcagu

SEQ ID NO: 475194 - RNA, 22 nt, Human
cuccucccucuuugccacacau

SEQ ID NO: 475195 - RNA, 22 nt, Human
guuagguagaaguuuacuuuga

SEQ ID NO: 475196 - RNA, 22 nt, Human
agcuggagaauguggaugaucc

SEQ ID NO: 475197 - RNA, 22 nt, Human
gaggagagaagcuaacggugcu

SEQ ID NO: 475198 - RNA, 22 nt, Human
aauuugauucccugcaccuguu

SEQ ID NO: 475199 - RNA, 22 nt, Human
ucacacacauggauaguauuuu

SEQ ID NO: 475200 - RNA, 22 nt, Human
cauugcuguuaauugucucuag

SEQ ID NO: 475201 - RNA, 22 nt, Human
agcuuccuacaaccaucucaga

SEQ ID NO: 475202 - RNA, 22 nt, Human
ggcagggaagcuggcaucacgg

SEQ ID NO: 475203 - RNA, 22 nt, Human
cccucugccugcgcccuggugu

SEQ ID NO: 475204 - RNA, 22 nt, Human
ggcuguggcagcuggaaguggu

SEQ ID NO: 475205 - RNA, 22 nt, Human
uggcucugagacacaggcucuc

SEQ ID NO: 475206 - RNA, 19 nt, Human
ggaugagggucaggcauag

SEQ ID NO: 475207 - RNA, 20 nt, Human
ugaugguucuuuccggguug

SEQ ID NO: 475208 - RNA, 22 nt, Human
gugugccagacaugaugcuaug

SEQ ID NO: 475209 - RNA, 22 nt, Human
caaaggcuuugcuaugaugcau

SEQ ID NO: 475210 - RNA, 22 nt, Human
uccugccucaggcucuggagua

SEQ ID NO: 475211 - RNA, 22 nt, Human
caccugagcacuggggccgccc

SEQ ID NO: 475212 - RNA, 22 nt, Human
gcagccacuaguuuuccuguuu

SEQ ID NO: 475213 - RNA, 22 nt, Human
ugucucagggcagcagcagggg

SEQ ID NO: 475214 - RNA, 23 nt, Human
uccuccuuuugcuugugcuuccc

SEQ ID NO: 475215 - RNA, 22 nt, Human
uguauuccaaaaugcugaggau

SEQ ID NO: 475216 - RNA, 22 nt, Human
auguagcaugaggcacugugcc

SEQ ID NO: 475217 - RNA, 22 nt, Human
uccucuggggcgugguccugga

SEQ ID NO: 475218 - RNA, 22 nt, Human
uggcugaguaaguugugauaug

SEQ ID NO: 475219 - RNA, 22 nt, Human
ugguaaagaaggcuagaucuga

SEQ ID NO: 475220 - RNA, 22 nt, Human
uuucuacagguugauggguuug

SEQ ID NO: 475221 - RNA, 22 nt, Human
uagcugcugcagcacagggagg

SEQ ID NO: 475222 - RNA, 22 nt, Human
gugcaggggccuccccuugcug

SEQ ID NO: 475223 - RNA, 22 nt, Human
cacugaaucucaaggggagggu

SEQ ID NO: 475224 - RNA, 22 nt, Human
caggaccccauauucacugaac

SEQ ID NO: 475225 - RNA, 22 nt, Human
aauuucaagucuugaagaagua

SEQ ID NO: 475226 - RNA, 22 nt, Human
auugucuucuggucuuaucuuu

SEQ ID NO: 475227 - RNA, 22 nt, Human
gggcccuggggccugauuugca

SEQ ID NO: 475228 - RNA, 23 nt, Human
ggacagggcccugcccuauggcc

SEQ ID NO: 475229 - RNA, 22 nt, Human
agucagugaaggcauugcucaa

SEQ ID NO: 475230 - RNA, 22 nt, Human
uugugucugggggagugacauc

SEQ ID NO: 475231 - RNA, 22 nt, Human
uggcagcuacagacagagguga

SEQ ID NO: 475232 - RNA, 22 nt, Human
gcaguggcuaggagucuggcgu

SEQ ID NO: 475233 - RNA, 22 nt, Human
aggcaggugggucacuugaguc

SEQ ID NO: 475234 - RNA, 22 nt, Human
aagcagaaguugaucuaccaua

SEQ ID NO: 475235 - RNA, 17 nt, Human
ccagagcuacugagacu

SEQ ID NO: 475236 - RNA, 22 nt, Human
uccuugaauccuagcauccuau

SEQ ID NO: 475237 - RNA, 22 nt, Human
ucauugcagaaauaaaggugaa

SEQ ID NO: 475238 - RNA, 22 nt, Human
aaugcacaugucuuggccucac

SEQ ID NO: 475239 - RNA, 22 nt, Human
gguggcaggcccugagcauccc

SEQ ID NO: 475240 - RNA, 22 nt, Human
aggagaaggaggccccucacac

SEQ ID NO: 475241 - RNA, 22 nt, Human
ugccacacucacuucuguggac

SEQ ID NO: 475242 - RNA, 19 nt, Human
gaaggcugaaaugaagcac

SEQ ID NO: 475243 - RNA, 19 nt, Human
cagaacagaggucauggcc

SEQ ID NO: 475244 - RNA, 22 nt, Human
cucaaggaaagucuggagaaga

SEQ ID NO: 475245 - RNA, 22 nt, Human
uaccaggcagcugcacagaggc

SEQ ID NO: 475246 - RNA, 22 nt, Human
uggcucaggccacuucuuuuau

SEQ ID NO: 475247 - RNA, 23 nt, Human
caggacaugggaggaaguauggc

SEQ ID NO: 475248 - RNA, 22 nt, Human
cugcccugccuggccagugugg

SEQ ID NO: 475249 - RNA, 22 nt, Human
aagauuucuuacuuauugaugc

SEQ ID NO: 475250 - RNA, 22 nt, Human
ugggcuggagcuuguugcuucc

SEQ ID NO: 475251 - RNA, 22 nt, Human
aaaggcaggcuuucacaucuca

SEQ ID NO: 475252 - RNA, 22 nt, Human
uucccaugccuggccccuaucc

SEQ ID NO: 475253 - RNA, 22 nt, Human
caguacuuauuucuauuuaggg

SEQ ID NO: 475254 - RNA, 22 nt, Human
gcagcugccuauucagggcuug

SEQ ID NO: 475255 - RNA, 22 nt, Human
cugagcugagccaaaucugucu

SEQ ID NO: 475256 - RNA, 22 nt, Human
cuuaauuuaagccuagaaugca

SEQ ID NO: 475257 - RNA, 22 nt, Human
uacccagcuucaagucaggacu

SEQ ID NO: 475258 - RNA, 22 nt, Human
aagggcagaauagagaagaugg

SEQ ID NO: 475259 - RNA, 22 nt, Human
agcagcauguaugagggugaac

SEQ ID NO: 475260 - RNA, 23 nt, Human
uuucauaugguguggaugaagaa

SEQ ID NO: 475261 - RNA, 22 nt, Human
gagagcugugguuugaccaggc

SEQ ID NO: 475262 - RNA, 22 nt, Human
aguggagacaggacagucgaua

SEQ ID NO: 475263 - RNA, 22 nt, Human
cugcagugaaaucaggaagcaa

SEQ ID NO: 475264 - RNA, 22 nt, Human
aaauuuucucucuaagacuuaa

SEQ ID NO: 475265 - RNA, 22 nt, Human
acccucccauuuccauguagca

SEQ ID NO: 475266 - RNA, 22 nt, Human
aaagacugggacugcagcaggc

SEQ ID NO: 475267 - RNA, 22 nt, Human
aagggcuguaagccaaguaaag

SEQ ID NO: 475268 - RNA, 22 nt, Human
aagccagcauuuucccauuccu

SEQ ID NO: 475269 - RNA, 22 nt, Human
cuagaaauacaggcacgugcca

SEQ ID NO: 475270 - RNA, 22 nt, Human
acugugcaaugaguaauaaacu

SEQ ID NO: 475271 - RNA, 22 nt, Human
ccuggcucuguccucgcgcaaa

SEQ ID NO: 475272 - RNA, 22 nt, Human
ucagaagaagagacuccacagc

SEQ ID NO: 475273 - RNA, 22 nt, Human
ugaguucucacccauucuucuu

SEQ ID NO: 475274 - RNA, 22 nt, Human
uuauuauuuuguguacagcaaa

SEQ ID NO: 475275 - RNA, 22 nt, Human
uaaccauauuuuccauuaaguu

SEQ ID NO: 475276 - RNA, 20 nt, Human
ugaaggccagcagcauaggg

SEQ ID NO: 475277 - RNA, 22 nt, Human
auaucuuuguaugguucagcag

SEQ ID NO: 475278 - RNA, 19 nt, Human
uccaggaggcugccauuga

SEQ ID NO: 475279 - RNA, 22 nt, Human
ugccaggggaccuagggauguc

SEQ ID NO: 475280 - RNA, 22 nt, Human
cuugaaagaagggucuuuuaau

SEQ ID NO: 475281 - RNA, 22 nt, Human
ugagcccagagaucugagcuau

SEQ ID NO: 475282 - RNA, 19 nt, Human
ugagcuggcugagccucuc

SEQ ID NO: 475283 - RNA, 22 nt, Human
agaggcugcacuugcucaugau

SEQ ID NO: 475284 - RNA, 22 nt, Human
aauaugcauguauacaugugua

SEQ ID NO: 475285 - RNA, 21 nt, Human
accaucuuccaugcauuauau

SEQ ID NO: 475286 - RNA, 20 nt, Human
ucuggcucuuugcuccuccc

SEQ ID NO: 475287 - RNA, 22 nt, Human
agggcugaguggugcagucaaa

SEQ ID NO: 475288 - RNA, 22 nt, Human
uaaacaucugucauguguuuau

SEQ ID NO: 475289 - RNA, 22 nt, Human
cacaugggcguaauguccaugg

SEQ ID NO: 475290 - RNA, 22 nt, Human
cugagccacugcuuguucagug

SEQ ID NO: 475291 - RNA, 23 nt, Human
gccaggcacaugguggacacgca

SEQ ID NO: 475292 - RNA, 22 nt, Human
caggagcaaggagcagugggau

SEQ ID NO: 475293 - RNA, 22 nt, Human
aaagaacaucggagugggcggg

SEQ ID NO: 475294 - RNA, 22 nt, Human
ugccucagucuaaagucucuca

SEQ ID NO: 475295 - RNA, 22 nt, Human
cugcagaggucuugcugauggu

SEQ ID NO: 475296 - RNA, 22 nt, Human
uucaggaucauuuguuuuaucu

SEQ ID NO: 475297 - RNA, 22 nt, Human
ggagaccagaaggaagcuucga

SEQ ID NO: 475298 - RNA, 22 nt, Human
ggaaagaggauaguggguaggu

SEQ ID NO: 475299 - RNA, 22 nt, Human
cagaccucaguccucaguagga

SEQ ID NO: 475300 - RNA, 21 nt, Human
cuugaaagguagagucuacag

SEQ ID NO: 475301 - RNA, 22 nt, Human
agccacagcauguguguaugua

SEQ ID NO: 475302 - RNA, 22 nt, Human
uuucaauguaacauuuccaggc

SEQ ID NO: 475303 - RNA, 22 nt, Human
gcuccucuccucggagucgggg

SEQ ID NO: 475304 - RNA, 22 nt, Human
ggacaggaugcugaagaugaag

SEQ ID NO: 475305 - RNA, 22 nt, Human
gaaacuuuuaaaccucaugagu

SEQ ID NO: 475306 - RNA, 22 nt, Human
aacuguaagacaaaugacuucu

SEQ ID NO: 475307 - RNA, 22 nt, Human
uacagaagcugagacacugaga

SEQ ID NO: 475308 - RNA, 22 nt, Human
gagggucccgagcccugucaga

SEQ ID NO: 475309 - RNA, 22 nt, Human
uacuuacagagcuuauaaguua

SEQ ID NO: 475310 - RNA, 22 nt, Human
gccucaggacuggcauacucau

SEQ ID NO: 475311 - RNA, 22 nt, Human
ucaggauguccaaaauccagcc

SEQ ID NO: 475312 - RNA, 22 nt, Human
uguaccuuuuucugugcaugcu

SEQ ID NO: 475313 - RNA, 22 nt, Human
cagugcagccaaggacaggcac

SEQ ID NO: 475314 - RNA, 22 nt, Human
auacaagaucacuccagaaaau

SEQ ID NO: 475315 - RNA, 22 nt, Human
auuauuaggacuacugggguug

SEQ ID NO: 475316 - RNA, 22 nt, Human
gcaggagagccagcaggcuucc

SEQ ID NO: 475317 - RNA, 22 nt, Human
aaaugcaauuguauguacucca

SEQ ID NO: 475318 - RNA, 22 nt, Human
uggcagaggcucugugauguug

SEQ ID NO: 475319 - RNA, 22 nt, Human
cugcugugaguuuggaggucua

SEQ ID NO: 475320 - RNA, 22 nt, Human
cagcugagucugagguucuuug

SEQ ID NO: 475321 - RNA, 22 nt, Human
agggcugcaucugccuggugaa

SEQ ID NO: 475322 - RNA, 18 nt, Human
gggcuguguucaugccca

SEQ ID NO: 475323 - RNA, 22 nt, Human
uaauacuuaccuugcagagucu

SEQ ID NO: 475324 - RNA, 20 nt, Human
acagaauaugcugguugugg

SEQ ID NO: 475325 - RNA, 22 nt, Human
uccaaaaaacguuugaauaguu

SEQ ID NO: 475326 - RNA, 22 nt, Human
ucuucucaguuucucuaggaug

SEQ ID NO: 475327 - RNA, 22 nt, Human
uucuaguugagggagacaaaua

SEQ ID NO: 475328 - RNA, 22 nt, Human
auaucacaaacaagucuguacu

SEQ ID NO: 475329 - RNA, 22 nt, Human
ugcccagggauaagccuagaga

SEQ ID NO: 475330 - RNA, 23 nt, Human
agcuucauugaccuccgcagggg

SEQ ID NO: 475331 - RNA, 21 nt, Human
gaugaagcaaucuuucuguug

SEQ ID NO: 475332 - RNA, 22 nt, Human
gcaccuggcugcccagguggag

SEQ ID NO: 475333 - RNA, 22 nt, Human
augaggcagaaaaaagucggag

SEQ ID NO: 475334 - RNA, 20 nt, Human
agaggccaguuaggagucua

SEQ ID NO: 475335 - RNA, 22 nt, Human
aagggcuccacuugaaucacac

SEQ ID NO: 475336 - RNA, 22 nt, Human
ucuuuugugauucuucaguuac

SEQ ID NO: 475337 - RNA, 22 nt, Human
uggagcugacucacaccagcua

SEQ ID NO: 475338 - RNA, 22 nt, Human
gcagcguggggacaggagcuca

SEQ ID NO: 475339 - RNA, 22 nt, Human
agcugaaggcuagaacagcugg

SEQ ID NO: 475340 - RNA, 22 nt, Human
ccaggcaggcuagaauguaaau

SEQ ID NO: 475341 - RNA, 22 nt, Human
agggucagugaugagggagccc

SEQ ID NO: 475342 - RNA, 22 nt, Human
ccuuugggugaauuccucucuu

SEQ ID NO: 475343 - RNA, 22 nt, Human
uggcucagcaagacauugaccu

SEQ ID NO: 475344 - RNA, 22 nt, Human
uggcugccuuucaccucaucuc

SEQ ID NO: 475345 - RNA, 22 nt, Human
ucuuuauuuaagucuguuguaa

SEQ ID NO: 475346 - RNA, 22 nt, Human
auucaaguucuucugucuuugc

SEQ ID NO: 475347 - RNA, 22 nt, Human
aaaagagguuaaccaggugugu

SEQ ID NO: 475348 - RNA, 22 nt, Human
ccagcugcaggggagcagugga

SEQ ID NO: 475349 - RNA, 22 nt, Human
uuuagggacaagggucuggggu

SEQ ID NO: 475350 - RNA, 22 nt, Human
acagggcagugucuugaaaaau

SEQ ID NO: 475351 - RNA, 22 nt, Human
ccugcccuagagaugacacaau

SEQ ID NO: 475352 - RNA, 22 nt, Human
ucuuuauuucugaaucccccau

SEQ ID NO: 475353 - RNA, 22 nt, Human
ggcaggagauaaaauauuaguu

SEQ ID NO: 475354 - RNA, 19 nt, Human
ucucagagcccuagaggcc

SEQ ID NO: 475355 - RNA, 22 nt, Human
aaagucaaaaugcucuccuguc

SEQ ID NO: 475356 - RNA, 22 nt, Human
aauuuuauuagaaggcaagggg

SEQ ID NO: 475357 - RNA, 22 nt, Human
aaaugaacucuuccugcauccc

SEQ ID NO: 475358 - RNA, 22 nt, Human
uaaggcacccauguucauacag

SEQ ID NO: 475359 - RNA, 22 nt, Human
uucaggaugcucagaguagucu

SEQ ID NO: 475360 - RNA, 22 nt, Human
cucuccuccaacagcccugccg

SEQ ID NO: 475361 - RNA, 21 nt, Human
gcugcugccccuagugaggcc

SEQ ID NO: 475362 - RNA, 22 nt, Human
gcucagagauguucaguagcuu

SEQ ID NO: 475363 - RNA, 19 nt, Human
ugccuggcaccagcuccac

SEQ ID NO: 475364 - RNA, 22 nt, Human
aaaggccaccaacaugaagcau

SEQ ID NO: 475365 - RNA, 22 nt, Human
aagccacugagauuucacugca

SEQ ID NO: 475366 - RNA, 22 nt, Human
ggcugaaggaugaaagcugcag

SEQ ID NO: 475367 - RNA, 22 nt, Human
gcaggcagucaucuuucauauu

SEQ ID NO: 475368 - RNA, 22 nt, Human
ucuuacauauagcaugaguaca

SEQ ID NO: 475369 - RNA, 23 nt, Human
ugucauugugacuacagaaccag

SEQ ID NO: 475370 - RNA, 22 nt, Human
cuggcucauccagguguugcuc

SEQ ID NO: 475371 - RNA, 22 nt, Human
gccaccagcagaaaaggggcca

SEQ ID NO: 475372 - RNA, 22 nt, Human
cucuggagcgcugcuucccgcg

SEQ ID NO: 475373 - RNA, 22 nt, Human
acuuuggaucugauguaaucag

SEQ ID NO: 475374 - RNA, 22 nt, Human
cagggccuuauccugccauuga

SEQ ID NO: 475375 - RNA, 22 nt, Human
ugaagccaucccucagauggcc

SEQ ID NO: 475376 - RNA, 22 nt, Human
cucaggaugaaagucaugguga

SEQ ID NO: 475377 - RNA, 22 nt, Human
uagcagggaagaugaucagaau

SEQ ID NO: 475378 - RNA, 22 nt, Human
auuaaaagcuucccaagaguua

SEQ ID NO: 475379 - RNA, 22 nt, Human
ccuggagcuuuuccauccugga

SEQ ID NO: 475380 - RNA, 19 nt, Human
agugaaauggaguauucaa

SEQ ID NO: 475381 - RNA, 22 nt, Human
aaaguguacuaugucaugaaca

SEQ ID NO: 475382 - RNA, 22 nt, Human
ccagaggcuggguucaccucag

SEQ ID NO: 475383 - RNA, 22 nt, Human
agccacagagguugaugugguu

SEQ ID NO: 475384 - RNA, 22 nt, Human
gccugccuagaauugcagcuuu

SEQ ID NO: 475385 - RNA, 22 nt, Human
ucugccuggauuuuggaaagcu

SEQ ID NO: 475386 - RNA, 22 nt, Human
cauccaggcaccacaaccagcu

SEQ ID NO: 475387 - RNA, 22 nt, Human
agacaggcagaggcugcagagg

SEQ ID NO: 475388 - RNA, 22 nt, Human
uaaauguguguagccaucugug

SEQ ID NO: 475389 - RNA, 22 nt, Human
gugccagggggcacugaacaga

SEQ ID NO: 475390 - RNA, 22 nt, Human
cuuaaagaugucaaggcuguuu

SEQ ID NO: 475391 - RNA, 22 nt, Human
uuagccauuuuauacaagugua

SEQ ID NO: 475392 - RNA, 21 nt, Human
uaagaacauuaucuucuuccu

SEQ ID NO: 475393 - RNA, 22 nt, Human
gagcagggccacuucuguaccu

SEQ ID NO: 475394 - RNA, 22 nt, Human
cuggagcagguuuaggaguccc

SEQ ID NO: 475395 - RNA, 22 nt, Human
agaagcaguuauuuuuugcaca

SEQ ID NO: 475396 - RNA, 22 nt, Human
ggcagagcuugcagugagccga

SEQ ID NO: 475397 - RNA, 22 nt, Human
ugcugccuugaccuccugggcu

SEQ ID NO: 475398 - RNA, 22 nt, Human
ugaagccaucaggaagccagca

SEQ ID NO: 475399 - RNA, 22 nt, Human
gcucugucauuuugcagacacu

SEQ ID NO: 475400 - RNA, 22 nt, Human
ucagccagguaauguggagaug

SEQ ID NO: 475401 - RNA, 20 nt, Human
aggcucagagcaguaguaca

SEQ ID NO: 475402 - RNA, 22 nt, Human
aaggguggauuucugagcucua

SEQ ID NO: 475403 - RNA, 22 nt, Human
ucugggagggagccucagaauc

SEQ ID NO: 475404 - RNA, 22 nt, Human
uggccucugugggagcugagca

SEQ ID NO: 475405 - RNA, 22 nt, Human
uaaggccaauuaacaaccaggg

SEQ ID NO: 475406 - RNA, 22 nt, Human
cagcuggcagcccuggcccugc

SEQ ID NO: 475407 - RNA, 22 nt, Human
cucuggccagagccugcgggaa

SEQ ID NO: 475408 - RNA, 20 nt, Human
ugcuuuaugcuauacuuugu

SEQ ID NO: 475409 - RNA, 22 nt, Human
cuccagggaggucugcaggacu

SEQ ID NO: 475410 - RNA, 22 nt, Human
gcuggccauucucuuugagaug

SEQ ID NO: 475411 - RNA, 22 nt, Human
ccacacagucaguuuccaagaa

SEQ ID NO: 475412 - RNA, 22 nt, Human
gggccaugagagguucaucaac

SEQ ID NO: 475413 - RNA, 22 nt, Human
ucuggcucaggagcuguguuca

SEQ ID NO: 475414 - RNA, 23 nt, Human
gcugucaguuguuuuugucucua

SEQ ID NO: 475415 - RNA, 22 nt, Human
uuugaaagccuggcuuuucucu

SEQ ID NO: 475416 - RNA, 20 nt, Human
gaguuccccauuucuccugg

SEQ ID NO: 475417 - RNA, 22 nt, Human
acagagguguuccagaccuagg

SEQ ID NO: 475418 - RNA, 22 nt, Human
uagggcaguuucauguuaucuu

SEQ ID NO: 475419 - RNA, 23 nt, Human
cccagcuuucccacugccgagag

SEQ ID NO: 475420 - RNA, 22 nt, Human
cugggggcaagcagacagcugu

SEQ ID NO: 475421 - RNA, 22 nt, Human
ugcucuggguccugggccuccu

SEQ ID NO: 475422 - RNA, 22 nt, Human
cagggccaagccccuuuggcug

SEQ ID NO: 475423 - RNA, 22 nt, Human
ggcugccugcuccuccugcacg

SEQ ID NO: 475424 - RNA, 22 nt, Human
gcacugaaaauguuggauucca

SEQ ID NO: 475425 - RNA, 22 nt, Human
cagagccagcuguccuuggcau

SEQ ID NO: 475426 - RNA, 22 nt, Human
ugagcuggaaucuucuugacug

SEQ ID NO: 475427 - RNA, 22 nt, Human
agauguuccagccaaugggaau

SEQ ID NO: 475428 - RNA, 22 nt, Human
ugggaauggaugcuaagugcua

SEQ ID NO: 475429 - RNA, 20 nt, Human
ucacauccucucccaacaug

SEQ ID NO: 475430 - RNA, 22 nt, Human
uuucauaauacuguacaugaaa

SEQ ID NO: 475431 - RNA, 22 nt, Human
aagacuuucucccaaauccuca

SEQ ID NO: 475432 - RNA, 22 nt, Human
ggucccugaagaggccuggggu

SEQ ID NO: 475433 - RNA, 18 nt, Human
aggcccuggccucgaaca

SEQ ID NO: 475434 - RNA, 19 nt, Human
ucucacaucagcuccuagc

SEQ ID NO: 475435 - RNA, 22 nt, Human
gggcugcuuuuaagggucucag

SEQ ID NO: 475436 - RNA, 22 nt, Human
caaggccaguucaccaagggca

SEQ ID NO: 475437 - RNA, 22 nt, Human
ggcagcaggagccaucugguag

SEQ ID NO: 475438 - RNA, 22 nt, Human
ugcuuuauuuuaaauaugccau

SEQ ID NO: 475439 - RNA, 22 nt, Human
agucaguggcuccgagccuggu

SEQ ID NO: 475440 - RNA, 22 nt, Human
uggccacccagcugacgccuuc

SEQ ID NO: 475441 - RNA, 22 nt, Human
ccauuguaaagaguauacuuug

SEQ ID NO: 475442 - RNA, 22 nt, Human
aaggugugaagagaugggaaga

SEQ ID NO: 475443 - RNA, 23 nt, Human
uugucugugcuuuuccaguugcu

SEQ ID NO: 475444 - RNA, 22 nt, Human
guggcugcagagccagcaagcu

SEQ ID NO: 475445 - RNA, 22 nt, Human
uaaaacugcuugguauggucua

SEQ ID NO: 475446 - RNA, 22 nt, Human
uggccuggaaccuggcagggac

SEQ ID NO: 475447 - RNA, 22 nt, Human
ccuggcagcuaagugcuuugag

SEQ ID NO: 475448 - RNA, 22 nt, Human
ggagcugaaggggugggcucag

SEQ ID NO: 475449 - RNA, 22 nt, Human
ugagccuguccugugcauguga

SEQ ID NO: 475450 - RNA, 22 nt, Human
ugagggcugcuuccagagcuag

SEQ ID NO: 475451 - RNA, 23 nt, Human
aggcugcagaagaauagggucau

SEQ ID NO: 475452 - RNA, 22 nt, Human
gcaucuuucuguccauucagca

SEQ ID NO: 475453 - RNA, 23 nt, Human
cauuucugggagauuuauaaaau

SEQ ID NO: 475454 - RNA, 22 nt, Human
caaauguguaaggaaguguuag

SEQ ID NO: 475455 - RNA, 22 nt, Human
ucugccugcggcugcagguggc

SEQ ID NO: 475456 - RNA, 22 nt, Human
uuguuucauggggauguuuauu

SEQ ID NO: 475457 - RNA, 22 nt, Human
aggaaaaauaaggcagcagggc

SEQ ID NO: 475458 - RNA, 22 nt, Human
ucugucuccucugaggugccag

SEQ ID NO: 475459 - RNA, 20 nt, Human
gggcuagaccagggcagagg

SEQ ID NO: 475460 - RNA, 22 nt, Human
ucucccaguggugcagaaagca

SEQ ID NO: 475461 - RNA, 22 nt, Human
auggcagggcagccucucagag

SEQ ID NO: 475462 - RNA, 22 nt, Human
uccagcuggggcaguggcuggg

SEQ ID NO: 475463 - RNA, 22 nt, Human
ggaggggcagccauggaacucc

SEQ ID NO: 475464 - RNA, 20 nt, Human
gccagcccugacacaggagc

SEQ ID NO: 475465 - RNA, 22 nt, Human
ggcagcugggucacaccgaucu

SEQ ID NO: 475466 - RNA, 22 nt, Human
ccagggcugcugugggacucca

SEQ ID NO: 475467 - RNA, 22 nt, Human
cuucagaacuauaaaaaguacu

SEQ ID NO: 475468 - RNA, 20 nt, Human
gagggcaggcacccauuuca

SEQ ID NO: 475469 - RNA, 22 nt, Human
acaugucaauuuaguacucuua

SEQ ID NO: 475470 - RNA, 22 nt, Human
uccugggagagugggacuguau

SEQ ID NO: 475471 - RNA, 22 nt, Human
gcaaggcugcugccacccaucu

SEQ ID NO: 475472 - RNA, 22 nt, Human
acauccagaucucagcauggcu

SEQ ID NO: 475473 - RNA, 22 nt, Human
ugcugggcuagaagcugaggcc

SEQ ID NO: 475474 - RNA, 22 nt, Human
aucugccucuucuucauugcga

SEQ ID NO: 475475 - RNA, 22 nt, Human
ugaauaugugacuuugauuuca

SEQ ID NO: 475476 - RNA, 22 nt, Human
uagcagaaccagcagucaauuu

SEQ ID NO: 475477 - RNA, 22 nt, Human
cagucucucugaaguauuaaga

SEQ ID NO: 475478 - RNA, 22 nt, Human
augcugugucaggaauuugaua

SEQ ID NO: 475479 - RNA, 22 nt, Human
ggucagagggugggcugccugu

SEQ ID NO: 475480 - RNA, 22 nt, Human
uucauguguauggaacauuuuu

SEQ ID NO: 475481 - RNA, 22 nt, Human
ggcuggcuuucucuccgcaccu

SEQ ID NO: 475482 - RNA, 21 nt, Human
uccucugcucucauaccacaa

SEQ ID NO: 475483 - RNA, 22 nt, Human
acaaaaagcuccauuacugucc

SEQ ID NO: 475484 - RNA, 22 nt, Human
ggucucagcaguugcuuugacu

SEQ ID NO: 475485 - RNA, 22 nt, Human
ugcaauaaguuguguuaucacu

SEQ ID NO: 475486 - RNA, 22 nt, Human
uggcagaguucgcuccuauuca

SEQ ID NO: 475487 - RNA, 22 nt, Human
gguuggaggugggaauagcuag

SEQ ID NO: 475488 - RNA, 20 nt, Human
gccugccucagcuagcugag

SEQ ID NO: 475489 - RNA, 22 nt, Human
ccagcuggucugugcucauguu

SEQ ID NO: 475490 - RNA, 22 nt, Human
cagaggcucaccagccuuucac

SEQ ID NO: 475491 - RNA, 22 nt, Human
cuggggcuggugaggcaggcuc

SEQ ID NO: 475492 - RNA, 21 nt, Human
ggcuuuaugcucacccagccu

SEQ ID NO: 475493 - RNA, 22 nt, Human
gcagagaguugggcugcgccag

SEQ ID NO: 475494 - RNA, 22 nt, Human
aagagcuggcccaaucugagca

SEQ ID NO: 475495 - RNA, 22 nt, Human
cagaguggcacucugcuggaug

SEQ ID NO: 475496 - RNA, 19 nt, Human
gcaggguguugacuguccc

SEQ ID NO: 475497 - RNA, 22 nt, Human
uggaaagacauucagccgcugg

SEQ ID NO: 475498 - RNA, 22 nt, Human
ucuuagcauuucauaacaacug

SEQ ID NO: 475499 - RNA, 22 nt, Human
aagcagaauuuaauagaaaggu

SEQ ID NO: 475500 - RNA, 22 nt, Human
gccagagguaucaaagauagua

SEQ ID NO: 475501 - RNA, 22 nt, Human
aagggcucccugccugaggugg

SEQ ID NO: 475502 - RNA, 22 nt, Human
aucgagggugaguacagcggac

SEQ ID NO: 475503 - RNA, 22 nt, Human
cauggcagagaaggggaacugg

SEQ ID NO: 475504 - RNA, 22 nt, Human
aaccugcaguuuuuauucugag

SEQ ID NO: 475505 - RNA, 22 nt, Human
uuacaagauaaccugaugcugu

SEQ ID NO: 475506 - RNA, 22 nt, Human
auguggaggaaaugaguguaca

SEQ ID NO: 475507 - RNA, 22 nt, Human
caaggccagagccagcgauaag

SEQ ID NO: 475508 - RNA, 22 nt, Human
uccucagggggccaacccagcc

SEQ ID NO: 475509 - RNA, 22 nt, Human
aaugcuguaaagaugcuaucug

SEQ ID NO: 475510 - RNA, 22 nt, Human
agugcacuggcaccaucucagc

SEQ ID NO: 475511 - RNA, 22 nt, Human
auguguccacaggugugagaga

SEQ ID NO: 475512 - RNA, 20 nt, Human
gccuggaggcagagauaaag

SEQ ID NO: 475513 - RNA, 22 nt, Human
aggagccccucuucaguccugg

SEQ ID NO: 475514 - RNA, 22 nt, Human
aacacuguacuggaagauggac

SEQ ID NO: 475515 - RNA, 22 nt, Human
ugucagugguagacccagaggu

SEQ ID NO: 475516 - RNA, 17 nt, Human
agauggcaggaggcaga

SEQ ID NO: 475517 - RNA, 22 nt, Human
ccuuucucuuugcugaucaugu

SEQ ID NO: 475518 - RNA, 22 nt, Human
aucugccugagucuagguuuuc

SEQ ID NO: 475519 - RNA, 21 nt, Human
gggagcuggaaacugggugac

SEQ ID NO: 475520 - RNA, 22 nt, Human
gcaggagcagucaggggcagcu

SEQ ID NO: 475521 - RNA, 22 nt, Human
accugagaaugggggcaugugu

SEQ ID NO: 475522 - RNA, 22 nt, Human
ugucccagguccuagaugacca

SEQ ID NO: 475523 - RNA, 22 nt, Human
ccagggucucugcugccugaga

SEQ ID NO: 475524 - RNA, 22 nt, Human
ggcugccuucagacuccagcuu

SEQ ID NO: 475525 - RNA, 22 nt, Human
agccccaguaagggagggccug

SEQ ID NO: 475526 - RNA, 22 nt, Human
agauuuccaucuuuuucaugug

SEQ ID NO: 475527 - RNA, 22 nt, Human
ucuuuacaaucuaagcauaguu

SEQ ID NO: 475528 - RNA, 22 nt, Human
caguggaaaucagagugagagu

SEQ ID NO: 475529 - RNA, 22 nt, Human
ucucccacgguacaggauaaac

SEQ ID NO: 475530 - RNA, 18 nt, Human
gaaaggagagacaguagg

SEQ ID NO: 475531 - RNA, 22 nt, Human
cagguaggauggaagggcucaa

SEQ ID NO: 475532 - RNA, 23 nt, Human
ccuccugggcacaggccugaugg

SEQ ID NO: 475533 - RNA, 20 nt, Human
ccaggcacugucccaugcag

SEQ ID NO: 475534 - RNA, 22 nt, Human
gugcucuccuggcugcccugac

SEQ ID NO: 475535 - RNA, 22 nt, Human
aagaauucacugguagagucaa

SEQ ID NO: 475536 - RNA, 22 nt, Human
cagacagacagccguggccacc

SEQ ID NO: 475537 - RNA, 22 nt, Human
cccagugccaggcacaggcagc

SEQ ID NO: 475538 - RNA, 22 nt, Human
acuaaaaacuacugccaauagc

SEQ ID NO: 475539 - RNA, 22 nt, Human
gccugcuggcuguccauugcag

SEQ ID NO: 475540 - RNA, 22 nt, Human
cucuggagguggagguugcagu

SEQ ID NO: 475541 - RNA, 22 nt, Human
ucucagagagaugaaacuucca

SEQ ID NO: 475542 - RNA, 22 nt, Human
cccagggacagcuagguggggc

SEQ ID NO: 475543 - RNA, 22 nt, Human
uggcccugaggggcugugcccc

SEQ ID NO: 475544 - RNA, 22 nt, Human
ccuggcugggguagaagugagg

SEQ ID NO: 475545 - RNA, 22 nt, Human
gagggccaacuagcaccacuuu

SEQ ID NO: 475546 - RNA, 22 nt, Human
gucagcagugucagcucugggg

SEQ ID NO: 475547 - RNA, 22 nt, Human
gaaagacauaguugcaagaugg

SEQ ID NO: 475548 - RNA, 22 nt, Human
guggccucuguuggcuccuagg

SEQ ID NO: 475549 - RNA, 22 nt, Human
uggcugagggggcucugcucag

SEQ ID NO: 475550 - RNA, 22 nt, Human
guuucauuaccugacccaugag

SEQ ID NO: 475551 - RNA, 22 nt, Human
uggaaagaaaguaaaggcguau

SEQ ID NO: 475552 - RNA, 22 nt, Human
ccagcuuuggaguguuguugcu

SEQ ID NO: 475553 - RNA, 22 nt, Human
ccaagaugaucuuuacaguguu

SEQ ID NO: 475554 - RNA, 20 nt, Human
cuguccccgaggucaccagg

SEQ ID NO: 475555 - RNA, 22 nt, Human
aaguccagugcuuuagauucca

SEQ ID NO: 475556 - RNA, 22 nt, Human
uaacagaauuugcuaaacuccg

SEQ ID NO: 475557 - RNA, 19 nt, Human
cucugccucuggcuguggc

SEQ ID NO: 475558 - RNA, 22 nt, Human
gcaguguuguuaaaagauuaga

SEQ ID NO: 475559 - RNA, 22 nt, Human
gaagcccagggcguggccgggc

SEQ ID NO: 475560 - RNA, 22 nt, Human
ccucccacauugaggacaugcu

SEQ ID NO: 475561 - RNA, 22 nt, Human
aaaguguagagacuuuggaacc

SEQ ID NO: 475562 - RNA, 22 nt, Human
cugaaggauuuaguucuuugcu

SEQ ID NO: 475563 - RNA, 22 nt, Human
aaaugugucauauucaaaguca

SEQ ID NO: 475564 - RNA, 22 nt, Human
gccuucugcgcucgugucuccg

SEQ ID NO: 475565 - RNA, 22 nt, Human
ggcucaccauuuucacucucug

SEQ ID NO: 475566 - RNA, 22 nt, Human
uggcugcucaagggaggaggcu

SEQ ID NO: 475567 - RNA, 22 nt, Human
aggcugugauuccaccacucuc

SEQ ID NO: 475568 - RNA, 22 nt, Human
cacaggaaugaacagggaaaga

SEQ ID NO: 475569 - RNA, 22 nt, Human
gcagggaggaagagaugcuucc

SEQ ID NO: 475570 - RNA, 17 nt, Human
ugagaaguaggcaucau

SEQ ID NO: 475571 - RNA, 22 nt, Human
gccaggcucucagugacugccc

SEQ ID NO: 475572 - RNA, 22 nt, Human
guccucaggaaagcagauaaca

SEQ ID NO: 475573 - RNA, 22 nt, Human
auccuuggaugugucuuuuugu

SEQ ID NO: 475574 - RNA, 22 nt, Human
auuugucucugcacuuuacuca

SEQ ID NO: 475575 - RNA, 22 nt, Human
ggaaggucgagcugcaucuggc

SEQ ID NO: 475576 - RNA, 22 nt, Human
gauacauuuuaucuccuaacag

SEQ ID NO: 475577 - RNA, 22 nt, Human
cccagccagccucuucccauau

SEQ ID NO: 475578 - RNA, 22 nt, Human
agagagcccgggccagggcaca

SEQ ID NO: 475579 - RNA, 22 nt, Human
aguugaagguuggcugauccau

SEQ ID NO: 475580 - RNA, 22 nt, Human
agggccucugacgcccccagcc

SEQ ID NO: 475581 - RNA, 22 nt, Human
aucuaagauguauugagcacuu

SEQ ID NO: 475582 - RNA, 22 nt, Human
ucucuggaagcgcagaucuguu

SEQ ID NO: 475583 - RNA, 21 nt, Human
aggaaguggccagauugggaa

SEQ ID NO: 475584 - RNA, 22 nt, Human
ugguaauuaauuugauagguuc

SEQ ID NO: 475585 - RNA, 22 nt, Human
uuguuuucuccacugcaucuua

SEQ ID NO: 475586 - RNA, 19 nt, Human
agccuggcuuugcucugcu

SEQ ID NO: 475587 - RNA, 22 nt, Human
aggcacugugcugaugucuuau

SEQ ID NO: 475588 - RNA, 22 nt, Human
cuggaagguuccucccagcucc

SEQ ID NO: 475589 - RNA, 22 nt, Human
acacuacaaucucagaacuaua

SEQ ID NO: 475590 - RNA, 21 nt, Human
uggccucccacacuuccaugg

SEQ ID NO: 475591 - RNA, 22 nt, Human
gugccagcucuccccacaucug

SEQ ID NO: 475592 - RNA, 22 nt, Human
guauuugauagauuucaaagga

SEQ ID NO: 475593 - RNA, 22 nt, Human
uaugcacauuaucuaauccauu

SEQ ID NO: 475594 - RNA, 22 nt, Human
caggggaaggagccuugaaacu

SEQ ID NO: 475595 - RNA, 22 nt, Human
cagagcugcaaaugccccuccg

SEQ ID NO: 475596 - RNA, 22 nt, Human
gcaguccaaaguggcucucacc

SEQ ID NO: 475597 - RNA, 22 nt, Human
gugugcaggccacaggccaggg

SEQ ID NO: 475598 - RNA, 23 nt, Human
uuccuuaacuguuaagauugucu

SEQ ID NO: 475599 - RNA, 22 nt, Human
gggacagaaggaagugagcaca

SEQ ID NO: 475600 - RNA, 22 nt, Human
gagcagugaagacagaaguaca

SEQ ID NO: 475601 - RNA, 22 nt, Human
ccagcucccugaagccuggucu

SEQ ID NO: 475602 - RNA, 22 nt, Human
uagcuuuacaaagugcugcacc

SEQ ID NO: 475603 - RNA, 22 nt, Human
gccuuugcaccaucagugcaau

SEQ ID NO: 475604 - RNA, 22 nt, Human
accaggcacucuuguggcagug

SEQ ID NO: 475605 - RNA, 22 nt, Human
gccucccuguucuuccacaaua

SEQ ID NO: 475606 - RNA, 22 nt, Human
ccgggcgggggcucucgucacc

SEQ ID NO: 475607 - RNA, 22 nt, Human
uaagaacauaaauucauacggg

SEQ ID NO: 475608 - RNA, 22 nt, Human
cagaggaggccaccgcauaggc

SEQ ID NO: 475609 - RNA, 22 nt, Human
ucaaagucauggcuaguaauga

SEQ ID NO: 475610 - RNA, 22 nt, Human
uaggcugggaagaaagauucuc

SEQ ID NO: 475611 - RNA, 22 nt, Human
acugcagcaaagcccgugucuu

SEQ ID NO: 475612 - RNA, 22 nt, Human
uguccucuaauuggccucuugc

SEQ ID NO: 475613 - RNA, 22 nt, Human
ugauuucaaguagugacaugcu

SEQ ID NO: 475614 - RNA, 20 nt, Human
gccugcagagaaggucagag

SEQ ID NO: 475615 - RNA, 22 nt, Human
caggaacagcaccaggagcuag

SEQ ID NO: 475616 - RNA, 18 nt, Human
acaaauguagugucuuaa

SEQ ID NO: 475617 - RNA, 22 nt, Human
aggccugggacgggagccguga

SEQ ID NO: 475618 - RNA, 22 nt, Human
acagggccagccugggaccugg

SEQ ID NO: 475619 - RNA, 22 nt, Human
cugucaguaggcucccaucauu

SEQ ID NO: 475620 - RNA, 17 nt, Human
gagccacccugugcgag

SEQ ID NO: 475621 - RNA, 22 nt, Human
uugcagaggcaaaaaugaacuc

SEQ ID NO: 475622 - RNA, 22 nt, Human
uacccaggagaaacagcagggc

SEQ ID NO: 475623 - RNA, 22 nt, Human
aaagaguucuaugaucuuucca

SEQ ID NO: 475624 - RNA, 21 nt, Human
gcacagggacagaucaucaca

SEQ ID NO: 475625 - RNA, 22 nt, Human
uggcugagccacuuguucagau

SEQ ID NO: 475626 - RNA, 22 nt, Human
aagcuuuaaggaauuuuaugga

SEQ ID NO: 475627 - RNA, 22 nt, Human
gaggcucagagggagcaugguc

SEQ ID NO: 475628 - RNA, 22 nt, Human
ucucaggggauucacuggcacc

SEQ ID NO: 475629 - RNA, 22 nt, Human
gcagcauuucucaaaggguggu

SEQ ID NO: 475630 - RNA, 22 nt, Human
gccagccugugcuuggccaggc

SEQ ID NO: 475631 - RNA, 21 nt, Human
gcagccagccgagaccaugcc

SEQ ID NO: 475632 - RNA, 22 nt, Human
gccugggagugcacagugaggu

SEQ ID NO: 475633 - RNA, 22 nt, Human
cagcagcagccccaggaagguu

SEQ ID NO: 475634 - RNA, 22 nt, Human
gccucuggucccucaugcugug

SEQ ID NO: 475635 - RNA, 22 nt, Human
gaucauuuacuuguucuggacu

SEQ ID NO: 475636 - RNA, 22 nt, Human
cagaagaauggugucugagcuc

SEQ ID NO: 475637 - RNA, 22 nt, Human
uaggugugggcucaggaaugug

SEQ ID NO: 475638 - RNA, 22 nt, Human
cucugugauuuugugagccaga

SEQ ID NO: 475639 - RNA, 22 nt, Human
uggcugcuagccagagcuucag

SEQ ID NO: 475640 - RNA, 22 nt, Human
cagagggcacaugguuuccuca

SEQ ID NO: 475641 - RNA, 22 nt, Human
ugccaggcugucaauucaccca

SEQ ID NO: 475642 - RNA, 22 nt, Human
cccagcucuuuuagcggcaucu

SEQ ID NO: 475643 - RNA, 22 nt, Human
agucaccaacaugguucccagg

SEQ ID NO: 475644 - RNA, 22 nt, Human
ggcagcaugagccuggugaauu

SEQ ID NO: 475645 - RNA, 22 nt, Human
cucagaaguucagccuagagua

SEQ ID NO: 475646 - RNA, 22 nt, Human
ggcuuuauauuguuugagcaga

SEQ ID NO: 475647 - RNA, 19 nt, Human
ccagcagguucauuucagg

SEQ ID NO: 475648 - RNA, 22 nt, Human
cauacauugcucauucaguauc

SEQ ID NO: 475649 - RNA, 22 nt, Human
ggcagccagcaaugagaaguuu

SEQ ID NO: 475650 - RNA, 22 nt, Human
ggcucuggucagugaggggccu

SEQ ID NO: 475651 - RNA, 22 nt, Human
ucaggggcugugcauuucccag

SEQ ID NO: 475652 - RNA, 22 nt, Human
cuguccuaugaguacucacuag

SEQ ID NO: 475653 - RNA, 22 nt, Human
ccaaggaggccccaggucagcu

SEQ ID NO: 475654 - RNA, 22 nt, Human
uagcagagaggggacaguggca

SEQ ID NO: 475655 - RNA, 22 nt, Human
gcacuaaaccaacauguaauaa

SEQ ID NO: 475656 - RNA, 22 nt, Human
gggccagguggaccccagccuc

SEQ ID NO: 475657 - RNA, 23 nt, Human
uggcagagacccagaaucuacau

SEQ ID NO: 475658 - RNA, 22 nt, Human
cacagaggaaaggcaguuggua

SEQ ID NO: 475659 - RNA, 22 nt, Human
ggcagugguuagaaacaugagc

SEQ ID NO: 475660 - RNA, 22 nt, Human
uuuccuuccuugcuagccugag

SEQ ID NO: 475661 - RNA, 22 nt, Human
ggagcugcauuuagggagccuu

SEQ ID NO: 475662 - RNA, 22 nt, Human
cugccucuccccagaguggccc

SEQ ID NO: 475663 - RNA, 22 nt, Human
ucuacugugguccuuguaacca

SEQ ID NO: 475664 - RNA, 22 nt, Human
aaugucugccugaacuuuauau

SEQ ID NO: 475665 - RNA, 22 nt, Human
caggguggcacucagcgcaucu

SEQ ID NO: 475666 - RNA, 22 nt, Human
gaggcucacgacgggacgaacu

SEQ ID NO: 475667 - RNA, 22 nt, Human
auuguaaguagaaauguuaugg

SEQ ID NO: 475668 - RNA, 22 nt, Human
uguggcugucuguucuccuagg

SEQ ID NO: 475669 - RNA, 22 nt, Human
gcacccaguuugucucaggguu

SEQ ID NO: 475670 - RNA, 22 nt, Human
uggaaguggcagaaaaugaaca

SEQ ID NO: 475671 - RNA, 22 nt, Human
caaggccauauugccuguaugu

SEQ ID NO: 475672 - RNA, 22 nt, Human
guaauuaggaauaaaaugggaa

SEQ ID NO: 475673 - RNA, 22 nt, Human
uccucaugccgggucucacgcu

SEQ ID NO: 475674 - RNA, 22 nt, Human
ugaaggccucugguacaugcca

SEQ ID NO: 475675 - RNA, 22 nt, Human
gcaaagcugggugugaaugcac

SEQ ID NO: 475676 - RNA, 18 nt, Human
aggccagcccugcuacug

SEQ ID NO: 475677 - RNA, 22 nt, Human
cuacacaguucugccuaauggc

SEQ ID NO: 475678 - RNA, 22 nt, Human
uaaugcaguacugauauaaaca

SEQ ID NO: 475679 - RNA, 19 nt, Human
acagagcucucugcuucug

SEQ ID NO: 475680 - RNA, 17 nt, Human
gcaaucucagucuccuu

SEQ ID NO: 475681 - RNA, 22 nt, Human
ugcaguggaagagguggagauc

SEQ ID NO: 475682 - RNA, 22 nt, Human
ugaccaaaggugguuuauuugg

SEQ ID NO: 475683 - RNA, 22 nt, Human
aggccacaguacuuugcagacc

SEQ ID NO: 475684 - RNA, 22 nt, Human
aaugcugcucucauaauuauag

SEQ ID NO: 475685 - RNA, 22 nt, Human
gcucccaguucccaaagugacc

SEQ ID NO: 475686 - RNA, 22 nt, Human
acccaggaggcagagguugcag

SEQ ID NO: 475687 - RNA, 22 nt, Human
uguaacaaaauaccuuggauug

SEQ ID NO: 475688 - RNA, 18 nt, Human
gcugagguggugucagag

SEQ ID NO: 475689 - RNA, 22 nt, Human
cacagaauuaagggagaaauau

SEQ ID NO: 475690 - RNA, 22 nt, Human
aucuagaaaguguugaagauca

SEQ ID NO: 475691 - RNA, 22 nt, Human
uucaaaauuguucuaagcucug

SEQ ID NO: 475692 - RNA, 22 nt, Human
gaguggagcaaaagagguagau

SEQ ID NO: 475693 - RNA, 22 nt, Human
cacacauugaauucauucuugu

SEQ ID NO: 475694 - RNA, 22 nt, Human
ugcagaagaccuuccagggcug

SEQ ID NO: 475695 - RNA, 22 nt, Human
ugggcagagaguagaggcaacg

SEQ ID NO: 475696 - RNA, 22 nt, Human
guguggcugauugacaugguca

SEQ ID NO: 475697 - RNA, 22 nt, Human
caggcagcucaaccuugggagc

SEQ ID NO: 475698 - RNA, 22 nt, Human
ggagaggcuuggcccagccugg

SEQ ID NO: 475699 - RNA, 22 nt, Human
gugcuucucuucacacccaacu

SEQ ID NO: 475700 - RNA, 22 nt, Human
ccaucccuccuccaccagcuag

SEQ ID NO: 475701 - RNA, 17 nt, Human
gcuuccugugcugggga

SEQ ID NO: 475702 - RNA, 22 nt, Human
cuguggaguggggaguacuggu

SEQ ID NO: 475703 - RNA, 22 nt, Human
cugccaggccucaucccagcca

SEQ ID NO: 475704 - RNA, 20 nt, Human
uaugaguauuacuuucagga

SEQ ID NO: 475705 - RNA, 22 nt, Human
gaguuauucuagguccuuugua

SEQ ID NO: 475706 - RNA, 22 nt, Human
uugcaucuagggcaacccagag

SEQ ID NO: 475707 - RNA, 22 nt, Human
aaaugucugagacuucugaacu

SEQ ID NO: 475708 - RNA, 22 nt, Human
uuauacauguguuuugagauga

SEQ ID NO: 475709 - RNA, 22 nt, Human
cuacauuuguucuauagcuuuu

SEQ ID NO: 475710 - RNA, 22 nt, Human
augcuuuuaugucacaugguca

SEQ ID NO: 475711 - RNA, 22 nt, Human
cccaggaggcagaaguugcagu

SEQ ID NO: 475712 - RNA, 22 nt, Human
aggcccaguccucugccgucug

SEQ ID NO: 475713 - RNA, 22 nt, Human
cccagggaaugacucuggccuu

SEQ ID NO: 475714 - RNA, 22 nt, Human
ucgugucagaucagagguuccu

SEQ ID NO: 475715 - RNA, 22 nt, Human
ugucccagcagcuggguucucu

SEQ ID NO: 475716 - RNA, 22 nt, Human
gugucccaggccucuggaauua

SEQ ID NO: 475717 - RNA, 22 nt, Human
acugugcacaauucuaaguccu

SEQ ID NO: 475718 - RNA, 22 nt, Human
ccagcuccuucugucuguggag

SEQ ID NO: 475719 - RNA, 22 nt, Human
aauucauccaugaacaauucca

SEQ ID NO: 475720 - RNA, 22 nt, Human
ugguggcuucugaggauggcga

SEQ ID NO: 475721 - RNA, 22 nt, Human
gaggcaggguguugauuacaga

SEQ ID NO: 475722 - RNA, 22 nt, Human
gccaggcuggcaaaaggaaacc

SEQ ID NO: 475723 - RNA, 22 nt, Human
ugagccagaggaggcugugugg

SEQ ID NO: 475724 - RNA, 22 nt, Human
ugugccauuucuauucugcagc

SEQ ID NO: 475725 - RNA, 23 nt, Human
uggggcugauggagacggaccag

SEQ ID NO: 475726 - RNA, 22 nt, Human
ucucauguauugcccuggugug

SEQ ID NO: 475727 - RNA, 22 nt, Human
ccagcaggagagaacauuuccc

SEQ ID NO: 475728 - RNA, 22 nt, Human
auguacauuuguaguaauauca

SEQ ID NO: 475729 - RNA, 22 nt, Human
aggcagguccccuggaaggcac

SEQ ID NO: 475730 - RNA, 22 nt, Human
acacuguagcugagggcaugcg

SEQ ID NO: 475731 - RNA, 22 nt, Human
ugagagagccugaaucucuuac

SEQ ID NO: 475732 - RNA, 22 nt, Human
gaggcugguaggaaaggaaaca

SEQ ID NO: 475733 - RNA, 22 nt, Human
gaggacaggagacucacuguuu

SEQ ID NO: 475734 - RNA, 22 nt, Human
acuuugcugcagguuuaaagag

SEQ ID NO: 475735 - RNA, 22 nt, Human
guccucuguuagaaaugugcuu

SEQ ID NO: 475736 - RNA, 22 nt, Human
ucauccaguaugacuggugucu

SEQ ID NO: 475737 - RNA, 22 nt, Human
gccucugcaccaguacugugcc

SEQ ID NO: 475738 - RNA, 23 nt, Human
ccugcagcugcuggggcuccacc

SEQ ID NO: 475739 - RNA, 20 nt, Human
aggaacuggaagggaggaaa

SEQ ID NO: 475740 - RNA, 22 nt, Human
ugaagacacauacaagggaaug

SEQ ID NO: 475741 - RNA, 19 nt, Human
ccugugacuaucuuuguaa

SEQ ID NO: 475742 - RNA, 22 nt, Human
acagaguaucuaucaggaguau

SEQ ID NO: 475743 - RNA, 22 nt, Human
agggcagaggcggacacggaag

SEQ ID NO: 475744 - RNA, 21 nt, Human
gccagggaagagaguuggcug

SEQ ID NO: 475745 - RNA, 22 nt, Human
cagcuuauucaguaagcacaua

SEQ ID NO: 475746 - RNA, 22 nt, Human
cugcccagaagccagaugggca

SEQ ID NO: 475747 - RNA, 23 nt, Human
aggcagugucucuuauccugucc

SEQ ID NO: 475748 - RNA, 19 nt, Human
ugaggggcucacagucuca

SEQ ID NO: 475749 - RNA, 20 nt, Human
ggccuuggguuucgccuguu

SEQ ID NO: 475750 - RNA, 22 nt, Human
ugcauccuuaaccagcaucacu

SEQ ID NO: 475751 - RNA, 22 nt, Human
acagaggcagugugagauacug

SEQ ID NO: 475752 - RNA, 22 nt, Human
gcugccaguguggcaugaugca

SEQ ID NO: 475753 - RNA, 21 nt, Human
uuguucuuccagaagcaaagu

SEQ ID NO: 475754 - RNA, 22 nt, Human
uuagaaacccagacucuuaggu

SEQ ID NO: 475755 - RNA, 22 nt, Human
ucauuucaaguucugacagcua

SEQ ID NO: 475756 - RNA, 22 nt, Human
ugugaccucaucuuaacuggaa

SEQ ID NO: 475757 - RNA, 22 nt, Human
acagaauugauggaaaucucag

SEQ ID NO: 475758 - RNA, 22 nt, Human
cagggagcuggcuggcugugcc

SEQ ID NO: 475759 - RNA, 22 nt, Human
uucugucucccugauguagagc

SEQ ID NO: 475760 - RNA, 22 nt, Human
agagcuguagcuuccuagagcc

SEQ ID NO: 475761 - RNA, 22 nt, Human
aaggcacuuaacgugggaggau

SEQ ID NO: 475762 - RNA, 22 nt, Human
aaagaagguagggcuggugacu

SEQ ID NO: 475763 - RNA, 22 nt, Human
agagggcugccucagucagcua

SEQ ID NO: 475764 - RNA, 22 nt, Human
aagggcucugugcuugucccau

SEQ ID NO: 475765 - RNA, 22 nt, Human
cagugcaugaaacaauaugcag

SEQ ID NO: 475766 - RNA, 17 nt, Human
uucaaugauuaaugcau

SEQ ID NO: 475767 - RNA, 22 nt, Human
ccacucugauuuuggcuccacu

SEQ ID NO: 475768 - RNA, 22 nt, Human
ucuucuuccuccacagggccca

SEQ ID NO: 475769 - RNA, 22 nt, Human
agcagcuguggaaaaguaacua

SEQ ID NO: 475770 - RNA, 22 nt, Human
gcuggggucugugaggagggcu

SEQ ID NO: 475771 - RNA, 19 nt, Human
ugucucagugucccuuccu

SEQ ID NO: 475772 - RNA, 22 nt, Human
uuaucauugucgcagucuaauu

SEQ ID NO: 475773 - RNA, 22 nt, Human
ucauccaguucacauggugagu

SEQ ID NO: 475774 - RNA, 22 nt, Human
cagcaugacagucugcagcaga

SEQ ID NO: 475775 - RNA, 23 nt, Human
caggcaggaugaggacuacacuc

SEQ ID NO: 475776 - RNA, 22 nt, Human
ggucacugcucuaaacaaaagu

SEQ ID NO: 475777 - RNA, 22 nt, Human
aaaugcacagguuuuaaauccu

SEQ ID NO: 475778 - RNA, 22 nt, Human
uggagccaaugaacauuugcug

SEQ ID NO: 475779 - RNA, 22 nt, Human
guucuugccagcauccucaggu

SEQ ID NO: 475780 - RNA, 17 nt, Human
uccuucagggccucaca

SEQ ID NO: 475781 - RNA, 22 nt, Human
aacaugaaaaccuccacagcaa

SEQ ID NO: 475782 - RNA, 22 nt, Human
aucaguuugauaauaaggcuug

SEQ ID NO: 475783 - RNA, 22 nt, Human
gcugggagcaaagccaugcaua

SEQ ID NO: 475784 - RNA, 22 nt, Human
gcugccugcucggcuccuggga

SEQ ID NO: 475785 - RNA, 22 nt, Human
ugagccaguggaagauggcagu

SEQ ID NO: 475786 - RNA, 22 nt, Human
ccagagagauugcuucuaaaga

SEQ ID NO: 475787 - RNA, 22 nt, Human
cagucacacaaguggacuuggg

SEQ ID NO: 475788 - RNA, 22 nt, Human
agcuuuaugggagcuuagauaa

SEQ ID NO: 475789 - RNA, 22 nt, Human
acaaagucugaaaccugaggca

SEQ ID NO: 475790 - RNA, 20 nt, Human
ucacaggggaccaggagcag

SEQ ID NO: 475791 - RNA, 22 nt, Human
caggccuggguucaaaucccuu

SEQ ID NO: 475792 - RNA, 22 nt, Human
agucagugaaaacuagaauguu

SEQ ID NO: 475793 - RNA, 18 nt, Human
aggcagcagcaucuucuc

SEQ ID NO: 475794 - RNA, 22 nt, Human
gcucccagucugauggaggaga

SEQ ID NO: 475795 - RNA, 22 nt, Human
cugccacuuacuaggcauggug

SEQ ID NO: 475796 - RNA, 19 nt, Human
cagcugcaccgugaccauc

SEQ ID NO: 475797 - RNA, 22 nt, Human
uacagaguggugagaucuuuug

SEQ ID NO: 475798 - RNA, 21 nt, Human
aacaaagggaugcucaucuuu

SEQ ID NO: 475799 - RNA, 22 nt, Human
ggugaagggccuuaggagacag

SEQ ID NO: 475800 - RNA, 22 nt, Human
gcgagggcacgcgguugaaggc

SEQ ID NO: 475801 - RNA, 22 nt, Human
cggagcugccugccaagccugc

SEQ ID NO: 475802 - RNA, 22 nt, Human
caacauuucaaggucuuuagga

SEQ ID NO: 475803 - RNA, 23 nt, Human
ugagaagccaggggagcgugagg

SEQ ID NO: 475804 - RNA, 22 nt, Human
uugcucugacuggagugcagug

SEQ ID NO: 475805 - RNA, 22 nt, Human
uccauuuuucaugacuccucaa

SEQ ID NO: 475806 - RNA, 22 nt, Human
acauuugaggauguuaagaaug

SEQ ID NO: 475807 - RNA, 22 nt, Human
uggagcugagagccaggcuggc

SEQ ID NO: 475808 - RNA, 22 nt, Human
ggcuccacccugcuuccagaag

SEQ ID NO: 475809 - RNA, 22 nt, Human
acauuucuuagccuaguuccag

SEQ ID NO: 475810 - RNA, 22 nt, Human
ccagcugcugugcagggaggcu

SEQ ID NO: 475811 - RNA, 20 nt, Human
cccagggaccugagcuccau

SEQ ID NO: 475812 - RNA, 22 nt, Human
aagucaaucacaugcacacuga

SEQ ID NO: 475813 - RNA, 22 nt, Human
uaguggagguggucugugaacu

SEQ ID NO: 475814 - RNA, 22 nt, Human
uucacagucacccuucuccaug

SEQ ID NO: 475815 - RNA, 22 nt, Human
agugcuccuauggaucaguugu

SEQ ID NO: 475816 - RNA, 22 nt, Human
auggaaaggcuguggaaacuua

SEQ ID NO: 475817 - RNA, 22 nt, Human
uguggcaggaagagcuucugag

SEQ ID NO: 475818 - RNA, 22 nt, Human
agaaugcaguuugaaauaaggu

SEQ ID NO: 475819 - RNA, 22 nt, Human
ucaaagucacaacucucuaauu

SEQ ID NO: 475820 - RNA, 22 nt, Human
cauauuucagucuaagaugugu

SEQ ID NO: 475821 - RNA, 22 nt, Human
caugggcaccuuaaaaugaggc

SEQ ID NO: 475822 - RNA, 22 nt, Human
cguguggucccggcaaggcaag

SEQ ID NO: 475823 - RNA, 22 nt, Human
ucacaggagggagagacaccca

SEQ ID NO: 475824 - RNA, 22 nt, Human
uccugggcuugcuccuccagcu

SEQ ID NO: 475825 - RNA, 22 nt, Human
cugagaaggaagccuccacucu

SEQ ID NO: 475826 - RNA, 22 nt, Human
agugggaggcggcugacgggcg

SEQ ID NO: 475827 - RNA, 22 nt, Human
cccaggagguggagcuugcagu

SEQ ID NO: 475828 - RNA, 22 nt, Human
gggaggaaggcuugggugagua

SEQ ID NO: 475829 - RNA, 22 nt, Human
auguaacauugaauuauauagu

SEQ ID NO: 475830 - RNA, 20 nt, Human
uccagccacuuccgcugguc

SEQ ID NO: 475831 - RNA, 22 nt, Human
gccugcagauauauaggauggu

SEQ ID NO: 475832 - RNA, 22 nt, Human
guaaaguucuacuagaaucaac

SEQ ID NO: 475833 - RNA, 22 nt, Human
uguugagacugagggagucagc

SEQ ID NO: 475834 - RNA, 18 nt, Human
ugaacagaugaguugaag

SEQ ID NO: 475835 - RNA, 22 nt, Human
gaacaaacacaucccagcagug

SEQ ID NO: 475836 - RNA, 22 nt, Human
ugaagccacuuuccagaaucac

SEQ ID NO: 475837 - RNA, 22 nt, Human
aguguccccuacagaggcauuc

SEQ ID NO: 475838 - RNA, 22 nt, Human
ugccagaagugcuuuauaagug

SEQ ID NO: 475839 - RNA, 22 nt, Human
uagaacagaguuccagugauca

SEQ ID NO: 475840 - RNA, 22 nt, Human
cugcucugcaaggcacagugau

SEQ ID NO: 475841 - RNA, 22 nt, Human
uggccugggccugccggugcaa

SEQ ID NO: 475842 - RNA, 22 nt, Human
ucagcaaugagaacuggcauuu

SEQ ID NO: 475843 - RNA, 22 nt, Human
aauauaaauuccugggcccagc

SEQ ID NO: 475844 - RNA, 22 nt, Human
cucuguccuccaccugcuuuca

SEQ ID NO: 475845 - RNA, 22 nt, Human
gccaggcagccacccucugcga

SEQ ID NO: 475846 - RNA, 22 nt, Human
ucauuuucaaguuugaacagga

SEQ ID NO: 475847 - RNA, 23 nt, Human
ucagagaaguuguaggcugggga

SEQ ID NO: 475848 - RNA, 22 nt, Human
acaggcucuggggcaggauggc

SEQ ID NO: 475849 - RNA, 22 nt, Human
ucuccuucgaggcccagcuccc

SEQ ID NO: 475850 - RNA, 22 nt, Human
uuugugaaaugaagucacaacu

SEQ ID NO: 475851 - RNA, 22 nt, Human
uucuaguuaaaguauguauuag

SEQ ID NO: 475852 - RNA, 18 nt, Human
ccugagcccugcuuacuu

SEQ ID NO: 475853 - RNA, 22 nt, Human
agagcugugcuuugcaccacgu

SEQ ID NO: 475854 - RNA, 22 nt, Human
ugaggcagugauguuuaagcac

SEQ ID NO: 475855 - RNA, 22 nt, Human
aaggcacugaacuuaaauucug

SEQ ID NO: 475856 - RNA, 22 nt, Human
ggcuucauggaggaggugaguc

SEQ ID NO: 475857 - RNA, 18 nt, Human
ugucauugccagggaagc

SEQ ID NO: 475858 - RNA, 22 nt, Human
cucuggagggaggcugagcugg

SEQ ID NO: 475859 - RNA, 22 nt, Human
ucaugcaaggcugaaacauggu

SEQ ID NO: 475860 - RNA, 22 nt, Human
ucagggacugcagagggaagcu

SEQ ID NO: 475861 - RNA, 22 nt, Human
accaugaugggaagcucagggc

SEQ ID NO: 475862 - RNA, 22 nt, Human
gcugccaugguccaggcuccag

SEQ ID NO: 475863 - RNA, 23 nt, Human
ggagccuggcauaugagacgcau

SEQ ID NO: 475864 - RNA, 22 nt, Human
agauggguaacuggagucugcu

SEQ ID NO: 475865 - RNA, 22 nt, Human
guguuuggucagacguccgggg

SEQ ID NO: 475866 - RNA, 22 nt, Human
ucagcccugaggacagaggcag

SEQ ID NO: 475867 - RNA, 22 nt, Human
uugagaagaaauaguuugcaau

SEQ ID NO: 475868 - RNA, 22 nt, Human
acagagcaauaacagggagagg

SEQ ID NO: 475869 - RNA, 22 nt, Human
ccagugggugcugggcucugcc

SEQ ID NO: 475870 - RNA, 22 nt, Human
gcugucugcugggucgcucagg

SEQ ID NO: 475871 - RNA, 22 nt, Human
cuucauuaaugucuauaaguuu

SEQ ID NO: 475872 - RNA, 22 nt, Human
cauugaaauauggaaacugaug

SEQ ID NO: 475873 - RNA, 22 nt, Human
gggcaggugccagcucccuguc

SEQ ID NO: 475874 - RNA, 22 nt, Human
cagcugaguuacucugaggucu

SEQ ID NO: 475875 - RNA, 22 nt, Human
agcucagggcgaucugucucgg

SEQ ID NO: 475876 - RNA, 22 nt, Human
cucacugucuguacuagcugau

SEQ ID NO: 475877 - RNA, 22 nt, Human
gcucccaggaugaggagccagg

SEQ ID NO: 475878 - RNA, 23 nt, Human
ggucccaguggagaggccucacc

SEQ ID NO: 475879 - RNA, 22 nt, Human
ggccugcuucucagugagcuug

SEQ ID NO: 475880 - RNA, 22 nt, Human
ugucucugugacuccuuccgcc

SEQ ID NO: 475881 - RNA, 22 nt, Human
gucccugcaucaccacgggacu

SEQ ID NO: 475882 - RNA, 22 nt, Human
agagccaggcggcugggcaccu

SEQ ID NO: 475883 - RNA, 22 nt, Human
uaaggccagcaugaaugcagca

SEQ ID NO: 475884 - RNA, 22 nt, Human
cucagcagagaccagggaggaa

SEQ ID NO: 475885 - RNA, 22 nt, Human
gggcaguugauggaggucugga

SEQ ID NO: 475886 - RNA, 18 nt, Human
cucagggcaucagucugg

SEQ ID NO: 475887 - RNA, 22 nt, Human
ugaaggcacuugccuaggggca

SEQ ID NO: 475888 - RNA, 22 nt, Human
aagagcuggauggaaucuggga

SEQ ID NO: 475889 - RNA, 22 nt, Human
ccaggugugccagcagggacug

SEQ ID NO: 475890 - RNA, 22 nt, Human
gaggacagugugaucugccagc

SEQ ID NO: 475891 - RNA, 22 nt, Human
auggaaagccaguguuccauca

SEQ ID NO: 475892 - RNA, 22 nt, Human
ccaggaggcagaaguugcagug

SEQ ID NO: 475893 - RNA, 22 nt, Human
ccugcagguaaggcuaacugcc

SEQ ID NO: 475894 - RNA, 22 nt, Human
agcagcagaggucagaaaggua

SEQ ID NO: 475895 - RNA, 22 nt, Human
gcaggugaaugauggacuagga

SEQ ID NO: 475896 - RNA, 22 nt, Human
gagcucuggcagggcaggucug

SEQ ID NO: 475897 - RNA, 22 nt, Human
acauuuaggauguuuugagaga

SEQ ID NO: 475898 - RNA, 22 nt, Human
aaaugaacaguugcauucucug

SEQ ID NO: 475899 - RNA, 22 nt, Human
accacuguaucuccagcacauu

SEQ ID NO: 475900 - RNA, 22 nt, Human
aggcugaggcaagaggaucacu

SEQ ID NO: 475901 - RNA, 17 nt, Human
ucugggcuucagugguc

SEQ ID NO: 475902 - RNA, 22 nt, Human
uggcagcuguguccagguagaa

SEQ ID NO: 475903 - RNA, 22 nt, Human
cagggccaugaggcacaggguc

SEQ ID NO: 475904 - RNA, 19 nt, Human
ugacaggcuguugccuuga

SEQ ID NO: 475905 - RNA, 22 nt, Human
gaggcucaaaccuggacagagc

SEQ ID NO: 475906 - RNA, 22 nt, Human
aucaguuuugggggacauacug

SEQ ID NO: 475907 - RNA, 22 nt, Human
aguggaccagaagacugaagcu

SEQ ID NO: 475908 - RNA, 22 nt, Human
aaaaaaucagaucuuugguuaa

SEQ ID NO: 475909 - RNA, 22 nt, Human
agcagcucuuaacaaagcaugg

SEQ ID NO: 475910 - RNA, 22 nt, Human
gcagagcauguccucaggacag

SEQ ID NO: 475911 - RNA, 22 nt, Human
ccaggaguuugaggcugcagug

SEQ ID NO: 475912 - RNA, 22 nt, Human
aggcugaggagggauguugcuu

SEQ ID NO: 475913 - RNA, 22 nt, Human
ucuggcuccacaccucacugca

SEQ ID NO: 475914 - RNA, 22 nt, Human
uggcccugacagguccugggca

SEQ ID NO: 475915 - RNA, 22 nt, Human
ugaggcagucacccccuccugc

SEQ ID NO: 475916 - RNA, 22 nt, Human
ugccaaggguaugggcaagaua

SEQ ID NO: 475917 - RNA, 17 nt, Human
cagacagauauccuggg

SEQ ID NO: 475918 - RNA, 22 nt, Human
uuugagaaaugggcucugugcu

SEQ ID NO: 475919 - RNA, 22 nt, Human
aaggccugggaggccucucuuc

SEQ ID NO: 475920 - RNA, 22 nt, Human
caggauggucagaugcauuguc

SEQ ID NO: 475921 - RNA, 22 nt, Human
cugucuuugguccugucuguua

SEQ ID NO: 475922 - RNA, 22 nt, Human
ugagccugguugcagugucugg

SEQ ID NO: 475923 - RNA, 22 nt, Human
cggcagagugugugcgugcaug

SEQ ID NO: 475924 - RNA, 22 nt, Human
aggagaaagacuggacagccaa

SEQ ID NO: 475925 - RNA, 22 nt, Human
ccugccugacagagaagguuca

SEQ ID NO: 475926 - RNA, 22 nt, Human
agucucugccagcuuguccucu

SEQ ID NO: 475927 - RNA, 22 nt, Human
uagucuuuuuaauaaauaaugc

SEQ ID NO: 475928 - RNA, 22 nt, Human
gaccauuuuuacagagcauuca

SEQ ID NO: 475929 - RNA, 22 nt, Human
uuuauucuugagagugagaaga

SEQ ID NO: 475930 - RNA, 22 nt, Human
aguguuccacacaucuggggaa

SEQ ID NO: 475931 - RNA, 22 nt, Human
ucucagaguuugaaucuggagu

SEQ ID NO: 475932 - RNA, 22 nt, Human
gcagccagaagacucagaacaa

SEQ ID NO: 475933 - RNA, 22 nt, Human
ugaaggugucuuugugaacauc

SEQ ID NO: 475934 - RNA, 22 nt, Human
ucagggcaccaaaaaagaugcc

SEQ ID NO: 475935 - RNA, 21 nt, Human
agcugggccucagccugcagu

SEQ ID NO: 475936 - RNA, 22 nt, Human
acucaggaauggggcugggacu

SEQ ID NO: 475937 - RNA, 22 nt, Human
uugcagagccaugaggcuggcu

SEQ ID NO: 475938 - RNA, 22 nt, Human
uuuucuuacugucugugauccu

SEQ ID NO: 475939 - RNA, 22 nt, Human
ggcagcagaacuggcccuguau

SEQ ID NO: 475940 - RNA, 22 nt, Human
ugggcagaucuuugguggcuag

SEQ ID NO: 475941 - RNA, 22 nt, Human
gccucuggggcagcugagucau

SEQ ID NO: 475942 - RNA, 22 nt, Human
gccugagccgccugagcggcgg

SEQ ID NO: 475943 - RNA, 22 nt, Human
cagugcagaggugcaagcaugu

SEQ ID NO: 475944 - RNA, 22 nt, Human
gcugucacaaauauuucucagc

SEQ ID NO: 475945 - RNA, 22 nt, Human
cugcugccggcgagccucccuu

SEQ ID NO: 475946 - RNA, 22 nt, Human
gacccggcuccaggcccagcag

SEQ ID NO: 475947 - RNA, 22 nt, Human
agugugaguaauucagggaggg

SEQ ID NO: 475948 - RNA, 22 nt, Human
cucaggauagcugcgcagccug

SEQ ID NO: 475949 - RNA, 22 nt, Human
aggcacugggaauaugcugagg

SEQ ID NO: 475950 - RNA, 22 nt, Human
acagcaaaggacgaacacucug

SEQ ID NO: 475951 - RNA, 22 nt, Human
gaaaccagcuagaggcagaggg

SEQ ID NO: 475952 - RNA, 22 nt, Human
gccagccuucuguggccugcaa

SEQ ID NO: 475953 - RNA, 22 nt, Human
gcuggccugggcagaggcuaug

SEQ ID NO: 475954 - RNA, 22 nt, Human
uccugaggaaaguucaugaaug

SEQ ID NO: 475955 - RNA, 22 nt, Human
gcacaugagcugcugggauggg

SEQ ID NO: 475956 - RNA, 20 nt, Human
cucucccagcacagcuuccu

SEQ ID NO: 475957 - RNA, 22 nt, Human
ccugccuguacuagagacccag

SEQ ID NO: 475958 - RNA, 22 nt, Human
acaggacaggcugggcuagacu

SEQ ID NO: 475959 - RNA, 17 nt, Human
ccagagaguaguuagga

SEQ ID NO: 475960 - RNA, 15 nt, Human
aggcacugugggacc

SEQ ID NO: 475961 - RNA, 22 nt, Human
aaucaguucuacaucuuaucca

SEQ ID NO: 475962 - RNA, 22 nt, Human
agagggcaugcuugguggccug

SEQ ID NO: 475963 - RNA, 22 nt, Human
agcccaugcaacaggccuagcg

SEQ ID NO: 475964 - RNA, 22 nt, Human
cgcuggggcuuuuugcuugaga

SEQ ID NO: 475965 - RNA, 22 nt, Human
ucuuuccucugagcuccuguag

SEQ ID NO: 475966 - RNA, 22 nt, Human
ugaccuauuagauuuccuugcc

SEQ ID NO: 475967 - RNA, 22 nt, Human
auuauuuuaugugcggccugau

SEQ ID NO: 475968 - RNA, 22 nt, Human
ggguccagcgacagcaggcuca

SEQ ID NO: 475969 - RNA, 22 nt, Human
gccuggcuccuaaggacuggcu

SEQ ID NO: 475970 - RNA, 22 nt, Human
gaccugccugagcugccucugc

SEQ ID NO: 475971 - RNA, 22 nt, Human
agugcaauagcaaagaacaaca

SEQ ID NO: 475972 - RNA, 22 nt, Human
agguuuaugccuuggagcuggg

SEQ ID NO: 475973 - RNA, 22 nt, Human
gauggcaggcaggugaguagag

SEQ ID NO: 475974 - RNA, 22 nt, Human
ugguaucagagccaucuguauu

SEQ ID NO: 475975 - RNA, 22 nt, Human
cagagugagggccugcaccugc

SEQ ID NO: 475976 - RNA, 22 nt, Human
aaagaacagauguguggugcau

SEQ ID NO: 475977 - RNA, 22 nt, Human
ugucagggcaugcgguccagcc

SEQ ID NO: 475978 - RNA, 22 nt, Human
aaucagaaaauucaguggaauu

SEQ ID NO: 475979 - RNA, 22 nt, Human
gccuucagcggccgcucgcugc

SEQ ID NO: 475980 - RNA, 22 nt, Human
agacaucauguuacagauuaag

SEQ ID NO: 475981 - RNA, 22 nt, Human
ucuacuuuucccuauacaguuu

SEQ ID NO: 475982 - RNA, 21 nt, Human
acauuuucuguuuuaggaagu

SEQ ID NO: 475983 - RNA, 22 nt, Human
gagcagaacaggccggguggga

SEQ ID NO: 475984 - RNA, 22 nt, Human
ugacagggugauuaugagagcu

SEQ ID NO: 475985 - RNA, 22 nt, Human
caguuucugggcguucacaggu

SEQ ID NO: 475986 - RNA, 22 nt, Human
ggccauggaccccgagcugacc

SEQ ID NO: 475987 - RNA, 22 nt, Human
aaaucugggagcagcucggcca

SEQ ID NO: 475988 - RNA, 21 nt, Human
uuuagggaggauauuuaacuu

SEQ ID NO: 475989 - RNA, 22 nt, Human
cugugcccuggccaggccucuc

SEQ ID NO: 475990 - RNA, 22 nt, Human
agaaaguucacugguauauuuu

SEQ ID NO: 475991 - RNA, 22 nt, Human
uggcugagagcaauugacucug

SEQ ID NO: 475992 - RNA, 22 nt, Human
acagagauguggaugagggauu

SEQ ID NO: 475993 - RNA, 22 nt, Human
aggucacauggauaaugaucag

SEQ ID NO: 475994 - RNA, 22 nt, Human
ggccagagagcagccaggauuc

SEQ ID NO: 475995 - RNA, 22 nt, Human
ugcagaaggccugacauugcac

SEQ ID NO: 475996 - RNA, 22 nt, Human
auguuuuauauuuugcagcagu

SEQ ID NO: 475997 - RNA, 22 nt, Human
guccucuggccuuucccaggac

SEQ ID NO: 475998 - RNA, 20 nt, Human
gaggcucugggcauggcgcc

SEQ ID NO: 475999 - RNA, 21 nt, Human
ccugagccuguuuauccagaa

SEQ ID NO: 476000 - RNA, 22 nt, Human
uggccugguaccacauagauuu

SEQ ID NO: 476001 - RNA, 22 nt, Human
ugcagcuguuacggacccuguc

SEQ ID NO: 476002 - RNA, 22 nt, Human
uauggaaaguguuuucuucugu

SEQ ID NO: 476003 - RNA, 20 nt, Human
cacaggcuauaugagagcca

SEQ ID NO: 476004 - RNA, 22 nt, Human
uggcucuggcgugaagcccaga

SEQ ID NO: 476005 - RNA, 22 nt, Human
ccaggguggaggcuggauggag

SEQ ID NO: 476006 - RNA, 19 nt, Human
augauacaggugaaaauug

SEQ ID NO: 476007 - RNA, 22 nt, Human
agaggcuccaccuucucugucc

SEQ ID NO: 476008 - RNA, 22 nt, Human
aagccaagaguuaacuauuugu

SEQ ID NO: 476009 - RNA, 22 nt, Human
agccuccaaaugucaggucccg

SEQ ID NO: 476010 - RNA, 20 nt, Human
guauuaggagguaaauguaa

SEQ ID NO: 476011 - RNA, 22 nt, Human
uaugagaaaauaaauaucuguu

SEQ ID NO: 476012 - RNA, 22 nt, Human
ucucagagugacaaugagaauu

SEQ ID NO: 476013 - RNA, 22 nt, Human
uagacacaucaaguauaguuaa

SEQ ID NO: 476014 - RNA, 22 nt, Human
cugugugcugaaaugcagugag

SEQ ID NO: 476015 - RNA, 22 nt, Human
ugcccaggauugugaggucagg

SEQ ID NO: 476016 - RNA, 23 nt, Human
agaagcagcuucuggaguaucgg

SEQ ID NO: 476017 - RNA, 22 nt, Human
ugagccuggguggucgaggcug

SEQ ID NO: 476018 - RNA, 22 nt, Human
uggaaggcaacggagugagcug

SEQ ID NO: 476019 - RNA, 22 nt, Human
cugggcacacagugacucugca

SEQ ID NO: 476020 - RNA, 22 nt, Human
ggcaguagccagggacuggcag

SEQ ID NO: 476021 - RNA, 22 nt, Human
cucagggccaaggaugcuguug

SEQ ID NO: 476022 - RNA, 22 nt, Human
ccaagggaaaccgagaggcugg

SEQ ID NO: 476023 - RNA, 22 nt, Human
gccaggugcauggcugagucuc

SEQ ID NO: 476024 - RNA, 22 nt, Human
cccaggcugaugggaugggcca

SEQ ID NO: 476025 - RNA, 22 nt, Human
uucacauuaucaggauuguuuc

SEQ ID NO: 476026 - RNA, 22 nt, Human
cuucucucugcauaggcauggg

SEQ ID NO: 476027 - RNA, 22 nt, Human
cuagaaauauuuuacagucaag

SEQ ID NO: 476028 - RNA, 22 nt, Human
gcauuucuuccuggugugagcc

SEQ ID NO: 476029 - RNA, 20 nt, Human
uuucagugguuugugccuag

SEQ ID NO: 476030 - RNA, 22 nt, Human
aauugcuaaagauuauguuuuc

SEQ ID NO: 476031 - RNA, 22 nt, Human
accugcagccacuucucuccuu

SEQ ID NO: 476032 - RNA, 22 nt, Human
uccaggcuggacaugaggcggg

SEQ ID NO: 476033 - RNA, 22 nt, Human
uggcagugccccuugaccagug

SEQ ID NO: 476034 - RNA, 22 nt, Human
caggaacacaaugagucucaaa

SEQ ID NO: 476035 - RNA, 22 nt, Human
cagagccccccuucugaucaca

SEQ ID NO: 476036 - RNA, 22 nt, Human
ggggcagauggaacagagcaca

SEQ ID NO: 476037 - RNA, 21 nt, Human
gagccuucccucugcccuuuc

SEQ ID NO: 476038 - RNA, 22 nt, Human
cacugcagaucagaggcugaga

SEQ ID NO: 476039 - RNA, 22 nt, Human
agaggcuggauugagcauagac

SEQ ID NO: 476040 - RNA, 22 nt, Human
ggggaccuggccacccauccuu

SEQ ID NO: 476041 - RNA, 22 nt, Human
uccagccaagccuugguagcug

SEQ ID NO: 476042 - RNA, 23 nt, Human
uguaaaaugggguaguguuacca

SEQ ID NO: 476043 - RNA, 22 nt, Human
cuucccagacgggguggcagcc

SEQ ID NO: 476044 - RNA, 22 nt, Human
cuccuggacauggagcggagga

SEQ ID NO: 476045 - RNA, 22 nt, Human
uaucugcaucugcauguguauu

SEQ ID NO: 476046 - RNA, 22 nt, Human
aacacuguggucuuuucaguaa

SEQ ID NO: 476047 - RNA, 22 nt, Human
caggugucuaauucucaccccc

SEQ ID NO: 476048 - RNA, 22 nt, Human
gacuacucaaacuuucucuaua

SEQ ID NO: 476049 - RNA, 22 nt, Human
ucaggcagaccaccgugggcag

SEQ ID NO: 476050 - RNA, 22 nt, Human
ugaagcaggaaacuucuuguuu

SEQ ID NO: 476051 - RNA, 22 nt, Human
gcuggccuugugucugaggaag

SEQ ID NO: 476052 - RNA, 22 nt, Human
cccaggcagagagcuggugagc

SEQ ID NO: 476053 - RNA, 23 nt, Human
gaagccacacaaaggucgccaag

SEQ ID NO: 476054 - RNA, 20 nt, Human
agccugccagcuggcccaga

SEQ ID NO: 476055 - RNA, 22 nt, Human
aaccccgcucaggcugggugag

SEQ ID NO: 476056 - RNA, 22 nt, Human
ugcagcucugaacagucaugaa

SEQ ID NO: 476057 - RNA, 22 nt, Human
uuccuguauucuaaagggaaag

SEQ ID NO: 476058 - RNA, 22 nt, Human
gagggaccccaggcuggcccuu

SEQ ID NO: 476059 - RNA, 23 nt, Human
acagagaucuugacuuguaugga

SEQ ID NO: 476060 - RNA, 22 nt, Human
cuugaaagucagcagaguggau

SEQ ID NO: 476061 - RNA, 22 nt, Human
cacaggagguuaggaagugguc

SEQ ID NO: 476062 - RNA, 22 nt, Human
agagacaggaguucuguuucca

SEQ ID NO: 476063 - RNA, 22 nt, Human
uggggaggacgggcgccuuccu

SEQ ID NO: 476064 - RNA, 22 nt, Human
cucuggcuucuaccuugcaguu

SEQ ID NO: 476065 - RNA, 22 nt, Human
ucagaggaauaaugcugcauuu

SEQ ID NO: 476066 - RNA, 22 nt, Human
uacauguauugauuucucuucu

SEQ ID NO: 476067 - RNA, 22 nt, Human
caguuucuacgaaggucaaccc

SEQ ID NO: 476068 - RNA, 22 nt, Human
cagcucccgccaucgggaggca

SEQ ID NO: 476069 - RNA, 22 nt, Human
ggagugacucacagcugggaca

SEQ ID NO: 476070 - RNA, 22 nt, Human
guccucuuagccacuuaauuau

SEQ ID NO: 476071 - RNA, 22 nt, Human
agcuuuaucuucaccugggaau

SEQ ID NO: 476072 - RNA, 22 nt, Human
agcagcaucugguucugaugug

SEQ ID NO: 476073 - RNA, 22 nt, Human
agugugugcaugcauucgugca

SEQ ID NO: 476074 - RNA, 22 nt, Human
aaagcuuuucaguauguucaug

SEQ ID NO: 476075 - RNA, 22 nt, Human
ugaugggacugccagcugcuga

SEQ ID NO: 476076 - RNA, 22 nt, Human
uacauguaauuuucauaguaag

SEQ ID NO: 476077 - RNA, 22 nt, Human
cucucuguuaugcuuucaugaa

SEQ ID NO: 476078 - RNA, 22 nt, Human
gcugucucauacaaggcccugc

SEQ ID NO: 476079 - RNA, 22 nt, Human
aaugcacacauuugguacugaa

SEQ ID NO: 476080 - RNA, 22 nt, Human
cagagcagagugauuguucugg

SEQ ID NO: 476081 - RNA, 22 nt, Human
aacaaacaaacauuuugucauc

SEQ ID NO: 476082 - RNA, 22 nt, Human
agaaagcuuaugaaugggcaag

SEQ ID NO: 476083 - RNA, 22 nt, Human
aaaguguugauaugugacaucc

SEQ ID NO: 476084 - RNA, 22 nt, Human
ucacagcuaagcuuggucacug

SEQ ID NO: 476085 - RNA, 22 nt, Human
cuccucuggcuuccuggaggca

SEQ ID NO: 476086 - RNA, 23 nt, Human
uggcucagcuaguuuuccauuuc

SEQ ID NO: 476087 - RNA, 22 nt, Human
ucucagagaccugaacucccug

SEQ ID NO: 476088 - RNA, 22 nt, Human
ugauuuccacagucaggggugc

SEQ ID NO: 476089 - RNA, 22 nt, Human
uuuccuuccaaaugcccgggag

SEQ ID NO: 476090 - RNA, 22 nt, Human
aaguuuaacuugaauucuuucu

SEQ ID NO: 476091 - RNA, 22 nt, Human
ugcaagaggaauucuagaagca

SEQ ID NO: 476092 - RNA, 22 nt, Human
agaccaagacuauaaugagagg

SEQ ID NO: 476093 - RNA, 22 nt, Human
cuggcuccuccaaggccuggag

SEQ ID NO: 476094 - RNA, 22 nt, Human
augggcaguuaggaggccagga

SEQ ID NO: 476095 - RNA, 22 nt, Human
gguggcagucuuaagagaucuu

SEQ ID NO: 476096 - RNA, 20 nt, Human
cccugcagccaugggagugg

SEQ ID NO: 476097 - RNA, 22 nt, Human
auuguggcuagacagucacaau

SEQ ID NO: 476098 - RNA, 22 nt, Human
ggcuccucucuggccgcucccg

SEQ ID NO: 476099 - RNA, 22 nt, Human
ucucagagcaucauuuucuuag

SEQ ID NO: 476100 - RNA, 22 nt, Human
gagcagaugugugccaggaugc

SEQ ID NO: 476101 - RNA, 22 nt, Human
gugggacucuucuuuggcagug

SEQ ID NO: 476102 - RNA, 19 nt, Human
agcuggggcgguguguguu

SEQ ID NO: 476103 - RNA, 22 nt, Human
cccuggagggacagcugcucua

SEQ ID NO: 476104 - RNA, 22 nt, Human
uugcauugaucccagcuugggc

SEQ ID NO: 476105 - RNA, 22 nt, Human
uccucaggauguggaguagaau

SEQ ID NO: 476106 - RNA, 22 nt, Human
ggaggccaaagugugggcggcu

SEQ ID NO: 476107 - RNA, 22 nt, Human
auuagggaaggauuuggccuga

SEQ ID NO: 476108 - RNA, 19 nt, Human
ccuguacauuauucucccc

SEQ ID NO: 476109 - RNA, 22 nt, Human
ucauugcaguugaguuguguua

SEQ ID NO: 476110 - RNA, 22 nt, Human
aguuucuauguaagcuacguga

SEQ ID NO: 476111 - RNA, 22 nt, Human
uuuauguacauauccacaagga

SEQ ID NO: 476112 - RNA, 22 nt, Human
gcacccagcccagggcgugaug

SEQ ID NO: 476113 - RNA, 22 nt, Human
ccagcucuggcuucuugcuggg

SEQ ID NO: 476114 - RNA, 19 nt, Human
ccagagagcuagguacaga

SEQ ID NO: 476115 - RNA, 22 nt, Human
agugauggagcuuccucugcua

SEQ ID NO: 476116 - RNA, 21 nt, Human
agcuuguguguaucacagugu

SEQ ID NO: 476117 - RNA, 22 nt, Human
auucagcaguuccugcuucagu

SEQ ID NO: 476118 - RNA, 22 nt, Human
ccagggccaguaagauuggcau

SEQ ID NO: 476119 - RNA, 19 nt, Human
cuggaaugagaacaugccc

SEQ ID NO: 476120 - RNA, 22 nt, Human
acagaauauugguuacuguugc

SEQ ID NO: 476121 - RNA, 22 nt, Human
auuguguaauuuucagcucaua

SEQ ID NO: 476122 - RNA, 19 nt, Human
cucuggagcagacacugga

SEQ ID NO: 476123 - RNA, 22 nt, Human
cugggcagcugugcaaacaaua

SEQ ID NO: 476124 - RNA, 22 nt, Human
uucaagaucuuccaaaggauac

SEQ ID NO: 476125 - RNA, 22 nt, Human
uuggcucaggaccccugugacu

SEQ ID NO: 476126 - RNA, 22 nt, Human
ccauuuguucgcccagcuccaa

SEQ ID NO: 476127 - RNA, 22 nt, Human
ggagccaguuuagaccucaguu

SEQ ID NO: 476128 - RNA, 22 nt, Human
ugcucccaaacgaccuacugug

SEQ ID NO: 476129 - RNA, 22 nt, Human
agcugcccuucucuugcccuug

SEQ ID NO: 476130 - RNA, 22 nt, Human
ugucucugccagcuagcagaau

SEQ ID NO: 476131 - RNA, 22 nt, Human
cauugcccaguaggaucaccag

SEQ ID NO: 476132 - RNA, 22 nt, Human
uccugggaagagaccugagcau

SEQ ID NO: 476133 - RNA, 23 nt, Human
ucccagccucuucucuugcauac

SEQ ID NO: 476134 - RNA, 22 nt, Human
aagacacagcgaaauguuccug

SEQ ID NO: 476135 - RNA, 22 nt, Human
aaauguaguauguugcauguau

SEQ ID NO: 476136 - RNA, 22 nt, Human
gccagcagccacagaagucacu

SEQ ID NO: 476137 - RNA, 22 nt, Human
gaaggagagagacaucgucccu

SEQ ID NO: 476138 - RNA, 22 nt, Human
auggacagugugaagcagauag

SEQ ID NO: 476139 - RNA, 20 nt, Human
uccagggcuagggagcucau

SEQ ID NO: 476140 - RNA, 22 nt, Human
ggcagauguuauaugaucugag

SEQ ID NO: 476141 - RNA, 22 nt, Human
aagaacagauucagccugaacu

SEQ ID NO: 476142 - RNA, 22 nt, Human
acugcuuuuagaaaucuauaga

SEQ ID NO: 476143 - RNA, 22 nt, Human
cagagcggccacuagagggcgc

SEQ ID NO: 476144 - RNA, 22 nt, Human
ccucugagagaaggccuucagc

SEQ ID NO: 476145 - RNA, 22 nt, Human
cagggcucgcugccagcuucag

SEQ ID NO: 476146 - RNA, 22 nt, Human
gucucagagagcuacucucuua

SEQ ID NO: 476147 - RNA, 22 nt, Human
cagaggcagaauggagauuugg

SEQ ID NO: 476148 - RNA, 22 nt, Human
gcucaggaaacagcagggcuug

SEQ ID NO: 476149 - RNA, 22 nt, Human
agcucccaggcagucaugagga

SEQ ID NO: 476150 - RNA, 22 nt, Human
cuguacaucccgagagccagua

SEQ ID NO: 476151 - RNA, 22 nt, Human
agcuuccucaccucagaggucu

SEQ ID NO: 476152 - RNA, 22 nt, Human
uggaccugcuggaugggcaggu

SEQ ID NO: 476153 - RNA, 23 nt, Human
cuggccuccgacacuggccaaga

SEQ ID NO: 476154 - RNA, 22 nt, Human
agaggaugguugaggaagaccu

SEQ ID NO: 476155 - RNA, 22 nt, Human
gggcacuguguucagagugcag

SEQ ID NO: 476156 - RNA, 22 nt, Human
uccuguaguugcuaaguuuguu

SEQ ID NO: 476157 - RNA, 22 nt, Human
gagguuagaggucagugcaguc

SEQ ID NO: 476158 - RNA, 21 nt, Human
cagaaguaaggguaacuucuc

SEQ ID NO: 476159 - RNA, 22 nt, Human
uuccucagaaaauacuguccaa

SEQ ID NO: 476160 - RNA, 22 nt, Human
ucucaggagccacagcgggagu

SEQ ID NO: 476161 - RNA, 22 nt, Human
ggccuucacgugaccuggcgug

SEQ ID NO: 476162 - RNA, 22 nt, Human
uuuucauugagcaccugaguaa

SEQ ID NO: 476163 - RNA, 22 nt, Human
auuuaucaccaguuagcugacu

SEQ ID NO: 476164 - RNA, 22 nt, Human
ucuggccuacuggaguccauga

SEQ ID NO: 476165 - RNA, 23 nt, Human
aggaaggagguccuaacaguauc

SEQ ID NO: 476166 - RNA, 22 nt, Human
caaagguaaagaucugcugugg

SEQ ID NO: 476167 - RNA, 22 nt, Human
gggcacugcuggaggcucccug

SEQ ID NO: 476168 - RNA, 22 nt, Human
ccugggcaaaugccagagacaa

SEQ ID NO: 476169 - RNA, 22 nt, Human
agagugggugaucucuguuguc

SEQ ID NO: 476170 - RNA, 22 nt, Human
gcugcugugugggagacaggcg

SEQ ID NO: 476171 - RNA, 22 nt, Human
cuauuacauuucuggacauuca

SEQ ID NO: 476172 - RNA, 22 nt, Human
uggcagcuggagggcaauggcc

SEQ ID NO: 476173 - RNA, 22 nt, Human
gggcuguggagccgcgagggcu

SEQ ID NO: 476174 - RNA, 23 nt, Human
uacauuguggauggaguccuggg

SEQ ID NO: 476175 - RNA, 22 nt, Human
acuuuggguaagccaggugcua

SEQ ID NO: 476176 - RNA, 22 nt, Human
ggaaggaggggcaaagcaguuc

SEQ ID NO: 476177 - RNA, 22 nt, Human
ugacaauacagagagagcaaaa

SEQ ID NO: 476178 - RNA, 22 nt, Human
ccugugccauccugagcauccc

SEQ ID NO: 476179 - RNA, 22 nt, Human
uggcccugugugcaggcugcac

SEQ ID NO: 476180 - RNA, 22 nt, Human
ggugccaggcucccagcucagg

SEQ ID NO: 476181 - RNA, 22 nt, Human
gcagggcagccacaggcccccu

SEQ ID NO: 476182 - RNA, 22 nt, Human
ugcaagggcuuagggggcugug

SEQ ID NO: 476183 - RNA, 22 nt, Human
cacugaguucccugacauuuca

SEQ ID NO: 476184 - RNA, 22 nt, Human
ucuccucaccaccagcagcaga

SEQ ID NO: 476185 - RNA, 22 nt, Human
cagugcaggcugggggcccugc

SEQ ID NO: 476186 - RNA, 19 nt, Human
uggcagaggcaguuuguac

SEQ ID NO: 476187 - RNA, 22 nt, Human
cuggcucaauuuguacugcugu

SEQ ID NO: 476188 - RNA, 22 nt, Human
gcuguccaugucuggccucagu

SEQ ID NO: 476189 - RNA, 22 nt, Human
ccagguggacggcgaguacagg

SEQ ID NO: 476190 - RNA, 18 nt, Human
ccuggaccugucuccuuu

SEQ ID NO: 476191 - RNA, 22 nt, Human
augaagucugcacaugcaugug

SEQ ID NO: 476192 - RNA, 22 nt, Human
ugcaagcacucaaugcaaacag

SEQ ID NO: 476193 - RNA, 22 nt, Human
uuucacaaacugaggagacaau

SEQ ID NO: 476194 - RNA, 22 nt, Human
aacaaaugaccugauuucuucc

SEQ ID NO: 476195 - RNA, 23 nt, Human
agguucaggagauggaggaacaa

SEQ ID NO: 476196 - RNA, 20 nt, Human
ggcugugcccuuccguggcc

SEQ ID NO: 476197 - RNA, 22 nt, Human
uacaaagucaccagcuucuugc

SEQ ID NO: 476198 - RNA, 17 nt, Human
agagagagcaugccacc

SEQ ID NO: 476199 - RNA, 22 nt, Human
agguggagacccagagaaggcg

SEQ ID NO: 476200 - RNA, 21 nt, Human
uuacaaagcaagugcuguguc

SEQ ID NO: 476201 - RNA, 22 nt, Human
acaagaauuauuucuaguuaac

SEQ ID NO: 476202 - RNA, 22 nt, Human
aaauguguuuagaugguuuauu

SEQ ID NO: 476203 - RNA, 22 nt, Human
gcccagcagcugguggagaagg

SEQ ID NO: 476204 - RNA, 22 nt, Human
caaagugcuaggauuacaggcc

SEQ ID NO: 476205 - RNA, 19 nt, Human
agcuggagauuggagggca

SEQ ID NO: 476206 - RNA, 22 nt, Human
ccagcagcucccucaggguccg

SEQ ID NO: 476207 - RNA, 22 nt, Human
auuugagaugguaaauaacuuu

SEQ ID NO: 476208 - RNA, 22 nt, Human
uuccuguaguugugcaauguac

SEQ ID NO: 476209 - RNA, 22 nt, Human
gagcagcuccagccgcaugacu

SEQ ID NO: 476210 - RNA, 22 nt, Human
auguuucaugacugagcaaaau

SEQ ID NO: 476211 - RNA, 22 nt, Human
cagagcugcgcuuuuuccuggu

SEQ ID NO: 476212 - RNA, 22 nt, Human
guuauuagaagugaaggauugu

SEQ ID NO: 476213 - RNA, 22 nt, Human
guacucucuugaaggccuuucu

SEQ ID NO: 476214 - RNA, 22 nt, Human
cucagaagaacccaggguccca

SEQ ID NO: 476215 - RNA, 22 nt, Human
aaggaccuauauugucagagga

SEQ ID NO: 476216 - RNA, 19 nt, Human
uccccagcaccucugaguc

SEQ ID NO: 476217 - RNA, 22 nt, Human
aacucagcauccugcacagaga

SEQ ID NO: 476218 - RNA, 22 nt, Human
cuccagggaggagcacggguuc

SEQ ID NO: 476219 - RNA, 22 nt, Human
ugaagccuuguguggccucucu

SEQ ID NO: 476220 - RNA, 22 nt, Human
auguucuaaucccugcuaugua

SEQ ID NO: 476221 - RNA, 22 nt, Human
ccugcugggccugagcaaugag

SEQ ID NO: 476222 - RNA, 22 nt, Human
aucaggauuauuaaaucuggau

SEQ ID NO: 476223 - RNA, 22 nt, Human
cugggcacagcguugggcucuu

SEQ ID NO: 476224 - RNA, 22 nt, Human
ucccuggguccugcuugcucuc

SEQ ID NO: 476225 - RNA, 21 nt, Human
uccugccuuaguccagagcag

SEQ ID NO: 476226 - RNA, 22 nt, Human
agcugagcacauucaaacaggu

SEQ ID NO: 476227 - RNA, 19 nt, Human
cagaguccuugaccagucc

SEQ ID NO: 476228 - RNA, 22 nt, Human
ggcugugcgggcagccguggga

SEQ ID NO: 476229 - RNA, 22 nt, Human
cuucucucccuggcacucagac

SEQ ID NO: 476230 - RNA, 22 nt, Human
agugaggcuaauaggcaauggu

SEQ ID NO: 476231 - RNA, 22 nt, Human
gcuggccaguguggugaccacc

SEQ ID NO: 476232 - RNA, 22 nt, Human
cagugcagaggccagggaggau

SEQ ID NO: 476233 - RNA, 22 nt, Human
caguguuuguauagaauaugca

SEQ ID NO: 476234 - RNA, 22 nt, Human
uggucaggcugcucugcggcgu

SEQ ID NO: 476235 - RNA, 19 nt, Human
ucugucacuggggguauuc

SEQ ID NO: 476236 - RNA, 22 nt, Human
gcagagaaaguuuuguccucag

SEQ ID NO: 476237 - RNA, 22 nt, Human
augggcagcugcagcaguggug

SEQ ID NO: 476238 - RNA, 22 nt, Human
acaagauuuuaugacucuuuuu

SEQ ID NO: 476239 - RNA, 21 nt, Human
agagagaaggccauauggucc

SEQ ID NO: 476240 - RNA, 22 nt, Human
cccagcuucugagggggccuug

SEQ ID NO: 476241 - RNA, 22 nt, Human
gcucaggauuucauccaugugu

SEQ ID NO: 476242 - RNA, 22 nt, Human
caaagugcuggaauuacaggug

SEQ ID NO: 476243 - RNA, 22 nt, Human
aguuauauaacuaucuagaugc

SEQ ID NO: 476244 - RNA, 22 nt, Human
caggaaugacccaacaguuuca

SEQ ID NO: 476245 - RNA, 22 nt, Human
uuucauguuuucuuaaauggca

SEQ ID NO: 476246 - RNA, 21 nt, Human
ccacaggggcuccccugucag

SEQ ID NO: 476247 - RNA, 22 nt, Human
aaguccaguuucauuugagguc

SEQ ID NO: 476248 - RNA, 22 nt, Human
gccaugccugugucuccaggcc

SEQ ID NO: 476249 - RNA, 22 nt, Human
gugccaggcccagggagcgggg

SEQ ID NO: 476250 - RNA, 22 nt, Human
uucuuuuacauuaagauuucag

SEQ ID NO: 476251 - RNA, 22 nt, Human
aacuguacgauaauaaauuugu

SEQ ID NO: 476252 - RNA, 22 nt, Human
caacagaaggaagcagggucag

SEQ ID NO: 476253 - RNA, 22 nt, Human
gcuucucgggccugaugucguc

SEQ ID NO: 476254 - RNA, 22 nt, Human
aaugaacaucaaaugccuacca

SEQ ID NO: 476255 - RNA, 22 nt, Human
cacauuucugugagucaauauu

SEQ ID NO: 476256 - RNA, 22 nt, Human
agcccuccucacaucagcgucc

SEQ ID NO: 476257 - RNA, 22 nt, Human
gcaguggggaaugcuggggaga

SEQ ID NO: 476258 - RNA, 22 nt, Human
cccugcagaccaaugccauaga

SEQ ID NO: 476259 - RNA, 22 nt, Human
ugcagccaucuuucuuggagga

SEQ ID NO: 476260 - RNA, 22 nt, Human
ucaggaugguccuuuaugagaa

SEQ ID NO: 476261 - RNA, 22 nt, Human
uagcacaucuggcgcuuauagg

SEQ ID NO: 476262 - RNA, 22 nt, Human
gaggggcuggcuguggucccau

SEQ ID NO: 476263 - RNA, 22 nt, Human
uccugggcccaggcugccaggg

SEQ ID NO: 476264 - RNA, 22 nt, Human
caccuagggcaucccugcccca

SEQ ID NO: 476265 - RNA, 22 nt, Human
uagcuuuaccauagaagaguau

SEQ ID NO: 476266 - RNA, 22 nt, Human
guggccucugugcuccugccua

SEQ ID NO: 476267 - RNA, 17 nt, Human
uuccuggaagucauucc

SEQ ID NO: 476268 - RNA, 22 nt, Human
gaugggaggaaccugggucccu

SEQ ID NO: 476269 - RNA, 22 nt, Human
ccuggaaggcaggcauggauug

SEQ ID NO: 476270 - RNA, 22 nt, Human
ggauggagaugaccauggugac

SEQ ID NO: 476271 - RNA, 19 nt, Human
ucuggcuccugccaggcug

SEQ ID NO: 476272 - RNA, 21 nt, Human
uucagcaguccucuagagaua

SEQ ID NO: 476273 - RNA, 22 nt, Human
cuggcagcugcccgagaugccc

SEQ ID NO: 476274 - RNA, 22 nt, Human
ugaguccaccuuaguauauggg

SEQ ID NO: 476275 - RNA, 22 nt, Human
acaugcauacaagcacauguag

SEQ ID NO: 476276 - RNA, 22 nt, Human
agucaaagcuacaggcauuuga

SEQ ID NO: 476277 - RNA, 22 nt, Human
uguauacaggauuacucauagc

SEQ ID NO: 476278 - RNA, 22 nt, Human
uagcaguggaaucuuuugucca

SEQ ID NO: 476279 - RNA, 22 nt, Human
cugccuccugccgugcagcuuc

SEQ ID NO: 476280 - RNA, 22 nt, Human
auuauuucucacucacauaaua

SEQ ID NO: 476281 - RNA, 22 nt, Human
uccucagaugcucuuggacgcc

SEQ ID NO: 476282 - RNA, 22 nt, Human
uuuuccucuguauuugaaaugc

SEQ ID NO: 476283 - RNA, 22 nt, Human
gucagcaccucuuuggggagcu

SEQ ID NO: 476284 - RNA, 19 nt, Human
uagaaugcccacuuaaaaa

SEQ ID NO: 476285 - RNA, 22 nt, Human
agagugggccucugagucccag

SEQ ID NO: 476286 - RNA, 22 nt, Human
uuuugcuugagugcacaaaaug

SEQ ID NO: 476287 - RNA, 22 nt, Human
agugggcaugaucuggugucug

SEQ ID NO: 476288 - RNA, 22 nt, Human
cccagcccagcguucgaggggu

SEQ ID NO: 476289 - RNA, 22 nt, Human
aggcagagcuggguuuugaaau

SEQ ID NO: 476290 - RNA, 22 nt, Human
auuuaugauuagccuauuguug

SEQ ID NO: 476291 - RNA, 22 nt, Human
gggcccuggacguggcggcaga

SEQ ID NO: 476292 - RNA, 22 nt, Human
agccuccacagaugcaaagggc

SEQ ID NO: 476293 - RNA, 22 nt, Human
agagcagcacguuguccccaca

SEQ ID NO: 476294 - RNA, 22 nt, Human
aggauccuccuuagaaaagacc

SEQ ID NO: 476295 - RNA, 22 nt, Human
agggucagagucaggugcagua

SEQ ID NO: 476296 - RNA, 22 nt, Human
uggcuuccgccgcgggccucgg

SEQ ID NO: 476297 - RNA, 22 nt, Human
cugccuggcauggagaagagaa

SEQ ID NO: 476298 - RNA, 22 nt, Human
agucacaguuccuacccaguaa

SEQ ID NO: 476299 - RNA, 22 nt, Human
agaagcuugaaggagcagugac

SEQ ID NO: 476300 - RNA, 22 nt, Human
gcagagaggauauuauugucca

SEQ ID NO: 476301 - RNA, 22 nt, Human
gcucagagcuugaaguuccacu

SEQ ID NO: 476302 - RNA, 22 nt, Human
gcugcucuccauggccgugagu

SEQ ID NO: 476303 - RNA, 22 nt, Human
gcuccagguauuugcccuuuua

SEQ ID NO: 476304 - RNA, 22 nt, Human
ggagccagagucugcaguguaa

SEQ ID NO: 476305 - RNA, 22 nt, Human
ugaaggccagggauuugcagcc

SEQ ID NO: 476306 - RNA, 21 nt, Human
cacaagacacauaggguguuu

SEQ ID NO: 476307 - RNA, 22 nt, Human
guggagaccuccuaggaugugu

SEQ ID NO: 476308 - RNA, 22 nt, Human
agggcagcagcuccuccuagcu

SEQ ID NO: 476309 - RNA, 22 nt, Human
uuaguuaguggggcugucaguc

SEQ ID NO: 476310 - RNA, 22 nt, Human
accugccucuaagcagcaggug

SEQ ID NO: 476311 - RNA, 22 nt, Human
uccugcagacauuuacaccuuu

SEQ ID NO: 476312 - RNA, 22 nt, Human
gcuugcuggugccugcaggcuc

SEQ ID NO: 476313 - RNA, 22 nt, Human
cuguuuuugugcugugucuccc

SEQ ID NO: 476314 - RNA, 22 nt, Human
augaaaacuuuagccucauuag

SEQ ID NO: 476315 - RNA, 22 nt, Human
uguuucauguggacauaguugu

SEQ ID NO: 476316 - RNA, 22 nt, Human
aucacgucaugguuugaucugg

SEQ ID NO: 476317 - RNA, 22 nt, Human
ccugucugcggaggaguggaag

SEQ ID NO: 476318 - RNA, 22 nt, Human
acugagcugugacaaugcuuaa

SEQ ID NO: 476319 - RNA, 20 nt, Human
ucagguagaucuuugagguc

SEQ ID NO: 476320 - RNA, 18 nt, Human
cccagcuuagcgccccuc

SEQ ID NO: 476321 - RNA, 22 nt, Human
ucuggcucccuggagcuccaca

SEQ ID NO: 476322 - RNA, 22 nt, Human
uggaauggaaacaaacugagga

SEQ ID NO: 476323 - RNA, 16 nt, Human
agcagccagcacugga

SEQ ID NO: 476324 - RNA, 22 nt, Human
ggacuucuaagugccagacacu

SEQ ID NO: 476325 - RNA, 22 nt, Human
aggcagcaugcucugcuucuac

SEQ ID NO: 476326 - RNA, 22 nt, Human
caggcagaagaaguggaaggac

SEQ ID NO: 476327 - RNA, 22 nt, Human
agaggcagaaguguucaaaccc

SEQ ID NO: 476328 - RNA, 22 nt, Human
uggagaaggacagccugagaaa

SEQ ID NO: 476329 - RNA, 22 nt, Human
aggcagcauuucugcuuaucca

SEQ ID NO: 476330 - RNA, 22 nt, Human
uauuuguugaguuguuaugucu

SEQ ID NO: 476331 - RNA, 22 nt, Human
ucugaacagaaaagaugcacaa

SEQ ID NO: 476332 - RNA, 22 nt, Human
ucauugcaggcauuccccugcc

SEQ ID NO: 476333 - RNA, 22 nt, Human
uuucacaaguaaaguccuaagu

SEQ ID NO: 476334 - RNA, 22 nt, Human
caaggagauaaaauguugagcu

SEQ ID NO: 476335 - RNA, 22 nt, Human
guggcagagggugagcuggacu

SEQ ID NO: 476336 - RNA, 22 nt, Human
cuggcagcgguuugcagccugg

SEQ ID NO: 476337 - RNA, 23 nt, Human
auacauacagucuuacugacuuu

SEQ ID NO: 476338 - RNA, 22 nt, Human
guuucauuuacaucuguaggua

SEQ ID NO: 476339 - RNA, 22 nt, Human
gggcacugaaugccaagcuagg

SEQ ID NO: 476340 - RNA, 22 nt, Human
agggcugacacaccuuauccuc

SEQ ID NO: 476341 - RNA, 22 nt, Human
ucuguggauuuuaguguucaug

SEQ ID NO: 476342 - RNA, 22 nt, Human
uugguuuaggaacuggcuugga

SEQ ID NO: 476343 - RNA, 22 nt, Human
aacaggagaguaaauauaugau

SEQ ID NO: 476344 - RNA, 17 nt, Human
uguggccuucugagcuu

SEQ ID NO: 476345 - RNA, 22 nt, Human
ggcugggcugcugggucagagc

SEQ ID NO: 476346 - RNA, 22 nt, Human
ugggcagacgggagcuugccuu

SEQ ID NO: 476347 - RNA, 22 nt, Human
aggcugagugcuccccuagaug

SEQ ID NO: 476348 - RNA, 22 nt, Human
cucuccagccacagaagcugcu

SEQ ID NO: 476349 - RNA, 22 nt, Human
agcagcauggaugggccucagc

SEQ ID NO: 476350 - RNA, 22 nt, Human
uuguaacagcuguuuauauagu

SEQ ID NO: 476351 - RNA, 22 nt, Human
caggaaagaaaugagaacacca

SEQ ID NO: 476352 - RNA, 19 nt, Human
cccagcuugaccaccugcu

SEQ ID NO: 476353 - RNA, 19 nt, Human
ucaggcaguuauucacaaa

SEQ ID NO: 476354 - RNA, 22 nt, Human
uauaguaaaauuuucauuuaug

SEQ ID NO: 476355 - RNA, 22 nt, Human
gcagagccccucaagccagccu

SEQ ID NO: 476356 - RNA, 22 nt, Human
uuugaacaugcugcaugauaau

SEQ ID NO: 476357 - RNA, 22 nt, Human
augcuauacauaugacaucaca

SEQ ID NO: 476358 - RNA, 22 nt, Human
gccugggaacucugaucuccug

SEQ ID NO: 476359 - RNA, 23 nt, Human
uccugagaugagacagugcugcc

SEQ ID NO: 476360 - RNA, 22 nt, Human
agcaugaagacuucagagcuag

SEQ ID NO: 476361 - RNA, 22 nt, Human
auaaggcagucccuuaacaagg

SEQ ID NO: 476362 - RNA, 22 nt, Human
cugcccugacugaccuuuugaa

SEQ ID NO: 476363 - RNA, 22 nt, Human
agaauuuuugauuaucuacucg

SEQ ID NO: 476364 - RNA, 22 nt, Human
uuccucagccaaggcugggauc

SEQ ID NO: 476365 - RNA, 22 nt, Human
acacugugucuagcauuuuaca

SEQ ID NO: 476366 - RNA, 22 nt, Human
uccagagccuauauguucaacu

SEQ ID NO: 476367 - RNA, 22 nt, Human
aagagccagugggaaagucuug

SEQ ID NO: 476368 - RNA, 22 nt, Human
ugcagagaaaccaguggaggac

SEQ ID NO: 476369 - RNA, 22 nt, Human
aaguaaaacacacaguccaccg

SEQ ID NO: 476370 - RNA, 22 nt, Human
aguguuccuugcuuucccagag

SEQ ID NO: 476371 - RNA, 22 nt, Human
gggggacuaacuggauccugga

SEQ ID NO: 476372 - RNA, 22 nt, Human
uaaauucugaucaaguuccuuc

SEQ ID NO: 476373 - RNA, 22 nt, Human
ggaggccaugaggcucuaggug

SEQ ID NO: 476374 - RNA, 22 nt, Human
gguagcagggcugugagucaga

SEQ ID NO: 476375 - RNA, 22 nt, Human
auuucacucucccugccacuua

SEQ ID NO: 476376 - RNA, 22 nt, Human
agagaauuacagaagaauguca

SEQ ID NO: 476377 - RNA, 22 nt, Human
gugccugguuuggggaauguuc

SEQ ID NO: 476378 - RNA, 22 nt, Human
auccaggguguggagagagcuc

SEQ ID NO: 476379 - RNA, 22 nt, Human
uuugaaagcaccauuugaguag

SEQ ID NO: 476380 - RNA, 22 nt, Human
uucacaauagcuggcaucaucu

SEQ ID NO: 476381 - RNA, 22 nt, Human
aguggcaguuugggagcuacag

SEQ ID NO: 476382 - RNA, 22 nt, Human
gaaagguugggugaauggugga

SEQ ID NO: 476383 - RNA, 22 nt, Human
ugcaggagcagagauggcugga

SEQ ID NO: 476384 - RNA, 22 nt, Human
ucuggcagggguucugcacuug

SEQ ID NO: 476385 - RNA, 22 nt, Human
ccucaggcuuacgggcaaugga

SEQ ID NO: 476386 - RNA, 22 nt, Human
uuuuuaagagauucuccagucu

SEQ ID NO: 476387 - RNA, 22 nt, Human
agagucugaggcagcugcagcc

SEQ ID NO: 476388 - RNA, 22 nt, Human
gaggccagaaugagcugaaugc

SEQ ID NO: 476389 - RNA, 22 nt, Human
gaggcagcggcucacagagaaa

SEQ ID NO: 476390 - RNA, 22 nt, Human
gugcuuccccaagccacagccu

SEQ ID NO: 476391 - RNA, 22 nt, Human
cagcugccuucugcgggaaguc

SEQ ID NO: 476392 - RNA, 22 nt, Human
agggcuccuaugccccauggac

SEQ ID NO: 476393 - RNA, 22 nt, Human
agucucugcaugaugcagcaca

SEQ ID NO: 476394 - RNA, 22 nt, Human
agaagccaaaugccagugaccu

SEQ ID NO: 476395 - RNA, 22 nt, Human
gcagcugguuaaugggagaauu

SEQ ID NO: 476396 - RNA, 22 nt, Human
agcuggugcucaggggcaugga

SEQ ID NO: 476397 - RNA, 22 nt, Human
gaggccaaucaauagggcaaua

SEQ ID NO: 476398 - RNA, 22 nt, Human
ccuggcagacugugagggcagg

SEQ ID NO: 476399 - RNA, 22 nt, Human
ggccuggcauggggacuaaggg

SEQ ID NO: 476400 - RNA, 22 nt, Human
aggcccugcccagugccacaag

SEQ ID NO: 476401 - RNA, 22 nt, Human
ccagcuuuagguugccugccag

SEQ ID NO: 476402 - RNA, 22 nt, Human
aggcaguguauugcuagcggcu

SEQ ID NO: 476403 - RNA, 22 nt, Human
uguaaucauuacaguacaugga

SEQ ID NO: 476404 - RNA, 22 nt, Human
cuuuccaacucuagugaaauuu

SEQ ID NO: 476405 - RNA, 22 nt, Human
ugggccacacacagaagaauca

SEQ ID NO: 476406 - RNA, 22 nt, Human
gcaggaagaugagcucagguaa

SEQ ID NO: 476407 - RNA, 19 nt, Human
cccaaggcccugggcaggc

SEQ ID NO: 476408 - RNA, 22 nt, Human
cugcccugucugcagccuggcu

SEQ ID NO: 476409 - RNA, 22 nt, Human
ucuucagagacucugagccccu

SEQ ID NO: 476410 - RNA, 20 nt, Human
gucugaggagcagugggaaa

SEQ ID NO: 476411 - RNA, 22 nt, Human
augauuucuauauaaacuuaaa

SEQ ID NO: 476412 - RNA, 22 nt, Human
caguggguaggaaaggcucuuc

SEQ ID NO: 476413 - RNA, 17 nt, Human
uagagcugguucaggag

SEQ ID NO: 476414 - RNA, 22 nt, Human
gagguucacaggcuaucacagu

SEQ ID NO: 476415 - RNA, 21 nt, Human
acagcagacaggcuuaggacc

SEQ ID NO: 476416 - RNA, 22 nt, Human
aggcagaggaaggguggauuug

SEQ ID NO: 476417 - RNA, 23 nt, Human
gggauauggaccuuggaggaguc

SEQ ID NO: 476418 - RNA, 22 nt, Human
uggaggaaguggacaguugugu

SEQ ID NO: 476419 - RNA, 22 nt, Human
uuauuacacugaaagaauugcg

SEQ ID NO: 476420 - RNA, 19 nt, Human
ucuuucauuucuagcucug

SEQ ID NO: 476421 - RNA, 22 nt, Human
cuggccagaguuggagggugug

SEQ ID NO: 476422 - RNA, 22 nt, Human
ggccucuggcaggcaggcccuc

SEQ ID NO: 476423 - RNA, 22 nt, Human
caggaggcuccuagggcucugu

SEQ ID NO: 476424 - RNA, 22 nt, Human
ugcagggcauaggguccaguuu

SEQ ID NO: 476425 - RNA, 22 nt, Human
cucucugguuucagcgaagggg

SEQ ID NO: 476426 - RNA, 19 nt, Human
ccugugugggguagagauc

SEQ ID NO: 476427 - RNA, 22 nt, Human
gucucagaccacccucuuuggc

SEQ ID NO: 476428 - RNA, 22 nt, Human
cugcuuccauaaauaaugugcu

SEQ ID NO: 476429 - RNA, 22 nt, Human
gcucccaccuccagccugaguu

SEQ ID NO: 476430 - RNA, 22 nt, Human
guggccugggguuuguucugag

SEQ ID NO: 476431 - RNA, 22 nt, Human
cacuuagucucaccaguucagu

SEQ ID NO: 476432 - RNA, 22 nt, Human
acccagcaaagauaaacuuaug

SEQ ID NO: 476433 - RNA, 22 nt, Human
acagcuggaggccccauugucc

SEQ ID NO: 476434 - RNA, 22 nt, Human
ugggauggcauccugggccuug

SEQ ID NO: 476435 - RNA, 22 nt, Human
agccaggcagacucucuuucuu

SEQ ID NO: 476436 - RNA, 22 nt, Human
uuccauauuuguguggcaaaag

SEQ ID NO: 476437 - RNA, 22 nt, Human
gccaccagggggcuccagugag

SEQ ID NO: 476438 - RNA, 22 nt, Human
agcugccugcuuaugagcucca

SEQ ID NO: 476439 - RNA, 22 nt, Human
uggcccugacugauguggaggg

SEQ ID NO: 476440 - RNA, 22 nt, Human
gcaguggaagccucuuuaagca

SEQ ID NO: 476441 - RNA, 22 nt, Human
aaagggaggggcgauaagccgg

SEQ ID NO: 476442 - RNA, 22 nt, Human
aaaugcuguguuuuaacauaga

SEQ ID NO: 476443 - RNA, 22 nt, Human
aaggccaucuacuuacggaauu

SEQ ID NO: 476444 - RNA, 22 nt, Human
agagccccugguggagugagaa

SEQ ID NO: 476445 - RNA, 22 nt, Human
ugcaguggaaucuggagagcag

SEQ ID NO: 476446 - RNA, 22 nt, Human
ucagcaauaugauaggcuuugu

SEQ ID NO: 476447 - RNA, 22 nt, Human
gugucccaaagauuagaaauca

SEQ ID NO: 476448 - RNA, 22 nt, Human
aggagaguucacacuggucaga

SEQ ID NO: 476449 - RNA, 22 nt, Human
gcaggagccacuucagggaugc

SEQ ID NO: 476450 - RNA, 22 nt, Human
ucugccuucgcugcucccugaa

SEQ ID NO: 476451 - RNA, 22 nt, Human
ugcagggcacacgcacgggugu

SEQ ID NO: 476452 - RNA, 22 nt, Human
acuggacagaggaaauauggag

SEQ ID NO: 476453 - RNA, 22 nt, Human
guggauggacaugggcaagagg

SEQ ID NO: 476454 - RNA, 22 nt, Human
agcuguguguuuccacugagcu

SEQ ID NO: 476455 - RNA, 22 nt, Human
aaagagcucacaguccacugga

SEQ ID NO: 476456 - RNA, 22 nt, Human
gccaggcauuuguuaggugcug

SEQ ID NO: 476457 - RNA, 22 nt, Human
gcagagccugggggucugcgga

SEQ ID NO: 476458 - RNA, 18 nt, Human
agcugcagaccaggaggu

SEQ ID NO: 476459 - RNA, 22 nt, Human
agaaaaaucuuggcgcuugucu

SEQ ID NO: 476460 - RNA, 22 nt, Human
cugguuccaggauggaucuuuc

SEQ ID NO: 476461 - RNA, 22 nt, Human
agaggagugggaagcagugcaa

SEQ ID NO: 476462 - RNA, 22 nt, Human
aacagaauaguugauguacagu

SEQ ID NO: 476463 - RNA, 22 nt, Human
uuagggacaaauuugcagaacc

SEQ ID NO: 476464 - RNA, 22 nt, Human
agucucugcugguugugccuau

SEQ ID NO: 476465 - RNA, 22 nt, Human
gcucugggauuaccagccuuag

SEQ ID NO: 476466 - RNA, 22 nt, Human
cugagguguugaugaccuaugc

SEQ ID NO: 476467 - RNA, 22 nt, Human
auaguggugagcugcauuuaug

SEQ ID NO: 476468 - RNA, 22 nt, Human
uggcagaaagaaccaugugcaa

SEQ ID NO: 476469 - RNA, 22 nt, Human
ggcaggucagguccaugaccaa

SEQ ID NO: 476470 - RNA, 22 nt, Human
uuucacaaguuucaggauucug

SEQ ID NO: 476471 - RNA, 22 nt, Human
gcucugcugaagccccuugcau

SEQ ID NO: 476472 - RNA, 22 nt, Human
agaaaugugaauuucauuuccu

SEQ ID NO: 476473 - RNA, 22 nt, Human
accaaggagacaaagguguauu

SEQ ID NO: 476474 - RNA, 22 nt, Human
ucugcaggaaaaaagugccugg

SEQ ID NO: 476475 - RNA, 22 nt, Human
cagaauuuuucgaauguacugu

SEQ ID NO: 476476 - RNA, 22 nt, Human
ucccaaggccaggcaucuagaa

SEQ ID NO: 476477 - RNA, 22 nt, Human
ucuggagcuggagggcaaggca

SEQ ID NO: 476478 - RNA, 22 nt, Human
uccucugccaaagggaguugcc

SEQ ID NO: 476479 - RNA, 22 nt, Human
ccuccacaggagcugcagugcu

SEQ ID NO: 476480 - RNA, 21 nt, Human
ccugggccaaauucccuggac

SEQ ID NO: 476481 - RNA, 22 nt, Human
uggaggcaacugaagauguagu

SEQ ID NO: 476482 - RNA, 22 nt, Human
ugauguucuguauaucauauag

SEQ ID NO: 476483 - RNA, 17 nt, Human
aguggcaggcagauggg

SEQ ID NO: 476484 - RNA, 22 nt, Human
uggcugcugagaaggcagcugu

SEQ ID NO: 476485 - RNA, 22 nt, Human
cucaggagagucuuauaucucc

SEQ ID NO: 476486 - RNA, 22 nt, Human
uccaagaagucaucuaaacugu

SEQ ID NO: 476487 - RNA, 22 nt, Human
aaccaggacaauuuugaaagua

SEQ ID NO: 476488 - RNA, 22 nt, Human
ucuuguccuaagagcuggauuc

SEQ ID NO: 476489 - RNA, 22 nt, Human
ucacugcaaggaggcuucucaa

SEQ ID NO: 476490 - RNA, 21 nt, Human
aacugcuggucuuuucugucu

SEQ ID NO: 476491 - RNA, 22 nt, Human
gagcuguccuaccaggaguccu

SEQ ID NO: 476492 - RNA, 22 nt, Human
aagcugcagacccccugucuca

SEQ ID NO: 476493 - RNA, 22 nt, Human
aacauuuaugguagucauugca

SEQ ID NO: 476494 - RNA, 22 nt, Human
cacugagaggucucauuuccaa

SEQ ID NO: 476495 - RNA, 22 nt, Human
gaggcagcuuggggcugugggu

SEQ ID NO: 476496 - RNA, 22 nt, Human
gggauggacuuggggacuccag

SEQ ID NO: 476497 - RNA, 18 nt, Human
acagaacucaggggcacc

SEQ ID NO: 476498 - RNA, 22 nt, Human
uugcugaaguuaaugcuugcaa

SEQ ID NO: 476499 - RNA, 22 nt, Human
aaguuugagagccuuuaguaua

SEQ ID NO: 476500 - RNA, 23 nt, Human
gcaggugguucgaacagaaguuu

SEQ ID NO: 476501 - RNA, 22 nt, Human
agggcagcuagcuguagaaaga

SEQ ID NO: 476502 - RNA, 22 nt, Human
cauugcaccacauugcaucccu

SEQ ID NO: 476503 - RNA, 22 nt, Human
ggcagcaaauauugucagcugu

SEQ ID NO: 476504 - RNA, 21 nt, Human
ugacauuuccaauauaaagcc

SEQ ID NO: 476505 - RNA, 19 nt, Human
cugugcaggccgggcugag

SEQ ID NO: 476506 - RNA, 22 nt, Human
uuuccucuuccgagggggaggc

SEQ ID NO: 476507 - RNA, 22 nt, Human
gaaagaggaaggagauguauua

SEQ ID NO: 476508 - RNA, 22 nt, Human
cuggugguucaggagaauggcu

SEQ ID NO: 476509 - RNA, 22 nt, Human
agcaguggcugaagauguuccu

SEQ ID NO: 476510 - RNA, 22 nt, Human
ugggagcccaagggagcugccg

SEQ ID NO: 476511 - RNA, 22 nt, Human
cagucucucagcuuucagcugu

SEQ ID NO: 476512 - RNA, 22 nt, Human
acacaugcugauaagaauauaa

SEQ ID NO: 476513 - RNA, 22 nt, Human
uuuaaucaggcaaagcauaaua

SEQ ID NO: 476514 - RNA, 22 nt, Human
gagcagcugguaggugaaccca

SEQ ID NO: 476515 - RNA, 22 nt, Human
gguggguuuggaagagcaggcu

SEQ ID NO: 476516 - RNA, 22 nt, Human
uagagaaaagcagggaucagga

SEQ ID NO: 476517 - RNA, 22 nt, Human
aagagcuggauugugcugcaga

SEQ ID NO: 476518 - RNA, 22 nt, Human
ggagaugcuuuccaguggggau

SEQ ID NO: 476519 - RNA, 22 nt, Human
agcaaacagugugcuaagaaau

SEQ ID NO: 476520 - RNA, 22 nt, Human
uuagggcuuuucugaauaggcc

SEQ ID NO: 476521 - RNA, 17 nt, Human
uagcugccccgaaugcu

SEQ ID NO: 476522 - RNA, 22 nt, Human
uugacaaaggaccuugcuauuu

SEQ ID NO: 476523 - RNA, 22 nt, Human
gggcuggugaggcugcccugca

SEQ ID NO: 476524 - RNA, 20 nt, Human
uguauauuuucugguguaaa

SEQ ID NO: 476525 - RNA, 22 nt, Human
gcugcucugaaaaugacuguug

SEQ ID NO: 476526 - RNA, 22 nt, Human
gcugaaggaggcucugguacua

SEQ ID NO: 476527 - RNA, 22 nt, Human
guuuuccuucucagccauugcc

SEQ ID NO: 476528 - RNA, 22 nt, Human
agggcuccaggggcugggugac

SEQ ID NO: 476529 - RNA, 22 nt, Human
aggcaagcauugggaacagggc

SEQ ID NO: 476530 - RNA, 22 nt, Human
gaacagcuucuugggagcuggg

SEQ ID NO: 476531 - RNA, 22 nt, Human
uucugucacuuaggaggucaua

SEQ ID NO: 476532 - RNA, 22 nt, Human
cugaggcugaagagggccuacg

SEQ ID NO: 476533 - RNA, 22 nt, Human
aagcuccccgaaacccaccucu

SEQ ID NO: 476534 - RNA, 22 nt, Human
gagcucagcacuaaaaucaugu

SEQ ID NO: 476535 - RNA, 22 nt, Human
aggaccaguaugagagcaucug

SEQ ID NO: 476536 - RNA, 22 nt, Human
cucagcagugacaagagaguau

SEQ ID NO: 476537 - RNA, 22 nt, Human
aggcugucugaccccagagccc

SEQ ID NO: 476538 - RNA, 22 nt, Human
gcucagaaaagugaggcucagu

SEQ ID NO: 476539 - RNA, 22 nt, Human
ccagguguggggaggacucaca

SEQ ID NO: 476540 - RNA, 18 nt, Human
ucucuuuuccccucauug

SEQ ID NO: 476541 - RNA, 22 nt, Human
aaggccagacaggaccacaucu

SEQ ID NO: 476542 - RNA, 22 nt, Human
agggccacaguggggccugaga

SEQ ID NO: 476543 - RNA, 22 nt, Human
gcagagguggcaucugggcucu

SEQ ID NO: 476544 - RNA, 22 nt, Human
ucaggggaaaucucucagcgaa

SEQ ID NO: 476545 - RNA, 18 nt, Human
augggaggggccaagaga

SEQ ID NO: 476546 - RNA, 22 nt, Human
aggguccaucaaggacugcaca

SEQ ID NO: 476547 - RNA, 22 nt, Human
aguugcagacgcagagauguug

SEQ ID NO: 476548 - RNA, 22 nt, Human
uguuuuuccaugugcagaacaa

SEQ ID NO: 476549 - RNA, 22 nt, Human
gaggguccccaugcagagcuca

SEQ ID NO: 476550 - RNA, 22 nt, Human
uucaggaugaaagugugcaaca

SEQ ID NO: 476551 - RNA, 22 nt, Human
caaugauggcuaggcagcugcu

SEQ ID NO: 476552 - RNA, 22 nt, Human
cugagcugcucccgcugcagcg

SEQ ID NO: 476553 - RNA, 22 nt, Human
ucacaugcuugaggaaagaaaa

SEQ ID NO: 476554 - RNA, 22 nt, Human
uccuucagcuuauuucuuagga

SEQ ID NO: 476555 - RNA, 22 nt, Human
cacugggcaauucugagccuaa

SEQ ID NO: 476556 - RNA, 22 nt, Human
cgccaggcuugguagcucaugc

SEQ ID NO: 476557 - RNA, 22 nt, Human
agcaggugacccaagcaggcug

SEQ ID NO: 476558 - RNA, 22 nt, Human
auuucucagcacuuccuaucuc

SEQ ID NO: 476559 - RNA, 23 nt, Human
uggcugagcccacuaucuuggcc

SEQ ID NO: 476560 - RNA, 22 nt, Human
aagccucaccuuuuagaagcua

SEQ ID NO: 476561 - RNA, 22 nt, Human
ugggcugaguggcagccagagu

SEQ ID NO: 476562 - RNA, 23 nt, Human
uggagaugccccacucccugucu

SEQ ID NO: 476563 - RNA, 22 nt, Human
gaaggccaagaggcuccaagau

SEQ ID NO: 476564 - RNA, 22 nt, Human
gcuuccugucccucagccauga

SEQ ID NO: 476565 - RNA, 22 nt, Human
cagcacuggggggauucggagc

SEQ ID NO: 476566 - RNA, 22 nt, Human
aaaaucugcuuccuuuuacaga

SEQ ID NO: 476567 - RNA, 22 nt, Human
uguacauacauagauauacaca

SEQ ID NO: 476568 - RNA, 22 nt, Human
cagagcuguugcggggcuuggc

SEQ ID NO: 476569 - RNA, 22 nt, Human
aucaguuuguauaugaaacacu

SEQ ID NO: 476570 - RNA, 22 nt, Human
ucaucucaaaacccaaggggca

SEQ ID NO: 476571 - RNA, 22 nt, Human
aaaucaguucucccuuucuuca

SEQ ID NO: 476572 - RNA, 22 nt, Human
ucagagagguuaaauaucuugu

SEQ ID NO: 476573 - RNA, 22 nt, Human
ugggccugacucaccugccucc

SEQ ID NO: 476574 - RNA, 21 nt, Human
aacauuucugggagaacucac

SEQ ID NO: 476575 - RNA, 22 nt, Human
ucccagccuuucuuuucugcug

SEQ ID NO: 476576 - RNA, 22 nt, Human
uuaacauuucuuuuccacucau

SEQ ID NO: 476577 - RNA, 23 nt, Human
gggagaauaugaggaugauggug

SEQ ID NO: 476578 - RNA, 22 nt, Human
augcuauacucaaagaaauuca

SEQ ID NO: 476579 - RNA, 22 nt, Human
gcugcucugugacagccuccgg

SEQ ID NO: 476580 - RNA, 22 nt, Human
cagucuucuaaccuagcagccu

SEQ ID NO: 476581 - RNA, 22 nt, Human
aacauuucuucugaaacugagu

SEQ ID NO: 476582 - RNA, 22 nt, Human
agguacagcaauauaagagguc

SEQ ID NO: 476583 - RNA, 22 nt, Human
auaugaagucagacaaacuggg

SEQ ID NO: 476584 - RNA, 22 nt, Human
uccaggcauguggccaguacuc

SEQ ID NO: 476585 - RNA, 22 nt, Human
cugcuggggucagagcacuggg

SEQ ID NO: 476586 - RNA, 22 nt, Human
uccagcagguuggucaggugca

SEQ ID NO: 476587 - RNA, 22 nt, Human
aggcaaaauuacaaaguuauua

SEQ ID NO: 476588 - RNA, 22 nt, Human
ccuggccuuaagggcagggagc

SEQ ID NO: 476589 - RNA, 22 nt, Human
agaugguuuugucuuuaugauu

SEQ ID NO: 476590 - RNA, 22 nt, Human
ggggcagcuaccggaaguaggg

SEQ ID NO: 476591 - RNA, 22 nt, Human
cagggcucccaaauaucucuuc

SEQ ID NO: 476592 - RNA, 22 nt, Human
ggagcugggguuggcaucuucc

SEQ ID NO: 476593 - RNA, 20 nt, Human
ccagguggugccuggagagg

SEQ ID NO: 476594 - RNA, 22 nt, Human
aacagacagaaaaaugugaucu

SEQ ID NO: 476595 - RNA, 18 nt, Human
auuuugaacaaugcugua

SEQ ID NO: 476596 - RNA, 22 nt, Human
aggagggugauccgggcugguc

SEQ ID NO: 476597 - RNA, 22 nt, Human
gaguccaggcucagaaacccgu

SEQ ID NO: 476598 - RNA, 22 nt, Human
ggccugaggccaccagcagccc

SEQ ID NO: 476599 - RNA, 22 nt, Human
cugacucccaaagaggacgcgu

SEQ ID NO: 476600 - RNA, 22 nt, Human
cagagccauccaggugccuguu

SEQ ID NO: 476601 - RNA, 22 nt, Human
acauaaaggugacuaacaucuu

SEQ ID NO: 476602 - RNA, 22 nt, Human
cuccaggagcugugucuuucuu

SEQ ID NO: 476603 - RNA, 22 nt, Human
caugucuguguacacaugcaca

SEQ ID NO: 476604 - RNA, 21 nt, Human
acucaggagacuaacuauguc

SEQ ID NO: 476605 - RNA, 22 nt, Human
cagggacauugguggccagguu

SEQ ID NO: 476606 - RNA, 22 nt, Human
ccagcccuucccaacuggccag

SEQ ID NO: 476607 - RNA, 22 nt, Human
acagccuguuugaucuggugcu

SEQ ID NO: 476608 - RNA, 22 nt, Human
uggcucagaacuacuucuaguu

SEQ ID NO: 476609 - RNA, 22 nt, Human
ucauuucuauugcuacugucug

SEQ ID NO: 476610 - RNA, 22 nt, Human
uuuguaaaaggaggaagcaugg

SEQ ID NO: 476611 - RNA, 22 nt, Human
gcuucgggguccaagcgcgugu

SEQ ID NO: 476612 - RNA, 22 nt, Human
cacaggagugcugcuauuguug

SEQ ID NO: 476613 - RNA, 22 nt, Human
aacagcagggggaccugcuggu

SEQ ID NO: 476614 - RNA, 22 nt, Human
gagggcucaacuacuacuaggc

SEQ ID NO: 476615 - RNA, 22 nt, Human
accucugcucaagaccccuccg

SEQ ID NO: 476616 - RNA, 22 nt, Human
aacagaaugcaggggaugcugc

SEQ ID NO: 476617 - RNA, 22 nt, Human
uucauguaauuccauaagguaa

SEQ ID NO: 476618 - RNA, 22 nt, Human
gugcaaugugcuucgugccaug

SEQ ID NO: 476619 - RNA, 21 nt, Human
gcagccacugccuucaacaau

SEQ ID NO: 476620 - RNA, 22 nt, Human
cagagccaaaccucagggcccg

SEQ ID NO: 476621 - RNA, 22 nt, Human
augaggcaggauuaagcuauca

SEQ ID NO: 476622 - RNA, 22 nt, Human
uggcuugucauguaucugaggc

SEQ ID NO: 476623 - RNA, 22 nt, Human
ugagaagcugcugacuuagccu

SEQ ID NO: 476624 - RNA, 22 nt, Human
uccuggaguauuucuguggugu

SEQ ID NO: 476625 - RNA, 22 nt, Human
agccugagccccauccagcuga

SEQ ID NO: 476626 - RNA, 22 nt, Human
aggagcugagggagcgcccuug

SEQ ID NO: 476627 - RNA, 22 nt, Human
gggaccuggggacuccuuguuc

SEQ ID NO: 476628 - RNA, 22 nt, Human
accucugcaguagggcugugcc

SEQ ID NO: 476629 - RNA, 22 nt, Human
cagaggcuaagaugagugggug

SEQ ID NO: 476630 - RNA, 22 nt, Human
gggcucugggaugcucuuagag

SEQ ID NO: 476631 - RNA, 22 nt, Human
gggaagcagcauugugcuggcu

SEQ ID NO: 476632 - RNA, 22 nt, Human
cuguccugcaguugggggcagg

SEQ ID NO: 476633 - RNA, 22 nt, Human
cuguccucuguccucagcagga

SEQ ID NO: 476634 - RNA, 22 nt, Human
aauguacaaaagucagccaacu

SEQ ID NO: 476635 - RNA, 22 nt, Human
agagccuggaccugagcuacaa

SEQ ID NO: 476636 - RNA, 22 nt, Human
aggagucauugagagggguccu

SEQ ID NO: 476637 - RNA, 22 nt, Human
ccaggcugcucacaagcugccc

SEQ ID NO: 476638 - RNA, 22 nt, Human
gcccagagagaugcuguagacc

SEQ ID NO: 476639 - RNA, 22 nt, Human
guggcagggugcucaucaugca

SEQ ID NO: 476640 - RNA, 23 nt, Human
uggcuggcagaaacugaagcaug

SEQ ID NO: 476641 - RNA, 22 nt, Human
ccagagagaguacugggcucug

SEQ ID NO: 476642 - RNA, 22 nt, Human
gcuggagccauuggcuuggccu

SEQ ID NO: 476643 - RNA, 18 nt, Human
uggagccauugccaccau

SEQ ID NO: 476644 - RNA, 22 nt, Human
uccauugucuuugguccuagcc

SEQ ID NO: 476645 - RNA, 22 nt, Human
ucucucagaggccaggguccug

SEQ ID NO: 476646 - RNA, 22 nt, Human
cagcuguguaugagagcaugcu

SEQ ID NO: 476647 - RNA, 22 nt, Human
agucacuguucugucaugucaa

SEQ ID NO: 476648 - RNA, 20 nt, Human
ucucccaggcucagggaaga

SEQ ID NO: 476649 - RNA, 22 nt, Human
agccucuguagaaagcagugug

SEQ ID NO: 476650 - RNA, 22 nt, Human
gggauggggggaagcguccaug

SEQ ID NO: 476651 - RNA, 22 nt, Human
uucauuccugagcccauauuua

SEQ ID NO: 476652 - RNA, 22 nt, Human
ugggcacuguagcuggugcugg

SEQ ID NO: 476653 - RNA, 22 nt, Human
caggagacuauggcccaaggcc

SEQ ID NO: 476654 - RNA, 22 nt, Human
gcccucagaguuccccacagug

SEQ ID NO: 476655 - RNA, 22 nt, Human
ccagagcuccagggcuacagaa

SEQ ID NO: 476656 - RNA, 22 nt, Human
cauguaaaacacucagaacagu

SEQ ID NO: 476657 - RNA, 22 nt, Human
gucccuggaauggacucugcgc

SEQ ID NO: 476658 - RNA, 22 nt, Human
ugagccugggagauggaggcug

SEQ ID NO: 476659 - RNA, 21 nt, Human
acagugugcuucucucccucc

SEQ ID NO: 476660 - RNA, 22 nt, Human
cugcugugcuuguggccacccg

SEQ ID NO: 476661 - RNA, 22 nt, Human
caguguggagggagagagccug

SEQ ID NO: 476662 - RNA, 20 nt, Human
uggcaggaggcagcagugga

SEQ ID NO: 476663 - RNA, 22 nt, Human
ugcauuguugaugaguugaaua

SEQ ID NO: 476664 - RNA, 22 nt, Human
ucuggagccuuggaugggaaag

SEQ ID NO: 476665 - RNA, 22 nt, Human
ggcagcuccucaaaaaauuaaa

SEQ ID NO: 476666 - RNA, 22 nt, Human
ucucuucuagcuucuugugguu

SEQ ID NO: 476667 - RNA, 22 nt, Human
cacagcuggggaagcugaggcc

SEQ ID NO: 476668 - RNA, 22 nt, Human
uccaggaggccucauuuccugu

SEQ ID NO: 476669 - RNA, 22 nt, Human
ggcucuggaaaguguccuugau

SEQ ID NO: 476670 - RNA, 22 nt, Human
ucugaaaugcaggcaauuugcu

SEQ ID NO: 476671 - RNA, 22 nt, Human
acugggaggcaucuggagcuga

SEQ ID NO: 476672 - RNA, 22 nt, Human
uuuaaaaaacuagucugagucu

SEQ ID NO: 476673 - RNA, 22 nt, Human
acuuugcaauacuuaauacaaa

SEQ ID NO: 476674 - RNA, 22 nt, Human
ccagagaggcaaaacuccuucc

SEQ ID NO: 476675 - RNA, 22 nt, Human
gagcagcuagauaaagcccuuc

SEQ ID NO: 476676 - RNA, 22 nt, Human
cccaggcacagauuaucccaau

SEQ ID NO: 476677 - RNA, 22 nt, Human
gaaaagagaacaucugaggauc

SEQ ID NO: 476678 - RNA, 22 nt, Human
ccuggcugggccugauuucuca

SEQ ID NO: 476679 - RNA, 22 nt, Human
ggcucagguuuaaagugcuuua

SEQ ID NO: 476680 - RNA, 22 nt, Human
gcagagccugugucugagcaaa

SEQ ID NO: 476681 - RNA, 22 nt, Human
aagagggaggugcgggugcaga

SEQ ID NO: 476682 - RNA, 23 nt, Human
cagaggcaucggauucaacauca

SEQ ID NO: 476683 - RNA, 22 nt, Human
cucagcccagcccaggaccagg

SEQ ID NO: 476684 - RNA, 22 nt, Human
uagcuuuaaugaguugguaaga

SEQ ID NO: 476685 - RNA, 22 nt, Human
guauuauuggguaguaugguaa

SEQ ID NO: 476686 - RNA, 20 nt, Human
ugcagcuucaccugugucau

SEQ ID NO: 476687 - RNA, 22 nt, Human
ggagcugaugacgucaccaugg

SEQ ID NO: 476688 - RNA, 22 nt, Human
ccaucccuucaccacagcagua

SEQ ID NO: 476689 - RNA, 22 nt, Human
augggaggguggaaaggcucug

SEQ ID NO: 476690 - RNA, 22 nt, Human
ggugaguugggguucacagguc

SEQ ID NO: 476691 - RNA, 22 nt, Human
cugggacagcugagacaggaga

SEQ ID NO: 476692 - RNA, 22 nt, Human
acuuucucccacccacccgucu

SEQ ID NO: 476693 - RNA, 22 nt, Human
ccucuuugugccugcaggcugc

SEQ ID NO: 476694 - RNA, 22 nt, Human
acccaggguagaaccucagagc

SEQ ID NO: 476695 - RNA, 22 nt, Human
agggcaguucaacuucauagug

SEQ ID NO: 476696 - RNA, 22 nt, Human
auuugucuuugagugcccugcu

SEQ ID NO: 476697 - RNA, 22 nt, Human
ugaacagaucaauagaacugac

SEQ ID NO: 476698 - RNA, 22 nt, Human
gaggccuggaauuccagccugg

SEQ ID NO: 476699 - RNA, 22 nt, Human
ccagggcugguggcugcagagg

SEQ ID NO: 476700 - RNA, 22 nt, Human
uacauuguuuuuucuugccauc

SEQ ID NO: 476701 - RNA, 22 nt, Human
agccagcugccuuucacaucug

SEQ ID NO: 476702 - RNA, 22 nt, Human
gccagagccacuuuugggugau

SEQ ID NO: 476703 - RNA, 22 nt, Human
ccugggcuuucaaaaccagccu

SEQ ID NO: 476704 - RNA, 22 nt, Human
uggcuuucucccccagcuucuc

SEQ ID NO: 476705 - RNA, 22 nt, Human
ucuaccacuaagugugcuuuga

SEQ ID NO: 476706 - RNA, 19 nt, Human
ccagcccugucacuucuug

SEQ ID NO: 476707 - RNA, 21 nt, Human
cagugagguccccagccuagg

SEQ ID NO: 476708 - RNA, 22 nt, Human
augggcuguccuaguccagccc

SEQ ID NO: 476709 - RNA, 22 nt, Human
cugugucucuccuuacaagacu

SEQ ID NO: 476710 - RNA, 22 nt, Human
gcuccucuauuccccacauuuu

SEQ ID NO: 476711 - RNA, 22 nt, Human
auguaagguucagaguauguga

SEQ ID NO: 476712 - RNA, 22 nt, Human
ggagugaaguggcgcgaucucg

SEQ ID NO: 476713 - RNA, 22 nt, Human
acgcagaagggccuggcgugcc

SEQ ID NO: 476714 - RNA, 22 nt, Human
uagcagggaaggugugcugagc

SEQ ID NO: 476715 - RNA, 22 nt, Human
aaucaguuucuuggcaaguuua

SEQ ID NO: 476716 - RNA, 22 nt, Human
uugauacaggccuucuagauga

SEQ ID NO: 476717 - RNA, 20 nt, Human
ucccuggaggugguggcauc

SEQ ID NO: 476718 - RNA, 22 nt, Human
ugaaugaugcaguauaaugaua

SEQ ID NO: 476719 - RNA, 22 nt, Human
ucaguuuuucuauacuuuguag

SEQ ID NO: 476720 - RNA, 22 nt, Human
agucccagccuguaggauuggg

SEQ ID NO: 476721 - RNA, 22 nt, Human
cugcagugcaagcccagaugga

SEQ ID NO: 476722 - RNA, 22 nt, Human
gcuugcucaacccccgucucuc

SEQ ID NO: 476723 - RNA, 18 nt, Human
cccagcuggugggucagu

SEQ ID NO: 476724 - RNA, 22 nt, Human
ggcuucugagugcucugcuguu

SEQ ID NO: 476725 - RNA, 22 nt, Human
uguaggauuuucaccagaccuu

SEQ ID NO: 476726 - RNA, 22 nt, Human
ggggaaggauugaguugaccca

SEQ ID NO: 476727 - RNA, 22 nt, Human
ucaggcuggaaugcaguggggc

SEQ ID NO: 476728 - RNA, 22 nt, Human
aaacaucaccauuuuaccuaau

SEQ ID NO: 476729 - RNA, 19 nt, Human
gagcagcugcacccauuga

SEQ ID NO: 476730 - RNA, 22 nt, Human
ugcugccauggucgcugguguc

SEQ ID NO: 476731 - RNA, 22 nt, Human
aggcgcaggguuuggacccagg

SEQ ID NO: 476732 - RNA, 22 nt, Human
gagcuuaggccagggacaggga

SEQ ID NO: 476733 - RNA, 22 nt, Human
ugggagaagcagcagccaagug

SEQ ID NO: 476734 - RNA, 22 nt, Human
agaguccauaugugggaggagu

SEQ ID NO: 476735 - RNA, 22 nt, Human
gagguggguguaucacagguca

SEQ ID NO: 476736 - RNA, 22 nt, Human
ucucagggccccaaaggcuagu

SEQ ID NO: 476737 - RNA, 17 nt, Human
gacaagacagaauucau

SEQ ID NO: 476738 - RNA, 22 nt, Human
uagaaacauguucuguucuguu

SEQ ID NO: 476739 - RNA, 22 nt, Human
ugcagggccuucuagaccaugg

SEQ ID NO: 476740 - RNA, 22 nt, Human
ucagugucuugggcuugaaugc

SEQ ID NO: 476741 - RNA, 20 nt, Human
uaaggcuguuuuguauuccu

SEQ ID NO: 476742 - RNA, 22 nt, Human
acagucuugagcaucagccaga

SEQ ID NO: 476743 - RNA, 22 nt, Human
gggcugcugccaccagguggau

SEQ ID NO: 476744 - RNA, 22 nt, Human
aggcuggaguacaguggcuauu

SEQ ID NO: 476745 - RNA, 22 nt, Human
uaugcacgucuauuuaugaaga

SEQ ID NO: 476746 - RNA, 22 nt, Human
acaacacagcaaaaccccaucu

SEQ ID NO: 476747 - RNA, 22 nt, Human
agaauuagaggccauguacuug

SEQ ID NO: 476748 - RNA, 22 nt, Human
gcagagcaguacucucuugacu

SEQ ID NO: 476749 - RNA, 22 nt, Human
agcuuuauauuuaaugaauucu

SEQ ID NO: 476750 - RNA, 22 nt, Human
cugugccuaagaugcaugucuc

SEQ ID NO: 476751 - RNA, 22 nt, Human
auaugcauuuaccuggcauaua

SEQ ID NO: 476752 - RNA, 22 nt, Human
uagggcugccuauggcuagaua

SEQ ID NO: 476753 - RNA, 22 nt, Human
caggguacagaguuuucuaaac

SEQ ID NO: 476754 - RNA, 22 nt, Human
cugaagaugucugagaugcuca

SEQ ID NO: 476755 - RNA, 22 nt, Human
cccugcagccggccagcucauu

SEQ ID NO: 476756 - RNA, 22 nt, Human
gccaggcagcugggagggugcc

SEQ ID NO: 476757 - RNA, 23 nt, Human
cacugcagcguggucuggcagga

SEQ ID NO: 476758 - RNA, 22 nt, Human
caguguguggauccucccagga

SEQ ID NO: 476759 - RNA, 22 nt, Human
gcauggcagugaggauggugcu

SEQ ID NO: 476760 - RNA, 22 nt, Human
ucuuggagacucuuguauauuu

SEQ ID NO: 476761 - RNA, 22 nt, Human
cugucagguuggucucagagcu

SEQ ID NO: 476762 - RNA, 20 nt, Human
ccuaggcaugcugagucucc

SEQ ID NO: 476763 - RNA, 22 nt, Human
uagaggcagaagaaauugacaa

SEQ ID NO: 476764 - RNA, 22 nt, Human
agcuggagaaaccugggagggu

SEQ ID NO: 476765 - RNA, 19 nt, Human
auuccucaaggacagaaau

SEQ ID NO: 476766 - RNA, 22 nt, Human
ucccagauuguugauggcuuaa

SEQ ID NO: 476767 - RNA, 22 nt, Human
uccuugaacagagggccugggu

SEQ ID NO: 476768 - RNA, 22 nt, Human
ggccuggaaugcuuuccuacca

SEQ ID NO: 476769 - RNA, 22 nt, Human
cagggcucaccacugggauccu

SEQ ID NO: 476770 - RNA, 22 nt, Human
aggccuuaccauagcuguagca

SEQ ID NO: 476771 - RNA, 22 nt, Human
gagcuguccgccccugggccga

SEQ ID NO: 476772 - RNA, 22 nt, Human
ugaagcaggaaccagcagcauu

SEQ ID NO: 476773 - RNA, 22 nt, Human
ggaaagccaggugcucuggugu

SEQ ID NO: 476774 - RNA, 22 nt, Human
agccaguguuaagugacugguu

SEQ ID NO: 476775 - RNA, 22 nt, Human
gggccucucccuucucacgcau

SEQ ID NO: 476776 - RNA, 22 nt, Human
gagggcuccauuccccgugccc

SEQ ID NO: 476777 - RNA, 22 nt, Human
gcugucugggaugucacugcug

SEQ ID NO: 476778 - RNA, 22 nt, Human
cagcugugcuagaagccacgaa

SEQ ID NO: 476779 - RNA, 22 nt, Human
agccaggccagacucacacccu

SEQ ID NO: 476780 - RNA, 22 nt, Human
gugcagcagggggaagacagug

SEQ ID NO: 476781 - RNA, 23 nt, Human
gccucagagaaacagcugcacac

SEQ ID NO: 476782 - RNA, 22 nt, Human
cagggcuggauccuccagacuc

SEQ ID NO: 476783 - RNA, 22 nt, Human
uccagugguaguaaagaggucu

SEQ ID NO: 476784 - RNA, 22 nt, Human
agagcuuagaauuucagaugau

SEQ ID NO: 476785 - RNA, 22 nt, Human
gagcugagccuggguggaccgc

SEQ ID NO: 476786 - RNA, 22 nt, Human
ggccaugguuggggaagacaug

SEQ ID NO: 476787 - RNA, 22 nt, Human
caguacuuaacuuauaggagag

SEQ ID NO: 476788 - RNA, 22 nt, Human
agccaacuaggagauuaaggua

SEQ ID NO: 476789 - RNA, 22 nt, Human
cagggcuccccgcaccgcagcc

SEQ ID NO: 476790 - RNA, 22 nt, Human
aaggagucucagcugggccuga

SEQ ID NO: 476791 - RNA, 23 nt, Human
uggagcugacagucagagggagg

SEQ ID NO: 476792 - RNA, 22 nt, Human
agccucucuccagcuuggcaga

SEQ ID NO: 476793 - RNA, 19 nt, Human
agauggggaagagugugag

SEQ ID NO: 476794 - RNA, 21 nt, Human
uccuuccuugagguccuuucc

SEQ ID NO: 476795 - RNA, 22 nt, Human
agauacaugucaagagacuuau

SEQ ID NO: 476796 - RNA, 22 nt, Human
ccaaaguccauaguuuacauua

SEQ ID NO: 476797 - RNA, 22 nt, Human
uggcucugggcaccguguccac

SEQ ID NO: 476798 - RNA, 22 nt, Human
gaagagcuccaaaaacagugag

SEQ ID NO: 476799 - RNA, 22 nt, Human
gggcugccaagccugccugccu

SEQ ID NO: 476800 - RNA, 22 nt, Human
uuaagaauggaaugaggaauuu

SEQ ID NO: 476801 - RNA, 22 nt, Human
auuccaguucuccucucuaaag

SEQ ID NO: 476802 - RNA, 22 nt, Human
guuuuuccuugcugaggacccg

SEQ ID NO: 476803 - RNA, 22 nt, Human
cugggcagagcuaacaccugag

SEQ ID NO: 476804 - RNA, 22 nt, Human
agggcugccauuucuggcccaa

SEQ ID NO: 476805 - RNA, 22 nt, Human
uucuggaguauuccuggcaccu

SEQ ID NO: 476806 - RNA, 22 nt, Human
cuggagagaccgaaagaggcug

SEQ ID NO: 476807 - RNA, 22 nt, Human
caaagguauaaguuaauauaca

SEQ ID NO: 476808 - RNA, 22 nt, Human
ugccugaugcaggaguaucaga

SEQ ID NO: 476809 - RNA, 22 nt, Human
caaagugcugagauuacaggua

SEQ ID NO: 476810 - RNA, 22 nt, Human
uccuaguucucugccagucgcu

SEQ ID NO: 476811 - RNA, 22 nt, Human
uuccaaagucauguugcugaua

SEQ ID NO: 476812 - RNA, 22 nt, Human
auguagagcaguguuguccaau

SEQ ID NO: 476813 - RNA, 22 nt, Human
uugcauugaugucuauacgcug

SEQ ID NO: 476814 - RNA, 22 nt, Human
uuuagggaugucagaacaggga

SEQ ID NO: 476815 - RNA, 22 nt, Human
cagggccuucguaaguguccgg

SEQ ID NO: 476816 - RNA, 22 nt, Human
gcaggcugugaggcucagaugg

SEQ ID NO: 476817 - RNA, 21 nt, Human
acagcaagccuuccuuucagg

SEQ ID NO: 476818 - RNA, 22 nt, Human
agacagcauggagcugauaaca

SEQ ID NO: 476819 - RNA, 22 nt, Human
cccagagccucauucuguuggg

SEQ ID NO: 476820 - RNA, 22 nt, Human
ucucugagaaguuccuuuguga

SEQ ID NO: 476821 - RNA, 22 nt, Human
acacagggcggaaagcaugaga

SEQ ID NO: 476822 - RNA, 22 nt, Human
uaauuucuggagggagaaagag

SEQ ID NO: 476823 - RNA, 22 nt, Human
cuaaaugcccuacaaugacugg

SEQ ID NO: 476824 - RNA, 22 nt, Human
uccugaaaauaauuucacaaga

SEQ ID NO: 476825 - RNA, 22 nt, Human
uuucauaauagugcaguuuguu

SEQ ID NO: 476826 - RNA, 22 nt, Human
agccccuuccaguucucagauc

SEQ ID NO: 476827 - RNA, 22 nt, Human
uacugugacagaguacuuaaac

SEQ ID NO: 476828 - RNA, 22 nt, Human
ccuggggcucaagauggcgccg

SEQ ID NO: 476829 - RNA, 22 nt, Human
gaaggagggugcggaucugagc

SEQ ID NO: 476830 - RNA, 22 nt, Human
aggugccagcucucaggcagga

SEQ ID NO: 476831 - RNA, 22 nt, Human
aggcugagcugaccugguuugg

SEQ ID NO: 476832 - RNA, 22 nt, Human
ucccuggccauuccucuaggcc

SEQ ID NO: 476833 - RNA, 22 nt, Human
aagguacagaaauuaacaagga

SEQ ID NO: 476834 - RNA, 22 nt, Human
uggacagcgaaagugccuggga

SEQ ID NO: 476835 - RNA, 22 nt, Human
aggaugaauaacugaaauggug

SEQ ID NO: 476836 - RNA, 22 nt, Human
gugcaguggcagauccuagcuc

SEQ ID NO: 476837 - RNA, 22 nt, Human
uggccuggaagagaggucgagg

SEQ ID NO: 476838 - RNA, 22 nt, Human
ugcuuuuaagaacaaugcugcu

SEQ ID NO: 476839 - RNA, 18 nt, Human
ccuggcagccaugcgcgc

SEQ ID NO: 476840 - RNA, 22 nt, Human
acccuguaugcuauaucccuaa

SEQ ID NO: 476841 - RNA, 22 nt, Human
gcuggcuguguuccuucugcca

SEQ ID NO: 476842 - RNA, 22 nt, Human
uaacagaaauagaaaugagagu

SEQ ID NO: 476843 - RNA, 22 nt, Human
acagaggccccgugggagagcc

SEQ ID NO: 476844 - RNA, 22 nt, Human
gaggcuggaggucaaagaugaa

SEQ ID NO: 476845 - RNA, 17 nt, Human
ggcuggagcagcucccc

SEQ ID NO: 476846 - RNA, 22 nt, Human
agaauuguugggguaauaaaag

SEQ ID NO: 476847 - RNA, 17 nt, Human
uccagagcacagagcuc

SEQ ID NO: 476848 - RNA, 22 nt, Human
uauuugaaaguguacaaaaacu

SEQ ID NO: 476849 - RNA, 22 nt, Human
ucuggcucuuugggugauugua

SEQ ID NO: 476850 - RNA, 22 nt, Human
aaugucugccagaacugaucau

SEQ ID NO: 476851 - RNA, 19 nt, Human
ggagaagcccaggaauccu

SEQ ID NO: 476852 - RNA, 22 nt, Human
aucuauuaugcugagaaacugu

SEQ ID NO: 476853 - RNA, 22 nt, Human
gucaggauuugaacucaggucu

SEQ ID NO: 476854 - RNA, 22 nt, Human
cugccagcaaugugaccaugcu

SEQ ID NO: 476855 - RNA, 22 nt, Human
acaggcuguugggguccagggu

SEQ ID NO: 476856 - RNA, 22 nt, Human
gaaaggagaggguuaaggagcu

SEQ ID NO: 476857 - RNA, 22 nt, Human
gguggccaggccagcucuggcc

SEQ ID NO: 476858 - RNA, 22 nt, Human
cacauguuuggcaugucaccaa

SEQ ID NO: 476859 - RNA, 22 nt, Human
ccugccaggccagugagcuucc

SEQ ID NO: 476860 - RNA, 19 nt, Human
acccagagcccuuugcagg

SEQ ID NO: 476861 - RNA, 22 nt, Human
aagggcuccaagagguagcugg

SEQ ID NO: 476862 - RNA, 22 nt, Human
gcaggguaggugacagguaguc

SEQ ID NO: 476863 - RNA, 22 nt, Human
aucuuucagagcuccaucaggg

SEQ ID NO: 476864 - RNA, 22 nt, Human
ggcuggaaguccaagaucaaga

SEQ ID NO: 476865 - RNA, 22 nt, Human
aagcgccacgagaagcuggacc

SEQ ID NO: 476866 - RNA, 22 nt, Human
aaggucauuuuuuccucuguug

SEQ ID NO: 476867 - RNA, 22 nt, Human
gcacugaaauuauaugcauuug

SEQ ID NO: 476868 - RNA, 22 nt, Human
gcagagcagugcuugcccagcg

SEQ ID NO: 476869 - RNA, 22 nt, Human
uucagucuccucauuuuacaaa

SEQ ID NO: 476870 - RNA, 17 nt, Human
cucugcagugcauggcu

SEQ ID NO: 476871 - RNA, 22 nt, Human
agccuucacugggaccuuggau

SEQ ID NO: 476872 - RNA, 22 nt, Human
cugagcauggccgguccauggu

SEQ ID NO: 476873 - RNA, 22 nt, Human
guuugcauguauuaagucaaua

SEQ ID NO: 476874 - RNA, 22 nt, Human
uaagccacuagucuguuaugaa

SEQ ID NO: 476875 - RNA, 22 nt, Human
agggcagccugagugcuggccc

SEQ ID NO: 476876 - RNA, 20 nt, Human
uaggcagagcugugcagccu

SEQ ID NO: 476877 - RNA, 22 nt, Human
gaagagcugugauucaggcuua

SEQ ID NO: 476878 - RNA, 22 nt, Human
ugucuuuagaaagaagcagaca

SEQ ID NO: 476879 - RNA, 22 nt, Human
gccaggugggagacagacagca

SEQ ID NO: 476880 - RNA, 22 nt, Human
agccuggauccuaggcucagcu

SEQ ID NO: 476881 - RNA, 21 nt, Human
ucagaguguguuacagcaagc

SEQ ID NO: 476882 - RNA, 22 nt, Human
ucaaaggcaccaaggucacugc

SEQ ID NO: 476883 - RNA, 22 nt, Human
cauugcacuuuggguccaggac

SEQ ID NO: 476884 - RNA, 20 nt, Human
cugcccagccacugagggau

SEQ ID NO: 476885 - RNA, 22 nt, Human
cccaugccuucugacucacagg

SEQ ID NO: 476886 - RNA, 22 nt, Human
ucacuuaaaaauucuaguuaug

SEQ ID NO: 476887 - RNA, 22 nt, Human
ugaagccagcuuuggaagacac

SEQ ID NO: 476888 - RNA, 22 nt, Human
ucagcccugggacccagggaug

SEQ ID NO: 476889 - RNA, 22 nt, Human
cccaggccagaacuugguugcu

SEQ ID NO: 476890 - RNA, 22 nt, Human
gggcaugguggugcacaccugu

SEQ ID NO: 476891 - RNA, 20 nt, Human
aggcagagcgcacuuuuaga

SEQ ID NO: 476892 - RNA, 22 nt, Human
aaaugcauuuuuaauuagaccc

SEQ ID NO: 476893 - RNA, 22 nt, Human
gcucagccgaacuucagagcag

SEQ ID NO: 476894 - RNA, 22 nt, Human
gaagcucucaaacucuccccuu

SEQ ID NO: 476895 - RNA, 22 nt, Human
ugcucccaggcucuguggucug

SEQ ID NO: 476896 - RNA, 22 nt, Human
ugagccagccuugcagcugugc

SEQ ID NO: 476897 - RNA, 22 nt, Human
aaguuuaagguggaaguggugg

SEQ ID NO: 476898 - RNA, 22 nt, Human
cuggagccggcgagccccagcc

SEQ ID NO: 476899 - RNA, 22 nt, Human
ucccagaggcuccagucucuau

SEQ ID NO: 476900 - RNA, 22 nt, Human
aagucacacuagacaacugagg

SEQ ID NO: 476901 - RNA, 22 nt, Human
cagugaaguuuaaaguguagau

SEQ ID NO: 476902 - RNA, 22 nt, Human
ucucuggaauuggcugaggcaa

SEQ ID NO: 476903 - RNA, 22 nt, Human
gccaggcagcuagcaaccccug

SEQ ID NO: 476904 - RNA, 22 nt, Human
cucucuggaagggggagcugau

SEQ ID NO: 476905 - RNA, 22 nt, Human
agagccaggugcugcuguuuga

SEQ ID NO: 476906 - RNA, 22 nt, Human
ugaggcaguugagcuuccugag

SEQ ID NO: 476907 - RNA, 22 nt, Human
gaggcacaccagggagucuugu

SEQ ID NO: 476908 - RNA, 22 nt, Human
gcagagugggagcccagggcug

SEQ ID NO: 476909 - RNA, 22 nt, Human
cccacucccugcacgccugccg

SEQ ID NO: 476910 - RNA, 22 nt, Human
uggcucugcaccucaguguacc

SEQ ID NO: 476911 - RNA, 22 nt, Human
gggcagguuggcaucccgggca

SEQ ID NO: 476912 - RNA, 21 nt, Human
gcagcagaggcuugacagaca

SEQ ID NO: 476913 - RNA, 23 nt, Human
aggcacugaaugugucagugagu

SEQ ID NO: 476914 - RNA, 22 nt, Human
uagaaaugauuuugaugcuuca

SEQ ID NO: 476915 - RNA, 22 nt, Human
agagcugcaggguggacccagg

SEQ ID NO: 476916 - RNA, 22 nt, Human
caaggaaacaugaaaugcauug

SEQ ID NO: 476917 - RNA, 22 nt, Human
uauuauguagaguaaggguuaa

SEQ ID NO: 476918 - RNA, 22 nt, Human
aggccuccuggcuccaggccuu

SEQ ID NO: 476919 - RNA, 22 nt, Human
agggugucagccacggaauggg

SEQ ID NO: 476920 - RNA, 22 nt, Human
aggcagugugggccaagcuucc

SEQ ID NO: 476921 - RNA, 22 nt, Human
ggaagagccuggggugucaggc

SEQ ID NO: 476922 - RNA, 22 nt, Human
gcaggcagaucaccugucagga

SEQ ID NO: 476923 - RNA, 22 nt, Human
ccugacucuggccaggccagcu

SEQ ID NO: 476924 - RNA, 22 nt, Human
agcuggggguuggauaagggua

SEQ ID NO: 476925 - RNA, 22 nt, Human
cugcugggcuccucaugugacu

SEQ ID NO: 476926 - RNA, 22 nt, Human
gagaagcagguuuagcagacaa

SEQ ID NO: 476927 - RNA, 22 nt, Human
guuuuguugcugcagagcucaa

SEQ ID NO: 476928 - RNA, 22 nt, Human
gccagcugcuggaacagcgcga

SEQ ID NO: 476929 - RNA, 22 nt, Human
guucauuuaugauguaacaugu

SEQ ID NO: 476930 - RNA, 22 nt, Human
gcagcuguggguuccaagucua

SEQ ID NO: 476931 - RNA, 22 nt, Human
ugaggccacuuccccacagccc

SEQ ID NO: 476932 - RNA, 22 nt, Human
uguagcauguaaauugguuauu

SEQ ID NO: 476933 - RNA, 22 nt, Human
cagagcaggcccacugcccucc

SEQ ID NO: 476934 - RNA, 22 nt, Human
gagaagcaauuuccaacugugc

SEQ ID NO: 476935 - RNA, 22 nt, Human
ucucagagccuaacuaaccuaa

SEQ ID NO: 476936 - RNA, 22 nt, Human
aagagcugcaucuaagccauga

SEQ ID NO: 476937 - RNA, 22 nt, Human
agaaaagguugaaaguaggauu

SEQ ID NO: 476938 - RNA, 22 nt, Human
uaugcacauauaaccugcacug

SEQ ID NO: 476939 - RNA, 22 nt, Human
gagaaguuucugguuugcauag

SEQ ID NO: 476940 - RNA, 22 nt, Human
ggugaaggaggaagcugaugga

SEQ ID NO: 476941 - RNA, 22 nt, Human
cugccugcaugcugccauagcu

SEQ ID NO: 476942 - RNA, 22 nt, Human
acaaaggugcgucccuucagcu

SEQ ID NO: 476943 - RNA, 22 nt, Human
gucccuuggcucacaaacagcu

SEQ ID NO: 476944 - RNA, 22 nt, Human
cagggcccauggcucagguagg

SEQ ID NO: 476945 - RNA, 22 nt, Human
gcuggcucccauugguccuucc

SEQ ID NO: 476946 - RNA, 22 nt, Human
ugcucuguugugcaugugggau

SEQ ID NO: 476947 - RNA, 22 nt, Human
uccuugaauugugccacuuacc

SEQ ID NO: 476948 - RNA, 22 nt, Human
gcaaaaaaugcuuguugcuuag

SEQ ID NO: 476949 - RNA, 22 nt, Human
uuacaguuuaguccaagccaga

SEQ ID NO: 476950 - RNA, 22 nt, Human
uccaggcaucccccaggacaga

SEQ ID NO: 476951 - RNA, 22 nt, Human
ugcugugagguugagaaggaag

SEQ ID NO: 476952 - RNA, 22 nt, Human
uagaaauguugguauuaacauu

SEQ ID NO: 476953 - RNA, 22 nt, Human
gggcaagcucuucagaagcucu

SEQ ID NO: 476954 - RNA, 22 nt, Human
acagcugugagggucacuugua

SEQ ID NO: 476955 - RNA, 22 nt, Human
uucacaggcuuggagguggggg

SEQ ID NO: 476956 - RNA, 22 nt, Human
cagaguguuagcgcugguuggg

SEQ ID NO: 476957 - RNA, 23 nt, Human
aaguucaagucacagccugucuu

SEQ ID NO: 476958 - RNA, 22 nt, Human
cucugagagcggucuguggcuu

SEQ ID NO: 476959 - RNA, 18 nt, Human
aaggcuucaaagaguaga

SEQ ID NO: 476960 - RNA, 22 nt, Human
aggugcuggaguagaagaaaaa

SEQ ID NO: 476961 - RNA, 22 nt, Human
agagcagcuggggcagagacca

SEQ ID NO: 476962 - RNA, 22 nt, Human
aggcaguuguugcugagcagcu

SEQ ID NO: 476963 - RNA, 22 nt, Human
gccuggcacucacugaagaggc

SEQ ID NO: 476964 - RNA, 22 nt, Human
cgcugggggaacagcgagggug

SEQ ID NO: 476965 - RNA, 22 nt, Human
aggcugagcaaagggccuuacc

SEQ ID NO: 476966 - RNA, 22 nt, Human
aggcagguuucccggcugucaa

SEQ ID NO: 476967 - RNA, 22 nt, Human
acaggcugccuaccaaguauca

SEQ ID NO: 476968 - RNA, 22 nt, Human
cauugcacuccacccuaggcaa

SEQ ID NO: 476969 - RNA, 22 nt, Human
cuggcucagacagcugugcagu

SEQ ID NO: 476970 - RNA, 22 nt, Human
agaggccaguggcugugcuguc

SEQ ID NO: 476971 - RNA, 22 nt, Human
ucaggcugccuaucagacugug

SEQ ID NO: 476972 - RNA, 22 nt, Human
gaaggccacggaauggagcugg

SEQ ID NO: 476973 - RNA, 22 nt, Human
ucuucauuuuauagcaucugug

SEQ ID NO: 476974 - RNA, 22 nt, Human
ccugggagcuguggaaaggcug

SEQ ID NO: 476975 - RNA, 22 nt, Human
ccagggcagcgccccuccacgc

SEQ ID NO: 476976 - RNA, 21 nt, Human
gcucccugcucagcuccuggg

SEQ ID NO: 476977 - RNA, 22 nt, Human
gccccugggagcagagccacca

SEQ ID NO: 476978 - RNA, 22 nt, Human
cucagggggaaucaggucacag

SEQ ID NO: 476979 - RNA, 22 nt, Human
ccagagccagagaggugccugc

SEQ ID NO: 476980 - RNA, 22 nt, Human
caggagacaauggcuguggggc

SEQ ID NO: 476981 - RNA, 22 nt, Human
ugauucacagacuucacaaggc

SEQ ID NO: 476982 - RNA, 22 nt, Human
gcaguguuuacauauuagaaac

SEQ ID NO: 476983 - RNA, 22 nt, Human
ucucagagaacaguuggugcuu

SEQ ID NO: 476984 - RNA, 19 nt, Human
guggccagggcaggggcug

SEQ ID NO: 476985 - RNA, 22 nt, Human
ugagaguauuuuggcauuauca

SEQ ID NO: 476986 - RNA, 22 nt, Human
aggcucaguucacgucaacuuu

SEQ ID NO: 476987 - RNA, 20 nt, Human
guaaaauauggucuuugggu

SEQ ID NO: 476988 - RNA, 22 nt, Human
aguccggggucuggacaccugg

SEQ ID NO: 476989 - RNA, 22 nt, Human
aacagaacccgagugugaaucu

SEQ ID NO: 476990 - RNA, 22 nt, Human
ugggaccuguuacauugaguua

SEQ ID NO: 476991 - RNA, 22 nt, Human
uugaacauuaacuucagucuau

SEQ ID NO: 476992 - RNA, 22 nt, Human
cugagagcagggacuugagcca

SEQ ID NO: 476993 - RNA, 22 nt, Human
agugauuugggugucagaaagu

SEQ ID NO: 476994 - RNA, 19 nt, Human
gagggcucauuugaacaau

SEQ ID NO: 476995 - RNA, 22 nt, Human
ggagcagccacgucucagggca

SEQ ID NO: 476996 - RNA, 22 nt, Human
uccugcaggggcugaggaacca

SEQ ID NO: 476997 - RNA, 22 nt, Human
accaaaaauuguggggcugaau

SEQ ID NO: 476998 - RNA, 22 nt, Human
cucuggagugcagccugguggc

SEQ ID NO: 476999 - RNA, 22 nt, Human
cuguccagaaagggggcaacaa

SEQ ID NO: 477000 - RNA, 22 nt, Human
gaagaacugugacagaagcagu

SEQ ID NO: 477001 - RNA, 22 nt, Human
gagaaagggauaauuugaagag

SEQ ID NO: 477002 - RNA, 22 nt, Human
uugucuuaaauggauggacaau

SEQ ID NO: 477003 - RNA, 22 nt, Human
aggaggcugguucaggccauau

SEQ ID NO: 477004 - RNA, 22 nt, Human
cuccuuccugguuagcaccuua

SEQ ID NO: 477005 - RNA, 22 nt, Human
aggcugagcugguagugaguac

SEQ ID NO: 477006 - RNA, 22 nt, Human
agaaagaacgcacuugugcugc

SEQ ID NO: 477007 - RNA, 22 nt, Human
agucucagaaaauaugcuuuuu

SEQ ID NO: 477008 - RNA, 22 nt, Human
ccuggcuuuuguuuauaaauuc

SEQ ID NO: 477009 - RNA, 22 nt, Human
ggcaccuggagguuuacuggau

SEQ ID NO: 477010 - RNA, 22 nt, Human
gcacagggagcaggucucuggu

SEQ ID NO: 477011 - RNA, 22 nt, Human
caggcagaaauuuuguuucauu

SEQ ID NO: 477012 - RNA, 22 nt, Human
gagaaggcuggucuuaagucga

SEQ ID NO: 477013 - RNA, 21 nt, Human
ugccagcauuaaacagucauu

SEQ ID NO: 477014 - RNA, 22 nt, Human
ggcugcugugaccucaggugau

SEQ ID NO: 477015 - RNA, 19 nt, Human
gcagccaggugcucuaccu

SEQ ID NO: 477016 - RNA, 22 nt, Human
ugcagcauuauucacaguagcc

SEQ ID NO: 477017 - RNA, 22 nt, Human
ucacugcaaccucugccuuccg

SEQ ID NO: 477018 - RNA, 22 nt, Human
auuuucauuuugcagggugaga

SEQ ID NO: 477019 - RNA, 22 nt, Human
ugguggcuguugcagaacugag

SEQ ID NO: 477020 - RNA, 22 nt, Human
uaagaacaguagaacaguaggu

SEQ ID NO: 477021 - RNA, 22 nt, Human
uugucugugaaauggaaauagu

SEQ ID NO: 477022 - RNA, 22 nt, Human
cagggccagccauccugcuggg

SEQ ID NO: 477023 - RNA, 22 nt, Human
cccaggcugauguucagcgggu

SEQ ID NO: 477024 - RNA, 22 nt, Human
uguacaguauauuucaaagcca

SEQ ID NO: 477025 - RNA, 22 nt, Human
gggugggguucaggaaucuuca

SEQ ID NO: 477026 - RNA, 22 nt, Human
agugugagccuacaggccaaag

SEQ ID NO: 477027 - RNA, 22 nt, Human
ccaaugauggugcccacgauga

SEQ ID NO: 477028 - RNA, 21 nt, Human
gcugagagguugggaaguuca

SEQ ID NO: 477029 - RNA, 22 nt, Human
aucaggaagaagaauguguugg

SEQ ID NO: 477030 - RNA, 22 nt, Human
aaaguguaaaagcauguuaggg

SEQ ID NO: 477031 - RNA, 22 nt, Human
cacugcuuuaaggcugaguaac

SEQ ID NO: 477032 - RNA, 22 nt, Human
caguugcuacaguucaagugug

SEQ ID NO: 477033 - RNA, 22 nt, Human
cucagagaagucuuugcuaaac

SEQ ID NO: 477034 - RNA, 22 nt, Human
cucuggacacuggcaugggguc

SEQ ID NO: 477035 - RNA, 23 nt, Human
ggcuggcccggggcugcuccuga

SEQ ID NO: 477036 - RNA, 22 nt, Human
aaauguagaccuauagggaccu

SEQ ID NO: 477037 - RNA, 22 nt, Human
uggaugcuguaggacacgcucu

SEQ ID NO: 477038 - RNA, 22 nt, Human
uggcacugagcagccgcggcag

SEQ ID NO: 477039 - RNA, 22 nt, Human
caguagcacuagauaugugugg

SEQ ID NO: 477040 - RNA, 22 nt, Human
agggaaggagguuagaacccac

SEQ ID NO: 477041 - RNA, 22 nt, Human
gaggagaagcuaagaaacacag

SEQ ID NO: 477042 - RNA, 19 nt, Human
ggcagacacaguugacaug

SEQ ID NO: 477043 - RNA, 20 nt, Human
aagggcagagggaacagacu

SEQ ID NO: 477044 - RNA, 22 nt, Human
uugcagagagguuaggaacuca

SEQ ID NO: 477045 - RNA, 22 nt, Human
caaaguccuagaacagugcuug

SEQ ID NO: 477046 - RNA, 22 nt, Human
ucccaggcuaggccucugcguu

SEQ ID NO: 477047 - RNA, 22 nt, Human
ggagagaaauugagguagcaag

SEQ ID NO: 477048 - RNA, 22 nt, Human
ccuggcaggccccuccuggauu

SEQ ID NO: 477049 - RNA, 19 nt, Human
cagaaauagcgaaguguaa

SEQ ID NO: 477050 - RNA, 22 nt, Human
gaaguggaagccaucggcaguc

SEQ ID NO: 477051 - RNA, 22 nt, Human
gcaggccuuggcaaugagccug

SEQ ID NO: 477052 - RNA, 22 nt, Human
gcagcuggugcaaaugucacuc

SEQ ID NO: 477053 - RNA, 22 nt, Human
guuugauucaagaacaaagagu

SEQ ID NO: 477054 - RNA, 22 nt, Human
agugcuguccaguuucacaggu

SEQ ID NO: 477055 - RNA, 22 nt, Human
agagccuggggauuggcaaggg

SEQ ID NO: 477056 - RNA, 22 nt, Human
aaucuguucuacucuauucaga

SEQ ID NO: 477057 - RNA, 22 nt, Human
acauuguagacuuuucauaugu

SEQ ID NO: 477058 - RNA, 22 nt, Human
uacauaaugagcuaguuaaguu

SEQ ID NO: 477059 - RNA, 22 nt, Human
augcacagcagugaguucagug

SEQ ID NO: 477060 - RNA, 22 nt, Human
uggcagagaacacacaugauuc

SEQ ID NO: 477061 - RNA, 22 nt, Human
augugaggcagcacggagauua

SEQ ID NO: 477062 - RNA, 22 nt, Human
cugggccagggaggugucugua

SEQ ID NO: 477063 - RNA, 23 nt, Human
accaugaugggagugcaaauaag

SEQ ID NO: 477064 - RNA, 22 nt, Human
accauuuaauaaguauuuccau

SEQ ID NO: 477065 - RNA, 22 nt, Human
gccuggaguacuccuugaagug

SEQ ID NO: 477066 - RNA, 22 nt, Human
ucugucacuuuuauuuacugaa

SEQ ID NO: 477067 - RNA, 22 nt, Human
ccccuuccgucucuugaguguc

SEQ ID NO: 477068 - RNA, 22 nt, Human
gccuggcacauugcaguggauu

SEQ ID NO: 477069 - RNA, 22 nt, Human
gcaggccugacuguagggggca

SEQ ID NO: 477070 - RNA, 22 nt, Human
uggcugaaucugcagcaggaag

SEQ ID NO: 477071 - RNA, 22 nt, Human
auguaaggcugccuaugacacu

SEQ ID NO: 477072 - RNA, 22 nt, Human
gugcugucaauugcuuucagua

SEQ ID NO: 477073 - RNA, 22 nt, Human
ggggaccugggcuucaaggguu

SEQ ID NO: 477074 - RNA, 21 nt, Human
ugccaggccugagcugggguc

SEQ ID NO: 477075 - RNA, 22 nt, Human
ugaggcaguauuuuagugacuu

SEQ ID NO: 477076 - RNA, 19 nt, Human
aaaguuuuauucucauuug

SEQ ID NO: 477077 - RNA, 22 nt, Human
cccugcagacgucuugaugccu

SEQ ID NO: 477078 - RNA, 19 nt, Human
ugaguucugugguucucaa

SEQ ID NO: 477079 - RNA, 20 nt, Human
cucugcuuuaggagagucag

SEQ ID NO: 477080 - RNA, 20 nt, Human
gaaaugugaccucuucugug

SEQ ID NO: 477081 - RNA, 22 nt, Human
aaaguuacuaucacaaugaaau

SEQ ID NO: 477082 - RNA, 22 nt, Human
uaagcuauuccugaagaagguu

SEQ ID NO: 477083 - RNA, 22 nt, Human
augaaacaaaccucuauggagu

SEQ ID NO: 477084 - RNA, 22 nt, Human
gggaccuggucuagcacugagc

SEQ ID NO: 477085 - RNA, 22 nt, Human
cagacuggccacaucugcacug

SEQ ID NO: 477086 - RNA, 22 nt, Human
gcugggcugagcuagacuuggc

SEQ ID NO: 477087 - RNA, 22 nt, Human
aaggucauuuaacaauuuauga

SEQ ID NO: 477088 - RNA, 21 nt, Human
uagggcaggcauuggaagaga

SEQ ID NO: 477089 - RNA, 22 nt, Human
uuauccaaacuggugaaucauu

SEQ ID NO: 477090 - RNA, 22 nt, Human
uauuuguauuucaugcaguaaa

SEQ ID NO: 477091 - RNA, 22 nt, Human
aauguacaaggguuccaguuuu

SEQ ID NO: 477092 - RNA, 22 nt, Human
ugaagccaaucugccaggcaga

SEQ ID NO: 477093 - RNA, 22 nt, Human
caggacagaaauaaggaauaua

SEQ ID NO: 477094 - RNA, 22 nt, Human
ccuguguguaggccaggggagu

SEQ ID NO: 477095 - RNA, 22 nt, Human
gagagcuguguucauucuacca

SEQ ID NO: 477096 - RNA, 22 nt, Human
uggagcccagggugagaaggag

SEQ ID NO: 477097 - RNA, 22 nt, Human
ucagaggagaccaaggggaaua

SEQ ID NO: 477098 - RNA, 22 nt, Human
gaggaaaagagacagguuauug

SEQ ID NO: 477099 - RNA, 22 nt, Human
uuauuuugguaaauguuugccu

SEQ ID NO: 477100 - RNA, 22 nt, Human
gugcauugcgaugcagacgacc

SEQ ID NO: 477101 - RNA, 22 nt, Human
agagucugaaugcucagaguug

SEQ ID NO: 477102 - RNA, 22 nt, Human
aggaguguggccagggcucugg

SEQ ID NO: 477103 - RNA, 22 nt, Human
auccaaaccuggacaugagugg

SEQ ID NO: 477104 - RNA, 22 nt, Human
cugcccaguuugggagccuuuc

SEQ ID NO: 477105 - RNA, 22 nt, Human
uuuguuaaauauuuauugagug

SEQ ID NO: 477106 - RNA, 22 nt, Human
auuauguagcuaaaaauugugu

SEQ ID NO: 477107 - RNA, 22 nt, Human
gagaccaggaaguacagcagcc

SEQ ID NO: 477108 - RNA, 22 nt, Human
ucaaagucauggcaggcucaga

SEQ ID NO: 477109 - RNA, 22 nt, Human
agagccugcuguguaagucaca

SEQ ID NO: 477110 - RNA, 22 nt, Human
agaaggccuaacuugggggcaa

SEQ ID NO: 477111 - RNA, 22 nt, Human
agcagggcacuggaaggcacug

SEQ ID NO: 477112 - RNA, 21 nt, Human
cugagggccgcagcugggcuc

SEQ ID NO: 477113 - RNA, 22 nt, Human
ggcuagaguggaacuggagcgg

SEQ ID NO: 477114 - RNA, 22 nt, Human
cagaagucacccucagaauaac

SEQ ID NO: 477115 - RNA, 22 nt, Human
ucauccuuuugcaugggaaggc

SEQ ID NO: 477116 - RNA, 22 nt, Human
acccagagccagggucaggagc

SEQ ID NO: 477117 - RNA, 22 nt, Human
ggugcagugguguggcaaaggg

SEQ ID NO: 477118 - RNA, 22 nt, Human
cagcagcugcgugcccaggccg

SEQ ID NO: 477119 - RNA, 22 nt, Human
ccucgaccuccccaggcucagg

SEQ ID NO: 477120 - RNA, 22 nt, Human
ugggcugcagggguugagagcu

SEQ ID NO: 477121 - RNA, 22 nt, Human
uuagcucagaaaauuuaaacuu

SEQ ID NO: 477122 - RNA, 22 nt, Human
ugccaggcccugugcuggaugc

SEQ ID NO: 477123 - RNA, 23 nt, Human
auucuucauuaucuucuagaaaa

SEQ ID NO: 477124 - RNA, 22 nt, Human
ugugucagaaggcaauggggau

SEQ ID NO: 477125 - RNA, 22 nt, Human
aggccucuucagggagcaugga

SEQ ID NO: 477126 - RNA, 22 nt, Human
cauuucuagggaucauaaagua

SEQ ID NO: 477127 - RNA, 22 nt, Human
cagaggguugucaggcgccuug

SEQ ID NO: 477128 - RNA, 22 nt, Human
gccugaggaaugcuccugacuu

SEQ ID NO: 477129 - RNA, 22 nt, Human
ucauucagguugggcaaguguc

SEQ ID NO: 477130 - RNA, 22 nt, Human
caggugggagcgaggagcuacu

SEQ ID NO: 477131 - RNA, 22 nt, Human
gagggccagcagccucagcaug

SEQ ID NO: 477132 - RNA, 22 nt, Human
agggacuugaugucagggagau

SEQ ID NO: 477133 - RNA, 22 nt, Human
gugucccaggagaggagacaau

SEQ ID NO: 477134 - RNA, 22 nt, Human
ucaucaguuuagaaaaaauaug

SEQ ID NO: 477135 - RNA, 22 nt, Human
uucucagugaaguuuagaacau

SEQ ID NO: 477136 - RNA, 22 nt, Human
agggccaguaccaggugggugg

SEQ ID NO: 477137 - RNA, 22 nt, Human
gagagcuggccagcuucaguau

SEQ ID NO: 477138 - RNA, 22 nt, Human
cugugaggcccugggugcugga

SEQ ID NO: 477139 - RNA, 22 nt, Human
uacauguuauuucacuauuggu

SEQ ID NO: 477140 - RNA, 22 nt, Human
uggaggagggcuggugucugua

SEQ ID NO: 477141 - RNA, 22 nt, Human
gcugccucccccauggcuggaa

SEQ ID NO: 477142 - RNA, 22 nt, Human
ccugggcuucugucuagauguu

SEQ ID NO: 477143 - RNA, 22 nt, Human
ucagggcacguuucugcaaugc

SEQ ID NO: 477144 - RNA, 22 nt, Human
agcagggcagguaaggaucaga

SEQ ID NO: 477145 - RNA, 22 nt, Human
caaggccacuccagagacuggu

SEQ ID NO: 477146 - RNA, 23 nt, Human
gucagggcuggggucagagugac

SEQ ID NO: 477147 - RNA, 22 nt, Human
uccaggacuagcauuucugaua

SEQ ID NO: 477148 - RNA, 22 nt, Human
gggaaccagccgcuuccgccuc

SEQ ID NO: 477149 - RNA, 22 nt, Human
cuggaagggucuacuuagcaga

SEQ ID NO: 477150 - RNA, 22 nt, Human
ugcucugggcaacagccucccu

SEQ ID NO: 477151 - RNA, 22 nt, Human
cgucuuccucuuacgaugcgcu

SEQ ID NO: 477152 - RNA, 22 nt, Human
acaggcuggugguccuggccau

SEQ ID NO: 477153 - RNA, 22 nt, Human
uuucacauuuuauacuuaagcc

SEQ ID NO: 477154 - RNA, 22 nt, Human
cagcagcccacgcgugcugucc

SEQ ID NO: 477155 - RNA, 22 nt, Human
auauacuuggagacuaucauug

SEQ ID NO: 477156 - RNA, 22 nt, Human
aggcugggaagguaaaguugua

SEQ ID NO: 477157 - RNA, 22 nt, Human
uccauuggucucugugcccagg

SEQ ID NO: 477158 - RNA, 22 nt, Human
gccuggaggguugagguuuugu

SEQ ID NO: 477159 - RNA, 22 nt, Human
aaaugcaccuugcugugagacu

SEQ ID NO: 477160 - RNA, 22 nt, Human
ugggacagagugagcuuuggcc

SEQ ID NO: 477161 - RNA, 22 nt, Human
ugcucugcaagcaggagcaaga

SEQ ID NO: 477162 - RNA, 22 nt, Human
aggaagcaaaaggcagggucua

SEQ ID NO: 477163 - RNA, 22 nt, Human
cuacccaggcuggagugcagua

SEQ ID NO: 477164 - RNA, 22 nt, Human
auucuguauggaaaagcacuau

SEQ ID NO: 477165 - RNA, 22 nt, Human
guggccuggaaaggcuggucug

SEQ ID NO: 477166 - RNA, 22 nt, Human
uuuuaaguuaauauaauugagg

SEQ ID NO: 477167 - RNA, 22 nt, Human
aagaugcagcuuccacuuuugc

SEQ ID NO: 477168 - RNA, 22 nt, Human
cugaggaggggccugagugaga

SEQ ID NO: 477169 - RNA, 22 nt, Human
agaagcugccuacaugaccagc

SEQ ID NO: 477170 - RNA, 22 nt, Human
aguucacauuccgagguacugg

SEQ ID NO: 477171 - RNA, 23 nt, Human
aggugccaacugagagcugagag

SEQ ID NO: 477172 - RNA, 22 nt, Human
gcucaaggcaggcagacaugag

SEQ ID NO: 477173 - RNA, 22 nt, Human
ugggcuccucgucacucgcugu

SEQ ID NO: 477174 - RNA, 22 nt, Human
ugcccagcacugugccagucac

SEQ ID NO: 477175 - RNA, 22 nt, Human
uggcucugugucucccagcagc

SEQ ID NO: 477176 - RNA, 22 nt, Human
cauuguuauagcauuacacacc

SEQ ID NO: 477177 - RNA, 22 nt, Human
acaaagugcacaagaugagaac

SEQ ID NO: 477178 - RNA, 22 nt, Human
gcuggaccaggugugcacaggc

SEQ ID NO: 477179 - RNA, 22 nt, Human
ccagaggcauguucaaagcaau

SEQ ID NO: 477180 - RNA, 22 nt, Human
cugucuuuucauacuuucccuc

SEQ ID NO: 477181 - RNA, 22 nt, Human
gcagaggagaugaagauacuuu

SEQ ID NO: 477182 - RNA, 22 nt, Human
aagaauguucuuguagucauga

SEQ ID NO: 477183 - RNA, 22 nt, Human
ccagcugggauuaagggaaaau

SEQ ID NO: 477184 - RNA, 22 nt, Human
uugcuuuguggugguucuucca

SEQ ID NO: 477185 - RNA, 22 nt, Human
cccaggcaggagugugguggcu

SEQ ID NO: 477186 - RNA, 22 nt, Human
agagccugucaauuguaaagag

SEQ ID NO: 477187 - RNA, 22 nt, Human
ggcccaaggcccaggucgagcu

SEQ ID NO: 477188 - RNA, 19 nt, Human
ucuggcuccgccucuuagu

SEQ ID NO: 477189 - RNA, 22 nt, Human
agggcucccgcgguguccggga

SEQ ID NO: 477190 - RNA, 22 nt, Human
gcaaaggcuagagacacaggga

SEQ ID NO: 477191 - RNA, 22 nt, Human
gcaggaguguauuugcauguaa

SEQ ID NO: 477192 - RNA, 22 nt, Human
cagggugccaaagaacaaauau

SEQ ID NO: 477193 - RNA, 22 nt, Human
uccacuuuagcaaugauugaau

SEQ ID NO: 477194 - RNA, 22 nt, Human
gauuucuguaacacuucagaua

SEQ ID NO: 477195 - RNA, 22 nt, Human
cccuccccacaaagcuucacac

SEQ ID NO: 477196 - RNA, 22 nt, Human
uucacauuggugauauguuucu

SEQ ID NO: 477197 - RNA, 22 nt, Human
ucugcagaauucgaggaagaaa

SEQ ID NO: 477198 - RNA, 22 nt, Human
aggugucugugaugggagcgau

SEQ ID NO: 477199 - RNA, 22 nt, Human
cucugucccagacccaccucuc

SEQ ID NO: 477200 - RNA, 22 nt, Human
ucaggagggugacaggcccugg

SEQ ID NO: 477201 - RNA, 22 nt, Human
gcugagaguccaggaaaacauc

SEQ ID NO: 477202 - RNA, 23 nt, Human
ucugucaccuauggcugcucuuc

SEQ ID NO: 477203 - RNA, 22 nt, Human
agagccagcauuugacacuggc

SEQ ID NO: 477204 - RNA, 22 nt, Human
auuaaauuggacgcugggggaa

SEQ ID NO: 477205 - RNA, 22 nt, Human
caggcagagucagauuagacuu

SEQ ID NO: 477206 - RNA, 22 nt, Human
ccugggagagccaucuguggcc

SEQ ID NO: 477207 - RNA, 19 nt, Human
gggaaauucacuugcuucc

SEQ ID NO: 477208 - RNA, 20 nt, Human
aagagaagaagucuuugaaa

SEQ ID NO: 477209 - RNA, 17 nt, Human
ggccuugggcugcucuu

SEQ ID NO: 477210 - RNA, 22 nt, Human
uuaguuuucccaucuuuauggu

SEQ ID NO: 477211 - RNA, 22 nt, Human
uggaggcaccacuggcugcccg

SEQ ID NO: 477212 - RNA, 22 nt, Human
gcuccacuugcagcuaggcuug

SEQ ID NO: 477213 - RNA, 22 nt, Human
cauauaaauacaacauguguua

SEQ ID NO: 477214 - RNA, 23 nt, Human
aggauguaggauguauggcagag

SEQ ID NO: 477215 - RNA, 22 nt, Human
ugccacacauugucagguuagu

SEQ ID NO: 477216 - RNA, 22 nt, Human
gcagauggcucagacacugggg

SEQ ID NO: 477217 - RNA, 22 nt, Human
ccaggacccugcaaacccuguu

SEQ ID NO: 477218 - RNA, 22 nt, Human
cuuguacaggaauccaugguau

SEQ ID NO: 477219 - RNA, 22 nt, Human
cugggcagugguggcccuuccc

SEQ ID NO: 477220 - RNA, 22 nt, Human
gugucaugcacacucaguguug

SEQ ID NO: 477221 - RNA, 22 nt, Human
acaggcaggcgggacagcccga

SEQ ID NO: 477222 - RNA, 21 nt, Human
uccauaagagaccaucuccua

SEQ ID NO: 477223 - RNA, 22 nt, Human
ucuuugcaacucccauuuccau

SEQ ID NO: 477224 - RNA, 18 nt, Human
agugucuggauauuuggg

SEQ ID NO: 477225 - RNA, 22 nt, Human
uagaaagcuugggguguuuaaa

SEQ ID NO: 477226 - RNA, 16 nt, Human
ugggcagaugagaaga

SEQ ID NO: 477227 - RNA, 22 nt, Human
gcaggagugacauggaugugga

SEQ ID NO: 477228 - RNA, 20 nt, Human
gcugccuguuucuguaagua

SEQ ID NO: 477229 - RNA, 22 nt, Human
agcugagcucaggcugauguaa

SEQ ID NO: 477230 - RNA, 22 nt, Human
cacaggagcuguggggcagugu

SEQ ID NO: 477231 - RNA, 22 nt, Human
caggguggcaggcaccauggcc

SEQ ID NO: 477232 - RNA, 22 nt, Human
uaaaugugagugaugcggugaa

SEQ ID NO: 477233 - RNA, 19 nt, Human
gggaccugacuaauuggca

SEQ ID NO: 477234 - RNA, 23 nt, Human
acuuaaaugguucuuuaucucag

SEQ ID NO: 477235 - RNA, 22 nt, Human
acuuugcaaugggcagaaccca

SEQ ID NO: 477236 - RNA, 22 nt, Human
uacauuccauguguguguauuc

SEQ ID NO: 477237 - RNA, 22 nt, Human
cagagcugguguuacaagucca

SEQ ID NO: 477238 - RNA, 22 nt, Human
aguauuucuaguugguucuacu

SEQ ID NO: 477239 - RNA, 22 nt, Human
uggcaggggaggugcuugcuua

SEQ ID NO: 477240 - RNA, 22 nt, Human
cagccugcccuggaagcccagc

SEQ ID NO: 477241 - RNA, 22 nt, Human
aucuuucaguuucauaccaauu

SEQ ID NO: 477242 - RNA, 22 nt, Human
cccaagggagugccuggucaac

SEQ ID NO: 477243 - RNA, 22 nt, Human
gcucugcuguguuuguucagca

SEQ ID NO: 477244 - RNA, 22 nt, Human
ggcuggcuugccaagcucaggg

SEQ ID NO: 477245 - RNA, 22 nt, Human
aggccuggccccaguugcuagg

SEQ ID NO: 477246 - RNA, 18 nt, Human
gcuuuauuucuuggggaa

SEQ ID NO: 477247 - RNA, 22 nt, Human
uccuggaggcaaaugagcacau

SEQ ID NO: 477248 - RNA, 22 nt, Human
aucagcugaaaaacaggcagca

SEQ ID NO: 477249 - RNA, 22 nt, Human
gcaggaugagugaguacauuua

SEQ ID NO: 477250 - RNA, 22 nt, Human
aaaggucaagcuggacucaggu

SEQ ID NO: 477251 - RNA, 21 nt, Human
acagucuccccagaucucucc

SEQ ID NO: 477252 - RNA, 22 nt, Human
ugacccugcuucuuggugcagg

SEQ ID NO: 477253 - RNA, 22 nt, Human
ugcagcuucuccaucuccuugu

SEQ ID NO: 477254 - RNA, 22 nt, Human
cagaagaggacuggguagcuca

SEQ ID NO: 477255 - RNA, 22 nt, Human
cucaggaugcaauuccaucaag

SEQ ID NO: 477256 - RNA, 22 nt, Human
ugaggcaggagaaucaccggaa

SEQ ID NO: 477257 - RNA, 22 nt, Human
ccugggcuggaguacagcagug

SEQ ID NO: 477258 - RNA, 22 nt, Human
gagcccuggcagucugggaugg

SEQ ID NO: 477259 - RNA, 22 nt, Human
gcagagcucaugccugcaccuc

SEQ ID NO: 477260 - RNA, 22 nt, Human
ugggacuugccucgagggcugc

SEQ ID NO: 477261 - RNA, 22 nt, Human
uaaaaaguagugagaauggcgc

SEQ ID NO: 477262 - RNA, 22 nt, Human
uauguacaguccuuaacuuaaa

SEQ ID NO: 477263 - RNA, 22 nt, Human
ccagcugcuugggaaaaugucu

SEQ ID NO: 477264 - RNA, 20 nt, Human
ugggccuguggcagaagucu

SEQ ID NO: 477265 - RNA, 22 nt, Human
aagggcucacccaacucacuuc

SEQ ID NO: 477266 - RNA, 22 nt, Human
gccuggagcucuccacuugggg

SEQ ID NO: 477267 - RNA, 22 nt, Human
uugagucaguaauuccauuucu

SEQ ID NO: 477268 - RNA, 22 nt, Human
cucccagagaccaagcugagaa

SEQ ID NO: 477269 - RNA, 21 nt, Human
gcucccuggcugugugaccug

SEQ ID NO: 477270 - RNA, 18 nt, Human
cugucaccgccaccacac

SEQ ID NO: 477271 - RNA, 22 nt, Human
aagggcucuucuauuuauggcc

SEQ ID NO: 477272 - RNA, 22 nt, Human
auaacagagagcuacugaacug

SEQ ID NO: 477273 - RNA, 22 nt, Human
gaugaggcucaugcacccugcg

SEQ ID NO: 477274 - RNA, 22 nt, Human
agcuggccuuagugagcaccug

SEQ ID NO: 477275 - RNA, 22 nt, Human
cagaaauucccauuucagauuc

SEQ ID NO: 477276 - RNA, 22 nt, Human
agccagcagggcuuagaggaca

SEQ ID NO: 477277 - RNA, 22 nt, Human
agagaaaagaguucaggcuuug

SEQ ID NO: 477278 - RNA, 22 nt, Human
ucuguacaccaggggccauucu

SEQ ID NO: 477279 - RNA, 22 nt, Human
caggcccauucuaggcuugcua

SEQ ID NO: 477280 - RNA, 22 nt, Human
gggaccuggcaccuuugcucug

SEQ ID NO: 477281 - RNA, 22 nt, Human
aggcugucaucuuugcaggcag

SEQ ID NO: 477282 - RNA, 22 nt, Human
uauauagaaaagcagauguugg

SEQ ID NO: 477283 - RNA, 22 nt, Human
uaaaguucagugcaugaaugug

SEQ ID NO: 477284 - RNA, 22 nt, Human
caauauucaguggaaaagccau

SEQ ID NO: 477285 - RNA, 22 nt, Human
agaaaucacaggaggcagaagg

SEQ ID NO: 477286 - RNA, 22 nt, Human
cuguggcugcagccuugguccu

SEQ ID NO: 477287 - RNA, 22 nt, Human
aaauuguugaucuacaguaagg

SEQ ID NO: 477288 - RNA, 22 nt, Human
gccaccagugggggccugggca

SEQ ID NO: 477289 - RNA, 20 nt, Human
gacaggagaguuagguaggu

SEQ ID NO: 477290 - RNA, 22 nt, Human
ggcauggcucggagucagaaca

SEQ ID NO: 477291 - RNA, 22 nt, Human
ccugucauacuaacguaguggg

SEQ ID NO: 477292 - RNA, 22 nt, Human
cugcuggccuagcccauccucu

SEQ ID NO: 477293 - RNA, 22 nt, Human
cagggcacaguuauggaggugg

SEQ ID NO: 477294 - RNA, 22 nt, Human
cugccuugaaaaugaagcuuua

SEQ ID NO: 477295 - RNA, 22 nt, Human
aucagcaagcauuuauugagug

SEQ ID NO: 477296 - RNA, 22 nt, Human
uucaggauucuuucagacuggg

SEQ ID NO: 477297 - RNA, 22 nt, Human
ugaggcaggaauggggaaaagu

SEQ ID NO: 477298 - RNA, 22 nt, Human
ggagccagggaagcugcuuccu

SEQ ID NO: 477299 - RNA, 22 nt, Human
ugaacccaggagguugcaguga

SEQ ID NO: 477300 - RNA, 22 nt, Human
guccucuggugaaagcauuccc

SEQ ID NO: 477301 - RNA, 22 nt, Human
ugccaggcugaacagggucuua

SEQ ID NO: 477302 - RNA, 18 nt, Human
agcuggggccucuggucc

SEQ ID NO: 477303 - RNA, 22 nt, Human
ccuguacaucugcucucauugc

SEQ ID NO: 477304 - RNA, 22 nt, Human
cccaggucugccagccuguggg

SEQ ID NO: 477305 - RNA, 22 nt, Human
auacaucuaugccuuucugaca

SEQ ID NO: 477306 - RNA, 22 nt, Human
acuggcugaaguuuacuuuuug

SEQ ID NO: 477307 - RNA, 22 nt, Human
agcugguggauuaugcuguaca

SEQ ID NO: 477308 - RNA, 22 nt, Human
cagggccaagcugcagcaucug

SEQ ID NO: 477309 - RNA, 22 nt, Human
gcugccuguugaagggucugug

SEQ ID NO: 477310 - RNA, 22 nt, Human
acaaauguggacauggauaaug

SEQ ID NO: 477311 - RNA, 22 nt, Human
ugcauuucagaagaaaauucgg

SEQ ID NO: 477312 - RNA, 22 nt, Human
agcuguggcaaccuugucagac

SEQ ID NO: 477313 - RNA, 22 nt, Human
agagccuguuuugugggagaug

SEQ ID NO: 477314 - RNA, 22 nt, Human
ccugccaggacauugcuugaag

SEQ ID NO: 477315 - RNA, 22 nt, Human
cugagcugggacucaguagcaa

SEQ ID NO: 477316 - RNA, 19 nt, Human
uggggccuccugucccugg

SEQ ID NO: 477317 - RNA, 22 nt, Human
ccugggcaacauagugagaccc

SEQ ID NO: 477318 - RNA, 22 nt, Human
ccagagcugcauccagcagguu

SEQ ID NO: 477319 - RNA, 17 nt, Human
aaguccagaguugagca

SEQ ID NO: 477320 - RNA, 22 nt, Human
uaaguaaauuuauaaugugauu

SEQ ID NO: 477321 - RNA, 22 nt, Human
cacaugcauaaggauaauuacu

SEQ ID NO: 477322 - RNA, 20 nt, Human
ggcugccuccuuccuuuccu

SEQ ID NO: 477323 - RNA, 23 nt, Human
auauuagggagauuagcccucua

SEQ ID NO: 477324 - RNA, 22 nt, Human
ggagauagacuuggugagccac

SEQ ID NO: 477325 - RNA, 20 nt, Human
cugggcagguguuugaucuc

SEQ ID NO: 477326 - RNA, 22 nt, Human
cuggccuggcagggagggcaug

SEQ ID NO: 477327 - RNA, 22 nt, Human
aggucauuguuaagucaccaua

SEQ ID NO: 477328 - RNA, 22 nt, Human
gcaggggcugagcaccagcggg

SEQ ID NO: 477329 - RNA, 22 nt, Human
uguggcccagaugagugugcua

SEQ ID NO: 477330 - RNA, 22 nt, Human
ucucagaguuuacggggcugaa

SEQ ID NO: 477331 - RNA, 22 nt, Human
caguagcauguaauaaagacag

SEQ ID NO: 477332 - RNA, 22 nt, Human
acacuuuacagcuuccuuugca

SEQ ID NO: 477333 - RNA, 22 nt, Human
agagggagcccagucauagcug

SEQ ID NO: 477334 - RNA, 22 nt, Human
cacaucagguagaccuacagag

SEQ ID NO: 477335 - RNA, 18 nt, Human
uggcaggaaaugcacuuu

SEQ ID NO: 477336 - RNA, 23 nt, Human
ucagaggaucaucaaacguuuuc

SEQ ID NO: 477337 - RNA, 22 nt, Human
gcccaggcuagcguagagugca

SEQ ID NO: 477338 - RNA, 22 nt, Human
agucacccuccaacucuccacu

SEQ ID NO: 477339 - RNA, 22 nt, Human
augggcagagcuggugggaggc

SEQ ID NO: 477340 - RNA, 22 nt, Human
cgccuggaaccucuaggaccag

SEQ ID NO: 477341 - RNA, 22 nt, Human
uccaagggcagccauagaacuu

SEQ ID NO: 477342 - RNA, 22 nt, Human
ggcccagcugugcuuccagccc

SEQ ID NO: 477343 - RNA, 22 nt, Human
ucucuggguuuuuguccuguac

SEQ ID NO: 477344 - RNA, 22 nt, Human
gaaauucacuguauuucuuggg

SEQ ID NO: 477345 - RNA, 23 nt, Human
aaagacugcugagaauuuuagga

SEQ ID NO: 477346 - RNA, 22 nt, Human
cagugagggaagaucucagcac

SEQ ID NO: 477347 - RNA, 22 nt, Human
uauaagaaacaaggcaaauuuu

SEQ ID NO: 477348 - RNA, 22 nt, Human
agcuggccuguuagagcugagu

SEQ ID NO: 477349 - RNA, 22 nt, Human
cacugggcguguccugggugag

SEQ ID NO: 477350 - RNA, 22 nt, Human
gagucacaaaagaugcccaggg

SEQ ID NO: 477351 - RNA, 22 nt, Human
gcagggacaacugugcaccuga

SEQ ID NO: 477352 - RNA, 23 nt, Human
ugagcaucacaggagaaccaggc

SEQ ID NO: 477353 - RNA, 22 nt, Human
caucaaauggcaagugaaagcu

SEQ ID NO: 477354 - RNA, 19 nt, Human
ccaggccugcgggcguugg

SEQ ID NO: 477355 - RNA, 19 nt, Human
uggaggagaggaaaaguca

SEQ ID NO: 477356 - RNA, 22 nt, Human
acaguccuguacaggccauauc

SEQ ID NO: 477357 - RNA, 22 nt, Human
ucccagccugacagugcaucaa

SEQ ID NO: 477358 - RNA, 21 nt, Human
agugaaauugcaucagaggga

SEQ ID NO: 477359 - RNA, 22 nt, Human
cugagcugggaguggauagugg

SEQ ID NO: 477360 - RNA, 21 nt, Human
gugcucugggcagcagagggc

SEQ ID NO: 477361 - RNA, 22 nt, Human
ggccugcuuuccgagccugcag

SEQ ID NO: 477362 - RNA, 22 nt, Human
aagaauguuaguuucugauaca

SEQ ID NO: 477363 - RNA, 22 nt, Human
uuucugcucgcucucaaucagg

SEQ ID NO: 477364 - RNA, 22 nt, Human
cuggcagguccagcuggacuca

SEQ ID NO: 477365 - RNA, 22 nt, Human
cauaccuuucucaagcacaugu

SEQ ID NO: 477366 - RNA, 22 nt, Human
uuuauauagagauuugugcaug

SEQ ID NO: 477367 - RNA, 23 nt, Human
ucucagaggauuccugggccuug

SEQ ID NO: 477368 - RNA, 22 nt, Human
acccugagggguauagcagaag

SEQ ID NO: 477369 - RNA, 22 nt, Human
uuccucaugggguuccuucaga

SEQ ID NO: 477370 - RNA, 22 nt, Human
gcagcuggucuggccuagagua

SEQ ID NO: 477371 - RNA, 22 nt, Human
uuccagaauuuuguucugcuug

SEQ ID NO: 477372 - RNA, 22 nt, Human
caaggaaaacagaugaucaaca

SEQ ID NO: 477373 - RNA, 22 nt, Human
acaggccugugugcacacgagg

SEQ ID NO: 477374 - RNA, 22 nt, Human
gcacagaacagagaaauagcca

SEQ ID NO: 477375 - RNA, 18 nt, Human
cagaaaucacaccagcac

SEQ ID NO: 477376 - RNA, 22 nt, Human
cccagcaguuguuggugcacau

SEQ ID NO: 477377 - RNA, 22 nt, Human
uggccuuggacagagcgcuccu

SEQ ID NO: 477378 - RNA, 22 nt, Human
cagaaguaagauuacugugaga

SEQ ID NO: 477379 - RNA, 22 nt, Human
caggcagccugcggucugcaca

SEQ ID NO: 477380 - RNA, 22 nt, Human
ucucagagauguuagggaagag

SEQ ID NO: 477381 - RNA, 22 nt, Human
uaggcuggaacuuaggcagagg

SEQ ID NO: 477382 - RNA, 22 nt, Human
agcagcauccccggccuccacc

SEQ ID NO: 477383 - RNA, 22 nt, Human
aauaaauguuaagauugucuca

SEQ ID NO: 477384 - RNA, 19 nt, Human
ggcauccagaacuaccagu

SEQ ID NO: 477385 - RNA, 22 nt, Human
ccugcucugguuuagucagucu

SEQ ID NO: 477386 - RNA, 22 nt, Human
guggagccaggggcuguaggua

SEQ ID NO: 477387 - RNA, 22 nt, Human
auuaagacugcccauguuuuua

SEQ ID NO: 477388 - RNA, 22 nt, Human
ccccaccagcacccucucuauc

SEQ ID NO: 477389 - RNA, 22 nt, Human
aggagggcaggcuggcugccua

SEQ ID NO: 477390 - RNA, 22 nt, Human
uguguccauucaggcacugacc

SEQ ID NO: 477391 - RNA, 19 nt, Human
uggcagggagaguuugaag

SEQ ID NO: 477392 - RNA, 22 nt, Human
acagccuggacuggcucucugc

SEQ ID NO: 477393 - RNA, 22 nt, Human
aggugaguuacaggaggagguc

SEQ ID NO: 477394 - RNA, 22 nt, Human
aguuuauguaaaauuaguaaug

SEQ ID NO: 477395 - RNA, 22 nt, Human
ugcugucaguuggcaggaugag

SEQ ID NO: 477396 - RNA, 19 nt, Human
cugcugggugcugagggag

SEQ ID NO: 477397 - RNA, 22 nt, Human
ugcugcucuguaaagugaugag

SEQ ID NO: 477398 - RNA, 22 nt, Human
cuagcaucagaugagaagcugu

SEQ ID NO: 477399 - RNA, 22 nt, Human
ugccagugggugugcagagacu

SEQ ID NO: 477400 - RNA, 22 nt, Human
acacagggggcauucuaggagu

SEQ ID NO: 477401 - RNA, 21 nt, Human
ucuugaaaauuguagcaguuu

SEQ ID NO: 477402 - RNA, 22 nt, Human
gcagccagguuugaggaccacu

SEQ ID NO: 477403 - RNA, 22 nt, Human
uguggucucguuauguugccca

SEQ ID NO: 477404 - RNA, 22 nt, Human
ucaugacaucuguuuaucucaa

SEQ ID NO: 477405 - RNA, 22 nt, Human
uguccaggucagcagcagggac

SEQ ID NO: 477406 - RNA, 22 nt, Human
ucagcagcagcucagcauguuu

SEQ ID NO: 477407 - RNA, 22 nt, Human
gcagggcaggauuugaacccag

SEQ ID NO: 477408 - RNA, 22 nt, Human
gaggcucaguuauuuuagccug

SEQ ID NO: 477409 - RNA, 22 nt, Human
gcucucagguacaaagcugugu

SEQ ID NO: 477410 - RNA, 22 nt, Human
gccuucaggaggguuccagaca

SEQ ID NO: 477411 - RNA, 22 nt, Human
aaagccagugguaugagagaaa

SEQ ID NO: 477412 - RNA, 22 nt, Human
gagggcuguggggcaugaccag

SEQ ID NO: 477413 - RNA, 22 nt, Human
cuguccuugcuggccagguaug

SEQ ID NO: 477414 - RNA, 19 nt, Human
acaaagcugugagcagcuu

SEQ ID NO: 477415 - RNA, 22 nt, Human
gugcucuggcuggucucccggu

SEQ ID NO: 477416 - RNA, 22 nt, Human
ucuggccacccgaggccccugc

SEQ ID NO: 477417 - RNA, 22 nt, Human
gauugaaacauaggcagucgag

SEQ ID NO: 477418 - RNA, 22 nt, Human
uccagcagaccaucaaggcuca

SEQ ID NO: 477419 - RNA, 22 nt, Human
ggcuggcucagggcuugagaga

SEQ ID NO: 477420 - RNA, 22 nt, Human
ccucccaccauuuagagagagc

SEQ ID NO: 477421 - RNA, 22 nt, Human
ccucaggauacaggagccacag

SEQ ID NO: 477422 - RNA, 22 nt, Human
aauguguagauguugcauuccu

SEQ ID NO: 477423 - RNA, 22 nt, Human
uggcugaaggaagauucuucua

SEQ ID NO: 477424 - RNA, 22 nt, Human
uacaguauuaugagugauugaa

SEQ ID NO: 477425 - RNA, 19 nt, Human
gaaggagagcugaguuagg

SEQ ID NO: 477426 - RNA, 22 nt, Human
cagcugugaauugucuuaucua

SEQ ID NO: 477427 - RNA, 22 nt, Human
uauuaguagcuugaaauuggug

SEQ ID NO: 477428 - RNA, 22 nt, Human
gcacugaaugcuuuuacuguaa

SEQ ID NO: 477429 - RNA, 15 nt, Human
cagucccagggaccc

SEQ ID NO: 477430 - RNA, 22 nt, Human
cuguccagcuuggcuccugggg

SEQ ID NO: 477431 - RNA, 22 nt, Human
auuucucacucacaguccaugu

SEQ ID NO: 477432 - RNA, 22 nt, Human
caugucuugcccugauuaguag

SEQ ID NO: 477433 - RNA, 20 nt, Human
uaagaacaagacuaggaagc

SEQ ID NO: 477434 - RNA, 22 nt, Human
ugggcagaggacagggaagauc

SEQ ID NO: 477435 - RNA, 22 nt, Human
agaaacagcauuagcaucaauu

SEQ ID NO: 477436 - RNA, 22 nt, Human
aaguuacuggcaagggcugcag

SEQ ID NO: 477437 - RNA, 22 nt, Human
acuucuggugucauacugcauu

SEQ ID NO: 477438 - RNA, 22 nt, Human
uuauguaauuuguuugcucuuc

SEQ ID NO: 477439 - RNA, 22 nt, Human
ugaagcagagaauuugacaguc

SEQ ID NO: 477440 - RNA, 23 nt, Human
aaaguguagccagguuaagaacc

SEQ ID NO: 477441 - RNA, 22 nt, Human
ucauuucucugagucugauaau

SEQ ID NO: 477442 - RNA, 22 nt, Human
gaagccaggggccugacaggca

SEQ ID NO: 477443 - RNA, 22 nt, Human
ugccuuggugcuucuucaugug

SEQ ID NO: 477444 - RNA, 22 nt, Human
uuuaaauuauaguuaaugucug

SEQ ID NO: 477445 - RNA, 22 nt, Human
caggcagccugagggaucuggg

SEQ ID NO: 477446 - RNA, 22 nt, Human
ugaaagguagcuggccucauag

SEQ ID NO: 477447 - RNA, 22 nt, Human
uggcucuggauuaaucuaggaa

SEQ ID NO: 477448 - RNA, 22 nt, Human
cgaugguucuggcugcuuguau

SEQ ID NO: 477449 - RNA, 22 nt, Human
ccacaggaccagaggagaucac

SEQ ID NO: 477450 - RNA, 22 nt, Human
guccaggucuggacccugagcc

SEQ ID NO: 477451 - RNA, 22 nt, Human
ugcuauaagaauuauauuacuc

SEQ ID NO: 477452 - RNA, 23 nt, Human
cuuuuaacuugaucugagaccag

SEQ ID NO: 477453 - RNA, 19 nt, Human
uguggccaugguucagcug

SEQ ID NO: 477454 - RNA, 22 nt, Human
ccugccagcccgcguucaugcc

SEQ ID NO: 477455 - RNA, 22 nt, Human
gaagaacaagcagugcuuuccu

SEQ ID NO: 477456 - RNA, 22 nt, Human
gcugccuuugugagccaagggg

SEQ ID NO: 477457 - RNA, 22 nt, Human
uuauguacucugcaauguuuga

SEQ ID NO: 477458 - RNA, 22 nt, Human
acaguaccugcucucaagcaaa

SEQ ID NO: 477459 - RNA, 21 nt, Human
uggccaaaaccauauuauuaa

SEQ ID NO: 477460 - RNA, 22 nt, Human
agcauuuauuucuuagaaauug

SEQ ID NO: 477461 - RNA, 22 nt, Human
uggcucagaaggcugccuucac

SEQ ID NO: 477462 - RNA, 22 nt, Human
caagagcuagacuuugucagga

SEQ ID NO: 477463 - RNA, 22 nt, Human
cagagcauaauugacaugaggu

SEQ ID NO: 477464 - RNA, 22 nt, Human
cucaggauuuaaaggggcacuc

SEQ ID NO: 477465 - RNA, 22 nt, Human
ucagaggacagcagcuaaauaa

SEQ ID NO: 477466 - RNA, 22 nt, Human
cugggaggcccacguugggaag

SEQ ID NO: 477467 - RNA, 22 nt, Human
acacauuuacauguuuacguau

SEQ ID NO: 477468 - RNA, 22 nt, Human
cuggcucuaucuccaaggcugg

SEQ ID NO: 477469 - RNA, 22 nt, Human
aaauacagaguugcuuaaaagc

SEQ ID NO: 477470 - RNA, 22 nt, Human
ccagcaccuugaucuuggaguu

SEQ ID NO: 477471 - RNA, 22 nt, Human
ggcugcuuuaucggcugcugaa

SEQ ID NO: 477472 - RNA, 19 nt, Human
ccagaggacuguuaaugaa

SEQ ID NO: 477473 - RNA, 22 nt, Human
uuuagggaagaagcccauggcc

SEQ ID NO: 477474 - RNA, 22 nt, Human
cuggagagggagcccuggcagu

SEQ ID NO: 477475 - RNA, 21 nt, Human
ucucugugucuuuaagcugga

SEQ ID NO: 477476 - RNA, 22 nt, Human
cagagccagaacuagaccuugu

SEQ ID NO: 477477 - RNA, 20 nt, Human
ccuuuauuauuuguaugaug

SEQ ID NO: 477478 - RNA, 22 nt, Human
aaagcccauguggaaguacagg

SEQ ID NO: 477479 - RNA, 22 nt, Human
ccagcagcagcguccaaggaga

SEQ ID NO: 477480 - RNA, 22 nt, Human
guggcuucuggcugggccucag

SEQ ID NO: 477481 - RNA, 21 nt, Human
agaaaauggcguuuuagauuu

SEQ ID NO: 477482 - RNA, 22 nt, Human
ucaggagauguaaccuuagcug

SEQ ID NO: 477483 - RNA, 22 nt, Human
guacauuggcaacucucuuaga

SEQ ID NO: 477484 - RNA, 22 nt, Human
uagauuucgcugcaucucaauc

SEQ ID NO: 477485 - RNA, 22 nt, Human
gacuuucucuccucccaggugu

SEQ ID NO: 477486 - RNA, 22 nt, Human
acagaguauuggaaaggcagug

SEQ ID NO: 477487 - RNA, 20 nt, Human
aguagcagugugacauugac

SEQ ID NO: 477488 - RNA, 22 nt, Human
gccuggagcucaugugggcauu

SEQ ID NO: 477489 - RNA, 22 nt, Human
cccuucagcugagugggacagc

SEQ ID NO: 477490 - RNA, 22 nt, Human
uauguacaugauuucauuugcu

SEQ ID NO: 477491 - RNA, 22 nt, Human
aagcagccuggacuugggcugg

SEQ ID NO: 477492 - RNA, 22 nt, Human
ugugaaggagcaugcagagggg

SEQ ID NO: 477493 - RNA, 22 nt, Human
gagccagcgccuugccucuggg

SEQ ID NO: 477494 - RNA, 22 nt, Human
gcagagcuucuguccuucagga

SEQ ID NO: 477495 - RNA, 22 nt, Human
gcagggugugucucauacaguu

SEQ ID NO: 477496 - RNA, 22 nt, Human
aguuucuaacauauagcauugg

SEQ ID NO: 477497 - RNA, 22 nt, Human
gcuggcccagggucaccuagga

SEQ ID NO: 477498 - RNA, 22 nt, Human
uacauguuuacuccaagucagg

SEQ ID NO: 477499 - RNA, 22 nt, Human
ugcaggagcugugcggugaggg

SEQ ID NO: 477500 - RNA, 23 nt, Human
gccuggagaaaagcugcaguuca

SEQ ID NO: 477501 - RNA, 22 nt, Human
gcaggccagcugugcagauggg

SEQ ID NO: 477502 - RNA, 22 nt, Human
ucccagaguuuccuguguccca

SEQ ID NO: 477503 - RNA, 22 nt, Human
aagcccagaugggagcauuuca

SEQ ID NO: 477504 - RNA, 22 nt, Human
agcagggcagugaucagaaagg

SEQ ID NO: 477505 - RNA, 22 nt, Human
uucaagauaauaggaaugaaaa

SEQ ID NO: 477506 - RNA, 22 nt, Human
cagcuuuagagaaaacauauuu

SEQ ID NO: 477507 - RNA, 22 nt, Human
aacuguucuucauuuucaguau

SEQ ID NO: 477508 - RNA, 22 nt, Human
agcugcaggcccaugcucaguc

SEQ ID NO: 477509 - RNA, 22 nt, Human
uagccggguguugugucaugca

SEQ ID NO: 477510 - RNA, 22 nt, Human
gagauguacaauguguauuaau

SEQ ID NO: 477511 - RNA, 22 nt, Human
caaagguaguauauauauuguu

SEQ ID NO: 477512 - RNA, 22 nt, Human
gagcucagcccaaagagcagug

SEQ ID NO: 477513 - RNA, 22 nt, Human
guaucuuuugguggaaaaauaa

SEQ ID NO: 477514 - RNA, 22 nt, Human
gguuucaacucagcuaguaagg

SEQ ID NO: 477515 - RNA, 21 nt, Human
uaagccaccaugugaaaccag

SEQ ID NO: 477516 - RNA, 22 nt, Human
gaaggccauugcguccugggau

SEQ ID NO: 477517 - RNA, 22 nt, Human
cugugcuugacagugggaagca

SEQ ID NO: 477518 - RNA, 22 nt, Human
agggacagaugaaugacugagu

SEQ ID NO: 477519 - RNA, 22 nt, Human
ggcaugggccgaggugccuccu

SEQ ID NO: 477520 - RNA, 22 nt, Human
auuuauuauugugguuacuucu

SEQ ID NO: 477521 - RNA, 22 nt, Human
aucagcaaguccuguuaauucu

SEQ ID NO: 477522 - RNA, 22 nt, Human
gggcaguguggucgugccuuug

SEQ ID NO: 477523 - RNA, 22 nt, Human
guuucgucaggcuuauucuauc

SEQ ID NO: 477524 - RNA, 22 nt, Human
gcagggagguuugcugaccugg

SEQ ID NO: 477525 - RNA, 22 nt, Human
caguggugaagagcaggggcuc

SEQ ID NO: 477526 - RNA, 22 nt, Human
ggcuagaauaauugacuucauu

SEQ ID NO: 477527 - RNA, 22 nt, Human
ugaugaaauguugaggcaguga

SEQ ID NO: 477528 - RNA, 22 nt, Human
uccagcucaggguuggcucaag

SEQ ID NO: 477529 - RNA, 22 nt, Human
cugaggaugguguggucuucuc

SEQ ID NO: 477530 - RNA, 22 nt, Human
aggcucagucccggcccgcgcc

SEQ ID NO: 477531 - RNA, 22 nt, Human
ugggaaauguguuucuggacca

SEQ ID NO: 477532 - RNA, 22 nt, Human
ucugccuggaugauggcagggc

SEQ ID NO: 477533 - RNA, 22 nt, Human
aaggcaguuaauuuggcuagaa

SEQ ID NO: 477534 - RNA, 22 nt, Human
ccaggccugugcaaggagggag

SEQ ID NO: 477535 - RNA, 22 nt, Human
ugcacacacaugaaguagcaug

SEQ ID NO: 477536 - RNA, 22 nt, Human
gggauuugugggauggccagug

SEQ ID NO: 477537 - RNA, 22 nt, Human
aucauguuccagaaacagugau

SEQ ID NO: 477538 - RNA, 22 nt, Human
ggggauggaggcgugugguccu

SEQ ID NO: 477539 - RNA, 22 nt, Human
agcugcugugugcucaggcagg

SEQ ID NO: 477540 - RNA, 22 nt, Human
gaggggaaagugugaggcugcg

SEQ ID NO: 477541 - RNA, 22 nt, Human
aagccuuccugagugcaaggcc

SEQ ID NO: 477542 - RNA, 22 nt, Human
gagggcagagacagugauucac

SEQ ID NO: 477543 - RNA, 22 nt, Human
aagggcuggagacugggucuuc

SEQ ID NO: 477544 - RNA, 22 nt, Human
ccagcuggagccaagguggacu

SEQ ID NO: 477545 - RNA, 22 nt, Human
gcaggcuggucugaccaucccu

SEQ ID NO: 477546 - RNA, 22 nt, Human
auucuacaacccaauaauaauu

SEQ ID NO: 477547 - RNA, 22 nt, Human
uguguuccugccuggcucuggu

SEQ ID NO: 477548 - RNA, 22 nt, Human
cacugaagguaggaccaaggcu

SEQ ID NO: 477549 - RNA, 22 nt, Human
uaguccagccuuggguguagcc

SEQ ID NO: 477550 - RNA, 22 nt, Human
acauuucugcauguaggguaau

SEQ ID NO: 477551 - RNA, 22 nt, Human
auuuggcaacauuaauugaauc

SEQ ID NO: 477552 - RNA, 22 nt, Human
uucuuuccacagaggggaugau

SEQ ID NO: 477553 - RNA, 22 nt, Human
ugugcuucuugcagcuccugua

SEQ ID NO: 477554 - RNA, 22 nt, Human
guguguccaggcgggagucaag

SEQ ID NO: 477555 - RNA, 22 nt, Human
uaauguguugaauauuuguaca

SEQ ID NO: 477556 - RNA, 18 nt, Human
uguuuauuuuucucuuac

SEQ ID NO: 477557 - RNA, 22 nt, Human
uuaucguacgcuucagaaauuu

SEQ ID NO: 477558 - RNA, 22 nt, Human
gugcucuguguauuaggauguc

SEQ ID NO: 477559 - RNA, 19 nt, Human
ggaccagguccugggcagc

SEQ ID NO: 477560 - RNA, 23 nt, Human
auugaugacuugauuacacuuuu

SEQ ID NO: 477561 - RNA, 22 nt, Human
cacugugucaguuugguuagac

SEQ ID NO: 477562 - RNA, 22 nt, Human
ugccugucuucaggagugucac

SEQ ID NO: 477563 - RNA, 22 nt, Human
aacccuggggcagcugcuaggg

SEQ ID NO: 477564 - RNA, 22 nt, Human
gcagggcucauucuaguacaau

SEQ ID NO: 477565 - RNA, 22 nt, Human
ucagcagaggggaaggcaucug

SEQ ID NO: 477566 - RNA, 19 nt, Human
gcucugugaugcugagggg

SEQ ID NO: 477567 - RNA, 22 nt, Human
agugcugaagacuggcuaggga

SEQ ID NO: 477568 - RNA, 22 nt, Human
agccacagggggugagggacaa

SEQ ID NO: 477569 - RNA, 22 nt, Human
ccaggguaccccaagggcaggu

SEQ ID NO: 477570 - RNA, 22 nt, Human
gugcagugagcagugcagcacc

SEQ ID NO: 477571 - RNA, 22 nt, Human
accagagauggggcuucucugu

SEQ ID NO: 477572 - RNA, 22 nt, Human
cagcuuuuuagaaucuagggca

SEQ ID NO: 477573 - RNA, 22 nt, Human
agcuguucccucacugcaguca

SEQ ID NO: 477574 - RNA, 22 nt, Human
ugagcuguagcagaugcuguug

SEQ ID NO: 477575 - RNA, 18 nt, Human
gccugggaggaggaaaug

SEQ ID NO: 477576 - RNA, 22 nt, Human
uugguuuagagagugugguuac

SEQ ID NO: 477577 - RNA, 22 nt, Human
aggccugaaguguggagugggg

SEQ ID NO: 477578 - RNA, 22 nt, Human
gggcagcagaggaucccuuaau

SEQ ID NO: 477579 - RNA, 22 nt, Human
ggaccagagcucgggcuucuca

SEQ ID NO: 477580 - RNA, 22 nt, Human
aagugaguggccuggagaggug

SEQ ID NO: 477581 - RNA, 22 nt, Human
cugcugggucuaugcaagugga

SEQ ID NO: 477582 - RNA, 22 nt, Human
cuggccagggugcgaucguggu

SEQ ID NO: 477583 - RNA, 22 nt, Human
gcacccagggacuuggcuggcc

SEQ ID NO: 477584 - RNA, 22 nt, Human
cagucccaccaggaucgcucuu

SEQ ID NO: 477585 - RNA, 22 nt, Human
augaggcaugugaggagaaggg

SEQ ID NO: 477586 - RNA, 22 nt, Human
cuggggugucucgucugccauu

SEQ ID NO: 477587 - RNA, 22 nt, Human
uccucaggugacuagguaucuu

SEQ ID NO: 477588 - RNA, 22 nt, Human
agcccagguugaggcugcagug

SEQ ID NO: 477589 - RNA, 22 nt, Human
uccagccaagggagguuacuag

SEQ ID NO: 477590 - RNA, 22 nt, Human
agggaucaaaaaauguacaugc

SEQ ID NO: 477591 - RNA, 22 nt, Human
uccuuuuuauaguuagagaaac

SEQ ID NO: 477592 - RNA, 22 nt, Human
cagaaacuauguaagaaaguga

SEQ ID NO: 477593 - RNA, 23 nt, Human
ucacagggcacuggcugggguug

SEQ ID NO: 477594 - RNA, 22 nt, Human
augacacaauuuuagagcugaa

SEQ ID NO: 477595 - RNA, 22 nt, Human
guuuauuauucaacuucauguu

SEQ ID NO: 477596 - RNA, 22 nt, Human
aggcagcuggcagcacccaggg

SEQ ID NO: 477597 - RNA, 22 nt, Human
uggugaagucagcggagcccgg

SEQ ID NO: 477598 - RNA, 22 nt, Human
cagcaauaguguguuuguuuca

SEQ ID NO: 477599 - RNA, 22 nt, Human
uggggugccgacagggagggca

SEQ ID NO: 477600 - RNA, 22 nt, Human
ggccuugggaggagggucagaa

SEQ ID NO: 477601 - RNA, 22 nt, Human
augugcaugcacuuacaugugu

SEQ ID NO: 477602 - RNA, 22 nt, Human
augaguaagaccauaauuuuug

SEQ ID NO: 477603 - RNA, 22 nt, Human
ugccaggcuguccugggccugg

SEQ ID NO: 477604 - RNA, 22 nt, Human
gcagcugcaggcaggcuugcug

SEQ ID NO: 477605 - RNA, 22 nt, Human
ccaggcauccauugcuuccucu

SEQ ID NO: 477606 - RNA, 22 nt, Human
aaaaauagcuucucuugucccu

SEQ ID NO: 477607 - RNA, 22 nt, Human
agcuggguguguaucagauaaa

SEQ ID NO: 477608 - RNA, 22 nt, Human
ggggcccagcaccccuccucgc

SEQ ID NO: 477609 - RNA, 22 nt, Human
ugggaccugcccuggccccauc

SEQ ID NO: 477610 - RNA, 22 nt, Human
agcagcauauugugucuucaua

SEQ ID NO: 477611 - RNA, 22 nt, Human
ccugcucagccccagcucaccc

SEQ ID NO: 477612 - RNA, 22 nt, Human
gcagggcuguggacacuuuggu

SEQ ID NO: 477613 - RNA, 22 nt, Human
cccccaggcucugacacaggag

SEQ ID NO: 477614 - RNA, 22 nt, Human
guggcugcagagggcacagcau

SEQ ID NO: 477615 - RNA, 18 nt, Human
caaagcucacguuccauc

SEQ ID NO: 477616 - RNA, 22 nt, Human
aggugcuagguguguaguggag

SEQ ID NO: 477617 - RNA, 22 nt, Human
ugggccuggagcccuggagagu

SEQ ID NO: 477618 - RNA, 22 nt, Human
caugggcuacagaagcaugcug

SEQ ID NO: 477619 - RNA, 22 nt, Human
caggaaagagcugccaggcagg

SEQ ID NO: 477620 - RNA, 22 nt, Human
ccuggcaguuuugcccaggauu

SEQ ID NO: 477621 - RNA, 18 nt, Human
gagguccugcucuagccc

SEQ ID NO: 477622 - RNA, 22 nt, Human
caccugcagggggagucaagag

SEQ ID NO: 477623 - RNA, 19 nt, Human
acagaagcauagaaaagga

SEQ ID NO: 477624 - RNA, 22 nt, Human
gugccuggcaugcgccggugcu

SEQ ID NO: 477625 - RNA, 22 nt, Human
cacucuccagcacaccccauuu

SEQ ID NO: 477626 - RNA, 22 nt, Human
uaaaggcuucugcagggacuga

SEQ ID NO: 477627 - RNA, 22 nt, Human
ccucucucuccugcacacacac

SEQ ID NO: 477628 - RNA, 22 nt, Human
ucagaccauccugcuguuagug

SEQ ID NO: 477629 - RNA, 22 nt, Human
cucuuaguuuaucuuugacaaa

SEQ ID NO: 477630 - RNA, 22 nt, Human
uugggguguuggauggagcaag

SEQ ID NO: 477631 - RNA, 22 nt, Human
ugcagggaacuuggacagcuag

SEQ ID NO: 477632 - RNA, 22 nt, Human
uuuguacauccuaauucugagu

SEQ ID NO: 477633 - RNA, 21 nt, Human
aggcagcucaggcccagagag

SEQ ID NO: 477634 - RNA, 22 nt, Human
ugacagcauaacacuggucuug

SEQ ID NO: 477635 - RNA, 22 nt, Human
uaaggucauggugaauaauaag

SEQ ID NO: 477636 - RNA, 22 nt, Human
gagaaacuuggaguuauucugg

SEQ ID NO: 477637 - RNA, 22 nt, Human
ggccugggcccacugucaagag

SEQ ID NO: 477638 - RNA, 22 nt, Human
agcuuuauucaugauuucaggg

SEQ ID NO: 477639 - RNA, 22 nt, Human
gugucauguagaaauugaugaa

SEQ ID NO: 477640 - RNA, 22 nt, Human
gcccagcaggggauggcagcuc

SEQ ID NO: 477641 - RNA, 22 nt, Human
cacuuggaggaaggccuauuca

SEQ ID NO: 477642 - RNA, 22 nt, Human
uauuugcaacauaaaacucuga

SEQ ID NO: 477643 - RNA, 21 nt, Human
auucagaaagggaauaaacuc

SEQ ID NO: 477644 - RNA, 22 nt, Human
gcauggcauuugaagguagaag

SEQ ID NO: 477645 - RNA, 22 nt, Human
cccugggcaagcccuauuuucc

SEQ ID NO: 477646 - RNA, 23 nt, Human
acugagccagggccugggucagc

SEQ ID NO: 477647 - RNA, 22 nt, Human
cacagcuugggcucugacaaua

SEQ ID NO: 477648 - RNA, 22 nt, Human
cuccacagccccuccaguggca

SEQ ID NO: 477649 - RNA, 22 nt, Human
cagugcuccugauguacccuug

SEQ ID NO: 477650 - RNA, 22 nt, Human
caggcagcguccugcuuccugu

SEQ ID NO: 477651 - RNA, 22 nt, Human
cugcugcucagugucaucaugu

SEQ ID NO: 477652 - RNA, 22 nt, Human
agggcacaagacucugagcccc

SEQ ID NO: 477653 - RNA, 22 nt, Human
gcagggccagugcagagaggaa

SEQ ID NO: 477654 - RNA, 22 nt, Human
cggcuggugucgggcacagcaa

SEQ ID NO: 477655 - RNA, 22 nt, Human
aacauguagcagaaacgacuaa

SEQ ID NO: 477656 - RNA, 22 nt, Human
ucucuuauuuugccuuugacaa

SEQ ID NO: 477657 - RNA, 22 nt, Human
aagcagccacuggccaguuaua

SEQ ID NO: 477658 - RNA, 22 nt, Human
ucugagaggauuccugucccga

SEQ ID NO: 477659 - RNA, 22 nt, Human
gacagacauuuccugauccaau

SEQ ID NO: 477660 - RNA, 22 nt, Human
gacccagccugguuuuuauagg

SEQ ID NO: 477661 - RNA, 22 nt, Human
aggucaaaccacagcucuaggc

SEQ ID NO: 477662 - RNA, 22 nt, Human
cuggaggcugaguugggucucc

SEQ ID NO: 477663 - RNA, 22 nt, Human
ucacaagauacaguuagaagca

SEQ ID NO: 477664 - RNA, 22 nt, Human
ggcucugcccagaugaagagga

SEQ ID NO: 477665 - RNA, 22 nt, Human
gugagcaggauuucauggugua

SEQ ID NO: 477666 - RNA, 22 nt, Human
guuuauuagaguuuucugucug

SEQ ID NO: 477667 - RNA, 22 nt, Human
gggagccuugggagugccagcc

SEQ ID NO: 477668 - RNA, 22 nt, Human
aaacuuuaagacaguccucaag

SEQ ID NO: 477669 - RNA, 21 nt, Human
cagacccucuagaggccaccu

SEQ ID NO: 477670 - RNA, 21 nt, Human
cacucaggguaugugccaggc

SEQ ID NO: 477671 - RNA, 22 nt, Human
cugagguggaacagaggugaag

SEQ ID NO: 477672 - RNA, 22 nt, Human
gguggccuccagggcauaggug

SEQ ID NO: 477673 - RNA, 22 nt, Human
agaaaucugacugcugugcaca

SEQ ID NO: 477674 - RNA, 22 nt, Human
ccagcaggggaauauuuuuagg

SEQ ID NO: 477675 - RNA, 22 nt, Human
cagcuugcaguacuuguuuuug

SEQ ID NO: 477676 - RNA, 22 nt, Human
aggcucugaucagguggcugug

SEQ ID NO: 477677 - RNA, 22 nt, Human
cacagggcaccaguuggccauc

SEQ ID NO: 477678 - RNA, 22 nt, Human
aagucauugguagcuugauagg

SEQ ID NO: 477679 - RNA, 22 nt, Human
ucaaaguaaaaguauagaguuu

SEQ ID NO: 477680 - RNA, 22 nt, Human
uccaggcauguugggaagauga

SEQ ID NO: 477681 - RNA, 22 nt, Human
cccuggagguggagguugcagg

SEQ ID NO: 477682 - RNA, 22 nt, Human
gugggcuggacccuccugcucc

SEQ ID NO: 477683 - RNA, 22 nt, Human
auggcagccugagcagaggaau

SEQ ID NO: 477684 - RNA, 22 nt, Human
gcagcuuucugggacagaaagg

SEQ ID NO: 477685 - RNA, 22 nt, Human
aggacugggugcagagggcauc

SEQ ID NO: 477686 - RNA, 19 nt, Human
uagagcugcuuccuggcag

SEQ ID NO: 477687 - RNA, 22 nt, Human
ccagcuuuccugcgaguugauu

SEQ ID NO: 477688 - RNA, 22 nt, Human
cagcugcccauccugggaaaug

SEQ ID NO: 477689 - RNA, 22 nt, Human
ccuggcagcuccuccccggcgg

SEQ ID NO: 477690 - RNA, 22 nt, Human
gcuguacaucacaauuugcugu

SEQ ID NO: 477691 - RNA, 22 nt, Human
auaguaacuggcauguuuauga

SEQ ID NO: 477692 - RNA, 22 nt, Human
cagcacugcugcuguacacaca

SEQ ID NO: 477693 - RNA, 22 nt, Human
cuuuucaugccagcccaucaca

SEQ ID NO: 477694 - RNA, 22 nt, Human
guugaguggguuaggaugcuga

SEQ ID NO: 477695 - RNA, 22 nt, Human
auucaaguggcugcuauguuaa

SEQ ID NO: 477696 - RNA, 22 nt, Human
cagguuuagguggacgugcagg

SEQ ID NO: 477697 - RNA, 22 nt, Human
cugaggugcuagggucccugcu

SEQ ID NO: 477698 - RNA, 22 nt, Human
uaaggaaaguacauguuuugac

SEQ ID NO: 477699 - RNA, 22 nt, Human
ugccugucuuaauaucuggaaa

SEQ ID NO: 477700 - RNA, 22 nt, Human
uagggcagcugcaucaggcacu

SEQ ID NO: 477701 - RNA, 18 nt, Human
uccagagguguuggagcc

SEQ ID NO: 477702 - RNA, 22 nt, Human
ggggccugcgagguucaacuuc

SEQ ID NO: 477703 - RNA, 22 nt, Human
agggaagaaaauccaucgcugc

SEQ ID NO: 477704 - RNA, 22 nt, Human
uuacuuuguucucaagauaugu

SEQ ID NO: 477705 - RNA, 22 nt, Human
guggggcaugcacgcugcuccu

SEQ ID NO: 477706 - RNA, 22 nt, Human
agggcuccugaggcccuucugg

SEQ ID NO: 477707 - RNA, 22 nt, Human
cagcugccacaggacuuucuga

SEQ ID NO: 477708 - RNA, 22 nt, Human
ugaagcaggaucguuugcuuca

SEQ ID NO: 477709 - RNA, 22 nt, Human
auaguacacauccuacaauguu

SEQ ID NO: 477710 - RNA, 22 nt, Human
uagaaacccauguuuauucagu

SEQ ID NO: 477711 - RNA, 22 nt, Human
ugccaggcccucccacagauua

SEQ ID NO: 477712 - RNA, 22 nt, Human
ugccaaggagcuggaucagggc

SEQ ID NO: 477713 - RNA, 22 nt, Human
aguuuuucugggaggcacugcu

SEQ ID NO: 477714 - RNA, 22 nt, Human
gaagccucaacaucucugcguc

SEQ ID NO: 477715 - RNA, 22 nt, Human
auuguacagaugagguaaguga

SEQ ID NO: 477716 - RNA, 22 nt, Human
auauucuuccaaaacaucauuu

SEQ ID NO: 477717 - RNA, 20 nt, Human
gcccuggagccuuguccugg

SEQ ID NO: 477718 - RNA, 22 nt, Human
accugccucagugcagcuggau

SEQ ID NO: 477719 - RNA, 22 nt, Human
cccacucuggcucccuucuagu

SEQ ID NO: 477720 - RNA, 22 nt, Human
aaguucaauggaaaagcuuuag

SEQ ID NO: 477721 - RNA, 22 nt, Human
uguuuucuauuaccugagauug

SEQ ID NO: 477722 - RNA, 22 nt, Human
gcagaggccaucaacuuugcca

SEQ ID NO: 477723 - RNA, 22 nt, Human
cucagagaggcaguggaaguca

SEQ ID NO: 477724 - RNA, 22 nt, Human
aagaacauuuuguagaaugaca

SEQ ID NO: 477725 - RNA, 22 nt, Human
aaggcacugaaaaauugugugu

SEQ ID NO: 477726 - RNA, 22 nt, Human
uucaaagugcauguuccucaga

SEQ ID NO: 477727 - RNA, 20 nt, Human
cagcuuggaugagaggcuga

SEQ ID NO: 477728 - RNA, 19 nt, Human
ucucagaggaaaaauugcu

SEQ ID NO: 477729 - RNA, 17 nt, Human
aggaaacauuuucuuuc

SEQ ID NO: 477730 - RNA, 22 nt, Human
acacagggcaaugcuuugaccu

SEQ ID NO: 477731 - RNA, 22 nt, Human
gagggcugccacguugggcgag

SEQ ID NO: 477732 - RNA, 22 nt, Human
ugggcuacucugggagccuaac

SEQ ID NO: 477733 - RNA, 22 nt, Human
cagucccacaagaucuccacaa

SEQ ID NO: 477734 - RNA, 18 nt, Human
uggagcugagugcugugc

SEQ ID NO: 477735 - RNA, 22 nt, Human
ggcuucuuccugugaacauguu

SEQ ID NO: 477736 - RNA, 22 nt, Human
auucucaguucacuaguuucuu

SEQ ID NO: 477737 - RNA, 22 nt, Human
uggacagguuugggugccuguu

SEQ ID NO: 477738 - RNA, 22 nt, Human
cagucucagaggugggaguggg

SEQ ID NO: 477739 - RNA, 22 nt, Human
caguuucuacgacuuaagcaca

SEQ ID NO: 477740 - RNA, 22 nt, Human
agcuguggaagacugucagggu

SEQ ID NO: 477741 - RNA, 22 nt, Human
augcaucuauucccaagggcag

SEQ ID NO: 477742 - RNA, 22 nt, Human
uggcaugauaggaggugcagaa

SEQ ID NO: 477743 - RNA, 22 nt, Human
uuuaucuuuggaucuucagaaa

SEQ ID NO: 477744 - RNA, 22 nt, Human
uuugggaagaggaaucucugga

SEQ ID NO: 477745 - RNA, 22 nt, Human
agaugggcgcccuggacugagg

SEQ ID NO: 477746 - RNA, 22 nt, Human
agacccugcaccucucgugggc

SEQ ID NO: 477747 - RNA, 20 nt, Human
ucuguacacucaucuucugc

SEQ ID NO: 477748 - RNA, 22 nt, Human
guguggcuaccucagaggagca

SEQ ID NO: 477749 - RNA, 22 nt, Human
uguucccauuuucugcauaauc

SEQ ID NO: 477750 - RNA, 22 nt, Human
cucagggucugguccuuagauu

SEQ ID NO: 477751 - RNA, 22 nt, Human
cacccaggcuggagugcagggg

SEQ ID NO: 477752 - RNA, 22 nt, Human
gggcacuggaaggcucucaggc

SEQ ID NO: 477753 - RNA, 22 nt, Human
cuugcaggauuuugcugcugua

SEQ ID NO: 477754 - RNA, 22 nt, Human
ugugccuggaucucugugacaa

SEQ ID NO: 477755 - RNA, 22 nt, Human
uugggcuggcagagguggucuu

SEQ ID NO: 477756 - RNA, 22 nt, Human
ugcuucuggaaacaguggcugu

SEQ ID NO: 477757 - RNA, 22 nt, Human
agccaggcggggcagguuuccu

SEQ ID NO: 477758 - RNA, 22 nt, Human
uagcuuuaauaagcugcugaau

SEQ ID NO: 477759 - RNA, 22 nt, Human
aucugaagggaaguggaaggca

SEQ ID NO: 477760 - RNA, 22 nt, Human
cacagcugugagaagggagccu

SEQ ID NO: 477761 - RNA, 22 nt, Human
ugggcccaagagagucuccaac

SEQ ID NO: 477762 - RNA, 22 nt, Human
uuugaaaggguuaugagacuga

SEQ ID NO: 477763 - RNA, 22 nt, Human
gaaggcaacaccaggaugcacu

SEQ ID NO: 477764 - RNA, 22 nt, Human
gaggcucagagagguccacaua

SEQ ID NO: 477765 - RNA, 20 nt, Human
ucugaggcugagcucuacuu

SEQ ID NO: 477766 - RNA, 22 nt, Human
agaggaggccaggcccacaccu

SEQ ID NO: 477767 - RNA, 22 nt, Human
cucugcagaauuugagcugcuc

SEQ ID NO: 477768 - RNA, 22 nt, Human
caggcacugugcugagcucugc

SEQ ID NO: 477769 - RNA, 22 nt, Human
gccagguggagguugcagugag

SEQ ID NO: 477770 - RNA, 22 nt, Human
auggccugggcccgcuucagau

SEQ ID NO: 477771 - RNA, 22 nt, Human
uauaauuuuaagugguaaauua

SEQ ID NO: 477772 - RNA, 22 nt, Human
gcucugggaacugacugccuuc

SEQ ID NO: 477773 - RNA, 22 nt, Human
ccuggcugccgagugugcagcg

SEQ ID NO: 477774 - RNA, 22 nt, Human
gcccagccuccaagcuccaagg

SEQ ID NO: 477775 - RNA, 19 nt, Human
cugaagucuuuucagcugg

SEQ ID NO: 477776 - RNA, 22 nt, Human
gccuggcccagggcuccgcagg

SEQ ID NO: 477777 - RNA, 22 nt, Human
ggagccagcagggugacacuga

SEQ ID NO: 477778 - RNA, 22 nt, Human
ccaaaguccauaguuuacuuua

SEQ ID NO: 477779 - RNA, 22 nt, Human
auuccaaagcacaucagaacua

SEQ ID NO: 477780 - RNA, 21 nt, Human
uccacaaguuagaaggaaauu

SEQ ID NO: 477781 - RNA, 22 nt, Human
cagcugaguguuggcauguuca

SEQ ID NO: 477782 - RNA, 23 nt, Human
uugaaggagaaagcuuucuuggu

SEQ ID NO: 477783 - RNA, 22 nt, Human
aacauugcagcuuaauugcagg

SEQ ID NO: 477784 - RNA, 22 nt, Human
aagagcuguaugccauaugauu

SEQ ID NO: 477785 - RNA, 22 nt, Human
agggcagcccuucugggagggc

SEQ ID NO: 477786 - RNA, 22 nt, Human
uccagccaacugccuagggagc

SEQ ID NO: 477787 - RNA, 22 nt, Human
gugucccagcagcacauuggcu

SEQ ID NO: 477788 - RNA, 22 nt, Human
cagggccugccugguuccugga

SEQ ID NO: 477789 - RNA, 22 nt, Human
ccauccugcauugcuauucaga

SEQ ID NO: 477790 - RNA, 22 nt, Human
ggcugccauaacugauaccaua

SEQ ID NO: 477791 - RNA, 20 nt, Human
gguagcagcugcugucaucc

SEQ ID NO: 477792 - RNA, 22 nt, Human
cagccucuaagcacagccucuc

SEQ ID NO: 477793 - RNA, 22 nt, Human
cucacugcaaguuccaccuacc

SEQ ID NO: 477794 - RNA, 21 nt, Human
acagggcaugcagcuggcugu

SEQ ID NO: 477795 - RNA, 22 nt, Human
gagggcugugaaggagcggguu

SEQ ID NO: 477796 - RNA, 19 nt, Human
uuuggcacucugaaguguu

SEQ ID NO: 477797 - RNA, 22 nt, Human
aggcacugugcuucuuauaugu

SEQ ID NO: 477798 - RNA, 22 nt, Human
cagggcuggauuucauuucuag

SEQ ID NO: 477799 - RNA, 22 nt, Human
gccagaaagaggaggaccuggg

SEQ ID NO: 477800 - RNA, 22 nt, Human
acuuucuuaggcuguauaaaug

SEQ ID NO: 477801 - RNA, 22 nt, Human
uucuuucccuuccagcagcucc

SEQ ID NO: 477802 - RNA, 22 nt, Human
gaaagccauagcccagcuuuac

SEQ ID NO: 477803 - RNA, 22 nt, Human
cuucugcaauaaguuuuggucc

SEQ ID NO: 477804 - RNA, 22 nt, Human
ugcagcagacugaguaugagaa

SEQ ID NO: 477805 - RNA, 22 nt, Human
agggcugcugaggaagccuugc

SEQ ID NO: 477806 - RNA, 22 nt, Human
agcugguguccuccuggagcug

SEQ ID NO: 477807 - RNA, 22 nt, Human
gggcagaggggcgcuucccucu

SEQ ID NO: 477808 - RNA, 22 nt, Human
uuuucaucucugcuuuguaccu

SEQ ID NO: 477809 - RNA, 22 nt, Human
ugcuuuauuuauaaaauagcaa

SEQ ID NO: 477810 - RNA, 22 nt, Human
gcuggcuguuggagguaccugc

SEQ ID NO: 477811 - RNA, 22 nt, Human
agggcugcccagugugagagcu

SEQ ID NO: 477812 - RNA, 22 nt, Human
ucugggagagcacguggcugac

SEQ ID NO: 477813 - RNA, 22 nt, Human
gccagccccuuagggcucuccc

SEQ ID NO: 477814 - RNA, 22 nt, Human
uaaaaguggauaagcuguagga

SEQ ID NO: 477815 - RNA, 22 nt, Human
uagcauuuauggucaugugucc

SEQ ID NO: 477816 - RNA, 22 nt, Human
aaaagcucuuucugcuguagau

SEQ ID NO: 477817 - RNA, 22 nt, Human
cauaacuagagugaaauguuga

SEQ ID NO: 477818 - RNA, 22 nt, Human
gccacaugucaugugcucagua

SEQ ID NO: 477819 - RNA, 22 nt, Human
auggagacgcaagggaccuagg

SEQ ID NO: 477820 - RNA, 22 nt, Human
agcagagguuuguuggaaaccu

SEQ ID NO: 477821 - RNA, 22 nt, Human
gugccaggugcuaagcugugcu

SEQ ID NO: 477822 - RNA, 23 nt, Human
aggaaagcauucauuuuuaccau

SEQ ID NO: 477823 - RNA, 22 nt, Human
aucucccagccacagcauucuu

SEQ ID NO: 477824 - RNA, 22 nt, Human
agggcagcagcccauggcucug

SEQ ID NO: 477825 - RNA, 22 nt, Human
caggcacugugcuagauccuug

SEQ ID NO: 477826 - RNA, 22 nt, Human
gaagcagcaaaucugcaguauc

SEQ ID NO: 477827 - RNA, 22 nt, Human
ucacuguugaccuggaaguggg

SEQ ID NO: 477828 - RNA, 22 nt, Human
uuuguucacugagcaaugauua

SEQ ID NO: 477829 - RNA, 22 nt, Human
ucauuucuguugugcaucacug

SEQ ID NO: 477830 - RNA, 22 nt, Human
uauaucaccaaaaacaguucug

SEQ ID NO: 477831 - RNA, 22 nt, Human
cuguaaauaugaagaauauaug

SEQ ID NO: 477832 - RNA, 22 nt, Human
gacccaggguauccagagcugc

SEQ ID NO: 477833 - RNA, 22 nt, Human
gauuuccuaauguggaucucug

SEQ ID NO: 477834 - RNA, 22 nt, Human
gcucuggagauggagccuugag

SEQ ID NO: 477835 - RNA, 22 nt, Human
ggcuggcuggcugguagacaag

SEQ ID NO: 477836 - RNA, 22 nt, Human
agguggcuccucccauggcugg

SEQ ID NO: 477837 - RNA, 18 nt, Human
gcccagaggucugggccc

SEQ ID NO: 477838 - RNA, 22 nt, Human
ugcacaucuuucagcaucauac

SEQ ID NO: 477839 - RNA, 22 nt, Human
aacauuaauuacagucaaacau

SEQ ID NO: 477840 - RNA, 22 nt, Human
acagaauuaaaguguuugugga

SEQ ID NO: 477841 - RNA, 21 nt, Human
aggcacuguuugugguuuggg

SEQ ID NO: 477842 - RNA, 22 nt, Human
gccucugcgccucagccgaccu

SEQ ID NO: 477843 - RNA, 22 nt, Human
cagcugaauucuucagacucca

SEQ ID NO: 477844 - RNA, 22 nt, Human
gaggucaggcuugcagcagggu

SEQ ID NO: 477845 - RNA, 22 nt, Human
aaauaauugaguuggucaauau

SEQ ID NO: 477846 - RNA, 22 nt, Human
gggcagugguccaggcuacagc

SEQ ID NO: 477847 - RNA, 22 nt, Human
augugguugaagaauuacaucu

SEQ ID NO: 477848 - RNA, 22 nt, Human
ggaugcaggggcagcagagccu

SEQ ID NO: 477849 - RNA, 22 nt, Human
ugucuuuaaaauuaaacacauc

SEQ ID NO: 477850 - RNA, 22 nt, Human
cccugcugucaggugcugggag

SEQ ID NO: 477851 - RNA, 22 nt, Human
agcugaggaggaaugaugggua

SEQ ID NO: 477852 - RNA, 22 nt, Human
gggaauuauagcugucacaggc

SEQ ID NO: 477853 - RNA, 22 nt, Human
caaaggagguaaugggugugag

SEQ ID NO: 477854 - RNA, 22 nt, Human
gagccaggguuugaaacuagac

SEQ ID NO: 477855 - RNA, 22 nt, Human
cacuggugacuucugagcugga

SEQ ID NO: 477856 - RNA, 22 nt, Human
ggaccugccagaacucaggcua

SEQ ID NO: 477857 - RNA, 22 nt, Human
ucagggacauuuagacacugau

SEQ ID NO: 477858 - RNA, 22 nt, Human
acagagguguguguaggacagu

SEQ ID NO: 477859 - RNA, 23 nt, Human
cagggcugggcuugguguuaggc

SEQ ID NO: 477860 - RNA, 22 nt, Human
uuccuguaugucagugaagagc

SEQ ID NO: 477861 - RNA, 22 nt, Human
uuguuucagcuguaugcuaugu

SEQ ID NO: 477862 - RNA, 22 nt, Human
cuggccagacuacacaugugug

SEQ ID NO: 477863 - RNA, 22 nt, Human
caagcagagacuagauagcugu

SEQ ID NO: 477864 - RNA, 22 nt, Human
aggcugaggggcgagggacccu

SEQ ID NO: 477865 - RNA, 22 nt, Human
cuuccaaacccaggguaugggc

SEQ ID NO: 477866 - RNA, 22 nt, Human
ucugucugagggagugacauuu

SEQ ID NO: 477867 - RNA, 22 nt, Human
ugcucuguaaggucagaaaagg

SEQ ID NO: 477868 - RNA, 22 nt, Human
gaugcacaugugaguauagaag

SEQ ID NO: 477869 - RNA, 22 nt, Human
agcugaguuaauucaucacuua

SEQ ID NO: 477870 - RNA, 20 nt, Human
agagaauucccuuuggagau

SEQ ID NO: 477871 - RNA, 22 nt, Human
gagcuggugaucagcuggagga

SEQ ID NO: 477872 - RNA, 22 nt, Human
cugucuguuuuaccuucuccag

SEQ ID NO: 477873 - RNA, 20 nt, Human
cagagaccugucuucacaga

SEQ ID NO: 477874 - RNA, 22 nt, Human
uccugcagcugcagaccugggg

SEQ ID NO: 477875 - RNA, 22 nt, Human
gccagucugcucccacaaguuc

SEQ ID NO: 477876 - RNA, 22 nt, Human
ugaggcaggaguucaggcugcg

SEQ ID NO: 477877 - RNA, 22 nt, Human
guaaacaugcuguguacucagc

SEQ ID NO: 477878 - RNA, 22 nt, Human
cagagagagugggguguggauu

SEQ ID NO: 477879 - RNA, 22 nt, Human
cagucccaaggaggaagcaguc

SEQ ID NO: 477880 - RNA, 22 nt, Human
ucccugggccacagcugugagc

SEQ ID NO: 477881 - RNA, 22 nt, Human
ucaguggauauuucuguggcug

SEQ ID NO: 477882 - RNA, 22 nt, Human
ccuggcugugcauugccggccc

SEQ ID NO: 477883 - RNA, 22 nt, Human
ugggauaguggccaggaccccc

SEQ ID NO: 477884 - RNA, 22 nt, Human
cccuggaggaaaaucugaggcu

SEQ ID NO: 477885 - RNA, 22 nt, Human
cuggcuccaucacugggugaug

SEQ ID NO: 477886 - RNA, 22 nt, Human
aggaggggcauagaaauguaau

SEQ ID NO: 477887 - RNA, 22 nt, Human
gaacauuuccagaaaggaacua

SEQ ID NO: 477888 - RNA, 22 nt, Human
cagaugaggcaaccucauugcu

SEQ ID NO: 477889 - RNA, 22 nt, Human
ggacagaggguugacagaguau

SEQ ID NO: 477890 - RNA, 19 nt, Human
agcuguggaugugggauuu

SEQ ID NO: 477891 - RNA, 22 nt, Human
gagccucguggcggccacugcg

SEQ ID NO: 477892 - RNA, 22 nt, Human
ugcagaagcagagccgguggcc

SEQ ID NO: 477893 - RNA, 22 nt, Human
gagagaagaaagccaugguccu

SEQ ID NO: 477894 - RNA, 21 nt, Human
accucaagcaacaaccaaggu

SEQ ID NO: 477895 - RNA, 22 nt, Human
uucuggagaucugccuauggga

SEQ ID NO: 477896 - RNA, 22 nt, Human
ugaaaugcuguagagacuguau

SEQ ID NO: 477897 - RNA, 22 nt, Human
agugucauuuuguccaucuucu

SEQ ID NO: 477898 - RNA, 21 nt, Human
gcaggguccuuuccauuccua

SEQ ID NO: 477899 - RNA, 22 nt, Human
uggggcucaccuaggcuggaag

SEQ ID NO: 477900 - RNA, 22 nt, Human
uggcucaggugugagcugaaga

SEQ ID NO: 477901 - RNA, 22 nt, Human
aacaaauggaacacaaaucuuu

SEQ ID NO: 477902 - RNA, 22 nt, Human
ugaugguugauuauaaaucagu

SEQ ID NO: 477903 - RNA, 22 nt, Human
caaauguguuuuuucuucuaca

SEQ ID NO: 477904 - RNA, 22 nt, Human
uggcucuguuuuaugaguacca

SEQ ID NO: 477905 - RNA, 22 nt, Human
cugcagcuuuggaaaccuguuu

SEQ ID NO: 477906 - RNA, 22 nt, Human
uuugucaucccuuuugaaacug

SEQ ID NO: 477907 - RNA, 22 nt, Human
ggcaccaggcugggcauaggcc

SEQ ID NO: 477908 - RNA, 22 nt, Human
aggccuuccucggagacaggga

SEQ ID NO: 477909 - RNA, 22 nt, Human
ucagccucucugaguccagacc

SEQ ID NO: 477910 - RNA, 22 nt, Human
uuaugcuaagugcaacaagcca

SEQ ID NO: 477911 - RNA, 22 nt, Human
gcucugcuggagggaaagagaa

SEQ ID NO: 477912 - RNA, 22 nt, Human
aggcccugcccagagcuccucg

SEQ ID NO: 477913 - RNA, 22 nt, Human
agcuccugcacccagccuugag

SEQ ID NO: 477914 - RNA, 22 nt, Human
gcagggaccugccacugcuguc

SEQ ID NO: 477915 - RNA, 22 nt, Human
ugggcugagcacugaggaagga

SEQ ID NO: 477916 - RNA, 22 nt, Human
gcugccugguuucucagcugca

SEQ ID NO: 477917 - RNA, 22 nt, Human
acacauaugguugcugcaguga

SEQ ID NO: 477918 - RNA, 22 nt, Human
gccuggagaccugcuccucuac

SEQ ID NO: 477919 - RNA, 22 nt, Human
ccaggccucuggcugcuuaguc

SEQ ID NO: 477920 - RNA, 22 nt, Human
ucacucagguucaugucuuugu

SEQ ID NO: 477921 - RNA, 19 nt, Human
auagucuuuccaauuauac

SEQ ID NO: 477922 - RNA, 22 nt, Human
ggcagcuguaagaugagugaau

SEQ ID NO: 477923 - RNA, 22 nt, Human
ccagaagaggacacagugugga

SEQ ID NO: 477924 - RNA, 22 nt, Human
agcagcauguugggaugugaaa

SEQ ID NO: 477925 - RNA, 22 nt, Human
cuggcugcaggaugaggcugcc

SEQ ID NO: 477926 - RNA, 18 nt, Human
ugucucugaauuccagug

SEQ ID NO: 477927 - RNA, 22 nt, Human
ggccagaggccauccuccugcu

SEQ ID NO: 477928 - RNA, 22 nt, Human
cugggaguugacgaggcuugua

SEQ ID NO: 477929 - RNA, 20 nt, Human
agcuggccuguccuaggccu

SEQ ID NO: 477930 - RNA, 22 nt, Human
ggguccagaguugaagagguua

SEQ ID NO: 477931 - RNA, 22 nt, Human
agauuucagguuggggcagaag

SEQ ID NO: 477932 - RNA, 22 nt, Human
ugcccaggguggagugcagcgg

SEQ ID NO: 477933 - RNA, 22 nt, Human
ggggcggggcucugagaagcau

SEQ ID NO: 477934 - RNA, 22 nt, Human
ggcugagggccagggcuagucu

SEQ ID NO: 477935 - RNA, 22 nt, Human
ggccugagcuugggcagcguau

SEQ ID NO: 477936 - RNA, 22 nt, Human
gagcacagccaaaguaagaagg

SEQ ID NO: 477937 - RNA, 22 nt, Human
guagccauuggcaaugaagccu

SEQ ID NO: 477938 - RNA, 22 nt, Human
cgcagaagagguugucuagucc

SEQ ID NO: 477939 - RNA, 22 nt, Human
aggagccaagcagaacuaagga

SEQ ID NO: 477940 - RNA, 22 nt, Human
cagcucugaagaaaggugucua

SEQ ID NO: 477941 - RNA, 22 nt, Human
agaagagccuggggaccauggc

SEQ ID NO: 477942 - RNA, 22 nt, Human
cagaggacaauagaauggaaag

SEQ ID NO: 477943 - RNA, 22 nt, Human
ucaggcaguagaauugcuugaa

SEQ ID NO: 477944 - RNA, 23 nt, Human
agagccugaaagacuucuggcac

SEQ ID NO: 477945 - RNA, 22 nt, Human
uagcuuuaggcacguuugaauu

SEQ ID NO: 477946 - RNA, 22 nt, Human
cugucaucacaguugagcagcc

SEQ ID NO: 477947 - RNA, 22 nt, Human
gaaaggaaauauucuaagcacu

SEQ ID NO: 477948 - RNA, 22 nt, Human
uguguauuaccauuuuacagcu

SEQ ID NO: 477949 - RNA, 22 nt, Human
uuccauuuauucuuguccagau

SEQ ID NO: 477950 - RNA, 22 nt, Human
ggcuccugaaagacuaugggaa

SEQ ID NO: 477951 - RNA, 22 nt, Human
cuugggagacacaagaagacau

SEQ ID NO: 477952 - RNA, 22 nt, Human
ucugagagccucuagccuaagu

SEQ ID NO: 477953 - RNA, 20 nt, Human
ggcacuggaagcacacagga

SEQ ID NO: 477954 - RNA, 22 nt, Human
gcuuccuaaaugcacagggcag

SEQ ID NO: 477955 - RNA, 22 nt, Human
cugccagcagaggccagcgcug

SEQ ID NO: 477956 - RNA, 22 nt, Human
uucacaaaacacuauuuucugg

SEQ ID NO: 477957 - RNA, 19 nt, Human
agcuccugggcucugggcc

SEQ ID NO: 477958 - RNA, 22 nt, Human
ugguuuugcuccaguauaaaua

SEQ ID NO: 477959 - RNA, 22 nt, Human
acaggccucaagacacccaggu

SEQ ID NO: 477960 - RNA, 22 nt, Human
gaaacuguauguaguuuuuggg

SEQ ID NO: 477961 - RNA, 22 nt, Human
ggucccagaauugguuagcaca

SEQ ID NO: 477962 - RNA, 22 nt, Human
aacaguaaaaaucauuuaguug

SEQ ID NO: 477963 - RNA, 22 nt, Human
gugacucacacaggccugggcu

SEQ ID NO: 477964 - RNA, 22 nt, Human
ugacagaacagguugggagcaa

SEQ ID NO: 477965 - RNA, 22 nt, Human
acauuucugagcagggagcugu

SEQ ID NO: 477966 - RNA, 22 nt, Human
cauuucuagacaaguccuggag

SEQ ID NO: 477967 - RNA, 22 nt, Human
accuggcacuacaggcaccugu

SEQ ID NO: 477968 - RNA, 22 nt, Human
cugaagccaugugcucacuggu

SEQ ID NO: 477969 - RNA, 22 nt, Human
uggccucugcaauggauucacc

SEQ ID NO: 477970 - RNA, 22 nt, Human
aaagaagggacagacugccucu

SEQ ID NO: 477971 - RNA, 23 nt, Human
uuugaaaguaucaacucgccuga

SEQ ID NO: 477972 - RNA, 22 nt, Human
guggcagugugaggauccugcu

SEQ ID NO: 477973 - RNA, 22 nt, Human
ugggcuggcguggagaguuuag

SEQ ID NO: 477974 - RNA, 22 nt, Human
auaaggcagugacuucaucuau

SEQ ID NO: 477975 - RNA, 22 nt, Human
ucuguucuauuggucuaugugu

SEQ ID NO: 477976 - RNA, 22 nt, Human
aaaggccacugcaagggaaggu

SEQ ID NO: 477977 - RNA, 22 nt, Human
uaagaacaagcuggggguucca

SEQ ID NO: 477978 - RNA, 22 nt, Human
ccuccugggcuccugucugcac

SEQ ID NO: 477979 - RNA, 22 nt, Human
cagcaggaagguuuccccugca

SEQ ID NO: 477980 - RNA, 22 nt, Human
uugaauaguuuuggauagcaua

SEQ ID NO: 477981 - RNA, 22 nt, Human
aggcuggcgacaucuggcgggc

SEQ ID NO: 477982 - RNA, 22 nt, Human
gcugccugaagugucuacacug

SEQ ID NO: 477983 - RNA, 22 nt, Human
agccaggccagcugucuugagu

SEQ ID NO: 477984 - RNA, 22 nt, Human
ccagcccuguaaggaugaggca

SEQ ID NO: 477985 - RNA, 22 nt, Human
gaaaucugaacaacagcuguca

SEQ ID NO: 477986 - RNA, 22 nt, Human
augcuguguuuuaaauggaaau

SEQ ID NO: 477987 - RNA, 22 nt, Human
gcccagcuggcuuccagcacau

SEQ ID NO: 477988 - RNA, 22 nt, Human
aaggucauggcaaauuacuuuu

SEQ ID NO: 477989 - RNA, 22 nt, Human
cuuucucaaugccggaaggcac

SEQ ID NO: 477990 - RNA, 22 nt, Human
uggccugguuauauugcuauca

SEQ ID NO: 477991 - RNA, 22 nt, Human
gggcagagguucaacuucaaca

SEQ ID NO: 477992 - RNA, 22 nt, Human
agggcagagcugucuaaauggc

SEQ ID NO: 477993 - RNA, 22 nt, Human
uucuacaugguugcucagaggg

SEQ ID NO: 477994 - RNA, 21 nt, Human
agcagaggcagaauguaugca

SEQ ID NO: 477995 - RNA, 17 nt, Human
gccucugcuugugucau

SEQ ID NO: 477996 - RNA, 22 nt, Human
ccagggcacuuaggcccagccc

SEQ ID NO: 477997 - RNA, 22 nt, Human
aggggccugguuggccucuguu

SEQ ID NO: 477998 - RNA, 19 nt, Human
gccagcagaaugaugaggc

SEQ ID NO: 477999 - RNA, 22 nt, Human
uggccugucuuguugugcuaga

SEQ ID NO: 478000 - RNA, 22 nt, Human
acagagagggagugauaaaucc

SEQ ID NO: 478001 - RNA, 22 nt, Human
uugguuuacuaggauucaaauu

SEQ ID NO: 478002 - RNA, 20 nt, Human
agcaagaguaaggacagcga

SEQ ID NO: 478003 - RNA, 22 nt, Human
agaccaugggcucugaagagca

SEQ ID NO: 478004 - RNA, 22 nt, Human
agagcugggugaagugccauca

SEQ ID NO: 478005 - RNA, 22 nt, Human
cccaggucugugccagcucuga

SEQ ID NO: 478006 - RNA, 22 nt, Human
ugacauuuaagccucugauuuc

SEQ ID NO: 478007 - RNA, 22 nt, Human
agcuggcuccagaaggagucgu

SEQ ID NO: 478008 - RNA, 22 nt, Human
guggauggauuuugaggaaugg

SEQ ID NO: 478009 - RNA, 22 nt, Human
aaggguugaagauaaauaaggu

SEQ ID NO: 478010 - RNA, 22 nt, Human
cacuguaucuuuuccaaagucu

SEQ ID NO: 478011 - RNA, 22 nt, Human
auuuaugacuggugaauagaac

SEQ ID NO: 478012 - RNA, 22 nt, Human
gggcaaguccggugcccagagc

SEQ ID NO: 478013 - RNA, 22 nt, Human
ccugggaggcagagguugcagu

SEQ ID NO: 478014 - RNA, 22 nt, Human
gccuaauaugcaaaauugauac

SEQ ID NO: 478015 - RNA, 22 nt, Human
caguggcaaugggacagagcac

SEQ ID NO: 478016 - RNA, 22 nt, Human
cccugcagcauucucuaacugg

SEQ ID NO: 478017 - RNA, 22 nt, Human
agggcacagccuaaagccuaug

SEQ ID NO: 478018 - RNA, 22 nt, Human
ggugucccaggccagcugugug

SEQ ID NO: 478019 - RNA, 22 nt, Human
aaggagagagcuuugcuggaac

SEQ ID NO: 478020 - RNA, 19 nt, Human
cuggugcuugagugaguca

SEQ ID NO: 478021 - RNA, 23 nt, Human
ugcugggcagagcuggugcugag

SEQ ID NO: 478022 - RNA, 22 nt, Human
ugccaggcugcccuccagucug

SEQ ID NO: 478023 - RNA, 22 nt, Human
acaaaugccauauauaaauucu

SEQ ID NO: 478024 - RNA, 20 nt, Human
ccagagcugauggcugcccg

SEQ ID NO: 478025 - RNA, 22 nt, Human
gcagaugguggggcaggaaaau

SEQ ID NO: 478026 - RNA, 21 nt, Human
cugguguagcacucaggugcu

SEQ ID NO: 478027 - RNA, 22 nt, Human
ucuggcugcugcgugagugcuu

SEQ ID NO: 478028 - RNA, 22 nt, Human
aaacuguaagagaauaaacuac

SEQ ID NO: 478029 - RNA, 21 nt, Human
acacugugucauaaugcuuaa

SEQ ID NO: 478030 - RNA, 19 nt, Human
caguggccuggaggucucu

SEQ ID NO: 478031 - RNA, 20 nt, Human
ugcuugucaugcacucaggc

SEQ ID NO: 478032 - RNA, 22 nt, Human
ugaagccagucaauguuaaguu

SEQ ID NO: 478033 - RNA, 22 nt, Human
uuugagaagcaucugguccacu

SEQ ID NO: 478034 - RNA, 22 nt, Human
gugagaguguuuggaaauagaa

SEQ ID NO: 478035 - RNA, 22 nt, Human
ucuguccauuuuccauuuuggc

SEQ ID NO: 478036 - RNA, 20 nt, Human
ugcugcaguuucaugggacu

SEQ ID NO: 478037 - RNA, 22 nt, Human
gcugauuauuacaugucugugg

SEQ ID NO: 478038 - RNA, 22 nt, Human
aaaagacaucuauuucaggcag

SEQ ID NO: 478039 - RNA, 22 nt, Human
gcagagugaagcaguauggaaa

SEQ ID NO: 478040 - RNA, 22 nt, Human
cugggcugugguguggcccaaa

SEQ ID NO: 478041 - RNA, 22 nt, Human
auauauuugagaauauucauga

SEQ ID NO: 478042 - RNA, 22 nt, Human
agguggagugaaggaaaggcag

SEQ ID NO: 478043 - RNA, 22 nt, Human
agaaaucaugacuaagagcagu

SEQ ID NO: 478044 - RNA, 23 nt, Human
acagugugguggacaaggagcag

SEQ ID NO: 478045 - RNA, 22 nt, Human
aguuucauauuaccaugucacc

SEQ ID NO: 478046 - RNA, 22 nt, Human
caguguuuaaucauugugaauu

SEQ ID NO: 478047 - RNA, 22 nt, Human
ccaggggcuggugcugagcugg

SEQ ID NO: 478048 - RNA, 22 nt, Human
agcauuuaggagaauuugagaa

SEQ ID NO: 478049 - RNA, 22 nt, Human
cuuagaaauaaugguuucaguu

SEQ ID NO: 478050 - RNA, 22 nt, Human
gcuggccucaucacugacuucu

SEQ ID NO: 478051 - RNA, 22 nt, Human
gggcuugcugauuugggcagga

SEQ ID NO: 478052 - RNA, 22 nt, Human
ucuccaagcagggcugcaaggc

SEQ ID NO: 478053 - RNA, 22 nt, Human
caggcuggagugcaguugugca

SEQ ID NO: 478054 - RNA, 22 nt, Human
gccaggcugcuccagggaggcc

SEQ ID NO: 478055 - RNA, 17 nt, Human
aguguuuccuuaucauu

SEQ ID NO: 478056 - RNA, 18 nt, Human
cccagcccaccauuucuc

SEQ ID NO: 478057 - RNA, 22 nt, Human
guaagcaucugucucuucugca

SEQ ID NO: 478058 - RNA, 22 nt, Human
ucuugcacuucaugaauauguu

SEQ ID NO: 478059 - RNA, 22 nt, Human
uggcucagcugucacagccugg

SEQ ID NO: 478060 - RNA, 22 nt, Human
ugagcaucuuuuuacagguuua

SEQ ID NO: 478061 - RNA, 22 nt, Human
aaguguuaaaagauuaaaugcu

SEQ ID NO: 478062 - RNA, 22 nt, Human
ccagcuggcaggagagucaggg

SEQ ID NO: 478063 - RNA, 20 nt, Human
cccuggagagaagcuccacg

SEQ ID NO: 478064 - RNA, 22 nt, Human
gcagggcuauuggaaggagaug

SEQ ID NO: 478065 - RNA, 22 nt, Human
cuugccuucuguuccuauagaa

SEQ ID NO: 478066 - RNA, 22 nt, Human
aaaguuuuagaacuaggaagca

SEQ ID NO: 478067 - RNA, 22 nt, Human
acaaaggcagccaaucaucugc

SEQ ID NO: 478068 - RNA, 22 nt, Human
gucaggaugggcagccaaacua

SEQ ID NO: 478069 - RNA, 22 nt, Human
uccugucagugaggcagaugaa

SEQ ID NO: 478070 - RNA, 23 nt, Human
aggcagagccaaggucaaaaccc

SEQ ID NO: 478071 - RNA, 22 nt, Human
ucuggcucucaacaaauauuua

SEQ ID NO: 478072 - RNA, 22 nt, Human
acagagagcugugauugaguua

SEQ ID NO: 478073 - RNA, 22 nt, Human
agugauggugagugagaagcuc

SEQ ID NO: 478074 - RNA, 22 nt, Human
cuacccagcaccuaggcugccu

SEQ ID NO: 478075 - RNA, 22 nt, Human
agggcccaggacagcaucaggg

SEQ ID NO: 478076 - RNA, 22 nt, Human
cuggccgguauuugccucuggg

SEQ ID NO: 478077 - RNA, 22 nt, Human
ggccugcacagagguggcucua

SEQ ID NO: 478078 - RNA, 22 nt, Human
cuuccugaacaaugccaucaau

SEQ ID NO: 478079 - RNA, 22 nt, Human
caaaggcuucaucucagagcag

SEQ ID NO: 478080 - RNA, 22 nt, Human
ucugaaauguucucuuguuuug

SEQ ID NO: 478081 - RNA, 22 nt, Human
gagcugccuacauugccaagag

SEQ ID NO: 478082 - RNA, 19 nt, Human
gccugccuggguuucugag

SEQ ID NO: 478083 - RNA, 20 nt, Human
cugggaggucuuccaaauca

SEQ ID NO: 478084 - RNA, 22 nt, Human
agagacaggauaucugcucaug

SEQ ID NO: 478085 - RNA, 22 nt, Human
aggauccuguauggagaagcug

SEQ ID NO: 478086 - RNA, 22 nt, Human
ucuucucccaucuccaggcagg

SEQ ID NO: 478087 - RNA, 22 nt, Human
aagaaauuaaggaaugcaacga

SEQ ID NO: 478088 - RNA, 22 nt, Human
cagccagagaaagggcacugcc

SEQ ID NO: 478089 - RNA, 22 nt, Human
uucugaggcacuggcucuccca

SEQ ID NO: 478090 - RNA, 22 nt, Human
caguuccuaugggcaaaacaca

SEQ ID NO: 478091 - RNA, 22 nt, Human
ggcuuuauuaagcaggguaagu

SEQ ID NO: 478092 - RNA, 22 nt, Human
uuucaaauggagucgugaaaug

SEQ ID NO: 478093 - RNA, 22 nt, Human
ugcagggaaaguguuggcagca

SEQ ID NO: 478094 - RNA, 22 nt, Human
gagagcuguaauagucaugucu

SEQ ID NO: 478095 - RNA, 22 nt, Human
cuguuuucccuggaguucagca

SEQ ID NO: 478096 - RNA, 22 nt, Human
uuuccaauaaagugucauuguu

SEQ ID NO: 478097 - RNA, 22 nt, Human
uccaguucuaggucacucucug

SEQ ID NO: 478098 - RNA, 22 nt, Human
ccucugaggucauggacuuggc

SEQ ID NO: 478099 - RNA, 22 nt, Human
gacccagaaggagugcccuaga

SEQ ID NO: 478100 - RNA, 19 nt, Human
agaggccucagcagcuggc

SEQ ID NO: 478101 - RNA, 22 nt, Human
ggcacugggagaggugagacgg

SEQ ID NO: 478102 - RNA, 19 nt, Human
cucugccucccuccugggu

SEQ ID NO: 478103 - RNA, 22 nt, Human
ugagcccagucugucugacaug

SEQ ID NO: 478104 - RNA, 22 nt, Human
ccagaagucaggaaugagucuu

SEQ ID NO: 478105 - RNA, 21 nt, Human
gggaaauuaggauugcucauc

SEQ ID NO: 478106 - RNA, 22 nt, Human
cacagcagaaauaugaaggcag

SEQ ID NO: 478107 - RNA, 22 nt, Human
gccaggcaugggcuucugggcg

SEQ ID NO: 478108 - RNA, 23 nt, Human
ugcugggguaguuuguggcacag

SEQ ID NO: 478109 - RNA, 22 nt, Human
cugggaggcaccgcgucgugcu

SEQ ID NO: 478110 - RNA, 22 nt, Human
uagggcucacugagaugaauau

SEQ ID NO: 478111 - RNA, 22 nt, Human
uucaaaacagcuagauauugga

SEQ ID NO: 478112 - RNA, 22 nt, Human
auguacaguuucuagacucaaa

SEQ ID NO: 478113 - RNA, 22 nt, Human
agacagaacagaauaauuguug

SEQ ID NO: 478114 - RNA, 20 nt, Human
auaauuuacccugcaccacu

SEQ ID NO: 478115 - RNA, 22 nt, Human
uggcucagcugacucggcuucu

SEQ ID NO: 478116 - RNA, 22 nt, Human
ucucagucagccuugauguccc

SEQ ID NO: 478117 - RNA, 22 nt, Human
uggccaccccuuucucugcacu

SEQ ID NO: 478118 - RNA, 22 nt, Human
uuuucauuguuccucgagcauu

SEQ ID NO: 478119 - RNA, 22 nt, Human
cacagggcagaggguccguggc

SEQ ID NO: 478120 - RNA, 19 nt, Human
gggcuccuugggccucucu

SEQ ID NO: 478121 - RNA, 21 nt, Human
ucagaguggaagacaguuuga

SEQ ID NO: 478122 - RNA, 22 nt, Human
ugagccagauaagggcucacgc

SEQ ID NO: 478123 - RNA, 22 nt, Human
ucucucagaggaagaggcagug

SEQ ID NO: 478124 - RNA, 22 nt, Human
ucccugcagacguccugcgggu

SEQ ID NO: 478125 - RNA, 22 nt, Human
ggggaugguggcauuuguaaaa

SEQ ID NO: 478126 - RNA, 22 nt, Human
caggugcugcguggcggagcug

SEQ ID NO: 478127 - RNA, 22 nt, Human
uagggcagaguccaggaugggc

SEQ ID NO: 478128 - RNA, 22 nt, Human
ugaggaaguugaucucaucagu

SEQ ID NO: 478129 - RNA, 22 nt, Human
cuggccugaggccgccuucaga

SEQ ID NO: 478130 - RNA, 22 nt, Human
ugugccaggcacuugcccaggc

SEQ ID NO: 478131 - RNA, 22 nt, Human
acuaaauaguuuugacagaaca

SEQ ID NO: 478132 - RNA, 20 nt, Human
uauuucugggcaaccauuua

SEQ ID NO: 478133 - RNA, 22 nt, Human
uccuugaagcaacgugcagaca

SEQ ID NO: 478134 - RNA, 22 nt, Human
gagggcugcaaugagacagaga

SEQ ID NO: 478135 - RNA, 22 nt, Human
uguguccuucugggagucccag

SEQ ID NO: 478136 - RNA, 22 nt, Human
gcucugcugcuuacuagauggu

SEQ ID NO: 478137 - RNA, 22 nt, Human
aagauuucugcuuuuggaggca

SEQ ID NO: 478138 - RNA, 22 nt, Human
ccauguggugggaaggagaaug

SEQ ID NO: 478139 - RNA, 22 nt, Human
acagccaggagccaugggcagg

SEQ ID NO: 478140 - RNA, 22 nt, Human
aagacauugucauuuuauaauu

SEQ ID NO: 478141 - RNA, 22 nt, Human
uggcucagccagcccuaggaac

SEQ ID NO: 478142 - RNA, 17 nt, Human
gcaagggaugggagauu

SEQ ID NO: 478143 - RNA, 22 nt, Human
aggaccauccuaagguaggcaa

SEQ ID NO: 478144 - RNA, 22 nt, Human
guggccugccgugugguauggg

SEQ ID NO: 478145 - RNA, 22 nt, Human
cugcagaggguuugagcauccu

SEQ ID NO: 478146 - RNA, 22 nt, Human
ccugucuggaacauggccuguu

SEQ ID NO: 478147 - RNA, 22 nt, Human
ucugccugcuaacuccugcacc

SEQ ID NO: 478148 - RNA, 22 nt, Human
caggugggagcggagacugauu

SEQ ID NO: 478149 - RNA, 22 nt, Human
aacuguaauuuuuacauaguaa

SEQ ID NO: 478150 - RNA, 22 nt, Human
gcugucuccauagcuguguguc

SEQ ID NO: 478151 - RNA, 22 nt, Human
guguuccauguuugagguaguu

SEQ ID NO: 478152 - RNA, 22 nt, Human
ucugggagagcugcugucagag

SEQ ID NO: 478153 - RNA, 21 nt, Human
uggcccuggccacggcugcca

SEQ ID NO: 478154 - RNA, 22 nt, Human
uggcuaggcuccaagagcugga

SEQ ID NO: 478155 - RNA, 22 nt, Human
gaguuauuucagaaggaaagau

SEQ ID NO: 478156 - RNA, 22 nt, Human
agcuuuaugcuuccuacaagcu

SEQ ID NO: 478157 - RNA, 22 nt, Human
ccagccuuacugcccuucagug

SEQ ID NO: 478158 - RNA, 22 nt, Human
auguuacauaguccuuauuugu

SEQ ID NO: 478159 - RNA, 22 nt, Human
gcuggccugaccagccacaggc

SEQ ID NO: 478160 - RNA, 22 nt, Human
gggcagugguuacacagcugag

SEQ ID NO: 478161 - RNA, 22 nt, Human
ccuguggcucucuuuggagguc

SEQ ID NO: 478162 - RNA, 22 nt, Human
aagguacaaaguauuauuuaaa

SEQ ID NO: 478163 - RNA, 22 nt, Human
ggggcagagucuggacuguugu

SEQ ID NO: 478164 - RNA, 22 nt, Human
cccuccagcucaaagcaaccgg

SEQ ID NO: 478165 - RNA, 22 nt, Human
ucuggagauaagacagacagau

SEQ ID NO: 478166 - RNA, 22 nt, Human
auugaaaaaugacuauugcuua

SEQ ID NO: 478167 - RNA, 22 nt, Human
cucagagaaaugucacaacaau

SEQ ID NO: 478168 - RNA, 22 nt, Human
gccaggcaggugucggagcccu

SEQ ID NO: 478169 - RNA, 22 nt, Human
ggcugggcaggucugcacaggg

SEQ ID NO: 478170 - RNA, 22 nt, Human
uuucuuauauucugucauuguu

SEQ ID NO: 478171 - RNA, 23 nt, Human
ucccuggaggcagguccagggcc

SEQ ID NO: 478172 - RNA, 22 nt, Human
gagccuggagcuggaacgaagc

SEQ ID NO: 478173 - RNA, 22 nt, Human
agcagggcagugcuucagcucu

SEQ ID NO: 478174 - RNA, 22 nt, Human
uaggcaggugugcacugcccac

SEQ ID NO: 478175 - RNA, 22 nt, Human
gcaaaggccacuggggcgaugg

SEQ ID NO: 478176 - RNA, 22 nt, Human
acagcagccugcagcccugugu

SEQ ID NO: 478177 - RNA, 22 nt, Human
acagaacugcaggaggaaaagc

SEQ ID NO: 478178 - RNA, 22 nt, Human
caggcagggagcuggaaaggau

SEQ ID NO: 478179 - RNA, 22 nt, Human
gccuggcaggccugggccagca

SEQ ID NO: 478180 - RNA, 22 nt, Human
uccagugguuugaaaggggugu

SEQ ID NO: 478181 - RNA, 22 nt, Human
acuuucuccagaaaaccaagga

SEQ ID NO: 478182 - RNA, 22 nt, Human
cccagcuugucugauucagccu

SEQ ID NO: 478183 - RNA, 19 nt, Human
ggcagaagguguaggggga

SEQ ID NO: 478184 - RNA, 22 nt, Human
gaauuugaaaagugaugggaau

SEQ ID NO: 478185 - RNA, 22 nt, Human
uugaaaggcacaggcaccuggg

SEQ ID NO: 478186 - RNA, 22 nt, Human
gggcuggcaucgguugcugaga

SEQ ID NO: 478187 - RNA, 22 nt, Human
uccugccugagcguggaggagg

SEQ ID NO: 478188 - RNA, 22 nt, Human
acacugaaugcuguuuagaaau

SEQ ID NO: 478189 - RNA, 22 nt, Human
agagugaaguucaucgugcagc

SEQ ID NO: 478190 - RNA, 22 nt, Human
uugugaguagugccgcaauaaa

SEQ ID NO: 478191 - RNA, 22 nt, Human
uguguacucaauugagccauuu

SEQ ID NO: 478192 - RNA, 22 nt, Human
guguggcugccagccaagaggc

SEQ ID NO: 478193 - RNA, 22 nt, Human
acaauucuggguauuuauauag

SEQ ID NO: 478194 - RNA, 22 nt, Human
acauguuagaaaugcagaaucu

SEQ ID NO: 478195 - RNA, 22 nt, Human
uggcagggccuaccccaauauc

SEQ ID NO: 478196 - RNA, 21 nt, Human
uguaugcacgcacaugcacac

SEQ ID NO: 478197 - RNA, 20 nt, Human
accagguggcugaugacacc

SEQ ID NO: 478198 - RNA, 22 nt, Human
uuuccucuucuggcaggcaggg

SEQ ID NO: 478199 - RNA, 22 nt, Human
aaagggagcauggcugcaggga

SEQ ID NO: 478200 - RNA, 22 nt, Human
auuguacaaugccuggaacauu

SEQ ID NO: 478201 - RNA, 19 nt, Human
ugcauaaauuauauacuuu

SEQ ID NO: 478202 - RNA, 22 nt, Human
cugcccucuagaggaggacuga

SEQ ID NO: 478203 - RNA, 22 nt, Human
gcagggcucugcuguaguccua

SEQ ID NO: 478204 - RNA, 21 nt, Human
ugcccacagcaaaugcagagg

SEQ ID NO: 478205 - RNA, 22 nt, Human
acuugguugaugucauaagguu

SEQ ID NO: 478206 - RNA, 22 nt, Human
agggcccucuggcaggccaggc

SEQ ID NO: 478207 - RNA, 20 nt, Human
agugugcauuuagagucugc

SEQ ID NO: 478208 - RNA, 22 nt, Human
gcagagccaggagcccaggauc

SEQ ID NO: 478209 - RNA, 19 nt, Human
aggcaggugcagagguccc

SEQ ID NO: 478210 - RNA, 22 nt, Human
ccagagggccuuuggaguuauc

SEQ ID NO: 478211 - RNA, 22 nt, Human
caggcccagugaucagggcucu

SEQ ID NO: 478212 - RNA, 22 nt, Human
aagaaaugcagaaaugugcugg

SEQ ID NO: 478213 - RNA, 22 nt, Human
ucauuuauaaggaugcaauuaa

SEQ ID NO: 478214 - RNA, 22 nt, Human
uuugaaguccaucuggcccagu

SEQ ID NO: 478215 - RNA, 22 nt, Human
gaaucacgguauucugcacggg

SEQ ID NO: 478216 - RNA, 22 nt, Human
uaggaaaaauacagaauuauau

SEQ ID NO: 478217 - RNA, 22 nt, Human
ggcugcagaggcgaucugaggu

SEQ ID NO: 478218 - RNA, 22 nt, Human
ccagcugagaaguguaaaguga

SEQ ID NO: 478219 - RNA, 22 nt, Human
gagagcccugcuccuaucccag

SEQ ID NO: 478220 - RNA, 22 nt, Human
gagucccaugaugauagccaca

SEQ ID NO: 478221 - RNA, 22 nt, Human
ggcucaggaccugggauugcca

SEQ ID NO: 478222 - RNA, 22 nt, Human
uggcuucuugggaugggucauu

SEQ ID NO: 478223 - RNA, 22 nt, Human
uucuacacucacccagcuguaa

SEQ ID NO: 478224 - RNA, 19 nt, Human
aucugccuuagugcugcug

SEQ ID NO: 478225 - RNA, 18 nt, Human
cauuaugugguuauagaa

SEQ ID NO: 478226 - RNA, 22 nt, Human
guccucugaaguugugcaaugc

SEQ ID NO: 478227 - RNA, 22 nt, Human
cggggcugcgcucuuccugccg

SEQ ID NO: 478228 - RNA, 22 nt, Human
gaauucugguccuguccaaggu

SEQ ID NO: 478229 - RNA, 22 nt, Human
ucuggccuauuucugucagauc

SEQ ID NO: 478230 - RNA, 22 nt, Human
ccuccagggcagacggggagca

SEQ ID NO: 478231 - RNA, 22 nt, Human
ggccucugccucaucugggcac

SEQ ID NO: 478232 - RNA, 22 nt, Human
cagcaggcguugggagaaagac

SEQ ID NO: 478233 - RNA, 22 nt, Human
ugggcuccagcaccugugcucu

SEQ ID NO: 478234 - RNA, 22 nt, Human
cuucaguuuaucccaucaucca

SEQ ID NO: 478235 - RNA, 20 nt, Human
caggccagagguuugauggc

SEQ ID NO: 478236 - RNA, 22 nt, Human
agcugcugagccaggcugaugu

SEQ ID NO: 478237 - RNA, 22 nt, Human
gagaggcuaugagguucugugu

SEQ ID NO: 478238 - RNA, 22 nt, Human
uugaaagaggcaaaguuugauc

SEQ ID NO: 478239 - RNA, 22 nt, Human
gggcugagccauuugaaccuug

SEQ ID NO: 478240 - RNA, 22 nt, Human
ccuuucucuaucgacccaucgc

SEQ ID NO: 478241 - RNA, 22 nt, Human
uaaauuguuuucuagaaguugu

SEQ ID NO: 478242 - RNA, 22 nt, Human
gcacacccucucaccagcacug

SEQ ID NO: 478243 - RNA, 22 nt, Human
cuggcagcauuaacagagagca

SEQ ID NO: 478244 - RNA, 22 nt, Human
ccugcagggugcugccacagau

SEQ ID NO: 478245 - RNA, 22 nt, Human
ccaggccuuccaguacgcagaa

SEQ ID NO: 478246 - RNA, 20 nt, Human
cuuugccuauucucugccug

SEQ ID NO: 478247 - RNA, 22 nt, Human
acuguggaugccaaaggggagg

SEQ ID NO: 478248 - RNA, 22 nt, Human
auggggcuguucucugcccugc

SEQ ID NO: 478249 - RNA, 22 nt, Human
auucacagggacaaugggagag

SEQ ID NO: 478250 - RNA, 22 nt, Human
agucccaguucgguucuuccuc

SEQ ID NO: 478251 - RNA, 22 nt, Human
ucuagaaauuuugccuuguauu

SEQ ID NO: 478252 - RNA, 22 nt, Human
guacuuccguggacuaauuguu

SEQ ID NO: 478253 - RNA, 19 nt, Human
ccucugccagcccgccucu

SEQ ID NO: 478254 - RNA, 22 nt, Human
caaaugaagaaccuucucaccu

SEQ ID NO: 478255 - RNA, 22 nt, Human
aggucauuuuugccuucuauuu

SEQ ID NO: 478256 - RNA, 22 nt, Human
uaaauguguaaaccuccauuac

SEQ ID NO: 478257 - RNA, 22 nt, Human
ccagcagccaccuucucgaaau

SEQ ID NO: 478258 - RNA, 22 nt, Human
gaggcugaggguuagagaguca

SEQ ID NO: 478259 - RNA, 22 nt, Human
agcaugaaagcauaggacaguc

SEQ ID NO: 478260 - RNA, 22 nt, Human
cauugcugugggcauuugcugc

SEQ ID NO: 478261 - RNA, 22 nt, Human
gccugucaauuuuguguacaau

SEQ ID NO: 478262 - RNA, 22 nt, Human
aaacaugagcauuucuguuuaa

SEQ ID NO: 478263 - RNA, 22 nt, Human
cuccugggcucaagugauccuc

SEQ ID NO: 478264 - RNA, 22 nt, Human
cauuuguauguuccuccuuagg

SEQ ID NO: 478265 - RNA, 22 nt, Human
uucuaguucauauucucaaaga

SEQ ID NO: 478266 - RNA, 22 nt, Human
uggagcagcacaagaaagggga

SEQ ID NO: 478267 - RNA, 20 nt, Human
cucucuggaaggugggagcc

SEQ ID NO: 478268 - RNA, 22 nt, Human
uugcacagaugagggugaugcu

SEQ ID NO: 478269 - RNA, 22 nt, Human
ugggcagcauccuccacaguca

SEQ ID NO: 478270 - RNA, 22 nt, Human
ggagcugcucagagccaguccc

SEQ ID NO: 478271 - RNA, 22 nt, Human
agcuguccuggcucaggcugug

SEQ ID NO: 478272 - RNA, 22 nt, Human
uuguuacacauaauaacauuuu

SEQ ID NO: 478273 - RNA, 22 nt, Human
uuuuuccaccguacuuccugag

SEQ ID NO: 478274 - RNA, 22 nt, Human
ugcuuuauucaggguuuacccc

SEQ ID NO: 478275 - RNA, 22 nt, Human
ucacacacauaaucuaagauua

SEQ ID NO: 478276 - RNA, 22 nt, Human
aagccacuauggugauucucaa

SEQ ID NO: 478277 - RNA, 22 nt, Human
aggcagcauccagaggagaaug

SEQ ID NO: 478278 - RNA, 22 nt, Human
cacucugacuggcccugcagga

SEQ ID NO: 478279 - RNA, 22 nt, Human
cagcuggcagaaccugcaucca

SEQ ID NO: 478280 - RNA, 22 nt, Human
agaggcagcagucauacuacag

SEQ ID NO: 478281 - RNA, 22 nt, Human
ggagcuggucagccuugagcau

SEQ ID NO: 478282 - RNA, 22 nt, Human
ucuggccauggcaagccgagug

SEQ ID NO: 478283 - RNA, 22 nt, Human
uuaugaaagacauuucuguugg

SEQ ID NO: 478284 - RNA, 22 nt, Human
gaggaagaaagcauaggugggg

SEQ ID NO: 478285 - RNA, 22 nt, Human
gccugccuuugugaggaagcgg

SEQ ID NO: 478286 - RNA, 22 nt, Human
caggcaggugcagauuccucuu

SEQ ID NO: 478287 - RNA, 22 nt, Human
gaagggugcauggagggaaguc

SEQ ID NO: 478288 - RNA, 22 nt, Human
caaagacugcauaacacaugaa

SEQ ID NO: 478289 - RNA, 22 nt, Human
ccagggugggaggcugaaggcg

SEQ ID NO: 478290 - RNA, 22 nt, Human
agcugccaucagccuuuggaug

SEQ ID NO: 478291 - RNA, 22 nt, Human
ccugacgaaaggcgugcuggag

SEQ ID NO: 478292 - RNA, 22 nt, Human
gaggccaggagugcuguaaguu

SEQ ID NO: 478293 - RNA, 22 nt, Human
ugcccaggcuccucgcagccuu

SEQ ID NO: 478294 - RNA, 22 nt, Human
gucaugccuggcuucuuagaca

SEQ ID NO: 478295 - RNA, 22 nt, Human
cccagguguuuguggcagaggu

SEQ ID NO: 478296 - RNA, 22 nt, Human
ggcccucccugagccagguggg

SEQ ID NO: 478297 - RNA, 22 nt, Human
ugcagcaggagccaggccuggu

SEQ ID NO: 478298 - RNA, 22 nt, Human
ugccagucucacccuggguccu

SEQ ID NO: 478299 - RNA, 23 nt, Human
ccaaagucgaagucuaguccaga

SEQ ID NO: 478300 - RNA, 22 nt, Human
ugcauaaacagauacuucaugu

SEQ ID NO: 478301 - RNA, 22 nt, Human
ucugcaggccucgacaaggcca

SEQ ID NO: 478302 - RNA, 21 nt, Human
gggugggaggacacagcaggc

SEQ ID NO: 478303 - RNA, 21 nt, Human
gcagggacaaagcuucaggag

SEQ ID NO: 478304 - RNA, 22 nt, Human
uguacauagaucuugaaaauua

SEQ ID NO: 478305 - RNA, 22 nt, Human
ugguaaaguguacugaauauga

SEQ ID NO: 478306 - RNA, 22 nt, Human
agcugcccuggcggagcugcuc

SEQ ID NO: 478307 - RNA, 22 nt, Human
aaaacaggugucagcaaacuau

SEQ ID NO: 478308 - RNA, 22 nt, Human
ggcacugacugugcagcgcacc

SEQ ID NO: 478309 - RNA, 22 nt, Human
ugaggcagaaauuccuguuuuc

SEQ ID NO: 478310 - RNA, 22 nt, Human
cugagcagccccaccagccauu

SEQ ID NO: 478311 - RNA, 22 nt, Human
ugucuguacaaauuuucugugu

SEQ ID NO: 478312 - RNA, 22 nt, Human
ucagagguaguagcagaguuga

SEQ ID NO: 478313 - RNA, 22 nt, Human
aggcaccuugagagcaggagcu

SEQ ID NO: 478314 - RNA, 22 nt, Human
gcuuccuagaucugugguacuc

SEQ ID NO: 478315 - RNA, 22 nt, Human
ccuuucagaugggcauggaccg

SEQ ID NO: 478316 - RNA, 22 nt, Human
cacagcuucugagugaggauuu

SEQ ID NO: 478317 - RNA, 22 nt, Human
caagagcucccagaccugggca

SEQ ID NO: 478318 - RNA, 22 nt, Human
ucagauggcacacagagccugc

SEQ ID NO: 478319 - RNA, 22 nt, Human
ggaggagacggagugauuagug

SEQ ID NO: 478320 - RNA, 22 nt, Human
agcaugcacaugacuggcuuaa

SEQ ID NO: 478321 - RNA, 22 nt, Human
ccagggcaggagaaagacucac

SEQ ID NO: 478322 - RNA, 22 nt, Human
aucuggcucacuuagucuagga

SEQ ID NO: 478323 - RNA, 22 nt, Human
gcugagaguguaggauguuuac

SEQ ID NO: 478324 - RNA, 21 nt, Human
gcugucucuggcuccugggaa

SEQ ID NO: 478325 - RNA, 22 nt, Human
ccagagaguaaacauuuuccgg

SEQ ID NO: 478326 - RNA, 22 nt, Human
auugaggcagcauaguucaggg

SEQ ID NO: 478327 - RNA, 22 nt, Human
aagcugcccuguguuagaguuc

SEQ ID NO: 478328 - RNA, 22 nt, Human
ggcagcuccuccuagucugccc

SEQ ID NO: 478329 - RNA, 22 nt, Human
ugaagcaaacgcuucuguuccu

SEQ ID NO: 478330 - RNA, 22 nt, Human
ggagucccagcaaagccuuccc

SEQ ID NO: 478331 - RNA, 22 nt, Human
agaggucauaucucagaagaga

SEQ ID NO: 478332 - RNA, 22 nt, Human
ugaggcaguauucuccauucca

SEQ ID NO: 478333 - RNA, 22 nt, Human
agagcuguucagcagccagguu

SEQ ID NO: 478334 - RNA, 22 nt, Human
uaccugcacagccagccaugug

SEQ ID NO: 478335 - RNA, 21 nt, Human
auuuccaaggguaccuaagau

SEQ ID NO: 478336 - RNA, 21 nt, Human
uccaggaguggcugggcaggg

SEQ ID NO: 478337 - RNA, 22 nt, Human
cccugagaugccucacccuagu

SEQ ID NO: 478338 - RNA, 22 nt, Human
aucuacaggcugaggugggagg

SEQ ID NO: 478339 - RNA, 22 nt, Human
acugugcuuucucuggaggcau

SEQ ID NO: 478340 - RNA, 22 nt, Human
ucacuggggccuuuggucagga

SEQ ID NO: 478341 - RNA, 19 nt, Human
cuuauuagagugagagcuu

SEQ ID NO: 478342 - RNA, 22 nt, Human
gcuuuguguagaaggaggaugg

SEQ ID NO: 478343 - RNA, 22 nt, Human
auuaaacaauguaaaguucuug

SEQ ID NO: 478344 - RNA, 22 nt, Human
agaugcugucacacacacuguu

SEQ ID NO: 478345 - RNA, 18 nt, Human
caguuuuuauaucuggca

SEQ ID NO: 478346 - RNA, 22 nt, Human
uggcucagagagggagugugga

SEQ ID NO: 478347 - RNA, 22 nt, Human
ggcucagacucccaggcccucu

SEQ ID NO: 478348 - RNA, 22 nt, Human
cugcccugagucaugccagaug

SEQ ID NO: 478349 - RNA, 22 nt, Human
aaaauccucuaauucuagaaua

SEQ ID NO: 478350 - RNA, 22 nt, Human
ugucccauggauaccaggcuau

SEQ ID NO: 478351 - RNA, 22 nt, Human
ggccucuguucugcauuccucc

SEQ ID NO: 478352 - RNA, 22 nt, Human
gcuggugagcaaaggagaagga

SEQ ID NO: 478353 - RNA, 20 nt, Human
ccugccuguguuugugauga

SEQ ID NO: 478354 - RNA, 22 nt, Human
ugggcagacauugaguuuguuc

SEQ ID NO: 478355 - RNA, 22 nt, Human
uaguaacagauuuauacagucu

SEQ ID NO: 478356 - RNA, 22 nt, Human
guggcccugucccaggccuccu

SEQ ID NO: 478357 - RNA, 22 nt, Human
cacaggagagcugggaggugcc

SEQ ID NO: 478358 - RNA, 20 nt, Human
ucagauuuuucuaacuuuga

SEQ ID NO: 478359 - RNA, 22 nt, Human
cuggcagcuggaggcuagaggc

SEQ ID NO: 478360 - RNA, 22 nt, Human
agaccacagucaggcuccuggu

SEQ ID NO: 478361 - RNA, 22 nt, Human
acuccuggguugcaguccucaa

SEQ ID NO: 478362 - RNA, 19 nt, Human
ucaaagcaagcauguucug

SEQ ID NO: 478363 - RNA, 22 nt, Human
ugcucuucggggccacugcuug

SEQ ID NO: 478364 - RNA, 22 nt, Human
aaggcagccgugugacugcaug

SEQ ID NO: 478365 - RNA, 22 nt, Human
ggagcagagcauuucacagccu

SEQ ID NO: 478366 - RNA, 22 nt, Human
cagcagcuuugccaagucagcc

SEQ ID NO: 478367 - RNA, 22 nt, Human
ucacagaaggcaucacagaaga

SEQ ID NO: 478368 - RNA, 22 nt, Human
uucacaggaggguggaugcaug

SEQ ID NO: 478369 - RNA, 22 nt, Human
cucugugagggucuguacagaa

SEQ ID NO: 478370 - RNA, 19 nt, Human
uaguggagugacaaguucu

SEQ ID NO: 478371 - RNA, 22 nt, Human
ggcuggaaguccaagaucaagg

SEQ ID NO: 478372 - RNA, 22 nt, Human
ggaugcuggggaccaaucucug

SEQ ID NO: 478373 - RNA, 22 nt, Human
ucuggcucuguguccccaccca

SEQ ID NO: 478374 - RNA, 22 nt, Human
agggcucuguccccagaggccc

SEQ ID NO: 478375 - RNA, 22 nt, Human
agcagagccaggucucucugua

SEQ ID NO: 478376 - RNA, 22 nt, Human
uggcugggccgggccuugugcc

SEQ ID NO: 478377 - RNA, 22 nt, Human
uggagcagagaugguggccuuc

SEQ ID NO: 478378 - RNA, 22 nt, Human
uugaagcaaggcgaaucuugug

SEQ ID NO: 478379 - RNA, 22 nt, Human
gucuugaucuccugaccuugug

SEQ ID NO: 478380 - RNA, 22 nt, Human
acugaaggaagcgggcaggggu

SEQ ID NO: 478381 - RNA, 22 nt, Human
cauuuagagucuugcaauuuua

SEQ ID NO: 478382 - RNA, 22 nt, Human
aauauaauuuuauuccuagagu

SEQ ID NO: 478383 - RNA, 22 nt, Human
aaguccaucucugccccacaca

SEQ ID NO: 478384 - RNA, 22 nt, Human
ccucuccaguuuuaacgugacc

SEQ ID NO: 478385 - RNA, 22 nt, Human
ccagcugcugugaggaccacag

SEQ ID NO: 478386 - RNA, 22 nt, Human
cagugaggaagcugucuggacc

SEQ ID NO: 478387 - RNA, 22 nt, Human
gauccuugcaacucugugaggu

SEQ ID NO: 478388 - RNA, 22 nt, Human
gucucuuuuauggugaguugau

SEQ ID NO: 478389 - RNA, 22 nt, Human
ucagggcauguauguuucuuua

SEQ ID NO: 478390 - RNA, 22 nt, Human
uuuauuguuguuagucauaagu

SEQ ID NO: 478391 - RNA, 22 nt, Human
gucaccagcaccaaugccacau

SEQ ID NO: 478392 - RNA, 21 nt, Human
ucacaucuauguuaagcaaac

SEQ ID NO: 478393 - RNA, 22 nt, Human
gucaggaugcuauuguuauuaa

SEQ ID NO: 478394 - RNA, 22 nt, Human
ucucugguuauuaacuaacucc

SEQ ID NO: 478395 - RNA, 22 nt, Human
cugaaggacacgugaggagcca

SEQ ID NO: 478396 - RNA, 22 nt, Human
uaaaggcucguauuguugugug

SEQ ID NO: 478397 - RNA, 21 nt, Human
aggcagaaagagcccaggcug

SEQ ID NO: 478398 - RNA, 23 nt, Human
uuguuuuuagagguggcaugaga

SEQ ID NO: 478399 - RNA, 22 nt, Human
cugcuucugggaugauggagua

SEQ ID NO: 478400 - RNA, 22 nt, Human
uuguacuugccauagaacaaca

SEQ ID NO: 478401 - RNA, 22 nt, Human
gcaaaugaguuguaacauaaaa

SEQ ID NO: 478402 - RNA, 22 nt, Human
cuggccuuuuguuucuggagaa

SEQ ID NO: 478403 - RNA, 22 nt, Human
aagggaggaggauuuauuguac

SEQ ID NO: 478404 - RNA, 20 nt, Human
cccucccagaugcuucccaa

SEQ ID NO: 478405 - RNA, 17 nt, Human
cgagggcuugcuggcuc

SEQ ID NO: 478406 - RNA, 22 nt, Human
cauggggagacaccuagggaaa

SEQ ID NO: 478407 - RNA, 22 nt, Human
auguaauuugcccucaaguuaa

SEQ ID NO: 478408 - RNA, 22 nt, Human
ucagcugcucuguugagcugaa

SEQ ID NO: 478409 - RNA, 22 nt, Human
ugagguggcuagggaggcacuc

SEQ ID NO: 478410 - RNA, 22 nt, Human
gaggcaguuugccaugccagga

SEQ ID NO: 478411 - RNA, 22 nt, Human
ucucagggaccaugaugaugac

SEQ ID NO: 478412 - RNA, 22 nt, Human
ccacagggaacaugacagccuu

SEQ ID NO: 478413 - RNA, 22 nt, Human
gccuccuggauuuuagugccau

SEQ ID NO: 478414 - RNA, 22 nt, Human
aaggcugaggagggccugcagg

SEQ ID NO: 478415 - RNA, 23 nt, Human
cauguacacacagcuguacagug

SEQ ID NO: 478416 - RNA, 22 nt, Human
ugaaggaaugagggaguggguc

SEQ ID NO: 478417 - RNA, 22 nt, Human
uuacuuugaugaucaaugagcg

SEQ ID NO: 478418 - RNA, 22 nt, Human
auaccuuuuagacauguaguug

SEQ ID NO: 478419 - RNA, 22 nt, Human
uaugcauagguaucuauacuca

SEQ ID NO: 478420 - RNA, 22 nt, Human
gggaaggagguggcuugaagug

SEQ ID NO: 478421 - RNA, 19 nt, Human
ggaaacaggggccagagga

SEQ ID NO: 478422 - RNA, 22 nt, Human
agccagagcagggaauuggaca

SEQ ID NO: 478423 - RNA, 22 nt, Human
gcuggcucagggacuagaguuu

SEQ ID NO: 478424 - RNA, 22 nt, Human
ggcugugaacccuggcagugug

SEQ ID NO: 478425 - RNA, 22 nt, Human
aaaagcagagacucuggagcua

SEQ ID NO: 478426 - RNA, 20 nt, Human
agcugguuaucuuaauucuu

SEQ ID NO: 478427 - RNA, 22 nt, Human
ucaagagagugcugcuuggggu

SEQ ID NO: 478428 - RNA, 22 nt, Human
gggcugaaaggccgccucagau

SEQ ID NO: 478429 - RNA, 22 nt, Human
uauacuuuccugcaacuuugau

SEQ ID NO: 478430 - RNA, 22 nt, Human
caggaacacaaguucagggaug

SEQ ID NO: 478431 - RNA, 22 nt, Human
ugcuggcccaguauggacugca

SEQ ID NO: 478432 - RNA, 22 nt, Human
gcugccuggcuuuaguccacuu

SEQ ID NO: 478433 - RNA, 22 nt, Human
ugucccaguucccaggguugcu

SEQ ID NO: 478434 - RNA, 22 nt, Human
agggcugaccuaagcuccacuu

SEQ ID NO: 478435 - RNA, 18 nt, Human
gaaaugugauucuagggc

SEQ ID NO: 478436 - RNA, 22 nt, Human
uccaguggugguuugaagggca

SEQ ID NO: 478437 - RNA, 22 nt, Human
ggcagggcccugauuccugggg

SEQ ID NO: 478438 - RNA, 22 nt, Human
ccugggcaacauagugagaccu

SEQ ID NO: 478439 - RNA, 22 nt, Human
uggcagggaauacagauguuua

SEQ ID NO: 478440 - RNA, 22 nt, Human
cagcuccugcagcugcugccgu

SEQ ID NO: 478441 - RNA, 22 nt, Human
gggcauggaggucugucugcag

SEQ ID NO: 478442 - RNA, 22 nt, Human
uuagaaauacaagugagguuga

SEQ ID NO: 478443 - RNA, 22 nt, Human
aaggacuccaauucuuucaucu

SEQ ID NO: 478444 - RNA, 22 nt, Human
gcugagguggagauugcaguga

SEQ ID NO: 478445 - RNA, 22 nt, Human
agauaugacuagaagcucauuu

SEQ ID NO: 478446 - RNA, 22 nt, Human
aaaguucugggggagaagaacg

SEQ ID NO: 478447 - RNA, 22 nt, Human
ugggugaggaugaugaggcagc

SEQ ID NO: 478448 - RNA, 22 nt, Human
gaggcugcuuugaugacaggag

SEQ ID NO: 478449 - RNA, 22 nt, Human
cugggagcggcugucacugguu

SEQ ID NO: 478450 - RNA, 22 nt, Human
uuucuauugaucuaauaaacau

SEQ ID NO: 478451 - RNA, 22 nt, Human
uauuucccagggagcaacaagc

SEQ ID NO: 478452 - RNA, 22 nt, Human
ucaaauguucccuguacuggcc

SEQ ID NO: 478453 - RNA, 22 nt, Human
cuccagugggggugagccuaga

SEQ ID NO: 478454 - RNA, 22 nt, Human
uccucagggcggccuccgucuu

SEQ ID NO: 478455 - RNA, 22 nt, Human
uggcagaguucgcugugccuuu

SEQ ID NO: 478456 - RNA, 22 nt, Human
cccucugcugccuggcuggguc

SEQ ID NO: 478457 - RNA, 22 nt, Human
acugcagacucuacaguuauaa

SEQ ID NO: 478458 - RNA, 22 nt, Human
acuguucauuuguccuguaucu

SEQ ID NO: 478459 - RNA, 21 nt, Human
gcacagcaugaguguuggcau

SEQ ID NO: 478460 - RNA, 22 nt, Human
uggaggugagugugguacagca

SEQ ID NO: 478461 - RNA, 22 nt, Human
augauugaaaaugacauugcca

SEQ ID NO: 478462 - RNA, 22 nt, Human
aacuuuaaggcuauaaauuaug

SEQ ID NO: 478463 - RNA, 22 nt, Human
acugggccggugcagaguaguu

SEQ ID NO: 478464 - RNA, 22 nt, Human
acagguggcauaggcaguuuga

SEQ ID NO: 478465 - RNA, 22 nt, Human
ugcagagguguugcugagauaa

SEQ ID NO: 478466 - RNA, 22 nt, Human
gagccuucaucgcagccuuguu

SEQ ID NO: 478467 - RNA, 22 nt, Human
cuuccucaugugcaaugcaagc

SEQ ID NO: 478468 - RNA, 18 nt, Human
ggcucaggcuauccuaac

SEQ ID NO: 478469 - RNA, 22 nt, Human
uggagcccagacacuggcauug

SEQ ID NO: 478470 - RNA, 22 nt, Human
gggccagugaacaaugagggaa

SEQ ID NO: 478471 - RNA, 22 nt, Human
uggaagcaucacuucuugccug

SEQ ID NO: 478472 - RNA, 22 nt, Human
gcagaggacacaggagggcaag

SEQ ID NO: 478473 - RNA, 22 nt, Human
aacucaguguguuucuuaguau

SEQ ID NO: 478474 - RNA, 22 nt, Human
ucuuugcaugugcuucuuggcc

SEQ ID NO: 478475 - RNA, 22 nt, Human
cacauuucucuaccucacacaa

SEQ ID NO: 478476 - RNA, 22 nt, Human
acauuucugcaucucagagcua

SEQ ID NO: 478477 - RNA, 22 nt, Human
cuuguggcccauggcuuccugc

SEQ ID NO: 478478 - RNA, 22 nt, Human
ggguuucaugguucucacaaug

SEQ ID NO: 478479 - RNA, 22 nt, Human
aaaagagucuuaggcagucaua

SEQ ID NO: 478480 - RNA, 22 nt, Human
ggaggccaggaaggcucggaga

SEQ ID NO: 478481 - RNA, 21 nt, Human
cauugucgacauuuuccccuc

SEQ ID NO: 478482 - RNA, 22 nt, Human
cuggagcccaggccuggugucu

SEQ ID NO: 478483 - RNA, 22 nt, Human
uggcagagagagugcagucgac

SEQ ID NO: 478484 - RNA, 22 nt, Human
accaguccgcggagcuccgggg

SEQ ID NO: 478485 - RNA, 20 nt, Human
acaggagaucugaggaaagg

SEQ ID NO: 478486 - RNA, 22 nt, Human
ggcugccuccucgagacaggau

SEQ ID NO: 478487 - RNA, 22 nt, Human
uucuuucucaacaugaauguuu

SEQ ID NO: 478488 - RNA, 22 nt, Human
cagcaggauagguuucuuugga

SEQ ID NO: 478489 - RNA, 22 nt, Human
uuaaauuuuagaaacagacucu

SEQ ID NO: 478490 - RNA, 20 nt, Human
cugcagggugagugggcgau

SEQ ID NO: 478491 - RNA, 22 nt, Human
auggcaggcccagguguucauu

SEQ ID NO: 478492 - RNA, 22 nt, Human
uccaggcaaggauaauaaacau

SEQ ID NO: 478493 - RNA, 22 nt, Human
ugccucagcugaggccgcucca

SEQ ID NO: 478494 - RNA, 22 nt, Human
ugaaggagcucaaugaugaugc

SEQ ID NO: 478495 - RNA, 22 nt, Human
cagcaucccucaggggccucug

SEQ ID NO: 478496 - RNA, 22 nt, Human
uaauuucuagggacuaaggugc

SEQ ID NO: 478497 - RNA, 22 nt, Human
ucagcuuucuauguugcuaaac

SEQ ID NO: 478498 - RNA, 22 nt, Human
ccagcaggagaugccugugucu

SEQ ID NO: 478499 - RNA, 22 nt, Human
uuccucuccucccaccagguga

SEQ ID NO: 478500 - RNA, 22 nt, Human
uggcaucucaaacaggcagauu

SEQ ID NO: 478501 - RNA, 22 nt, Human
gcugucaggccaugugggccuu

SEQ ID NO: 478502 - RNA, 22 nt, Human
aagaauuuuccagcaugucagu

SEQ ID NO: 478503 - RNA, 22 nt, Human
aaggcacuguacuaguuaguua

SEQ ID NO: 478504 - RNA, 22 nt, Human
ugggcagguuguuauuugacau

SEQ ID NO: 478505 - RNA, 22 nt, Human
gaguggggcccacugcugggug

SEQ ID NO: 478506 - RNA, 20 nt, Human
auugucagccuucagaggag

SEQ ID NO: 478507 - RNA, 22 nt, Human
ggguuccuccaguuccuagagc

SEQ ID NO: 478508 - RNA, 21 nt, Human
ggauggauagggaagagauuu

SEQ ID NO: 478509 - RNA, 22 nt, Human
ggggcaggagcccuucuucagc

SEQ ID NO: 478510 - RNA, 22 nt, Human
aucaggaaauacuuauuuauaa

SEQ ID NO: 478511 - RNA, 22 nt, Human
cugggaggauacacaagaucag

SEQ ID NO: 478512 - RNA, 22 nt, Human
uuuauuuggcauccagggagaa

SEQ ID NO: 478513 - RNA, 22 nt, Human
aagucauuaucucuucuaaucu

SEQ ID NO: 478514 - RNA, 22 nt, Human
agggcugagacuaaggccagau

SEQ ID NO: 478515 - RNA, 22 nt, Human
aggcugagcggggucccagagc

SEQ ID NO: 478516 - RNA, 22 nt, Human
caagagcuggguggcaagcuag

SEQ ID NO: 478517 - RNA, 22 nt, Human
cagcagggggcagcgcagauca

SEQ ID NO: 478518 - RNA, 22 nt, Human
cggucaggugcagcguuggcac

SEQ ID NO: 478519 - RNA, 22 nt, Human
gguggguauaguuagggccucu

SEQ ID NO: 478520 - RNA, 22 nt, Human
ggaccugcccuggcucagaugc

SEQ ID NO: 478521 - RNA, 22 nt, Human
cccagggauuauaaaggugaaa

SEQ ID NO: 478522 - RNA, 22 nt, Human
guuauauauaguauuucucuga

SEQ ID NO: 478523 - RNA, 22 nt, Human
ggcuguggucauuaggagguug

SEQ ID NO: 478524 - RNA, 22 nt, Human
uccauggggcccaggaugagag

SEQ ID NO: 478525 - RNA, 19 nt, Human
ucaaaggcuuuuaggagac

SEQ ID NO: 478526 - RNA, 22 nt, Human
agcaggugggcaugaaagcuga

SEQ ID NO: 478527 - RNA, 22 nt, Human
agcucacagaaauccugcagga

SEQ ID NO: 478528 - RNA, 23 nt, Human
uauuagggccaggacuggcaaau

SEQ ID NO: 478529 - RNA, 18 nt, Human
acaaaggucugcaagacc

SEQ ID NO: 478530 - RNA, 22 nt, Human
gcuggccuuugaggaagcugcg

SEQ ID NO: 478531 - RNA, 22 nt, Human
ccaggagcagauauggacauaa

SEQ ID NO: 478532 - RNA, 22 nt, Human
caagauggaguccgggaaugug

SEQ ID NO: 478533 - RNA, 22 nt, Human
ucagucucuggggcuucuguuu

SEQ ID NO: 478534 - RNA, 22 nt, Human
ugugaaaggagccauagacagu

SEQ ID NO: 478535 - RNA, 22 nt, Human
uuuuugaaggcugaugugauua

SEQ ID NO: 478536 - RNA, 22 nt, Human
ucaguuuucucauuuaugagau

SEQ ID NO: 478537 - RNA, 22 nt, Human
aaauguguuugauaggaauauu

SEQ ID NO: 478538 - RNA, 22 nt, Human
ucucccagaaguccucaguaca

SEQ ID NO: 478539 - RNA, 22 nt, Human
gcugagccccccugcguggguc

SEQ ID NO: 478540 - RNA, 22 nt, Human
ucagcugaaguggagaagcaga

SEQ ID NO: 478541 - RNA, 22 nt, Human
agaagaaaugaggccguucugc

SEQ ID NO: 478542 - RNA, 23 nt, Human
aaguaacagggauaauagcaguu

SEQ ID NO: 478543 - RNA, 22 nt, Human
gcuggcagagacaagaagacua

SEQ ID NO: 478544 - RNA, 22 nt, Human
gggggacuggaccguccugggu

SEQ ID NO: 478545 - RNA, 22 nt, Human
gaggccuggugugucucccgcu

SEQ ID NO: 478546 - RNA, 22 nt, Human
caguagcagggauuauuuuagg

SEQ ID NO: 478547 - RNA, 23 nt, Human
uggcucugugucacauacaggau

SEQ ID NO: 478548 - RNA, 22 nt, Human
ucccagagcccaaguuggagag

SEQ ID NO: 478549 - RNA, 21 nt, Human
ccuggcagaagccugauaugc

SEQ ID NO: 478550 - RNA, 22 nt, Human
gaaggcugagcagacaggccaa

SEQ ID NO: 478551 - RNA, 22 nt, Human
gcugcuucucugauggagucca

SEQ ID NO: 478552 - RNA, 19 nt, Human
ugcagccacgugagagacu

SEQ ID NO: 478553 - RNA, 22 nt, Human
agcugcugagagucugccgggc

SEQ ID NO: 478554 - RNA, 22 nt, Human
agagcugccgagcuggggccau

SEQ ID NO: 478555 - RNA, 22 nt, Human
agagcugugaaaaugagguuug

SEQ ID NO: 478556 - RNA, 22 nt, Human
ucagcuuugggggucucaggag

SEQ ID NO: 478557 - RNA, 22 nt, Human
agggaggcaggaaaguugucug

SEQ ID NO: 478558 - RNA, 22 nt, Human
uggcagaaguucacuaguagcu

SEQ ID NO: 478559 - RNA, 22 nt, Human
uccagccuaggggaacagcugc

SEQ ID NO: 478560 - RNA, 22 nt, Human
cucugcauuuuaacagaugauu

SEQ ID NO: 478561 - RNA, 22 nt, Human
acugucuuccaggucuggaggu

SEQ ID NO: 478562 - RNA, 22 nt, Human
ucagggcaaugucccucagaag

SEQ ID NO: 478563 - RNA, 22 nt, Human
ugcacacaguucucaggaaaga

SEQ ID NO: 478564 - RNA, 22 nt, Human
guggccuggauagacuccaucu

SEQ ID NO: 478565 - RNA, 22 nt, Human
uaugugaauacagcaguggaug

SEQ ID NO: 478566 - RNA, 22 nt, Human
cacugcccagcgucuuaggcac

SEQ ID NO: 478567 - RNA, 22 nt, Human
uguauuagagcaguagaauuau

SEQ ID NO: 478568 - RNA, 22 nt, Human
cuggaagaggaagccagcugga

SEQ ID NO: 478569 - RNA, 22 nt, Human
gcugccuugaacuuggccuggg

SEQ ID NO: 478570 - RNA, 22 nt, Human
cucugugcccuacugcucagcu

SEQ ID NO: 478571 - RNA, 21 nt, Human
ugggcagauggcaguguggcu

SEQ ID NO: 478572 - RNA, 22 nt, Human
ucagagugaggcgucaacauga

SEQ ID NO: 478573 - RNA, 22 nt, Human
ggcaggcugcuugggucauguc

SEQ ID NO: 478574 - RNA, 22 nt, Human
cagagggcucuuggcugccugc

SEQ ID NO: 478575 - RNA, 22 nt, Human
ccugggcauucuuugaguucuc

SEQ ID NO: 478576 - RNA, 22 nt, Human
aggcugcagugcagguaggauu

SEQ ID NO: 478577 - RNA, 22 nt, Human
gagcacccuuugcacaucaguc

SEQ ID NO: 478578 - RNA, 22 nt, Human
ugaaaaggagccuuagguaggu

SEQ ID NO: 478579 - RNA, 22 nt, Human
uccagaccaugugagaggcgca

SEQ ID NO: 478580 - RNA, 22 nt, Human
augauggugagguugagcacag

SEQ ID NO: 478581 - RNA, 22 nt, Human
cuuuauuccuacaagauuuucu

SEQ ID NO: 478582 - RNA, 22 nt, Human
gcagcugccgugagcucacgcc

SEQ ID NO: 478583 - RNA, 22 nt, Human
uugacagcuauuuugcuuugau

SEQ ID NO: 478584 - RNA, 22 nt, Human
cugcucugaagccaggauucug

SEQ ID NO: 478585 - RNA, 22 nt, Human
gccugagaaggauaggaagcga

SEQ ID NO: 478586 - RNA, 22 nt, Human
cucugaagggagggccaagccc

SEQ ID NO: 478587 - RNA, 22 nt, Human
ccuggcucucugcagauccugg

SEQ ID NO: 478588 - RNA, 22 nt, Human
ggagugucagaaacaguguccu

SEQ ID NO: 478589 - RNA, 22 nt, Human
ucaauucaacacaugcacauug

SEQ ID NO: 478590 - RNA, 22 nt, Human
aagaguuuucuauaaucuuggc

SEQ ID NO: 478591 - RNA, 22 nt, Human
cugggagguggagguugcauug

SEQ ID NO: 478592 - RNA, 22 nt, Human
cccaggaccgcgcggcugagcg

SEQ ID NO: 478593 - RNA, 19 nt, Human
aaaaggaauauucuuuggg

SEQ ID NO: 478594 - RNA, 22 nt, Human
ucuuuccuguaacugcuguuca

SEQ ID NO: 478595 - RNA, 22 nt, Human
ugggcagacuaaggucaaagcu

SEQ ID NO: 478596 - RNA, 22 nt, Human
uccauucauucauugaugaaca

SEQ ID NO: 478597 - RNA, 22 nt, Human
ggagccaggcaaucuguacuuu

SEQ ID NO: 478598 - RNA, 22 nt, Human
aauguuaaaaccuucagugcuu

SEQ ID NO: 478599 - RNA, 22 nt, Human
caaggaaaaagcgagcucgggg

SEQ ID NO: 478600 - RNA, 23 nt, Human
agacccagagacuggcucugcuc

SEQ ID NO: 478601 - RNA, 22 nt, Human
uagggcucugcucaucaguugu

SEQ ID NO: 478602 - RNA, 22 nt, Human
ggccugcugacccaaguccugu

SEQ ID NO: 478603 - RNA, 22 nt, Human
ugucccuggaacuauggcucca

SEQ ID NO: 478604 - RNA, 22 nt, Human
ccucacagggccaggccccuca

SEQ ID NO: 478605 - RNA, 22 nt, Human
guggguggaggcgucgagggca

SEQ ID NO: 478606 - RNA, 22 nt, Human
uuaugacauaugaguacaagua

SEQ ID NO: 478607 - RNA, 22 nt, Human
acuuccugcaaucguccacucc

SEQ ID NO: 478608 - RNA, 22 nt, Human
ccucaggggcuuuucguuguug

SEQ ID NO: 478609 - RNA, 20 nt, Human
gcacugaagguuccagggga

SEQ ID NO: 478610 - RNA, 22 nt, Human
uagccaggucacacuguguguu

SEQ ID NO: 478611 - RNA, 22 nt, Human
ugccaggccucaggagucucca

SEQ ID NO: 478612 - RNA, 22 nt, Human
guaaucucagcuacuugggagg

SEQ ID NO: 478613 - RNA, 22 nt, Human
uggaagcagugauucuugucug

SEQ ID NO: 478614 - RNA, 22 nt, Human
ugccugaguuuaacccucagag

SEQ ID NO: 478615 - RNA, 22 nt, Human
guucaaagcuccugguacagua

SEQ ID NO: 478616 - RNA, 22 nt, Human
cugggcagguauacaaaaaaug

SEQ ID NO: 478617 - RNA, 20 nt, Human
aaaagcagccagagauggua

SEQ ID NO: 478618 - RNA, 22 nt, Human
uuccauaaaggugauaguauac

SEQ ID NO: 478619 - RNA, 22 nt, Human
ugaaagggguugaguuacagcu

SEQ ID NO: 478620 - RNA, 22 nt, Human
acucaggaaaugaagacugguu

SEQ ID NO: 478621 - RNA, 22 nt, Human
uuuuccucugcaauaaaagcag

SEQ ID NO: 478622 - RNA, 22 nt, Human
uuggcuucucuuaacccuaaag

SEQ ID NO: 478623 - RNA, 22 nt, Human
ugggcuccggcggccucaggcu

SEQ ID NO: 478624 - RNA, 22 nt, Human
aaauuucuugaggcucucuagc

SEQ ID NO: 478625 - RNA, 22 nt, Human
aacaugaaacccaaacagaaua

SEQ ID NO: 478626 - RNA, 22 nt, Human
acagaguacauucagagacuau

SEQ ID NO: 478627 - RNA, 22 nt, Human
uacauaguauucacauuguuuu

SEQ ID NO: 478628 - RNA, 22 nt, Human
aagauucuacaguagguacauu

SEQ ID NO: 478629 - RNA, 22 nt, Human
gcucccuccaugaggcagaccg

SEQ ID NO: 478630 - RNA, 22 nt, Human
ccuguacuagggucucauugcc

SEQ ID NO: 478631 - RNA, 22 nt, Human
gagcugugagggacacauugcu

SEQ ID NO: 478632 - RNA, 23 nt, Human
uugcauguagcccaugaguaacu

SEQ ID NO: 478633 - RNA, 22 nt, Human
agugaaaugacugaaucagaua

SEQ ID NO: 478634 - RNA, 22 nt, Human
gcugagucuugagcacugagca

SEQ ID NO: 478635 - RNA, 22 nt, Human
uuucacauucagauauagacuu

SEQ ID NO: 478636 - RNA, 22 nt, Human
ggcucugcagugacuugagggg

SEQ ID NO: 478637 - RNA, 22 nt, Human
ugucaccagcugcuccucagga

SEQ ID NO: 478638 - RNA, 22 nt, Human
cugugcaagcccaagauaaaac

SEQ ID NO: 478639 - RNA, 22 nt, Human
agcagugggugacagagcugag

SEQ ID NO: 478640 - RNA, 22 nt, Human
acaggccacaguggagucucug

SEQ ID NO: 478641 - RNA, 22 nt, Human
cacagcuuaugccacugauugg

SEQ ID NO: 478642 - RNA, 22 nt, Human
gaggcacauauauacagagccc

SEQ ID NO: 478643 - RNA, 22 nt, Human
accaucagagcacaguccgugc

SEQ ID NO: 478644 - RNA, 22 nt, Human
caggaggaaaugugacccugcu

SEQ ID NO: 478645 - RNA, 22 nt, Human
uccucuggggucagggcacuac

SEQ ID NO: 478646 - RNA, 22 nt, Human
uuauuuugagagaaugugugcu

SEQ ID NO: 478647 - RNA, 22 nt, Human
agcauugccugccuauugcuaa

SEQ ID NO: 478648 - RNA, 22 nt, Human
ugucccauggacacaacuucuu

SEQ ID NO: 478649 - RNA, 22 nt, Human
cuuuggcaaugaaacacaagaa

SEQ ID NO: 478650 - RNA, 22 nt, Human
aggcucauucuugccucugagc

SEQ ID NO: 478651 - RNA, 22 nt, Human
caggacccaaccucccugcucu

SEQ ID NO: 478652 - RNA, 22 nt, Human
guucauauuacuuugagugcag

SEQ ID NO: 478653 - RNA, 22 nt, Human
acagccagguaaaggcauggca

SEQ ID NO: 478654 - RNA, 22 nt, Human
agcagggggccacagucacagc

SEQ ID NO: 478655 - RNA, 22 nt, Human
gcaggauggugcccuuucugcc

SEQ ID NO: 478656 - RNA, 20 nt, Human
uacauucaaaacaaacucug

SEQ ID NO: 478657 - RNA, 20 nt, Human
caucagugccugacaggucc

SEQ ID NO: 478658 - RNA, 23 nt, Human
uagggcagcugggagggacaugc

SEQ ID NO: 478659 - RNA, 22 nt, Human
acauucuagaagucuuugcaau

SEQ ID NO: 478660 - RNA, 22 nt, Human
ccucccugcgcuccugcggcgg

SEQ ID NO: 478661 - RNA, 22 nt, Human
aacaaauguguggcaguguggg

SEQ ID NO: 478662 - RNA, 22 nt, Human
cagcucccagagugaccagcag

SEQ ID NO: 478663 - RNA, 22 nt, Human
caggagcagaggguggucagca

SEQ ID NO: 478664 - RNA, 22 nt, Human
acauaccauacauggugagaug

SEQ ID NO: 478665 - RNA, 22 nt, Human
uggcccugcuuaugucucucuu

SEQ ID NO: 478666 - RNA, 22 nt, Human
cugugcugauucagcacaggcc

SEQ ID NO: 478667 - RNA, 22 nt, Human
gcugagcuagaaaaggaccaca

SEQ ID NO: 478668 - RNA, 22 nt, Human
gccugcagggugaugggcugcc

SEQ ID NO: 478669 - RNA, 22 nt, Human
cugugugugucugcagcauacu

SEQ ID NO: 478670 - RNA, 22 nt, Human
uugaaagaagaagcugcgaugu

SEQ ID NO: 478671 - RNA, 22 nt, Human
gcugagagugagcacuggauau

SEQ ID NO: 478672 - RNA, 17 nt, Human
cacaggugugguuugag

SEQ ID NO: 478673 - RNA, 22 nt, Human
uggcagcugaggggaggcuuug

SEQ ID NO: 478674 - RNA, 22 nt, Human
guggcagcugguaugcagacag

SEQ ID NO: 478675 - RNA, 22 nt, Human
cagagcucuauguucauggagg

SEQ ID NO: 478676 - RNA, 22 nt, Human
gauggcagcagcagccagggau

SEQ ID NO: 478677 - RNA, 22 nt, Human
aaggcugauuagacugauagcu

SEQ ID NO: 478678 - RNA, 22 nt, Human
agcaggcagccauuuggaaggc

SEQ ID NO: 478679 - RNA, 22 nt, Human
aucucagggcuggagcccugga

SEQ ID NO: 478680 - RNA, 22 nt, Human
agaagcagcuuucaaggugauu

SEQ ID NO: 478681 - RNA, 22 nt, Human
cucuuaaauaacaucauugcuu

SEQ ID NO: 478682 - RNA, 22 nt, Human
cacaguggcagguguggguugu

SEQ ID NO: 478683 - RNA, 22 nt, Human
uggcagcaauuagcuagagcug

SEQ ID NO: 478684 - RNA, 22 nt, Human
cccaggucccgccccagcucua

SEQ ID NO: 478685 - RNA, 22 nt, Human
ggcuucccagcagagggcgcac

SEQ ID NO: 478686 - RNA, 22 nt, Human
gggcugacucugcacugagcca

SEQ ID NO: 478687 - RNA, 22 nt, Human
augcagagacagauguggcaug

SEQ ID NO: 478688 - RNA, 18 nt, Human
uuucacagauucaugacu

SEQ ID NO: 478689 - RNA, 22 nt, Human
aaggccugcucagcugucugug

SEQ ID NO: 478690 - RNA, 22 nt, Human
uucugaaaggcagguuguuugc

SEQ ID NO: 478691 - RNA, 22 nt, Human
agacagagauacuauguuguca

SEQ ID NO: 478692 - RNA, 22 nt, Human
uuucuguaauuaaaagggcagg

SEQ ID NO: 478693 - RNA, 22 nt, Human
uccuugaaugaauguucucucc

SEQ ID NO: 478694 - RNA, 22 nt, Human
gcucucuggguggugggcaaca

SEQ ID NO: 478695 - RNA, 22 nt, Human
ggccucucauguccugggcuuc

SEQ ID NO: 478696 - RNA, 22 nt, Human
acuuugcagggcuugauaucca

SEQ ID NO: 478697 - RNA, 23 nt, Human
ggggaaguggcagugagugaggc

SEQ ID NO: 478698 - RNA, 22 nt, Human
cuuauguaaaacggaaagggaa

SEQ ID NO: 478699 - RNA, 22 nt, Human
aaguucaagaucaagguuccag

SEQ ID NO: 478700 - RNA, 22 nt, Human
aaggcacugagccagccgucuc

SEQ ID NO: 478701 - RNA, 22 nt, Human
uggaggccagagguacugggac

SEQ ID NO: 478702 - RNA, 22 nt, Human
gccugccuucggugcgcagcgg

SEQ ID NO: 478703 - RNA, 22 nt, Human
agggucagggagugaguauuua

SEQ ID NO: 478704 - RNA, 22 nt, Human
ucaguuuuguauguuguaaguc

SEQ ID NO: 478705 - RNA, 21 nt, Human
aggugcagagccagggaccag

SEQ ID NO: 478706 - RNA, 22 nt, Human
gggcugaggaacauauuuuguu

SEQ ID NO: 478707 - RNA, 22 nt, Human
aucacaaaggcugcuucaugau

SEQ ID NO: 478708 - RNA, 22 nt, Human
ccuggaggagcgcugaccagcu

SEQ ID NO: 478709 - RNA, 22 nt, Human
agcccaaggcuucccugcuggc

SEQ ID NO: 478710 - RNA, 22 nt, Human
acaguggaagaagcacugaacu

SEQ ID NO: 478711 - RNA, 22 nt, Human
uucuggaggccccuuccuucuc

SEQ ID NO: 478712 - RNA, 22 nt, Human
acuuggcaaguaucuauaaagu

SEQ ID NO: 478713 - RNA, 22 nt, Human
ugaauaaucuuggguauuaaua

SEQ ID NO: 478714 - RNA, 22 nt, Human
cugcaggggccucgagcacagg

SEQ ID NO: 478715 - RNA, 22 nt, Human
auugacaauguauuuguaucug

SEQ ID NO: 478716 - RNA, 22 nt, Human
uuacauuuggcuauguccucua

SEQ ID NO: 478717 - RNA, 22 nt, Human
aaggaagacuugagaagguucc

SEQ ID NO: 478718 - RNA, 22 nt, Human
cugggcagaauuuuaggauggc

SEQ ID NO: 478719 - RNA, 21 nt, Human
ugagccaggcugacggcugug

SEQ ID NO: 478720 - RNA, 22 nt, Human
caggguggaaaagcuaguugga

SEQ ID NO: 478721 - RNA, 22 nt, Human
cccucccaggaguggccagaga

SEQ ID NO: 478722 - RNA, 22 nt, Human
ggcacucagagauucaggcugu

SEQ ID NO: 478723 - RNA, 22 nt, Human
gccuuucaguuccaucaaagga

SEQ ID NO: 478724 - RNA, 22 nt, Human
auuuguacaaauuuauguuagu

SEQ ID NO: 478725 - RNA, 22 nt, Human
augggcugugagguccggcagg

SEQ ID NO: 478726 - RNA, 22 nt, Human
cagcugaagaaagagugguuag

SEQ ID NO: 478727 - RNA, 22 nt, Human
cgugagcaaaauggacacuccc

SEQ ID NO: 478728 - RNA, 22 nt, Human
gagucgagcagaaagccgucgg

SEQ ID NO: 478729 - RNA, 22 nt, Human
aaugaacaggugaaugucagau

SEQ ID NO: 478730 - RNA, 21 nt, Human
uuacuuuugcaccaaccuaau

SEQ ID NO: 478731 - RNA, 22 nt, Human
cuuacauuuaaucaugugucau

SEQ ID NO: 478732 - RNA, 15 nt, Human
uucaggauaugacuc

SEQ ID NO: 478733 - RNA, 20 nt, Human
ugugugcacacaugacauuc

SEQ ID NO: 478734 - RNA, 22 nt, Human
agccugucugucuccaaagcug

SEQ ID NO: 478735 - RNA, 22 nt, Human
gccugccuggagcuugagguga

SEQ ID NO: 478736 - RNA, 23 nt, Human
ugaagugaaauuucacaagggac

SEQ ID NO: 478737 - RNA, 22 nt, Human
gugugcagcagagacaggacuc

SEQ ID NO: 478738 - RNA, 17 nt, Human
ggugagaccucccacuc

SEQ ID NO: 478739 - RNA, 22 nt, Human
aaaauacacauacuaggggaaa

SEQ ID NO: 478740 - RNA, 22 nt, Human
caggaugagaggcccagggaag

SEQ ID NO: 478741 - RNA, 22 nt, Human
cacacaggaugaagcagcagaa

SEQ ID NO: 478742 - RNA, 22 nt, Human
uuuaagaugguauuuuauaaag

SEQ ID NO: 478743 - RNA, 19 nt, Human
ccugggagucagcugaagg

SEQ ID NO: 478744 - RNA, 22 nt, Human
cuucagaggggacucaaaguca

SEQ ID NO: 478745 - RNA, 22 nt, Human
ugggccugggucuuugcugcca

SEQ ID NO: 478746 - RNA, 22 nt, Human
cauagcaacagcaucaagucaa

SEQ ID NO: 478747 - RNA, 22 nt, Human
ugaggcaggacauggacaacug

SEQ ID NO: 478748 - RNA, 23 nt, Human
ucucaggacacacaugucuauca

SEQ ID NO: 478749 - RNA, 22 nt, Human
aaggcagcaccgccuccugaaa

SEQ ID NO: 478750 - RNA, 22 nt, Human
uguagcacagagcuuugacacu

SEQ ID NO: 478751 - RNA, 22 nt, Human
ucacagggauggaauagaaaua

SEQ ID NO: 478752 - RNA, 22 nt, Human
gaggccaaguuggagaccaggu

SEQ ID NO: 478753 - RNA, 20 nt, Human
ucauugcacauaauggaagc

SEQ ID NO: 478754 - RNA, 22 nt, Human
uguaauggaagugggauugcau

SEQ ID NO: 478755 - RNA, 22 nt, Human
uggggccuggucagagcugcac

SEQ ID NO: 478756 - RNA, 17 nt, Human
gcugcagcgguaggcag

SEQ ID NO: 478757 - RNA, 22 nt, Human
gcauuuaaauuugaacuucaga

SEQ ID NO: 478758 - RNA, 22 nt, Human
ggcagcuccaaaaggaaacacu

SEQ ID NO: 478759 - RNA, 22 nt, Human
cuggagugaggucugggagccu

SEQ ID NO: 478760 - RNA, 22 nt, Human
ucagcuccucaugcaggggaua

SEQ ID NO: 478761 - RNA, 22 nt, Human
ccagggcagccaacccagaugc

SEQ ID NO: 478762 - RNA, 22 nt, Human
cuacagacccaccuuggaagaa

SEQ ID NO: 478763 - RNA, 22 nt, Human
caaaauucugcauuucuaauaa

SEQ ID NO: 478764 - RNA, 22 nt, Human
ggagccaggggaccuucacaga

SEQ ID NO: 478765 - RNA, 18 nt, Human
gagagcugcuaccuagcu

SEQ ID NO: 478766 - RNA, 22 nt, Human
ggcagcuccucucagcaaaaga

SEQ ID NO: 478767 - RNA, 22 nt, Human
ggugugccuggggcuuagcugc

SEQ ID NO: 478768 - RNA, 22 nt, Human
guggguggaucaccugagguca

SEQ ID NO: 478769 - RNA, 22 nt, Human
uuuuccucuguuauuaguguga

SEQ ID NO: 478770 - RNA, 22 nt, Human
accagagcucuucagcacagga

SEQ ID NO: 478771 - RNA, 22 nt, Human
ccaggcuggauuuugcaguuca

SEQ ID NO: 478772 - RNA, 22 nt, Human
aaaacucugcaguuaguuucua

SEQ ID NO: 478773 - RNA, 22 nt, Human
ugcagugguugagagcccagac

SEQ ID NO: 478774 - RNA, 22 nt, Human
uuaaugcuugucuagaucuucu

SEQ ID NO: 478775 - RNA, 23 nt, Human
cacacccaucacuaagagcuccu

SEQ ID NO: 478776 - RNA, 19 nt, Human
ugaggccaaggucacagau

SEQ ID NO: 478777 - RNA, 19 nt, Human
agaaaucucgagauuuguu

SEQ ID NO: 478778 - RNA, 22 nt, Human
uacaaaugaaccaacuuugaug

SEQ ID NO: 478779 - RNA, 22 nt, Human
uauguguuugacacccugcaag

SEQ ID NO: 478780 - RNA, 22 nt, Human
gccugcagccucaagggcugag

SEQ ID NO: 478781 - RNA, 22 nt, Human
uggccuggggaccugugagacc

SEQ ID NO: 478782 - RNA, 22 nt, Human
auguccaggaucuauccccaga

SEQ ID NO: 478783 - RNA, 22 nt, Human
cagggcuguggcuuugugcugu

SEQ ID NO: 478784 - RNA, 23 nt, Human
uagagcagggaaaucugucagag

SEQ ID NO: 478785 - RNA, 22 nt, Human
uuuucauuguaaaucaggaaac

SEQ ID NO: 478786 - RNA, 17 nt, Human
ugcauuguaggcuagcc

SEQ ID NO: 478787 - RNA, 22 nt, Human
agcuucuggaagccuggcagca

SEQ ID NO: 478788 - RNA, 22 nt, Human
ucaucaaagucaaagaaugacu

SEQ ID NO: 478789 - RNA, 22 nt, Human
cuggugggagcagcaggcagcu

SEQ ID NO: 478790 - RNA, 22 nt, Human
ugcaggagaaaguacggagcgu

SEQ ID NO: 478791 - RNA, 22 nt, Human
aucaggaaugaauacuuuugga

SEQ ID NO: 478792 - RNA, 22 nt, Human
uggaguuccuuugaaaggcucu

SEQ ID NO: 478793 - RNA, 22 nt, Human
cagggcucccucuggcucccag

SEQ ID NO: 478794 - RNA, 22 nt, Human
cugucccaggagcuguaagaca

SEQ ID NO: 478795 - RNA, 22 nt, Human
uagcagggucucaggagucagg

SEQ ID NO: 478796 - RNA, 22 nt, Human
ugggagcugggguuggacgucu

SEQ ID NO: 478797 - RNA, 22 nt, Human
guucagcccacagagggggccg

SEQ ID NO: 478798 - RNA, 22 nt, Human
uggcuccaucauccaugcaaga

SEQ ID NO: 478799 - RNA, 18 nt, Human
ugcuuuaugcuuauauaa

SEQ ID NO: 478800 - RNA, 22 nt, Human
gccagggggucagcaggcacuu

SEQ ID NO: 478801 - RNA, 22 nt, Human
cccaggugggcaccucgaggaa

SEQ ID NO: 478802 - RNA, 22 nt, Human
uaagugcaauguuuuacuuaaa

SEQ ID NO: 478803 - RNA, 20 nt, Human
auuccauaguuggcacuuuu

SEQ ID NO: 478804 - RNA, 22 nt, Human
gugcaggagguaacauagcaaa

SEQ ID NO: 478805 - RNA, 22 nt, Human
aggugaaguugaggaggcagaa

SEQ ID NO: 478806 - RNA, 22 nt, Human
caggacaguuugcuuugcccug

SEQ ID NO: 478807 - RNA, 22 nt, Human
gggcugagggccaauuccuacu

SEQ ID NO: 478808 - RNA, 23 nt, Human
aggagccaggaaccagcuucccc

SEQ ID NO: 478809 - RNA, 17 nt, Human
cagugaggccuuuccuc

SEQ ID NO: 478810 - RNA, 21 nt, Human
agcagccauuucacagagacu

SEQ ID NO: 478811 - RNA, 22 nt, Human
aagccaggggcugcuuaggaga

SEQ ID NO: 478812 - RNA, 22 nt, Human
accaaggaagaaucuauuugag

SEQ ID NO: 478813 - RNA, 22 nt, Human
ugcugucuguuuacuggcuaua

SEQ ID NO: 478814 - RNA, 23 nt, Human
acaugggagggacauggaggcug

SEQ ID NO: 478815 - RNA, 22 nt, Human
uccagcuugacaaaugauuuua

SEQ ID NO: 478816 - RNA, 22 nt, Human
uucacauugguucuugauagcu

SEQ ID NO: 478817 - RNA, 22 nt, Human
ucuggcucaaaauacguacucu

SEQ ID NO: 478818 - RNA, 22 nt, Human
aggagggcuaggaaaaccagga

SEQ ID NO: 478819 - RNA, 22 nt, Human
uccagucaucucccuucacauu

SEQ ID NO: 478820 - RNA, 22 nt, Human
uggaaagaugaagauguuuaag

SEQ ID NO: 478821 - RNA, 22 nt, Human
uucuuucacucaagaaggaucu

SEQ ID NO: 478822 - RNA, 22 nt, Human
ucaggaugagcucauaacuaug

SEQ ID NO: 478823 - RNA, 22 nt, Human
guggcugcuguccucucugguu

SEQ ID NO: 478824 - RNA, 22 nt, Human
gcucuguccagcgugcacagaa

SEQ ID NO: 478825 - RNA, 22 nt, Human
aauauuuguuaguguuuuaaug

SEQ ID NO: 478826 - RNA, 22 nt, Human
agggucuguggaugcaucuggg

SEQ ID NO: 478827 - RNA, 22 nt, Human
ccugggcagguguggcuucccc

SEQ ID NO: 478828 - RNA, 22 nt, Human
ggcuucugguaaagaccacacc

SEQ ID NO: 478829 - RNA, 21 nt, Human
ugcuuuaugggaaaaauguca

SEQ ID NO: 478830 - RNA, 22 nt, Human
agccuggauccauguggcuacc

SEQ ID NO: 478831 - RNA, 22 nt, Human
cccugccuuguuggagccuaug

SEQ ID NO: 478832 - RNA, 20 nt, Human
acaauauguagaugaauagc

SEQ ID NO: 478833 - RNA, 22 nt, Human
ucagaguguuuuacuaaacaag

SEQ ID NO: 478834 - RNA, 22 nt, Human
gcuaggagauugagcucugaag

SEQ ID NO: 478835 - RNA, 22 nt, Human
cugagccuguguuucucuggca

SEQ ID NO: 478836 - RNA, 22 nt, Human
ucaccugggagggcugugguag

SEQ ID NO: 478837 - RNA, 19 nt, Human
agccagugagccucugggu

SEQ ID NO: 478838 - RNA, 22 nt, Human
gccuccugagaagccacaggcu

SEQ ID NO: 478839 - RNA, 22 nt, Human
ugaugaaaauaugauucugagg

SEQ ID NO: 478840 - RNA, 22 nt, Human
caaaguuaugaaugauaagauu

SEQ ID NO: 478841 - RNA, 22 nt, Human
aggcucagugauguaaaauaua

SEQ ID NO: 478842 - RNA, 22 nt, Human
ucacuuagauggggaucaucac

SEQ ID NO: 478843 - RNA, 22 nt, Human
aaaugucuuucuucugcuacgu

SEQ ID NO: 478844 - RNA, 22 nt, Human
agacaaaggauuaaugaugaug

SEQ ID NO: 478845 - RNA, 22 nt, Human
gggagggaaggaggcgccgugu

SEQ ID NO: 478846 - RNA, 22 nt, Human
gcacggcuaauuuuuguauuuu

SEQ ID NO: 478847 - RNA, 22 nt, Human
ucauaaaacacaccagguaguu

SEQ ID NO: 478848 - RNA, 22 nt, Human
cagccuucugaaugaacguacu

SEQ ID NO: 478849 - RNA, 22 nt, Human
ucccuggaacagagagacaacg

SEQ ID NO: 478850 - RNA, 22 nt, Human
ugaacgcagguccacauggcuc

SEQ ID NO: 478851 - RNA, 22 nt, Human
agucuucccugugccagagugu

SEQ ID NO: 478852 - RNA, 22 nt, Human
cagcucucuaaggucuugcuuu

SEQ ID NO: 478853 - RNA, 22 nt, Human
cuguauuuucaugccuacguac

SEQ ID NO: 478854 - RNA, 22 nt, Human
ucugucacuuauuaagauggau

SEQ ID NO: 478855 - RNA, 22 nt, Human
augcaguaaauguuaagaaaaa

SEQ ID NO: 478856 - RNA, 22 nt, Human
ggcccagaauacuuuguaaaau

SEQ ID NO: 478857 - RNA, 22 nt, Human
cagagcuggacuuaaauauauu

SEQ ID NO: 478858 - RNA, 22 nt, Human
ccaggcugcuuagccuuaucuu

SEQ ID NO: 478859 - RNA, 22 nt, Human
uguaagauauucagcuuauuga

SEQ ID NO: 478860 - RNA, 22 nt, Human
uaaguuuucuggaauaacuugg

SEQ ID NO: 478861 - RNA, 22 nt, Human
guggcagcaaaauccugcauuc

SEQ ID NO: 478862 - RNA, 22 nt, Human
gcagugcuuuagucuguccuuu

SEQ ID NO: 478863 - RNA, 22 nt, Human
ugucucuggcccaugagcagag

SEQ ID NO: 478864 - RNA, 22 nt, Human
uuggccuuaaccucucugugcc

SEQ ID NO: 478865 - RNA, 21 nt, Human
ugccagggauuuacagagccu

SEQ ID NO: 478866 - RNA, 22 nt, Human
cucagagagggcaccagggcca

SEQ ID NO: 478867 - RNA, 22 nt, Human
gggacccugggaggcuggcgca

SEQ ID NO: 478868 - RNA, 22 nt, Human
ccagugccugugggcauggugc

SEQ ID NO: 478869 - RNA, 20 nt, Human
cagcaguggaugagaguuuu

SEQ ID NO: 478870 - RNA, 22 nt, Human
auccuucaaggggcugacagcu

SEQ ID NO: 478871 - RNA, 20 nt, Human
uguuucuuuuaaugagcggc

SEQ ID NO: 478872 - RNA, 22 nt, Human
ccagcugcccaagaggcauccu

SEQ ID NO: 478873 - RNA, 22 nt, Human
aagugauuucugccugcauguu

SEQ ID NO: 478874 - RNA, 22 nt, Human
uugaggagcaggaugggaggcu

SEQ ID NO: 478875 - RNA, 22 nt, Human
gaggaagccccauugaagccag

SEQ ID NO: 478876 - RNA, 22 nt, Human
ugggaccucucuugagagagca

SEQ ID NO: 478877 - RNA, 22 nt, Human
gccugagauucccggagccgug

SEQ ID NO: 478878 - RNA, 22 nt, Human
uucuaguguccuuggacuugcu

SEQ ID NO: 478879 - RNA, 22 nt, Human
uagcagggguagauagagugug

SEQ ID NO: 478880 - RNA, 22 nt, Human
ucauaauacaaagaguucugca

SEQ ID NO: 478881 - RNA, 22 nt, Human
ugccagcacaaguuaagagauc

SEQ ID NO: 478882 - RNA, 22 nt, Human
caaaguccauaguuuacaauag

SEQ ID NO: 478883 - RNA, 22 nt, Human
cuguggcuaggaagcuguggga

SEQ ID NO: 478884 - RNA, 22 nt, Human
ccagcaggagacuagcaacaua

SEQ ID NO: 478885 - RNA, 22 nt, Human
ucuccucuauuucuguauguau

SEQ ID NO: 478886 - RNA, 22 nt, Human
aggugccagaugcacagcugaa

SEQ ID NO: 478887 - RNA, 22 nt, Human
agccucucuuucugguggcuaa

SEQ ID NO: 478888 - RNA, 22 nt, Human
ucaggcacugcuuucugauaug

SEQ ID NO: 478889 - RNA, 22 nt, Human
gagagaagggggauaugagccu

SEQ ID NO: 478890 - RNA, 23 nt, Human
aacaauagguuuuggcagaauag

SEQ ID NO: 478891 - RNA, 22 nt, Human
aaagacuuggcuuaugauuugc

SEQ ID NO: 478892 - RNA, 22 nt, Human
cugagcugguucucuugugaaa

SEQ ID NO: 478893 - RNA, 22 nt, Human
gaggugggagggcagucccuaa

SEQ ID NO: 478894 - RNA, 22 nt, Human
gcugggagaggcccugaaguga

SEQ ID NO: 478895 - RNA, 22 nt, Human
agggccaccucucuggguuccc

SEQ ID NO: 478896 - RNA, 22 nt, Human
cuuagaugaagucacagaaccc

SEQ ID NO: 478897 - RNA, 22 nt, Human
uagaaacauauaggauggcagg

SEQ ID NO: 478898 - RNA, 22 nt, Human
ugucacaguuuguacuuuauag

SEQ ID NO: 478899 - RNA, 22 nt, Human
cucagagaaccuaagcggagga

SEQ ID NO: 478900 - RNA, 20 nt, Human
agaagcugauacugauggaa

SEQ ID NO: 478901 - RNA, 22 nt, Human
guguugaugacauuuuagaaac

SEQ ID NO: 478902 - RNA, 22 nt, Human
ucccuggcugggggcugccuug

SEQ ID NO: 478903 - RNA, 22 nt, Human
auuugcagagcucugaauuuug

SEQ ID NO: 478904 - RNA, 20 nt, Human
aggagaugauccagagucag

SEQ ID NO: 478905 - RNA, 22 nt, Human
ucagagugcagggaguagcagc

SEQ ID NO: 478906 - RNA, 22 nt, Human
augcuguguccuagugaaagaa

SEQ ID NO: 478907 - RNA, 22 nt, Human
cauggaaggcaaaagacacaga

SEQ ID NO: 478908 - RNA, 22 nt, Human
ccaggagcaccaggccugugcc

SEQ ID NO: 478909 - RNA, 22 nt, Human
uacauaguuccauuuacaggaa

SEQ ID NO: 478910 - RNA, 22 nt, Human
aagcccagcaucccugcaccag

SEQ ID NO: 478911 - RNA, 22 nt, Human
acuguacaugcaucuugucuau

SEQ ID NO: 478912 - RNA, 22 nt, Human
gcagggcaugggcccugucugc

SEQ ID NO: 478913 - RNA, 22 nt, Human
auucuuggcaaggagauuuaaa

SEQ ID NO: 478914 - RNA, 18 nt, Human
gcaggagauggguggggu

SEQ ID NO: 478915 - RNA, 22 nt, Human
cacugaaggacaguaggaaggg

SEQ ID NO: 478916 - RNA, 23 nt, Human
aguuuguaaagaaauauuugcac

SEQ ID NO: 478917 - RNA, 22 nt, Human
cacauugaaaugacccaauaau

SEQ ID NO: 478918 - RNA, 22 nt, Human
agagcuggauggucaagauggc

SEQ ID NO: 478919 - RNA, 22 nt, Human
uucagagauggaaggcagaaug

SEQ ID NO: 478920 - RNA, 22 nt, Human
gcaaaaacugcaauuacuuuug

SEQ ID NO: 478921 - RNA, 22 nt, Human
gcauccagucuuggcuccugga

SEQ ID NO: 478922 - RNA, 20 nt, Human
gugcauuucaccuguacugu

SEQ ID NO: 478923 - RNA, 22 nt, Human
ucacugcucucuaagcaucgcc

SEQ ID NO: 478924 - RNA, 22 nt, Human
guccagugacaaguagcuggcc

SEQ ID NO: 478925 - RNA, 20 nt, Human
aaaguguaagcauauaauua

SEQ ID NO: 478926 - RNA, 22 nt, Human
gccugcuggauguggccaggcc

SEQ ID NO: 478927 - RNA, 22 nt, Human
gccucugcaggugcgguuaucc

SEQ ID NO: 478928 - RNA, 22 nt, Human
agaaaucauucccaaacccaua

SEQ ID NO: 478929 - RNA, 22 nt, Human
agcagggcaugaauaaggguuu

SEQ ID NO: 478930 - RNA, 21 nt, Human
ggcuccugcuuugugaggggc

SEQ ID NO: 478931 - RNA, 22 nt, Human
aggccucagugaucaucaucag

SEQ ID NO: 478932 - RNA, 22 nt, Human
gugcaggguagcgacggcagga

SEQ ID NO: 478933 - RNA, 22 nt, Human
cuggcuuucucugugguguuca

SEQ ID NO: 478934 - RNA, 22 nt, Human
augcaguacauacaaacacuga

SEQ ID NO: 478935 - RNA, 22 nt, Human
agaaaaggauugauggaucaga

SEQ ID NO: 478936 - RNA, 22 nt, Human
gaugccucuuuuggcugaauua

SEQ ID NO: 478937 - RNA, 22 nt, Human
auguauguuaguguauuaucua

SEQ ID NO: 478938 - RNA, 22 nt, Human
aagguuaaauagguauuuucca

SEQ ID NO: 478939 - RNA, 22 nt, Human
ggcugagacuagagugaggcau

SEQ ID NO: 478940 - RNA, 16 nt, Human
ccacagggcaaggggc

SEQ ID NO: 478941 - RNA, 22 nt, Human
uugaagcaaauucugugcagua

SEQ ID NO: 478942 - RNA, 22 nt, Human
ucucagagggaaacaugaguga

SEQ ID NO: 478943 - RNA, 22 nt, Human
cagugccaugucugagccccua

SEQ ID NO: 478944 - RNA, 22 nt, Human
gagagcugggcuuugggugaag

SEQ ID NO: 478945 - RNA, 22 nt, Human
ugaagccauaggacagaggaua

SEQ ID NO: 478946 - RNA, 22 nt, Human
aagccaguguuuuugagaguug

SEQ ID NO: 478947 - RNA, 22 nt, Human
gcagagcagcaaauggaaagga

SEQ ID NO: 478948 - RNA, 21 nt, Human
ugucagcaacaauacuuucuc

SEQ ID NO: 478949 - RNA, 22 nt, Human
agaguguuuuucugucaaggac

SEQ ID NO: 478950 - RNA, 22 nt, Human
auggaaagggaagcaaggaaca

SEQ ID NO: 478951 - RNA, 22 nt, Human
acaucucaugaaugauaaauca

SEQ ID NO: 478952 - RNA, 22 nt, Human
acuggagcccguggaggcgcag

SEQ ID NO: 478953 - RNA, 22 nt, Human
auuagggaaacugacuugucuc

SEQ ID NO: 478954 - RNA, 22 nt, Human
uccugcagucugcacucugccu

SEQ ID NO: 478955 - RNA, 23 nt, Human
agcccagcagagaaccuaggucc

SEQ ID NO: 478956 - RNA, 22 nt, Human
ggcuuuauuuugcaugaaugcu

SEQ ID NO: 478957 - RNA, 22 nt, Human
gcuuccugauauucauacuguu

SEQ ID NO: 478958 - RNA, 22 nt, Human
aggaaggguucuuugugaaaga

SEQ ID NO: 478959 - RNA, 22 nt, Human
gggacagacccaugggccaggu

SEQ ID NO: 478960 - RNA, 22 nt, Human
gagagaggccuccauguacuga

SEQ ID NO: 478961 - RNA, 22 nt, Human
cagccaggagccucugcaacua

SEQ ID NO: 478962 - RNA, 22 nt, Human
aaaggcuaugagauagaagaua

SEQ ID NO: 478963 - RNA, 22 nt, Human
caggaaagguagucacaaugua

SEQ ID NO: 478964 - RNA, 22 nt, Human
aucaauucuuaggaaaauagcu

SEQ ID NO: 478965 - RNA, 22 nt, Human
ggccugagucacaucaggagag

SEQ ID NO: 478966 - RNA, 22 nt, Human
aauuagggaggacaaagguaca

SEQ ID NO: 478967 - RNA, 22 nt, Human
auuucccuccagggaaagcuua

SEQ ID NO: 478968 - RNA, 22 nt, Human
auucauuuagguauucacuuac

SEQ ID NO: 478969 - RNA, 19 nt, Human
ugaagcagcaaacucucag

SEQ ID NO: 478970 - RNA, 22 nt, Human
uaaggcacgcauaagagggggc

SEQ ID NO: 478971 - RNA, 22 nt, Human
uuggccacacucacuagagccc

SEQ ID NO: 478972 - RNA, 22 nt, Human
uuuaauuuguauuucuagaggg

SEQ ID NO: 478973 - RNA, 22 nt, Human
guccucuggaagaugaguucuu

SEQ ID NO: 478974 - RNA, 22 nt, Human
agcuggcccucgagagccaauu

SEQ ID NO: 478975 - RNA, 22 nt, Human
gcugguccacucccuggaggcu

SEQ ID NO: 478976 - RNA, 22 nt, Human
uugcagagugguugugaggauu

SEQ ID NO: 478977 - RNA, 22 nt, Human
ccagccagcugcccuuggggcc

SEQ ID NO: 478978 - RNA, 22 nt, Human
uggcugagaaguucugguggga

SEQ ID NO: 478979 - RNA, 22 nt, Human
gccagguggucuggcuccagag

SEQ ID NO: 478980 - RNA, 22 nt, Human
ucugggcacugcugagccugua

SEQ ID NO: 478981 - RNA, 22 nt, Human
gagucacauuaauuuaauuuua

SEQ ID NO: 478982 - RNA, 22 nt, Human
ccaaaguccauaguuuacauaa

SEQ ID NO: 478983 - RNA, 22 nt, Human
aagagcuggagcugcuacagga

SEQ ID NO: 478984 - RNA, 22 nt, Human
agucccagacuccaguuuucug

SEQ ID NO: 478985 - RNA, 22 nt, Human
cagcugccugcaacacaagcuu

SEQ ID NO: 478986 - RNA, 22 nt, Human
augauugcagcccuacagcugu

SEQ ID NO: 478987 - RNA, 19 nt, Human
ggaagagaggaaaggugga

SEQ ID NO: 478988 - RNA, 22 nt, Human
ccuguacaagagccaucuggau

SEQ ID NO: 478989 - RNA, 22 nt, Human
caggccugaguguggaagucuu

SEQ ID NO: 478990 - RNA, 22 nt, Human
agcagagccugggcuaggggug

SEQ ID NO: 478991 - RNA, 22 nt, Human
acaggcugcugagccauuugcu

SEQ ID NO: 478992 - RNA, 22 nt, Human
uauuuugucuucugcucaucac

SEQ ID NO: 478993 - RNA, 22 nt, Human
auaccuguguauccacaagcgu

SEQ ID NO: 478994 - RNA, 22 nt, Human
agcugcuaugacaacaccagcc

SEQ ID NO: 478995 - RNA, 22 nt, Human
ggugacugguuuaucuggcagu

SEQ ID NO: 478996 - RNA, 22 nt, Human
cucaggaguuggaggcuacagu

SEQ ID NO: 478997 - RNA, 22 nt, Human
ggcugggcuccgggagcaugcg

SEQ ID NO: 478998 - RNA, 22 nt, Human
ugccucugggugaccaaggagc

SEQ ID NO: 478999 - RNA, 22 nt, Human
gcagcugaauguccauugcugc

SEQ ID NO: 479000 - RNA, 20 nt, Human
augccucuaauuuugcaaac

SEQ ID NO: 479001 - RNA, 22 nt, Human
caaaguuuggcucucaugacau

SEQ ID NO: 479002 - RNA, 22 nt, Human
cuacagguaugugcaugacauc

SEQ ID NO: 479003 - RNA, 23 nt, Human
gugagcagcccacuaggaaugcc

SEQ ID NO: 479004 - RNA, 22 nt, Human
cuucuuaaugacagauuaaaau

SEQ ID NO: 479005 - RNA, 22 nt, Human
ucccuggcuguguucaggugcg

SEQ ID NO: 479006 - RNA, 22 nt, Human
gagccaaggguugccauggaga

SEQ ID NO: 479007 - RNA, 22 nt, Human
acagagcuucccagccugagca

SEQ ID NO: 479008 - RNA, 22 nt, Human
aacucuauuuacccuacuaaac

SEQ ID NO: 479009 - RNA, 22 nt, Human
ucauugcagugauguuguaugu

SEQ ID NO: 479010 - RNA, 18 nt, Human
gggcaucauucacaaagu

SEQ ID NO: 479011 - RNA, 22 nt, Human
agcagccauuuaaaaugaauug

SEQ ID NO: 479012 - RNA, 22 nt, Human
gcagcuuucuuuuugcaugucu

SEQ ID NO: 479013 - RNA, 21 nt, Human
uggcucugaaagagugcugca

SEQ ID NO: 479014 - RNA, 22 nt, Human
ccuggcagcgccgaagcuggcc

SEQ ID NO: 479015 - RNA, 22 nt, Human
cacaggagaacccacagauucu

SEQ ID NO: 479016 - RNA, 22 nt, Human
cccugcagaucagugagaacuu

SEQ ID NO: 479017 - RNA, 20 nt, Human
uucauucauuccacaacuuc

SEQ ID NO: 479018 - RNA, 22 nt, Human
aaauauguaagauuagcacuag

SEQ ID NO: 479019 - RNA, 22 nt, Human
uuuggaaaguguacaaauuuga

SEQ ID NO: 479020 - RNA, 22 nt, Human
gugaggugguacaauauuaacu

SEQ ID NO: 479021 - RNA, 18 nt, Human
cagggccccagaauuauc

SEQ ID NO: 479022 - RNA, 22 nt, Human
ggaagccaggcugggggaucug

SEQ ID NO: 479023 - RNA, 22 nt, Human
aucaguuuggaacauucaggcc

SEQ ID NO: 479024 - RNA, 22 nt, Human
uggaggaaaaaaccaggcagag

SEQ ID NO: 479025 - RNA, 22 nt, Human
ucagaggugguaaaggacagca

SEQ ID NO: 479026 - RNA, 22 nt, Human
aggagcuggguuccuuuggugg

SEQ ID NO: 479027 - RNA, 22 nt, Human
aaaggucagcugccaucguucu

SEQ ID NO: 479028 - RNA, 22 nt, Human
acagagcuuaauucaggagcuu

SEQ ID NO: 479029 - RNA, 22 nt, Human
agggagcuguggucagcucagu

SEQ ID NO: 479030 - RNA, 20 nt, Human
caggaugauuggacacgaug

SEQ ID NO: 479031 - RNA, 20 nt, Human
uggcuccucuuggcuguggc

SEQ ID NO: 479032 - RNA, 22 nt, Human
cugagcagcaacccagagccuc

SEQ ID NO: 479033 - RNA, 17 nt, Human
ggagagugggaauggcc

SEQ ID NO: 479034 - RNA, 22 nt, Human
agggcaguucagccacaggcuc

SEQ ID NO: 479035 - RNA, 22 nt, Human
acaaagugaauugcaucgaguu

SEQ ID NO: 479036 - RNA, 22 nt, Human
caguggccugagccaggcuucc

SEQ ID NO: 479037 - RNA, 22 nt, Human
gacucugcuacaggccgagguu

SEQ ID NO: 479038 - RNA, 22 nt, Human
gcaaggcuuugugaauuuuaaa

SEQ ID NO: 479039 - RNA, 22 nt, Human
agcccuagagcuggaggucagu

SEQ ID NO: 479040 - RNA, 22 nt, Human
aguuuaugaaacacagauuuga

SEQ ID NO: 479041 - RNA, 22 nt, Human
agagggaucacccuguuucugg

SEQ ID NO: 479042 - RNA, 22 nt, Human
ugauuuccugugcgcccuuagg

SEQ ID NO: 479043 - RNA, 19 nt, Human
ugucacugucauggcccag

SEQ ID NO: 479044 - RNA, 22 nt, Human
acauacauaugacaacuuuccu

SEQ ID NO: 479045 - RNA, 22 nt, Human
agagugaaguuuuugaaaguga

SEQ ID NO: 479046 - RNA, 20 nt, Human
uauaacaguguugggugugu

SEQ ID NO: 479047 - RNA, 22 nt, Human
cugggaggacaacuuggagcuc

SEQ ID NO: 479048 - RNA, 22 nt, Human
uacauggugguggcacuugacu

SEQ ID NO: 479049 - RNA, 22 nt, Human
cagcuuuaggacucauaauaaa

SEQ ID NO: 479050 - RNA, 22 nt, Human
ugugcuucugcagagacuauuu

SEQ ID NO: 479051 - RNA, 22 nt, Human
ugcagcuguaacagaggccuca

SEQ ID NO: 479052 - RNA, 22 nt, Human
cagagguagaaggcaugcagug

SEQ ID NO: 479053 - RNA, 22 nt, Human
uuucauaaacaguagaagacua

SEQ ID NO: 479054 - RNA, 22 nt, Human
gggagccacagugaggugcaug

SEQ ID NO: 479055 - RNA, 22 nt, Human
uuuauauccaucuuugaaguaa

SEQ ID NO: 479056 - RNA, 22 nt, Human
ccugagugccaugagagcaccc

SEQ ID NO: 479057 - RNA, 21 nt, Human
ggagggcagcccagacuggcu

SEQ ID NO: 479058 - RNA, 22 nt, Human
uagucucuggagacucuagggg

SEQ ID NO: 479059 - RNA, 21 nt, Human
uaaagaagaugaaugugauca

SEQ ID NO: 479060 - RNA, 22 nt, Human
cagggcuguuagcugcugcucu

SEQ ID NO: 479061 - RNA, 18 nt, Human
ggagagugacagagucgu

SEQ ID NO: 479062 - RNA, 22 nt, Human
acauuugucuucuuucagauua

SEQ ID NO: 479063 - RNA, 22 nt, Human
ucucagggugaggaaagaauuu

SEQ ID NO: 479064 - RNA, 23 nt, Human
cagggcccugcucaauuucucca

SEQ ID NO: 479065 - RNA, 22 nt, Human
uugacaauugggagauauaaag

SEQ ID NO: 479066 - RNA, 18 nt, Human
uggcagcaggaagccauu

SEQ ID NO: 479067 - RNA, 22 nt, Human
gcagagugauggaaugugggug

SEQ ID NO: 479068 - RNA, 22 nt, Human
gugggcagacagugcuuugcag

SEQ ID NO: 479069 - RNA, 22 nt, Human
uagacagauuucuuguuagaca

SEQ ID NO: 479070 - RNA, 22 nt, Human
gagcugccaguguaugaauucu

SEQ ID NO: 479071 - RNA, 22 nt, Human
aaacuguaggagggaaaggaag

SEQ ID NO: 479072 - RNA, 20 nt, Human
gggcuggcgcauggggaaag

SEQ ID NO: 479073 - RNA, 22 nt, Human
agaagugccgaaaggaagacag

SEQ ID NO: 479074 - RNA, 22 nt, Human
cucuccucagaacaggcccucu

SEQ ID NO: 479075 - RNA, 20 nt, Human
accaggagauggaggcaggg

SEQ ID NO: 479076 - RNA, 22 nt, Human
cagcuuuggcccagucgggagg

SEQ ID NO: 479077 - RNA, 22 nt, Human
gcugcccugucugcagcaggac

SEQ ID NO: 479078 - RNA, 22 nt, Human
agaugauggccauguccucucc

SEQ ID NO: 479079 - RNA, 21 nt, Human
gagacagcccagugccagggc

SEQ ID NO: 479080 - RNA, 17 nt, Human
cagugcagagcccuuuc

SEQ ID NO: 479081 - RNA, 22 nt, Human
uaaggcacuucaauguuuagaa

SEQ ID NO: 479082 - RNA, 22 nt, Human
cucuugaagcaggggccaguuc

SEQ ID NO: 479083 - RNA, 22 nt, Human
uuugcauuguaauauuuaguuc

SEQ ID NO: 479084 - RNA, 22 nt, Human
uccuucaggccucauucucaua

SEQ ID NO: 479085 - RNA, 22 nt, Human
guguccuuauuucugucucuca

SEQ ID NO: 479086 - RNA, 22 nt, Human
uccagagggcgauggcuggggg

SEQ ID NO: 479087 - RNA, 22 nt, Human
aggcugaggcagguggaucacc

SEQ ID NO: 479088 - RNA, 22 nt, Human
gcagcaggcuuuucauaccuug

SEQ ID NO: 479089 - RNA, 22 nt, Human
uggcucugccacuaacuuggua

SEQ ID NO: 479090 - RNA, 22 nt, Human
aagggcaggcacccacccucac

SEQ ID NO: 479091 - RNA, 22 nt, Human
ugucauugaggaaaacuaggug

SEQ ID NO: 479092 - RNA, 22 nt, Human
uggggacacagagguucguugg

SEQ ID NO: 479093 - RNA, 22 nt, Human
cugccagcacugccuccugagg

SEQ ID NO: 479094 - RNA, 22 nt, Human
aggcaggugcuuaugacuugcu

SEQ ID NO: 479095 - RNA, 22 nt, Human
uuaugcuaguauaguccuuaga

SEQ ID NO: 479096 - RNA, 22 nt, Human
accaggcuggagugcaguggcg

SEQ ID NO: 479097 - RNA, 22 nt, Human
agcagcuuacauguggccuauc

SEQ ID NO: 479098 - RNA, 22 nt, Human
uugaagcagagaaauacuugaa

SEQ ID NO: 479099 - RNA, 22 nt, Human
acccaggagguggaggcugcag

SEQ ID NO: 479100 - RNA, 22 nt, Human
agggaagagcuugcaagaaacc

SEQ ID NO: 479101 - RNA, 22 nt, Human
agaagccaaucagcucucugcu

SEQ ID NO: 479102 - RNA, 22 nt, Human
caggugggccaugaaaaaugac

SEQ ID NO: 479103 - RNA, 22 nt, Human
uugcagcuucuaccacuguuuc

SEQ ID NO: 479104 - RNA, 22 nt, Human
uuuacaaguuuacagaaugaug

SEQ ID NO: 479105 - RNA, 22 nt, Human
agaaaucucaguaucucaggga

SEQ ID NO: 479106 - RNA, 22 nt, Human
cccugcagccuugcaugccuuc

SEQ ID NO: 479107 - RNA, 22 nt, Human
cauugacaucaggcuuggccaa

SEQ ID NO: 479108 - RNA, 22 nt, Human
aaagacuagcauuuauauguac

SEQ ID NO: 479109 - RNA, 23 nt, Human
gccugggacugguagugugaccu

SEQ ID NO: 479110 - RNA, 22 nt, Human
gugaagagcuguugcagagauu

SEQ ID NO: 479111 - RNA, 23 nt, Human
agaauuguaaauagaauauaccu

SEQ ID NO: 479112 - RNA, 22 nt, Human
gccugcagacguguuuuccuca

SEQ ID NO: 479113 - RNA, 22 nt, Human
uuugucauaucacacaauuuug

SEQ ID NO: 479114 - RNA, 23 nt, Human
agggcaugaagcagaggacgugg

SEQ ID NO: 479115 - RNA, 20 nt, Human
ccugggguacacuggcaugu

SEQ ID NO: 479116 - RNA, 22 nt, Human
uguggcaggcaagauguacaga

SEQ ID NO: 479117 - RNA, 22 nt, Human
uaggcuggaggaagcagugccu

SEQ ID NO: 479118 - RNA, 22 nt, Human
cagggcagagggaaacuccuuu

SEQ ID NO: 479119 - RNA, 22 nt, Human
auuucuacugugagaaacauga

SEQ ID NO: 479120 - RNA, 18 nt, Human
agaguguucucagugaaa

SEQ ID NO: 479121 - RNA, 22 nt, Human
acauuucuuucuauucaguagc

SEQ ID NO: 479122 - RNA, 22 nt, Human
uuucuagaggcuccaggggagu

SEQ ID NO: 479123 - RNA, 22 nt, Human
uugcugaaaacaguggguauug

SEQ ID NO: 479124 - RNA, 22 nt, Human
ggaggaagcacacggcuuguau

SEQ ID NO: 479125 - RNA, 22 nt, Human
gaagaaagauuggcaugcuuca

SEQ ID NO: 479126 - RNA, 22 nt, Human
uuagggacagcucuguagguga

SEQ ID NO: 479127 - RNA, 22 nt, Human
guggaaguagauuugagaaggu

SEQ ID NO: 479128 - RNA, 22 nt, Human
ggcagaagaaaggcuaagucuc

SEQ ID NO: 479129 - RNA, 22 nt, Human
guaaaugugcuucuuuuaacuu

SEQ ID NO: 479130 - RNA, 22 nt, Human
aaauuuaagaagugugugcgug

SEQ ID NO: 479131 - RNA, 22 nt, Human
ggggcagggagguuaucgccga

SEQ ID NO: 479132 - RNA, 22 nt, Human
gugucacaagagcccaggaaac

SEQ ID NO: 479133 - RNA, 22 nt, Human
acccaggagccgugagagguua

SEQ ID NO: 479134 - RNA, 22 nt, Human
aagauuucagaguuugggggaa

SEQ ID NO: 479135 - RNA, 22 nt, Human
ucaggauggcuucugcaucaaa

SEQ ID NO: 479136 - RNA, 22 nt, Human
gucccagggagguucagggcuu

SEQ ID NO: 479137 - RNA, 22 nt, Human
acacugugagcugaagggcugc

SEQ ID NO: 479138 - RNA, 22 nt, Human
uuccaggggcagcagugauggu

SEQ ID NO: 479139 - RNA, 22 nt, Human
agucaauuaucucuaggucauc

SEQ ID NO: 479140 - RNA, 22 nt, Human
cugcuucuccaaaguaggacuu

SEQ ID NO: 479141 - RNA, 22 nt, Human
ccagcuugaagaugugcugguu

SEQ ID NO: 479142 - RNA, 18 nt, Human
ccucaggggaccuggcag

SEQ ID NO: 479143 - RNA, 22 nt, Human
ugaggcucagaagugccaagug

SEQ ID NO: 479144 - RNA, 22 nt, Human
uuucaaauaccauaaaccuaau

SEQ ID NO: 479145 - RNA, 22 nt, Human
gagcagcugagcuggaaugaga

SEQ ID NO: 479146 - RNA, 22 nt, Human
acugugugggccgcucacuggg

SEQ ID NO: 479147 - RNA, 22 nt, Human
ugaagcagauggucuggucauu

SEQ ID NO: 479148 - RNA, 17 nt, Human
ccucacagggaccagac

SEQ ID NO: 479149 - RNA, 22 nt, Human
agaaauguacgauguuaugcag

SEQ ID NO: 479150 - RNA, 22 nt, Human
uccaggagaggccugaccaggu

SEQ ID NO: 479151 - RNA, 22 nt, Human
ucucagagaaaugugucaccau

SEQ ID NO: 479152 - RNA, 22 nt, Human
ucaggaguaaagacagaguucc

SEQ ID NO: 479153 - RNA, 22 nt, Human
cugccugugccaccgccucauu

SEQ ID NO: 479154 - RNA, 22 nt, Human
ugugccuacugauagagccaag

SEQ ID NO: 479155 - RNA, 20 nt, Human
guugaaaguaauaugaugcu

SEQ ID NO: 479156 - RNA, 17 nt, Human
agccccucagcgucacc

SEQ ID NO: 479157 - RNA, 22 nt, Human
ugaucaguguugguucuaucua

SEQ ID NO: 479158 - RNA, 22 nt, Human
acauucaugucccacuucuagc

SEQ ID NO: 479159 - RNA, 20 nt, Human
gggcagccucgggagugggu

SEQ ID NO: 479160 - RNA, 22 nt, Human
agggugccugcugcagguucag

SEQ ID NO: 479161 - RNA, 22 nt, Human
acuccagggcuccaucccuugu

SEQ ID NO: 479162 - RNA, 22 nt, Human
ucagucuucccuccagugcaac

SEQ ID NO: 479163 - RNA, 22 nt, Human
uucauugugaacacauucugcc

SEQ ID NO: 479164 - RNA, 22 nt, Human
uugaccauaccuccaggcaguu

SEQ ID NO: 479165 - RNA, 22 nt, Human
aaggcaguaggaucuuccacag

SEQ ID NO: 479166 - RNA, 22 nt, Human
aagggcuggccacauucugggu

SEQ ID NO: 479167 - RNA, 22 nt, Human
gaaggccacaaaaaaugucaua

SEQ ID NO: 479168 - RNA, 22 nt, Human
cccuggggcugagggauggccg

SEQ ID NO: 479169 - RNA, 22 nt, Human
aaagccagggacagugugcaug

SEQ ID NO: 479170 - RNA, 22 nt, Human
uagcuuuaagaugagaugugga

SEQ ID NO: 479171 - RNA, 22 nt, Human
ucaauuaugccauugcaauauu

SEQ ID NO: 479172 - RNA, 19 nt, Human
cuggcagccugucuguguc

SEQ ID NO: 479173 - RNA, 22 nt, Human
aggcucaggcaggaauggcgga

SEQ ID NO: 479174 - RNA, 22 nt, Human
ccugagggaggguauaggcugu

SEQ ID NO: 479175 - RNA, 21 nt, Human
ugcuucucuagaucaacuacu

SEQ ID NO: 479176 - RNA, 17 nt, Human
ugcauuguuggaaauuu

SEQ ID NO: 479177 - RNA, 22 nt, Human
agaggugacauaggagaggcuc

SEQ ID NO: 479178 - RNA, 22 nt, Human
cagaagcauuccagcaaauagu

SEQ ID NO: 479179 - RNA, 22 nt, Human
aguguccccuccaagggccugg

SEQ ID NO: 479180 - RNA, 22 nt, Human
caggaaugacugcagauggggc

SEQ ID NO: 479181 - RNA, 18 nt, Human
cucucugggugaggacaa

SEQ ID NO: 479182 - RNA, 22 nt, Human
ugaaggcagcaugcacacuagu

SEQ ID NO: 479183 - RNA, 22 nt, Human
ugcauuguugaccaguugugca

SEQ ID NO: 479184 - RNA, 21 nt, Human
ggccugaguauaggacaggcc

SEQ ID NO: 479185 - RNA, 22 nt, Human
agugaccaacaaugcugagaag

SEQ ID NO: 479186 - RNA, 22 nt, Human
ucccggcgcugggagguggguc

SEQ ID NO: 479187 - RNA, 22 nt, Human
uguacauuuagagcucaauaga

SEQ ID NO: 479188 - RNA, 22 nt, Human
auuucugauaaacguaagcugc

SEQ ID NO: 479189 - RNA, 21 nt, Human
auggagccuaagaguggaggu

SEQ ID NO: 479190 - RNA, 22 nt, Human
uggcagcugauuagauggugcc

SEQ ID NO: 479191 - RNA, 22 nt, Human
cugcuguguuucacaccucugg

SEQ ID NO: 479192 - RNA, 22 nt, Human
uguuugcucugacuaucuugcg

SEQ ID NO: 479193 - RNA, 22 nt, Human
gagggcugauaacaggaauaca

SEQ ID NO: 479194 - RNA, 22 nt, Human
auguccuucuccucuuaccugc

SEQ ID NO: 479195 - RNA, 22 nt, Human
uuuguacauauauaaaaucugu

SEQ ID NO: 479196 - RNA, 22 nt, Human
gguccccagcaguggcugcuuc

SEQ ID NO: 479197 - RNA, 22 nt, Human
gccugagcuacuagggagucug

SEQ ID NO: 479198 - RNA, 22 nt, Human
aggauccuuuggccacuucuua

SEQ ID NO: 479199 - RNA, 22 nt, Human
cccagcaggucggugcugccug

SEQ ID NO: 479200 - RNA, 22 nt, Human
auacauuagaaucugguacuca

SEQ ID NO: 479201 - RNA, 22 nt, Human
guggccuggaguuugauguagg

SEQ ID NO: 479202 - RNA, 23 nt, Human
uggggagaguuacccuggaagcg

SEQ ID NO: 479203 - RNA, 22 nt, Human
guuauaaaggugauaaugguca

SEQ ID NO: 479204 - RNA, 22 nt, Human
aaugcacaaaaauuguauguaa

SEQ ID NO: 479205 - RNA, 22 nt, Human
acagaaauaacuuuuuauguuu

SEQ ID NO: 479206 - RNA, 22 nt, Human
gaauuucuggacccuuugagaa

SEQ ID NO: 479207 - RNA, 22 nt, Human
uuugacaggacuaacauauggc

SEQ ID NO: 479208 - RNA, 19 nt, Human
auuucaagagguuuauugg

SEQ ID NO: 479209 - RNA, 22 nt, Human
ggaaaguggugguggaaagagg

SEQ ID NO: 479210 - RNA, 22 nt, Human
ccagugcccagucucccugguc

SEQ ID NO: 479211 - RNA, 22 nt, Human
cagcaggacccaggaauccugc

SEQ ID NO: 479212 - RNA, 22 nt, Human
uggcucagauaauucaaggggc

SEQ ID NO: 479213 - RNA, 22 nt, Human
cuggagugauacucagaaugug

SEQ ID NO: 479214 - RNA, 22 nt, Human
ugaaugauacagaauuauguag

SEQ ID NO: 479215 - RNA, 22 nt, Human
uggcugaguuacgaacagagca

SEQ ID NO: 479216 - RNA, 22 nt, Human
ggcagccagagggcagcuggau

SEQ ID NO: 479217 - RNA, 22 nt, Human
agcaggaggguuuuguagaguc

SEQ ID NO: 479218 - RNA, 22 nt, Human
guauuaggugguggaauuguag

SEQ ID NO: 479219 - RNA, 22 nt, Human
uccagggaccucccugagagcu

SEQ ID NO: 479220 - RNA, 22 nt, Human
gcccagcacuaaaagcuuugcu

SEQ ID NO: 479221 - RNA, 22 nt, Human
cugguuuagcuguaagguuccc

SEQ ID NO: 479222 - RNA, 22 nt, Human
gaauacaaauaauaccaaggug

SEQ ID NO: 479223 - RNA, 22 nt, Human
uccucaggaugugggguagaau

SEQ ID NO: 479224 - RNA, 22 nt, Human
aaucagaauuuauugaaucuuu

SEQ ID NO: 479225 - RNA, 22 nt, Human
uaguaucuuucuauauuuccca

SEQ ID NO: 479226 - RNA, 23 nt, Human
cucugcaggagagugggcagggc

SEQ ID NO: 479227 - RNA, 22 nt, Human
cagcuguggagggaggaaaugc

SEQ ID NO: 479228 - RNA, 22 nt, Human
gcagaagcccggucagcgcacg

SEQ ID NO: 479229 - RNA, 22 nt, Human
cucccaagauaaauaaggcagu

SEQ ID NO: 479230 - RNA, 23 nt, Human
aagcugccagucugaagccuggg

SEQ ID NO: 479231 - RNA, 22 nt, Human
gccuaggaguggggauggcggu

SEQ ID NO: 479232 - RNA, 22 nt, Human
gaaaauguuuccuguuauuugc

SEQ ID NO: 479233 - RNA, 22 nt, Human
ccagcuuuccaggguugacugg

SEQ ID NO: 479234 - RNA, 22 nt, Human
uauuuauaaucugccaaagaga

SEQ ID NO: 479235 - RNA, 22 nt, Human
uaguuaggguucugcagagaca

SEQ ID NO: 479236 - RNA, 22 nt, Human
uggcugccuagucccucagccu

SEQ ID NO: 479237 - RNA, 22 nt, Human
gccuguguggaugcgccggugc

SEQ ID NO: 479238 - RNA, 22 nt, Human
aggaagccuggggcugcccucg

SEQ ID NO: 479239 - RNA, 22 nt, Human
gccagguggcugagcagcugca

SEQ ID NO: 479240 - RNA, 22 nt, Human
agguaacacuacuuaguauacu

SEQ ID NO: 479241 - RNA, 19 nt, Human
uguuuuguuaaagcagucc

SEQ ID NO: 479242 - RNA, 22 nt, Human
ugcugggcuugaaagcugcuaa

SEQ ID NO: 479243 - RNA, 22 nt, Human
agggaggagaauggacuccuuc

SEQ ID NO: 479244 - RNA, 22 nt, Human
aagugacaccucuucccuuucc

SEQ ID NO: 479245 - RNA, 22 nt, Human
gcaguaggagaagaggaugcuu

SEQ ID NO: 479246 - RNA, 22 nt, Human
agcuuuaucacaauauuggcua

SEQ ID NO: 479247 - RNA, 22 nt, Human
gcuguggcuguacagagaccau

SEQ ID NO: 479248 - RNA, 22 nt, Human
agggcagcaaugcagcugcugc

SEQ ID NO: 479249 - RNA, 22 nt, Human
cuucaagaagacagcagagcau

SEQ ID NO: 479250 - RNA, 22 nt, Human
cagcagugugcaggugugcugg

SEQ ID NO: 479251 - RNA, 22 nt, Human
gugcagggagcccagaaggucc

SEQ ID NO: 479252 - RNA, 22 nt, Human
uucuucaauuauuggaaagaaa

SEQ ID NO: 479253 - RNA, 22 nt, Human
uccuggcccgaucccugugaag

SEQ ID NO: 479254 - RNA, 22 nt, Human
cagggcuguggaaaacuggugc

SEQ ID NO: 479255 - RNA, 22 nt, Human
accgaaggaaacuggaaccguu

SEQ ID NO: 479256 - RNA, 21 nt, Human
acagauuuuauaucucugcug

SEQ ID NO: 479257 - RNA, 21 nt, Human
gagcucucaggcaagaagcag

SEQ ID NO: 479258 - RNA, 22 nt, Human
ugcagggauuagaggccgggga

SEQ ID NO: 479259 - RNA, 22 nt, Human
agggcagagagaugaaugggau

SEQ ID NO: 479260 - RNA, 22 nt, Human
aucugguuuggggauccuugug

SEQ ID NO: 479261 - RNA, 22 nt, Human
gauucuuacuucuaagcaagcu

SEQ ID NO: 479262 - RNA, 22 nt, Human
uccugccucuuuucuuauucca

SEQ ID NO: 479263 - RNA, 22 nt, Human
gauuucaaggauguuagaggug

SEQ ID NO: 479264 - RNA, 22 nt, Human
uggaggcauuuuagguugucac

SEQ ID NO: 479265 - RNA, 22 nt, Human
ugcucccaggcauucucuguug

SEQ ID NO: 479266 - RNA, 22 nt, Human
ggcacugagcugccuuggggca

SEQ ID NO: 479267 - RNA, 22 nt, Human
aaggcuaugaucuuuuucauga

SEQ ID NO: 479268 - RNA, 19 nt, Human
ccagucccauacaggagau

SEQ ID NO: 479269 - RNA, 22 nt, Human
guucacaucacuucacugaacc

SEQ ID NO: 479270 - RNA, 22 nt, Human
aaagacugcaaaaacgcacaga

SEQ ID NO: 479271 - RNA, 22 nt, Human
agcagccagagaaugaugcagu

SEQ ID NO: 479272 - RNA, 22 nt, Human
ucucagagaggggccgggccuu

SEQ ID NO: 479273 - RNA, 22 nt, Human
uaucuacuccucuuucagaugc

SEQ ID NO: 479274 - RNA, 22 nt, Human
uucaggauucucucccauuuac

SEQ ID NO: 479275 - RNA, 22 nt, Human
uuccucucucuugccagaaugu

SEQ ID NO: 479276 - RNA, 22 nt, Human
ggcuuccuggggccuccugcaa

SEQ ID NO: 479277 - RNA, 22 nt, Human
cuguggcauugccgaggcuggc

SEQ ID NO: 479278 - RNA, 20 nt, Human
ucccaagggcugagaggauc

SEQ ID NO: 479279 - RNA, 22 nt, Human
uagaaauguuagauguauugag

SEQ ID NO: 479280 - RNA, 22 nt, Human
augucuuucuuauggucuguug

SEQ ID NO: 479281 - RNA, 23 nt, Human
acagagguccaaacaguauaagc

SEQ ID NO: 479282 - RNA, 22 nt, Human
ucagagugaggcccagcaaucu

SEQ ID NO: 479283 - RNA, 22 nt, Human
cauuuauugaguggccacagug

SEQ ID NO: 479284 - RNA, 17 nt, Human
aaguccagccugcagcu

SEQ ID NO: 479285 - RNA, 22 nt, Human
cagguggggcgcccucaggcag

SEQ ID NO: 479286 - RNA, 22 nt, Human
agcaggguuccaggaguugcag

SEQ ID NO: 479287 - RNA, 21 nt, Human
agagccugagaucuuccagca

SEQ ID NO: 479288 - RNA, 19 nt, Human
gcugugggacagcagggug

SEQ ID NO: 479289 - RNA, 22 nt, Human
ugagagucucagaccuccuggu

SEQ ID NO: 479290 - RNA, 22 nt, Human
ugcugugggcaguacauaagcu

SEQ ID NO: 479291 - RNA, 22 nt, Human
gaaaugcaggcuuggauucagc

SEQ ID NO: 479292 - RNA, 22 nt, Human
gaggccacgguuuuccuugggg

SEQ ID NO: 479293 - RNA, 22 nt, Human
agggcaugcuggaggagagaca

SEQ ID NO: 479294 - RNA, 22 nt, Human
augcuucagugcuaccuucaaa

SEQ ID NO: 479295 - RNA, 22 nt, Human
aagggcugccagggggugccag

SEQ ID NO: 479296 - RNA, 22 nt, Human
agcagcugagccccagcuguga

SEQ ID NO: 479297 - RNA, 22 nt, Human
ugaggcaggaaguuauauaaug

SEQ ID NO: 479298 - RNA, 22 nt, Human
acagcugggugcugcucagagc

SEQ ID NO: 479299 - RNA, 22 nt, Human
auguccagagccggccugcuga

SEQ ID NO: 479300 - RNA, 20 nt, Human
agagccuugaggaagaugau

SEQ ID NO: 479301 - RNA, 22 nt, Human
ggcucugcuggauugaggccag

SEQ ID NO: 479302 - RNA, 22 nt, Human
cugcugagcaucagggcugccc

SEQ ID NO: 479303 - RNA, 19 nt, Human
agcauuuggaauucuacac

SEQ ID NO: 479304 - RNA, 22 nt, Human
uggcagcuccuggggccagcac

SEQ ID NO: 479305 - RNA, 22 nt, Human
uaauuuacuugcaaauaacaau

SEQ ID NO: 479306 - RNA, 22 nt, Human
ucccagaggaaauggcagcuga

SEQ ID NO: 479307 - RNA, 22 nt, Human
acucaggaaauugagauaaugg

SEQ ID NO: 479308 - RNA, 22 nt, Human
aagagcugcccaaggugaacag

SEQ ID NO: 479309 - RNA, 22 nt, Human
auaaacaguagagaaagguggu

SEQ ID NO: 479310 - RNA, 22 nt, Human
cugaggccagcugcagagcucu

SEQ ID NO: 479311 - RNA, 22 nt, Human
cccaaggccucuccuuggcuug

SEQ ID NO: 479312 - RNA, 22 nt, Human
cacucacuuauuucuaacagaa

SEQ ID NO: 479313 - RNA, 22 nt, Human
gccugcagggcccuuguggguc

SEQ ID NO: 479314 - RNA, 22 nt, Human
aguuauauuccauagauucaga

SEQ ID NO: 479315 - RNA, 22 nt, Human
cucaggccauucuuccagcugc

SEQ ID NO: 479316 - RNA, 23 nt, Human
ugcuguccaacagacuggccaug

SEQ ID NO: 479317 - RNA, 21 nt, Human
ugggaccuagcuuugcacagg

SEQ ID NO: 479318 - RNA, 22 nt, Human
uaauuuaauuccauggauucua

SEQ ID NO: 479319 - RNA, 22 nt, Human
gguuugcaugugauguugggca

SEQ ID NO: 479320 - RNA, 22 nt, Human
gcagcugagcgugaggaagagu

SEQ ID NO: 479321 - RNA, 22 nt, Human
uaccugcagcgggaauccauua

SEQ ID NO: 479322 - RNA, 22 nt, Human
ggguggaggagaacaggcccca

SEQ ID NO: 479323 - RNA, 22 nt, Human
uccuuggcuuucuggagcuucu

SEQ ID NO: 479324 - RNA, 22 nt, Human
agcauuuaguuaguaaauguuu

SEQ ID NO: 479325 - RNA, 22 nt, Human
aguggcagccgagcaggagaug

SEQ ID NO: 479326 - RNA, 23 nt, Human
acacaauagaguacuauucagcc

SEQ ID NO: 479327 - RNA, 22 nt, Human
caagauggacauaaggagagaa

SEQ ID NO: 479328 - RNA, 22 nt, Human
uuugaaagggaaauaaacuccu

SEQ ID NO: 479329 - RNA, 22 nt, Human
augccuggacugacaugcacug

SEQ ID NO: 479330 - RNA, 22 nt, Human
uccaggcauuccagccauucca

SEQ ID NO: 479331 - RNA, 22 nt, Human
cacugccuggaaggagagacau

SEQ ID NO: 479332 - RNA, 22 nt, Human
uccagggcugacuugggagagg

SEQ ID NO: 479333 - RNA, 22 nt, Human
ccuggccugcucggcucuuaag

SEQ ID NO: 479334 - RNA, 22 nt, Human
aggcacuguggguguggccgga

SEQ ID NO: 479335 - RNA, 22 nt, Human
uccagggagauacuggcugcca

SEQ ID NO: 479336 - RNA, 22 nt, Human
ucuggaguccagauccauuugg

SEQ ID NO: 479337 - RNA, 22 nt, Human
aguggcaguggggcagggcccu

SEQ ID NO: 479338 - RNA, 19 nt, Human
accugcaguaauaauuccu

SEQ ID NO: 479339 - RNA, 22 nt, Human
gcaugcugcaccagagccucuc

SEQ ID NO: 479340 - RNA, 22 nt, Human
uuugaaagagcugauacaugaa

SEQ ID NO: 479341 - RNA, 22 nt, Human
cagagugaacagugggaugugc

SEQ ID NO: 479342 - RNA, 22 nt, Human
ccagucuggcaggagggggaac

SEQ ID NO: 479343 - RNA, 22 nt, Human
cugggccagcaacugcaaugga

SEQ ID NO: 479344 - RNA, 22 nt, Human
aauggccagcaacaggagugaa

SEQ ID NO: 479345 - RNA, 22 nt, Human
ugcagggcaucuuugaagugug

SEQ ID NO: 479346 - RNA, 22 nt, Human
uacauauacugagugauuugcu

SEQ ID NO: 479347 - RNA, 22 nt, Human
ggugggcacccgagacuggauc

SEQ ID NO: 479348 - RNA, 22 nt, Human
aggaccaacauagcagcagugg

SEQ ID NO: 479349 - RNA, 22 nt, Human
ucaauucugguccucaggaacu

SEQ ID NO: 479350 - RNA, 23 nt, Human
uuugcaaauuggacacaaccaca

SEQ ID NO: 479351 - RNA, 22 nt, Human
uggugccuugggccuacagcgc

SEQ ID NO: 479352 - RNA, 22 nt, Human
uuaauacagucuccagaaguaa

SEQ ID NO: 479353 - RNA, 22 nt, Human
auuauucaacacuugagaaauu

SEQ ID NO: 479354 - RNA, 22 nt, Human
augcugugauuguagaaauauu

SEQ ID NO: 479355 - RNA, 19 nt, Human
agaaucaggucaggugaca

SEQ ID NO: 479356 - RNA, 22 nt, Human
cacaguccuacagagaucagag

SEQ ID NO: 479357 - RNA, 21 nt, Human
cuguccaguaauuccuggcac

SEQ ID NO: 479358 - RNA, 22 nt, Human
cacugcuuaguugguaaaugug

SEQ ID NO: 479359 - RNA, 22 nt, Human
cuggccugagaaugcuacccuu

SEQ ID NO: 479360 - RNA, 22 nt, Human
aaaagaggagugguuuaugaca

SEQ ID NO: 479361 - RNA, 22 nt, Human
gcuguccucuuggacucagggc

SEQ ID NO: 479362 - RNA, 22 nt, Human
aggagccaagauggggcaagua

SEQ ID NO: 479363 - RNA, 22 nt, Human
acagcagcuggguucccaccau

SEQ ID NO: 479364 - RNA, 22 nt, Human
cugcuuuggcucagugacauca

SEQ ID NO: 479365 - RNA, 22 nt, Human
uugaagcauuguggcuuguauu

SEQ ID NO: 479366 - RNA, 22 nt, Human
aauaugcauuaacuguguacau

SEQ ID NO: 479367 - RNA, 22 nt, Human
acagcagagacacucaggaggc

SEQ ID NO: 479368 - RNA, 22 nt, Human
aggcugccuguuccaaucuccu

SEQ ID NO: 479369 - RNA, 22 nt, Human
gccugggugaauuugauccuaa

SEQ ID NO: 479370 - RNA, 22 nt, Human
cuggugggaggcaagguggaag

SEQ ID NO: 479371 - RNA, 23 nt, Human
gguggcaggaguggaugcugagc

SEQ ID NO: 479372 - RNA, 22 nt, Human
ggcccugggaugcucagcagug

SEQ ID NO: 479373 - RNA, 22 nt, Human
ggacuccucuagaaguugaggc

SEQ ID NO: 479374 - RNA, 22 nt, Human
ccagggcaggggcuggaguuca

SEQ ID NO: 479375 - RNA, 22 nt, Human
cuucuuuccuuccuccaguggc

SEQ ID NO: 479376 - RNA, 22 nt, Human
ccaggguggggcaggcccacug

SEQ ID NO: 479377 - RNA, 18 nt, Human
uguggcaggggugggaga

SEQ ID NO: 479378 - RNA, 22 nt, Human
ccugcagaaaggguccccagga

SEQ ID NO: 479379 - RNA, 22 nt, Human
ucacaggacccugaggguggcg

SEQ ID NO: 479380 - RNA, 22 nt, Human
uacagauacagaucuagauaca

SEQ ID NO: 479381 - RNA, 22 nt, Human
agaugugguaguugaagggaag

SEQ ID NO: 479382 - RNA, 22 nt, Human
agggcuggcaucucuaaugcug

SEQ ID NO: 479383 - RNA, 22 nt, Human
gcccaggcuggagugcaguagc

SEQ ID NO: 479384 - RNA, 22 nt, Human
caacagaagguguacuacugaa

SEQ ID NO: 479385 - RNA, 22 nt, Human
caguuucuauggcugggcucug

SEQ ID NO: 479386 - RNA, 23 nt, Human
aucaagauaauccagaugaccua

SEQ ID NO: 479387 - RNA, 22 nt, Human
guuuuacacaccuaugaaagac

SEQ ID NO: 479388 - RNA, 22 nt, Human
auugacaaauggauguugacau

SEQ ID NO: 479389 - RNA, 22 nt, Human
gcuguacauucugcacaggccc

SEQ ID NO: 479390 - RNA, 22 nt, Human
uuucuuuguuguuaucacauca

SEQ ID NO: 479391 - RNA, 22 nt, Human
uccucaggcugccuggaagacu

SEQ ID NO: 479392 - RNA, 22 nt, Human
uucacaggugacuggggauaac

SEQ ID NO: 479393 - RNA, 22 nt, Human
caccagguuccgggcagagcug

SEQ ID NO: 479394 - RNA, 22 nt, Human
gagggcucuacucaccacccug

SEQ ID NO: 479395 - RNA, 22 nt, Human
gcaggcugggguagccccacuu

SEQ ID NO: 479396 - RNA, 22 nt, Human
agauuuccugcacugccuuuga

SEQ ID NO: 479397 - RNA, 22 nt, Human
aggacagagggaccagagccca

SEQ ID NO: 479398 - RNA, 22 nt, Human
agagcugaaaaagcugacccgg

SEQ ID NO: 479399 - RNA, 22 nt, Human
ugcaggugccucuugagcuugu

SEQ ID NO: 479400 - RNA, 22 nt, Human
ucaggaaagaguguauccauca

SEQ ID NO: 479401 - RNA, 20 nt, Human
ucacuaguaaccaucugcuu

SEQ ID NO: 479402 - RNA, 22 nt, Human
cagugcagguggcagaggacag

SEQ ID NO: 479403 - RNA, 22 nt, Human
aggcuccaugcaaaggcuguuu

SEQ ID NO: 479404 - RNA, 22 nt, Human
cuaguucuagaucccugaggaa

SEQ ID NO: 479405 - RNA, 22 nt, Human
cuggcugcuuguagacucgacu

SEQ ID NO: 479406 - RNA, 21 nt, Human
acagaacuguauagugauaaa

SEQ ID NO: 479407 - RNA, 22 nt, Human
aacccgggaggcagagguugug

SEQ ID NO: 479408 - RNA, 20 nt, Human
agcccuguuuccuggagaga

SEQ ID NO: 479409 - RNA, 21 nt, Human
aaggaaaagcuuggucucuga

SEQ ID NO: 479410 - RNA, 22 nt, Human
auacagaagaacuauagccacu

SEQ ID NO: 479411 - RNA, 22 nt, Human
gcagugggagcuuaggcagugc

SEQ ID NO: 479412 - RNA, 22 nt, Human
gcauuuagcuuuaaaauauuuc

SEQ ID NO: 479413 - RNA, 21 nt, Human
cccaggucguggucuucccag

SEQ ID NO: 479414 - RNA, 22 nt, Human
acugugcaugaaccgaaacaaa

SEQ ID NO: 479415 - RNA, 22 nt, Human
caggcugagcucuggccugggc

SEQ ID NO: 479416 - RNA, 22 nt, Human
acguuuucagugacugugcuuc

SEQ ID NO: 479417 - RNA, 22 nt, Human
aggaaaaaagucugugauuaua

SEQ ID NO: 479418 - RNA, 22 nt, Human
ucugggggcgaccagggacugc

SEQ ID NO: 479419 - RNA, 22 nt, Human
agcagggcccacuaggggagau

SEQ ID NO: 479420 - RNA, 22 nt, Human
gccugagcccaggugugcagag

SEQ ID NO: 479421 - RNA, 20 nt, Human
aucaggauucuugcuuuguu

SEQ ID NO: 479422 - RNA, 22 nt, Human
cagcuggccugaucccuguggc

SEQ ID NO: 479423 - RNA, 22 nt, Human
agggaugguggagguugcaagu

SEQ ID NO: 479424 - RNA, 22 nt, Human
augagcuucccagacaggaugg

SEQ ID NO: 479425 - RNA, 22 nt, Human
cagggcaggaauuugacauugc

SEQ ID NO: 479426 - RNA, 22 nt, Human
ucuucacaccgggcagcaggaa

SEQ ID NO: 479427 - RNA, 22 nt, Human
cugaggccuaagacaugaauga

SEQ ID NO: 479428 - RNA, 22 nt, Human
gugcaugaagacucagaaaguc

SEQ ID NO: 479429 - RNA, 22 nt, Human
cccagcacuuugaauaugucac

SEQ ID NO: 479430 - RNA, 22 nt, Human
ucaccaggcaacuauguacucc

SEQ ID NO: 479431 - RNA, 22 nt, Human
uggagcaggaagucuauggcug

SEQ ID NO: 479432 - RNA, 20 nt, Human
cuuuggcaaugagaacaggg

SEQ ID NO: 479433 - RNA, 22 nt, Human
aguggcagacacaaugugggca

SEQ ID NO: 479434 - RNA, 22 nt, Human
uaauuuauuucaacugccaagg

SEQ ID NO: 479435 - RNA, 22 nt, Human
ggcagcagcaagguuggagcug

SEQ ID NO: 479436 - RNA, 22 nt, Human
aaggaggaauuucagggugaau

SEQ ID NO: 479437 - RNA, 22 nt, Human
aaacaucaauugcaucucccaa

SEQ ID NO: 479438 - RNA, 22 nt, Human
agccuggagcuugaguuaugag

SEQ ID NO: 479439 - RNA, 22 nt, Human
gagcugccggcccacaguacua

SEQ ID NO: 479440 - RNA, 22 nt, Human
uguuuuaugagccauauaaccu

SEQ ID NO: 479441 - RNA, 22 nt, Human
guuuucuuugaaugcuucuaga

SEQ ID NO: 479442 - RNA, 22 nt, Human
ucagaacauuuaaaaagugguu

SEQ ID NO: 479443 - RNA, 22 nt, Human
cugaggcugggcauggggucca

SEQ ID NO: 479444 - RNA, 17 nt, Human
aggcugcugggccaggg

SEQ ID NO: 479445 - RNA, 22 nt, Human
ugggggucaggaugaggccuug

SEQ ID NO: 479446 - RNA, 22 nt, Human
auuaagggccaauccuccagcc

SEQ ID NO: 479447 - RNA, 22 nt, Human
acuguacacacuucucugucuu

SEQ ID NO: 479448 - RNA, 22 nt, Human
agcacagguacggagaugcuac

SEQ ID NO: 479449 - RNA, 22 nt, Human
uacuacauuaauaaaacauuca

SEQ ID NO: 479450 - RNA, 22 nt, Human
ugcucuguaacaaauugacaug

SEQ ID NO: 479451 - RNA, 22 nt, Human
ccagcaggacuuuggaaauaug

SEQ ID NO: 479452 - RNA, 22 nt, Human
uccagaguacggaagagucauc

SEQ ID NO: 479453 - RNA, 22 nt, Human
agucugcacucagguggagguc

SEQ ID NO: 479454 - RNA, 22 nt, Human
ccagaggaaaaauaucucccua

SEQ ID NO: 479455 - RNA, 22 nt, Human
auguccagccaaccacuggauu

SEQ ID NO: 479456 - RNA, 22 nt, Human
uggcugaguuucaugcaucaug

SEQ ID NO: 479457 - RNA, 22 nt, Human
gaggccugucgcuaggccucug

SEQ ID NO: 479458 - RNA, 22 nt, Human
ucaggcuggagugcaguggcgc

SEQ ID NO: 479459 - RNA, 22 nt, Human
ucccagagaaagucaaggucuu

SEQ ID NO: 479460 - RNA, 22 nt, Human
uuucaugugcaauuagcaauau

SEQ ID NO: 479461 - RNA, 22 nt, Human
guuccacaaaauguacccaguu

SEQ ID NO: 479462 - RNA, 23 nt, Human
aucagucuugguagcugugccca

SEQ ID NO: 479463 - RNA, 22 nt, Human
uagcuuuagugaaaaauaucag

SEQ ID NO: 479464 - RNA, 22 nt, Human
cugccuggaccggcagcccucc

SEQ ID NO: 479465 - RNA, 22 nt, Human
auaaacagaguaguugcuacug

SEQ ID NO: 479466 - RNA, 20 nt, Human
gcucccugguagaaauguuu

SEQ ID NO: 479467 - RNA, 17 nt, Human
gcauccaguaacaugcc

SEQ ID NO: 479468 - RNA, 22 nt, Human
cugcagagguugguucuaagau

SEQ ID NO: 479469 - RNA, 22 nt, Human
gccuugccucagccauggaaac

SEQ ID NO: 479470 - RNA, 19 nt, Human
ccuuggaguuccaggugga

SEQ ID NO: 479471 - RNA, 22 nt, Human
gauuuucauuauagcuaguuuc

SEQ ID NO: 479472 - RNA, 22 nt, Human
augggaguuuucucugaugcuc

SEQ ID NO: 479473 - RNA, 22 nt, Human
agggcuacugccugccuucagg

SEQ ID NO: 479474 - RNA, 17 nt, Human
caaggccagcaucuuca

SEQ ID NO: 479475 - RNA, 22 nt, Human
agaaaugcauuagcacauauag

SEQ ID NO: 479476 - RNA, 22 nt, Human
aguguauugauuggaacagccu

SEQ ID NO: 479477 - RNA, 22 nt, Human
gguuugcauucugaaaggcuca

SEQ ID NO: 479478 - RNA, 22 nt, Human
cuucagggugacgcaggcugca

SEQ ID NO: 479479 - RNA, 22 nt, Human
gcaguggcuaagcucgcaugca

SEQ ID NO: 479480 - RNA, 22 nt, Human
gggagcugagggaccucugugg

SEQ ID NO: 479481 - RNA, 22 nt, Human
agcagggcuuugucucugugaa

SEQ ID NO: 479482 - RNA, 22 nt, Human
uauuaucauugguaauaugguc

SEQ ID NO: 479483 - RNA, 22 nt, Human
aaaaguaauugaugcaaucgua

SEQ ID NO: 479484 - RNA, 22 nt, Human
auagcuguuagauuggggucga

SEQ ID NO: 479485 - RNA, 22 nt, Human
caggggcugugggcggagccuc

SEQ ID NO: 479486 - RNA, 19 nt, Human
uccuucagucagaucuggg

SEQ ID NO: 479487 - RNA, 22 nt, Human
ucaggaugguguggaggaaaua

SEQ ID NO: 479488 - RNA, 22 nt, Human
acccaggggcagccuugcugug

SEQ ID NO: 479489 - RNA, 21 nt, Human
ggugucaguuuuggucauuag

SEQ ID NO: 479490 - RNA, 19 nt, Human
ugggcuuccccagggcaga

SEQ ID NO: 479491 - RNA, 22 nt, Human
agggguggccugccuuacuccc

SEQ ID NO: 479492 - RNA, 22 nt, Human
uucccaggcugugcuaccagag

SEQ ID NO: 479493 - RNA, 22 nt, Human
ggcucacgcaauuaucccggcc

SEQ ID NO: 479494 - RNA, 22 nt, Human
uugcaccaaaugaguuaaaauu

SEQ ID NO: 479495 - RNA, 22 nt, Human
gguggggucacgacagagggaa

SEQ ID NO: 479496 - RNA, 22 nt, Human
gcaggcugaugacuggaguugg

SEQ ID NO: 479497 - RNA, 22 nt, Human
aauguguguucggggcccagag

SEQ ID NO: 479498 - RNA, 22 nt, Human
aucagcaaaaaugccuucagaa

SEQ ID NO: 479499 - RNA, 19 nt, Human
cugcagggaugugcagagu

SEQ ID NO: 479500 - RNA, 22 nt, Human
uuuccacuguagagauguugaa

SEQ ID NO: 479501 - RNA, 22 nt, Human
gaagaaggugccagaggcuuac

SEQ ID NO: 479502 - RNA, 22 nt, Human
ugugccaugaggcucugauaug

SEQ ID NO: 479503 - RNA, 22 nt, Human
gagacacacacaggagguggca

SEQ ID NO: 479504 - RNA, 22 nt, Human
gugcauauaugcacauaugugu

SEQ ID NO: 479505 - RNA, 22 nt, Human
uguaugcagcaaaacaauuagu

SEQ ID NO: 479506 - RNA, 22 nt, Human
agucagcagccuggccaggaga

SEQ ID NO: 479507 - RNA, 23 nt, Human
ccucccaccuauuucacuuucuu

SEQ ID NO: 479508 - RNA, 22 nt, Human
ccaggagcaacuugaaggcaag

SEQ ID NO: 479509 - RNA, 22 nt, Human
gaaugugugacucuauugagca

SEQ ID NO: 479510 - RNA, 22 nt, Human
agauacauauagaaaacaucaa

SEQ ID NO: 479511 - RNA, 22 nt, Human
gcugaagagagaugcguccagc

SEQ ID NO: 479512 - RNA, 22 nt, Human
cagaaugcaaauuuuauaauau

SEQ ID NO: 479513 - RNA, 22 nt, Human
gcugucucggggcuuucuccug

SEQ ID NO: 479514 - RNA, 22 nt, Human
gcaggcaguuugcuuuucccuc

SEQ ID NO: 479515 - RNA, 22 nt, Human
cccagaaggucgaggcugcagu

SEQ ID NO: 479516 - RNA, 22 nt, Human
cccaggaggucgaagcugcagu

SEQ ID NO: 479517 - RNA, 22 nt, Human
caagggugguauugggagcaua

SEQ ID NO: 479518 - RNA, 22 nt, Human
agcagcauggagaaaccguuca

SEQ ID NO: 479519 - RNA, 22 nt, Human
agucucuuuugcgaagaguguu

SEQ ID NO: 479520 - RNA, 22 nt, Human
acauacuuuuuaaaagauugcu

SEQ ID NO: 479521 - RNA, 22 nt, Human
agaagcugacagaugcagcagg

SEQ ID NO: 479522 - RNA, 22 nt, Human
acagacuguuugguucaugucu

SEQ ID NO: 479523 - RNA, 22 nt, Human
ucuggcucugaauucacuucug

SEQ ID NO: 479524 - RNA, 22 nt, Human
ucggagcuguagaugaaacccu

SEQ ID NO: 479525 - RNA, 22 nt, Human
gcagggcugcagagggcacugu

SEQ ID NO: 479526 - RNA, 22 nt, Human
agggcugacagugaggagucaa

SEQ ID NO: 479527 - RNA, 22 nt, Human
cugccuguuuucugauagauuu

SEQ ID NO: 479528 - RNA, 22 nt, Human
caggacugauguuccuccagcc

SEQ ID NO: 479529 - RNA, 22 nt, Human
cagcaggaggcauggcuucccu

SEQ ID NO: 479530 - RNA, 22 nt, Human
uccuuuccagccucaccucagc

SEQ ID NO: 479531 - RNA, 22 nt, Human
guacccagaggcaugaucccag

SEQ ID NO: 479532 - RNA, 22 nt, Human
uuucuauuggcgucacuguugu

SEQ ID NO: 479533 - RNA, 22 nt, Human
cccagcuaccucugcuaggaga

SEQ ID NO: 479534 - RNA, 18 nt, Human
caugggugacagguggau

SEQ ID NO: 479535 - RNA, 22 nt, Human
agcccccaaaagugcuuaugau

SEQ ID NO: 479536 - RNA, 22 nt, Human
gagggccaauggauuucaacug

SEQ ID NO: 479537 - RNA, 22 nt, Human
gcacagcaauuucuauaagcuc

SEQ ID NO: 479538 - RNA, 22 nt, Human
uggcugaggucuggggcuucug

SEQ ID NO: 479539 - RNA, 22 nt, Human
ucuaauccuugcuaccugggug

SEQ ID NO: 479540 - RNA, 20 nt, Human
uguuaaaggacacuugcuuu

SEQ ID NO: 479541 - RNA, 20 nt, Human
uauuugaaauggccaagugu

SEQ ID NO: 479542 - RNA, 22 nt, Human
cacuacuugaaagaauuacaga

SEQ ID NO: 479543 - RNA, 22 nt, Human
agcagccagaaagggcagucga

SEQ ID NO: 479544 - RNA, 22 nt, Human
gaaaugcauaaucuuaguagau

SEQ ID NO: 479545 - RNA, 22 nt, Human
cugcuuuguguggucccuccag

SEQ ID NO: 479546 - RNA, 20 nt, Human
uuugucuguuaaguguuucu

SEQ ID NO: 479547 - RNA, 22 nt, Human
agagagcauggcacagaggggu

SEQ ID NO: 479548 - RNA, 22 nt, Human
cugagccauaagggaggcuggg

SEQ ID NO: 479549 - RNA, 22 nt, Human
auugcaccuuggguuuugaaag

SEQ ID NO: 479550 - RNA, 22 nt, Human
gggaguguugagcgcccugcca

SEQ ID NO: 479551 - RNA, 18 nt, Human
acagacaaaauggaaaug

SEQ ID NO: 479552 - RNA, 22 nt, Human
guguccuuuuaugugacugguu

SEQ ID NO: 479553 - RNA, 22 nt, Human
cagcuugggucaggugccugcu

SEQ ID NO: 479554 - RNA, 22 nt, Human
gccuggaggggacagucucugg

SEQ ID NO: 479555 - RNA, 22 nt, Human
gcagggacagggcagggccuuu

SEQ ID NO: 479556 - RNA, 20 nt, Human
acugccuugguucaguaggu

SEQ ID NO: 479557 - RNA, 22 nt, Human
ggacuggacucucaggcucaca

SEQ ID NO: 479558 - RNA, 22 nt, Human
uggcucagaagaaaagguaaac

SEQ ID NO: 479559 - RNA, 22 nt, Human
uuuguucauuuugagcucauca

SEQ ID NO: 479560 - RNA, 22 nt, Human
cauuuguuaaccaguguggauu

SEQ ID NO: 479561 - RNA, 22 nt, Human
agaggccuaauugcuacccuuu

SEQ ID NO: 479562 - RNA, 22 nt, Human
aaaaugcaugagaaugugcucg

SEQ ID NO: 479563 - RNA, 22 nt, Human
acacagggcagagagcuggcuc

SEQ ID NO: 479564 - RNA, 22 nt, Human
ggccucucucccuggcuugcag

SEQ ID NO: 479565 - RNA, 22 nt, Human
uggcugagugauauuugcaaag

SEQ ID NO: 479566 - RNA, 22 nt, Human
cagggcugucuccaaaggcccc

SEQ ID NO: 479567 - RNA, 22 nt, Human
cagugaggcucugcugagcggu

SEQ ID NO: 479568 - RNA, 22 nt, Human
ccaggccauucccagaguugcu

SEQ ID NO: 479569 - RNA, 22 nt, Human
uuagaaaucugcugccaugcaa

SEQ ID NO: 479570 - RNA, 22 nt, Human
agccucucuguuagucacuggg

SEQ ID NO: 479571 - RNA, 22 nt, Human
ccauaagguugaaaacuguaca

SEQ ID NO: 479572 - RNA, 22 nt, Human
gagacugcauuguccaaggguu

SEQ ID NO: 479573 - RNA, 22 nt, Human
aggaaacuccccuacaucucaa

SEQ ID NO: 479574 - RNA, 22 nt, Human
agauggggcucaguguggaggc

SEQ ID NO: 479575 - RNA, 22 nt, Human
uguuaaauguuccuuuacugga

SEQ ID NO: 479576 - RNA, 22 nt, Human
uguuuaaucuauaaaauggaga

SEQ ID NO: 479577 - RNA, 22 nt, Human
uuagauaacaguagaauaucaa

SEQ ID NO: 479578 - RNA, 22 nt, Human
ucuccuccuuuuuucaacauag

SEQ ID NO: 479579 - RNA, 22 nt, Human
ucccagagcugauaagccuuua

SEQ ID NO: 479580 - RNA, 22 nt, Human
aguuauuucaguaacauaauag

SEQ ID NO: 479581 - RNA, 22 nt, Human
cucuuuccucagccacagucua

SEQ ID NO: 479582 - RNA, 22 nt, Human
ucuuccucuagaucugaggccc

SEQ ID NO: 479583 - RNA, 22 nt, Human
ucaguggauugacaugaaaaag

SEQ ID NO: 479584 - RNA, 22 nt, Human
acaugauuggacuccuuccccu

SEQ ID NO: 479585 - RNA, 22 nt, Human
uccucuggcccagcugccucug

SEQ ID NO: 479586 - RNA, 22 nt, Human
uagggcucugagaguucagccu

SEQ ID NO: 479587 - RNA, 18 nt, Human
ugucucaggcugaaacag

SEQ ID NO: 479588 - RNA, 19 nt, Human
ugggcagguucaguaaugg

SEQ ID NO: 479589 - RNA, 22 nt, Human
augaagcugguuuuggcuuggg

SEQ ID NO: 479590 - RNA, 23 nt, Human
ggccauggagacuuagaaugggc

SEQ ID NO: 479591 - RNA, 22 nt, Human
auucaguaggucuagaauaaga

SEQ ID NO: 479592 - RNA, 22 nt, Human
uagaaauccccagucucauagu

SEQ ID NO: 479593 - RNA, 22 nt, Human
uguucuugggaaucuuacaguu

SEQ ID NO: 479594 - RNA, 22 nt, Human
gaggaggaaguucucuguaggc

SEQ ID NO: 479595 - RNA, 22 nt, Human
cagaguggcgacccccucagcu

SEQ ID NO: 479596 - RNA, 22 nt, Human
guucccauacaguaucagugcu

SEQ ID NO: 479597 - RNA, 22 nt, Human
ucucaggacuuugggaagcuca

SEQ ID NO: 479598 - RNA, 22 nt, Human
accugagggcccaaacuuggua

SEQ ID NO: 479599 - RNA, 22 nt, Human
cacagcugcacagaggaggugc

SEQ ID NO: 479600 - RNA, 21 nt, Human
ugguuugcggccaaaguuaaa

SEQ ID NO: 479601 - RNA, 22 nt, Human
gugccugugcggacucagggaa

SEQ ID NO: 479602 - RNA, 22 nt, Human
ugcauuuuuaacaaggcuaauu

SEQ ID NO: 479603 - RNA, 22 nt, Human
aagauacugaugauguaggcua

SEQ ID NO: 479604 - RNA, 22 nt, Human
uugaagcauuucuuugagcuuc

SEQ ID NO: 479605 - RNA, 22 nt, Human
gugucccagccccacaggccug

SEQ ID NO: 479606 - RNA, 20 nt, Human
ucugcucagcccucaguggc

SEQ ID NO: 479607 - RNA, 22 nt, Human
aggcucagggacggggccccuu

SEQ ID NO: 479608 - RNA, 22 nt, Human
aggagcagaccguaguccugca

SEQ ID NO: 479609 - RNA, 22 nt, Human
cagagaaagaagcccauucauu

SEQ ID NO: 479610 - RNA, 22 nt, Human
cuaaaugccuuuccuaccuaac

SEQ ID NO: 479611 - RNA, 17 nt, Human
gguguauggggagggaa

SEQ ID NO: 479612 - RNA, 22 nt, Human
uacaaaguuuucuuggauugag

SEQ ID NO: 479613 - RNA, 22 nt, Human
cuguuaaucugcuugcaugaug

SEQ ID NO: 479614 - RNA, 22 nt, Human
accaucuuaguggccagcucuc

SEQ ID NO: 479615 - RNA, 21 nt, Human
acagaugggaugagcacacug

SEQ ID NO: 479616 - RNA, 22 nt, Human
ugcugccagccaggccauggag

SEQ ID NO: 479617 - RNA, 22 nt, Human
gaggccugaggcugccuggagc

SEQ ID NO: 479618 - RNA, 22 nt, Human
ugaggcuguucuaccagggcca

SEQ ID NO: 479619 - RNA, 22 nt, Human
aggaagcccaagucucaucuuc

SEQ ID NO: 479620 - RNA, 22 nt, Human
ucucuguacaguacaugccgug

SEQ ID NO: 479621 - RNA, 22 nt, Human
gccacagggcagaugcgcagag

SEQ ID NO: 479622 - RNA, 22 nt, Human
uguauuagaucugagaacuucu

SEQ ID NO: 479623 - RNA, 22 nt, Human
uuguacaaguauuaugugaaca

SEQ ID NO: 479624 - RNA, 22 nt, Human
uuucaaagguggaagagugaau

SEQ ID NO: 479625 - RNA, 22 nt, Human
caggagaagucucuagggggug

SEQ ID NO: 479626 - RNA, 22 nt, Human
ccucagagaaagguauggcuga

SEQ ID NO: 479627 - RNA, 22 nt, Human
agcucagcuuccucuccaugcu

SEQ ID NO: 479628 - RNA, 22 nt, Human
gcagggcagaaggugcugagga

SEQ ID NO: 479629 - RNA, 19 nt, Human
ugggcagcucccucugucc

SEQ ID NO: 479630 - RNA, 22 nt, Human
auaaggcacacauagauagggu

SEQ ID NO: 479631 - RNA, 22 nt, Human
cccacacauuuuucacuuaccg

SEQ ID NO: 479632 - RNA, 22 nt, Human
ggggugggcgugcagggacacc

SEQ ID NO: 479633 - RNA, 22 nt, Human
ccugucugcaugagugagcaua

SEQ ID NO: 479634 - RNA, 22 nt, Human
uccaggcaugucugaguccuuc

SEQ ID NO: 479635 - RNA, 22 nt, Human
auaaaaguaggaccaacuuaca

SEQ ID NO: 479636 - RNA, 20 nt, Human
cccugagaccagagagcagc

SEQ ID NO: 479637 - RNA, 22 nt, Human
cccagcagcuugcacagugcug

SEQ ID NO: 479638 - RNA, 22 nt, Human
gugggcagugguuugcgcgguc

SEQ ID NO: 479639 - RNA, 22 nt, Human
uaacagaaaggcucaggugcuc

SEQ ID NO: 479640 - RNA, 22 nt, Human
cuggcagcccaaccuagagucu

SEQ ID NO: 479641 - RNA, 22 nt, Human
gcacagggagacagccguggcc

SEQ ID NO: 479642 - RNA, 22 nt, Human
ccugggcaauauagugaggccc

SEQ ID NO: 479643 - RNA, 22 nt, Human
aauguguagggugccuguuuuu

SEQ ID NO: 479644 - RNA, 22 nt, Human
aggcuguccucucuugcucagu

SEQ ID NO: 479645 - RNA, 22 nt, Human
ugcauuguugaauauuucauag

SEQ ID NO: 479646 - RNA, 22 nt, Human
uuucacagguacaaacacuccu

SEQ ID NO: 479647 - RNA, 23 nt, Human
uuacuuuugcaccaaccuaauau

SEQ ID NO: 479648 - RNA, 17 nt, Human
cucagaguugcuuuguc

SEQ ID NO: 479649 - RNA, 22 nt, Human
ucuguccuguuuccuccugaca

SEQ ID NO: 479650 - RNA, 22 nt, Human
ugccugggccucugaggaaggc

SEQ ID NO: 479651 - RNA, 22 nt, Human
uuccaaagaaauugaccaagac

SEQ ID NO: 479652 - RNA, 22 nt, Human
cugggagcccgcguccuggugg

SEQ ID NO: 479653 - RNA, 21 nt, Human
aggcucccagaaaugggcauc

SEQ ID NO: 479654 - RNA, 22 nt, Human
aguggggagguccaggccaccc

SEQ ID NO: 479655 - RNA, 22 nt, Human
gacaugcaacaauuuggcauuu

SEQ ID NO: 479656 - RNA, 22 nt, Human
guaucuuuuacaccaggaaauu

SEQ ID NO: 479657 - RNA, 22 nt, Human
caguagacacauuaauauggaa

SEQ ID NO: 479658 - RNA, 22 nt, Human
uccagaccuagggcaccccagu

SEQ ID NO: 479659 - RNA, 22 nt, Human
auacauguaacugcauuguaau

SEQ ID NO: 479660 - RNA, 22 nt, Human
gggcagcucuggcugugggaag

SEQ ID NO: 479661 - RNA, 22 nt, Human
agaagccaauucugugugaguc

SEQ ID NO: 479662 - RNA, 22 nt, Human
ccagagggcaaaaugaagcuua

SEQ ID NO: 479663 - RNA, 22 nt, Human
cugggcugcgggcgccccucca

SEQ ID NO: 479664 - RNA, 22 nt, Human
ccugucucuuucaaucugagag

SEQ ID NO: 479665 - RNA, 23 nt, Human
cccugcagucagggugagauggu

SEQ ID NO: 479666 - RNA, 22 nt, Human
ugaaacaaaaguauguagcuug

SEQ ID NO: 479667 - RNA, 22 nt, Human
gccaggcuggugcaaggauauu

SEQ ID NO: 479668 - RNA, 22 nt, Human
caccagggcucugagcucugaa

SEQ ID NO: 479669 - RNA, 22 nt, Human
ggccugccucacagucagcacc

SEQ ID NO: 479670 - RNA, 22 nt, Human
gcugagagaucaaggcaggauu

SEQ ID NO: 479671 - RNA, 22 nt, Human
aacagaaaagguagguggcuuu

SEQ ID NO: 479672 - RNA, 22 nt, Human
uuauuagguuauucucuguacu

SEQ ID NO: 479673 - RNA, 22 nt, Human
aucuggcucgcuaggcucuggg

SEQ ID NO: 479674 - RNA, 22 nt, Human
ugcuccagugagcuggccaucc

SEQ ID NO: 479675 - RNA, 22 nt, Human
cagguccugcagggagaguaaa

SEQ ID NO: 479676 - RNA, 18 nt, Human
gaagggagcuggaaugca

SEQ ID NO: 479677 - RNA, 22 nt, Human
ggcugugagcaggcagaaugcu

SEQ ID NO: 479678 - RNA, 22 nt, Human
cagagcauuuggaagccacgug

SEQ ID NO: 479679 - RNA, 22 nt, Human
gggcauggugaugugcaccugu

SEQ ID NO: 479680 - RNA, 22 nt, Human
aucaguuuaaaugggcuguugg

SEQ ID NO: 479681 - RNA, 18 nt, Human
aagaacugagguccuaga

SEQ ID NO: 479682 - RNA, 22 nt, Human
agcucccugagaugccacagca

SEQ ID NO: 479683 - RNA, 22 nt, Human
acacaggaagucagcacugaug

SEQ ID NO: 479684 - RNA, 22 nt, Human
aguggcagaagccaagucugca

SEQ ID NO: 479685 - RNA, 22 nt, Human
agcagagguguuuauuauggga

SEQ ID NO: 479686 - RNA, 22 nt, Human
auagcagaaaccaagcuucuuc

SEQ ID NO: 479687 - RNA, 22 nt, Human
ggcugccuucccugagccccgg

SEQ ID NO: 479688 - RNA, 17 nt, Human
cugaagauaauggcaac

SEQ ID NO: 479689 - RNA, 22 nt, Human
caguggaagcuggcugugaaga

SEQ ID NO: 479690 - RNA, 22 nt, Human
uguuacuuaucucacgugaugc

SEQ ID NO: 479691 - RNA, 22 nt, Human
ggagucaccaaguaggagucuu

SEQ ID NO: 479692 - RNA, 22 nt, Human
aucaggaugacuauaaggcugc

SEQ ID NO: 479693 - RNA, 18 nt, Human
agacccucuaagggcagu

SEQ ID NO: 479694 - RNA, 22 nt, Human
ugucuguaagguguuuauguua

SEQ ID NO: 479695 - RNA, 22 nt, Human
ucucuggaauuuugagagugac

SEQ ID NO: 479696 - RNA, 17 nt, Human
uggcuucccugggccac

SEQ ID NO: 479697 - RNA, 22 nt, Human
agccuccaguagcugaagagac

SEQ ID NO: 479698 - RNA, 22 nt, Human
ccugucucccuggcauggcuca

SEQ ID NO: 479699 - RNA, 22 nt, Human
uacaagaugacaggugcaugau

SEQ ID NO: 479700 - RNA, 22 nt, Human
aggcugaggcgggaggaucacu

SEQ ID NO: 479701 - RNA, 22 nt, Human
cagcuggacuuuugauagaagu

SEQ ID NO: 479702 - RNA, 22 nt, Human
ugccuaggaaaccucaugcuuc

SEQ ID NO: 479703 - RNA, 22 nt, Human
aauucuagcauugugaaaauau

SEQ ID NO: 479704 - RNA, 22 nt, Human
ggcacugggcaccggcugaggg

SEQ ID NO: 479705 - RNA, 22 nt, Human
auucaaguccagcuucucuaca

SEQ ID NO: 479706 - RNA, 22 nt, Human
uguauauucugccuaaaagcuu

SEQ ID NO: 479707 - RNA, 22 nt, Human
ugggagaugguucugagacuuu

SEQ ID NO: 479708 - RNA, 22 nt, Human
aagagcauggaauggagaucca

SEQ ID NO: 479709 - RNA, 22 nt, Human
acugcccuguaacugccaggua

SEQ ID NO: 479710 - RNA, 22 nt, Human
ugauuucuuccuugucauuaga

SEQ ID NO: 479711 - RNA, 22 nt, Human
gcuguucugcgucccaggcugg

SEQ ID NO: 479712 - RNA, 22 nt, Human
aggcuggcccuacuggcugccu

SEQ ID NO: 479713 - RNA, 22 nt, Human
ggucccaggagaauaggugcaa

SEQ ID NO: 479714 - RNA, 22 nt, Human
aagcaggauggaucuaguguuc

SEQ ID NO: 479715 - RNA, 21 nt, Human
cagaggcagguccugggacgg

SEQ ID NO: 479716 - RNA, 22 nt, Human
auaugcacacucugcccacaga

SEQ ID NO: 479717 - RNA, 22 nt, Human
accauuuuggguauuuucagag

SEQ ID NO: 479718 - RNA, 22 nt, Human
gcugccaguaguuggagcucca

SEQ ID NO: 479719 - RNA, 22 nt, Human
cugccuuccaaccccagacucc

SEQ ID NO: 479720 - RNA, 23 nt, Human
ucuccagugucucuucauugagu

SEQ ID NO: 479721 - RNA, 22 nt, Human
acuuccuguuaugugugccucu

SEQ ID NO: 479722 - RNA, 22 nt, Human
ccaaagugcugggguuacaggc

SEQ ID NO: 479723 - RNA, 22 nt, Human
aggcuuuaaguggccuacagcu

SEQ ID NO: 479724 - RNA, 22 nt, Human
ugcuggcuacugauggcaggcc

SEQ ID NO: 479725 - RNA, 22 nt, Human
accucugccacuuucuaacucu

SEQ ID NO: 479726 - RNA, 22 nt, Human
auuucacaaagaacagaugcag

SEQ ID NO: 479727 - RNA, 22 nt, Human
cagggcucccugcagccucugu

SEQ ID NO: 479728 - RNA, 22 nt, Human
cagaauggcuuuuauggcucag

SEQ ID NO: 479729 - RNA, 22 nt, Human
aggccuggguguucaccagaag

SEQ ID NO: 479730 - RNA, 22 nt, Human
ccagccucacuggcaucaccua

SEQ ID NO: 479731 - RNA, 22 nt, Human
uucuuuccaaccagauauuggu

SEQ ID NO: 479732 - RNA, 22 nt, Human
ugggaguguucuuggcuugcuu

SEQ ID NO: 479733 - RNA, 18 nt, Human
uggguggcuagggaguuu

SEQ ID NO: 479734 - RNA, 22 nt, Human
ugggaggagcccucugggaagg

SEQ ID NO: 479735 - RNA, 22 nt, Human
ucagggacgugagcucagaguc

SEQ ID NO: 479736 - RNA, 22 nt, Human
cugagcuuggccaggaaugaau

SEQ ID NO: 479737 - RNA, 22 nt, Human
ugcugccaagcccgugcuccug

SEQ ID NO: 479738 - RNA, 19 nt, Human
aggcagcacccaguccuug

SEQ ID NO: 479739 - RNA, 22 nt, Human
acaggcugacuuccugccaugu

SEQ ID NO: 479740 - RNA, 22 nt, Human
caaaugcaugagaaauaagagg

SEQ ID NO: 479741 - RNA, 22 nt, Human
aaagucugagcagaauuucuca

SEQ ID NO: 479742 - RNA, 22 nt, Human
ggcagggugccuggcuccuguu

SEQ ID NO: 479743 - RNA, 22 nt, Human
acugaguguaggacuuugaguu

SEQ ID NO: 479744 - RNA, 22 nt, Human
gagggcugaugcuuacuuauuu

SEQ ID NO: 479745 - RNA, 22 nt, Human
cacaggcucuucucacuugauu

SEQ ID NO: 479746 - RNA, 22 nt, Human
cacagccugcugcacucaagaa

SEQ ID NO: 479747 - RNA, 22 nt, Human
uggcagagguaauucaaauccc

SEQ ID NO: 479748 - RNA, 17 nt, Human
gggcugacaguggccuc

SEQ ID NO: 479749 - RNA, 21 nt, Human
agaaaaaccagcauguuuuca

SEQ ID NO: 479750 - RNA, 18 nt, Human
gccagagggaagcaggug

SEQ ID NO: 479751 - RNA, 22 nt, Human
ugggaggcagguaggugaugau

SEQ ID NO: 479752 - RNA, 22 nt, Human
cuguuuauaaauagaggggagu

SEQ ID NO: 479753 - RNA, 22 nt, Human
ugcuuuauucccuucugaugug

SEQ ID NO: 479754 - RNA, 22 nt, Human
agcagcucuggcacuguagcau

SEQ ID NO: 479755 - RNA, 22 nt, Human
uuguuaaaaauagauuuccagg

SEQ ID NO: 479756 - RNA, 22 nt, Human
cugagcugggaguagagacucu

SEQ ID NO: 479757 - RNA, 22 nt, Human
agggcugccugacuccagagcc

SEQ ID NO: 479758 - RNA, 22 nt, Human
ccauaaucuggcuuugagagag

SEQ ID NO: 479759 - RNA, 23 nt, Human
uggccugcagaguuucugcuggg

SEQ ID NO: 479760 - RNA, 22 nt, Human
uccuuccucggggacccagauc

SEQ ID NO: 479761 - RNA, 22 nt, Human
ugucagcagcugguuugcuguu

SEQ ID NO: 479762 - RNA, 21 nt, Human
ggagucauuagucauuuccuu

SEQ ID NO: 479763 - RNA, 22 nt, Human
uagcauuuggcaccaguuauuu

SEQ ID NO: 479764 - RNA, 21 nt, Human
uccagggaacuucucaggaau

SEQ ID NO: 479765 - RNA, 22 nt, Human
ugucuagggagcugcucaggcu

SEQ ID NO: 479766 - RNA, 22 nt, Human
cccaggccccagggcuugucag

SEQ ID NO: 479767 - RNA, 22 nt, Human
gcuuccuucuaccacaucaugc

SEQ ID NO: 479768 - RNA, 21 nt, Human
aaagugguaaggauuauuuug

SEQ ID NO: 479769 - RNA, 22 nt, Human
gucccacaccuugaggggucuu

SEQ ID NO: 479770 - RNA, 22 nt, Human
agagggcccauguugggcugcu

SEQ ID NO: 479771 - RNA, 22 nt, Human
ugagugaggaagcgguggagga

SEQ ID NO: 479772 - RNA, 22 nt, Human
gaggcucagggaguauaugaau

SEQ ID NO: 479773 - RNA, 22 nt, Human
ucuuagaaauuccccaguggcu

SEQ ID NO: 479774 - RNA, 22 nt, Human
aggguaggguaaaugaugcauc

SEQ ID NO: 479775 - RNA, 22 nt, Human
ucccaaggcacagggcagggac

SEQ ID NO: 479776 - RNA, 22 nt, Human
cuggaaguauaggggagaugau

SEQ ID NO: 479777 - RNA, 22 nt, Human
ggcucugcgcgguaaagugacu

SEQ ID NO: 479778 - RNA, 22 nt, Human
cugcaggauucucccaguugga

SEQ ID NO: 479779 - RNA, 22 nt, Human
cagggccagccgcagcauccac

SEQ ID NO: 479780 - RNA, 22 nt, Human
cccaggcagcccuucugacgca

SEQ ID NO: 479781 - RNA, 22 nt, Human
agcagccaaccuuacauucauc

SEQ ID NO: 479782 - RNA, 18 nt, Human
gugacagcugcuagcuca

SEQ ID NO: 479783 - RNA, 22 nt, Human
cagagccugcucacgucucugu

SEQ ID NO: 479784 - RNA, 22 nt, Human
ugcaggccggcccuaggccuca

SEQ ID NO: 479785 - RNA, 22 nt, Human
gacaggguacgggcuaggcaca

SEQ ID NO: 479786 - RNA, 22 nt, Human
ugucucugaggugagggucagc

SEQ ID NO: 479787 - RNA, 22 nt, Human
cuuaauuuaaaauaguucaggc

SEQ ID NO: 479788 - RNA, 22 nt, Human
uuagaaagaacuuuagauauca

SEQ ID NO: 479789 - RNA, 22 nt, Human
gacauucacagguaaacauucc

SEQ ID NO: 479790 - RNA, 22 nt, Human
ggccugcugcuaugacuuccug

SEQ ID NO: 479791 - RNA, 22 nt, Human
aggugcagcaugaguccaacgg

SEQ ID NO: 479792 - RNA, 22 nt, Human
gagcuggcaggaggcuccccga

SEQ ID NO: 479793 - RNA, 22 nt, Human
ggccucaguuucuccauggguu

SEQ ID NO: 479794 - RNA, 21 nt, Human
uggcugaguggaugcaugaau

SEQ ID NO: 479795 - RNA, 22 nt, Human
ucaggagcagcaugggugagag

SEQ ID NO: 479796 - RNA, 22 nt, Human
cugugccaggcccagcugacuu

SEQ ID NO: 479797 - RNA, 22 nt, Human
ggcugagcacuuuaggcaggag

SEQ ID NO: 479798 - RNA, 22 nt, Human
uacaagagguauauagaaacag

SEQ ID NO: 479799 - RNA, 22 nt, Human
aaggcgacacaggcagcaggcc

SEQ ID NO: 479800 - RNA, 22 nt, Human
augaaacaugagaaauggagag

SEQ ID NO: 479801 - RNA, 22 nt, Human
ugggccacuugaaaguggaugu

SEQ ID NO: 479802 - RNA, 22 nt, Human
guggggcaguggccugggagca

SEQ ID NO: 479803 - RNA, 22 nt, Human
ucccaggacaggccacauggaa

SEQ ID NO: 479804 - RNA, 22 nt, Human
cugcugugggcaggguagcugg

SEQ ID NO: 479805 - RNA, 22 nt, Human
aaagauuuaugaaguucaauua

SEQ ID NO: 479806 - RNA, 22 nt, Human
cuuccuguugucacagucugcg

SEQ ID NO: 479807 - RNA, 22 nt, Human
cuuauuagaaagaaaagacaug

SEQ ID NO: 479808 - RNA, 22 nt, Human
cugcccugagggccuguguguu

SEQ ID NO: 479809 - RNA, 22 nt, Human
cauuucuaagaaggcugcacau

SEQ ID NO: 479810 - RNA, 22 nt, Human
aaauguuccuuuggauuaaacu

SEQ ID NO: 479811 - RNA, 22 nt, Human
acacaggggaaaguggagcuga

SEQ ID NO: 479812 - RNA, 22 nt, Human
gaaaugugaccuacuuccuugu

SEQ ID NO: 479813 - RNA, 22 nt, Human
uggagcaggcaucuuucucucu

SEQ ID NO: 479814 - RNA, 22 nt, Human
cuuggccucuucucaggguggg

SEQ ID NO: 479815 - RNA, 23 nt, Human
ccagcugugccuggcccaggagc

SEQ ID NO: 479816 - RNA, 22 nt, Human
auaaggaaugauguaucaguuu

SEQ ID NO: 479817 - RNA, 22 nt, Human
cauuuuauccucugggaagcua

SEQ ID NO: 479818 - RNA, 22 nt, Human
cuucuuaacuguauauacuaug

SEQ ID NO: 479819 - RNA, 21 nt, Human
uucaaugaaaacaaagugagg

SEQ ID NO: 479820 - RNA, 22 nt, Human
augaagcuaaacccugcagcca

SEQ ID NO: 479821 - RNA, 22 nt, Human
aagaacagguucuagaaccauu

SEQ ID NO: 479822 - RNA, 21 nt, Human
ucucuggaauuagaccauguu

SEQ ID NO: 479823 - RNA, 22 nt, Human
gcaaaugcuaaaguguagagac

SEQ ID NO: 479824 - RNA, 22 nt, Human
ucccugggcaucacguugcuuc

SEQ ID NO: 479825 - RNA, 22 nt, Human
cccaggacucggcacucuccuu

SEQ ID NO: 479826 - RNA, 22 nt, Human
caggguccaucuuucaucacug

SEQ ID NO: 479827 - RNA, 22 nt, Human
ugggcagacugagcccuguccc

SEQ ID NO: 479828 - RNA, 22 nt, Human
uucauauaaauggaaucagaau

SEQ ID NO: 479829 - RNA, 22 nt, Human
caugaaugcuggguucauguaa

SEQ ID NO: 479830 - RNA, 22 nt, Human
uggaagggagugacagucagag

SEQ ID NO: 479831 - RNA, 22 nt, Human
agcugcuccuuuccugcaggcg

SEQ ID NO: 479832 - RNA, 22 nt, Human
auguagcagaagauguuuuccu

SEQ ID NO: 479833 - RNA, 22 nt, Human
cuggggcccaucgagggcugag

SEQ ID NO: 479834 - RNA, 22 nt, Human
aggcugggcuccgcccaacucc

SEQ ID NO: 479835 - RNA, 22 nt, Human
gccaggcuggccagcaccuucu

SEQ ID NO: 479836 - RNA, 22 nt, Human
guauuagguuggugcaaaauug

SEQ ID NO: 479837 - RNA, 22 nt, Human
uccuucagcuacucaguuucca

SEQ ID NO: 479838 - RNA, 22 nt, Human
cauuucugauuacagaauacua

SEQ ID NO: 479839 - RNA, 22 nt, Human
uguacuugaacuugacuguaga

SEQ ID NO: 479840 - RNA, 22 nt, Human
ucagaacaauugggaaccauua

SEQ ID NO: 479841 - RNA, 22 nt, Human
ucuggcucugacacuacuguua

SEQ ID NO: 479842 - RNA, 22 nt, Human
gcagcugcagguggucccaugc

SEQ ID NO: 479843 - RNA, 22 nt, Human
uggcuucagacuucugcuacgu

SEQ ID NO: 479844 - RNA, 22 nt, Human
aaaaugaggucaauauccuuuu

SEQ ID NO: 479845 - RNA, 22 nt, Human
cauacauuuugcauauuuacca

SEQ ID NO: 479846 - RNA, 22 nt, Human
agaaacuucagcuauucuuuug

SEQ ID NO: 479847 - RNA, 22 nt, Human
ucugagaguccaucuccaagcc

SEQ ID NO: 479848 - RNA, 22 nt, Human
gcagcugagagaagaacagggc

SEQ ID NO: 479849 - RNA, 22 nt, Human
caaagccauagaguagauaaga

SEQ ID NO: 479850 - RNA, 17 nt, Human
guuugcaugguguuaac

SEQ ID NO: 479851 - RNA, 22 nt, Human
ugcagggaaagggcacugggcu

SEQ ID NO: 479852 - RNA, 22 nt, Human
ggcuggguuauuuauggccaag

SEQ ID NO: 479853 - RNA, 22 nt, Human
cuuauguauaauguuccacaua

SEQ ID NO: 479854 - RNA, 22 nt, Human
auggcaagcaagcugaagagau

SEQ ID NO: 479855 - RNA, 19 nt, Human
agcagagcagggccguggg

SEQ ID NO: 479856 - RNA, 22 nt, Human
ggcagcuggggcagugcccugu

SEQ ID NO: 479857 - RNA, 22 nt, Human
uuguuucugaguuuucauguau

SEQ ID NO: 479858 - RNA, 22 nt, Human
aauuuuauuaacuggauguagc

SEQ ID NO: 479859 - RNA, 22 nt, Human
gcuggccugcugggcaccaccg

SEQ ID NO: 479860 - RNA, 19 nt, Human
aggcagaggcuuggcuagc

SEQ ID NO: 479861 - RNA, 22 nt, Human
gugugccaccagucaaggugaa

SEQ ID NO: 479862 - RNA, 22 nt, Human
uccagcuugccuggucuuuugg

SEQ ID NO: 479863 - RNA, 22 nt, Human
aggccuggccugggcggcauug

SEQ ID NO: 479864 - RNA, 22 nt, Human
aaggcagagggcuggaucagag

SEQ ID NO: 479865 - RNA, 22 nt, Human
ugccuguccugaggaugagggu

SEQ ID NO: 479866 - RNA, 22 nt, Human
cacccaggcagguggcugagaa

SEQ ID NO: 479867 - RNA, 22 nt, Human
agcaauauaaauguuggguaga

SEQ ID NO: 479868 - RNA, 22 nt, Human
cagggcuggguuaaaagcaggg

SEQ ID NO: 479869 - RNA, 19 nt, Human
ggcugucuggcguguggau

SEQ ID NO: 479870 - RNA, 22 nt, Human
uagaaaauagggccuguggagc

SEQ ID NO: 479871 - RNA, 22 nt, Human
ggagaugguggaagcuggugca

SEQ ID NO: 479872 - RNA, 20 nt, Human
uguuccaugacuauuuggau

SEQ ID NO: 479873 - RNA, 23 nt, Human
aggugcagcccuggaccugcccc

SEQ ID NO: 479874 - RNA, 22 nt, Human
gggcuccaacggugagcaugga

SEQ ID NO: 479875 - RNA, 20 nt, Human
ccucaggaugagggugagca

SEQ ID NO: 479876 - RNA, 22 nt, Human
gcugggagucgcgucuguggcc

SEQ ID NO: 479877 - RNA, 22 nt, Human
uuuauugacccaaagcgagagu

SEQ ID NO: 479878 - RNA, 22 nt, Human
caguaggaaggaugcagaaaaa

SEQ ID NO: 479879 - RNA, 22 nt, Human
ccagggaggguccuguggcuuc

SEQ ID NO: 479880 - RNA, 22 nt, Human
uaugugcaguuugcucuuaaca

SEQ ID NO: 479881 - RNA, 22 nt, Human
gaaugaauagguguccagaugg

SEQ ID NO: 479882 - RNA, 22 nt, Human
aaugucugcucuacucaggagg

SEQ ID NO: 479883 - RNA, 17 nt, Human
uugggagagaaagguau

SEQ ID NO: 479884 - RNA, 20 nt, Human
aggcucagcugagcucuugg

SEQ ID NO: 479885 - RNA, 22 nt, Human
agcaggugaauuccuggaugug

SEQ ID NO: 479886 - RNA, 22 nt, Human
gaagcagcuagcccacuaguca

SEQ ID NO: 479887 - RNA, 22 nt, Human
uuuacucuugcuacacaacugu

SEQ ID NO: 479888 - RNA, 22 nt, Human
auguguaaaaagugcuuaauau

SEQ ID NO: 479889 - RNA, 22 nt, Human
cugggagauugcuagagaugca

SEQ ID NO: 479890 - RNA, 22 nt, Human
aaaagggacuacucucagcucc

SEQ ID NO: 479891 - RNA, 22 nt, Human
aggcccuggguuagggcccacu

SEQ ID NO: 479892 - RNA, 22 nt, Human
uggcugagggcacuaugaagcc

SEQ ID NO: 479893 - RNA, 19 nt, Human
acauggcaucccaggaggu

SEQ ID NO: 479894 - RNA, 22 nt, Human
agcuaggaaauugaggcugaga

SEQ ID NO: 479895 - RNA, 22 nt, Human
aucuucaacuugaucauuugaa

SEQ ID NO: 479896 - RNA, 22 nt, Human
uccuggguccauggcagccgaa

SEQ ID NO: 479897 - RNA, 22 nt, Human
ugaagcaacuggacaaguuggc

SEQ ID NO: 479898 - RNA, 22 nt, Human
ugccuggguguaaagggccaac

SEQ ID NO: 479899 - RNA, 22 nt, Human
cugccugugugugccugcagaa

SEQ ID NO: 479900 - RNA, 22 nt, Human
cuuauguaugcuacuuuguggu

SEQ ID NO: 479901 - RNA, 22 nt, Human
uucaugugaucacagauuguaa

SEQ ID NO: 479902 - RNA, 22 nt, Human
gggcuggucuggcuuagucagg

SEQ ID NO: 479903 - RNA, 21 nt, Human
ccacauucucauucugacugc

SEQ ID NO: 479904 - RNA, 22 nt, Human
ggcagaccucuccagccccaca

SEQ ID NO: 479905 - RNA, 22 nt, Human
aggucauuaaaguuaaaugagg

SEQ ID NO: 479906 - RNA, 22 nt, Human
agcagcugcagggagggucugc

SEQ ID NO: 479907 - RNA, 22 nt, Human
uguggccucaaggcugcccuca

SEQ ID NO: 479908 - RNA, 22 nt, Human
gggcacuggaggccaaggagcu

SEQ ID NO: 479909 - RNA, 22 nt, Human
cagagguauugcaaaagccuag

SEQ ID NO: 479910 - RNA, 22 nt, Human
uguuuauugagugccuacuaua

SEQ ID NO: 479911 - RNA, 22 nt, Human
auauuaggaguuaaauguauua

SEQ ID NO: 479912 - RNA, 22 nt, Human
ugucucugauaaguaguucagu

SEQ ID NO: 479913 - RNA, 22 nt, Human
agauuucaaugugagcauuagu

SEQ ID NO: 479914 - RNA, 22 nt, Human
cuuaaauuggaugaguuaaguu

SEQ ID NO: 479915 - RNA, 22 nt, Human
ccacagggcacagacaggaagc

SEQ ID NO: 479916 - RNA, 22 nt, Human
agggccagcacuccuggcagga

SEQ ID NO: 479917 - RNA, 22 nt, Human
gggcucugcgcucagcuccagc

SEQ ID NO: 479918 - RNA, 22 nt, Human
uucuugcaggucacucacugag

SEQ ID NO: 479919 - RNA, 22 nt, Human
ucccugcucagcucaccuggca

SEQ ID NO: 479920 - RNA, 22 nt, Human
auucuucacuguuucagaauga

SEQ ID NO: 479921 - RNA, 22 nt, Human
ccagccuggguguuagaagaca

SEQ ID NO: 479922 - RNA, 22 nt, Human
cugagccaugagccugcgccca

SEQ ID NO: 479923 - RNA, 22 nt, Human
cagcugagcaucacuagucugg

SEQ ID NO: 479924 - RNA, 22 nt, Human
gggaggugauggcaagcagcgg

SEQ ID NO: 479925 - RNA, 22 nt, Human
aaaagacauaugugggcauucu

SEQ ID NO: 479926 - RNA, 22 nt, Human
ggcagugaaugaaacagaggcu

SEQ ID NO: 479927 - RNA, 22 nt, Human
gcugugugacugagagccuggc

SEQ ID NO: 479928 - RNA, 22 nt, Human
cuauuaggcuuccauuucaugc

SEQ ID NO: 479929 - RNA, 22 nt, Human
gcuggugcauuagcugcaguuc

SEQ ID NO: 479930 - RNA, 22 nt, Human
gcaggagcaaacugcagugugg

SEQ ID NO: 479931 - RNA, 22 nt, Human
augcccgauaccuaguuaacuc

SEQ ID NO: 479932 - RNA, 22 nt, Human
gcugucccgaaccccugguaau

SEQ ID NO: 479933 - RNA, 22 nt, Human
gcugagagugggugcagugcuu

SEQ ID NO: 479934 - RNA, 22 nt, Human
ggccagggccuggggacugucc

SEQ ID NO: 479935 - RNA, 22 nt, Human
uacuuccagcaaucugcauauu

SEQ ID NO: 479936 - RNA, 22 nt, Human
caguuuuucaaaauuacaugau

SEQ ID NO: 479937 - RNA, 22 nt, Human
ugcagaagugagucaugaggaa

SEQ ID NO: 479938 - RNA, 22 nt, Human
aaaaauguuaucuacuguccga

SEQ ID NO: 479939 - RNA, 22 nt, Human
guguaaggccccagguucuuua

SEQ ID NO: 479940 - RNA, 22 nt, Human
agaacagcaguuaugguucauu

SEQ ID NO: 479941 - RNA, 22 nt, Human
cagcuauuuucucauuaaggau

SEQ ID NO: 479942 - RNA, 22 nt, Human
aucuguaaaugcaaauguagcu

SEQ ID NO: 479943 - RNA, 22 nt, Human
cccauucauccucgcuuccuuc

SEQ ID NO: 479944 - RNA, 20 nt, Human
gagauggcuaagugcugaac

SEQ ID NO: 479945 - RNA, 22 nt, Human
ccucagggaggccucuguggcu

SEQ ID NO: 479946 - RNA, 22 nt, Human
ugcuguagcccugcacagugca

SEQ ID NO: 479947 - RNA, 22 nt, Human
ugaugggaaaaugaggccuggg

SEQ ID NO: 479948 - RNA, 22 nt, Human
uccaggcaaaaaccaacuacag

SEQ ID NO: 479949 - RNA, 18 nt, Human
cggcagagugcuucuagc

SEQ ID NO: 479950 - RNA, 22 nt, Human
cacagggccacuuucccaguaa

SEQ ID NO: 479951 - RNA, 22 nt, Human
caggcagagugagguggucuaa

SEQ ID NO: 479952 - RNA, 22 nt, Human
cgcugccaggauccccugccgg

SEQ ID NO: 479953 - RNA, 22 nt, Human
ccugggcaucucaugcaccugc

SEQ ID NO: 479954 - RNA, 22 nt, Human
gagagugagauaauuucacaua

SEQ ID NO: 479955 - RNA, 22 nt, Human
ggcuucucucuucacauggcuu

SEQ ID NO: 479956 - RNA, 19 nt, Human
acagaaauguaagugagac

SEQ ID NO: 479957 - RNA, 22 nt, Human
ugaaggccagcagagugaaggc

SEQ ID NO: 479958 - RNA, 22 nt, Human
agccaggcugcaguuggcuggc

SEQ ID NO: 479959 - RNA, 22 nt, Human
cagccagcugaauguaccauga

SEQ ID NO: 479960 - RNA, 22 nt, Human
caugggaggucugcaaggugcu

SEQ ID NO: 479961 - RNA, 22 nt, Human
ucccaguguggcaggccaugga

SEQ ID NO: 479962 - RNA, 22 nt, Human
accugccuaucagcugccugcu

SEQ ID NO: 479963 - RNA, 22 nt, Human
cucaggcuugggaggaggccca

SEQ ID NO: 479964 - RNA, 22 nt, Human
gccuggagacagcagaggcggc

SEQ ID NO: 479965 - RNA, 22 nt, Human
uuugaaaggaauuaggaugaca

SEQ ID NO: 479966 - RNA, 22 nt, Human
gggcucugggauucagagcaag

SEQ ID NO: 479967 - RNA, 22 nt, Human
gcuuuuauuucuucacaaaagu

SEQ ID NO: 479968 - RNA, 22 nt, Human
ucucagaggcccgacguucucc

SEQ ID NO: 479969 - RNA, 22 nt, Human
aauguguacuuuuucaugcuca

SEQ ID NO: 479970 - RNA, 22 nt, Human
cagacagaccugcaagggcaca

SEQ ID NO: 479971 - RNA, 22 nt, Human
auguuauuaaaguacagauucu

SEQ ID NO: 479972 - RNA, 22 nt, Human
gaaggccacuuuguguugagaa

SEQ ID NO: 479973 - RNA, 22 nt, Human
auugucgcuuauuuaggugcuu

SEQ ID NO: 479974 - RNA, 23 nt, Human
ucuugaaaagccuacagcaguuc

SEQ ID NO: 479975 - RNA, 22 nt, Human
aggggagcuaacaccagagccc

SEQ ID NO: 479976 - RNA, 22 nt, Human
cccagcugcaccucuauggccu

SEQ ID NO: 479977 - RNA, 22 nt, Human
uacauauuugucuuuguacugu

SEQ ID NO: 479978 - RNA, 22 nt, Human
uuaugcuaaaugaaucaaguca

SEQ ID NO: 479979 - RNA, 22 nt, Human
gccugaagaacagcugugagga

SEQ ID NO: 479980 - RNA, 22 nt, Human
augcacuugcguguuugcaaau

SEQ ID NO: 479981 - RNA, 22 nt, Human
ugggacuuguguggcaguauuu

SEQ ID NO: 479982 - RNA, 22 nt, Human
guccuuugaaggcaaaaggaga

SEQ ID NO: 479983 - RNA, 22 nt, Human
gacccugccaugagugacaggg

SEQ ID NO: 479984 - RNA, 22 nt, Human
uuuuuccuuggaugugucucuc

SEQ ID NO: 479985 - RNA, 22 nt, Human
uuucccaaguguaaacauggca

SEQ ID NO: 479986 - RNA, 22 nt, Human
uuagccauauagaaaaagagcu

SEQ ID NO: 479987 - RNA, 22 nt, Human
augcaguagauaggcacuuuua

SEQ ID NO: 479988 - RNA, 22 nt, Human
gaaaccucuuagccucucuuug

SEQ ID NO: 479989 - RNA, 22 nt, Human
cuugccuguggcuaguuggcuc

SEQ ID NO: 479990 - RNA, 22 nt, Human
ccaggagccacucaggcccaca

SEQ ID NO: 479991 - RNA, 22 nt, Human
cuagggcacuaggacucaugug

SEQ ID NO: 479992 - RNA, 22 nt, Human
cugugacagagcuugagugaga

SEQ ID NO: 479993 - RNA, 22 nt, Human
ucuuugcaaauguuauuaucuu

SEQ ID NO: 479994 - RNA, 22 nt, Human
cuggcugguuacuauuucuggu

SEQ ID NO: 479995 - RNA, 22 nt, Human
ucucaggaagauuagggcuaag

SEQ ID NO: 479996 - RNA, 22 nt, Human
ggccugaggcgucccagcugug

SEQ ID NO: 479997 - RNA, 22 nt, Human
guggcugcucgggcuccggccc

SEQ ID NO: 479998 - RNA, 21 nt, Human
ccagaggccucucuuggccac

SEQ ID NO: 479999 - RNA, 22 nt, Human
gccuggcaggccucaugagggg

SEQ ID NO: 480000 - RNA, 22 nt, Human
aggcugaggcagguggaucacu

SEQ ID NO: 480001 - RNA, 20 nt, Human
ggaagccagcauccuugagg

SEQ ID NO: 480002 - RNA, 22 nt, Human
uuucaguguaagguuuccagga

SEQ ID NO: 480003 - RNA, 22 nt, Human
gagcuggugugugcccgagcac

SEQ ID NO: 480004 - RNA, 22 nt, Human
aacaacuugcguucagagaugu

SEQ ID NO: 480005 - RNA, 23 nt, Human
aaaugcagggucgcagguuacag

SEQ ID NO: 480006 - RNA, 22 nt, Human
uccaggcaaagccuuguagacg

SEQ ID NO: 480007 - RNA, 21 nt, Human
uccugcagaaugccuuccuac

SEQ ID NO: 480008 - RNA, 22 nt, Human
auucagcauaaucaguagcuug

SEQ ID NO: 480009 - RNA, 22 nt, Human
auacuguuucucuucuacauga

SEQ ID NO: 480010 - RNA, 22 nt, Human
ugacagaaugugacucucagau

SEQ ID NO: 480011 - RNA, 22 nt, Human
cugcugucuuuauuucacugcu

SEQ ID NO: 480012 - RNA, 22 nt, Human
aggagcugaagucucugcacuc

SEQ ID NO: 480013 - RNA, 22 nt, Human
agaaugcuccagagcugaaaga

SEQ ID NO: 480014 - RNA, 22 nt, Human
cauuuguaguaucuguuuauau

SEQ ID NO: 480015 - RNA, 22 nt, Human
ugaggccaaugacccugggcag

SEQ ID NO: 480016 - RNA, 22 nt, Human
aggacagaccuaggacuggagc

SEQ ID NO: 480017 - RNA, 22 nt, Human
gcuucauuacugacagucugug

SEQ ID NO: 480018 - RNA, 22 nt, Human
aucaggaugaagcuguagcgaa

SEQ ID NO: 480019 - RNA, 22 nt, Human
uagcugccuaugugauaagaga

SEQ ID NO: 480020 - RNA, 22 nt, Human
gcugaggccucagaaggcugag

SEQ ID NO: 480021 - RNA, 17 nt, Human
ccagguggaaucgugga

SEQ ID NO: 480022 - RNA, 22 nt, Human
ggcagugaaaaaguauguuucc

SEQ ID NO: 480023 - RNA, 20 nt, Human
gagagcuggggaugaggcug

SEQ ID NO: 480024 - RNA, 22 nt, Human
cucuggccugcuuccucaggua

SEQ ID NO: 480025 - RNA, 22 nt, Human
uuguuucaggaugguuuguuac

SEQ ID NO: 480026 - RNA, 22 nt, Human
ccagcugcagguguuccagaug

SEQ ID NO: 480027 - RNA, 22 nt, Human
guaaaucccauccuuucucugg

SEQ ID NO: 480028 - RNA, 22 nt, Human
guuuuauaauugcuucauaaga

SEQ ID NO: 480029 - RNA, 22 nt, Human
cagcuuuaccaauauuuggaaa

SEQ ID NO: 480030 - RNA, 22 nt, Human
acagauccugguuacagccauu

SEQ ID NO: 480031 - RNA, 22 nt, Human
ggccagaggugguacauagcuu

SEQ ID NO: 480032 - RNA, 22 nt, Human
ccaaagagcuagaauuauaggc

SEQ ID NO: 480033 - RNA, 22 nt, Human
agggcugcaccggggcuucgcg

SEQ ID NO: 480034 - RNA, 22 nt, Human
gcugucuguggugucagcugac

SEQ ID NO: 480035 - RNA, 22 nt, Human
agacucugugcuccuugcuuuc

SEQ ID NO: 480036 - RNA, 22 nt, Human
aaaaacugcaauuacuuuuguc

SEQ ID NO: 480037 - RNA, 22 nt, Human
agccagaggccagccugccuca

SEQ ID NO: 480038 - RNA, 22 nt, Human
uggcugagaaugggaugaugcc

SEQ ID NO: 480039 - RNA, 22 nt, Human
cagcugggugaucuugggcagg

SEQ ID NO: 480040 - RNA, 22 nt, Human
ccucuggcuguaccacuggcac

SEQ ID NO: 480041 - RNA, 22 nt, Human
agccaagcugaucuccugcuga

SEQ ID NO: 480042 - RNA, 22 nt, Human
gaggagagggcugcgggcccac

SEQ ID NO: 480043 - RNA, 22 nt, Human
cggagccugcuuguugcagcug

SEQ ID NO: 480044 - RNA, 22 nt, Human
acauuuaaauaugccuuauauu

SEQ ID NO: 480045 - RNA, 22 nt, Human
ugggcacuauggcucugugcac

SEQ ID NO: 480046 - RNA, 21 nt, Human
uuuagggaccaggucauaggc

SEQ ID NO: 480047 - RNA, 22 nt, Human
ugggcagaaaucaguaucagau

SEQ ID NO: 480048 - RNA, 22 nt, Human
acacagggaggaggugcugugc

SEQ ID NO: 480049 - RNA, 16 nt, Human
aggcucagaggcugga

SEQ ID NO: 480050 - RNA, 22 nt, Human
gccuggagcccaguguggggcu

SEQ ID NO: 480051 - RNA, 22 nt, Human
aaggcaguagguguuucaaacu

SEQ ID NO: 480052 - RNA, 22 nt, Human
agaggcugucccuugcuauucc

SEQ ID NO: 480053 - RNA, 22 nt, Human
auuuauuaugggauuuggcuca

SEQ ID NO: 480054 - RNA, 22 nt, Human
cuauuaaacacuacugugcacu

SEQ ID NO: 480055 - RNA, 22 nt, Human
cuggagugaagcuuauuuuuca

SEQ ID NO: 480056 - RNA, 22 nt, Human
ggcucuggugggaagguuagau

SEQ ID NO: 480057 - RNA, 22 nt, Human
gggcugcuguagagaacauguu

SEQ ID NO: 480058 - RNA, 22 nt, Human
uggcuagcccuuguggggagag

SEQ ID NO: 480059 - RNA, 22 nt, Human
uaggccauucuuggagcuuacu

SEQ ID NO: 480060 - RNA, 22 nt, Human
ccagcugucacucagaaaggcc

SEQ ID NO: 480061 - RNA, 22 nt, Human
gcuggccacacugcugauggag

SEQ ID NO: 480062 - RNA, 22 nt, Human
acugucugcccugagaugccag

SEQ ID NO: 480063 - RNA, 22 nt, Human
caggcagcccugcaccaagugu

SEQ ID NO: 480064 - RNA, 22 nt, Human
aggcacaguggcucacaccugu

SEQ ID NO: 480065 - RNA, 22 nt, Human
cagggccacacggaagggaaca

SEQ ID NO: 480066 - RNA, 22 nt, Human
ucaggcagagggagaagccaag

SEQ ID NO: 480067 - RNA, 22 nt, Human
gcagggacaucuucagaucacu

SEQ ID NO: 480068 - RNA, 22 nt, Human
caccagggcagcagccuagucu

SEQ ID NO: 480069 - RNA, 20 nt, Human
uggcaucucucaauuguagg

SEQ ID NO: 480070 - RNA, 22 nt, Human
gaaggcuggcuuucugagagca

SEQ ID NO: 480071 - RNA, 22 nt, Human
uugucuguaaagacggccacca

SEQ ID NO: 480072 - RNA, 22 nt, Human
gcagggccuuagcagcggcugc

SEQ ID NO: 480073 - RNA, 22 nt, Human
ggugcagaaggaagggagcugg

SEQ ID NO: 480074 - RNA, 22 nt, Human
gagauauguuagaaagcuauug

SEQ ID NO: 480075 - RNA, 22 nt, Human
ccaggcuuucccagccucucca

SEQ ID NO: 480076 - RNA, 18 nt, Human
agcagggcauuuugccau

SEQ ID NO: 480077 - RNA, 22 nt, Human
cccucagcuccacccucagcag

SEQ ID NO: 480078 - RNA, 22 nt, Human
gcucagagcaucccagugaaug

SEQ ID NO: 480079 - RNA, 22 nt, Human
gggaccugccaaggccacccag

SEQ ID NO: 480080 - RNA, 22 nt, Human
auguaucagauaaagcaugugg

SEQ ID NO: 480081 - RNA, 22 nt, Human
gcaccuggacagugacccuagc

SEQ ID NO: 480082 - RNA, 22 nt, Human
cagggagcuuucccaggacccu

SEQ ID NO: 480083 - RNA, 22 nt, Human
ccagagagcuacaaggcauaaa

SEQ ID NO: 480084 - RNA, 22 nt, Human
cugcaggcucgaagacacggau

SEQ ID NO: 480085 - RNA, 22 nt, Human
ccagcaggguugguuucuucug

SEQ ID NO: 480086 - RNA, 22 nt, Human
uucaguuucagucuugcaaaaa

SEQ ID NO: 480087 - RNA, 22 nt, Human
auucaguucuaaggucagugcc

SEQ ID NO: 480088 - RNA, 22 nt, Human
gccacccccaaguagguggucu

SEQ ID NO: 480089 - RNA, 22 nt, Human
gcauggcaaauaucgagggcag

SEQ ID NO: 480090 - RNA, 22 nt, Human
gagcuggcuccgccaugcugcu

SEQ ID NO: 480091 - RNA, 22 nt, Human
gcucugggugaacuuggagcaa

SEQ ID NO: 480092 - RNA, 22 nt, Human
cugagaguguggcuuccaggcc

SEQ ID NO: 480093 - RNA, 22 nt, Human
aucaaaguuucccagaaguugu

SEQ ID NO: 480094 - RNA, 20 nt, Human
cugcaggguuagaggcucca

SEQ ID NO: 480095 - RNA, 22 nt, Human
ugggcugccggcaggcucugcc

SEQ ID NO: 480096 - RNA, 22 nt, Human
ugccaggcuaaguggaggacuu

SEQ ID NO: 480097 - RNA, 18 nt, Human
cuucagugacagucuggc

SEQ ID NO: 480098 - RNA, 22 nt, Human
gcacagccacugagugagaacc

SEQ ID NO: 480099 - RNA, 21 nt, Human
cccagggaagccgcagucacc

SEQ ID NO: 480100 - RNA, 22 nt, Human
aucacauugccagugauuaccc

SEQ ID NO: 480101 - RNA, 22 nt, Human
ucagaaauuuucucaguaguuc

SEQ ID NO: 480102 - RNA, 22 nt, Human
cagaccugagguugaguaccag

SEQ ID NO: 480103 - RNA, 18 nt, Human
aguggucuguuauaucau

SEQ ID NO: 480104 - RNA, 22 nt, Human
ggcucaggggccaggccugucc

SEQ ID NO: 480105 - RNA, 22 nt, Human
gagcacaggcuuugguggacac

SEQ ID NO: 480106 - RNA, 22 nt, Human
gagaggccaccugacgagcagu

SEQ ID NO: 480107 - RNA, 22 nt, Human
ccagggcugagcugugaccaug

SEQ ID NO: 480108 - RNA, 22 nt, Human
ggagaagcaggugcuuuggguc

SEQ ID NO: 480109 - RNA, 22 nt, Human
aggagagaauguuccaggcuug

SEQ ID NO: 480110 - RNA, 22 nt, Human
guuauaaauaccuaauaggauu

SEQ ID NO: 480111 - RNA, 22 nt, Human
cagagguagccgagugcaaucg

SEQ ID NO: 480112 - RNA, 22 nt, Human
agccaaggacacggagccuccu

SEQ ID NO: 480113 - RNA, 22 nt, Human
gccucugcacuguggcacacca

SEQ ID NO: 480114 - RNA, 22 nt, Human
ugaaacaagggaccguccuuuc

SEQ ID NO: 480115 - RNA, 22 nt, Human
ugaagggcaaccccaggcccag

SEQ ID NO: 480116 - RNA, 22 nt, Human
uucacauuugcccuuaugugug

SEQ ID NO: 480117 - RNA, 22 nt, Human
ggcucagaaacuaaaggcgcug

SEQ ID NO: 480118 - RNA, 22 nt, Human
uaauuuuaugacaguguauuuu

SEQ ID NO: 480119 - RNA, 22 nt, Human
agcaggcuaagggaccuguuua

SEQ ID NO: 480120 - RNA, 22 nt, Human
aguggcagggcuggcugcugca

SEQ ID NO: 480121 - RNA, 22 nt, Human
ggaagccacccagcuuugauag

SEQ ID NO: 480122 - RNA, 22 nt, Human
gaaggaaaggucucaugccuuu

SEQ ID NO: 480123 - RNA, 22 nt, Human
ccugggcaggaugggcccggug

SEQ ID NO: 480124 - RNA, 22 nt, Human
ucugccuguugcuagaauguca

SEQ ID NO: 480125 - RNA, 22 nt, Human
aaaaaugugaccacaggguguu

SEQ ID NO: 480126 - RNA, 22 nt, Human
cagcagugaugugugaggguuc

SEQ ID NO: 480127 - RNA, 22 nt, Human
cacauggggcgcugcauuggcc

SEQ ID NO: 480128 - RNA, 22 nt, Human
agauacauuguucuaagcauug

SEQ ID NO: 480129 - RNA, 22 nt, Human
ggcugcuugcuguuucuuggau

SEQ ID NO: 480130 - RNA, 22 nt, Human
ucauaacagcuaagucccuuuc

SEQ ID NO: 480131 - RNA, 22 nt, Human
cucacagaugcugugggucagg

SEQ ID NO: 480132 - RNA, 22 nt, Human
agacagcaugauacaugaugcu

SEQ ID NO: 480133 - RNA, 20 nt, Human
uuucacaucugucccuuuaa

SEQ ID NO: 480134 - RNA, 22 nt, Human
ccuucugcucccuggccagggc

SEQ ID NO: 480135 - RNA, 22 nt, Human
acucccacuccagaguagaagc

SEQ ID NO: 480136 - RNA, 22 nt, Human
gaaggcuaaaggggcagagguu

SEQ ID NO: 480137 - RNA, 22 nt, Human
ccugggagugugccaucucugu

SEQ ID NO: 480138 - RNA, 22 nt, Human
agggcucugagcuggaccaccu

SEQ ID NO: 480139 - RNA, 22 nt, Human
cuccagggaaaggggcguccgc

SEQ ID NO: 480140 - RNA, 22 nt, Human
ccuggccuggcacucccucugc

SEQ ID NO: 480141 - RNA, 22 nt, Human
ugucucaguucccuucucugga

SEQ ID NO: 480142 - RNA, 22 nt, Human
cugcugugcaggugccuaugau

SEQ ID NO: 480143 - RNA, 22 nt, Human
cacagguguucuugcagugaaa

SEQ ID NO: 480144 - RNA, 22 nt, Human
augcuuuacaguuuuccaaaca

SEQ ID NO: 480145 - RNA, 22 nt, Human
agucccuucucaaagugugcgg

SEQ ID NO: 480146 - RNA, 22 nt, Human
cugggcaguaugaauauucaaa

SEQ ID NO: 480147 - RNA, 22 nt, Human
cuugucagccaauuguggauuu

SEQ ID NO: 480148 - RNA, 22 nt, Human
gccagaagacuggagucagcug

SEQ ID NO: 480149 - RNA, 22 nt, Human
aaagccacguggccuggggagc

SEQ ID NO: 480150 - RNA, 22 nt, Human
uuucauugcagagucugugugc

SEQ ID NO: 480151 - RNA, 22 nt, Human
caaaugcaggucauaaccugag

SEQ ID NO: 480152 - RNA, 22 nt, Human
acagaccaaguuuccagcaggu

SEQ ID NO: 480153 - RNA, 21 nt, Human
ucugucugguuuuagaguggc

SEQ ID NO: 480154 - RNA, 22 nt, Human
aagggcucgguagcaguccuga

SEQ ID NO: 480155 - RNA, 18 nt, Human
cccagugcucacugccuc

SEQ ID NO: 480156 - RNA, 22 nt, Human
ccugugucuuccccacuggugu

SEQ ID NO: 480157 - RNA, 22 nt, Human
agccauugaguuuuaugugcua

SEQ ID NO: 480158 - RNA, 22 nt, Human
ugccagccagguucugaggcua

SEQ ID NO: 480159 - RNA, 22 nt, Human
cccagcaucccagugggcagca

SEQ ID NO: 480160 - RNA, 22 nt, Human
acauuucucuugaugucucuau

SEQ ID NO: 480161 - RNA, 22 nt, Human
aagauuuaccacuuuauucaag

SEQ ID NO: 480162 - RNA, 22 nt, Human
gggccagagcuuggcagcuggg

SEQ ID NO: 480163 - RNA, 19 nt, Human
agaggcagucuccaacagg

SEQ ID NO: 480164 - RNA, 22 nt, Human
gaggcaugucuggccuguccca

SEQ ID NO: 480165 - RNA, 22 nt, Human
ucuuacagaaaauagauaacau

SEQ ID NO: 480166 - RNA, 22 nt, Human
aggcagaugguaacugugauau

SEQ ID NO: 480167 - RNA, 22 nt, Human
agccagugggauuagagccucu

SEQ ID NO: 480168 - RNA, 22 nt, Human
aggugcagaaaaaaguccuuua

SEQ ID NO: 480169 - RNA, 22 nt, Human
ugcuggaggggccugaccagga

SEQ ID NO: 480170 - RNA, 22 nt, Human
uuugcagcaaggagagagcauu

SEQ ID NO: 480171 - RNA, 22 nt, Human
uucauuccuucuguaccuugcc

SEQ ID NO: 480172 - RNA, 23 nt, Human
uuaggcacuuaguagggccagag

SEQ ID NO: 480173 - RNA, 22 nt, Human
aaacaucauaggcaugcaugau

SEQ ID NO: 480174 - RNA, 23 nt, Human
ggaguuggauuguacuugcugcu

SEQ ID NO: 480175 - RNA, 22 nt, Human
agaauaguggcaaugacugcac

SEQ ID NO: 480176 - RNA, 22 nt, Human
cucaccaggaacagcugcggag

SEQ ID NO: 480177 - RNA, 21 nt, Human
acaggcuuuagaaaaugacuc

SEQ ID NO: 480178 - RNA, 22 nt, Human
ugggggaagagcuuguuaaagu

SEQ ID NO: 480179 - RNA, 22 nt, Human
cagaggaggcgguauacacugc

SEQ ID NO: 480180 - RNA, 22 nt, Human
cugccagcucgccacaaugaca

SEQ ID NO: 480181 - RNA, 22 nt, Human
caggaugguggcaugaucagaa

SEQ ID NO: 480182 - RNA, 22 nt, Human
ugggaggacuugugggcuucau

SEQ ID NO: 480183 - RNA, 22 nt, Human
cuccaggccauggcugcggagg

SEQ ID NO: 480184 - RNA, 22 nt, Human
agccuucaguaaauccacugug

SEQ ID NO: 480185 - RNA, 22 nt, Human
gcugagcugggacaguccuggg

SEQ ID NO: 480186 - RNA, 22 nt, Human
gauuauauaauggaagcucuug

SEQ ID NO: 480187 - RNA, 20 nt, Human
agugcaagaaagcacagcug

SEQ ID NO: 480188 - RNA, 22 nt, Human
uagagcuggaauuugcagcaag

SEQ ID NO: 480189 - RNA, 22 nt, Human
agagccuguaacaucuuucuua

SEQ ID NO: 480190 - RNA, 22 nt, Human
acagcuuuuaugggaccagcca

SEQ ID NO: 480191 - RNA, 22 nt, Human
caguuucuuaucuucaaaauug

SEQ ID NO: 480192 - RNA, 22 nt, Human
gcaaaaaccacaauuacuuuua

SEQ ID NO: 480193 - RNA, 22 nt, Human
ccagcuccagguagaugggcag

SEQ ID NO: 480194 - RNA, 20 nt, Human
ggcugcugugggcagagagg

SEQ ID NO: 480195 - RNA, 22 nt, Human
ugcagggaaucuguggcuggac

SEQ ID NO: 480196 - RNA, 22 nt, Human
aauguauaaaguguuaauaacu

SEQ ID NO: 480197 - RNA, 22 nt, Human
ugcuuaaacccugaucaugugu

SEQ ID NO: 480198 - RNA, 23 nt, Human
gggugggccaaauuagguagccu

SEQ ID NO: 480199 - RNA, 22 nt, Human
auguguagaacuguaaugccca

SEQ ID NO: 480200 - RNA, 22 nt, Human
cugugggcugaaagugcucccg

SEQ ID NO: 480201 - RNA, 20 nt, Human
ccuggaagagcuccccaggc

SEQ ID NO: 480202 - RNA, 22 nt, Human
ggcugggcaaacaagacucuuc

SEQ ID NO: 480203 - RNA, 19 nt, Human
agcagccaucgaccaugga

SEQ ID NO: 480204 - RNA, 22 nt, Human
cagggcugaagaaauucaaaag

SEQ ID NO: 480205 - RNA, 18 nt, Human
cagaggagagacauucag

SEQ ID NO: 480206 - RNA, 22 nt, Human
acagcagggggagcuguuggac

SEQ ID NO: 480207 - RNA, 22 nt, Human
aaaagguuuugaguacaaauau

SEQ ID NO: 480208 - RNA, 20 nt, Human
aggcugggguguuuugccca

SEQ ID NO: 480209 - RNA, 22 nt, Human
ucuuuacacaagacaagaauaa

SEQ ID NO: 480210 - RNA, 20 nt, Human
accuuucaaaugauucagca

SEQ ID NO: 480211 - RNA, 22 nt, Human
aggccugagcagaggaguggac

SEQ ID NO: 480212 - RNA, 23 nt, Human
uggccucuccccaccuggcagaa

SEQ ID NO: 480213 - RNA, 22 nt, Human
gcucuguguccacagcuggaaa

SEQ ID NO: 480214 - RNA, 22 nt, Human
aaaaguaauugcaauuuuguag

SEQ ID NO: 480215 - RNA, 18 nt, Human
uguacaguuaugagcauu

SEQ ID NO: 480216 - RNA, 22 nt, Human
agagugaaguaauuguuaggau

SEQ ID NO: 480217 - RNA, 22 nt, Human
cagguggaucucuaaggacuga

SEQ ID NO: 480218 - RNA, 22 nt, Human
uacauuuauaaggcuucucugu

SEQ ID NO: 480219 - RNA, 22 nt, Human
gagccagggcugugagcugagc

SEQ ID NO: 480220 - RNA, 21 nt, Human
ucagaacaauuccaugccucc

SEQ ID NO: 480221 - RNA, 22 nt, Human
cagagccacugucugccaggca

SEQ ID NO: 480222 - RNA, 22 nt, Human
cagagccccucagcucucuccc

SEQ ID NO: 480223 - RNA, 22 nt, Human
aagaugcuuauugcuccugcag

SEQ ID NO: 480224 - RNA, 22 nt, Human
cuggaaugccucccugucagag

SEQ ID NO: 480225 - RNA, 22 nt, Human
caguguggcugagacagaggcu

SEQ ID NO: 480226 - RNA, 22 nt, Human
cagugguauuugagagaaugga

SEQ ID NO: 480227 - RNA, 22 nt, Human
ucgccagggaugcuguaaggaa

SEQ ID NO: 480228 - RNA, 22 nt, Human
agggcugaagggaggugcucau

SEQ ID NO: 480229 - RNA, 22 nt, Human
gggaggaaaugugcagcgaauu

SEQ ID NO: 480230 - RNA, 22 nt, Human
gggacuggaacuacuggugcag

SEQ ID NO: 480231 - RNA, 22 nt, Human
gcugggagugggcaagaugaga

SEQ ID NO: 480232 - RNA, 22 nt, Human
uugccucccagcaugggcagcu

SEQ ID NO: 480233 - RNA, 22 nt, Human
auggcagggaccaagcugucau

SEQ ID NO: 480234 - RNA, 22 nt, Human
guccacauaggaacccagcuuc

SEQ ID NO: 480235 - RNA, 23 nt, Human
ggccuguguuuugucugaaguac

SEQ ID NO: 480236 - RNA, 22 nt, Human
accagacacugugaagacaggc

SEQ ID NO: 480237 - RNA, 21 nt, Human
ugcucaugcaaugcaugucca

SEQ ID NO: 480238 - RNA, 22 nt, Human
cugucacacugauaucaggcuu

SEQ ID NO: 480239 - RNA, 22 nt, Human
guggagcccugguagggacccc

SEQ ID NO: 480240 - RNA, 23 nt, Human
guggagccacaucacaggcuccu

SEQ ID NO: 480241 - RNA, 22 nt, Human
augauacaagcaaaacuaauca

SEQ ID NO: 480242 - RNA, 22 nt, Human
caggaggcagagguugcagcga

SEQ ID NO: 480243 - RNA, 22 nt, Human
uccugccucacaguugaaguuu

SEQ ID NO: 480244 - RNA, 22 nt, Human
ugggcugcagagcccggccuuc

SEQ ID NO: 480245 - RNA, 22 nt, Human
cccagcacaggcaauuccauac

SEQ ID NO: 480246 - RNA, 22 nt, Human
uuauuuauggcacuguuggugg

SEQ ID NO: 480247 - RNA, 22 nt, Human
ucacauuuuccuugguaucugu

SEQ ID NO: 480248 - RNA, 22 nt, Human
cugcagcuauauuuucccacag

SEQ ID NO: 480249 - RNA, 22 nt, Human
aaagcucacaguaauacaaggc

SEQ ID NO: 480250 - RNA, 22 nt, Human
uaaauguaccuucugccuuacu

SEQ ID NO: 480251 - RNA, 20 nt, Human
gccuguccugagugucaugg

SEQ ID NO: 480252 - RNA, 22 nt, Human
cuugucugugucggauaaaacu

SEQ ID NO: 480253 - RNA, 22 nt, Human
cccucugaccuccugccacagu

SEQ ID NO: 480254 - RNA, 22 nt, Human
ggguccagacacuccagaggaa

SEQ ID NO: 480255 - RNA, 22 nt, Human
ggcugcucuucuuggcgaccuc

SEQ ID NO: 480256 - RNA, 20 nt, Human
cagccuccacucacucagcu

SEQ ID NO: 480257 - RNA, 22 nt, Human
cagcuggcaaguggagcagggu

SEQ ID NO: 480258 - RNA, 22 nt, Human
agggaccuugauggguuuggga

SEQ ID NO: 480259 - RNA, 22 nt, Human
uucauucccaagaguaaacaua

SEQ ID NO: 480260 - RNA, 22 nt, Human
uaguaugggaagaacuuuguag

SEQ ID NO: 480261 - RNA, 22 nt, Human
augcugagacuggagcagcugg

SEQ ID NO: 480262 - RNA, 19 nt, Human
cagagcugcuggccucguc

SEQ ID NO: 480263 - RNA, 22 nt, Human
acugaaggguaaugugggagcc

SEQ ID NO: 480264 - RNA, 19 nt, Human
aucagcaagguaggaugug

SEQ ID NO: 480265 - RNA, 22 nt, Human
uggcugaauaaaauaugguguu

SEQ ID NO: 480266 - RNA, 22 nt, Human
aagaagagaaaugugcugcugg

SEQ ID NO: 480267 - RNA, 22 nt, Human
agcagccacacgccuccuucuc

SEQ ID NO: 480268 - RNA, 22 nt, Human
uuacaucuaaacugugaacaau

SEQ ID NO: 480269 - RNA, 22 nt, Human
uccugaaaaauuacauguucag

SEQ ID NO: 480270 - RNA, 22 nt, Human
ugcagggaaugcuugcagcaug

SEQ ID NO: 480271 - RNA, 22 nt, Human
gaaccaaguaggauacaaggag

SEQ ID NO: 480272 - RNA, 21 nt, Human
gaguggaacgcucuucacacc

SEQ ID NO: 480273 - RNA, 22 nt, Human
gggcuagaaauucugcagugga

SEQ ID NO: 480274 - RNA, 22 nt, Human
ggcaggagcucagguugguucc

SEQ ID NO: 480275 - RNA, 22 nt, Human
gccaguggcaugcggcagggac

SEQ ID NO: 480276 - RNA, 22 nt, Human
ccuggaaguuggagguugcagu

SEQ ID NO: 480277 - RNA, 22 nt, Human
ggaggccuagccagcuccaguu

SEQ ID NO: 480278 - RNA, 20 nt, Human
uggcaggaauagggccagag

SEQ ID NO: 480279 - RNA, 22 nt, Human
guacccaggcacgccuugcuga

SEQ ID NO: 480280 - RNA, 22 nt, Human
aggagcugggcugcugcuggga

SEQ ID NO: 480281 - RNA, 22 nt, Human
agggccuggugaccuggguccu

SEQ ID NO: 480282 - RNA, 23 nt, Human
cagagcugauuaaacuuaaucuc

SEQ ID NO: 480283 - RNA, 22 nt, Human
agagccuggagguucugcugaa

SEQ ID NO: 480284 - RNA, 22 nt, Human
uaaguuuaaauguacaugaagc

SEQ ID NO: 480285 - RNA, 22 nt, Human
agaacagaugugggcagaccug

SEQ ID NO: 480286 - RNA, 22 nt, Human
ucccugcacagccgagccaugc

SEQ ID NO: 480287 - RNA, 22 nt, Human
agcugguaugaacaggauagga

SEQ ID NO: 480288 - RNA, 22 nt, Human
agccccaguccgcugcgggcgg

SEQ ID NO: 480289 - RNA, 22 nt, Human
agaggcuccuucacucuggcac

SEQ ID NO: 480290 - RNA, 22 nt, Human
ugaggcagcauucuucaagaca

SEQ ID NO: 480291 - RNA, 22 nt, Human
cagccagugugaccgaggagga

SEQ ID NO: 480292 - RNA, 22 nt, Human
ggccaccucugcccuacugagu

SEQ ID NO: 480293 - RNA, 22 nt, Human
ugccuucaaucaggauggucuc

SEQ ID NO: 480294 - RNA, 22 nt, Human
agagcuguuuggacaucugagu

SEQ ID NO: 480295 - RNA, 22 nt, Human
ugaugggaggugcugcaggacc

SEQ ID NO: 480296 - RNA, 22 nt, Human
agggcuggcuaggugcguuccc

SEQ ID NO: 480297 - RNA, 22 nt, Human
uccuuugguuguagacaggaau

SEQ ID NO: 480298 - RNA, 22 nt, Human
cagcugccuaugaccuagccuc

SEQ ID NO: 480299 - RNA, 22 nt, Human
uuuccucugucaugacagcuga

SEQ ID NO: 480300 - RNA, 22 nt, Human
agccuggacagcuacggagaac

SEQ ID NO: 480301 - RNA, 22 nt, Human
ugaagcaguucucagaaguggg

SEQ ID NO: 480302 - RNA, 18 nt, Human
cccagcuccacuucccuc

SEQ ID NO: 480303 - RNA, 22 nt, Human
ucucagucuuugcaaggaugcu

SEQ ID NO: 480304 - RNA, 22 nt, Human
gcucagagggaacaaggggcug

SEQ ID NO: 480305 - RNA, 22 nt, Human
gguuggggcgagcuggaggccc

SEQ ID NO: 480306 - RNA, 22 nt, Human
ugcugccucagcuuccugggcu

SEQ ID NO: 480307 - RNA, 22 nt, Human
agacaggacacaagcugcauaa

SEQ ID NO: 480308 - RNA, 22 nt, Human
cagggccauuggcguggcuguc

SEQ ID NO: 480309 - RNA, 20 nt, Human
uggcagaguugucccaccca

SEQ ID NO: 480310 - RNA, 22 nt, Human
ugcuuuauggauuuguguccug

SEQ ID NO: 480311 - RNA, 22 nt, Human
uccugccucuugccuucuucac

SEQ ID NO: 480312 - RNA, 22 nt, Human
gugggcuucuguuagggaggcu

SEQ ID NO: 480313 - RNA, 22 nt, Human
gaauucugggagagaucugaca

SEQ ID NO: 480314 - RNA, 22 nt, Human
agcagcagaagggagacccagg

SEQ ID NO: 480315 - RNA, 22 nt, Human
uagaggugacacugagaccaua

SEQ ID NO: 480316 - RNA, 22 nt, Human
uuagaaaauuugcuucuuugga

SEQ ID NO: 480317 - RNA, 23 nt, Human
cccuggaguaaauucuuggaagg

SEQ ID NO: 480318 - RNA, 22 nt, Human
cucucuggcuuggcacggagau

SEQ ID NO: 480319 - RNA, 19 nt, Human
ugagcaugcgagcugagaa

SEQ ID NO: 480320 - RNA, 23 nt, Human
ucucaagaggaagcagggcucau

SEQ ID NO: 480321 - RNA, 22 nt, Human
uucucauggugucuuuauacau

SEQ ID NO: 480322 - RNA, 21 nt, Human
uaaaucucuguauucuucagu

SEQ ID NO: 480323 - RNA, 22 nt, Human
gcuguacauuuguguacacuug

SEQ ID NO: 480324 - RNA, 22 nt, Human
ggcucaggccuguaauccuagc

SEQ ID NO: 480325 - RNA, 22 nt, Human
aagguacaguuuuaagaauaag

SEQ ID NO: 480326 - RNA, 22 nt, Human
gcagugcuaaguagcuggccca

SEQ ID NO: 480327 - RNA, 22 nt, Human
gcugucugcaagccaggaaaug

SEQ ID NO: 480328 - RNA, 22 nt, Human
uugcagcugcaguaaauguuca

SEQ ID NO: 480329 - RNA, 22 nt, Human
uggagcaggacggggaguggua

SEQ ID NO: 480330 - RNA, 22 nt, Human
caaggagaguaauugaaugaga

SEQ ID NO: 480331 - RNA, 22 nt, Human
caggggcaagaaugcugucagc

SEQ ID NO: 480332 - RNA, 22 nt, Human
acaggugugagaacaugccuug

SEQ ID NO: 480333 - RNA, 22 nt, Human
aguacuucagaggcugcccagg

SEQ ID NO: 480334 - RNA, 22 nt, Human
uaacaucuuuagcagcucgaac

SEQ ID NO: 480335 - RNA, 22 nt, Human
agcugcagucaagcugggccac

SEQ ID NO: 480336 - RNA, 22 nt, Human
acuguacaaccucugccccugu

SEQ ID NO: 480337 - RNA, 22 nt, Human
ccugccugucaucgccugcgcc

SEQ ID NO: 480338 - RNA, 22 nt, Human
cagggcugguuugucgaagaaa

SEQ ID NO: 480339 - RNA, 22 nt, Human
ccugagcuggaagagcuugugc

SEQ ID NO: 480340 - RNA, 22 nt, Human
ccugggaggcggagguugcagu

SEQ ID NO: 480341 - RNA, 22 nt, Human
cugaggcuggcguuugaggaag

SEQ ID NO: 480342 - RNA, 22 nt, Human
aaagacacacagugcuucaguu

SEQ ID NO: 480343 - RNA, 22 nt, Human
cuggagcuaauaauccaucuga

SEQ ID NO: 480344 - RNA, 22 nt, Human
ccugucugagccagggugggca

SEQ ID NO: 480345 - RNA, 22 nt, Human
gcugccugaucauacaccaggg

SEQ ID NO: 480346 - RNA, 22 nt, Human
uuucauuuugguuaugccauaa

SEQ ID NO: 480347 - RNA, 22 nt, Human
uugacaauguccuuugaauuuc

SEQ ID NO: 480348 - RNA, 22 nt, Human
auaucuuuuagagcaagcuugu

SEQ ID NO: 480349 - RNA, 22 nt, Human
uucagagcaucucuaaagccag

SEQ ID NO: 480350 - RNA, 22 nt, Human
gcuccaggagagggaagcagau

SEQ ID NO: 480351 - RNA, 22 nt, Human
cauugcacagcccuguggugau

SEQ ID NO: 480352 - RNA, 22 nt, Human
cacagggcaggccccaggccuc

SEQ ID NO: 480353 - RNA, 20 nt, Human
uacagucagggcacaggcag

SEQ ID NO: 480354 - RNA, 22 nt, Human
uagccuucucaagacaaaguug

SEQ ID NO: 480355 - RNA, 22 nt, Human
cagcccuggugccaagguuccc

SEQ ID NO: 480356 - RNA, 22 nt, Human
ccugggagagucuguggucucc

SEQ ID NO: 480357 - RNA, 22 nt, Human
aaguggagucccuacaaccagc

SEQ ID NO: 480358 - RNA, 22 nt, Human
cccuggagcugcuugcauguug

SEQ ID NO: 480359 - RNA, 22 nt, Human
uugugcauuucucugagugugu

SEQ ID NO: 480360 - RNA, 22 nt, Human
cccugcaguccuuucuuggcuc

SEQ ID NO: 480361 - RNA, 21 nt, Human
ugagagccuccaaccggcuac

SEQ ID NO: 480362 - RNA, 22 nt, Human
ucacaucuuauuagaguaucuc

SEQ ID NO: 480363 - RNA, 22 nt, Human
gagccagguuugaaucucaguc

SEQ ID NO: 480364 - RNA, 22 nt, Human
cauguuaauaugcauugaguac

SEQ ID NO: 480365 - RNA, 22 nt, Human
aguauuuccuggcuuaucugcu

SEQ ID NO: 480366 - RNA, 22 nt, Human
aggccagaaauuuggaguaugu

SEQ ID NO: 480367 - RNA, 22 nt, Human
ggagcacuauaauagagauuuu

SEQ ID NO: 480368 - RNA, 22 nt, Human
gcaggaagaggcucgaagcccc

SEQ ID NO: 480369 - RNA, 22 nt, Human
ccacagggucagccacucugca

SEQ ID NO: 480370 - RNA, 22 nt, Human
caccaggcugaaccagagggga

SEQ ID NO: 480371 - RNA, 22 nt, Human
acaaaggcauagugaauguuuu

SEQ ID NO: 480372 - RNA, 20 nt, Human
ccagcuuucccugcagcauc

SEQ ID NO: 480373 - RNA, 22 nt, Human
ccagagccucgcccggagccuc

SEQ ID NO: 480374 - RNA, 22 nt, Human
aggggccucgcaggaccgcucc

SEQ ID NO: 480375 - RNA, 22 nt, Human
gagcaggaugggagcuggggcc

SEQ ID NO: 480376 - RNA, 22 nt, Human
cauuuguaguuaaaaaugucuc

SEQ ID NO: 480377 - RNA, 22 nt, Human
aaauucuaugucaauguuuauu

SEQ ID NO: 480378 - RNA, 18 nt, Human
agcagcugucagaaugcc

SEQ ID NO: 480379 - RNA, 21 nt, Human
gcagcaguguucuagaauacu

SEQ ID NO: 480380 - RNA, 22 nt, Human
cauguuaaaauauacauucuga

SEQ ID NO: 480381 - RNA, 22 nt, Human
ggguggaguagaaagaugaauu

SEQ ID NO: 480382 - RNA, 22 nt, Human
gccaagagaaugugagagaaau

SEQ ID NO: 480383 - RNA, 22 nt, Human
cucuccagaucugcugagccag

SEQ ID NO: 480384 - RNA, 22 nt, Human
uccagccuaauguucuucccac

SEQ ID NO: 480385 - RNA, 22 nt, Human
ucccagagacagagccuccucc

SEQ ID NO: 480386 - RNA, 22 nt, Human
gcaggcuggaggcuguucuggg

SEQ ID NO: 480387 - RNA, 22 nt, Human
ugaguucuaguggcugcagauu

SEQ ID NO: 480388 - RNA, 22 nt, Human
cagagccaaaugcugugguuau

SEQ ID NO: 480389 - RNA, 22 nt, Human
agggagcaugggugaagcaggc

SEQ ID NO: 480390 - RNA, 21 nt, Human
agaagccuggguggagguggg

SEQ ID NO: 480391 - RNA, 22 nt, Human
aggucaaguuuagauagaguua

SEQ ID NO: 480392 - RNA, 22 nt, Human
aaggaagggaaauagugauguc

SEQ ID NO: 480393 - RNA, 22 nt, Human
gccugcagaggugcugcuagcu

SEQ ID NO: 480394 - RNA, 22 nt, Human
agggcagugggaaagccugcuc

SEQ ID NO: 480395 - RNA, 22 nt, Human
cagcauggagacaaagugggca

SEQ ID NO: 480396 - RNA, 22 nt, Human
ugcagcauugcaaagcagucuu

SEQ ID NO: 480397 - RNA, 22 nt, Human
uggcucaguaaucgagucuccu

SEQ ID NO: 480398 - RNA, 22 nt, Human
aauuaggggaggacguaucaua

SEQ ID NO: 480399 - RNA, 22 nt, Human
ucagguggcuucggggaguggc

SEQ ID NO: 480400 - RNA, 22 nt, Human
uucuugcucaaugucuguuuaa

SEQ ID NO: 480401 - RNA, 22 nt, Human
gucaggcugccagucuuuauug

SEQ ID NO: 480402 - RNA, 22 nt, Human
ucagccuggcaggauggccugg

SEQ ID NO: 480403 - RNA, 22 nt, Human
gagcagugguugaacagaggca

SEQ ID NO: 480404 - RNA, 22 nt, Human
uggcucagagcagggacucugg

SEQ ID NO: 480405 - RNA, 22 nt, Human
gccugguggacacugggcauca

SEQ ID NO: 480406 - RNA, 22 nt, Human
uucaagauggccccagugagcc

SEQ ID NO: 480407 - RNA, 22 nt, Human
aaaagcaguuaucugggaggaa

SEQ ID NO: 480408 - RNA, 22 nt, Human
gcagguguggaguggggugagc

SEQ ID NO: 480409 - RNA, 22 nt, Human
agucucagaaaagaagcaugga

SEQ ID NO: 480410 - RNA, 22 nt, Human
uauaauccauucauugauuucu

SEQ ID NO: 480411 - RNA, 22 nt, Human
uuggagcccugaggaucuggau

SEQ ID NO: 480412 - RNA, 22 nt, Human
cagugcagaacacauggaaaau

SEQ ID NO: 480413 - RNA, 22 nt, Human
gagcugggcacacgccacuuga

SEQ ID NO: 480414 - RNA, 22 nt, Human
uguuuucauuugauguaacaaa

SEQ ID NO: 480415 - RNA, 20 nt, Human
gcagggcaucuuggccccca

SEQ ID NO: 480416 - RNA, 22 nt, Human
cugaaggagguagagugacaua

SEQ ID NO: 480417 - RNA, 22 nt, Human
cagcagcaacaacggaagccuu

SEQ ID NO: 480418 - RNA, 22 nt, Human
aggcacugacucaagggagcca

SEQ ID NO: 480419 - RNA, 22 nt, Human
auucuucauguugaagcuguca

SEQ ID NO: 480420 - RNA, 22 nt, Human
ugcagagggacagccacagcuc

SEQ ID NO: 480421 - RNA, 17 nt, Human
gguggccugcaguggcu

SEQ ID NO: 480422 - RNA, 22 nt, Human
ccagagcccgggaccuggacuu

SEQ ID NO: 480423 - RNA, 22 nt, Human
aaaugcagcagcuaauugaaaa

SEQ ID NO: 480424 - RNA, 22 nt, Human
uagugaaauuuaugcacagcua

SEQ ID NO: 480425 - RNA, 21 nt, Human
ggcccugguuacgccuccucu

SEQ ID NO: 480426 - RNA, 23 nt, Human
ugcugguguuuuugggaccaggg

SEQ ID NO: 480427 - RNA, 22 nt, Human
gccacaggcacuuaagggcugg

SEQ ID NO: 480428 - RNA, 22 nt, Human
ccucugcugcuguugagcaccg

SEQ ID NO: 480429 - RNA, 22 nt, Human
gcaggagcugcucuccugacga

SEQ ID NO: 480430 - RNA, 19 nt, Human
agaggcugucaccuguagc

SEQ ID NO: 480431 - RNA, 22 nt, Human
acaguggagaagcaaaugcagu

SEQ ID NO: 480432 - RNA, 22 nt, Human
ugcuuaaaaugaugauuauuuu

SEQ ID NO: 480433 - RNA, 22 nt, Human
ucugucaccgagggcauccaaa

SEQ ID NO: 480434 - RNA, 22 nt, Human
acagagcauuugggacagagag

SEQ ID NO: 480435 - RNA, 22 nt, Human
aagaggaagucuccauggagag

SEQ ID NO: 480436 - RNA, 22 nt, Human
cagagccacuuggagaugagaa

SEQ ID NO: 480437 - RNA, 22 nt, Human
uuacaagugucagguacuggca

SEQ ID NO: 480438 - RNA, 22 nt, Human
auucagaaauagaaaauuugau

SEQ ID NO: 480439 - RNA, 22 nt, Human
ggucccaggcugcgggcuggug

SEQ ID NO: 480440 - RNA, 22 nt, Human
cuggcccuucucuugcuuccug

SEQ ID NO: 480441 - RNA, 19 nt, Human
ugaagcaauaccauuuuug

SEQ ID NO: 480442 - RNA, 22 nt, Human
aggcugggaaauguauuccagc

SEQ ID NO: 480443 - RNA, 22 nt, Human
aaggagagguuguccguguugu

SEQ ID NO: 480444 - RNA, 20 nt, Human
ucauuucuugggguuccaag

SEQ ID NO: 480445 - RNA, 22 nt, Human
ucaccaggauugggcuguaggc

SEQ ID NO: 480446 - RNA, 22 nt, Human
uggccucugggaaagcagauuc

SEQ ID NO: 480447 - RNA, 23 nt, Human
aggcccaacucugugagggcugc

SEQ ID NO: 480448 - RNA, 22 nt, Human
cugggcugcaguuccugguccu

SEQ ID NO: 480449 - RNA, 22 nt, Human
acaggcaggcuucggccagagc

SEQ ID NO: 480450 - RNA, 22 nt, Human
cacaaaugacugaaacgacugu

SEQ ID NO: 480451 - RNA, 22 nt, Human
aggcaggucacaugcuuggcga

SEQ ID NO: 480452 - RNA, 22 nt, Human
gggcucucaugaguguguggua

SEQ ID NO: 480453 - RNA, 22 nt, Human
aggugauguccacagcuugcag

SEQ ID NO: 480454 - RNA, 22 nt, Human
ucacauuugcaauugcauuguu

SEQ ID NO: 480455 - RNA, 22 nt, Human
caguccugcccaggcugacaga

SEQ ID NO: 480456 - RNA, 22 nt, Human
uucauugucucuguuugccuuc

SEQ ID NO: 480457 - RNA, 22 nt, Human
uccguauuugacuauugcaccg

SEQ ID NO: 480458 - RNA, 22 nt, Human
aaggcaggaugcggacccaucu

SEQ ID NO: 480459 - RNA, 22 nt, Human
agcagcauacacaucauguuga

SEQ ID NO: 480460 - RNA, 22 nt, Human
uuuugagauggagucuugcucu

SEQ ID NO: 480461 - RNA, 22 nt, Human
ucaggauccauagacucccaaa

SEQ ID NO: 480462 - RNA, 22 nt, Human
uggcucaggggucuggcucugu

SEQ ID NO: 480463 - RNA, 22 nt, Human
uuucuguuaggcaucauuuuaa

SEQ ID NO: 480464 - RNA, 22 nt, Human
gcauuucugugcauacacauga

SEQ ID NO: 480465 - RNA, 22 nt, Human
cagcuccccucuguggggcagu

SEQ ID NO: 480466 - RNA, 22 nt, Human
caggcugggcuccggagauaaa

SEQ ID NO: 480467 - RNA, 22 nt, Human
cacagaauaaauugguaucaga

SEQ ID NO: 480468 - RNA, 22 nt, Human
gugccugugccaggggugugcu

SEQ ID NO: 480469 - RNA, 18 nt, Human
ucagcuggggcugcagcc

SEQ ID NO: 480470 - RNA, 18 nt, Human
uccagagcuacuguggug

SEQ ID NO: 480471 - RNA, 22 nt, Human
agaauucucuuccauugaaaca

SEQ ID NO: 480472 - RNA, 22 nt, Human
uaggggugaggccaggcaucag

SEQ ID NO: 480473 - RNA, 17 nt, Human
aggcauggucuggggug

SEQ ID NO: 480474 - RNA, 22 nt, Human
cagcaggggaacugugggccag

SEQ ID NO: 480475 - RNA, 22 nt, Human
aguugaaauuagaguccuggcu

SEQ ID NO: 480476 - RNA, 22 nt, Human
agcugacuucuugauccaauga

SEQ ID NO: 480477 - RNA, 22 nt, Human
agugaaauagcauuuaugaagc

SEQ ID NO: 480478 - RNA, 22 nt, Human
ggcugaguugagaggauuacuu

SEQ ID NO: 480479 - RNA, 22 nt, Human
gggcuacauugugagagaaguu

SEQ ID NO: 480480 - RNA, 22 nt, Human
cagggcaguaccgcccucuggc

SEQ ID NO: 480481 - RNA, 22 nt, Human
ugcucugucaagaaaagaugcc

SEQ ID NO: 480482 - RNA, 22 nt, Human
aggcagcauuugaauccagguc

SEQ ID NO: 480483 - RNA, 22 nt, Human
ugagcuuacgugggaacagacu

SEQ ID NO: 480484 - RNA, 22 nt, Human
cccaggaguuugaguucagcau

SEQ ID NO: 480485 - RNA, 22 nt, Human
ucaggagcuugguagugugauu

SEQ ID NO: 480486 - RNA, 22 nt, Human
gcaggaagcauagaagaaugcc

SEQ ID NO: 480487 - RNA, 22 nt, Human
cugagauggccacugggucuca

SEQ ID NO: 480488 - RNA, 22 nt, Human
aagcccagaugugagaacugag

SEQ ID NO: 480489 - RNA, 22 nt, Human
caauguguuugcauauuaaaau

SEQ ID NO: 480490 - RNA, 22 nt, Human
ugcagccauuuucugccaaugc

SEQ ID NO: 480491 - RNA, 19 nt, Human
acucaagucuaaugaaauc

SEQ ID NO: 480492 - RNA, 22 nt, Human
gcagcuuuguggagaggcccau

SEQ ID NO: 480493 - RNA, 22 nt, Human
aagccucuggggccucaucugu

SEQ ID NO: 480494 - RNA, 21 nt, Human
ggagaaggacaauguugagua

SEQ ID NO: 480495 - RNA, 22 nt, Human
aaggcucccucuucucgagugu

SEQ ID NO: 480496 - RNA, 22 nt, Human
aucaguuucuaccauguggaau

SEQ ID NO: 480497 - RNA, 22 nt, Human
gaaggucaccuccccucucugg

SEQ ID NO: 480498 - RNA, 20 nt, Human
aauguauauuuuaugccagg

SEQ ID NO: 480499 - RNA, 22 nt, Human
gcucuggacuggggccugagaa

SEQ ID NO: 480500 - RNA, 22 nt, Human
gacugucauucuagugcccaug

SEQ ID NO: 480501 - RNA, 22 nt, Human
caggagacaaguuagcagcuga

SEQ ID NO: 480502 - RNA, 22 nt, Human
ucuguacaguaccagauaguaa

SEQ ID NO: 480503 - RNA, 21 nt, Human
cgggcuggccgggcccucacc

SEQ ID NO: 480504 - RNA, 22 nt, Human
cagagacuggagugcaguggcg

SEQ ID NO: 480505 - RNA, 22 nt, Human
agggaccucauguaaguggauu

SEQ ID NO: 480506 - RNA, 22 nt, Human
uggggccugagguggagcugca

SEQ ID NO: 480507 - RNA, 22 nt, Human
cauccugguuaccccauaguca

SEQ ID NO: 480508 - RNA, 22 nt, Human
agaaauacuaggaauauucaua

SEQ ID NO: 480509 - RNA, 22 nt, Human
cuguccugauggugccacuggu

SEQ ID NO: 480510 - RNA, 22 nt, Human
uguggcucucagauccuccaau

SEQ ID NO: 480511 - RNA, 22 nt, Human
gagggcugcugccagauaugcc

SEQ ID NO: 480512 - RNA, 22 nt, Human
aggcacugcagauuacaggcgc

SEQ ID NO: 480513 - RNA, 22 nt, Human
uucaggagaaaguucaguacuu

SEQ ID NO: 480514 - RNA, 22 nt, Human
cauugcacucuggcuggaacgg

SEQ ID NO: 480515 - RNA, 17 nt, Human
gcucccugaggacagcu

SEQ ID NO: 480516 - RNA, 22 nt, Human
ugcucagugagucugugacagg

SEQ ID NO: 480517 - RNA, 22 nt, Human
caggggcucugagauugucuaa

SEQ ID NO: 480518 - RNA, 19 nt, Human
ugagaaggcaguggggagc

SEQ ID NO: 480519 - RNA, 22 nt, Human
gagaaagcuucuuucccacagg

SEQ ID NO: 480520 - RNA, 22 nt, Human
uuucacaauuuuaaggagcaaa

SEQ ID NO: 480521 - RNA, 22 nt, Human
uauguacagggauagaacuuga

SEQ ID NO: 480522 - RNA, 22 nt, Human
ccagcagcuguggcuuugccuc

SEQ ID NO: 480523 - RNA, 22 nt, Human
aggcacugaagugguaaaugua

SEQ ID NO: 480524 - RNA, 22 nt, Human
agccugcuggaccaagcucaug

SEQ ID NO: 480525 - RNA, 22 nt, Human
ggccucggcccacugcugcggu

SEQ ID NO: 480526 - RNA, 22 nt, Human
augauuuccaguuguugcuaag

SEQ ID NO: 480527 - RNA, 22 nt, Human
ggcaggaggugaguggcgggug

SEQ ID NO: 480528 - RNA, 22 nt, Human
gggacagcuguagugcuuggcu

SEQ ID NO: 480529 - RNA, 22 nt, Human
aggggugaaggcccgauaggag

SEQ ID NO: 480530 - RNA, 19 nt, Human
uggaccugugcccauggcu

SEQ ID NO: 480531 - RNA, 22 nt, Human
uuugcauuauauuuauagaaga

SEQ ID NO: 480532 - RNA, 22 nt, Human
agaggagguccuuuucugaugu

SEQ ID NO: 480533 - RNA, 22 nt, Human
augcauaauguauguauugacu

SEQ ID NO: 480534 - RNA, 22 nt, Human
gcuggggagggcgucaaggcca

SEQ ID NO: 480535 - RNA, 22 nt, Human
agaggaggcucugggaucgucc

SEQ ID NO: 480536 - RNA, 22 nt, Human
gugccugggcaugagcuuguug

SEQ ID NO: 480537 - RNA, 22 nt, Human
gggugcugacuggggccugaaa

SEQ ID NO: 480538 - RNA, 22 nt, Human
uucucuucuguucagugcccaa

SEQ ID NO: 480539 - RNA, 22 nt, Human
guguuaaccagcuaaacuuugc

SEQ ID NO: 480540 - RNA, 22 nt, Human
gccuuggccaacaccuugcaaa

SEQ ID NO: 480541 - RNA, 22 nt, Human
cagggcagaaggcacucuacuc

SEQ ID NO: 480542 - RNA, 22 nt, Human
gcugucugcugugcacugagca

SEQ ID NO: 480543 - RNA, 22 nt, Human
aaauguguauaugaaacaugau

SEQ ID NO: 480544 - RNA, 22 nt, Human
uucugcagcccaacaguaguuu

SEQ ID NO: 480545 - RNA, 22 nt, Human
aucugccugcaguggagguggg

SEQ ID NO: 480546 - RNA, 22 nt, Human
ugcuagaaaucugaaacuagca

SEQ ID NO: 480547 - RNA, 22 nt, Human
ucauugcagcuucagguguuca

SEQ ID NO: 480548 - RNA, 22 nt, Human
uauuuagaacagacaauagaaa

SEQ ID NO: 480549 - RNA, 22 nt, Human
cacaccagagguuaccugcaaa

SEQ ID NO: 480550 - RNA, 22 nt, Human
ugugacaucgcugugucuguuu

SEQ ID NO: 480551 - RNA, 22 nt, Human
aaaugugugcacaaagacagcu

SEQ ID NO: 480552 - RNA, 22 nt, Human
guaucuuuccacaucuucagua

SEQ ID NO: 480553 - RNA, 22 nt, Human
ggccuguguccuccuugcccug

SEQ ID NO: 480554 - RNA, 22 nt, Human
uuucuaguccucaugcaucauu

SEQ ID NO: 480555 - RNA, 23 nt, Human
uggggccaagugaggaagggucu

SEQ ID NO: 480556 - RNA, 22 nt, Human
uuguggcucgugagauguuagg

SEQ ID NO: 480557 - RNA, 20 nt, Human
ggcucuggaaucuggugggc

SEQ ID NO: 480558 - RNA, 22 nt, Human
ucaggauguuaauauagcauua

SEQ ID NO: 480559 - RNA, 22 nt, Human
uuuccuuugcccaauacauguc

SEQ ID NO: 480560 - RNA, 22 nt, Human
guuauguaaucuaacacucagu

SEQ ID NO: 480561 - RNA, 22 nt, Human
gcuucuggaggagcugggcuga

SEQ ID NO: 480562 - RNA, 22 nt, Human
gccagcagguggagagaucaag

SEQ ID NO: 480563 - RNA, 22 nt, Human
aacaaauguaaaaugcagaugc

SEQ ID NO: 480564 - RNA, 22 nt, Human
gacauuucaaucucauuauggg

SEQ ID NO: 480565 - RNA, 22 nt, Human
gaguguuccagaaacuggcccu

SEQ ID NO: 480566 - RNA, 22 nt, Human
gcugugugcucacguaguggaa

SEQ ID NO: 480567 - RNA, 22 nt, Human
cacagcuucuccuugauaucgc

SEQ ID NO: 480568 - RNA, 22 nt, Human
ccagcuccccucagcagguaau

SEQ ID NO: 480569 - RNA, 22 nt, Human
augcacgccccacacuggugug

SEQ ID NO: 480570 - RNA, 22 nt, Human
gccagaagggguggauccaggc

SEQ ID NO: 480571 - RNA, 22 nt, Human
ggaaggagggcggcaaugauga

SEQ ID NO: 480572 - RNA, 22 nt, Human
cccuguccuuggcugugaggcu

SEQ ID NO: 480573 - RNA, 22 nt, Human
ccucugaguccucccugguugc

SEQ ID NO: 480574 - RNA, 22 nt, Human
ucacuguaucauguugcacuua

SEQ ID NO: 480575 - RNA, 21 nt, Human
ugcagccauucagcccuaugc

SEQ ID NO: 480576 - RNA, 21 nt, Human
uuagaaagcucacuacaguua

SEQ ID NO: 480577 - RNA, 22 nt, Human
ccaggccagcaggcacaccugc

SEQ ID NO: 480578 - RNA, 22 nt, Human
ucucaggaaauaggauuugagu

SEQ ID NO: 480579 - RNA, 22 nt, Human
agggaggaccaaugugugguua

SEQ ID NO: 480580 - RNA, 22 nt, Human
gaagcccacguuuggugaugua

SEQ ID NO: 480581 - RNA, 22 nt, Human
agagaacacgugcaucugcaau

SEQ ID NO: 480582 - RNA, 22 nt, Human
ccagcuggagcucgcagauagg

SEQ ID NO: 480583 - RNA, 22 nt, Human
ucucagaguuuuuuuccaggac

SEQ ID NO: 480584 - RNA, 22 nt, Human
caguauguuugggagacaugac

SEQ ID NO: 480585 - RNA, 22 nt, Human
cagcucaaguuucccaggucag

SEQ ID NO: 480586 - RNA, 22 nt, Human
ugaggcaggacugagcgggaug

SEQ ID NO: 480587 - RNA, 22 nt, Human
ucuggagcuuccucauuuacag

SEQ ID NO: 480588 - RNA, 22 nt, Human
uccucccacauaggacaauggg

SEQ ID NO: 480589 - RNA, 22 nt, Human
ccugccagucacuaugucaccu

SEQ ID NO: 480590 - RNA, 22 nt, Human
cagccugcuagggcaaugccuu

SEQ ID NO: 480591 - RNA, 22 nt, Human
gagaggcauggaacagauucuu

SEQ ID NO: 480592 - RNA, 22 nt, Human
acagagagaaacaaucagcagc

SEQ ID NO: 480593 - RNA, 22 nt, Human
aggcagagaaaaaccagauaug

SEQ ID NO: 480594 - RNA, 22 nt, Human
agauuaugcuggcugcuacaag

SEQ ID NO: 480595 - RNA, 22 nt, Human
gagcugccugaacaagcagcag

SEQ ID NO: 480596 - RNA, 22 nt, Human
agggaccugucaaugacaguua

SEQ ID NO: 480597 - RNA, 22 nt, Human
uccuugaaaagaaugucuccau

SEQ ID NO: 480598 - RNA, 22 nt, Human
ccucaggggugcccacagcugc

SEQ ID NO: 480599 - RNA, 22 nt, Human
aggcacaguuucauccccgggc

SEQ ID NO: 480600 - RNA, 22 nt, Human
uccuguggucuggaaggaaugg

SEQ ID NO: 480601 - RNA, 18 nt, Human
aagcugcccucaggcagg

SEQ ID NO: 480602 - RNA, 22 nt, Human
gccaggcaggccacgcuguguu

SEQ ID NO: 480603 - RNA, 22 nt, Human
uccuugaaugaagagaggugac

SEQ ID NO: 480604 - RNA, 22 nt, Human
cacugcuucuggaggaauuugg

SEQ ID NO: 480605 - RNA, 22 nt, Human
ucagaggaucaugucccuacuc

SEQ ID NO: 480606 - RNA, 22 nt, Human
ccagagugacgugaagugugaa

SEQ ID NO: 480607 - RNA, 19 nt, Human
ucccgcccacugagcgugc

SEQ ID NO: 480608 - RNA, 22 nt, Human
agcagcucacaggauuccugaa

SEQ ID NO: 480609 - RNA, 22 nt, Human
ugagccuguggggugacaacca

SEQ ID NO: 480610 - RNA, 17 nt, Human
ugguggcuggagucagg

SEQ ID NO: 480611 - RNA, 22 nt, Human
cagcucugggugacaggagggc

SEQ ID NO: 480612 - RNA, 22 nt, Human
ggguacuuaauauuuacggggu

SEQ ID NO: 480613 - RNA, 22 nt, Human
caggcaggagccagggauucca

SEQ ID NO: 480614 - RNA, 22 nt, Human
ugugcuucaucacuucucaguu

SEQ ID NO: 480615 - RNA, 22 nt, Human
uguagaaagcucuucugaaauc

SEQ ID NO: 480616 - RNA, 22 nt, Human
guggcugcuacagagcuggagg

SEQ ID NO: 480617 - RNA, 22 nt, Human
aagguacaccaaaguucaaguu

SEQ ID NO: 480618 - RNA, 22 nt, Human
agcaggcuuucaagagucuucu

SEQ ID NO: 480619 - RNA, 22 nt, Human
cagcaauaagguaagcuucucc

SEQ ID NO: 480620 - RNA, 22 nt, Human
cccuuccuccucgccugucaga

SEQ ID NO: 480621 - RNA, 22 nt, Human
uccaguggguugcugagggagg

SEQ ID NO: 480622 - RNA, 22 nt, Human
uccuggcccggccgggccugcu

SEQ ID NO: 480623 - RNA, 22 nt, Human
aggcagccuuuagacagucugc

SEQ ID NO: 480624 - RNA, 22 nt, Human
uggagcugggaguccugggcug

SEQ ID NO: 480625 - RNA, 22 nt, Human
cacugccugugagcugugugcc

SEQ ID NO: 480626 - RNA, 22 nt, Human
cccagagcugagucugauauau

SEQ ID NO: 480627 - RNA, 22 nt, Human
uggcucagugaagagauaacuu

SEQ ID NO: 480628 - RNA, 22 nt, Human
ggcucugccugcccagcagcac

SEQ ID NO: 480629 - RNA, 22 nt, Human
aaggcagauauaaagacuagag

SEQ ID NO: 480630 - RNA, 22 nt, Human
aggcacuguacuagguacaggg

SEQ ID NO: 480631 - RNA, 22 nt, Human
cuggugucugcucccucacagc

SEQ ID NO: 480632 - RNA, 22 nt, Human
ucccagcauaacaaacugcccg

SEQ ID NO: 480633 - RNA, 22 nt, Human
cucaggagguuuccugucuagg

SEQ ID NO: 480634 - RNA, 22 nt, Human
ucacacguccuugcuacuccuc

SEQ ID NO: 480635 - RNA, 22 nt, Human
auuuagaaauuccaaaaguauu

SEQ ID NO: 480636 - RNA, 22 nt, Human
cagggcugagaauuuagagaca

SEQ ID NO: 480637 - RNA, 22 nt, Human
acacaaacagucuauagcacca

SEQ ID NO: 480638 - RNA, 22 nt, Human
cgaggcagaggcugaaacggcu

SEQ ID NO: 480639 - RNA, 22 nt, Human
ugccaggcauguaguagacuug

SEQ ID NO: 480640 - RNA, 22 nt, Human
uggcccugacuuggaggccuga

SEQ ID NO: 480641 - RNA, 22 nt, Human
gccucccugagucacccaagca

SEQ ID NO: 480642 - RNA, 19 nt, Human
gcugcucugggucucaucu

SEQ ID NO: 480643 - RNA, 22 nt, Human
uaacagaaauauuuccagguga

SEQ ID NO: 480644 - RNA, 22 nt, Human
agaagccauguuuaguaggaug

SEQ ID NO: 480645 - RNA, 19 nt, Human
augauggucccauucaccu

SEQ ID NO: 480646 - RNA, 22 nt, Human
gucucccaaccccugugcccag

SEQ ID NO: 480647 - RNA, 22 nt, Human
gcugccuggagcucagccugcc

SEQ ID NO: 480648 - RNA, 22 nt, Human
ggcugcuggggacgugggagag

SEQ ID NO: 480649 - RNA, 22 nt, Human
cauacauaugcauguguguaua

SEQ ID NO: 480650 - RNA, 22 nt, Human
cugaggccucuguucaccagaa

SEQ ID NO: 480651 - RNA, 22 nt, Human
aguggcagcugucaugcccuag

SEQ ID NO: 480652 - RNA, 22 nt, Human
guucuuaagaccacaauaaaaa

SEQ ID NO: 480653 - RNA, 22 nt, Human
uauuugcaaagaacuacacuag

SEQ ID NO: 480654 - RNA, 22 nt, Human
augggaggcaggcucagaaccg

SEQ ID NO: 480655 - RNA, 22 nt, Human
gggcugcacagaucuucaaggg

SEQ ID NO: 480656 - RNA, 22 nt, Human
aggcucaguuugguuuccauug

SEQ ID NO: 480657 - RNA, 22 nt, Human
gucccaggaguugcugggccuu

SEQ ID NO: 480658 - RNA, 22 nt, Human
augaggcaggagugcaguggca

SEQ ID NO: 480659 - RNA, 22 nt, Human
acuccugguuuguguccuggcu

SEQ ID NO: 480660 - RNA, 22 nt, Human
ggggcugguggugguuucucca

SEQ ID NO: 480661 - RNA, 22 nt, Human
aauggcugccagggcaggaggu

SEQ ID NO: 480662 - RNA, 22 nt, Human
caucugccuaaguggcccuguu

SEQ ID NO: 480663 - RNA, 22 nt, Human
cacagcuuccauuagaaugaga

SEQ ID NO: 480664 - RNA, 21 nt, Human
ucucuggaguuagcagagaga

SEQ ID NO: 480665 - RNA, 22 nt, Human
ugugacaugugucaucuuuucu

SEQ ID NO: 480666 - RNA, 22 nt, Human
gaggcccaggucaagcagccac

SEQ ID NO: 480667 - RNA, 22 nt, Human
ucagcugagcuccagcucauag

SEQ ID NO: 480668 - RNA, 22 nt, Human
ucagcuuugccaccagcuguaa

SEQ ID NO: 480669 - RNA, 21 nt, Human
agagaagggacucuuccaguc

SEQ ID NO: 480670 - RNA, 22 nt, Human
gguuugcacgauauuuccaugg

SEQ ID NO: 480671 - RNA, 21 nt, Human
agggagcuauuuauaguaagc

SEQ ID NO: 480672 - RNA, 22 nt, Human
uagaugaccuuguguuaggcaa

SEQ ID NO: 480673 - RNA, 22 nt, Human
gaggucaauaauaugugcuuua

SEQ ID NO: 480674 - RNA, 22 nt, Human
gggcuggcucccagguguugaa

SEQ ID NO: 480675 - RNA, 22 nt, Human
ccaguggccaugcacgagcagc

SEQ ID NO: 480676 - RNA, 18 nt, Human
ucucagaggccauccuag

SEQ ID NO: 480677 - RNA, 22 nt, Human
cacagaggacuguagcggggag

SEQ ID NO: 480678 - RNA, 22 nt, Human
aauaguguuguucacucaggag

SEQ ID NO: 480679 - RNA, 22 nt, Human
gaggagagagggacugucugca

SEQ ID NO: 480680 - RNA, 22 nt, Human
uauguagaagcugcucaaagaa

SEQ ID NO: 480681 - RNA, 22 nt, Human
ccaggugggaggaaagcagaga

SEQ ID NO: 480682 - RNA, 22 nt, Human
aaggaagagaauccuucucaga

SEQ ID NO: 480683 - RNA, 22 nt, Human
agcaauaugacauugcuacauc

SEQ ID NO: 480684 - RNA, 22 nt, Human
cuaguccacuguccugccucca

SEQ ID NO: 480685 - RNA, 22 nt, Human
acccagaggcggagguugcagu

SEQ ID NO: 480686 - RNA, 22 nt, Human
gaggccugguuuccagcauccu

SEQ ID NO: 480687 - RNA, 22 nt, Human
ucuguacaugaguugagaauca

SEQ ID NO: 480688 - RNA, 22 nt, Human
agggaccugcucacugccuggc

SEQ ID NO: 480689 - RNA, 22 nt, Human
aagcugccuuccaugugaggaa

SEQ ID NO: 480690 - RNA, 22 nt, Human
augaugguaaauucaguauccg

SEQ ID NO: 480691 - RNA, 22 nt, Human
gcuggcauuacaggagagaacc

SEQ ID NO: 480692 - RNA, 22 nt, Human
aacaaaugauaccaguucucaa

SEQ ID NO: 480693 - RNA, 22 nt, Human
gggggcuggaauauccaucaac

SEQ ID NO: 480694 - RNA, 22 nt, Human
aaaauccuuagccgagugaggu

SEQ ID NO: 480695 - RNA, 22 nt, Human
acugcagccuugaacucugggc

SEQ ID NO: 480696 - RNA, 22 nt, Human
ucagaggacaagcucccuggug

SEQ ID NO: 480697 - RNA, 22 nt, Human
agagaaaacucauugagguguc

SEQ ID NO: 480698 - RNA, 22 nt, Human
auguuacacauaggcauaaaug

SEQ ID NO: 480699 - RNA, 22 nt, Human
ggccuugguaaagggaugcaug

SEQ ID NO: 480700 - RNA, 22 nt, Human
augguuuguguggcccagauga

SEQ ID NO: 480701 - RNA, 22 nt, Human
aaggggaaguagcaccagaggu

SEQ ID NO: 480702 - RNA, 22 nt, Human
aaugaugguuucaucacuugaa

SEQ ID NO: 480703 - RNA, 22 nt, Human
agaauaaaucaaauguccugag

SEQ ID NO: 480704 - RNA, 22 nt, Human
cuggcucccguuguccuugaag

SEQ ID NO: 480705 - RNA, 22 nt, Human
ugcuucaggaagaaacgccagg

SEQ ID NO: 480706 - RNA, 22 nt, Human
gcuccugucuuggggcacuggc

SEQ ID NO: 480707 - RNA, 19 nt, Human
ucauucaggaccaguggau

SEQ ID NO: 480708 - RNA, 22 nt, Human
ucucaagcuuguugguauguuu

SEQ ID NO: 480709 - RNA, 22 nt, Human
gagagucuaggaaccucauaua

SEQ ID NO: 480710 - RNA, 22 nt, Human
cauuccuuaacguggggagucu

SEQ ID NO: 480711 - RNA, 22 nt, Human
ugcugccagagagacagggacu

SEQ ID NO: 480712 - RNA, 22 nt, Human
ccugccuggcugucagcagagc

SEQ ID NO: 480713 - RNA, 22 nt, Human
ugggccuggacaaggccacuag

SEQ ID NO: 480714 - RNA, 22 nt, Human
ggaguuggugagcaccaggcuu

SEQ ID NO: 480715 - RNA, 22 nt, Human
gcuccugggcucuaccuugcua

SEQ ID NO: 480716 - RNA, 22 nt, Human
caggacauugauccauuggcac

SEQ ID NO: 480717 - RNA, 22 nt, Human
cugcaguguucuggaaugcauu

SEQ ID NO: 480718 - RNA, 22 nt, Human
ggcugccuccugcugggcugga

SEQ ID NO: 480719 - RNA, 20 nt, Human
caguccaaucagaggccacc

SEQ ID NO: 480720 - RNA, 22 nt, Human
ucacagaauagcacuguaagcg

SEQ ID NO: 480721 - RNA, 22 nt, Human
gagcugaguuaccuccagauca

SEQ ID NO: 480722 - RNA, 22 nt, Human
agaaauguauucuguauguuuu

SEQ ID NO: 480723 - RNA, 22 nt, Human
gggagaagaaugugucaauugu

SEQ ID NO: 480724 - RNA, 22 nt, Human
aggcacugauucucagaguuac

SEQ ID NO: 480725 - RNA, 22 nt, Human
uggcucaguuucugcccagcug

SEQ ID NO: 480726 - RNA, 23 nt, Human
aggaggaaaaguuaucugcugag

SEQ ID NO: 480727 - RNA, 22 nt, Human
uagagcugaguugacuccauuu

SEQ ID NO: 480728 - RNA, 22 nt, Human
cuguggcuaugguguacauacu

SEQ ID NO: 480729 - RNA, 22 nt, Human
ugauuuccaguugcugggugcu

SEQ ID NO: 480730 - RNA, 22 nt, Human
agaugcugugaggaagcuagga

SEQ ID NO: 480731 - RNA, 22 nt, Human
cugggggcaauggucagagugu

SEQ ID NO: 480732 - RNA, 21 nt, Human
acagcagagaucaagacuaag

SEQ ID NO: 480733 - RNA, 22 nt, Human
ugccucugcugcuguggcauca

SEQ ID NO: 480734 - RNA, 22 nt, Human
caccugcaaggagcuuucauuu

SEQ ID NO: 480735 - RNA, 22 nt, Human
uccugcagugugucuccugcac

SEQ ID NO: 480736 - RNA, 22 nt, Human
ucaggggacuuaggagagaagu

SEQ ID NO: 480737 - RNA, 22 nt, Human
cccagcauggagugaggacuca

SEQ ID NO: 480738 - RNA, 22 nt, Human
ucagcaggcgguuccuuguggg

SEQ ID NO: 480739 - RNA, 22 nt, Human
guauuagguuggugcaaaagua

SEQ ID NO: 480740 - RNA, 22 nt, Human
ucugccuugagguccucagcuc

SEQ ID NO: 480741 - RNA, 22 nt, Human
gcagacaggcccaguggaggga

SEQ ID NO: 480742 - RNA, 22 nt, Human
gccagagccggcuucacaggau

SEQ ID NO: 480743 - RNA, 22 nt, Human
cagagccaggguugcaccccug

SEQ ID NO: 480744 - RNA, 20 nt, Human
ucucugagcuucucuugggg

SEQ ID NO: 480745 - RNA, 22 nt, Human
aucaggauuacacggggaugcu

SEQ ID NO: 480746 - RNA, 22 nt, Human
gcacacagauuaggaaacagaa

SEQ ID NO: 480747 - RNA, 20 nt, Human
gccugagcuauugccaggau

SEQ ID NO: 480748 - RNA, 22 nt, Human
ucuggagagucacagugccaga

SEQ ID NO: 480749 - RNA, 22 nt, Human
guggcaggucccauuggagcag

SEQ ID NO: 480750 - RNA, 22 nt, Human
caguauguacucuuaucaugua

SEQ ID NO: 480751 - RNA, 17 nt, Human
gagauggguggaucacc

SEQ ID NO: 480752 - RNA, 22 nt, Human
aggccugaggaccagauaaaug

SEQ ID NO: 480753 - RNA, 22 nt, Human
gucucuggguuaagcagugcau

SEQ ID NO: 480754 - RNA, 22 nt, Human
uuucucaaggugucauguauuu

SEQ ID NO: 480755 - RNA, 22 nt, Human
cuuucucugugugguaaagggc

SEQ ID NO: 480756 - RNA, 22 nt, Human
ucauuuaauagcuuuugucuuu

SEQ ID NO: 480757 - RNA, 22 nt, Human
uuguggaaauacagacuccaag

SEQ ID NO: 480758 - RNA, 22 nt, Human
cacaccuguaauaccagcuacu

SEQ ID NO: 480759 - RNA, 22 nt, Human
cuagagaggcagauguccugug

SEQ ID NO: 480760 - RNA, 22 nt, Human
ccagcagcuuuauuggcucucc

SEQ ID NO: 480761 - RNA, 22 nt, Human
ggcaccugcucaucuggacuca

SEQ ID NO: 480762 - RNA, 22 nt, Human
cacugcaguaacucuaggacug

SEQ ID NO: 480763 - RNA, 22 nt, Human
gacaagacagcuugcagacaac

SEQ ID NO: 480764 - RNA, 22 nt, Human
aagacuguacauuuuccagucu

SEQ ID NO: 480765 - RNA, 18 nt, Human
gucacuguguuucugagc

SEQ ID NO: 480766 - RNA, 22 nt, Human
agaaauuccuaagguacacaag

SEQ ID NO: 480767 - RNA, 22 nt, Human
ugguccagaugccuuggcuuua

SEQ ID NO: 480768 - RNA, 23 nt, Human
aaaguugauuugcaguuuaagag

SEQ ID NO: 480769 - RNA, 22 nt, Human
guuuuccauggaggucugaccu

SEQ ID NO: 480770 - RNA, 22 nt, Human
aguuuuuccguggcuacgauaa

SEQ ID NO: 480771 - RNA, 22 nt, Human
cuucauuaaccaaaaugcaaua

SEQ ID NO: 480772 - RNA, 22 nt, Human
acauuucuuccacaugcugcug

SEQ ID NO: 480773 - RNA, 22 nt, Human
gggcugcugcccaggaggcacc

SEQ ID NO: 480774 - RNA, 22 nt, Human
ucucaggguuuguacaagugua

SEQ ID NO: 480775 - RNA, 22 nt, Human
agggcuccaggggaccaucagu

SEQ ID NO: 480776 - RNA, 22 nt, Human
cagguggcaugacugccuacaa

SEQ ID NO: 480777 - RNA, 22 nt, Human
ucucagagugguggucccucug

SEQ ID NO: 480778 - RNA, 19 nt, Human
ggcugccuggagcgagggc

SEQ ID NO: 480779 - RNA, 22 nt, Human
gcucccacaaccuucuugcucc

SEQ ID NO: 480780 - RNA, 22 nt, Human
cagcuucuggcguggagccuga

SEQ ID NO: 480781 - RNA, 22 nt, Human
acaggcagggaccuuggcuaag

SEQ ID NO: 480782 - RNA, 22 nt, Human
uuccuauuuccaugaaacacaa

SEQ ID NO: 480783 - RNA, 22 nt, Human
aaaaaugaaacggcugguuggc

SEQ ID NO: 480784 - RNA, 19 nt, Human
ucugaggguccagaugcau

SEQ ID NO: 480785 - RNA, 22 nt, Human
cacaguccagacuccuggaguu

SEQ ID NO: 480786 - RNA, 21 nt, Human
gcagaugggagucaucaggcu

SEQ ID NO: 480787 - RNA, 22 nt, Human
cguagguggcucagcaccuggg

SEQ ID NO: 480788 - RNA, 22 nt, Human
ugucacauaggcaaaauguuuu

SEQ ID NO: 480789 - RNA, 22 nt, Human
cauuauggcagccaggauauug

SEQ ID NO: 480790 - RNA, 22 nt, Human
uuuuuccuuagggguuacucac

SEQ ID NO: 480791 - RNA, 22 nt, Human
uggagcagcaucacuuugagcu

SEQ ID NO: 480792 - RNA, 18 nt, Human
cguuuuuccgggauugca

SEQ ID NO: 480793 - RNA, 22 nt, Human
ucucugagguuguuuccagcac

SEQ ID NO: 480794 - RNA, 22 nt, Human
uccagggacagcgcuggagcua

SEQ ID NO: 480795 - RNA, 22 nt, Human
cauuuucagcacccaucugaaa

SEQ ID NO: 480796 - RNA, 22 nt, Human
gcccagugguaaaagcaggccu

SEQ ID NO: 480797 - RNA, 22 nt, Human
ccagaggugccacagaaagagc

SEQ ID NO: 480798 - RNA, 22 nt, Human
ccugucugcaugaucccugcca

SEQ ID NO: 480799 - RNA, 22 nt, Human
gcucaaagaauauucagaauga

SEQ ID NO: 480800 - RNA, 22 nt, Human
cagccagggucaggcagcuucu

SEQ ID NO: 480801 - RNA, 22 nt, Human
ugaugcugagccugggacugac

SEQ ID NO: 480802 - RNA, 22 nt, Human
ccugagcugaacuaagcaguuu

SEQ ID NO: 480803 - RNA, 22 nt, Human
cauuuucaugaguuucuguuca

SEQ ID NO: 480804 - RNA, 22 nt, Human
ugaagcaggguggccagauugu

SEQ ID NO: 480805 - RNA, 22 nt, Human
agaaaaggcuugaagagguuuu

SEQ ID NO: 480806 - RNA, 22 nt, Human
acauuucucccugcaugccugc

SEQ ID NO: 480807 - RNA, 22 nt, Human
ucauacaucuuguauaucuauc

SEQ ID NO: 480808 - RNA, 22 nt, Human
gggcagagacucagaaacagaa

SEQ ID NO: 480809 - RNA, 22 nt, Human
auuuucaugacuaccuuaaaua

SEQ ID NO: 480810 - RNA, 22 nt, Human
ccagcagagggucuuggccauu

SEQ ID NO: 480811 - RNA, 22 nt, Human
cugccacuagcuuucacaucuu

SEQ ID NO: 480812 - RNA, 22 nt, Human
ucuuuugagggccagaggaaga

SEQ ID NO: 480813 - RNA, 22 nt, Human
gccugccugcugucaucugccu

SEQ ID NO: 480814 - RNA, 22 nt, Human
gaggagaaauuauccuuggugu

SEQ ID NO: 480815 - RNA, 22 nt, Human
gugcucaggaagcuguuccugc

SEQ ID NO: 480816 - RNA, 22 nt, Human
gcacagggcugccaggcggcuu

SEQ ID NO: 480817 - RNA, 22 nt, Human
ugccugucuuggaguccuggcc

SEQ ID NO: 480818 - RNA, 22 nt, Human
uaaaauguagcuucuaggcugg

SEQ ID NO: 480819 - RNA, 21 nt, Human
uuagcaaagcaaacacaugcu

SEQ ID NO: 480820 - RNA, 22 nt, Human
uccccagccgugaaggagagga

SEQ ID NO: 480821 - RNA, 22 nt, Human
gaagaagcaggaguguguagca

SEQ ID NO: 480822 - RNA, 22 nt, Human
uccugagaaggcacagcuugca

SEQ ID NO: 480823 - RNA, 22 nt, Human
ugcagggcuccuggcuccaauc

SEQ ID NO: 480824 - RNA, 22 nt, Human
cuucccuuggugaacagagcau

SEQ ID NO: 480825 - RNA, 22 nt, Human
aggagguggccugagcgugccc

SEQ ID NO: 480826 - RNA, 22 nt, Human
ugcagggcuacaggacuacaac

SEQ ID NO: 480827 - RNA, 22 nt, Human
caguaugagaguugaaucaagg

SEQ ID NO: 480828 - RNA, 22 nt, Human
ucaggaguccugccugcagccu

SEQ ID NO: 480829 - RNA, 19 nt, Human
agucucaguguacagaggc

SEQ ID NO: 480830 - RNA, 22 nt, Human
gagggcuccacacgggcccagc

SEQ ID NO: 480831 - RNA, 20 nt, Human
caaugcacacagcugcuucu

SEQ ID NO: 480832 - RNA, 21 nt, Human
uauuugcugccaucuuugagg

SEQ ID NO: 480833 - RNA, 22 nt, Human
gccagggcaggggagcaucugc

SEQ ID NO: 480834 - RNA, 22 nt, Human
gccucugccaagggggcugcgg

SEQ ID NO: 480835 - RNA, 22 nt, Human
uggcucagccauucguguugcc

SEQ ID NO: 480836 - RNA, 22 nt, Human
gaucauuuugaugcccuuuuag

SEQ ID NO: 480837 - RNA, 22 nt, Human
gcuggccugcgagggcaggcug

SEQ ID NO: 480838 - RNA, 22 nt, Human
ggagaggugaauggcugcucua

SEQ ID NO: 480839 - RNA, 22 nt, Human
ugugggcaggcccgggucugag

SEQ ID NO: 480840 - RNA, 20 nt, Human
ugcagggccuaaaaagggaa

SEQ ID NO: 480841 - RNA, 22 nt, Human
ugggggacugcacuggcgucag

SEQ ID NO: 480842 - RNA, 22 nt, Human
ggcaugggguguauguggcacg

SEQ ID NO: 480843 - RNA, 22 nt, Human
cugucauugagccugucagggc

SEQ ID NO: 480844 - RNA, 21 nt, Human
agcagcaucagccucaccuga

SEQ ID NO: 480845 - RNA, 22 nt, Human
cugccaggcacgugcagcauca

SEQ ID NO: 480846 - RNA, 19 nt, Human
gccacuccugaugcugccc

SEQ ID NO: 480847 - RNA, 22 nt, Human
agcccagccggauucccaguuc

SEQ ID NO: 480848 - RNA, 22 nt, Human
guuuuauaggugaaauauuacu

SEQ ID NO: 480849 - RNA, 22 nt, Human
auggcagauggcuggagcaggu

SEQ ID NO: 480850 - RNA, 22 nt, Human
uggaaagaauuccuaugguuca

SEQ ID NO: 480851 - RNA, 22 nt, Human
uugcugaagugaagguauguuu

SEQ ID NO: 480852 - RNA, 17 nt, Human
gcacugaacaauccugu

SEQ ID NO: 480853 - RNA, 22 nt, Human
ggagugggaacaaugacauggu

SEQ ID NO: 480854 - RNA, 22 nt, Human
ccacagagacaggguccuugcu

SEQ ID NO: 480855 - RNA, 22 nt, Human
ggcagggaggaggugaaaguga

SEQ ID NO: 480856 - RNA, 22 nt, Human
gagcugagaucgugccauugca

SEQ ID NO: 480857 - RNA, 22 nt, Human
gcuggcaccugcaccaagcagg

SEQ ID NO: 480858 - RNA, 22 nt, Human
ccuggcuguggcggugcucuca

SEQ ID NO: 480859 - RNA, 22 nt, Human
ccagcuccugggucuuagucag

SEQ ID NO: 480860 - RNA, 22 nt, Human
uccucugcuggaagggcaagag

SEQ ID NO: 480861 - RNA, 22 nt, Human
aggcaguuuaggcagcgauuua

SEQ ID NO: 480862 - RNA, 22 nt, Human
gcacagguugcaaaaguucaca

SEQ ID NO: 480863 - RNA, 22 nt, Human
uuuaauuuuccucuuccuggag

SEQ ID NO: 480864 - RNA, 22 nt, Human
agggcugaugcaccauguagcc

SEQ ID NO: 480865 - RNA, 22 nt, Human
gccggggcuggggagagacaug

SEQ ID NO: 480866 - RNA, 22 nt, Human
ggucauugucagagccuguacu

SEQ ID NO: 480867 - RNA, 22 nt, Human
ugccugggggacuaaggccaaa

SEQ ID NO: 480868 - RNA, 22 nt, Human
uggcugaguucuccaggaguag

SEQ ID NO: 480869 - RNA, 22 nt, Human
accuuaaaacugacacauggag

SEQ ID NO: 480870 - RNA, 22 nt, Human
agcugaagaaaugggaagcauu

SEQ ID NO: 480871 - RNA, 22 nt, Human
aaguggagcuauaggcucagau

SEQ ID NO: 480872 - RNA, 22 nt, Human
cauggccucaaaggacugcaga

SEQ ID NO: 480873 - RNA, 22 nt, Human
aauuagggaaaauuuacuugua

SEQ ID NO: 480874 - RNA, 22 nt, Human
caggaaggcccaccuguccugu

SEQ ID NO: 480875 - RNA, 22 nt, Human
cuguacauaaaggaauaggugu

SEQ ID NO: 480876 - RNA, 22 nt, Human
aaggagaaaugguagaugugca

SEQ ID NO: 480877 - RNA, 21 nt, Human
agggaaagaaaaugagcuaau

SEQ ID NO: 480878 - RNA, 22 nt, Human
aaguuaugaaauuuggacagcu

SEQ ID NO: 480879 - RNA, 22 nt, Human
caggaugggugucggccagcac

SEQ ID NO: 480880 - RNA, 22 nt, Human
ucuuagaaugucaacugauguu

SEQ ID NO: 480881 - RNA, 23 nt, Human
acagccaguucaccucuccuugg

SEQ ID NO: 480882 - RNA, 22 nt, Human
ccacagaguuacaaaacaguca

SEQ ID NO: 480883 - RNA, 22 nt, Human
acccucaacaaauucacucuau

SEQ ID NO: 480884 - RNA, 22 nt, Human
agagugauucuaguuagggaau

SEQ ID NO: 480885 - RNA, 22 nt, Human
ggaggccagggacccagucagc

SEQ ID NO: 480886 - RNA, 22 nt, Human
aaggccaggacaccaggggacu

SEQ ID NO: 480887 - RNA, 17 nt, Human
uggcaagaauggaaaug

SEQ ID NO: 480888 - RNA, 22 nt, Human
cugcaagauuggaagaugcaau

SEQ ID NO: 480889 - RNA, 22 nt, Human
cuggcagcauggagccugugcu

SEQ ID NO: 480890 - RNA, 22 nt, Human
gccuggguuccaugaucuccag

SEQ ID NO: 480891 - RNA, 22 nt, Human
caggggcuguuugccucaggcc

SEQ ID NO: 480892 - RNA, 22 nt, Human
cagagcagggugcaccuugggc

SEQ ID NO: 480893 - RNA, 22 nt, Human
agcuguguggugucugacagcu

SEQ ID NO: 480894 - RNA, 22 nt, Human
ccuuuuucccuggagggacagc

SEQ ID NO: 480895 - RNA, 22 nt, Human
uuguccuuggaugaagcuggga

SEQ ID NO: 480896 - RNA, 22 nt, Human
ucagagugaccuuacauggucu

SEQ ID NO: 480897 - RNA, 22 nt, Human
cuuaaauucuuaaugcccucau

SEQ ID NO: 480898 - RNA, 22 nt, Human
ugcuggaggccugacuguguuu

SEQ ID NO: 480899 - RNA, 22 nt, Human
aucagagaaauggagggcgcuu

SEQ ID NO: 480900 - RNA, 22 nt, Human
uccaggcaugucccaagccgga

SEQ ID NO: 480901 - RNA, 22 nt, Human
auuuuucucuuuccacugagau

SEQ ID NO: 480902 - RNA, 22 nt, Human
cagagcagguaucuuuggugaa

SEQ ID NO: 480903 - RNA, 22 nt, Human
acagaggucauggagaguucuc

SEQ ID NO: 480904 - RNA, 22 nt, Human
gccaguggcccucuggagaagg

SEQ ID NO: 480905 - RNA, 22 nt, Human
ugccugcugcuaagcucuuugu

SEQ ID NO: 480906 - RNA, 22 nt, Human
ugucuuuauauauuuggaaaau

SEQ ID NO: 480907 - RNA, 22 nt, Human
gcagggaccuugcccacccucc

SEQ ID NO: 480908 - RNA, 22 nt, Human
uguaugcuuuccaaaaaugcug

SEQ ID NO: 480909 - RNA, 22 nt, Human
accugcaggggugcucucuggg

SEQ ID NO: 480910 - RNA, 22 nt, Human
aaaaagauguccugaaguuuag

SEQ ID NO: 480911 - RNA, 22 nt, Human
ugauuuccacgugcacccaggu

SEQ ID NO: 480912 - RNA, 19 nt, Human
ucaggaguuaguugugcuc

SEQ ID NO: 480913 - RNA, 22 nt, Human
uaugaguacaaggacucugucu

SEQ ID NO: 480914 - RNA, 22 nt, Human
agggacacaugugauuauuuau

SEQ ID NO: 480915 - RNA, 22 nt, Human
gaugaagccugacuucucggug

SEQ ID NO: 480916 - RNA, 22 nt, Human
ucagagccccuccgcuguccca

SEQ ID NO: 480917 - RNA, 22 nt, Human
ggcuucagugagcugagcucac

SEQ ID NO: 480918 - RNA, 22 nt, Human
ugucacuucaggaaugcaggga

SEQ ID NO: 480919 - RNA, 22 nt, Human
ugaaaguugcacauaagagaau

SEQ ID NO: 480920 - RNA, 22 nt, Human
uucaagaugacccagucacacg

SEQ ID NO: 480921 - RNA, 22 nt, Human
uggugguuaugcgcuuuguggg

SEQ ID NO: 480922 - RNA, 20 nt, Human
caucaucacaugagccaauu

SEQ ID NO: 480923 - RNA, 22 nt, Human
aagcaaaagguuacacuucugg

SEQ ID NO: 480924 - RNA, 22 nt, Human
gcagugugaccgagcuugcuuc

SEQ ID NO: 480925 - RNA, 22 nt, Human
ccagcagaggggcggagugcag

SEQ ID NO: 480926 - RNA, 22 nt, Human
ucaagucuggagaucuggaacu

SEQ ID NO: 480927 - RNA, 22 nt, Human
aucaguuuuuauuaauguagcu

SEQ ID NO: 480928 - RNA, 22 nt, Human
uguggcagcuggagguggagaa

SEQ ID NO: 480929 - RNA, 22 nt, Human
agccuggcacugccccauccau

SEQ ID NO: 480930 - RNA, 19 nt, Human
gaaaggcugcugcuaccug

SEQ ID NO: 480931 - RNA, 22 nt, Human
acucucucacagcuuggcugau

SEQ ID NO: 480932 - RNA, 22 nt, Human
aaaugucuaucuggcauauucc

SEQ ID NO: 480933 - RNA, 22 nt, Human
agcugccucagcaacacagacc

SEQ ID NO: 480934 - RNA, 22 nt, Human
accgggaaguccugcacugggc

SEQ ID NO: 480935 - RNA, 22 nt, Human
uugcugaauugaauccuuuggu

SEQ ID NO: 480936 - RNA, 22 nt, Human
auaauuuacuaagcucuaccuu

SEQ ID NO: 480937 - RNA, 22 nt, Human
ucucccacagucucccauggcu

SEQ ID NO: 480938 - RNA, 22 nt, Human
cuucccagaccuuagagugcag

SEQ ID NO: 480939 - RNA, 22 nt, Human
acagccugcugccugcuucuug

SEQ ID NO: 480940 - RNA, 20 nt, Human
aacacugugcgugguaggug

SEQ ID NO: 480941 - RNA, 22 nt, Human
cccagcccaucucaaaggucua

SEQ ID NO: 480942 - RNA, 22 nt, Human
auuuuaucugcuuacuuucagg

SEQ ID NO: 480943 - RNA, 19 nt, Human
augucuguugaauuucaua

SEQ ID NO: 480944 - RNA, 18 nt, Human
uauauuucacacauauuc

SEQ ID NO: 480945 - RNA, 22 nt, Human
aaaaauaggucaaccguguaug

SEQ ID NO: 480946 - RNA, 20 nt, Human
uucaggauucuagaccacac

SEQ ID NO: 480947 - RNA, 22 nt, Human
gcagggugaaggucacauagaa

SEQ ID NO: 480948 - RNA, 22 nt, Human
caggggcagucugugugcgugg

SEQ ID NO: 480949 - RNA, 17 nt, Human
cugucugcgcaugaggu

SEQ ID NO: 480950 - RNA, 22 nt, Human
aacaugauggggaagaacaaga

SEQ ID NO: 480951 - RNA, 22 nt, Human
cugcugcaggaugggcacucug

SEQ ID NO: 480952 - RNA, 22 nt, Human
guugaaagcuuuucauuuaguu

SEQ ID NO: 480953 - RNA, 22 nt, Human
ugccaggcucaggaugucccug

SEQ ID NO: 480954 - RNA, 22 nt, Human
aaagauuugaguucugcuuaua

SEQ ID NO: 480955 - RNA, 22 nt, Human
ucucaccauggugcuugcuuau

SEQ ID NO: 480956 - RNA, 22 nt, Human
gcaaguacaaacgcaucggcug

SEQ ID NO: 480957 - RNA, 22 nt, Human
gccugagauucugcauuucuaa

SEQ ID NO: 480958 - RNA, 22 nt, Human
ucccacugugccuguuguaauc

SEQ ID NO: 480959 - RNA, 22 nt, Human
ggcagcucaccucugguccagg

SEQ ID NO: 480960 - RNA, 22 nt, Human
accagcagaguugaggaggaca

SEQ ID NO: 480961 - RNA, 22 nt, Human
agggaguguaaauggugcucag

SEQ ID NO: 480962 - RNA, 22 nt, Human
uacauuaucuuguuaucuuuca

SEQ ID NO: 480963 - RNA, 22 nt, Human
gggcuucuagaccagcagugag

SEQ ID NO: 480964 - RNA, 22 nt, Human
ucucagaguuccucuggagucc

SEQ ID NO: 480965 - RNA, 22 nt, Human
gggccugacugagagcuccuca

SEQ ID NO: 480966 - RNA, 22 nt, Human
aaggcugagacagcacaggucc

SEQ ID NO: 480967 - RNA, 22 nt, Human
agcuuuuaguacguuaaaauug

SEQ ID NO: 480968 - RNA, 22 nt, Human
ugaaaaggguagaucccuaagu

SEQ ID NO: 480969 - RNA, 22 nt, Human
aggcugaguuucucauucucgc

SEQ ID NO: 480970 - RNA, 22 nt, Human
ucaggcugcuggccagcaggcu

SEQ ID NO: 480971 - RNA, 22 nt, Human
uggcagagaauaaaucuugacu

SEQ ID NO: 480972 - RNA, 22 nt, Human
auuuauguaucuguguagauca

SEQ ID NO: 480973 - RNA, 22 nt, Human
ccugucagcugauggcuaugua

SEQ ID NO: 480974 - RNA, 21 nt, Human
cugccuugaaugguacuggga

SEQ ID NO: 480975 - RNA, 22 nt, Human
accagggcugacaaucugaugg

SEQ ID NO: 480976 - RNA, 22 nt, Human
cucugggcaaguuucuucauga

SEQ ID NO: 480977 - RNA, 22 nt, Human
ucaguuuucaauuucaucagag

SEQ ID NO: 480978 - RNA, 22 nt, Human
agcagcugaucaaagcacuuau

SEQ ID NO: 480979 - RNA, 22 nt, Human
agcugcucugauaaaccuacuu

SEQ ID NO: 480980 - RNA, 18 nt, Human
aggcuucccaggcaggcc

SEQ ID NO: 480981 - RNA, 22 nt, Human
ucauugcagacuaacaaucuca

SEQ ID NO: 480982 - RNA, 22 nt, Human
ucagcagggaggcucugugccc

SEQ ID NO: 480983 - RNA, 22 nt, Human
uccugggcugugugccacucug

SEQ ID NO: 480984 - RNA, 22 nt, Human
ucuguacauuuggggaccccag

SEQ ID NO: 480985 - RNA, 22 nt, Human
caggcugaucagggcugggaug

SEQ ID NO: 480986 - RNA, 22 nt, Human
cagaggccaccuguggccacug

SEQ ID NO: 480987 - RNA, 22 nt, Human
gagucaguaauggauaugucau

SEQ ID NO: 480988 - RNA, 22 nt, Human
caucacuguccaaaguucaguu

SEQ ID NO: 480989 - RNA, 22 nt, Human
gccugcaguucugugcuaggca

SEQ ID NO: 480990 - RNA, 23 nt, Human
cuugcagggcuggaggcuuagaa

SEQ ID NO: 480991 - RNA, 22 nt, Human
ucugaagaacugaguaaacaug

SEQ ID NO: 480992 - RNA, 22 nt, Human
gacacagggggauguguggacg

SEQ ID NO: 480993 - RNA, 19 nt, Human
cuggggcuuugguacugcc

SEQ ID NO: 480994 - RNA, 22 nt, Human
ggcugcaggcagaggcugucug

SEQ ID NO: 480995 - RNA, 22 nt, Human
uacaguaacauguuguacaagc

SEQ ID NO: 480996 - RNA, 22 nt, Human
uauguguaggaggaggacaggg

SEQ ID NO: 480997 - RNA, 17 nt, Human
guccuacccauggucua

SEQ ID NO: 480998 - RNA, 22 nt, Human
aggcucaggucucaggucuggc

SEQ ID NO: 480999 - RNA, 22 nt, Human
gcuggccuucugcagaguucug

SEQ ID NO: 481000 - RNA, 22 nt, Human
ccaaggcuucccagagaugcuc

SEQ ID NO: 481001 - RNA, 22 nt, Human
gaggagcaugggaaggcucugg

SEQ ID NO: 481002 - RNA, 22 nt, Human
uucucauucugacucaguguag

SEQ ID NO: 481003 - RNA, 22 nt, Human
agaaggcagaugggacggagca

SEQ ID NO: 481004 - RNA, 22 nt, Human
uucacuuaacaucauaucauga

SEQ ID NO: 481005 - RNA, 22 nt, Human
ggucccagcugcucaagaggcu

SEQ ID NO: 481006 - RNA, 22 nt, Human
cugugacuguguuggaugcaca

SEQ ID NO: 481007 - RNA, 22 nt, Human
gggcugugcugaguaggaggug

SEQ ID NO: 481008 - RNA, 22 nt, Human
ccugggugacccgugagcgucc

SEQ ID NO: 481009 - RNA, 21 nt, Human
uuaagagcuuagcaguaggcc

SEQ ID NO: 481010 - RNA, 19 nt, Human
aggagaagacucucucccc

SEQ ID NO: 481011 - RNA, 22 nt, Human
caggaugagguagaggcagaua

SEQ ID NO: 481012 - RNA, 22 nt, Human
aggcccagggcugcucucugaa

SEQ ID NO: 481013 - RNA, 22 nt, Human
gcagcuggacccacacggcuua

SEQ ID NO: 481014 - RNA, 22 nt, Human
ucacaccuguaaucccaggccu

SEQ ID NO: 481015 - RNA, 16 nt, Human
ggcaccagugaacaca

SEQ ID NO: 481016 - RNA, 22 nt, Human
aaacuguaaacacagcaguaca

SEQ ID NO: 481017 - RNA, 22 nt, Human
uggagcaggccggaaguggcuu

SEQ ID NO: 481018 - RNA, 21 nt, Human
gagugcaggucugaugccauc

SEQ ID NO: 481019 - RNA, 22 nt, Human
aaaugcacaggagaaccaauuc

SEQ ID NO: 481020 - RNA, 22 nt, Human
agggacacacuccaguguuauu

SEQ ID NO: 481021 - RNA, 22 nt, Human
ggcuucaccgcgggguugcagg

SEQ ID NO: 481022 - RNA, 22 nt, Human
uggcuccuaucaaggagugggu

SEQ ID NO: 481023 - RNA, 22 nt, Human
ggccuuggggaggauggugucc

SEQ ID NO: 481024 - RNA, 22 nt, Human
gaaaucuuuauggaaauaacaa

SEQ ID NO: 481025 - RNA, 21 nt, Human
agcagaggggacauguuugau

SEQ ID NO: 481026 - RNA, 23 nt, Human
augcaguauaugucaguaguuua

SEQ ID NO: 481027 - RNA, 18 nt, Human
ugugguggagcugccuuc

SEQ ID NO: 481028 - RNA, 22 nt, Human
ugggccuguggcuuggcucuag

SEQ ID NO: 481029 - RNA, 22 nt, Human
ugguuucccauuaucugcagga

SEQ ID NO: 481030 - RNA, 22 nt, Human
gccacacuuauucucaugcaca

SEQ ID NO: 481031 - RNA, 22 nt, Human
caggagccagcugucccaacca

SEQ ID NO: 481032 - RNA, 22 nt, Human
cuccuucccuucaaguguuccu

SEQ ID NO: 481033 - RNA, 22 nt, Human
gagggcugauguugccaccuca

SEQ ID NO: 481034 - RNA, 22 nt, Human
gagcucuguguagccugagggu

SEQ ID NO: 481035 - RNA, 22 nt, Human
gcaccugggguacacagcuaca

SEQ ID NO: 481036 - RNA, 22 nt, Human
agauacauugaguuuccuccug

SEQ ID NO: 481037 - RNA, 22 nt, Human
ugguaauuuacgcauuucugua

SEQ ID NO: 481038 - RNA, 22 nt, Human
ccuuucucauuuuaagcauuag

SEQ ID NO: 481039 - RNA, 22 nt, Human
uccgccaggacugagggcccau

SEQ ID NO: 481040 - RNA, 22 nt, Human
aaggcagaaauucaacuacugg

SEQ ID NO: 481041 - RNA, 22 nt, Human
uguauuuucugaagauaaucaa

SEQ ID NO: 481042 - RNA, 22 nt, Human
acccagcaugacaccugcacau

SEQ ID NO: 481043 - RNA, 22 nt, Human
ucaacagaagugauagcuauua

SEQ ID NO: 481044 - RNA, 22 nt, Human
gcucacagccggcuggcagggg

SEQ ID NO: 481045 - RNA, 22 nt, Human
ugaggcagcccacuuuccuuag

SEQ ID NO: 481046 - RNA, 22 nt, Human
gcugugcagguccccacugccu

SEQ ID NO: 481047 - RNA, 22 nt, Human
ccaggcccugcuccucacacca

SEQ ID NO: 481048 - RNA, 22 nt, Human
aaccauuugccauuaucuuaag

SEQ ID NO: 481049 - RNA, 22 nt, Human
cugccuggaaggagcaagggga

SEQ ID NO: 481050 - RNA, 22 nt, Human
cuggcaggaaguuagaugguaa

SEQ ID NO: 481051 - RNA, 22 nt, Human
auccuugagccuuaucuuuugu

SEQ ID NO: 481052 - RNA, 22 nt, Human
gaggccagcgcgcagcacuuuu

SEQ ID NO: 481053 - RNA, 22 nt, Human
uuccuggugguggugacagcac

SEQ ID NO: 481054 - RNA, 17 nt, Human
ucaggcugggugcagug

SEQ ID NO: 481055 - RNA, 22 nt, Human
uggagcugaacuuugaggccag

SEQ ID NO: 481056 - RNA, 22 nt, Human
uaugcacaguuacaagaauauc

SEQ ID NO: 481057 - RNA, 22 nt, Human
cugcacagagcagggcagacac

SEQ ID NO: 481058 - RNA, 22 nt, Human
ucuggcuccacucugugcaugc

SEQ ID NO: 481059 - RNA, 22 nt, Human
caggaggcaguuucagaaguca

SEQ ID NO: 481060 - RNA, 22 nt, Human
cccagccugucuuucccaauga

SEQ ID NO: 481061 - RNA, 22 nt, Human
agaaugcaagauaaacuuuauu

SEQ ID NO: 481062 - RNA, 22 nt, Human
cccagcucucucaguucugcuu

SEQ ID NO: 481063 - RNA, 22 nt, Human
gggggucccaagcugggcugcu

SEQ ID NO: 481064 - RNA, 22 nt, Human
uaaagguagugugacauauugu

SEQ ID NO: 481065 - RNA, 22 nt, Human
ucaccuuagcuagaggaagaga

SEQ ID NO: 481066 - RNA, 22 nt, Human
gcuaccugagcaagagcuucaa

SEQ ID NO: 481067 - RNA, 22 nt, Human
cagcagagguuggaacaguucu

SEQ ID NO: 481068 - RNA, 22 nt, Human
uaagacaauucuucagucacaa

SEQ ID NO: 481069 - RNA, 22 nt, Human
gcauuuguguucuuccuagagc

SEQ ID NO: 481070 - RNA, 22 nt, Human
cagagccagcaguggggacagg

SEQ ID NO: 481071 - RNA, 22 nt, Human
uuccaguugguagaauguaagg

SEQ ID NO: 481072 - RNA, 22 nt, Human
auucuggccuuggcucugucac

SEQ ID NO: 481073 - RNA, 22 nt, Human
cucaggaucgcuugcccuaggg

SEQ ID NO: 481074 - RNA, 22 nt, Human
aggcagaaaauagucauccaaa

SEQ ID NO: 481075 - RNA, 22 nt, Human
cacagcuucccaaaguggaccu

SEQ ID NO: 481076 - RNA, 22 nt, Human
ccagggcaucacauccaguguu

SEQ ID NO: 481077 - RNA, 22 nt, Human
ucuggcucuguguccucaccca

SEQ ID NO: 481078 - RNA, 18 nt, Human
ccagcaugccagaggcug

SEQ ID NO: 481079 - RNA, 22 nt, Human
uggagggcaugcuguccauggg

SEQ ID NO: 481080 - RNA, 22 nt, Human
agggccugcaucaggagcuugg

SEQ ID NO: 481081 - RNA, 22 nt, Human
cuuauguaaacuacagauaaua

SEQ ID NO: 481082 - RNA, 22 nt, Human
ugaggaggucagagucuggcug

SEQ ID NO: 481083 - RNA, 22 nt, Human
cuguagccagaagcagaaggcc

SEQ ID NO: 481084 - RNA, 22 nt, Human
agucuucucauuucacaugcuu

SEQ ID NO: 481085 - RNA, 22 nt, Human
ccugguguugugaaguagccgu

SEQ ID NO: 481086 - RNA, 22 nt, Human
ucagcuuuccuugcuuuagauu

SEQ ID NO: 481087 - RNA, 22 nt, Human
guggcagagguuccucagugug

SEQ ID NO: 481088 - RNA, 22 nt, Human
uaugaagauauaucugaucucu

SEQ ID NO: 481089 - RNA, 22 nt, Human
gcuuugcauuguuuaaucagga

SEQ ID NO: 481090 - RNA, 22 nt, Human
cugugaauuaaguauuguuauc

SEQ ID NO: 481091 - RNA, 22 nt, Human
cucuuccucucaugcggucaua

SEQ ID NO: 481092 - RNA, 22 nt, Human
aggccagcuguuacuagagcca

SEQ ID NO: 481093 - RNA, 22 nt, Human
ucaaagucuaucuguaauuacu

SEQ ID NO: 481094 - RNA, 22 nt, Human
ccacuugugaaauaaucaaaua

SEQ ID NO: 481095 - RNA, 22 nt, Human
ucugaagggcugaguggaggag

SEQ ID NO: 481096 - RNA, 22 nt, Human
cagagugaaaacugagcucaaa

SEQ ID NO: 481097 - RNA, 22 nt, Human
auccugggaagcugacauugaa

SEQ ID NO: 481098 - RNA, 22 nt, Human
auucagugugagguuuucaagu

SEQ ID NO: 481099 - RNA, 22 nt, Human
cccuggguucuggcugggcugc

SEQ ID NO: 481100 - RNA, 22 nt, Human
gaggcugggaaguccaagacca

SEQ ID NO: 481101 - RNA, 20 nt, Human
ugggagcuggugaggucuca

SEQ ID NO: 481102 - RNA, 17 nt, Human
aucuggaagcuagcuga

SEQ ID NO: 481103 - RNA, 22 nt, Human
agagccuguacuuuucugugaa

SEQ ID NO: 481104 - RNA, 22 nt, Human
guuuuuaucuaauagcaguuau

SEQ ID NO: 481105 - RNA, 22 nt, Human
caggaaccuaaugaaggcucac

SEQ ID NO: 481106 - RNA, 22 nt, Human
aauuucaauuacuuuugcacca

SEQ ID NO: 481107 - RNA, 22 nt, Human
gcuggagccuucugcucuguug

SEQ ID NO: 481108 - RNA, 22 nt, Human
gaaaggugccccauaggcagga

SEQ ID NO: 481109 - RNA, 22 nt, Human
ggccucugcccucacuccuguc

SEQ ID NO: 481110 - RNA, 22 nt, Human
gaggcucaguuaugucaucagg

SEQ ID NO: 481111 - RNA, 22 nt, Human
agguauuauuagcaucucuauu

SEQ ID NO: 481112 - RNA, 22 nt, Human
uccagucaggcugaauucaagg

SEQ ID NO: 481113 - RNA, 22 nt, Human
ugucauaaaacacaagcuguug

SEQ ID NO: 481114 - RNA, 22 nt, Human
auuuaguguguauugcuauuau

SEQ ID NO: 481115 - RNA, 19 nt, Human
uuucaauggcuuagagaaa

SEQ ID NO: 481116 - RNA, 22 nt, Human
ugccacaccaacaucuuucagc

SEQ ID NO: 481117 - RNA, 22 nt, Human
aaguucuaauuuugcauucagg

SEQ ID NO: 481118 - RNA, 22 nt, Human
caaaugcagucccuuuguugcu

SEQ ID NO: 481119 - RNA, 22 nt, Human
acuuaguauuuuucagcuuuga

SEQ ID NO: 481120 - RNA, 22 nt, Human
gcugucugucuucacaucucgc

SEQ ID NO: 481121 - RNA, 22 nt, Human
ucuuuuggaaaugaugugcagg

SEQ ID NO: 481122 - RNA, 22 nt, Human
cucccuggcuuuguccugaggc

SEQ ID NO: 481123 - RNA, 22 nt, Human
gccaguggucacugaggaagaa

SEQ ID NO: 481124 - RNA, 19 nt, Human
cucuggccucuggaugcug

SEQ ID NO: 481125 - RNA, 22 nt, Human
ucuguacaacaaagggaugaga

SEQ ID NO: 481126 - RNA, 22 nt, Human
cagcaugcaaguccagaugugg

SEQ ID NO: 481127 - RNA, 21 nt, Human
cacuggaauuuucugugacau

SEQ ID NO: 481128 - RNA, 22 nt, Human
cagcuuucaucagugacacuca

SEQ ID NO: 481129 - RNA, 22 nt, Human
uggcuggacagugggcagugga

SEQ ID NO: 481130 - RNA, 22 nt, Human
cuguguccugcgucaagccaau

SEQ ID NO: 481131 - RNA, 22 nt, Human
uguccuuuucuuuagugcagcu

SEQ ID NO: 481132 - RNA, 18 nt, Human
agggaucaucacugcagc

SEQ ID NO: 481133 - RNA, 22 nt, Human
uucagagaugacaccugguguu

SEQ ID NO: 481134 - RNA, 19 nt, Human
agccacagaacuugcagga

SEQ ID NO: 481135 - RNA, 20 nt, Human
uacugggcaagcccacagac

SEQ ID NO: 481136 - RNA, 22 nt, Human
ggcuccugauaggagaaugcgg

SEQ ID NO: 481137 - RNA, 22 nt, Human
uccuuuuugguccaaggugacc

SEQ ID NO: 481138 - RNA, 22 nt, Human
gguuccccaggcggcccuugga

SEQ ID NO: 481139 - RNA, 22 nt, Human
ccuggcagucaggggaguccuu

SEQ ID NO: 481140 - RNA, 22 nt, Human
guugaaagaucauguggcugcc

SEQ ID NO: 481141 - RNA, 22 nt, Human
agggagguccaucccugcagag

SEQ ID NO: 481142 - RNA, 22 nt, Human
caguggaggccuugggaccuuu

SEQ ID NO: 481143 - RNA, 22 nt, Human
acaccauacucauguugguucc

SEQ ID NO: 481144 - RNA, 22 nt, Human
uggcugagcugcagcguggcuu

SEQ ID NO: 481145 - RNA, 22 nt, Human
ugaguccacuuuaaaaugucag

SEQ ID NO: 481146 - RNA, 22 nt, Human
acacugaauguuuaagaacuug

SEQ ID NO: 481147 - RNA, 20 nt, Human
gccugagcuccgccuccugu

SEQ ID NO: 481148 - RNA, 22 nt, Human
uuuuucaucugauugauaacuc

SEQ ID NO: 481149 - RNA, 22 nt, Human
gcagcagagcuuuguccuggcu

SEQ ID NO: 481150 - RNA, 22 nt, Human
ugaggcucagagcaccugcucc

SEQ ID NO: 481151 - RNA, 22 nt, Human
ugccugucuccucugcagggug

SEQ ID NO: 481152 - RNA, 19 nt, Human
uucuaccuuacuguaggcu

SEQ ID NO: 481153 - RNA, 22 nt, Human
acucaggaaaaauguagugaua

SEQ ID NO: 481154 - RNA, 23 nt, Human
agcagugaguaaacagauaggau

SEQ ID NO: 481155 - RNA, 22 nt, Human
agcagggcaguuaaaggguccu

SEQ ID NO: 481156 - RNA, 22 nt, Human
agucucaggcagaggaaggcua

SEQ ID NO: 481157 - RNA, 22 nt, Human
cuuaaauuuucaucuacaagaa

SEQ ID NO: 481158 - RNA, 22 nt, Human
gcaugucaugucauguaggaau

SEQ ID NO: 481159 - RNA, 22 nt, Human
uaagaacagauaaaguuucccc

SEQ ID NO: 481160 - RNA, 22 nt, Human
gcucugucuucagcacacagua

SEQ ID NO: 481161 - RNA, 22 nt, Human
ccuccugguccagcaucucuuu

SEQ ID NO: 481162 - RNA, 22 nt, Human
ugaaggcuguuggauggggaag

SEQ ID NO: 481163 - RNA, 20 nt, Human
ugucaugcauuagaugaaga

SEQ ID NO: 481164 - RNA, 19 nt, Human
uggcaucuguaaaauggug

SEQ ID NO: 481165 - RNA, 22 nt, Human
aucaggaugacaacugcugggu

SEQ ID NO: 481166 - RNA, 22 nt, Human
caguuucucucaauaagcaucg

SEQ ID NO: 481167 - RNA, 22 nt, Human
ggcugcugcccaccccugcaug

SEQ ID NO: 481168 - RNA, 19 nt, Human
aaggcagaaguuggauaug

SEQ ID NO: 481169 - RNA, 18 nt, Human
ccagagcuggcuccucgc

SEQ ID NO: 481170 - RNA, 18 nt, Human
ucugucucuguccuugcu

SEQ ID NO: 481171 - RNA, 20 nt, Human
auguagaugaaagcaaaggc

SEQ ID NO: 481172 - RNA, 22 nt, Human
gauuucaaagguucugcaugcc

SEQ ID NO: 481173 - RNA, 22 nt, Human
uaggugucugcucuuauuuaac

SEQ ID NO: 481174 - RNA, 22 nt, Human
cugcuguggaugcaggaccuca

SEQ ID NO: 481175 - RNA, 22 nt, Human
acaggggcuccgaaggugaggg

SEQ ID NO: 481176 - RNA, 22 nt, Human
gcaggggaguggaugauggauu

SEQ ID NO: 481177 - RNA, 22 nt, Human
cuucucuucccagggacacagg

SEQ ID NO: 481178 - RNA, 22 nt, Human
uuguauauauucuuaaagaugu

SEQ ID NO: 481179 - RNA, 22 nt, Human
gcugcaggggggucuggacuug

SEQ ID NO: 481180 - RNA, 22 nt, Human
caauuucuuguuaauucucagg

SEQ ID NO: 481181 - RNA, 20 nt, Human
gggguuggcuggcacaggga

SEQ ID NO: 481182 - RNA, 19 nt, Human
acaagggcaggcaagguga

SEQ ID NO: 481183 - RNA, 22 nt, Human
gcaggaaagguugagacuuugc

SEQ ID NO: 481184 - RNA, 22 nt, Human
uaaggccaggcuguggucggca

SEQ ID NO: 481185 - RNA, 22 nt, Human
uggagcagagaugggagcccaa

SEQ ID NO: 481186 - RNA, 22 nt, Human
gcugucuguucgagcguguguu

SEQ ID NO: 481187 - RNA, 22 nt, Human
cuacugaguccuucagcugcca

SEQ ID NO: 481188 - RNA, 22 nt, Human
ccugccugggcucacuugccag

SEQ ID NO: 481189 - RNA, 22 nt, Human
gggcugcugcugccagcgacac

SEQ ID NO: 481190 - RNA, 22 nt, Human
aagccagguguuuaggccagcg

SEQ ID NO: 481191 - RNA, 22 nt, Human
uuuauuauucucuggagaaugu

SEQ ID NO: 481192 - RNA, 18 nt, Human
acacacacaccuguguau

SEQ ID NO: 481193 - RNA, 22 nt, Human
aaaguuagaaugauaucaacga

SEQ ID NO: 481194 - RNA, 22 nt, Human
uugugguuaaccgcacauuuuu

SEQ ID NO: 481195 - RNA, 22 nt, Human
ggcagaggaagcuggaaguggg

SEQ ID NO: 481196 - RNA, 22 nt, Human
agcaugaaaggcgugccaacuu

SEQ ID NO: 481197 - RNA, 22 nt, Human
auauauuuacucuccuguugca

SEQ ID NO: 481198 - RNA, 22 nt, Human
ggcugcuggaagacugaacaag

SEQ ID NO: 481199 - RNA, 22 nt, Human
agugggcagugcgcucggaugc

SEQ ID NO: 481200 - RNA, 22 nt, Human
uaaauguauaggcacuaaaccu

SEQ ID NO: 481201 - RNA, 20 nt, Human
agagccuggaaaaagacauc

SEQ ID NO: 481202 - RNA, 22 nt, Human
agaaagcacucugucuuuuacc

SEQ ID NO: 481203 - RNA, 22 nt, Human
uuaaaaccaucagcuguaagau

SEQ ID NO: 481204 - RNA, 22 nt, Human
auuugucuuuggaccugugaga

SEQ ID NO: 481205 - RNA, 22 nt, Human
caagagcugaggcuggagaggu

SEQ ID NO: 481206 - RNA, 22 nt, Human
gaagucugcugcucaggaguuu

SEQ ID NO: 481207 - RNA, 22 nt, Human
uccagcagaaaagagguaggga

SEQ ID NO: 481208 - RNA, 22 nt, Human
gcagaaggauccgcaggugcaa

SEQ ID NO: 481209 - RNA, 23 nt, Human
aaauuauugcucuucaauugccu

SEQ ID NO: 481210 - RNA, 22 nt, Human
agagcccucuucacugccccuu

SEQ ID NO: 481211 - RNA, 22 nt, Human
gacccaggguuucugcacaggg

SEQ ID NO: 481212 - RNA, 22 nt, Human
ugcaauaacuacuuuaauguug

SEQ ID NO: 481213 - RNA, 22 nt, Human
agccagccaguucacuaggaaa

SEQ ID NO: 481214 - RNA, 22 nt, Human
caggccugauacacugaacucu

SEQ ID NO: 481215 - RNA, 22 nt, Human
gccuggugaaaggcagagagcg

SEQ ID NO: 481216 - RNA, 22 nt, Human
ccagacuguggaguuccuggug

SEQ ID NO: 481217 - RNA, 23 nt, Human
uuacaguaggaguuggaaaacca

SEQ ID NO: 481218 - RNA, 15 nt, Human
uccaggcauucauuc

SEQ ID NO: 481219 - RNA, 22 nt, Human
ccuauugacaauucucuucucc

SEQ ID NO: 481220 - RNA, 22 nt, Human
agcuucuguucaucuuccaggc

SEQ ID NO: 481221 - RNA, 22 nt, Human
aaggcaguaaaaucuaccuugc

SEQ ID NO: 481222 - RNA, 16 nt, Human
gagccaggugccuuga

SEQ ID NO: 481223 - RNA, 19 nt, Human
ugggccugcaucugggucu

SEQ ID NO: 481224 - RNA, 22 nt, Human
agccaggauggucucgaucggc

SEQ ID NO: 481225 - RNA, 22 nt, Human
gccaggcaguucaaguacacca

SEQ ID NO: 481226 - RNA, 21 nt, Human
ggcagugaugugaagugcauc

SEQ ID NO: 481227 - RNA, 22 nt, Human
acaggcacugucaagucaugaa

SEQ ID NO: 481228 - RNA, 22 nt, Human
cagagacaguuucacagggucu

SEQ ID NO: 481229 - RNA, 19 nt, Human
agcagccauagacaauaug

SEQ ID NO: 481230 - RNA, 22 nt, Human
agaugagggguagaaaggacuu

SEQ ID NO: 481231 - RNA, 22 nt, Human
agagaugucgccuugcccaggg

SEQ ID NO: 481232 - RNA, 22 nt, Human
ucccagagccaagcuauggaug

SEQ ID NO: 481233 - RNA, 22 nt, Human
gggccucugugcagaggggccu

SEQ ID NO: 481234 - RNA, 22 nt, Human
ggccucugccccagccacaccu

SEQ ID NO: 481235 - RNA, 22 nt, Human
agugaaaugauaguguaaauac

SEQ ID NO: 481236 - RNA, 20 nt, Human
caggccucugggggcccugg

SEQ ID NO: 481237 - RNA, 22 nt, Human
ggcugccagugagugcagaccg

SEQ ID NO: 481238 - RNA, 22 nt, Human
uagcuaucuguguccagaucca

SEQ ID NO: 481239 - RNA, 22 nt, Human
cccaaggcauggcaugguggca

SEQ ID NO: 481240 - RNA, 22 nt, Human
agucucugagguucagaugccu

SEQ ID NO: 481241 - RNA, 22 nt, Human
cagaguaaggagcugucaaacg

SEQ ID NO: 481242 - RNA, 22 nt, Human
uugaaaggugaacaugaugcac

SEQ ID NO: 481243 - RNA, 22 nt, Human
gaaaucugcccagugcacuggu

SEQ ID NO: 481244 - RNA, 22 nt, Human
agauuuagugguggaauuuugg

SEQ ID NO: 481245 - RNA, 22 nt, Human
uuuccuaugauauucuaugugu

SEQ ID NO: 481246 - RNA, 22 nt, Human
auugaaaguccuaucuaaggga

SEQ ID NO: 481247 - RNA, 22 nt, Human
cgcagcagccccgugguaggug

SEQ ID NO: 481248 - RNA, 22 nt, Human
cagggagaagucuggucagucc

SEQ ID NO: 481249 - RNA, 22 nt, Human
gggcugacgaaggccaugugug

SEQ ID NO: 481250 - RNA, 22 nt, Human
gccugggagagggauagugcag

SEQ ID NO: 481251 - RNA, 22 nt, Human
ugcuaucucuauauccauuuau

SEQ ID NO: 481252 - RNA, 22 nt, Human
agggaccucuucuugcagcuga

SEQ ID NO: 481253 - RNA, 22 nt, Human
uuugcuuguucaagauuucugu

SEQ ID NO: 481254 - RNA, 22 nt, Human
aauugugcuaugauuaugaaag

SEQ ID NO: 481255 - RNA, 22 nt, Human
uuuugcuuuuguaacacagugu

SEQ ID NO: 481256 - RNA, 22 nt, Human
uagaaaucagguuuuuagaaag

SEQ ID NO: 481257 - RNA, 22 nt, Human
ggaggccaguccuggccgggcu

SEQ ID NO: 481258 - RNA, 22 nt, Human
gugaaggacuagcauggagggc

SEQ ID NO: 481259 - RNA, 22 nt, Human
ucuucagagugaaagucuguga

SEQ ID NO: 481260 - RNA, 22 nt, Human
gcugggaggaucucucccuguc

SEQ ID NO: 481261 - RNA, 22 nt, Human
aagucagagcaacugagacauu

SEQ ID NO: 481262 - RNA, 22 nt, Human
gaggaggcacuaguuagugaca

SEQ ID NO: 481263 - RNA, 22 nt, Human
ugaggccaggaucccaggcucu

SEQ ID NO: 481264 - RNA, 22 nt, Human
acagagcacugcccugugccgc

SEQ ID NO: 481265 - RNA, 22 nt, Human
aaguggagagcccuggaggucu

SEQ ID NO: 481266 - RNA, 22 nt, Human
guuauuuuaucucugagagguu

SEQ ID NO: 481267 - RNA, 21 nt, Human
gaacauuuggguuguuucuac

SEQ ID NO: 481268 - RNA, 22 nt, Human
cuggaggcacccuuagagaggc

SEQ ID NO: 481269 - RNA, 22 nt, Human
aaguuauuuccucgugacugaa

SEQ ID NO: 481270 - RNA, 22 nt, Human
cuggcugccacuucagggucuu

SEQ ID NO: 481271 - RNA, 22 nt, Human
agauacaucuugaacuucuaga

SEQ ID NO: 481272 - RNA, 22 nt, Human
gguuuauuaaugugaacuguau

SEQ ID NO: 481273 - RNA, 22 nt, Human
cugccucuugacagaucguggc

SEQ ID NO: 481274 - RNA, 22 nt, Human
cccuggagcuagucugagcaga

SEQ ID NO: 481275 - RNA, 22 nt, Human
agcugagccagcagcaacagga

SEQ ID NO: 481276 - RNA, 19 nt, Human
gcagcugugggaagagcca

SEQ ID NO: 481277 - RNA, 22 nt, Human
ccccaggacacauggaccaagu

SEQ ID NO: 481278 - RNA, 22 nt, Human
agccugugugcuuuggacaggg

SEQ ID NO: 481279 - RNA, 22 nt, Human
cagggcuagugacaccccaguc

SEQ ID NO: 481280 - RNA, 22 nt, Human
cucugcagaggcccaaggcuga

SEQ ID NO: 481281 - RNA, 22 nt, Human
guguuuccucacuucucugacu

SEQ ID NO: 481282 - RNA, 22 nt, Human
uccucacauggugagccacaca

SEQ ID NO: 481283 - RNA, 22 nt, Human
ccugugcauccgguggucauug

SEQ ID NO: 481284 - RNA, 19 nt, Human
ugcucaggccaaggagccc

SEQ ID NO: 481285 - RNA, 22 nt, Human
gccaggcacaguucuaggugcu

SEQ ID NO: 481286 - RNA, 22 nt, Human
gcaaugauauugaagugaugaa

SEQ ID NO: 481287 - RNA, 22 nt, Human
uggcuggcuagugggcaggauu

SEQ ID NO: 481288 - RNA, 22 nt, Human
cugaaugucgaucagcuugggu

SEQ ID NO: 481289 - RNA, 22 nt, Human
agagccugugggagaugcagcu

SEQ ID NO: 481290 - RNA, 19 nt, Human
agacaaguuuccagaagcc

SEQ ID NO: 481291 - RNA, 22 nt, Human
acucacauuucaucaggccaag

SEQ ID NO: 481292 - RNA, 22 nt, Human
acaguuucuccauuuacaccuu

SEQ ID NO: 481293 - RNA, 22 nt, Human
uucaggauaguggugaguggca

SEQ ID NO: 481294 - RNA, 22 nt, Human
ccucccucuguuagagcugucu

SEQ ID NO: 481295 - RNA, 22 nt, Human
agccuggaggaggaguugagca

SEQ ID NO: 481296 - RNA, 22 nt, Human
cugcuucuaagaaccugcagcu

SEQ ID NO: 481297 - RNA, 22 nt, Human
ugaggcagggaguuuaauuguc

SEQ ID NO: 481298 - RNA, 22 nt, Human
ccucacucugcacccugcagca

SEQ ID NO: 481299 - RNA, 22 nt, Human
ccugggagguggagguugcagu

SEQ ID NO: 481300 - RNA, 22 nt, Human
cuacaggucaguaagaccuaga

SEQ ID NO: 481301 - RNA, 22 nt, Human
ccugggagggcaagugcugaug

SEQ ID NO: 481302 - RNA, 22 nt, Human
gaggaaaauggaguguaauuaa

SEQ ID NO: 481303 - RNA, 22 nt, Human
cuaaaauuaccuaccaguuuag

SEQ ID NO: 481304 - RNA, 22 nt, Human
ggucucugacuuagagauggau

SEQ ID NO: 481305 - RNA, 22 nt, Human
gccuggcaggccuguuggggcu

SEQ ID NO: 481306 - RNA, 22 nt, Human
cuuuucaugagucuguuauggg

SEQ ID NO: 481307 - RNA, 18 nt, Human
uggcucuggacuugcucc

SEQ ID NO: 481308 - RNA, 22 nt, Human
ggcagcucugugucugggaagc

SEQ ID NO: 481309 - RNA, 22 nt, Human
ccuuucucuggcagcaggacag

SEQ ID NO: 481310 - RNA, 22 nt, Human
accagaguaauguguggaaauu

SEQ ID NO: 481311 - RNA, 22 nt, Human
aggcugaggcagguggaucauu

SEQ ID NO: 481312 - RNA, 22 nt, Human
gaagagcugcucagaacaugau

SEQ ID NO: 481313 - RNA, 17 nt, Human
aggcuggcucacaggga

SEQ ID NO: 481314 - RNA, 22 nt, Human
ugcuuucaaaggcuuucuagau

SEQ ID NO: 481315 - RNA, 23 nt, Human
agcaauaagaagggauacaugug

SEQ ID NO: 481316 - RNA, 22 nt, Human
uugggaaggcguggaagcagaa

SEQ ID NO: 481317 - RNA, 22 nt, Human
ugcugucugcaacaguacuaca

SEQ ID NO: 481318 - RNA, 22 nt, Human
cugggccugguagggcuugaaa

SEQ ID NO: 481319 - RNA, 22 nt, Human
uucacagaugccugaugugugg

SEQ ID NO: 481320 - RNA, 22 nt, Human
cugggccuagcaacagaggagu

SEQ ID NO: 481321 - RNA, 22 nt, Human
guacauuuuacuuuguuugaau

SEQ ID NO: 481322 - RNA, 23 nt, Human
uuauuuugucagaagggacuuuu

SEQ ID NO: 481323 - RNA, 22 nt, Human
caccugagugucaguauucuca

SEQ ID NO: 481324 - RNA, 22 nt, Human
gggcacugugcuaggugcugag

SEQ ID NO: 481325 - RNA, 22 nt, Human
acugugugaaacaucaaugugu

SEQ ID NO: 481326 - RNA, 22 nt, Human
cugccugugcaugcagucagaa

SEQ ID NO: 481327 - RNA, 22 nt, Human
uucaauucaauucuaaauauau

SEQ ID NO: 481328 - RNA, 18 nt, Human
gucaccuggaucagauua

SEQ ID NO: 481329 - RNA, 22 nt, Human
aggcaguguguagcuggaagag

SEQ ID NO: 481330 - RNA, 22 nt, Human
uucauucccuuauauuagcauu

SEQ ID NO: 481331 - RNA, 22 nt, Human
agggcagccucucagccuaggu

SEQ ID NO: 481332 - RNA, 19 nt, Human
uccucaggggcucacagac

SEQ ID NO: 481333 - RNA, 22 nt, Human
agguuuauguuuggugcaggag

SEQ ID NO: 481334 - RNA, 22 nt, Human
aggcaggagugacccugacagg

SEQ ID NO: 481335 - RNA, 19 nt, Human
uccauaagcuuguguucau

SEQ ID NO: 481336 - RNA, 22 nt, Human
agugugagcccuggaguggugc

SEQ ID NO: 481337 - RNA, 22 nt, Human
ccaggccuucugaggacacucu

SEQ ID NO: 481338 - RNA, 19 nt, Human
cuuuucaucaacagccaau

SEQ ID NO: 481339 - RNA, 22 nt, Human
ucagcugccccaguggccccag

SEQ ID NO: 481340 - RNA, 22 nt, Human
gucccugggaugcccuucuggg

SEQ ID NO: 481341 - RNA, 20 nt, Human
gauuucaaagcagaguggcc

SEQ ID NO: 481342 - RNA, 17 nt, Human
cagucgaggaggaccug

SEQ ID NO: 481343 - RNA, 22 nt, Human
ggcucuggcaaggggaggcuac

SEQ ID NO: 481344 - RNA, 20 nt, Human
agcaggaaugaugcuuucau

SEQ ID NO: 481345 - RNA, 22 nt, Human
ucucugaaggggagcuguuuaa

SEQ ID NO: 481346 - RNA, 22 nt, Human
uucacaggaauguaggggucuu

SEQ ID NO: 481347 - RNA, 22 nt, Human
agcagggcucugccaugggccc

SEQ ID NO: 481348 - RNA, 22 nt, Human
acccagagcugggcuuggcaaa

SEQ ID NO: 481349 - RNA, 22 nt, Human
agggccucuaccauccaagguu

SEQ ID NO: 481350 - RNA, 22 nt, Human
uggaagggggaagacagcucug

SEQ ID NO: 481351 - RNA, 22 nt, Human
uugcauuguaggauguuagaag

SEQ ID NO: 481352 - RNA, 22 nt, Human
guuauaaaugacugcaaaaguu

SEQ ID NO: 481353 - RNA, 18 nt, Human
aggcuucuuggcucaguc

SEQ ID NO: 481354 - RNA, 22 nt, Human
uacauguaagacaugagacucu

SEQ ID NO: 481355 - RNA, 19 nt, Human
auaaggcagugacuuuuuu

SEQ ID NO: 481356 - RNA, 22 nt, Human
ugcuuuauggagcccaucucau

SEQ ID NO: 481357 - RNA, 22 nt, Human
gcacagggccuggcacauaaga

SEQ ID NO: 481358 - RNA, 19 nt, Human
ugaagcaggcagagaagau

SEQ ID NO: 481359 - RNA, 20 nt, Human
gucagugucuucaguaguga

SEQ ID NO: 481360 - RNA, 19 nt, Human
gagguggguccccgcagcc

SEQ ID NO: 481361 - RNA, 17 nt, Human
gacaggcucagugacga

SEQ ID NO: 481362 - RNA, 22 nt, Human
ccacugucugcaggccucagca

SEQ ID NO: 481363 - RNA, 23 nt, Human
ccucagggucuagcagagagaag

SEQ ID NO: 481364 - RNA, 22 nt, Human
ggccagggggcuucagacucca

SEQ ID NO: 481365 - RNA, 22 nt, Human
ucuggagcuuguuucagauggu

SEQ ID NO: 481366 - RNA, 23 nt, Human
agcuuugugaaagcagacauggg

SEQ ID NO: 481367 - RNA, 20 nt, Human
ugcagagcuggcuggcuccu

SEQ ID NO: 481368 - RNA, 22 nt, Human
gccagggcugugcagguuuguu

SEQ ID NO: 481369 - RNA, 22 nt, Human
ugggcagccaucccagccucuc

SEQ ID NO: 481370 - RNA, 22 nt, Human
gaggcucagagaagucauggua

SEQ ID NO: 481371 - RNA, 22 nt, Human
aacagcaauagcacuauucauu

SEQ ID NO: 481372 - RNA, 22 nt, Human
uugaaaguccuucuugaguuac

SEQ ID NO: 481373 - RNA, 22 nt, Human
ccagcugcgggcaucgagaguu

SEQ ID NO: 481374 - RNA, 22 nt, Human
uuugcauugcagugguuuacag

SEQ ID NO: 481375 - RNA, 19 nt, Human
aggcugugagggaggacuc

SEQ ID NO: 481376 - RNA, 21 nt, Human
acagcagggcuggcaugacag

SEQ ID NO: 481377 - RNA, 22 nt, Human
guguaauugaaauugagaacca

SEQ ID NO: 481378 - RNA, 22 nt, Human
gggcugcacguauucugcucac

SEQ ID NO: 481379 - RNA, 22 nt, Human
guucauuuuacuguaaauagca

SEQ ID NO: 481380 - RNA, 22 nt, Human
gggcagguggcagggucucugg

SEQ ID NO: 481381 - RNA, 22 nt, Human
cauggcaggugcagauucugug

SEQ ID NO: 481382 - RNA, 22 nt, Human
uaaaugcaguacaaauuguucu

SEQ ID NO: 481383 - RNA, 22 nt, Human
gcuguucucuguaacaugcauu

SEQ ID NO: 481384 - RNA, 22 nt, Human
uucaaucauuuuuacauagucc

SEQ ID NO: 481385 - RNA, 22 nt, Human
acagaaagaagguguauuugag

SEQ ID NO: 481386 - RNA, 20 nt, Human
auauguguacguguauacau

SEQ ID NO: 481387 - RNA, 22 nt, Human
cagugcccuuccaggacugcag

SEQ ID NO: 481388 - RNA, 22 nt, Human
uaaggguucagaaugcaguggu

SEQ ID NO: 481389 - RNA, 22 nt, Human
aggcccugaagucggccccuca

SEQ ID NO: 481390 - RNA, 22 nt, Human
gggauggcuuuguggcugacuc

SEQ ID NO: 481391 - RNA, 22 nt, Human
agccuccaucccaugcacaaag

SEQ ID NO: 481392 - RNA, 22 nt, Human
auuucucagugaaaugacaggc

SEQ ID NO: 481393 - RNA, 22 nt, Human
cagagggcucaguccugcugga

SEQ ID NO: 481394 - RNA, 22 nt, Human
ucacugcagacaaccucaguca

SEQ ID NO: 481395 - RNA, 22 nt, Human
guuuucaugucuauugggcaua

SEQ ID NO: 481396 - RNA, 22 nt, Human
agcugccuggagucauuuccug

SEQ ID NO: 481397 - RNA, 22 nt, Human
cugggccaucagaggggcugga

SEQ ID NO: 481398 - RNA, 22 nt, Human
gugccugggguugagcuaugaa

SEQ ID NO: 481399 - RNA, 22 nt, Human
acuuccugggcaugcagagucc

SEQ ID NO: 481400 - RNA, 22 nt, Human
aggucacccguuugacuaucca

SEQ ID NO: 481401 - RNA, 22 nt, Human
ccugggcucaagugauccuccu

SEQ ID NO: 481402 - RNA, 22 nt, Human
accaggcuugaugauuugcuua

SEQ ID NO: 481403 - RNA, 22 nt, Human
aaaaucaguacacuuuauuuug

SEQ ID NO: 481404 - RNA, 22 nt, Human
ggcaggcaggagcgugcuuggg

SEQ ID NO: 481405 - RNA, 22 nt, Human
uguccugggaaugggaugcagu

SEQ ID NO: 481406 - RNA, 22 nt, Human
aauuuagauugauaaacaugga

SEQ ID NO: 481407 - RNA, 22 nt, Human
uucagagagaaaccagugggaa

SEQ ID NO: 481408 - RNA, 22 nt, Human
gaugggggccagggccugcuuu

SEQ ID NO: 481409 - RNA, 22 nt, Human
ucuggcucucauacucgccagu

SEQ ID NO: 481410 - RNA, 22 nt, Human
ccagagccuggcaucugcauaa

SEQ ID NO: 481411 - RNA, 22 nt, Human
caagaaggcuauaugggccagg

SEQ ID NO: 481412 - RNA, 22 nt, Human
gagacagaguuucacucuuguu

SEQ ID NO: 481413 - RNA, 22 nt, Human
guauuugauacaugaaauggug

SEQ ID NO: 481414 - RNA, 22 nt, Human
ugaaaaggaguccuuguuuuca

SEQ ID NO: 481415 - RNA, 22 nt, Human
ggcaaaaaccgcaauaacuucu

SEQ ID NO: 481416 - RNA, 22 nt, Human
uuagccauggacugaauugacu

SEQ ID NO: 481417 - RNA, 22 nt, Human
gcuguucccauguggggcucag

SEQ ID NO: 481418 - RNA, 22 nt, Human
ugucacaaacauacauuauaga

SEQ ID NO: 481419 - RNA, 22 nt, Human
gcuuuuauugucuuuacgacga

SEQ ID NO: 481420 - RNA, 22 nt, Human
uauuaggguaaauuugacaugc

SEQ ID NO: 481421 - RNA, 22 nt, Human
caggccugggcuucggggcuga

SEQ ID NO: 481422 - RNA, 22 nt, Human
gcugugcagauguagggagugg

SEQ ID NO: 481423 - RNA, 21 nt, Human
cugaggcagcacagcuaguca

SEQ ID NO: 481424 - RNA, 22 nt, Human
cuuauuauaaaauccuguuuga

SEQ ID NO: 481425 - RNA, 22 nt, Human
uggcuggcuuguucacugacug

SEQ ID NO: 481426 - RNA, 20 nt, Human
uccaguggccugaaucugga

SEQ ID NO: 481427 - RNA, 23 nt, Human
acaguuauagcugugaauaacau

SEQ ID NO: 481428 - RNA, 22 nt, Human
acucuugucucaacuuuuguau

SEQ ID NO: 481429 - RNA, 21 nt, Human
agaugcugugcuccaggagca

SEQ ID NO: 481430 - RNA, 22 nt, Human
ucaaaugcuucuacuccuaaga

SEQ ID NO: 481431 - RNA, 22 nt, Human
guaggaagcucugaggcuaguu

SEQ ID NO: 481432 - RNA, 22 nt, Human
cuggccagcauuuuugcuuuag

SEQ ID NO: 481433 - RNA, 22 nt, Human
acuggaagccaguugacaauca

SEQ ID NO: 481434 - RNA, 22 nt, Human
agucaggauaugccuugugggc

SEQ ID NO: 481435 - RNA, 17 nt, Human
uccuggcucugccacug

SEQ ID NO: 481436 - RNA, 22 nt, Human
ugcagggaggccccgcagcccu

SEQ ID NO: 481437 - RNA, 22 nt, Human
cucaggauugugccuagggaga

SEQ ID NO: 481438 - RNA, 22 nt, Human
augaugguggguaauguguaaa

SEQ ID NO: 481439 - RNA, 22 nt, Human
ggauggcagucugcaugagaaa

SEQ ID NO: 481440 - RNA, 17 nt, Human
ucugucuugacugucac

SEQ ID NO: 481441 - RNA, 22 nt, Human
gaaguucaggugggaauugagc

SEQ ID NO: 481442 - RNA, 22 nt, Human
uuuaucacagaauaagaaguca

SEQ ID NO: 481443 - RNA, 22 nt, Human
auuguauuuccagcuugaaugu

SEQ ID NO: 481444 - RNA, 22 nt, Human
ugaggcaggaggauugcaggau

SEQ ID NO: 481445 - RNA, 22 nt, Human
agaagccauucccuguaggcuc

SEQ ID NO: 481446 - RNA, 22 nt, Human
ggcugccaggagggaggccagu

SEQ ID NO: 481447 - RNA, 22 nt, Human
ugaaauuccaggagaguuaaaa

SEQ ID NO: 481448 - RNA, 22 nt, Human
caucacagauguuguguggagu

SEQ ID NO: 481449 - RNA, 22 nt, Human
uaaagguacgaagugagggauu

SEQ ID NO: 481450 - RNA, 22 nt, Human
uccugcagccacugcaggcaga

SEQ ID NO: 481451 - RNA, 22 nt, Human
gaaaagcuaggccaguucagcu

SEQ ID NO: 481452 - RNA, 22 nt, Human
cacagcuggugacagagcccag

SEQ ID NO: 481453 - RNA, 22 nt, Human
aggucacacaacugucagaggc

SEQ ID NO: 481454 - RNA, 22 nt, Human
uccugccuagcaggugaccuau

SEQ ID NO: 481455 - RNA, 22 nt, Human
uggccugaggcucggcaugggu

SEQ ID NO: 481456 - RNA, 22 nt, Human
acguggagagaauagggcacca

SEQ ID NO: 481457 - RNA, 22 nt, Human
aggcuucuacguggucccaggg

SEQ ID NO: 481458 - RNA, 17 nt, Human
gcagugaaaagagauca

SEQ ID NO: 481459 - RNA, 22 nt, Human
cauuuguauagugcuuagacca

SEQ ID NO: 481460 - RNA, 19 nt, Human
cagcaauaaugccagaugg

SEQ ID NO: 481461 - RNA, 22 nt, Human
gcaccugggacccagaggcacc

SEQ ID NO: 481462 - RNA, 22 nt, Human
gagaggcugaaaucacaggagc

SEQ ID NO: 481463 - RNA, 22 nt, Human
aaauccuaaugacaaguuuagu

SEQ ID NO: 481464 - RNA, 22 nt, Human
uggagcuggcuuguggaaguug

SEQ ID NO: 481465 - RNA, 22 nt, Human
aaaggccauuacuugcuuuuag

SEQ ID NO: 481466 - RNA, 22 nt, Human
auucagcaaugagcuuggauuu

SEQ ID NO: 481467 - RNA, 22 nt, Human
gugucauggaaaauugcaaugg

SEQ ID NO: 481468 - RNA, 22 nt, Human
uuagccaugcccuagaagagga

SEQ ID NO: 481469 - RNA, 22 nt, Human
ccagagcccagggucaugcagg

SEQ ID NO: 481470 - RNA, 22 nt, Human
ggccugagcagacagcaugaug

SEQ ID NO: 481471 - RNA, 22 nt, Human
ugcuggagaucauuaauguuca

SEQ ID NO: 481472 - RNA, 22 nt, Human
acagucucuccacacugcaggg

SEQ ID NO: 481473 - RNA, 22 nt, Human
ugaaggagcugauguaaggggu

SEQ ID NO: 481474 - RNA, 22 nt, Human
acugcuuuagaccuagagcucu

SEQ ID NO: 481475 - RNA, 21 nt, Human
ggucuuccaaauaaggagaaa

SEQ ID NO: 481476 - RNA, 22 nt, Human
ugcagggauuauguagggguug

SEQ ID NO: 481477 - RNA, 22 nt, Human
ugagaagcugcuugugcuguau

SEQ ID NO: 481478 - RNA, 22 nt, Human
ucuuugcaugcauuuucccuua

SEQ ID NO: 481479 - RNA, 22 nt, Human
gcaguguuaggaauaaaaauga

SEQ ID NO: 481480 - RNA, 22 nt, Human
uucacauugugcagauuauggu

SEQ ID NO: 481481 - RNA, 22 nt, Human
cuggguggcuguccagccagcc

SEQ ID NO: 481482 - RNA, 22 nt, Human
aaaguuugcaauuuauguuaau

SEQ ID NO: 481483 - RNA, 22 nt, Human
agcuggcagagcauuuguggcc

SEQ ID NO: 481484 - RNA, 22 nt, Human
gucagaggaauggaugagugau

SEQ ID NO: 481485 - RNA, 18 nt, Human
uucaccagugugaugggu

SEQ ID NO: 481486 - RNA, 22 nt, Human
caggaugggauguagugggccc

SEQ ID NO: 481487 - RNA, 22 nt, Human
aaaucaguuguuauauuaaaga

SEQ ID NO: 481488 - RNA, 22 nt, Human
aaagaaggaccuggaggaggau

SEQ ID NO: 481489 - RNA, 20 nt, Human
gugaccagaagacagugggu

SEQ ID NO: 481490 - RNA, 22 nt, Human
acagggcagcaacuuugugccu

SEQ ID NO: 481491 - RNA, 22 nt, Human
uuuuaccugaaccacacaguau

SEQ ID NO: 481492 - RNA, 22 nt, Human
gaaaucugcggugaggccugag

SEQ ID NO: 481493 - RNA, 22 nt, Human
uagagugguuaacaguuuagaa

SEQ ID NO: 481494 - RNA, 22 nt, Human
uucaaaggcaggauagcagcug

SEQ ID NO: 481495 - RNA, 22 nt, Human
cugagccaaaaagcagagcuug

SEQ ID NO: 481496 - RNA, 22 nt, Human
uugcauguuauuuaaucuguau

SEQ ID NO: 481497 - RNA, 22 nt, Human
aggucauuuccuuagaggcaga

SEQ ID NO: 481498 - RNA, 22 nt, Human
ugaaccagagucuccagugguu

SEQ ID NO: 481499 - RNA, 22 nt, Human
acugcaucugaaacauggguca

SEQ ID NO: 481500 - RNA, 22 nt, Human
uccuuuuuaagucguuguggua

SEQ ID NO: 481501 - RNA, 22 nt, Human
ucucagaguuuagagcugagcc

SEQ ID NO: 481502 - RNA, 22 nt, Human
gccagguggcugagugacugag

SEQ ID NO: 481503 - RNA, 22 nt, Human
cugagccagcgggcucacuuuu

SEQ ID NO: 481504 - RNA, 22 nt, Human
uggccuggugcucaggcaguag

SEQ ID NO: 481505 - RNA, 21 nt, Human
aagccagcccacagugguuug

SEQ ID NO: 481506 - RNA, 22 nt, Human
uaugagcuuccaguguugcaug

SEQ ID NO: 481507 - RNA, 22 nt, Human
ggcucugcugguaagaugccuc

SEQ ID NO: 481508 - RNA, 22 nt, Human
gccagagguucaacaacugucu

SEQ ID NO: 481509 - RNA, 22 nt, Human
gagaggagucccuaucacaguu

SEQ ID NO: 481510 - RNA, 22 nt, Human
ucagcuuugaucucaggcaauc

SEQ ID NO: 481511 - RNA, 21 nt, Human
auggagucaggggaaugggcc

SEQ ID NO: 481512 - RNA, 22 nt, Human
ccugucucuguuaccacauuug

SEQ ID NO: 481513 - RNA, 22 nt, Human
cccugcagggaggauucugaag

SEQ ID NO: 481514 - RNA, 22 nt, Human
cucugugccucaguuuucuucu

SEQ ID NO: 481515 - RNA, 22 nt, Human
agucccagugagaugaaccagg

SEQ ID NO: 481516 - RNA, 23 nt, Human
cagcaggagggugccugggcugc

SEQ ID NO: 481517 - RNA, 22 nt, Human
ucuguuccaguagaaaggugca

SEQ ID NO: 481518 - RNA, 22 nt, Human
uuuggaaaguugucacuuuaga

SEQ ID NO: 481519 - RNA, 22 nt, Human
acauuucuaauuuaauguaaca

SEQ ID NO: 481520 - RNA, 22 nt, Human
uauuugauagagauaaaugaua

SEQ ID NO: 481521 - RNA, 22 nt, Human
aggaggggcaaugauagucugg

SEQ ID NO: 481522 - RNA, 22 nt, Human
aggccugacuugaauuuagggc

SEQ ID NO: 481523 - RNA, 22 nt, Human
cccaccaguacagaugguagau

SEQ ID NO: 481524 - RNA, 22 nt, Human
aaauuagucgguuuaggaauuu

SEQ ID NO: 481525 - RNA, 21 nt, Human
ucagggcagcugcucuucaga

SEQ ID NO: 481526 - RNA, 22 nt, Human
uuccacuuaguggaagggcaug

SEQ ID NO: 481527 - RNA, 22 nt, Human
aaacuucauggauaauauaaag

SEQ ID NO: 481528 - RNA, 22 nt, Human
aagcugccaaugguaagcugcu

SEQ ID NO: 481529 - RNA, 22 nt, Human
ggaggcucugcuccguguguuc

SEQ ID NO: 481530 - RNA, 22 nt, Human
auuucucaguuccuacuguuua

SEQ ID NO: 481531 - RNA, 21 nt, Human
cagcaaaucauugggcagacu

SEQ ID NO: 481532 - RNA, 22 nt, Human
uggccuuccuggugacucauga

SEQ ID NO: 481533 - RNA, 22 nt, Human
auacauacauguacacauaaau

SEQ ID NO: 481534 - RNA, 22 nt, Human
caggcaccccaggugagcacug

SEQ ID NO: 481535 - RNA, 22 nt, Human
aguccaggaguugggugacauu

SEQ ID NO: 481536 - RNA, 22 nt, Human
acaagagauuaucuacagauga

SEQ ID NO: 481537 - RNA, 22 nt, Human
cuccaggccagggaaguggaca

SEQ ID NO: 481538 - RNA, 22 nt, Human
cuuuggcaugguccucacuaua

SEQ ID NO: 481539 - RNA, 22 nt, Human
gagguacaugaggauacacagg

SEQ ID NO: 481540 - RNA, 22 nt, Human
caggguggggcuggcuaucaaa

SEQ ID NO: 481541 - RNA, 22 nt, Human
ugaggaaguuguuucucuucua

SEQ ID NO: 481542 - RNA, 22 nt, Human
ggcuucaccaggugcaugcaug

SEQ ID NO: 481543 - RNA, 22 nt, Human
agcuucuugaccaagccuguaa

SEQ ID NO: 481544 - RNA, 22 nt, Human
aagugccugaccuagccuggag

SEQ ID NO: 481545 - RNA, 18 nt, Human
cugaaggauccaggugua

SEQ ID NO: 481546 - RNA, 22 nt, Human
acucugaggagugacuagaggu

SEQ ID NO: 481547 - RNA, 22 nt, Human
acagagagaauuggguuuacag

SEQ ID NO: 481548 - RNA, 22 nt, Human
uggcaguggcucagagugcaga

SEQ ID NO: 481549 - RNA, 22 nt, Human
ggcagcagggucuagauugaug

SEQ ID NO: 481550 - RNA, 21 nt, Human
uugcaccaugauaaauucaga

SEQ ID NO: 481551 - RNA, 22 nt, Human
aagggacccuggaucaaaugga

SEQ ID NO: 481552 - RNA, 22 nt, Human
aaucaguuaaauauugaguaca

SEQ ID NO: 481553 - RNA, 22 nt, Human
cagaguacugggagaacagaag

SEQ ID NO: 481554 - RNA, 22 nt, Human
ggagcauguggggugagcaggg

SEQ ID NO: 481555 - RNA, 21 nt, Human
aaauguguuccauaaugcuuu

SEQ ID NO: 481556 - RNA, 22 nt, Human
cacugaaggcugcagcucagcc

SEQ ID NO: 481557 - RNA, 22 nt, Human
ucaggcugguccccacagugga

SEQ ID NO: 481558 - RNA, 20 nt, Human
uccagcugucuuucagagac

SEQ ID NO: 481559 - RNA, 20 nt, Human
ggggcugcaugcagagaaga

SEQ ID NO: 481560 - RNA, 22 nt, Human
agcugauuccacuuuuucccca

SEQ ID NO: 481561 - RNA, 22 nt, Human
cuggcuucugggccagggcaga

SEQ ID NO: 481562 - RNA, 22 nt, Human
aagaacaacugcuuuaaaagca

SEQ ID NO: 481563 - RNA, 22 nt, Human
cuguggagcuuguggcaguggg

SEQ ID NO: 481564 - RNA, 22 nt, Human
agaauccugaugaaaaggagag

SEQ ID NO: 481565 - RNA, 22 nt, Human
gccuuccuuuuaccaccagcca

SEQ ID NO: 481566 - RNA, 22 nt, Human
ccugccugcggcccgcggggag

SEQ ID NO: 481567 - RNA, 22 nt, Human
gaauguaauagucaguagaaca

SEQ ID NO: 481568 - RNA, 22 nt, Human
caggugcccagcuccugcugug

SEQ ID NO: 481569 - RNA, 19 nt, Human
uguagcaguuuaaaacaac

SEQ ID NO: 481570 - RNA, 22 nt, Human
uugaaggaggcuccuuuuuaaa

SEQ ID NO: 481571 - RNA, 22 nt, Human
gcccagcuccucugcagacccu

SEQ ID NO: 481572 - RNA, 22 nt, Human
auguaacaaaugguauacaugu

SEQ ID NO: 481573 - RNA, 22 nt, Human
agcaggguuuggggauuggcac

SEQ ID NO: 481574 - RNA, 23 nt, Human
ucaguuuuggcuguucaguguug

SEQ ID NO: 481575 - RNA, 22 nt, Human
uccuguggcguuaucaugugau

SEQ ID NO: 481576 - RNA, 20 nt, Human
gucucagaauggauuugcau

SEQ ID NO: 481577 - RNA, 22 nt, Human
ggagcugcacgcucugaagccu

SEQ ID NO: 481578 - RNA, 22 nt, Human
caaagcaaggcucaguuugaac

SEQ ID NO: 481579 - RNA, 19 nt, Human
agagaaggauccuaugguu

SEQ ID NO: 481580 - RNA, 22 nt, Human
ucagagaaguaagguggggugc

SEQ ID NO: 481581 - RNA, 22 nt, Human
cucucugcuguauccuuaggcu

SEQ ID NO: 481582 - RNA, 22 nt, Human
cucagagauauagucccugcuu

SEQ ID NO: 481583 - RNA, 22 nt, Human
ccaggccugcaucugcugcgca

SEQ ID NO: 481584 - RNA, 22 nt, Human
uucugcaucugaauuuaaguac

SEQ ID NO: 481585 - RNA, 22 nt, Human
agugcaaaauucagaagcaauu

SEQ ID NO: 481586 - RNA, 22 nt, Human
auuuuccaaaauaauuguuacu

SEQ ID NO: 481587 - RNA, 22 nt, Human
acccugccgugggcugcuugug

SEQ ID NO: 481588 - RNA, 22 nt, Human
guguaaggugaaaucaacaaau

SEQ ID NO: 481589 - RNA, 22 nt, Human
uggcagagcccagaacugagca

SEQ ID NO: 481590 - RNA, 22 nt, Human
aggaccugacuggcuccugcuu

SEQ ID NO: 481591 - RNA, 22 nt, Human
cuggcccagagagcagagcuua

SEQ ID NO: 481592 - RNA, 22 nt, Human
gagugggcaccgugggcacacu

SEQ ID NO: 481593 - RNA, 22 nt, Human
aagggccauaacuugcaguguu

SEQ ID NO: 481594 - RNA, 22 nt, Human
uggcucagccuggcccuuucau

SEQ ID NO: 481595 - RNA, 22 nt, Human
cccuccagagcuugaccugcug

SEQ ID NO: 481596 - RNA, 22 nt, Human
ccagucagccaagcugcagcgg

SEQ ID NO: 481597 - RNA, 22 nt, Human
uggcgugcccuccagacuuggc

SEQ ID NO: 481598 - RNA, 22 nt, Human
uggcugagccuuuggggcuuuc

SEQ ID NO: 481599 - RNA, 22 nt, Human
ucccagaggacuguuggugcua

SEQ ID NO: 481600 - RNA, 22 nt, Human
aucaccaggcaaaaugucagag

SEQ ID NO: 481601 - RNA, 22 nt, Human
uccugccucuccaugcuaacua

SEQ ID NO: 481602 - RNA, 22 nt, Human
cagggccuuuuagcaucuucuc

SEQ ID NO: 481603 - RNA, 22 nt, Human
augcauugucugguuucauuuu

SEQ ID NO: 481604 - RNA, 22 nt, Human
aagagcaucaaugacucgcagu

SEQ ID NO: 481605 - RNA, 22 nt, Human
ggucccagcuggucacugucag

SEQ ID NO: 481606 - RNA, 22 nt, Human
acugucaccaucagagcgggaa

SEQ ID NO: 481607 - RNA, 22 nt, Human
acugugugcccugacgccaggg

SEQ ID NO: 481608 - RNA, 22 nt, Human
ggaagccagaaagugagaauau

SEQ ID NO: 481609 - RNA, 21 nt, Human
uugaaaguaaauucagcagcu

SEQ ID NO: 481610 - RNA, 22 nt, Human
agagugguacuucuuuuucuuc

SEQ ID NO: 481611 - RNA, 22 nt, Human
ccucauggaccucagacugucc

SEQ ID NO: 481612 - RNA, 22 nt, Human
aaguauauuuuuugaagcauau

SEQ ID NO: 481613 - RNA, 22 nt, Human
cccagggagguagcaggagaaa

SEQ ID NO: 481614 - RNA, 22 nt, Human
gggcaugguggcaggcaccugu

SEQ ID NO: 481615 - RNA, 22 nt, Human
guggcucuaggugagcauggag

SEQ ID NO: 481616 - RNA, 22 nt, Human
gggcacugcuuugcucugucac

SEQ ID NO: 481617 - RNA, 22 nt, Human
caaggcugugcaggguccauau

SEQ ID NO: 481618 - RNA, 22 nt, Human
cauuuguagcuauuuacuguau

SEQ ID NO: 481619 - RNA, 22 nt, Human
gcacccaggccggcgacugcag

SEQ ID NO: 481620 - RNA, 21 nt, Human
ugggaugggucugggaccagc

SEQ ID NO: 481621 - RNA, 22 nt, Human
cacagcugaaguagccaugugg

SEQ ID NO: 481622 - RNA, 22 nt, Human
uuuauuauagugguggggacug

SEQ ID NO: 481623 - RNA, 22 nt, Human
ugcuuuauugcaucaguguggg

SEQ ID NO: 481624 - RNA, 22 nt, Human
gcaucuucacacaaagccagug

SEQ ID NO: 481625 - RNA, 16 nt, Human
cuacccagugagaagg

SEQ ID NO: 481626 - RNA, 22 nt, Human
uugaaggacauccuauuucuag

SEQ ID NO: 481627 - RNA, 21 nt, Human
gagugcagcaagguagagucu

SEQ ID NO: 481628 - RNA, 22 nt, Human
caucacagggggcuagaagucu

SEQ ID NO: 481629 - RNA, 22 nt, Human
cugccucucagccugaccgcca

SEQ ID NO: 481630 - RNA, 22 nt, Human
uugaacagcuguuacauuguua

SEQ ID NO: 481631 - RNA, 21 nt, Human
acagaguaguugaaacagaga

SEQ ID NO: 481632 - RNA, 22 nt, Human
agaagccacaggccucgucugg

SEQ ID NO: 481633 - RNA, 19 nt, Human
uggcugggugccaauggcc

SEQ ID NO: 481634 - RNA, 17 nt, Human
agaugcuggccacaugu

SEQ ID NO: 481635 - RNA, 22 nt, Human
cgcugccaggucaccaggggua

SEQ ID NO: 481636 - RNA, 21 nt, Human
ggcagcccgcccucuccuggc

SEQ ID NO: 481637 - RNA, 22 nt, Human
gggauggggucaacauguaccu

SEQ ID NO: 481638 - RNA, 22 nt, Human
acagaccaaaaaaggauauugg

SEQ ID NO: 481639 - RNA, 22 nt, Human
ggccaggagcaagccaggcucu

SEQ ID NO: 481640 - RNA, 20 nt, Human
cugugccuaaaccuccgggu

SEQ ID NO: 481641 - RNA, 17 nt, Human
uggcucugaggcugaau

SEQ ID NO: 481642 - RNA, 22 nt, Human
ucagcuuuuuacaugugaaaua

SEQ ID NO: 481643 - RNA, 22 nt, Human
uggcagagucugggcuugggca

SEQ ID NO: 481644 - RNA, 22 nt, Human
gccuggagaagauggaacuagc

SEQ ID NO: 481645 - RNA, 22 nt, Human
acacugaagagcacuuucaaag

SEQ ID NO: 481646 - RNA, 22 nt, Human
gcagggacgcagcacucuccgu

SEQ ID NO: 481647 - RNA, 22 nt, Human
aggcuucccaagcagcugcaaa

SEQ ID NO: 481648 - RNA, 22 nt, Human
uugaaaaaauugguagaggaug

SEQ ID NO: 481649 - RNA, 22 nt, Human
uccuguguuacugccuggagcg

SEQ ID NO: 481650 - RNA, 22 nt, Human
ccagcugaggcagccacacagg

SEQ ID NO: 481651 - RNA, 22 nt, Human
gcaggagucacugacuuggucc

SEQ ID NO: 481652 - RNA, 19 nt, Human
ucgagucaagacacuaggc

SEQ ID NO: 481653 - RNA, 22 nt, Human
accugagcaugccaggagagug

SEQ ID NO: 481654 - RNA, 22 nt, Human
cauuucugucacguucuuuuau

SEQ ID NO: 481655 - RNA, 22 nt, Human
gcaagcugcuuaagcucauugu

SEQ ID NO: 481656 - RNA, 20 nt, Human
aaaaacaguaaugcugaaga

SEQ ID NO: 481657 - RNA, 22 nt, Human
gcaaggacucccugggucauuc

SEQ ID NO: 481658 - RNA, 22 nt, Human
cagacccugggccacagaggag

SEQ ID NO: 481659 - RNA, 22 nt, Human
auaaacaguaaaugugagcagu

SEQ ID NO: 481660 - RNA, 22 nt, Human
uauagaaguaagcauugugaug

SEQ ID NO: 481661 - RNA, 22 nt, Human
gcucugcugagauaucugggag

SEQ ID NO: 481662 - RNA, 22 nt, Human
ggcgcaggccuuggauccuggu

SEQ ID NO: 481663 - RNA, 22 nt, Human
caaggccaagguuuugugaacu

SEQ ID NO: 481664 - RNA, 22 nt, Human
ccuuggcccuagccucaggcaa

SEQ ID NO: 481665 - RNA, 20 nt, Human
cugggcugcccagcuauggg

SEQ ID NO: 481666 - RNA, 22 nt, Human
uugcuauuuugagagucauagu

SEQ ID NO: 481667 - RNA, 22 nt, Human
agggcugagcccaggcauguag

SEQ ID NO: 481668 - RNA, 22 nt, Human
uagcuuuccuuguugccugugc

SEQ ID NO: 481669 - RNA, 22 nt, Human
gcaggagccaggccgagcuggu

SEQ ID NO: 481670 - RNA, 22 nt, Human
gcucccucugcucaggcacuug

SEQ ID NO: 481671 - RNA, 22 nt, Human
aagcuggacucugccauuuacu

SEQ ID NO: 481672 - RNA, 22 nt, Human
ggugaggaauuggggacugacc

SEQ ID NO: 481673 - RNA, 22 nt, Human
cucaggauguacuacagaaggc

SEQ ID NO: 481674 - RNA, 22 nt, Human
gaagcagcuggugagauggagc

SEQ ID NO: 481675 - RNA, 22 nt, Human
ucacugaagacugggcucuaaa

SEQ ID NO: 481676 - RNA, 22 nt, Human
cauacuuuugcccugacauucu

SEQ ID NO: 481677 - RNA, 22 nt, Human
ugucauuuaguccucugugugu

SEQ ID NO: 481678 - RNA, 22 nt, Human
uucuuucccagaagauauguuu

SEQ ID NO: 481679 - RNA, 22 nt, Human
cacaaugcguacauauaucaaa

SEQ ID NO: 481680 - RNA, 22 nt, Human
gagcccagguucugcuuccagc

SEQ ID NO: 481681 - RNA, 22 nt, Human
gacagaggcaagaccagaagcc

SEQ ID NO: 481682 - RNA, 22 nt, Human
aggaccuguaccucagcaucua

SEQ ID NO: 481683 - RNA, 22 nt, Human
caaauguguagagcuuuugggg

SEQ ID NO: 481684 - RNA, 22 nt, Human
aggccucaggaagguaaagaag

SEQ ID NO: 481685 - RNA, 22 nt, Human
uaaggaaagugccaugauuucu

SEQ ID NO: 481686 - RNA, 22 nt, Human
cauuagaagaacaguuauauua

SEQ ID NO: 481687 - RNA, 22 nt, Human
gggagggaggugaugcuuggcu

SEQ ID NO: 481688 - RNA, 22 nt, Human
gggccuggugcuucugacuccu

SEQ ID NO: 481689 - RNA, 22 nt, Human
auaaaagaaguuuugguacuug

SEQ ID NO: 481690 - RNA, 22 nt, Human
cuggggaggcagggcugccccu

SEQ ID NO: 481691 - RNA, 22 nt, Human
ugcaggcuuuagccccauggcu

SEQ ID NO: 481692 - RNA, 23 nt, Human
agagcaucaugaugcuaagucug

SEQ ID NO: 481693 - RNA, 22 nt, Human
ugcacuggggucccagcgcacg

SEQ ID NO: 481694 - RNA, 22 nt, Human
gaggccuguagucauggaugua

SEQ ID NO: 481695 - RNA, 22 nt, Human
guggcuucacauggcauuuggc

SEQ ID NO: 481696 - RNA, 22 nt, Human
agcccaagcauaggagggaggc

SEQ ID NO: 481697 - RNA, 22 nt, Human
cuacauuuugugauuaugaaau

SEQ ID NO: 481698 - RNA, 21 nt, Human
acagacagggccagugucccc

SEQ ID NO: 481699 - RNA, 22 nt, Human
uuuauuagauuaucaaagaggu

SEQ ID NO: 481700 - RNA, 22 nt, Human
ugcaaaauaaugaacgauuuuu

SEQ ID NO: 481701 - RNA, 22 nt, Human
ccagguggaggugugagguccu

SEQ ID NO: 481702 - RNA, 22 nt, Human
ucccaggauguuggcggcaggu

SEQ ID NO: 481703 - RNA, 22 nt, Human
gcucuguguugucagaggcacc

SEQ ID NO: 481704 - RNA, 22 nt, Human
cuggggugugcucagagcaggg

SEQ ID NO: 481705 - RNA, 22 nt, Human
gcagccagggagagaaccaggg

SEQ ID NO: 481706 - RNA, 22 nt, Human
ucugcgcugccuugauccuugg

SEQ ID NO: 481707 - RNA, 22 nt, Human
caggguggaagcuguagagugg

SEQ ID NO: 481708 - RNA, 22 nt, Human
uuauuuugccacaggugaccuu

SEQ ID NO: 481709 - RNA, 22 nt, Human
cagcaauaacucaaagccauuu

SEQ ID NO: 481710 - RNA, 22 nt, Human
ccugugaggucaucugugguaa

SEQ ID NO: 481711 - RNA, 22 nt, Human
uacccagcuccucagaagacca

SEQ ID NO: 481712 - RNA, 18 nt, Human
gagaggcccggcugugcc

SEQ ID NO: 481713 - RNA, 22 nt, Human
ugaggcagccugcauuaaagag

SEQ ID NO: 481714 - RNA, 22 nt, Human
ucagaggagaugguuaccaggg

SEQ ID NO: 481715 - RNA, 22 nt, Human
acacaguaugaaaagucuaguu

SEQ ID NO: 481716 - RNA, 22 nt, Human
guggagcccugccuugcucaug

SEQ ID NO: 481717 - RNA, 22 nt, Human
ggccagcagucacagggucaga

SEQ ID NO: 481718 - RNA, 21 nt, Human
gcaaggcuuuuguguuuccca

SEQ ID NO: 481719 - RNA, 19 nt, Human
aucugaaguaggugcagcu

SEQ ID NO: 481720 - RNA, 22 nt, Human
uuccagaaaucuuucagcucaa

SEQ ID NO: 481721 - RNA, 21 nt, Human
agcuggcagauauggugucug

SEQ ID NO: 481722 - RNA, 22 nt, Human
agcagccagugggagugauaca

SEQ ID NO: 481723 - RNA, 22 nt, Human
ccagaggaggggggucuuucug

SEQ ID NO: 481724 - RNA, 22 nt, Human
ugccaggcuuuggucaaaggcu

SEQ ID NO: 481725 - RNA, 22 nt, Human
ccauaagguuuggggccaugca

SEQ ID NO: 481726 - RNA, 22 nt, Human
ucagcuuuugucagaaauugua

SEQ ID NO: 481727 - RNA, 22 nt, Human
cagcuuugugcaaugcagucuc

SEQ ID NO: 481728 - RNA, 22 nt, Human
ucaacacuauccaggcaaucuu

SEQ ID NO: 481729 - RNA, 22 nt, Human
guacuuccagccaagugagaca

SEQ ID NO: 481730 - RNA, 21 nt, Human
augggcagaggcagagaggcu

SEQ ID NO: 481731 - RNA, 22 nt, Human
caacaguguugcaaucugaaaa

SEQ ID NO: 481732 - RNA, 22 nt, Human
cugugucccuugucccagagcc

SEQ ID NO: 481733 - RNA, 22 nt, Human
uuugaaagggacaaagucacug

SEQ ID NO: 481734 - RNA, 22 nt, Human
gggccacauugaagggugggua

SEQ ID NO: 481735 - RNA, 22 nt, Human
cagcaggacguccaagugcuau

SEQ ID NO: 481736 - RNA, 22 nt, Human
cauuuguuaauuacuauuaucu

SEQ ID NO: 481737 - RNA, 22 nt, Human
cagaggcagacccuccagggcg

SEQ ID NO: 481738 - RNA, 22 nt, Human
ugcauacacaugugcacauacg

SEQ ID NO: 481739 - RNA, 22 nt, Human
ucugcagcuucuugccagagag

SEQ ID NO: 481740 - RNA, 23 nt, Human
uucuuauuuacuuuggaaucucc

SEQ ID NO: 481741 - RNA, 22 nt, Human
agucaggagcugcugcauugua

SEQ ID NO: 481742 - RNA, 22 nt, Human
gccacccugagcugggccaggg

SEQ ID NO: 481743 - RNA, 22 nt, Human
ugauuuccuagcugacaugaaa

SEQ ID NO: 481744 - RNA, 21 nt, Human
cagagcuguccaaacccugac

SEQ ID NO: 481745 - RNA, 22 nt, Human
gcagaggauagcauaugaaccu

SEQ ID NO: 481746 - RNA, 18 nt, Human
gcaaggcucaggccaggc

SEQ ID NO: 481747 - RNA, 22 nt, Human
uucugugaaucuuuuuucccac

SEQ ID NO: 481748 - RNA, 22 nt, Human
gcagcuggcccugacacgcaga

SEQ ID NO: 481749 - RNA, 22 nt, Human
gcucagggaacuuuuugcaggc

SEQ ID NO: 481750 - RNA, 22 nt, Human
gcuggcugaggucuagcucuuu

SEQ ID NO: 481751 - RNA, 21 nt, Human
ccaggguccagcugccauggu

SEQ ID NO: 481752 - RNA, 22 nt, Human
ucagcuuuggucacauugaguu

SEQ ID NO: 481753 - RNA, 22 nt, Human
uucacaguggcugugccauuug

SEQ ID NO: 481754 - RNA, 22 nt, Human
ggugggugagcccugggagcug

SEQ ID NO: 481755 - RNA, 22 nt, Human
cagccugggcuccagagucccu

SEQ ID NO: 481756 - RNA, 22 nt, Human
ggcagggcuugucucugugaug

SEQ ID NO: 481757 - RNA, 20 nt, Human
ucagugauuaucucugagug

SEQ ID NO: 481758 - RNA, 22 nt, Human
gucucagauucagacaucuaca

SEQ ID NO: 481759 - RNA, 22 nt, Human
aucuuugaagaggacuugaagu

SEQ ID NO: 481760 - RNA, 22 nt, Human
ugccugggagugaccaagacuc

SEQ ID NO: 481761 - RNA, 22 nt, Human
gcaaauacauguugagcaccua

SEQ ID NO: 481762 - RNA, 22 nt, Human
gccgaagcugccgucugguccu

SEQ ID NO: 481763 - RNA, 22 nt, Human
acagccagggucucaggaggcg

SEQ ID NO: 481764 - RNA, 22 nt, Human
aggcaggaaaaucgcuugaacc

SEQ ID NO: 481765 - RNA, 18 nt, Human
uccuccuuuggccuuuuc

SEQ ID NO: 481766 - RNA, 22 nt, Human
cuguauuucccacauucucuau

SEQ ID NO: 481767 - RNA, 22 nt, Human
uuuauuaugauggacaccuucg

SEQ ID NO: 481768 - RNA, 21 nt, Human
gcaggggauagaaauggucug

SEQ ID NO: 481769 - RNA, 22 nt, Human
uggccuggugucugcgaggccu

SEQ ID NO: 481770 - RNA, 20 nt, Human
cugccaugauugauagagug

SEQ ID NO: 481771 - RNA, 22 nt, Human
caugggcuuuggaggcuggagg

SEQ ID NO: 481772 - RNA, 20 nt, Human
uccuucaggcagggccuagu

SEQ ID NO: 481773 - RNA, 19 nt, Human
acaggcagaauugggugug

SEQ ID NO: 481774 - RNA, 22 nt, Human
ucuggcucaucucuccagguaa

SEQ ID NO: 481775 - RNA, 22 nt, Human
gaggccuggagccgccuaggcg

SEQ ID NO: 481776 - RNA, 22 nt, Human
ugaaggaagaauaggcaguguu

SEQ ID NO: 481777 - RNA, 22 nt, Human
aggaccugaaauucuugcuuuu

SEQ ID NO: 481778 - RNA, 22 nt, Human
ugucacagggauaccauggggc

SEQ ID NO: 481779 - RNA, 22 nt, Human
guccugggcccaggggcugccu

SEQ ID NO: 481780 - RNA, 23 nt, Human
ccuggcagcaaacgaggagguua

SEQ ID NO: 481781 - RNA, 22 nt, Human
gaggggcuggcacgauggcugc

SEQ ID NO: 481782 - RNA, 22 nt, Human
gcaaaggcuucuuuuauucucc

SEQ ID NO: 481783 - RNA, 22 nt, Human
agucccagugacuuggccagaa

SEQ ID NO: 481784 - RNA, 22 nt, Human
acccuggacuggggcugaggcu

SEQ ID NO: 481785 - RNA, 22 nt, Human
gucuuguuugggauguggaugg

SEQ ID NO: 481786 - RNA, 22 nt, Human
uuuuauuaucuuugaaugggac

SEQ ID NO: 481787 - RNA, 22 nt, Human
cuuccucacggugcaacaggaa

SEQ ID NO: 481788 - RNA, 20 nt, Human
uuggcucugaucaguggagc

SEQ ID NO: 481789 - RNA, 22 nt, Human
aggaggcccuagagcucuagag

SEQ ID NO: 481790 - RNA, 22 nt, Human
ggcugccuugacccuggcuccg

SEQ ID NO: 481791 - RNA, 22 nt, Human
uuauuaaugaguacaaguuauu

SEQ ID NO: 481792 - RNA, 22 nt, Human
uguaguaagugcgcaauaaaua

SEQ ID NO: 481793 - RNA, 22 nt, Human
augagcugugggauuccagagg

SEQ ID NO: 481794 - RNA, 22 nt, Human
agcugcagcguucauuuuucca

SEQ ID NO: 481795 - RNA, 20 nt, Human
agcaccagugggggcagccc

SEQ ID NO: 481796 - RNA, 22 nt, Human
caggugaccuuuguccuaaguu

SEQ ID NO: 481797 - RNA, 22 nt, Human
caugcuuuaccaaagcagugau

SEQ ID NO: 481798 - RNA, 22 nt, Human
ugacucuguaccugucugccuu

SEQ ID NO: 481799 - RNA, 22 nt, Human
uggcagaguuauggguauuuau

SEQ ID NO: 481800 - RNA, 22 nt, Human
ccagaggaguugaggcuuuggg

SEQ ID NO: 481801 - RNA, 18 nt, Human
caggaugagugaugggga

SEQ ID NO: 481802 - RNA, 22 nt, Human
ggucauugaaaucagaaggguu

SEQ ID NO: 481803 - RNA, 22 nt, Human
agcagccacagcagaucugagu

SEQ ID NO: 481804 - RNA, 22 nt, Human
uccuccagugucuggggccuug

SEQ ID NO: 481805 - RNA, 22 nt, Human
auugucuuuggugcuuccagga

SEQ ID NO: 481806 - RNA, 22 nt, Human
cagggcaguuuuacuucucucu

SEQ ID NO: 481807 - RNA, 22 nt, Human
auacaaaguauuaauccuggau

SEQ ID NO: 481808 - RNA, 22 nt, Human
ugagcccagagcccuuguaggg

SEQ ID NO: 481809 - RNA, 22 nt, Human
gcccaggauucuuucuuccuua

SEQ ID NO: 481810 - RNA, 22 nt, Human
gcucaggacccaggugugaccu

SEQ ID NO: 481811 - RNA, 22 nt, Human
cugugcuuccaggauggcagcu

SEQ ID NO: 481812 - RNA, 22 nt, Human
gagagugagauccuccugggga

SEQ ID NO: 481813 - RNA, 22 nt, Human
aggcagagcuaggaagaauugu

SEQ ID NO: 481814 - RNA, 22 nt, Human
uccaggcacagaguuggucagu

SEQ ID NO: 481815 - RNA, 22 nt, Human
cucucccagucaggcucaggau

SEQ ID NO: 481816 - RNA, 22 nt, Human
uccuggcccuguggccugcagu

SEQ ID NO: 481817 - RNA, 22 nt, Human
ggccagagaagucagacccuug

SEQ ID NO: 481818 - RNA, 21 nt, Human
cugugcuuuuuaagugugaug

SEQ ID NO: 481819 - RNA, 22 nt, Human
ucccagagcucuggagguugga

SEQ ID NO: 481820 - RNA, 22 nt, Human
aacaguaaugugguguuggguu

SEQ ID NO: 481821 - RNA, 22 nt, Human
cuggccuuuagccccagugucu

SEQ ID NO: 481822 - RNA, 22 nt, Human
auuuccaccggcucaggaaguu

SEQ ID NO: 481823 - RNA, 22 nt, Human
ugggacagggaaucugaucccc

SEQ ID NO: 481824 - RNA, 22 nt, Human
agggacugagcuaggaucuagu

SEQ ID NO: 481825 - RNA, 22 nt, Human
uccagggaugccagccauguug

SEQ ID NO: 481826 - RNA, 22 nt, Human
guacauuucauuuaaaugaugu

SEQ ID NO: 481827 - RNA, 22 nt, Human
agcucugcaggcacagcugagg

SEQ ID NO: 481828 - RNA, 22 nt, Human
caguuaaaggcccaauaucugg

SEQ ID NO: 481829 - RNA, 22 nt, Human
uguguacuugaaagggcagguc

SEQ ID NO: 481830 - RNA, 22 nt, Human
cuggugugauugagcccaggug

SEQ ID NO: 481831 - RNA, 20 nt, Human
cagagccaagagcagcaucu

SEQ ID NO: 481832 - RNA, 22 nt, Human
cacagaguggaggcuuggccug

SEQ ID NO: 481833 - RNA, 22 nt, Human
agugggaccggugcuauuccag

SEQ ID NO: 481834 - RNA, 22 nt, Human
aauuagagaucaguucuuugac

SEQ ID NO: 481835 - RNA, 22 nt, Human
uaaaucuccuguuuuucaucua

SEQ ID NO: 481836 - RNA, 22 nt, Human
cugaggcugggcugaggguaua

SEQ ID NO: 481837 - RNA, 22 nt, Human
gguggguauugaauacaggugu

SEQ ID NO: 481838 - RNA, 22 nt, Human
ugcugucuuccaggauggugaa

SEQ ID NO: 481839 - RNA, 22 nt, Human
gcagcugaaagggaucucuaca

SEQ ID NO: 481840 - RNA, 22 nt, Human
uaaguggaagguuauaugcuaa

SEQ ID NO: 481841 - RNA, 22 nt, Human
ccucugcagcagagagccagag

SEQ ID NO: 481842 - RNA, 22 nt, Human
cauccugcggggagcagagggc

SEQ ID NO: 481843 - RNA, 22 nt, Human
ccugagagcauuccacacugaa

SEQ ID NO: 481844 - RNA, 22 nt, Human
cagcaggguuaagugacucacc

SEQ ID NO: 481845 - RNA, 22 nt, Human
auacaaagcuaaauaugguuuc

SEQ ID NO: 481846 - RNA, 22 nt, Human
guuccaggcaagugggauagga

SEQ ID NO: 481847 - RNA, 22 nt, Human
uucucaggugaggcugaggcug

SEQ ID NO: 481848 - RNA, 22 nt, Human
agagccagccuucucagcuuac

SEQ ID NO: 481849 - RNA, 22 nt, Human
caugggcucuucuggacugcac

SEQ ID NO: 481850 - RNA, 22 nt, Human
aggcaggagcaagcccuacaag

SEQ ID NO: 481851 - RNA, 22 nt, Human
aagggcaggagaagacggauau

SEQ ID NO: 481852 - RNA, 22 nt, Human
ugggacagugugccuugcuccu

SEQ ID NO: 481853 - RNA, 22 nt, Human
uagagcuagcuucaaaaugcga

SEQ ID NO: 481854 - RNA, 22 nt, Human
gggcaggugcccagggccagag

SEQ ID NO: 481855 - RNA, 22 nt, Human
ggggaggcugaugugggcaaag

SEQ ID NO: 481856 - RNA, 22 nt, Human
gagagugaugaaugguuaaaca

SEQ ID NO: 481857 - RNA, 19 nt, Human
ucaaggcucccugagggau

SEQ ID NO: 481858 - RNA, 22 nt, Human
aaaugcacugaacacauguugu

SEQ ID NO: 481859 - RNA, 22 nt, Human
gucaccaggucugaugcagcca

SEQ ID NO: 481860 - RNA, 22 nt, Human
aggcugaugcuggcugaggcug

SEQ ID NO: 481861 - RNA, 22 nt, Human
agcucccagaaggcccugcgcc

SEQ ID NO: 481862 - RNA, 22 nt, Human
agagaagagcaaugauaaauuu

SEQ ID NO: 481863 - RNA, 22 nt, Human
ucaaaguagggguaagccaggc

SEQ ID NO: 481864 - RNA, 22 nt, Human
cacaggcuuccaguccccagcu

SEQ ID NO: 481865 - RNA, 22 nt, Human
gggcacuguggggcccaugcug

SEQ ID NO: 481866 - RNA, 18 nt, Human
gccaggcaggguggggaa

SEQ ID NO: 481867 - RNA, 22 nt, Human
uucaagaucgaguuuaaaguga

SEQ ID NO: 481868 - RNA, 22 nt, Human
uguggccuccuguuccugggua

SEQ ID NO: 481869 - RNA, 22 nt, Human
ggugaggaaagauggugacagu

SEQ ID NO: 481870 - RNA, 22 nt, Human
gcuggccugggcagccugucgg

SEQ ID NO: 481871 - RNA, 20 nt, Human
cagucccaauccagggccag

SEQ ID NO: 481872 - RNA, 19 nt, Human
ccaggccaucccaguuccc

SEQ ID NO: 481873 - RNA, 22 nt, Human
ggcaggcaguguggugugaaac

SEQ ID NO: 481874 - RNA, 22 nt, Human
gaggcccuccagcugucagcug

SEQ ID NO: 481875 - RNA, 22 nt, Human
uuggaaagcaagcuggacauac

SEQ ID NO: 481876 - RNA, 22 nt, Human
ccagcugguuaaaauagagaaa

SEQ ID NO: 481877 - RNA, 21 nt, Human
accagcaggagaucagaagga

SEQ ID NO: 481878 - RNA, 22 nt, Human
cuuaacagagagaaguguugcu

SEQ ID NO: 481879 - RNA, 22 nt, Human
ucccacucccaggcaggccucu

SEQ ID NO: 481880 - RNA, 22 nt, Human
cacaugggugugccuggaggaa

SEQ ID NO: 481881 - RNA, 22 nt, Human
ugaaugaguuuggcugcuguuc

SEQ ID NO: 481882 - RNA, 18 nt, Human
uguagagccagguuugcc

SEQ ID NO: 481883 - RNA, 22 nt, Human
uggcagcagacaaaaggccauu

SEQ ID NO: 481884 - RNA, 22 nt, Human
ucagcuggagaugagaaccgaa

SEQ ID NO: 481885 - RNA, 22 nt, Human
aggcuccuuguucaucauccau

SEQ ID NO: 481886 - RNA, 20 nt, Human
acuuucucgguuucucaccu

SEQ ID NO: 481887 - RNA, 20 nt, Human
ugcucugucuaaaacuuccc

SEQ ID NO: 481888 - RNA, 22 nt, Human
aaugcacagcguuccaugcuug

SEQ ID NO: 481889 - RNA, 23 nt, Human
uugcuuagagaccuccucaucag

SEQ ID NO: 481890 - RNA, 22 nt, Human
aagcagcauaauugcuauuuua

SEQ ID NO: 481891 - RNA, 22 nt, Human
gaaggcugcgaggggagugccg

SEQ ID NO: 481892 - RNA, 22 nt, Human
ucagcagggagaggagaaugca

SEQ ID NO: 481893 - RNA, 22 nt, Human
uggccugggucacaccaggguc

SEQ ID NO: 481894 - RNA, 18 nt, Human
cacaggcaggugauaggu

SEQ ID NO: 481895 - RNA, 17 nt, Human
aucuggcugcuucuaga

SEQ ID NO: 481896 - RNA, 22 nt, Human
agccugguuuaagcauuuuaua

SEQ ID NO: 481897 - RNA, 22 nt, Human
gcaggccucuguugagggccuu

SEQ ID NO: 481898 - RNA, 22 nt, Human
ggagccugagcggcccagggcc

SEQ ID NO: 481899 - RNA, 17 nt, Human
aggccagaugaggcaag

SEQ ID NO: 481900 - RNA, 22 nt, Human
ccugccugcaccuucucugggg

SEQ ID NO: 481901 - RNA, 22 nt, Human
ugugggaggaauuagaauggga

SEQ ID NO: 481902 - RNA, 22 nt, Human
aagggcagggaguuugugucua

SEQ ID NO: 481903 - RNA, 18 nt, Human
acauuucuccuucugacc

SEQ ID NO: 481904 - RNA, 22 nt, Human
uggcaggaggaugaggcggcua

SEQ ID NO: 481905 - RNA, 20 nt, Human
agaauucuuacccuuugaug

SEQ ID NO: 481906 - RNA, 22 nt, Human
aggccagcaccagagucaagaa

SEQ ID NO: 481907 - RNA, 22 nt, Human
aauuaguaaccuaauuccaucu

SEQ ID NO: 481908 - RNA, 22 nt, Human
cuugugcaauugacauugaauc

SEQ ID NO: 481909 - RNA, 22 nt, Human
agaagccagucgcucucccgca

SEQ ID NO: 481910 - RNA, 22 nt, Human
uagcugccauugcuccaggaag

SEQ ID NO: 481911 - RNA, 20 nt, Human
cagagcugggauuugaacac

SEQ ID NO: 481912 - RNA, 19 nt, Human
ucaguggaugaacauguuu

SEQ ID NO: 481913 - RNA, 22 nt, Human
caggaggaggugagguagaacu

SEQ ID NO: 481914 - RNA, 22 nt, Human
ggagugaguacuggaguagcug

SEQ ID NO: 481915 - RNA, 22 nt, Human
ucauuuguucucauucucuacu

SEQ ID NO: 481916 - RNA, 22 nt, Human
ucucuggaguauaaccagggau

SEQ ID NO: 481917 - RNA, 22 nt, Human
uggggcagggaugggaaacuau

SEQ ID NO: 481918 - RNA, 22 nt, Human
ucaggcugagaaaaucuggacc

SEQ ID NO: 481919 - RNA, 22 nt, Human
gcagggcugggugggagacaga

SEQ ID NO: 481920 - RNA, 18 nt, Human
ccagguggugacagagau

SEQ ID NO: 481921 - RNA, 22 nt, Human
uucacagauguauuggaacucc

SEQ ID NO: 481922 - RNA, 22 nt, Human
gcucccugacucaguuccugag

SEQ ID NO: 481923 - RNA, 22 nt, Human
acauuuuuuagagucccacauu

SEQ ID NO: 481924 - RNA, 22 nt, Human
gcagcuuucuugcccuaaucuu

SEQ ID NO: 481925 - RNA, 22 nt, Human
uacacacagaggccaugggauu

SEQ ID NO: 481926 - RNA, 22 nt, Human
cucuggcuuugcucaugcaucc

SEQ ID NO: 481927 - RNA, 22 nt, Human
cccaggcacacugaagugacau

SEQ ID NO: 481928 - RNA, 22 nt, Human
gggaguggauuauguggaccca

SEQ ID NO: 481929 - RNA, 22 nt, Human
uauugaaauucuucauguccuc

SEQ ID NO: 481930 - RNA, 22 nt, Human
aagauuucugcuccugagagaa

SEQ ID NO: 481931 - RNA, 22 nt, Human
gacccaggcccaaggcugccag

SEQ ID NO: 481932 - RNA, 22 nt, Human
acuuguguaacacagaaagaac

SEQ ID NO: 481933 - RNA, 22 nt, Human
gcucuuccauuucucuugaacu

SEQ ID NO: 481934 - RNA, 22 nt, Human
uaauuuaauccaaguguuacau

SEQ ID NO: 481935 - RNA, 20 nt, Human
cucuuaaauguaaaguaggc

SEQ ID NO: 481936 - RNA, 22 nt, Human
gacccagcuaaccaggugggga

SEQ ID NO: 481937 - RNA, 22 nt, Human
cugaggcugcccagggccaggu

SEQ ID NO: 481938 - RNA, 22 nt, Human
ucugcagaaguggcugggccac

SEQ ID NO: 481939 - RNA, 22 nt, Human
aaugcacauguuguaauaaaua

SEQ ID NO: 481940 - RNA, 22 nt, Human
accugaggccuccccagcagac

SEQ ID NO: 481941 - RNA, 22 nt, Human
ggaaagagcuaaaagggugaga

SEQ ID NO: 481942 - RNA, 22 nt, Human
uggguagaggaauugggcuacc

SEQ ID NO: 481943 - RNA, 18 nt, Human
auggucucauacugggag

SEQ ID NO: 481944 - RNA, 22 nt, Human
aaguggugguaugaaccgaggg

SEQ ID NO: 481945 - RNA, 22 nt, Human
uaccugagcccagugcagcaua

SEQ ID NO: 481946 - RNA, 23 nt, Human
uggcuucugccccauucucucca

SEQ ID NO: 481947 - RNA, 22 nt, Human
agggggcccuugcaggugagcg

SEQ ID NO: 481948 - RNA, 22 nt, Human
ucccuggggauguuggccugcc

SEQ ID NO: 481949 - RNA, 22 nt, Human
ggcugggcucgcugauuggcug

SEQ ID NO: 481950 - RNA, 22 nt, Human
ggcuggcacugaggagagcucu

SEQ ID NO: 481951 - RNA, 22 nt, Human
ugggcacuggaagccugcugug

SEQ ID NO: 481952 - RNA, 22 nt, Human
ugggagcucagaaagggagguc

SEQ ID NO: 481953 - RNA, 22 nt, Human
gaagccaguguuugaagaauuu

SEQ ID NO: 481954 - RNA, 22 nt, Human
gaaugcacucacccaucacuca

SEQ ID NO: 481955 - RNA, 22 nt, Human
auuuuucucuccacuccauuaa

SEQ ID NO: 481956 - RNA, 22 nt, Human
cuucuuaaucccuuauauauuu

SEQ ID NO: 481957 - RNA, 22 nt, Human
cggcagcuccgcgccguaggac

SEQ ID NO: 481958 - RNA, 20 nt, Human
cacguuuuuccacuagcaaa

SEQ ID NO: 481959 - RNA, 22 nt, Human
cugcuguguuggcauuggauag

SEQ ID NO: 481960 - RNA, 22 nt, Human
gcugagguggcugccuuaguaa

SEQ ID NO: 481961 - RNA, 22 nt, Human
gggagguucuguucgcacuuga

SEQ ID NO: 481962 - RNA, 22 nt, Human
ugcccacaggaagacaccagcg

SEQ ID NO: 481963 - RNA, 19 nt, Human
ucaucucacagggccuggc

SEQ ID NO: 481964 - RNA, 22 nt, Human
aggcagagcugauguucuguga

SEQ ID NO: 481965 - RNA, 22 nt, Human
acauuucuccuacuuguuauuu

SEQ ID NO: 481966 - RNA, 22 nt, Human
gaggccuggucuaugagauguu

SEQ ID NO: 481967 - RNA, 22 nt, Human
gcuuuauguaaguccaaaggca

SEQ ID NO: 481968 - RNA, 22 nt, Human
gaggccugaaaggggaccuaug

SEQ ID NO: 481969 - RNA, 19 nt, Human
ucugugcugggaggcagca

SEQ ID NO: 481970 - RNA, 22 nt, Human
cuggcugggagcgagcugcuca

SEQ ID NO: 481971 - RNA, 22 nt, Human
uccauaagcagguucuuccuga

SEQ ID NO: 481972 - RNA, 22 nt, Human
gcugguuaggugagggugcgcc

SEQ ID NO: 481973 - RNA, 22 nt, Human
ugucaacacaccuaucucaauu

SEQ ID NO: 481974 - RNA, 16 nt, Human
ccuuucucugccuucc

SEQ ID NO: 481975 - RNA, 22 nt, Human
gcugagugauugauauuuuagu

SEQ ID NO: 481976 - RNA, 22 nt, Human
cauuucugcagaauugcucuuc

SEQ ID NO: 481977 - RNA, 22 nt, Human
ucuggcaggcaaucggcucugg

SEQ ID NO: 481978 - RNA, 22 nt, Human
aggguggcaguuacuggagcaa

SEQ ID NO: 481979 - RNA, 22 nt, Human
uuuuuggguccaggcuguaucu

SEQ ID NO: 481980 - RNA, 22 nt, Human
gagcgggaggaacggcucgggc

SEQ ID NO: 481981 - RNA, 22 nt, Human
uggcucuguugagguauggauu

SEQ ID NO: 481982 - RNA, 23 nt, Human
agccuucaggcaaugucaguaga

SEQ ID NO: 481983 - RNA, 22 nt, Human
agaauaaacugcuuuagggcag

SEQ ID NO: 481984 - RNA, 22 nt, Human
uugcagggcaggaccauggaca

SEQ ID NO: 481985 - RNA, 22 nt, Human
ggcugccugggagcccuccucu

SEQ ID NO: 481986 - RNA, 22 nt, Human
cagggccugcuuccuucuuguu

SEQ ID NO: 481987 - RNA, 22 nt, Human
uggcuggcaaggcuggagucag

SEQ ID NO: 481988 - RNA, 22 nt, Human
agugaguggacccugcaaggaa

SEQ ID NO: 481989 - RNA, 19 nt, Human
gaucuuugccaauuuaagc

SEQ ID NO: 481990 - RNA, 22 nt, Human
ugggaggaaugucacugagcca

SEQ ID NO: 481991 - RNA, 22 nt, Human
ggcaggugugagaucgaggcca

SEQ ID NO: 481992 - RNA, 22 nt, Human
guuugcauuucuugaacuauau

SEQ ID NO: 481993 - RNA, 22 nt, Human
cuagagggauguuaggauagca

SEQ ID NO: 481994 - RNA, 22 nt, Human
cagaggccccagaacuagcucu

SEQ ID NO: 481995 - RNA, 22 nt, Human
agcucccauuaucuucugaaac

SEQ ID NO: 481996 - RNA, 17 nt, Human
aaaauucuguaaagagg

SEQ ID NO: 481997 - RNA, 22 nt, Human
aggcugagcuggcccuugaaau

SEQ ID NO: 481998 - RNA, 22 nt, Human
gaagaacacuucaugauucauu

SEQ ID NO: 481999 - RNA, 22 nt, Human
gguggccucgguggugcacagg

SEQ ID NO: 482000 - RNA, 22 nt, Human
cucucagacugaagggccugug

SEQ ID NO: 482001 - RNA, 22 nt, Human
ugcaccauacccauuccccucu

SEQ ID NO: 482002 - RNA, 22 nt, Human
cuggaguguaaagagcauagaa

SEQ ID NO: 482003 - RNA, 22 nt, Human
uggcccugcuaugauccugcaa

SEQ ID NO: 482004 - RNA, 22 nt, Human
aggucauuccagccauuccccu

SEQ ID NO: 482005 - RNA, 22 nt, Human
uggcuggcccugggagugcaga

SEQ ID NO: 482006 - RNA, 22 nt, Human
gcugucagaaggugaaggguaa

SEQ ID NO: 482007 - RNA, 22 nt, Human
uagagcuggaaaacugcaggua

SEQ ID NO: 482008 - RNA, 22 nt, Human
gcagucaguaaggcagccagaa

SEQ ID NO: 482009 - RNA, 22 nt, Human
aagacauuuauuugaaucaauu

SEQ ID NO: 482010 - RNA, 22 nt, Human
caggggcugagaaggaacgucc

SEQ ID NO: 482011 - RNA, 22 nt, Human
ugggaccugcuccuggaaugag

SEQ ID NO: 482012 - RNA, 22 nt, Human
aggagccaugagugacaucaca

SEQ ID NO: 482013 - RNA, 22 nt, Human
ugaagcaguuacuggguguuaa

SEQ ID NO: 482014 - RNA, 22 nt, Human
agugaaauccuggucaacaggu

SEQ ID NO: 482015 - RNA, 22 nt, Human
ccaggugugcucugcaguggau

SEQ ID NO: 482016 - RNA, 22 nt, Human
aucaggauggguuuggcuuagg

SEQ ID NO: 482017 - RNA, 22 nt, Human
agaggcaggaagagcugauuuu

SEQ ID NO: 482018 - RNA, 22 nt, Human
aaagguuaagguguucaagaaa

SEQ ID NO: 482019 - RNA, 22 nt, Human
aucagucuguguuagaaaagag

SEQ ID NO: 482020 - RNA, 22 nt, Human
ugucagaggcucagggucucag

SEQ ID NO: 482021 - RNA, 22 nt, Human
acaggggaauuuacugucauua

SEQ ID NO: 482022 - RNA, 22 nt, Human
uagggaccuuagaauuguaugu

SEQ ID NO: 482023 - RNA, 22 nt, Human
ugaguccauugauggauaguga

SEQ ID NO: 482024 - RNA, 16 nt, Human
gcaggcagaucacaug

SEQ ID NO: 482025 - RNA, 22 nt, Human
ccagagccccugagcuucccug

SEQ ID NO: 482026 - RNA, 22 nt, Human
ggaggccaggguggguggaucg

SEQ ID NO: 482027 - RNA, 17 nt, Human
acaggcagaucaccuga

SEQ ID NO: 482028 - RNA, 22 nt, Human
cagccugcauuuguaucuguau

SEQ ID NO: 482029 - RNA, 22 nt, Human
aaagcagcagcacguggaagag

SEQ ID NO: 482030 - RNA, 22 nt, Human
ucaguauccacaaaugcucaaa

SEQ ID NO: 482031 - RNA, 22 nt, Human
gggcagguggcaaagccagagg

SEQ ID NO: 482032 - RNA, 22 nt, Human
ggaggccaaggugggcggauca

SEQ ID NO: 482033 - RNA, 22 nt, Human
auuauuagacuuauaugguagu

SEQ ID NO: 482034 - RNA, 22 nt, Human
uaugcacaauaugaucuauuug

SEQ ID NO: 482035 - RNA, 22 nt, Human
ucaguguaaguuauguagaugu

SEQ ID NO: 482036 - RNA, 22 nt, Human
acauuguauaaugauuaucaca

SEQ ID NO: 482037 - RNA, 22 nt, Human
acaguggaugugauguccaggu

SEQ ID NO: 482038 - RNA, 20 nt, Human
ugccaugguaacagagugug

SEQ ID NO: 482039 - RNA, 22 nt, Human
guggauggauugaggcaguggg

SEQ ID NO: 482040 - RNA, 22 nt, Human
cuggagccacugggucuuguau

SEQ ID NO: 482041 - RNA, 22 nt, Human
gugugcaggugucagugcagcu

SEQ ID NO: 482042 - RNA, 22 nt, Human
cugccuguuagucuagcaguua

SEQ ID NO: 482043 - RNA, 23 nt, Human
ucugggcaccuuguugacaugau

SEQ ID NO: 482044 - RNA, 22 nt, Human
aaaguuucaauagaggaagugg

SEQ ID NO: 482045 - RNA, 22 nt, Human
gaugcacuugccccuccucaga

SEQ ID NO: 482046 - RNA, 22 nt, Human
ugucccagcacuuugggagucu

SEQ ID NO: 482047 - RNA, 22 nt, Human
uaaacaugugagugugcauaua

SEQ ID NO: 482048 - RNA, 22 nt, Human
caagaacauugugaucacuuca

SEQ ID NO: 482049 - RNA, 22 nt, Human
gcccagcacauugcugaggacc

SEQ ID NO: 482050 - RNA, 22 nt, Human
cuggccuggggccucagcugcu

SEQ ID NO: 482051 - RNA, 22 nt, Human
gucuccugagccuugacugcaa

SEQ ID NO: 482052 - RNA, 22 nt, Human
cugccuggccugaucuccacgc

SEQ ID NO: 482053 - RNA, 22 nt, Human
cacaggcuugucagcaugaggc

SEQ ID NO: 482054 - RNA, 22 nt, Human
cccagccucugggcucacccaa

SEQ ID NO: 482055 - RNA, 21 nt, Human
aauaaaacaguuggugucaau

SEQ ID NO: 482056 - RNA, 22 nt, Human
agaggggcucaagcaguggucu

SEQ ID NO: 482057 - RNA, 22 nt, Human
aaauauguauggaguucaugaa

SEQ ID NO: 482058 - RNA, 22 nt, Human
gccucugcugacaagauggaca

SEQ ID NO: 482059 - RNA, 22 nt, Human
agugcagagaccuggucaggca

SEQ ID NO: 482060 - RNA, 22 nt, Human
ggccaggcacugugugagauau

SEQ ID NO: 482061 - RNA, 17 nt, Human
ggccuuggggccucagu

SEQ ID NO: 482062 - RNA, 22 nt, Human
uuccauaauaggcuuaagugaa

SEQ ID NO: 482063 - RNA, 22 nt, Human
auugacaagacaauggcucuua

SEQ ID NO: 482064 - RNA, 22 nt, Human
aagggcagcuuaaauugguagc

SEQ ID NO: 482065 - RNA, 22 nt, Human
aucagcaaggcaaucacugcag

SEQ ID NO: 482066 - RNA, 22 nt, Human
uggcagagaugaagaguuguuu

SEQ ID NO: 482067 - RNA, 22 nt, Human
uucuuucagaacacaagugauu

SEQ ID NO: 482068 - RNA, 22 nt, Human
gcagaggcauuucugacgcugc

SEQ ID NO: 482069 - RNA, 22 nt, Human
auuugucuagugguauucacgu

SEQ ID NO: 482070 - RNA, 22 nt, Human
agcaggaaggcuuuggggguuc

SEQ ID NO: 482071 - RNA, 22 nt, Human
ugccagaguuacaugaggguca

SEQ ID NO: 482072 - RNA, 22 nt, Human
agguaggguuaauggagauaua

SEQ ID NO: 482073 - RNA, 22 nt, Human
uggcagcuugaaugcagucuuu

SEQ ID NO: 482074 - RNA, 22 nt, Human
guccuggggaauacagaagccg

SEQ ID NO: 482075 - RNA, 22 nt, Human
ucagcuuuuaaaaacaagaagu

SEQ ID NO: 482076 - RNA, 22 nt, Human
uucagaaagugaaucuuguuau

SEQ ID NO: 482077 - RNA, 22 nt, Human
ggaggccaaggaggagcuugcc

SEQ ID NO: 482078 - RNA, 22 nt, Human
aggcagaggagaaugaucuucc

SEQ ID NO: 482079 - RNA, 22 nt, Human
ucacagacauggugagguaaca

SEQ ID NO: 482080 - RNA, 22 nt, Human
ugccagcccaccuuggggccuc

SEQ ID NO: 482081 - RNA, 22 nt, Human
uuuucauuuacauuagggaaga

SEQ ID NO: 482082 - RNA, 21 nt, Human
agcugagcccagaagacuggu

SEQ ID NO: 482083 - RNA, 21 nt, Human
aguucauacugaguaacaaaa

SEQ ID NO: 482084 - RNA, 22 nt, Human
aaagcagcagcaccugcauuuc

SEQ ID NO: 482085 - RNA, 22 nt, Human
gccuguccuggaugcucugcaa

SEQ ID NO: 482086 - RNA, 22 nt, Human
auaugaagaauuccaauuugga

SEQ ID NO: 482087 - RNA, 22 nt, Human
cugagccagggccacacaugga

SEQ ID NO: 482088 - RNA, 22 nt, Human
ugucucugguauuaggugaaaa

SEQ ID NO: 482089 - RNA, 22 nt, Human
agcuggguggagggcccacggu

SEQ ID NO: 482090 - RNA, 22 nt, Human
gcugccucugcacagcucacuc

SEQ ID NO: 482091 - RNA, 17 nt, Human
agcugagcuggccaggg

SEQ ID NO: 482092 - RNA, 22 nt, Human
uaucuacaggugucagguaaga

SEQ ID NO: 482093 - RNA, 22 nt, Human
aggcagccugguuugaauggaa

SEQ ID NO: 482094 - RNA, 22 nt, Human
gucugucucucuccagagugca

SEQ ID NO: 482095 - RNA, 22 nt, Human
aagugagugguaaggagcaugg

SEQ ID NO: 482096 - RNA, 22 nt, Human
gagcccucucuguaggcaagua

SEQ ID NO: 482097 - RNA, 22 nt, Human
aucuggcucuuccuggaguucc

SEQ ID NO: 482098 - RNA, 22 nt, Human
cacugcuuauaaauucuaggca

SEQ ID NO: 482099 - RNA, 22 nt, Human
uuugaaaguucuucugacacua

SEQ ID NO: 482100 - RNA, 22 nt, Human
ccaucuccacugucccugucaa

SEQ ID NO: 482101 - RNA, 22 nt, Human
agcuuuauggugccucacuuga

SEQ ID NO: 482102 - RNA, 22 nt, Human
uuucacauuuguuuuaagaagu

SEQ ID NO: 482103 - RNA, 22 nt, Human
acuauacauugaauguuaaggu

SEQ ID NO: 482104 - RNA, 22 nt, Human
acaauucucucauaucuuauua

SEQ ID NO: 482105 - RNA, 22 nt, Human
uuguaaauaguaguaagaugcc

SEQ ID NO: 482106 - RNA, 22 nt, Human
guccucagucaguuuggugggg

SEQ ID NO: 482107 - RNA, 22 nt, Human
gaacaauagugguaacaaagcc

SEQ ID NO: 482108 - RNA, 22 nt, Human
gggccacacagaaccuccuggu

SEQ ID NO: 482109 - RNA, 22 nt, Human
gcagggcagcucacugugguuc

SEQ ID NO: 482110 - RNA, 22 nt, Human
guuauguaugagggaaugauua

SEQ ID NO: 482111 - RNA, 22 nt, Human
cucugaccauucccuugauuuu

SEQ ID NO: 482112 - RNA, 22 nt, Human
uguuugaauuuugcuaacgugu

SEQ ID NO: 482113 - RNA, 20 nt, Human
caggcacacucauuccugcu

SEQ ID NO: 482114 - RNA, 22 nt, Human
ucuagaaacaugacauugaucu

SEQ ID NO: 482115 - RNA, 22 nt, Human
accuuucaaaguggcuaucacu

SEQ ID NO: 482116 - RNA, 22 nt, Human
aaggcaguacuuuauguccaua

SEQ ID NO: 482117 - RNA, 22 nt, Human
cagccaccauacagcagaagcu

SEQ ID NO: 482118 - RNA, 22 nt, Human
aggagcugcaaauauuaguaau

SEQ ID NO: 482119 - RNA, 22 nt, Human
ccucagaguaggucucagcugu

SEQ ID NO: 482120 - RNA, 22 nt, Human
uaugcacacaucgcagcaggaa

SEQ ID NO: 482121 - RNA, 22 nt, Human
uuuuccuauaugcaaagaaugc

SEQ ID NO: 482122 - RNA, 22 nt, Human
cccaggcagcggggucuccuug

SEQ ID NO: 482123 - RNA, 16 nt, Human
gagggcagaggcggaa

SEQ ID NO: 482124 - RNA, 22 nt, Human
aggggcagccucacaauccucu

SEQ ID NO: 482125 - RNA, 22 nt, Human
uccucacaagcaagcacaggua

SEQ ID NO: 482126 - RNA, 22 nt, Human
gucaggauguuuauucuccagu

SEQ ID NO: 482127 - RNA, 22 nt, Human
acagggcagagaggcaggcuug

SEQ ID NO: 482128 - RNA, 22 nt, Human
agggugccuggaagccacucac

SEQ ID NO: 482129 - RNA, 22 nt, Human
gucagaggggacaagacacaga

SEQ ID NO: 482130 - RNA, 22 nt, Human
uggcucaguuucaguccugguu

SEQ ID NO: 482131 - RNA, 19 nt, Human
ucauaaggagagaggaaau

SEQ ID NO: 482132 - RNA, 22 nt, Human
gccaggcauuauuccgaucccu

SEQ ID NO: 482133 - RNA, 22 nt, Human
gugcagggcuggcaccggaggc

SEQ ID NO: 482134 - RNA, 22 nt, Human
augucuuuggcuuugacauggc

SEQ ID NO: 482135 - RNA, 22 nt, Human
cuggaugcuuccucucugcuag

SEQ ID NO: 482136 - RNA, 16 nt, Human
cuuccucuucacuggc

SEQ ID NO: 482137 - RNA, 22 nt, Human
ucuggaaguuagaggaggaaag

SEQ ID NO: 482138 - RNA, 22 nt, Human
aggcacugaaggaagcuugcgc

SEQ ID NO: 482139 - RNA, 22 nt, Human
ggcuuuaucaaaugagacccug

SEQ ID NO: 482140 - RNA, 18 nt, Human
aggggcagcuugugugga

SEQ ID NO: 482141 - RNA, 22 nt, Human
uugaaagucacaauggcauuaa

SEQ ID NO: 482142 - RNA, 22 nt, Human
cuggacagaaaaggccacugga

SEQ ID NO: 482143 - RNA, 22 nt, Human
aggcugagauagguggaucauu

SEQ ID NO: 482144 - RNA, 22 nt, Human
aguggcagagccaaguagagcc

SEQ ID NO: 482145 - RNA, 22 nt, Human
cauuuacauuuaagguuaauau

SEQ ID NO: 482146 - RNA, 22 nt, Human
gucaggggccaugggccaagga

SEQ ID NO: 482147 - RNA, 22 nt, Human
caggaagagguaucaccgagca

SEQ ID NO: 482148 - RNA, 23 nt, Human
agggaaaguaguaauggccuuug

SEQ ID NO: 482149 - RNA, 22 nt, Human
uucauucaucucuaaaaugccu

SEQ ID NO: 482150 - RNA, 22 nt, Human
ugaagcccugugucagcuucca

SEQ ID NO: 482151 - RNA, 22 nt, Human
cuggcuuucauuucaagcacgu

SEQ ID NO: 482152 - RNA, 22 nt, Human
cagagcugcacauucuaugaug

SEQ ID NO: 482153 - RNA, 23 nt, Human
acucagagaccccgggaagugac

SEQ ID NO: 482154 - RNA, 22 nt, Human
uuuuucugccauucaaagagga

SEQ ID NO: 482155 - RNA, 22 nt, Human
guguaucaaagcacagacuuca

SEQ ID NO: 482156 - RNA, 22 nt, Human
cagcaggagcagucagacuccu

SEQ ID NO: 482157 - RNA, 22 nt, Human
gggaccugaggcccugcuccac

SEQ ID NO: 482158 - RNA, 22 nt, Human
auaacagauacucucugugagg

SEQ ID NO: 482159 - RNA, 19 nt, Human
uggcagaggacaaggacuu

SEQ ID NO: 482160 - RNA, 22 nt, Human
ucaggggcuugaggugcauguc

SEQ ID NO: 482161 - RNA, 22 nt, Human
aguguugucaaacggcucagca

SEQ ID NO: 482162 - RNA, 22 nt, Human
uggaguucucaggugagggcuu

SEQ ID NO: 482163 - RNA, 22 nt, Human
acuugcauuauauuuaucacaa

SEQ ID NO: 482164 - RNA, 22 nt, Human
aguguuucuggcaaaugaaagu

SEQ ID NO: 482165 - RNA, 22 nt, Human
uauugacaauuugugaaacuau

SEQ ID NO: 482166 - RNA, 22 nt, Human
uggcucaguuaggucagaaaca

SEQ ID NO: 482167 - RNA, 22 nt, Human
aggugccaauuuucagugaaca

SEQ ID NO: 482168 - RNA, 22 nt, Human
agcagggcugugcuccuuccga

SEQ ID NO: 482169 - RNA, 22 nt, Human
gcaggcaggagcccaacugccu

SEQ ID NO: 482170 - RNA, 22 nt, Human
caagccugucucaccagugcua

SEQ ID NO: 482171 - RNA, 22 nt, Human
uggcucaggccuacgacgccuu

SEQ ID NO: 482172 - RNA, 22 nt, Human
uguuaucugagcaacgucgacg

SEQ ID NO: 482173 - RNA, 22 nt, Human
cuggagcagcagguggccaggg

SEQ ID NO: 482174 - RNA, 22 nt, Human
ugggccugaguuugggaacugg

SEQ ID NO: 482175 - RNA, 21 nt, Human
uccuccuucaaguccuggccu

SEQ ID NO: 482176 - RNA, 22 nt, Human
uuugcauugcauuaaguauucu

SEQ ID NO: 482177 - RNA, 22 nt, Human
aggcucugugacaaucaagcug

SEQ ID NO: 482178 - RNA, 22 nt, Human
ucaugcacaugugucaccauca

SEQ ID NO: 482179 - RNA, 22 nt, Human
gcaggggcuacucugagcuucc

SEQ ID NO: 482180 - RNA, 22 nt, Human
aaucaguuguucacucugaaaa

SEQ ID NO: 482181 - RNA, 20 nt, Human
cagaggcauuuucagacucu

SEQ ID NO: 482182 - RNA, 22 nt, Human
agccucugcacgggcacgggug

SEQ ID NO: 482183 - RNA, 22 nt, Human
cuucaagagaaugcagggaugu

SEQ ID NO: 482184 - RNA, 22 nt, Human
acauuuguaugcguuuuuacug

SEQ ID NO: 482185 - RNA, 22 nt, Human
ucauucuccucuggaaaaggca

SEQ ID NO: 482186 - RNA, 22 nt, Human
uggccugguccuugucaaggca

SEQ ID NO: 482187 - RNA, 22 nt, Human
cugcagcugucucuacugggca

SEQ ID NO: 482188 - RNA, 23 nt, Human
uggcucugagcuuccugguggcc

SEQ ID NO: 482189 - RNA, 22 nt, Human
uucauguauuuaucauguaaau

SEQ ID NO: 482190 - RNA, 22 nt, Human
cugagcucuaaugucagccuug

SEQ ID NO: 482191 - RNA, 22 nt, Human
ucagccuuguggcccugcucca

SEQ ID NO: 482192 - RNA, 22 nt, Human
uaaugaauaaacuugagaguca

SEQ ID NO: 482193 - RNA, 22 nt, Human
aggccuggugaaugaaguaucu

SEQ ID NO: 482194 - RNA, 22 nt, Human
auuagcugaccucuaaggagcc

SEQ ID NO: 482195 - RNA, 22 nt, Human
ccagggcaaaugagaucauagc

SEQ ID NO: 482196 - RNA, 22 nt, Human
agacucaagcagauaggaauua

SEQ ID NO: 482197 - RNA, 22 nt, Human
agggcagagauuaauuaagaca

SEQ ID NO: 482198 - RNA, 21 nt, Human
cucuugugucagagccagagg

SEQ ID NO: 482199 - RNA, 22 nt, Human
aaacauuugcaacucgguuugg

SEQ ID NO: 482200 - RNA, 22 nt, Human
cagcugagcucccaggccauca

SEQ ID NO: 482201 - RNA, 22 nt, Human
uuagccauuaauguccugugca

SEQ ID NO: 482202 - RNA, 22 nt, Human
cugagcuuccaguuccuccagg

SEQ ID NO: 482203 - RNA, 22 nt, Human
aaaaguguccagauuaugaaga

SEQ ID NO: 482204 - RNA, 22 nt, Human
cgcccagggcaggaggccgcuc

SEQ ID NO: 482205 - RNA, 22 nt, Human
gacaucauagggugggaggaaa

SEQ ID NO: 482206 - RNA, 22 nt, Human
uagggcuguuuaaaagugaggu

SEQ ID NO: 482207 - RNA, 22 nt, Human
ccaaguacucucaccaaagcuu

SEQ ID NO: 482208 - RNA, 22 nt, Human
ucuggcucagggcucugaggga

SEQ ID NO: 482209 - RNA, 22 nt, Human
uucuucauggguucuuuuagga

SEQ ID NO: 482210 - RNA, 20 nt, Human
guccugggagccacagcaca

SEQ ID NO: 482211 - RNA, 22 nt, Human
aaagcaguauauugguaguugu

SEQ ID NO: 482212 - RNA, 22 nt, Human
accuuuuuguucuguucucagc

SEQ ID NO: 482213 - RNA, 22 nt, Human
ccuggcagguggagguugcagu

SEQ ID NO: 482214 - RNA, 22 nt, Human
agggcugacaguaaaaguauga

SEQ ID NO: 482215 - RNA, 22 nt, Human
gcuggcagguccaagauagagc

SEQ ID NO: 482216 - RNA, 22 nt, Human
cagcugugagcagccaguugcc

SEQ ID NO: 482217 - RNA, 22 nt, Human
auacaugucaucauauguuugu

SEQ ID NO: 482218 - RNA, 22 nt, Human
aucccuggacggcgccucccca

SEQ ID NO: 482219 - RNA, 22 nt, Human
uggccugguuguugcugccguu

SEQ ID NO: 482220 - RNA, 22 nt, Human
gucccagaggcuuuggccacag

SEQ ID NO: 482221 - RNA, 22 nt, Human
ccagugcauaaucaauacagcc

SEQ ID NO: 482222 - RNA, 22 nt, Human
uguggccagcagguggcugugu

SEQ ID NO: 482223 - RNA, 22 nt, Human
agcaggaacgaguucaugggga

SEQ ID NO: 482224 - RNA, 22 nt, Human
gcagcuggauuucaagagggag

SEQ ID NO: 482225 - RNA, 22 nt, Human
uucaauucugcucugaucuuag

SEQ ID NO: 482226 - RNA, 22 nt, Human
acucugaggcaggucagggcag

SEQ ID NO: 482227 - RNA, 22 nt, Human
gguguccuugcagaaggcggcg

SEQ ID NO: 482228 - RNA, 22 nt, Human
gcucaggaaggcucaaccagga

SEQ ID NO: 482229 - RNA, 22 nt, Human
aaaguuugaaugauauauuagu

SEQ ID NO: 482230 - RNA, 21 nt, Human
uucauaaaccauucucaugca

SEQ ID NO: 482231 - RNA, 22 nt, Human
aggguagggcccggagacagac

SEQ ID NO: 482232 - RNA, 22 nt, Human
ugucucugggugauucaguccu

SEQ ID NO: 482233 - RNA, 22 nt, Human
caggcuugauuauucagacaau

SEQ ID NO: 482234 - RNA, 22 nt, Human
uuaacagagugccuggcaugua

SEQ ID NO: 482235 - RNA, 22 nt, Human
cacagggcagagaccugggugc

SEQ ID NO: 482236 - RNA, 22 nt, Human
gcaggggcaggagaucucaggc

SEQ ID NO: 482237 - RNA, 22 nt, Human
uuaaagaugcagcuuuagagaa

SEQ ID NO: 482238 - RNA, 22 nt, Human
cagcugggcuaagaguagaggc

SEQ ID NO: 482239 - RNA, 22 nt, Human
gccugggaagacuaagugggag

SEQ ID NO: 482240 - RNA, 22 nt, Human
uauuucuugaguggucaguuuc

SEQ ID NO: 482241 - RNA, 22 nt, Human
ugggaugggaucucgcuguguc

SEQ ID NO: 482242 - RNA, 18 nt, Human
gggcaagcggcugucacc

SEQ ID NO: 482243 - RNA, 22 nt, Human
ccauggcauuuuaugugucuua

SEQ ID NO: 482244 - RNA, 22 nt, Human
agugaaauuuguuuagauaggu

SEQ ID NO: 482245 - RNA, 22 nt, Human
agcucccagggcugggcaaguu

SEQ ID NO: 482246 - RNA, 22 nt, Human
caggugggaccaugauagggca

SEQ ID NO: 482247 - RNA, 22 nt, Human
agcugugguucugggcagcgac

SEQ ID NO: 482248 - RNA, 22 nt, Human
cauuucauaguugucacaauaa

SEQ ID NO: 482249 - RNA, 16 nt, Human
ucagggcagaauggca

SEQ ID NO: 482250 - RNA, 22 nt, Human
ccagcuuguuugaagcucguca

SEQ ID NO: 482251 - RNA, 23 nt, Human
gggagccauggguggucauggag

SEQ ID NO: 482252 - RNA, 22 nt, Human
cuguugucuucauugucauauc

SEQ ID NO: 482253 - RNA, 22 nt, Human
agccagcuggagaccacuguuu

SEQ ID NO: 482254 - RNA, 22 nt, Human
ucugccugaaauucacauguaa

SEQ ID NO: 482255 - RNA, 22 nt, Human
uccaggcuggaaaugucaaacu

SEQ ID NO: 482256 - RNA, 21 nt, Human
agcagcugggcaacauggagg

SEQ ID NO: 482257 - RNA, 22 nt, Human
uaugaagaaguucugugaaaug

SEQ ID NO: 482258 - RNA, 22 nt, Human
cagcccucagguccucagcagc

SEQ ID NO: 482259 - RNA, 19 nt, Human
ggcuggaguggccaucugu

SEQ ID NO: 482260 - RNA, 22 nt, Human
agcagcauguucauuacauuau

SEQ ID NO: 482261 - RNA, 22 nt, Human
ugugugccagccuacgaggagc

SEQ ID NO: 482262 - RNA, 22 nt, Human
ccuuguccucugguuuccuguu

SEQ ID NO: 482263 - RNA, 22 nt, Human
ccacaaguuucagcacccagag

SEQ ID NO: 482264 - RNA, 22 nt, Human
cagugguggaaugaggaauugu

SEQ ID NO: 482265 - RNA, 22 nt, Human
gugggccuugcagggugcaggg

SEQ ID NO: 482266 - RNA, 22 nt, Human
accaggggugucaacagcauuu

SEQ ID NO: 482267 - RNA, 22 nt, Human
gcccagcagaucucagugucuc

SEQ ID NO: 482268 - RNA, 22 nt, Human
cugucauuuaagacauucugga

SEQ ID NO: 482269 - RNA, 22 nt, Human
cugucuccuccacugcauggga

SEQ ID NO: 482270 - RNA, 22 nt, Human
gauuucuucauucauuagaugg

SEQ ID NO: 482271 - RNA, 22 nt, Human
ggagauggcucugcaaggucua

SEQ ID NO: 482272 - RNA, 22 nt, Human
aaagccuucaaguagauguaag

SEQ ID NO: 482273 - RNA, 22 nt, Human
caagagcugugaccucauucac

SEQ ID NO: 482274 - RNA, 22 nt, Human
gcagcuggggccacacuuaggc

SEQ ID NO: 482275 - RNA, 22 nt, Human
ccuggcugguggcagcgacaag

SEQ ID NO: 482276 - RNA, 19 nt, Human
cagagccucagagcuagaa

SEQ ID NO: 482277 - RNA, 22 nt, Human
agcugacugaugaagaggccuu

SEQ ID NO: 482278 - RNA, 22 nt, Human
ccuggugcuuaccagagcuuuu

SEQ ID NO: 482279 - RNA, 22 nt, Human
uaaagcaggccacauaugugau

SEQ ID NO: 482280 - RNA, 22 nt, Human
ucuggcucuccagugcucuuag

SEQ ID NO: 482281 - RNA, 22 nt, Human
aauggcugggaguguauuuugg

SEQ ID NO: 482282 - RNA, 22 nt, Human
gaaauugucagcuucuuucagu

SEQ ID NO: 482283 - RNA, 20 nt, Human
uauuuagauucaaguaugga

SEQ ID NO: 482284 - RNA, 22 nt, Human
gucacuggggccacaugcagaa

SEQ ID NO: 482285 - RNA, 22 nt, Human
gccuucaggaaaucaguccuug

SEQ ID NO: 482286 - RNA, 22 nt, Human
gcagggucugaggccacagagg

SEQ ID NO: 482287 - RNA, 22 nt, Human
gagaugaauguaaacaaaggca

SEQ ID NO: 482288 - RNA, 19 nt, Human
gguaaaagugagcuucagg

SEQ ID NO: 482289 - RNA, 22 nt, Human
caguuucuucaucaguuaagca

SEQ ID NO: 482290 - RNA, 22 nt, Human
caggggaagaugccaagggaga

SEQ ID NO: 482291 - RNA, 22 nt, Human
aaagccaaaugaaagaugguuc

SEQ ID NO: 482292 - RNA, 22 nt, Human
gauuuucaugauaaacuuguga

SEQ ID NO: 482293 - RNA, 22 nt, Human
caguguacuuggaauguaacag

SEQ ID NO: 482294 - RNA, 22 nt, Human
aguggagaauaugcagaaagcc

SEQ ID NO: 482295 - RNA, 22 nt, Human
ugauuuccuaggucuggagaag

SEQ ID NO: 482296 - RNA, 22 nt, Human
uucuagaugauaaaccagcagc

SEQ ID NO: 482297 - RNA, 22 nt, Human
cagcuugugcaaagguccuggg

SEQ ID NO: 482298 - RNA, 22 nt, Human
uccaggcuagaagucacaggcc

SEQ ID NO: 482299 - RNA, 22 nt, Human
cuauuucugccuaaugaccugu

SEQ ID NO: 482300 - RNA, 22 nt, Human
ucaagagaagugcuccacagua

SEQ ID NO: 482301 - RNA, 22 nt, Human
agcagaggaggauuuaguuagg

SEQ ID NO: 482302 - RNA, 22 nt, Human
accugggagucacaccugagaa

SEQ ID NO: 482303 - RNA, 22 nt, Human
acaguggaauggugggccugca

SEQ ID NO: 482304 - RNA, 22 nt, Human
gugcagagaaaugagaagucga

SEQ ID NO: 482305 - RNA, 19 nt, Human
agggucaggacaaggacuu

SEQ ID NO: 482306 - RNA, 22 nt, Human
uggggugguaauacaccguucu

SEQ ID NO: 482307 - RNA, 19 nt, Human
gcuguauuaaagauacaug

SEQ ID NO: 482308 - RNA, 22 nt, Human
agauuucaauggauauugcaag

SEQ ID NO: 482309 - RNA, 22 nt, Human
gaguggggcguggauccagcgu

SEQ ID NO: 482310 - RNA, 22 nt, Human
ccuggccucuccgaguaaccug

SEQ ID NO: 482311 - RNA, 22 nt, Human
agaggccagcagugccuaucug

SEQ ID NO: 482312 - RNA, 22 nt, Human
aaacacaccuuuggaacuguga

SEQ ID NO: 482313 - RNA, 22 nt, Human
caguggguggcuaaguggcuga

SEQ ID NO: 482314 - RNA, 22 nt, Human
cugggccagauccagccucaca

SEQ ID NO: 482315 - RNA, 22 nt, Human
cagggcucaucugugugaccag

SEQ ID NO: 482316 - RNA, 22 nt, Human
ucaaaguccuugcuuuuucugu

SEQ ID NO: 482317 - RNA, 22 nt, Human
ucaugaaaauagaucagaaauu

SEQ ID NO: 482318 - RNA, 20 nt, Human
uugauaggcagcuugucagg

SEQ ID NO: 482319 - RNA, 22 nt, Human
gucugagaaucuugcauaucau

SEQ ID NO: 482320 - RNA, 22 nt, Human
ucucaggaauagaguggcagca

SEQ ID NO: 482321 - RNA, 22 nt, Human
ugcugguggagaaaguggaggu

SEQ ID NO: 482322 - RNA, 21 nt, Human
gggccacaccuucugcagacc

SEQ ID NO: 482323 - RNA, 22 nt, Human
agggcaugugggagaggagccu

SEQ ID NO: 482324 - RNA, 22 nt, Human
uugcucugaacccagggcacca

SEQ ID NO: 482325 - RNA, 21 nt, Human
agcagcugcaguuucuaucug

SEQ ID NO: 482326 - RNA, 22 nt, Human
agugcagagagcaauacucuac

SEQ ID NO: 482327 - RNA, 22 nt, Human
uuacaaagaguguucuuuucca

SEQ ID NO: 482328 - RNA, 22 nt, Human
ugcuugggaauguggagucaga

SEQ ID NO: 482329 - RNA, 22 nt, Human
ccagaagggcuauugcagugac

SEQ ID NO: 482330 - RNA, 17 nt, Human
agguggcugcugcgccu

SEQ ID NO: 482331 - RNA, 22 nt, Human
guauuaggagguggagccuuug

SEQ ID NO: 482332 - RNA, 22 nt, Human
uuagaucuuaggcaaauguguu

SEQ ID NO: 482333 - RNA, 22 nt, Human
acuguacaacugcugagcagaa

SEQ ID NO: 482334 - RNA, 22 nt, Human
auuucacucauucauguuacuu

SEQ ID NO: 482335 - RNA, 22 nt, Human
cuuacauugugugcaugagggg

SEQ ID NO: 482336 - RNA, 22 nt, Human
auagauauuugaguuguuucca

SEQ ID NO: 482337 - RNA, 20 nt, Human
ugcuggggacauacagggug

SEQ ID NO: 482338 - RNA, 22 nt, Human
gacauucacaguuuccgauggu

SEQ ID NO: 482339 - RNA, 22 nt, Human
uaaggcaccauaauauauuuaa

SEQ ID NO: 482340 - RNA, 21 nt, Human
uucuacaggaugaaugaaaac

SEQ ID NO: 482341 - RNA, 22 nt, Human
ucucucagggggaaggcugaag

SEQ ID NO: 482342 - RNA, 22 nt, Human
ggagcuguuggcagcuaucuug

SEQ ID NO: 482343 - RNA, 22 nt, Human
cagagcuguuacuauucaugaa

SEQ ID NO: 482344 - RNA, 22 nt, Human
agugccaggagcaaggagcucc

SEQ ID NO: 482345 - RNA, 22 nt, Human
uuugaaagacagaauauuuuug

SEQ ID NO: 482346 - RNA, 22 nt, Human
aaacuucagugaaugacuuaug

SEQ ID NO: 482347 - RNA, 17 nt, Human
ugcauguccuuuguucc

SEQ ID NO: 482348 - RNA, 22 nt, Human
augacagaaggccucccugaca

SEQ ID NO: 482349 - RNA, 22 nt, Human
gugugcagggggccagcgcagc

SEQ ID NO: 482350 - RNA, 22 nt, Human
ccagggcagugggagaaggugc

SEQ ID NO: 482351 - RNA, 22 nt, Human
ggagacagugacuuagagacug

SEQ ID NO: 482352 - RNA, 22 nt, Human
ccuggcagcaggugggcccgug

SEQ ID NO: 482353 - RNA, 22 nt, Human
gggcugagugucccaggccgaa

SEQ ID NO: 482354 - RNA, 21 nt, Human
ucccacucuaaauggacugaa

SEQ ID NO: 482355 - RNA, 22 nt, Human
ggggacaguuaaagaccaagac

SEQ ID NO: 482356 - RNA, 22 nt, Human
ggccucugcaacuggcuguggc

SEQ ID NO: 482357 - RNA, 22 nt, Human
aggccagaaaugucagggagug

SEQ ID NO: 482358 - RNA, 22 nt, Human
ccacagaggacaacugccuggc

SEQ ID NO: 482359 - RNA, 22 nt, Human
agaugcugugucuguucccuug

SEQ ID NO: 482360 - RNA, 22 nt, Human
aaugauuggcacuagauacaca

SEQ ID NO: 482361 - RNA, 22 nt, Human
agauguaaacucucaugucauu

SEQ ID NO: 482362 - RNA, 22 nt, Human
agagcugcaccuaugcagaccu

SEQ ID NO: 482363 - RNA, 22 nt, Human
ccugggcagggagaccaggcuc

SEQ ID NO: 482364 - RNA, 22 nt, Human
guugggaagcagauggaugagc

SEQ ID NO: 482365 - RNA, 18 nt, Human
accugccuguucuucucu

SEQ ID NO: 482366 - RNA, 22 nt, Human
aacaaaugauuguugguuggag

SEQ ID NO: 482367 - RNA, 22 nt, Human
cuguuuucaaagagagagaaug

SEQ ID NO: 482368 - RNA, 22 nt, Human
ucagugcuucggcgagcaccua

SEQ ID NO: 482369 - RNA, 22 nt, Human
ggugucuguugccuccugguua

SEQ ID NO: 482370 - RNA, 22 nt, Human
gccugccugcugugugcaaguu

SEQ ID NO: 482371 - RNA, 22 nt, Human
gcuguggccuggcgcagagcug

SEQ ID NO: 482372 - RNA, 22 nt, Human
gagccaccuucaacucaggaau

SEQ ID NO: 482373 - RNA, 22 nt, Human
ggucccaggaagugcggcggcg

SEQ ID NO: 482374 - RNA, 22 nt, Human
ucaggaauccagacagggcaca

SEQ ID NO: 482375 - RNA, 22 nt, Human
gagagaagaauguuccgaggcc

SEQ ID NO: 482376 - RNA, 22 nt, Human
cugcugugagugguucuugccu

SEQ ID NO: 482377 - RNA, 22 nt, Human
acagggccaggugagaggugcu

SEQ ID NO: 482378 - RNA, 22 nt, Human
aguauuucugcucaugaaagag

SEQ ID NO: 482379 - RNA, 22 nt, Human
ugggccugggagggcagacgcu

SEQ ID NO: 482380 - RNA, 22 nt, Human
aaguguuuauuuauaacgaucu

SEQ ID NO: 482381 - RNA, 18 nt, Human
gugagcagagagcaucac

SEQ ID NO: 482382 - RNA, 22 nt, Human
gcucugucaacagcuagcugug

SEQ ID NO: 482383 - RNA, 19 nt, Human
auuuccaagaauuggagag

SEQ ID NO: 482384 - RNA, 22 nt, Human
aagagcugcacauauuuauauc

SEQ ID NO: 482385 - RNA, 22 nt, Human
acauacuaugaauacauguguc

SEQ ID NO: 482386 - RNA, 22 nt, Human
ugcucuggggagcuccucugcg

SEQ ID NO: 482387 - RNA, 21 nt, Human
ccaggcuccugaggcugguca

SEQ ID NO: 482388 - RNA, 22 nt, Human
cggcugaggaucuccaggccug

SEQ ID NO: 482389 - RNA, 22 nt, Human
caggccugucugcacaugaggc

SEQ ID NO: 482390 - RNA, 22 nt, Human
agagggcauuaacucugucuug

SEQ ID NO: 482391 - RNA, 22 nt, Human
ugcugccacauuuaaagagggg

SEQ ID NO: 482392 - RNA, 22 nt, Human
auccaaaucaugucagaagaac

SEQ ID NO: 482393 - RNA, 22 nt, Human
aggagcugucagagugccagag

SEQ ID NO: 482394 - RNA, 22 nt, Human
ucagaggaccuuacugagaacc

SEQ ID NO: 482395 - RNA, 22 nt, Human
caggagcccguugcuccggcgg

SEQ ID NO: 482396 - RNA, 22 nt, Human
uaaucacaucaggguaaauggg

SEQ ID NO: 482397 - RNA, 22 nt, Human
gcagauggcagcccaggcuggg

SEQ ID NO: 482398 - RNA, 22 nt, Human
agggcuccuaugaugcucugcc

SEQ ID NO: 482399 - RNA, 22 nt, Human
uggagccugagucagcggaggc

SEQ ID NO: 482400 - RNA, 22 nt, Human
ucccagcgcggggggaggaucc

SEQ ID NO: 482401 - RNA, 22 nt, Human
agcaauauuuaaagguuugcaa

SEQ ID NO: 482402 - RNA, 22 nt, Human
cgcuggccauagccuccugugu

SEQ ID NO: 482403 - RNA, 22 nt, Human
ugcugccacaaauucagcugcc

SEQ ID NO: 482404 - RNA, 22 nt, Human
ugccuggguucccaccccaaag

SEQ ID NO: 482405 - RNA, 22 nt, Human
gggcugagagcuggaaucugag

SEQ ID NO: 482406 - RNA, 22 nt, Human
caggucagaggcgcagccccca

SEQ ID NO: 482407 - RNA, 22 nt, Human
uacacacaugcauuugccuuau

SEQ ID NO: 482408 - RNA, 22 nt, Human
agcagagcgccugcucagaggg

SEQ ID NO: 482409 - RNA, 21 nt, Human
agaaaaacacgauauaagccc

SEQ ID NO: 482410 - RNA, 19 nt, Human
aggaaagguggccuuagca

SEQ ID NO: 482411 - RNA, 22 nt, Human
uagaaaguaaaucaguuuuauu

SEQ ID NO: 482412 - RNA, 22 nt, Human
uguccucaaggagcuucagucu

SEQ ID NO: 482413 - RNA, 22 nt, Human
cuggugagacgguugacaggag

SEQ ID NO: 482414 - RNA, 22 nt, Human
ugcucacagcccagaacauaau

SEQ ID NO: 482415 - RNA, 22 nt, Human
aaaaaugcuuggacuuaauaaa

SEQ ID NO: 482416 - RNA, 22 nt, Human
ucagcaguguaguuuaucauuc

SEQ ID NO: 482417 - RNA, 16 nt, Human
gcagaggaaaggggag

SEQ ID NO: 482418 - RNA, 21 nt, Human
uggcaggcagcuggaagcuug

SEQ ID NO: 482419 - RNA, 22 nt, Human
acugucugcaaaacucauacuc

SEQ ID NO: 482420 - RNA, 20 nt, Human
aggcucaggguguuuaggaa

SEQ ID NO: 482421 - RNA, 22 nt, Human
caggcauggugagaacucagcc

SEQ ID NO: 482422 - RNA, 22 nt, Human
cuccagggaugagacagaguag

SEQ ID NO: 482423 - RNA, 22 nt, Human
ccuggagcccaaggcagugaga

SEQ ID NO: 482424 - RNA, 22 nt, Human
uucuucaaaauccagcaugauu

SEQ ID NO: 482425 - RNA, 22 nt, Human
auuuguaauuucuuaucugugu

SEQ ID NO: 482426 - RNA, 22 nt, Human
agcugucuuucugccuccugau

SEQ ID NO: 482427 - RNA, 22 nt, Human
aguggcagagcaggugcuggaa

SEQ ID NO: 482428 - RNA, 22 nt, Human
uuccucaggcuucccuuugucc

SEQ ID NO: 482429 - RNA, 22 nt, Human
acaggccugagauuuugcauuu

SEQ ID NO: 482430 - RNA, 22 nt, Human
augggaggaugcucgggugcuc

SEQ ID NO: 482431 - RNA, 22 nt, Human
cugccucaugcugccugcagcc

SEQ ID NO: 482432 - RNA, 22 nt, Human
uugucuuuggaaauuuaauguu

SEQ ID NO: 482433 - RNA, 22 nt, Human
aaagccagcaaggugaguuuca

SEQ ID NO: 482434 - RNA, 22 nt, Human
cagccaggagcucccccugcuc

SEQ ID NO: 482435 - RNA, 22 nt, Human
agaggccacuuugccugugaug

SEQ ID NO: 482436 - RNA, 22 nt, Human
uagcugccaaaagggugggcua

SEQ ID NO: 482437 - RNA, 22 nt, Human
cagggccaguucucgcagcagu

SEQ ID NO: 482438 - RNA, 22 nt, Human
ucagaggagaaguugggaaaau

SEQ ID NO: 482439 - RNA, 22 nt, Human
acuguggcgucaggaagaaauu

SEQ ID NO: 482440 - RNA, 22 nt, Human
ggugggcaggucacucugccuc

SEQ ID NO: 482441 - RNA, 22 nt, Human
gagcuuuaccuuagguucuguu

SEQ ID NO: 482442 - RNA, 22 nt, Human
aacaaccaaaaagaugaaugua

SEQ ID NO: 482443 - RNA, 22 nt, Human
cucaggagaugacagaagguau

SEQ ID NO: 482444 - RNA, 22 nt, Human
agaagggccagcuggacaccug

SEQ ID NO: 482445 - RNA, 22 nt, Human
ucgagucauguucucccauuaa

SEQ ID NO: 482446 - RNA, 22 nt, Human
uagagcugcuggacuguaacag

SEQ ID NO: 482447 - RNA, 22 nt, Human
cugcucuggucucuucauguuu

SEQ ID NO: 482448 - RNA, 22 nt, Human
aaaugugcuugugaucagcugu

SEQ ID NO: 482449 - RNA, 22 nt, Human
ccucuggcaacuucacagccca

SEQ ID NO: 482450 - RNA, 22 nt, Human
uucucuuauucuggauaugcag

SEQ ID NO: 482451 - RNA, 22 nt, Human
uagccaggcgaggucagugucg

SEQ ID NO: 482452 - RNA, 20 nt, Human
gcugccagugccugaugcuu

SEQ ID NO: 482453 - RNA, 19 nt, Human
ccagguggaacugagguag

SEQ ID NO: 482454 - RNA, 22 nt, Human
uuugcauuuccagaguagcaga

SEQ ID NO: 482455 - RNA, 22 nt, Human
cccaggcuggagugcaauggca

SEQ ID NO: 482456 - RNA, 22 nt, Human
aggaaagcucccaguagggcuc

SEQ ID NO: 482457 - RNA, 22 nt, Human
cucaggaggaugacugccuugg

SEQ ID NO: 482458 - RNA, 22 nt, Human
agcagggcaaagucaggcuaac

SEQ ID NO: 482459 - RNA, 19 nt, Human
aggcagcauucuggggcuu

SEQ ID NO: 482460 - RNA, 22 nt, Human
gcaggcagagucaauuugaucc

SEQ ID NO: 482461 - RNA, 22 nt, Human
uugcaagacacuuggaagcaca

SEQ ID NO: 482462 - RNA, 22 nt, Human
uuguacaaaggauuuggaagag

SEQ ID NO: 482463 - RNA, 22 nt, Human
guaagggauuugaacauagguu

SEQ ID NO: 482464 - RNA, 22 nt, Human
acugaaggucucagcaaggaug

SEQ ID NO: 482465 - RNA, 22 nt, Human
cagagccuaaaacgacuccacu

SEQ ID NO: 482466 - RNA, 16 nt, Human
gggcugggggauucug

SEQ ID NO: 482467 - RNA, 22 nt, Human
aaaugcagaucccugaaucuca

SEQ ID NO: 482468 - RNA, 22 nt, Human
gugccugcugcagagucgcugu

SEQ ID NO: 482469 - RNA, 22 nt, Human
ccaggguuuaaauucugacuau

SEQ ID NO: 482470 - RNA, 22 nt, Human
cccuuccucccaggcuucugug

SEQ ID NO: 482471 - RNA, 22 nt, Human
gcagaggagugauuaugccgug

SEQ ID NO: 482472 - RNA, 22 nt, Human
agugaaaacacuaguucuugcc

SEQ ID NO: 482473 - RNA, 22 nt, Human
uuaguuagucccugguaccuuu

SEQ ID NO: 482474 - RNA, 22 nt, Human
gcugcucuugaggggcucacug

SEQ ID NO: 482475 - RNA, 22 nt, Human
auucuagaugcuguaaguagca

SEQ ID NO: 482476 - RNA, 22 nt, Human
cagcuggcccuuugguagccuu

SEQ ID NO: 482477 - RNA, 22 nt, Human
gcagagcuaucuucuggauuug

SEQ ID NO: 482478 - RNA, 22 nt, Human
acaugauuaaaagauuuuaaag

SEQ ID NO: 482479 - RNA, 22 nt, Human
cagaguguugaccauaagccca

SEQ ID NO: 482480 - RNA, 22 nt, Human
ugggauggagccugaguauagu

SEQ ID NO: 482481 - RNA, 22 nt, Human
uggcagcacaagguggcccaug

SEQ ID NO: 482482 - RNA, 22 nt, Human
uaaacaagcugucugauauucu

SEQ ID NO: 482483 - RNA, 22 nt, Human
agagcuguggauaguccuggau

SEQ ID NO: 482484 - RNA, 22 nt, Human
cagcugagaccagaaugcaggu

SEQ ID NO: 482485 - RNA, 22 nt, Human
ucaaacuagccugacugguauu

SEQ ID NO: 482486 - RNA, 22 nt, Human
gccuggucucuuucaugucagu

SEQ ID NO: 482487 - RNA, 22 nt, Human
gggcagcucucacagcagccaa

SEQ ID NO: 482488 - RNA, 22 nt, Human
aaucuuucccuauuaaaugugg

SEQ ID NO: 482489 - RNA, 22 nt, Human
ccagagagggcgccaccuggag

SEQ ID NO: 482490 - RNA, 21 nt, Human
cagaggcaggcucugugugug

SEQ ID NO: 482491 - RNA, 22 nt, Human
guauuagggccaaaggcaggaa

SEQ ID NO: 482492 - RNA, 22 nt, Human
agagggcuggacgcagguugga

SEQ ID NO: 482493 - RNA, 22 nt, Human
agggggugcuacuuccagaguu

SEQ ID NO: 482494 - RNA, 22 nt, Human
uggggagugaugccucggauaa

SEQ ID NO: 482495 - RNA, 22 nt, Human
uucaggauggcggauguugggg

SEQ ID NO: 482496 - RNA, 22 nt, Human
guagggacaauauguuauuaga

SEQ ID NO: 482497 - RNA, 22 nt, Human
agggcugacaaauggcagugac

SEQ ID NO: 482498 - RNA, 22 nt, Human
ccuggcagacagcacugaagcu

SEQ ID NO: 482499 - RNA, 21 nt, Human
agucccaggggugagugaugu

SEQ ID NO: 482500 - RNA, 22 nt, Human
uugggcucaggaguuugagacc

SEQ ID NO: 482501 - RNA, 22 nt, Human
cagucccaguuugagacucugg

SEQ ID NO: 482502 - RNA, 22 nt, Human
aggcagccagauggcagccugc

SEQ ID NO: 482503 - RNA, 22 nt, Human
gaggggaagacuucuggacagu

SEQ ID NO: 482504 - RNA, 22 nt, Human
gcauggcaagaucaggagacca

SEQ ID NO: 482505 - RNA, 22 nt, Human
ggggauggauuccgggucccug

SEQ ID NO: 482506 - RNA, 22 nt, Human
uuauuuucuccucagaaagugg

SEQ ID NO: 482507 - RNA, 22 nt, Human
acauuucuuccuaauuaucccu

SEQ ID NO: 482508 - RNA, 22 nt, Human
uguguacacaaugauugcagag

SEQ ID NO: 482509 - RNA, 22 nt, Human
cccagacucaucccugggagcu

SEQ ID NO: 482510 - RNA, 22 nt, Human
auguaacuguuauauuuuguug

SEQ ID NO: 482511 - RNA, 22 nt, Human
gccugccugaaggcuguaccag

SEQ ID NO: 482512 - RNA, 20 nt, Human
ccucucugaagaggucaucu

SEQ ID NO: 482513 - RNA, 22 nt, Human
ucacaacucuuuccauuuaaua

SEQ ID NO: 482514 - RNA, 22 nt, Human
uaauuucuaauucauuuucagu

SEQ ID NO: 482515 - RNA, 22 nt, Human
aaagaggaaccaagagcacgug

SEQ ID NO: 482516 - RNA, 22 nt, Human
gccaggcagcaggaagccagug

SEQ ID NO: 482517 - RNA, 22 nt, Human
aagaggaacugggggcugaguc

SEQ ID NO: 482518 - RNA, 22 nt, Human
ugauggcuaucccuggaagggc

SEQ ID NO: 482519 - RNA, 22 nt, Human
ggugccaggcuguagucagggu

SEQ ID NO: 482520 - RNA, 22 nt, Human
agagaggcugggcguagggcuu

SEQ ID NO: 482521 - RNA, 22 nt, Human
uucuuuccccauggaguucgga

SEQ ID NO: 482522 - RNA, 22 nt, Human
ucucacucauuuccuaggucuu

SEQ ID NO: 482523 - RNA, 23 nt, Human
gagagcugacugucaagacuguu

SEQ ID NO: 482524 - RNA, 21 nt, Human
ugaaugaggaggauggcauuu

SEQ ID NO: 482525 - RNA, 22 nt, Human
ugcuggggguucagaugaguaa

SEQ ID NO: 482526 - RNA, 22 nt, Human
gccagcuggagacuggcagggg

SEQ ID NO: 482527 - RNA, 22 nt, Human
uggagccagcccaggccccucu

SEQ ID NO: 482528 - RNA, 22 nt, Human
agaggccuccgaaaggugggcu

SEQ ID NO: 482529 - RNA, 22 nt, Human
uuugaaauaugaggcauuauga

SEQ ID NO: 482530 - RNA, 22 nt, Human
ucaggcugcccguucagggcuc

SEQ ID NO: 482531 - RNA, 22 nt, Human
ucugucacuauuggccagaaca

SEQ ID NO: 482532 - RNA, 22 nt, Human
guuugcauuccaauuuagggga

SEQ ID NO: 482533 - RNA, 22 nt, Human
agagugaaaagcuagagcagua

SEQ ID NO: 482534 - RNA, 22 nt, Human
aauucuauaggcaagcuauuuu

SEQ ID NO: 482535 - RNA, 22 nt, Human
gaggcuggugguuaguuccauu

SEQ ID NO: 482536 - RNA, 22 nt, Human
cugcccugcccaggccuugggc

SEQ ID NO: 482537 - RNA, 22 nt, Human
aagccagggucaggggccuccu

SEQ ID NO: 482538 - RNA, 22 nt, Human
gagucugagaacugggcucagu

SEQ ID NO: 482539 - RNA, 22 nt, Human
ugcaguggaggccgugagacag

SEQ ID NO: 482540 - RNA, 22 nt, Human
agguaguguagcugagugggau

SEQ ID NO: 482541 - RNA, 22 nt, Human
ugacagcugagccccaggcaag

SEQ ID NO: 482542 - RNA, 22 nt, Human
ugcacacaaguuggagaaugaa

SEQ ID NO: 482543 - RNA, 22 nt, Human
aucuggaaaacacaguguagac

SEQ ID NO: 482544 - RNA, 22 nt, Human
caguguuccaggcggcagugaa

SEQ ID NO: 482545 - RNA, 22 nt, Human
gagcuuccacucuagaaggagu

SEQ ID NO: 482546 - RNA, 22 nt, Human
gggggcaguaaccucaaagugu

SEQ ID NO: 482547 - RNA, 22 nt, Human
gaggaaugucagcacaggccuc

SEQ ID NO: 482548 - RNA, 22 nt, Human
ggugacuggagggacccaggcc

SEQ ID NO: 482549 - RNA, 22 nt, Human
cuggcuggucaucagcaguacg

SEQ ID NO: 482550 - RNA, 22 nt, Human
aaucuggcauguaagcuuagag

SEQ ID NO: 482551 - RNA, 22 nt, Human
cacaggguuguucugaggauuc

SEQ ID NO: 482552 - RNA, 22 nt, Human
uccagagcagguggucagaagg

SEQ ID NO: 482553 - RNA, 22 nt, Human
ugcagggccaugguggcggcug

SEQ ID NO: 482554 - RNA, 21 nt, Human
ugaagccugaggcauagcccc

SEQ ID NO: 482555 - RNA, 22 nt, Human
ccugccuguaagauggguacaa

SEQ ID NO: 482556 - RNA, 22 nt, Human
cuuccucccggcccaugcucug

SEQ ID NO: 482557 - RNA, 22 nt, Human
aggaggccgggauucuggagau

SEQ ID NO: 482558 - RNA, 22 nt, Human
ggcaaaaaccauaauuacuuuu

SEQ ID NO: 482559 - RNA, 22 nt, Human
cugaaggagcauagucaguuuu

SEQ ID NO: 482560 - RNA, 22 nt, Human
aaggggaauagaguggguugug

SEQ ID NO: 482561 - RNA, 19 nt, Human
gaggaggaaaacuagugua

SEQ ID NO: 482562 - RNA, 22 nt, Human
uuaaguccuugguaauuuucuu

SEQ ID NO: 482563 - RNA, 22 nt, Human
agucucuuggcauucugaaaca

SEQ ID NO: 482564 - RNA, 22 nt, Human
aggcugcuuucauggccgcccc

SEQ ID NO: 482565 - RNA, 22 nt, Human
cccagccaaggugcugguguug

SEQ ID NO: 482566 - RNA, 22 nt, Human
ccaguccuggccaguaacauga

SEQ ID NO: 482567 - RNA, 17 nt, Human
ugccagccugucccagg

SEQ ID NO: 482568 - RNA, 22 nt, Human
gagcuggcuaauacugacuuau

SEQ ID NO: 482569 - RNA, 22 nt, Human
aggcuucagaaagaguaauugg

SEQ ID NO: 482570 - RNA, 22 nt, Human
cucagaagaacaaaggcucuac

SEQ ID NO: 482571 - RNA, 22 nt, Human
uggcuggcgccgggcuagccac

SEQ ID NO: 482572 - RNA, 22 nt, Human
cuucuuaaugcauaaacugugu

SEQ ID NO: 482573 - RNA, 20 nt, Human
ucagccagcuaacaugggga

SEQ ID NO: 482574 - RNA, 22 nt, Human
cucaggauccaucuccugcccu

SEQ ID NO: 482575 - RNA, 23 nt, Human
ugugaagguggguccaagggcug

SEQ ID NO: 482576 - RNA, 22 nt, Human
uuucagugcuucuguuuaccgg

SEQ ID NO: 482577 - RNA, 22 nt, Human
caggcacuggggaugcugggau

SEQ ID NO: 482578 - RNA, 22 nt, Human
gcuuuuucaaaugaaagcuggu

SEQ ID NO: 482579 - RNA, 22 nt, Human
uccucuggauauaagccucacc

SEQ ID NO: 482580 - RNA, 22 nt, Human
ggcaaaaacagcaaugacuuuu

SEQ ID NO: 482581 - RNA, 18 nt, Human
uggagcaggaagccuggc

SEQ ID NO: 482582 - RNA, 21 nt, Human
gcagagccugagguucuugag

SEQ ID NO: 482583 - RNA, 22 nt, Human
uacugugaauacaaaauaaauu

SEQ ID NO: 482584 - RNA, 22 nt, Human
aaucuggcauuugagaguagga

SEQ ID NO: 482585 - RNA, 22 nt, Human
ccaagggcucugacuugccugc

SEQ ID NO: 482586 - RNA, 22 nt, Human
ucacuugccuagcccaguucag

SEQ ID NO: 482587 - RNA, 22 nt, Human
gacagaagaggaacuuggacag

SEQ ID NO: 482588 - RNA, 22 nt, Human
agaacuguccuuggaggagagu

SEQ ID NO: 482589 - RNA, 22 nt, Human
uagaucugauacaauucaucug

SEQ ID NO: 482590 - RNA, 22 nt, Human
uaggcagcugcaaacuucgguc

SEQ ID NO: 482591 - RNA, 22 nt, Human
ugggcugcugucugcacaugcu

SEQ ID NO: 482592 - RNA, 22 nt, Human
cagaaauguucuaaugauucag

SEQ ID NO: 482593 - RNA, 22 nt, Human
cugccuugaggagguuguggga

SEQ ID NO: 482594 - RNA, 22 nt, Human
caggaagagaacauggaggcug

SEQ ID NO: 482595 - RNA, 22 nt, Human
cugcuuugaggggcucuguaua

SEQ ID NO: 482596 - RNA, 22 nt, Human
ggacucagcagccaggaguggc

SEQ ID NO: 482597 - RNA, 22 nt, Human
agcugacucuggccucuggucc

SEQ ID NO: 482598 - RNA, 22 nt, Human
agcagcaucucuuauugcagug

SEQ ID NO: 482599 - RNA, 19 nt, Human
ugcagaggguaggaaggcc

SEQ ID NO: 482600 - RNA, 22 nt, Human
agggccagcccauaaugccaaa

SEQ ID NO: 482601 - RNA, 19 nt, Human
agcuuccauauucucuagu

SEQ ID NO: 482602 - RNA, 22 nt, Human
caggagcugggucuggaagcag

SEQ ID NO: 482603 - RNA, 22 nt, Human
cauucucaauaguagaugagua

SEQ ID NO: 482604 - RNA, 22 nt, Human
ugauugaacugagcuucaagau

SEQ ID NO: 482605 - RNA, 22 nt, Human
caggcagcugacugucagauau

SEQ ID NO: 482606 - RNA, 22 nt, Human
ucaagauaccaccauuauaugu

SEQ ID NO: 482607 - RNA, 22 nt, Human
acuuccuggcguagcugacauu

SEQ ID NO: 482608 - RNA, 22 nt, Human
gugcauuugacgaauacucacu

SEQ ID NO: 482609 - RNA, 22 nt, Human
aaucaguuguccaaaguucaca

SEQ ID NO: 482610 - RNA, 22 nt, Human
cagggcagccaggccccguggg

SEQ ID NO: 482611 - RNA, 22 nt, Human
aagcagagccaccagcuuugga

SEQ ID NO: 482612 - RNA, 22 nt, Human
uaagaacagugacagccaacau

SEQ ID NO: 482613 - RNA, 22 nt, Human
auaaguucagguaaagaaauca

SEQ ID NO: 482614 - RNA, 22 nt, Human
acagcaggauuuggcgauguug

SEQ ID NO: 482615 - RNA, 22 nt, Human
auuauuagauucuuaauuguaa

SEQ ID NO: 482616 - RNA, 22 nt, Human
ugcauuauuugcaugugccugu

SEQ ID NO: 482617 - RNA, 22 nt, Human
ggcagaguugguggagucaguu

SEQ ID NO: 482618 - RNA, 22 nt, Human
ugcagggcuaagucagagccug

SEQ ID NO: 482619 - RNA, 22 nt, Human
cagggaguuuuuguuccucuag

SEQ ID NO: 482620 - RNA, 18 nt, Human
uggcucugcagccagaug

SEQ ID NO: 482621 - RNA, 22 nt, Human
ugaauaaacuaugaggaggaau

SEQ ID NO: 482622 - RNA, 22 nt, Human
caggagugaaaugaggcccagg

SEQ ID NO: 482623 - RNA, 23 nt, Human
cccagcagauuguaaagugucca

SEQ ID NO: 482624 - RNA, 22 nt, Human
gugaaggcuacaagagaucaag

SEQ ID NO: 482625 - RNA, 22 nt, Human
aggcuuccuggaggaagaggua

SEQ ID NO: 482626 - RNA, 22 nt, Human
ugaugcugcugggaguggugcu

SEQ ID NO: 482627 - RNA, 22 nt, Human
accugaggcuguuagucuaggu

SEQ ID NO: 482628 - RNA, 22 nt, Human
ugucccagucaaggcugucauc

SEQ ID NO: 482629 - RNA, 22 nt, Human
ugcccuguuaucuuggaagagu

SEQ ID NO: 482630 - RNA, 22 nt, Human
gcaggaggaucacuugagccca

SEQ ID NO: 482631 - RNA, 22 nt, Human
aaggccagcuuguagggcuggu

SEQ ID NO: 482632 - RNA, 22 nt, Human
gcugucaggaacaugccuuggu

SEQ ID NO: 482633 - RNA, 22 nt, Human
gccugugcauagcagcggacuc

SEQ ID NO: 482634 - RNA, 22 nt, Human
cccagcauccucagggagcggg

SEQ ID NO: 482635 - RNA, 22 nt, Human
gcuuccugagaaacaaucugau

SEQ ID NO: 482636 - RNA, 22 nt, Human
agucuccuuggccucaaugccu

SEQ ID NO: 482637 - RNA, 22 nt, Human
agcagcugggcucagagcuggg

SEQ ID NO: 482638 - RNA, 22 nt, Human
aggcucccaagcacugacccca

SEQ ID NO: 482639 - RNA, 22 nt, Human
gccagcaguauguccuggcagu

SEQ ID NO: 482640 - RNA, 22 nt, Human
agcagccaagguaaccugugcu

SEQ ID NO: 482641 - RNA, 22 nt, Human
aggguggagggagucccugagc

SEQ ID NO: 482642 - RNA, 22 nt, Human
ugugcagcuaguccuggacuug

SEQ ID NO: 482643 - RNA, 22 nt, Human
agguacagggugaaaguuuaug

SEQ ID NO: 482644 - RNA, 22 nt, Human
uggauuaaagauuaaaaugaca

SEQ ID NO: 482645 - RNA, 22 nt, Human
gaugcacugcaguauauacugu

SEQ ID NO: 482646 - RNA, 22 nt, Human
aaaaguauuggccaccauuucu

SEQ ID NO: 482647 - RNA, 22 nt, Human
cagcagcaggcgcacggccguc

SEQ ID NO: 482648 - RNA, 22 nt, Human
uuccuguccgcaauggccuggg

SEQ ID NO: 482649 - RNA, 22 nt, Human
gcuguccugggaacaggcacua

SEQ ID NO: 482650 - RNA, 22 nt, Human
gggagggacacaaagaguuccc

SEQ ID NO: 482651 - RNA, 22 nt, Human
aaucgguugaacccaggaagug

SEQ ID NO: 482652 - RNA, 22 nt, Human
ucaggcugcagcugucagcagc

SEQ ID NO: 482653 - RNA, 22 nt, Human
ucugcagauuuaucagcagcug

SEQ ID NO: 482654 - RNA, 18 nt, Human
gggcacuggggacuggag

SEQ ID NO: 482655 - RNA, 19 nt, Human
gcucugagaggggcauggg

SEQ ID NO: 482656 - RNA, 23 nt, Human
cccagcgcugagcccugcaggca

SEQ ID NO: 482657 - RNA, 22 nt, Human
cuggggacuugcagacacaauu

SEQ ID NO: 482658 - RNA, 22 nt, Human
ugcuggggcucugaccacucca

SEQ ID NO: 482659 - RNA, 22 nt, Human
gaggaguggaguugcuggguug

SEQ ID NO: 482660 - RNA, 22 nt, Human
gagugaaaaaggaagggccaua

SEQ ID NO: 482661 - RNA, 22 nt, Human
cagcaggaccauugaggcauca

SEQ ID NO: 482662 - RNA, 22 nt, Human
ccagcccucacugaggccucuc

SEQ ID NO: 482663 - RNA, 22 nt, Human
gcccuggaaucucuccauggga

SEQ ID NO: 482664 - RNA, 22 nt, Human
aguucccaggugaugcugaugu

SEQ ID NO: 482665 - RNA, 22 nt, Human
caguacuuggucaaggaagcag

SEQ ID NO: 482666 - RNA, 22 nt, Human
aaaauggucucagcuggcacca

SEQ ID NO: 482667 - RNA, 22 nt, Human
aggcaggcucaggcccaugcuu

SEQ ID NO: 482668 - RNA, 22 nt, Human
ugccacccagccaggaguggga

SEQ ID NO: 482669 - RNA, 20 nt, Human
cccagagccauagccagaca

SEQ ID NO: 482670 - RNA, 18 nt, Human
ggaaaccacaggguucug

SEQ ID NO: 482671 - RNA, 22 nt, Human
augacagaggagugcaggugau

SEQ ID NO: 482672 - RNA, 21 nt, Human
guauucuuuaugaagugaaaa

SEQ ID NO: 482673 - RNA, 22 nt, Human
cagggcagagccaggauuucaa

SEQ ID NO: 482674 - RNA, 22 nt, Human
gagaggaguaggcugauggugc

SEQ ID NO: 482675 - RNA, 22 nt, Human
uuaugcaaaggggccucuuccu

SEQ ID NO: 482676 - RNA, 22 nt, Human
aguucucagcuuaguaugcugu

SEQ ID NO: 482677 - RNA, 22 nt, Human
ccaggcugagcaugauuggagc

SEQ ID NO: 482678 - RNA, 22 nt, Human
uggccugccccgagauccuggc

SEQ ID NO: 482679 - RNA, 22 nt, Human
cugcucuguuaauuaaacuuug

SEQ ID NO: 482680 - RNA, 22 nt, Human
ccagaaggcggagauugcagug

SEQ ID NO: 482681 - RNA, 22 nt, Human
caaaggcaguuacugaaugaag

SEQ ID NO: 482682 - RNA, 22 nt, Human
uccuggugucgccuggucaguu

SEQ ID NO: 482683 - RNA, 22 nt, Human
caggauggccccggggcugugc

SEQ ID NO: 482684 - RNA, 19 nt, Human
uugaaagauuagcuuucua

SEQ ID NO: 482685 - RNA, 22 nt, Human
guauuuauaggggaaugagagu

SEQ ID NO: 482686 - RNA, 22 nt, Human
uggggcagcagaccuuucuugg

SEQ ID NO: 482687 - RNA, 22 nt, Human
ugucccagaucacaggagggga

SEQ ID NO: 482688 - RNA, 22 nt, Human
gaggcaguggucugaugcaagg

SEQ ID NO: 482689 - RNA, 22 nt, Human
ucaagcaggguagcaagcuggu

SEQ ID NO: 482690 - RNA, 22 nt, Human
accagcucagaagccagaaaga

SEQ ID NO: 482691 - RNA, 22 nt, Human
agcugcucuugggugacuucaa

SEQ ID NO: 482692 - RNA, 22 nt, Human
ccugcccagcuucaccucaggc

SEQ ID NO: 482693 - RNA, 22 nt, Human
agcuggagccagugugaggcuu

SEQ ID NO: 482694 - RNA, 22 nt, Human
aaugauguauuaguacaacaca

SEQ ID NO: 482695 - RNA, 22 nt, Human
gugugcagaagacacaagacau

SEQ ID NO: 482696 - RNA, 21 nt, Human
aucuggaagaacugguaagug

SEQ ID NO: 482697 - RNA, 22 nt, Human
auaugcauaugucaaaacuuau

SEQ ID NO: 482698 - RNA, 22 nt, Human
aguuuuucuccccuggcuucau

SEQ ID NO: 482699 - RNA, 22 nt, Human
agggcagagcacugaauuggga

SEQ ID NO: 482700 - RNA, 20 nt, Human
ucagaggcugccagcugggg

SEQ ID NO: 482701 - RNA, 22 nt, Human
uuccaggacaagauguuucagg

SEQ ID NO: 482702 - RNA, 22 nt, Human
acagugaaugcccaagaaaagu

SEQ ID NO: 482703 - RNA, 22 nt, Human
gcaggugggggucggugcaucu

SEQ ID NO: 482704 - RNA, 19 nt, Human
ugagaggcuuaaggcagcu

SEQ ID NO: 482705 - RNA, 22 nt, Human
uuacaggggacauuggggacau

SEQ ID NO: 482706 - RNA, 22 nt, Human
cauugcacaucugagaagagau

SEQ ID NO: 482707 - RNA, 22 nt, Human
ucaccaggcuccuguuaagaug

SEQ ID NO: 482708 - RNA, 22 nt, Human
ugucuccucauacugucauauu

SEQ ID NO: 482709 - RNA, 22 nt, Human
ugcugccaggucuugcugucca

SEQ ID NO: 482710 - RNA, 22 nt, Human
ugucaugcccaggagcaaggua

SEQ ID NO: 482711 - RNA, 21 nt, Human
cauuucuauugaugagaaaag

SEQ ID NO: 482712 - RNA, 22 nt, Human
ccaccaggacagcccugagggg

SEQ ID NO: 482713 - RNA, 19 nt, Human
auuugaaagcugugcuugc

SEQ ID NO: 482714 - RNA, 22 nt, Human
uauuucuuguuauucucguuga

SEQ ID NO: 482715 - RNA, 18 nt, Human
aggcaggugcuggaaguc

SEQ ID NO: 482716 - RNA, 22 nt, Human
ucacauuuucauauucucugag

SEQ ID NO: 482717 - RNA, 23 nt, Human
acagcaagaggaccagaugugag

SEQ ID NO: 482718 - RNA, 22 nt, Human
ccaggccaaauucagucagcag

SEQ ID NO: 482719 - RNA, 21 nt, Human
aaacugaccuugccugagaca

SEQ ID NO: 482720 - RNA, 22 nt, Human
aauuucaaugcacucaugguug

SEQ ID NO: 482721 - RNA, 22 nt, Human
acauuuaaccaaacuguuuaau

SEQ ID NO: 482722 - RNA, 20 nt, Human
ccugggcuccaggagccccg

SEQ ID NO: 482723 - RNA, 22 nt, Human
acacugcagaugaaagcauaag

SEQ ID NO: 482724 - RNA, 22 nt, Human
ucuuuacaucacaauuguaugg

SEQ ID NO: 482725 - RNA, 22 nt, Human
ucuguccucuuugaagcugcuc

SEQ ID NO: 482726 - RNA, 22 nt, Human
agucucugcaugccugcugugc

SEQ ID NO: 482727 - RNA, 22 nt, Human
agcugucagugcugugccugua

SEQ ID NO: 482728 - RNA, 22 nt, Human
gcuucuauuauuuggagcugag

SEQ ID NO: 482729 - RNA, 22 nt, Human
cuguacucaagguaaaccagga

SEQ ID NO: 482730 - RNA, 22 nt, Human
ugggcacaaacaucugccuguu

SEQ ID NO: 482731 - RNA, 22 nt, Human
gccuggagggauagaaugcaag

SEQ ID NO: 482732 - RNA, 22 nt, Human
acugagcucuugacugggaguu

SEQ ID NO: 482733 - RNA, 21 nt, Human
guccagagagccggcuccuga

SEQ ID NO: 482734 - RNA, 22 nt, Human
ucugccuguucaagucuucuag

SEQ ID NO: 482735 - RNA, 19 nt, Human
uugguggugguuuugguuc

SEQ ID NO: 482736 - RNA, 22 nt, Human
ucccaggugaugcugaggccac

SEQ ID NO: 482737 - RNA, 22 nt, Human
cuuauaaaguccaucugaacaa

SEQ ID NO: 482738 - RNA, 22 nt, Human
acagcuuuucaauucugcugag

SEQ ID NO: 482739 - RNA, 22 nt, Human
uggcugagguaacuaugaauaa

SEQ ID NO: 482740 - RNA, 22 nt, Human
uuucucauagucaugccucuua

SEQ ID NO: 482741 - RNA, 22 nt, Human
gcucaggaaaacagucuaguaa

SEQ ID NO: 482742 - RNA, 22 nt, Human
uacagagaguacagcauccaca

SEQ ID NO: 482743 - RNA, 22 nt, Human
agcagggccaacaguaaacacc

SEQ ID NO: 482744 - RNA, 22 nt, Human
gcuguggcugaccaccaggggg

SEQ ID NO: 482745 - RNA, 22 nt, Human
agcuuuaugaggagaccuuagu

SEQ ID NO: 482746 - RNA, 22 nt, Human
cuggcucaguucuugguuuuca

SEQ ID NO: 482747 - RNA, 22 nt, Human
gagcucugacugcugggugaca

SEQ ID NO: 482748 - RNA, 22 nt, Human
ucaggcugugggcacuggccau

SEQ ID NO: 482749 - RNA, 22 nt, Human
uggcucagauuuuuguaggcuu

SEQ ID NO: 482750 - RNA, 23 nt, Human
ccugugugcccuuaauucacagc

SEQ ID NO: 482751 - RNA, 22 nt, Human
cugcccuguuuggacagcccgg

SEQ ID NO: 482752 - RNA, 22 nt, Human
cuugaaagucacaugcagcccu

SEQ ID NO: 482753 - RNA, 22 nt, Human
agggcuggagccacagcuggga

SEQ ID NO: 482754 - RNA, 22 nt, Human
cagcugccagcuucucuccauc

SEQ ID NO: 482755 - RNA, 22 nt, Human
ugaagaagccaauugguaggcu

SEQ ID NO: 482756 - RNA, 22 nt, Human
agccacagucaaccuguccaua

SEQ ID NO: 482757 - RNA, 22 nt, Human
gagagugucgggggccccagga

SEQ ID NO: 482758 - RNA, 22 nt, Human
uaugacaagguggaguaugagu

SEQ ID NO: 482759 - RNA, 22 nt, Human
guggccagaagacugcaaugcu

SEQ ID NO: 482760 - RNA, 22 nt, Human
caggauggagggagggcuguua

SEQ ID NO: 482761 - RNA, 22 nt, Human
acaguguccuuguggucccugu

SEQ ID NO: 482762 - RNA, 22 nt, Human
aacuuaaacccacucauguaga

SEQ ID NO: 482763 - RNA, 22 nt, Human
uuucuuccuuaccuuacuagag

SEQ ID NO: 482764 - RNA, 22 nt, Human
uggagcauauucuggagcuugg

SEQ ID NO: 482765 - RNA, 22 nt, Human
gaggcagcaugguaccuuggag

SEQ ID NO: 482766 - RNA, 22 nt, Human
ccacugcccccugaagaccagg

SEQ ID NO: 482767 - RNA, 22 nt, Human
guaaaauucuagcaucugaaag

SEQ ID NO: 482768 - RNA, 22 nt, Human
gaggaaccaaaucagcuugcac

SEQ ID NO: 482769 - RNA, 22 nt, Human
ggcucugggucuguggggagcg

SEQ ID NO: 482770 - RNA, 22 nt, Human
aggagucauaaaugugaacaaa

SEQ ID NO: 482771 - RNA, 22 nt, Human
ggccaggagauggacaccacau

SEQ ID NO: 482772 - RNA, 22 nt, Human
uuuugaaagccagguuuguaug

SEQ ID NO: 482773 - RNA, 22 nt, Human
ucccagcauuaaugccugucag

SEQ ID NO: 482774 - RNA, 22 nt, Human
gcauuuauuucuuuacugcauc

SEQ ID NO: 482775 - RNA, 22 nt, Human
cuugcaggcagggccuccugga

SEQ ID NO: 482776 - RNA, 22 nt, Human
gccugagacagugugguccaau

SEQ ID NO: 482777 - RNA, 22 nt, Human
uuccucuuucucugugcuaugu

SEQ ID NO: 482778 - RNA, 22 nt, Human
aggagagagaacacuugggucc

SEQ ID NO: 482779 - RNA, 22 nt, Human
ugucucagaguaucccugaacu

SEQ ID NO: 482780 - RNA, 22 nt, Human
uuuuaucagcagggauaacaag

SEQ ID NO: 482781 - RNA, 22 nt, Human
cugcaggaauucaaagugagcu

SEQ ID NO: 482782 - RNA, 22 nt, Human
ucagcugccucucccuggaaga

SEQ ID NO: 482783 - RNA, 20 nt, Human
uggagcuccagcguccaugu

SEQ ID NO: 482784 - RNA, 22 nt, Human
cagcaggguauacagggaauuu

SEQ ID NO: 482785 - RNA, 22 nt, Human
agaucacaguggcaacucccuu

SEQ ID NO: 482786 - RNA, 22 nt, Human
cacagggcagugcugcccacuc

SEQ ID NO: 482787 - RNA, 22 nt, Human
aggcugggcaccguuuugaucc

SEQ ID NO: 482788 - RNA, 22 nt, Human
aucuggcuuucuuaaugacuua

SEQ ID NO: 482789 - RNA, 22 nt, Human
ucuuucuacaucauuugcuucu

SEQ ID NO: 482790 - RNA, 22 nt, Human
cuuggucauuucuuguccuguu

SEQ ID NO: 482791 - RNA, 22 nt, Human
aggauccugcgcuuugggggag

SEQ ID NO: 482792 - RNA, 22 nt, Human
cagagcuguauuuaucuuucca

SEQ ID NO: 482793 - RNA, 22 nt, Human
uggcagaguggaccauacucaa

SEQ ID NO: 482794 - RNA, 18 nt, Human
acugugguuuauguguag

SEQ ID NO: 482795 - RNA, 22 nt, Human
acccagcuguuucccgugucau

SEQ ID NO: 482796 - RNA, 22 nt, Human
acucugcuuauugcugcaggca

SEQ ID NO: 482797 - RNA, 22 nt, Human
aggcugaaaacgagauggcaau

SEQ ID NO: 482798 - RNA, 22 nt, Human
gauggggaugagaagugagcag

SEQ ID NO: 482799 - RNA, 22 nt, Human
ucaaaggcuugugguucuggga

SEQ ID NO: 482800 - RNA, 23 nt, Human
cacuccuguuucuaagccagcau

SEQ ID NO: 482801 - RNA, 21 nt, Human
caugaagccgguucccuguuu

SEQ ID NO: 482802 - RNA, 22 nt, Human
cagcagcucccauccgcugagc

SEQ ID NO: 482803 - RNA, 22 nt, Human
agcgugaaggcgggcagucggc

SEQ ID NO: 482804 - RNA, 21 nt, Human
cucaggauggcggccuggugg

SEQ ID NO: 482805 - RNA, 21 nt, Human
uggcugagccaggugugugga

SEQ ID NO: 482806 - RNA, 22 nt, Human
cuggagaggcugggaacagguu

SEQ ID NO: 482807 - RNA, 22 nt, Human
gugugccaacaaaagacagugc

SEQ ID NO: 482808 - RNA, 22 nt, Human
ugcagagguuuccaggcaaguu

SEQ ID NO: 482809 - RNA, 22 nt, Human
uggcacugccuggcagggcccc

SEQ ID NO: 482810 - RNA, 22 nt, Human
augucuuucucacagccaguuc

SEQ ID NO: 482811 - RNA, 22 nt, Human
ugaggcucaagaaagauuuguu

SEQ ID NO: 482812 - RNA, 22 nt, Human
ccaaggagcaaggcucaacaag

SEQ ID NO: 482813 - RNA, 22 nt, Human
ucauugaauuucacagcuuuau

SEQ ID NO: 482814 - RNA, 22 nt, Human
augaaacugggauaacuauagc

SEQ ID NO: 482815 - RNA, 22 nt, Human
gagggcagagucuaaugaugca

SEQ ID NO: 482816 - RNA, 22 nt, Human
ccagggcauccucacaucgcag

SEQ ID NO: 482817 - RNA, 22 nt, Human
aguccaaggagagacagcauuu

SEQ ID NO: 482818 - RNA, 22 nt, Human
gucccagaaacauauugcuggu

SEQ ID NO: 482819 - RNA, 22 nt, Human
ucacauuuauuucaaaguuacu

SEQ ID NO: 482820 - RNA, 22 nt, Human
aaauuauuaugccccucuauaa

SEQ ID NO: 482821 - RNA, 22 nt, Human
auuuugaaaccaaguuauuucc

SEQ ID NO: 482822 - RNA, 22 nt, Human
ccauggccgccgcugcucagga

SEQ ID NO: 482823 - RNA, 22 nt, Human
uccaagaucuacagcaguuuag

SEQ ID NO: 482824 - RNA, 22 nt, Human
ugaagcagagugaaggugaauu

SEQ ID NO: 482825 - RNA, 22 nt, Human
cagcuccccaugguuccugaag

SEQ ID NO: 482826 - RNA, 22 nt, Human
ggccccacgggggaguccuagu

SEQ ID NO: 482827 - RNA, 22 nt, Human
aaagagcuucauuuccauuuau

SEQ ID NO: 482828 - RNA, 22 nt, Human
ccagggcaugggaagaacugaa

SEQ ID NO: 482829 - RNA, 22 nt, Human
agcaauaacagaaaacuuuccu

SEQ ID NO: 482830 - RNA, 22 nt, Human
guguccaucagcagccacugug

SEQ ID NO: 482831 - RNA, 17 nt, Human
acagggcagaaacagcu

SEQ ID NO: 482832 - RNA, 22 nt, Human
acagaauacuacagacugguua

SEQ ID NO: 482833 - RNA, 22 nt, Human
uacaaagucagaauaacaggug

SEQ ID NO: 482834 - RNA, 22 nt, Human
ggagaagcagcuucuugaugaa

SEQ ID NO: 482835 - RNA, 22 nt, Human
acaguaaaucaacagaauaucu

SEQ ID NO: 482836 - RNA, 22 nt, Human
gucagagagggcacgugcacac

SEQ ID NO: 482837 - RNA, 20 nt, Human
aagagcauaguacaggaaga

SEQ ID NO: 482838 - RNA, 22 nt, Human
ucccagagcagaugugcuaaag

SEQ ID NO: 482839 - RNA, 20 nt, Human
gggugagauguaggagaggg

SEQ ID NO: 482840 - RNA, 23 nt, Human
ucaggauauugugugccaaggug

SEQ ID NO: 482841 - RNA, 22 nt, Human
auaugucgcuacaucauuagau

SEQ ID NO: 482842 - RNA, 22 nt, Human
augucuaaaagauaaaguuuaa

SEQ ID NO: 482843 - RNA, 22 nt, Human
ugaggcagggagaguggauaug

SEQ ID NO: 482844 - RNA, 22 nt, Human
cacagagagcuacgugcagcgu

SEQ ID NO: 482845 - RNA, 22 nt, Human
gggcugagaauucagcuuuccu

SEQ ID NO: 482846 - RNA, 22 nt, Human
uaaaucccuacaucuguguuuu

SEQ ID NO: 482847 - RNA, 22 nt, Human
cagagcuggagaaguggauuua

SEQ ID NO: 482848 - RNA, 19 nt, Human
cucagcuguagcucaugug

SEQ ID NO: 482849 - RNA, 22 nt, Human
ggcagggcaggaaagucaggaa

SEQ ID NO: 482850 - RNA, 22 nt, Human
gaaggccacaagagaaguuaag

SEQ ID NO: 482851 - RNA, 22 nt, Human
aggcugucucaccucaggaggg

SEQ ID NO: 482852 - RNA, 22 nt, Human
ccuuggaggacugcugcuucuu

SEQ ID NO: 482853 - RNA, 22 nt, Human
ugccaggagagugcaugcaggg

SEQ ID NO: 482854 - RNA, 20 nt, Human
cccuccagcaaccaggacuu

SEQ ID NO: 482855 - RNA, 22 nt, Human
ugggcagaauugugguaguuaa

SEQ ID NO: 482856 - RNA, 18 nt, Human
ugcccagaaaagcaggga

SEQ ID NO: 482857 - RNA, 22 nt, Human
ucucagggcgcagugaggcagu

SEQ ID NO: 482858 - RNA, 22 nt, Human
gcucucugccuuucucaaugac

SEQ ID NO: 482859 - RNA, 22 nt, Human
auuuauuaagcaucugcuaugu

SEQ ID NO: 482860 - RNA, 22 nt, Human
gaugggcguggcgcguuuggug

SEQ ID NO: 482861 - RNA, 22 nt, Human
ccugggcauaaaucacuccaag

SEQ ID NO: 482862 - RNA, 22 nt, Human
aucugccuccaaguccaugugu

SEQ ID NO: 482863 - RNA, 22 nt, Human
aguauacauauauuagccuucg

SEQ ID NO: 482864 - RNA, 22 nt, Human
gcagccacacuguuacagaaug

SEQ ID NO: 482865 - RNA, 23 nt, Human
ccucagcauggcaggagcccagc

SEQ ID NO: 482866 - RNA, 22 nt, Human
ggccucuggucaagacaagcau

SEQ ID NO: 482867 - RNA, 22 nt, Human
aguuuagaguucaaauuaguuc

SEQ ID NO: 482868 - RNA, 22 nt, Human
uauuucugaggcccaggaagug

SEQ ID NO: 482869 - RNA, 22 nt, Human
uucucuagguuuuagaugaaga

SEQ ID NO: 482870 - RNA, 22 nt, Human
uggcagaggaggcucagauuga

SEQ ID NO: 482871 - RNA, 22 nt, Human
cuggacagaaagggcugcugug

SEQ ID NO: 482872 - RNA, 17 nt, Human
uggagcugcguguguuc

SEQ ID NO: 482873 - RNA, 22 nt, Human
uggcucaguggcagccgcagcu

SEQ ID NO: 482874 - RNA, 22 nt, Human
auaauuuaaauuaguaugugau

SEQ ID NO: 482875 - RNA, 22 nt, Human
ugcagggagggcccagcaaucu

SEQ ID NO: 482876 - RNA, 22 nt, Human
uaccacuacauuugcuaauggc

SEQ ID NO: 482877 - RNA, 22 nt, Human
aggugucugggcuuuggaguca

SEQ ID NO: 482878 - RNA, 22 nt, Human
uuguaacaaucugucauaaaug

SEQ ID NO: 482879 - RNA, 17 nt, Human
agggacagcaguuuagg

SEQ ID NO: 482880 - RNA, 22 nt, Human
ccaggaagccucagaugcugag

SEQ ID NO: 482881 - RNA, 22 nt, Human
cagagcugugauaaauagauau

SEQ ID NO: 482882 - RNA, 22 nt, Human
aggcaucugaguuugcaagcuu

SEQ ID NO: 482883 - RNA, 22 nt, Human
gccuucugauugcuggacugac

SEQ ID NO: 482884 - RNA, 22 nt, Human
gcccugcugucuucagaguaua

SEQ ID NO: 482885 - RNA, 22 nt, Human
acacccagagcgccagugccga

SEQ ID NO: 482886 - RNA, 22 nt, Human
cuggagguaauguuauuuuugu

SEQ ID NO: 482887 - RNA, 22 nt, Human
aguuacaaccaugacacaagca

SEQ ID NO: 482888 - RNA, 22 nt, Human
ccagagucuaugaguccucauu

SEQ ID NO: 482889 - RNA, 22 nt, Human
gaggaacccagcugggguugcc

SEQ ID NO: 482890 - RNA, 22 nt, Human
uaaggccauuauggugggcccg

SEQ ID NO: 482891 - RNA, 20 nt, Human
uuuuuccuucucuacaggca

SEQ ID NO: 482892 - RNA, 22 nt, Human
uuucacaaucaaauggugaaau

SEQ ID NO: 482893 - RNA, 22 nt, Human
ucuggccaacaaaaacuaaguc

SEQ ID NO: 482894 - RNA, 22 nt, Human
augcaguguuuggaagcuuaag

SEQ ID NO: 482895 - RNA, 22 nt, Human
aacagaaaucauuuagggcucu

SEQ ID NO: 482896 - RNA, 22 nt, Human
acaagagacaagagguucuucu

SEQ ID NO: 482897 - RNA, 22 nt, Human
ugaggaaacuuacaaggcagaa

SEQ ID NO: 482898 - RNA, 22 nt, Human
accagggcaaauguuuguacuc

SEQ ID NO: 482899 - RNA, 22 nt, Human
gaggcucaacccacagggguug

SEQ ID NO: 482900 - RNA, 22 nt, Human
uuuguuuacucauucauugaug

SEQ ID NO: 482901 - RNA, 22 nt, Human
agauuucucuuucccuggcuga

SEQ ID NO: 482902 - RNA, 22 nt, Human
ugcugcacaauuggaaaguauc

SEQ ID NO: 482903 - RNA, 22 nt, Human
ccugccagggccuuggaagaaa

SEQ ID NO: 482904 - RNA, 22 nt, Human
ugcagccaucgcagagucugua

SEQ ID NO: 482905 - RNA, 22 nt, Human
gguguagcucugugucccacug

SEQ ID NO: 482906 - RNA, 22 nt, Human
uauucauaguaaacaaaagugg

SEQ ID NO: 482907 - RNA, 22 nt, Human
ccuuuauucaauuaguccuaau

SEQ ID NO: 482908 - RNA, 22 nt, Human
ggagaagccacacauugggugu

SEQ ID NO: 482909 - RNA, 22 nt, Human
cugggccuuggauugacacugu

SEQ ID NO: 482910 - RNA, 22 nt, Human
aaaugaccagaauacaggcuuc

SEQ ID NO: 482911 - RNA, 22 nt, Human
gggagagaugcugauugccaau

SEQ ID NO: 482912 - RNA, 22 nt, Human
ccuggagcaggagcugcagagg

SEQ ID NO: 482913 - RNA, 22 nt, Human
agagacaggguuuugucguguu

SEQ ID NO: 482914 - RNA, 22 nt, Human
ccaguggacuucucccuguggu

SEQ ID NO: 482915 - RNA, 22 nt, Human
acccugagucagacagccugac

SEQ ID NO: 482916 - RNA, 22 nt, Human
cagggugcagugucgcugcuag

SEQ ID NO: 482917 - RNA, 22 nt, Human
cagggcagggauguugcggcag

SEQ ID NO: 482918 - RNA, 22 nt, Human
ccacagggugucaucagcuuga

SEQ ID NO: 482919 - RNA, 23 nt, Human
gccucugcucugcguuggggacu

SEQ ID NO: 482920 - RNA, 22 nt, Human
acagcagccuuguugguuucga

SEQ ID NO: 482921 - RNA, 22 nt, Human
guuguauagagggcaugaaucu

SEQ ID NO: 482922 - RNA, 22 nt, Human
aucauaaagugcuaucugauug

SEQ ID NO: 482923 - RNA, 22 nt, Human
uggcugagagucauccugugug

SEQ ID NO: 482924 - RNA, 22 nt, Human
gaggcucugugaugugccaggc

SEQ ID NO: 482925 - RNA, 22 nt, Human
aaagcaaugaugguagacacgu

SEQ ID NO: 482926 - RNA, 19 nt, Human
gcuuuaguuuacucaucua

SEQ ID NO: 482927 - RNA, 22 nt, Human
augaggcagucuggccugaggg

SEQ ID NO: 482928 - RNA, 17 nt, Human
agugaaauuuacauugc

SEQ ID NO: 482929 - RNA, 22 nt, Human
gcaguaaaaaaggauaugugca

SEQ ID NO: 482930 - RNA, 22 nt, Human
auugaaagaguuuucugcugca

SEQ ID NO: 482931 - RNA, 21 nt, Human
agagaauugccuuagauguuc

SEQ ID NO: 482932 - RNA, 22 nt, Human
cagugcagucaaggaagaacca

SEQ ID NO: 482933 - RNA, 22 nt, Human
ucuccugugcacccucccugug

SEQ ID NO: 482934 - RNA, 22 nt, Human
acagccuggccugaguuaaggc

SEQ ID NO: 482935 - RNA, 19 nt, Human
gugaggauacugcucagag

SEQ ID NO: 482936 - RNA, 21 nt, Human
uauacaugugugcauacgugu

SEQ ID NO: 482937 - RNA, 22 nt, Human
uauaauuuuagaagagauggaa

SEQ ID NO: 482938 - RNA, 22 nt, Human
cagaguccuggacacagagaca

SEQ ID NO: 482939 - RNA, 22 nt, Human
uuacaaagcguugagacaagua

SEQ ID NO: 482940 - RNA, 22 nt, Human
ugugaagcuggauccuggagcu

SEQ ID NO: 482941 - RNA, 22 nt, Human
ugugaagguaaggaggggcaag

SEQ ID NO: 482942 - RNA, 22 nt, Human
ucugaacauccagcaaugcaca

SEQ ID NO: 482943 - RNA, 22 nt, Human
agggccuggaacuggagaccac

SEQ ID NO: 482944 - RNA, 22 nt, Human
ucagaaauguaagcugaugacu

SEQ ID NO: 482945 - RNA, 22 nt, Human
cagcagugucuccagcaucaca

SEQ ID NO: 482946 - RNA, 22 nt, Human
ggcccugagcugaaguacugug

SEQ ID NO: 482947 - RNA, 22 nt, Human
gacuguacuugagagaggaacu

SEQ ID NO: 482948 - RNA, 22 nt, Human
gucuggaguggggccugagaau

SEQ ID NO: 482949 - RNA, 21 nt, Human
cccuugccugcacuccucggc

SEQ ID NO: 482950 - RNA, 22 nt, Human
cuggcagggugggcuuugcuuu

SEQ ID NO: 482951 - RNA, 22 nt, Human
cagagcuggagggaacccuggc

SEQ ID NO: 482952 - RNA, 22 nt, Human
aagagguaaccauagcaaccac

SEQ ID NO: 482953 - RNA, 22 nt, Human
ccucagggccaucucugucccu

SEQ ID NO: 482954 - RNA, 17 nt, Human
cagggcugucugccuag

SEQ ID NO: 482955 - RNA, 22 nt, Human
cagcaggauaugguggagagag

SEQ ID NO: 482956 - RNA, 18 nt, Human
acauacauucugucugca

SEQ ID NO: 482957 - RNA, 22 nt, Human
ucauuacagagauauaaucuac

SEQ ID NO: 482958 - RNA, 22 nt, Human
cucuggaauguuuacaugcccu

SEQ ID NO: 482959 - RNA, 22 nt, Human
ucugccagugguuuggcccuga

SEQ ID NO: 482960 - RNA, 17 nt, Human
gaauuucuuggucaaaa

SEQ ID NO: 482961 - RNA, 22 nt, Human
gccuaggagacaagcgugaaag

SEQ ID NO: 482962 - RNA, 22 nt, Human
aggcacugaccugcuuccuuga

SEQ ID NO: 482963 - RNA, 22 nt, Human
aggcccuggcacugccugggag

SEQ ID NO: 482964 - RNA, 22 nt, Human
ucuggccugggccugccggugc

SEQ ID NO: 482965 - RNA, 22 nt, Human
auuuucauggcuucugcucagu

SEQ ID NO: 482966 - RNA, 22 nt, Human
gcuggcagggacagcugcgugu

SEQ ID NO: 482967 - RNA, 22 nt, Human
uaguuauuauuguuacuaucag

SEQ ID NO: 482968 - RNA, 22 nt, Human
aagggcucugcugucucucccc

SEQ ID NO: 482969 - RNA, 22 nt, Human
ucagaacagaagcuggcuauaa

SEQ ID NO: 482970 - RNA, 22 nt, Human
ggaugcacgaaggcgccucgga

SEQ ID NO: 482971 - RNA, 22 nt, Human
gaggcucaccuagggagcacug

SEQ ID NO: 482972 - RNA, 22 nt, Human
ucaggcugaaggaggccuaucu

SEQ ID NO: 482973 - RNA, 20 nt, Human
ugccaggcugcacgccugcc

SEQ ID NO: 482974 - RNA, 22 nt, Human
uccuggagauaauugcagugaa

SEQ ID NO: 482975 - RNA, 22 nt, Human
ccucaggggucacugugaggag

SEQ ID NO: 482976 - RNA, 19 nt, Human
agccuggagggcuggucac

SEQ ID NO: 482977 - RNA, 22 nt, Human
ucacauacacuaggauauuuuu

SEQ ID NO: 482978 - RNA, 22 nt, Human
gugagcaggauaggggcucccu

SEQ ID NO: 482979 - RNA, 22 nt, Human
ccuggagccccucuggccagcc

SEQ ID NO: 482980 - RNA, 22 nt, Human
uucccaguuagucauuuuuaca

SEQ ID NO: 482981 - RNA, 22 nt, Human
ucccaggguccucuucuggaau

SEQ ID NO: 482982 - RNA, 22 nt, Human
gucaaguuuauccgcucauuca

SEQ ID NO: 482983 - RNA, 21 nt, Human
aggagcuguguuagcuggucg

SEQ ID NO: 482984 - RNA, 22 nt, Human
uuaauuuuaaccuguuuguguc

SEQ ID NO: 482985 - RNA, 22 nt, Human
ucugucaccauucagcuugaau

SEQ ID NO: 482986 - RNA, 22 nt, Human
aaguuacaggagaaagagauca

SEQ ID NO: 482987 - RNA, 22 nt, Human
ucugagcauugaauuuucuucc

SEQ ID NO: 482988 - RNA, 22 nt, Human
gcaggcuccaggccggccccuu

SEQ ID NO: 482989 - RNA, 22 nt, Human
ccaaguacagauuccuccacug

SEQ ID NO: 482990 - RNA, 22 nt, Human
ggguaccaagcugcuugggggc

SEQ ID NO: 482991 - RNA, 22 nt, Human
acugucuuguguuaaagaacca

SEQ ID NO: 482992 - RNA, 22 nt, Human
uccagcuuugagauuuuaugga

SEQ ID NO: 482993 - RNA, 22 nt, Human
auucuucugccuacuuucaucc

SEQ ID NO: 482994 - RNA, 20 nt, Human
agguggcuccugcugggggu

SEQ ID NO: 482995 - RNA, 22 nt, Human
uggcucagcgguggcagcagac

SEQ ID NO: 482996 - RNA, 22 nt, Human
ccuggcagcagcacaugccuuc

SEQ ID NO: 482997 - RNA, 22 nt, Human
cugagccaaccacagcaggagc

SEQ ID NO: 482998 - RNA, 22 nt, Human
guuucauucggcagcucauaag

SEQ ID NO: 482999 - RNA, 22 nt, Human
ucugucugcaccuaagcacagu

SEQ ID NO: 483000 - RNA, 22 nt, Human
gccagggcucgcggucccucgu

SEQ ID NO: 483001 - RNA, 22 nt, Human
guuuacaaauauuuuaaauggu

SEQ ID NO: 483002 - RNA, 22 nt, Human
acauuuacagugcuagacaauc

SEQ ID NO: 483003 - RNA, 22 nt, Human
aggagcugagucagcccgacag

SEQ ID NO: 483004 - RNA, 22 nt, Human
aggcucagcccaagguggagag

SEQ ID NO: 483005 - RNA, 22 nt, Human
gcugucugagaacaugguggaa

SEQ ID NO: 483006 - RNA, 22 nt, Human
cucugagaaagcugugagcuaa

SEQ ID NO: 483007 - RNA, 22 nt, Human
guccuggggauuauagaguguu

SEQ ID NO: 483008 - RNA, 22 nt, Human
cagaguguauucugcaguugca

SEQ ID NO: 483009 - RNA, 22 nt, Human
cuuauguauauuuggaacguac

SEQ ID NO: 483010 - RNA, 22 nt, Human
auuauuaggugcucucugacaa

SEQ ID NO: 483011 - RNA, 22 nt, Human
cucccaagggguaagggagcug

SEQ ID NO: 483012 - RNA, 22 nt, Human
ggccccaggaccuccacggucc

SEQ ID NO: 483013 - RNA, 22 nt, Human
ucagagaaaugaaguagggauu

SEQ ID NO: 483014 - RNA, 22 nt, Human
uggaccugagccuggcccugcc

SEQ ID NO: 483015 - RNA, 22 nt, Human
uccuugaagcuuguaucuaaua

SEQ ID NO: 483016 - RNA, 20 nt, Human
ccacaggaguccagucgacc

SEQ ID NO: 483017 - RNA, 22 nt, Human
gccagggaggcuguaggguccu

SEQ ID NO: 483018 - RNA, 22 nt, Human
caguuuuugccauuaagaguaa

SEQ ID NO: 483019 - RNA, 22 nt, Human
uacaaaguagaaauucaguaaa

SEQ ID NO: 483020 - RNA, 22 nt, Human
ggcagagaugugggucagaauc

SEQ ID NO: 483021 - RNA, 22 nt, Human
agcugagagguggcaagcugua

SEQ ID NO: 483022 - RNA, 22 nt, Human
gggauggcucaaaggagucagg

SEQ ID NO: 483023 - RNA, 22 nt, Human
accaaggaagagauucucaguu

SEQ ID NO: 483024 - RNA, 22 nt, Human
uagcagcugugaguaaaagcca

SEQ ID NO: 483025 - RNA, 20 nt, Human
ccuggcugcauucaggacgg

SEQ ID NO: 483026 - RNA, 22 nt, Human
gcauuguccugcuucugagugu

SEQ ID NO: 483027 - RNA, 21 nt, Human
uaaggccaagucuauuucugu

SEQ ID NO: 483028 - RNA, 22 nt, Human
accaggcagucaccguccagga

SEQ ID NO: 483029 - RNA, 22 nt, Human
agcuuuauauaaaagaguacau

SEQ ID NO: 483030 - RNA, 22 nt, Human
uccaggcuggccucgcgugaca

SEQ ID NO: 483031 - RNA, 22 nt, Human
uuucauguuuauggaaaaugag

SEQ ID NO: 483032 - RNA, 22 nt, Human
gcacccagaggucagcagugcu

SEQ ID NO: 483033 - RNA, 22 nt, Human
cuucuuuacuuucuagaaauaa

SEQ ID NO: 483034 - RNA, 22 nt, Human
gaggccugguuugcaugagaau

SEQ ID NO: 483035 - RNA, 22 nt, Human
gagccuggauugucaccgacuu

SEQ ID NO: 483036 - RNA, 22 nt, Human
gcucccagcuggagccucaaca

SEQ ID NO: 483037 - RNA, 22 nt, Human
aggccagguuccucaaucuuga

SEQ ID NO: 483038 - RNA, 22 nt, Human
cucccagggccaucgagucacu

SEQ ID NO: 483039 - RNA, 22 nt, Human
uaagaacaucuguccccagauu

SEQ ID NO: 483040 - RNA, 22 nt, Human
gccagcucagugccaggccccu

SEQ ID NO: 483041 - RNA, 22 nt, Human
uaggccagaggagcagcuuugg

SEQ ID NO: 483042 - RNA, 22 nt, Human
uuuccucuuugugacacagcug

SEQ ID NO: 483043 - RNA, 22 nt, Human
cagucucuaaaucaaucugaau

SEQ ID NO: 483044 - RNA, 22 nt, Human
agcagcaugaugacagagucuc

SEQ ID NO: 483045 - RNA, 22 nt, Human
cucacaggcaucucaucaggcu

SEQ ID NO: 483046 - RNA, 22 nt, Human
auacauguuguaccauauguuu

SEQ ID NO: 483047 - RNA, 17 nt, Human
ggcaccagacggagagu

SEQ ID NO: 483048 - RNA, 22 nt, Human
cccugcagcuuuugcauaguca

SEQ ID NO: 483049 - RNA, 22 nt, Human
aggucauuggggacuaucuccg

SEQ ID NO: 483050 - RNA, 21 nt, Human
agaugaggauacugaggccua

SEQ ID NO: 483051 - RNA, 21 nt, Human
cugcucuggggaccggcugug

SEQ ID NO: 483052 - RNA, 22 nt, Human
gguguccaucaggcugugcuuc

SEQ ID NO: 483053 - RNA, 22 nt, Human
cagggcaguaacgggaacaucu

SEQ ID NO: 483054 - RNA, 22 nt, Human
aguaaaauuucugcugaggaga

SEQ ID NO: 483055 - RNA, 19 nt, Human
ccaggccucuggggccugu

SEQ ID NO: 483056 - RNA, 22 nt, Human
aaaauccacaacgcucauuuca

SEQ ID NO: 483057 - RNA, 22 nt, Human
uggcaggaaaaagggccagagg

SEQ ID NO: 483058 - RNA, 18 nt, Human
gacccagcagaugggcuu

SEQ ID NO: 483059 - RNA, 22 nt, Human
agaccauagggaccucagguug

SEQ ID NO: 483060 - RNA, 22 nt, Human
ugaggcuggcaaggcugguauu

SEQ ID NO: 483061 - RNA, 22 nt, Human
acagagaaagugggcugaagau

SEQ ID NO: 483062 - RNA, 21 nt, Human
ugaggcucaucuuauguggcu

SEQ ID NO: 483063 - RNA, 22 nt, Human
cugaggucaauuaaucaacaac

SEQ ID NO: 483064 - RNA, 22 nt, Human
cagagcugcuucccaguuugug

SEQ ID NO: 483065 - RNA, 22 nt, Human
cugagaaaggaccucaaacagg

SEQ ID NO: 483066 - RNA, 22 nt, Human
aggcuuccgaguagcugggacu

SEQ ID NO: 483067 - RNA, 22 nt, Human
gagcuuuagcugagaccugcuu

SEQ ID NO: 483068 - RNA, 22 nt, Human
uugggcaaaguguuucuggagc

SEQ ID NO: 483069 - RNA, 22 nt, Human
cucacugcccugaaguuggguu

SEQ ID NO: 483070 - RNA, 22 nt, Human
gagaggagguggcuaugacagc

SEQ ID NO: 483071 - RNA, 22 nt, Human
aggagcagaacuguuguggagg

SEQ ID NO: 483072 - RNA, 22 nt, Human
guccucugacucagccuuggga

SEQ ID NO: 483073 - RNA, 22 nt, Human
uggauaaacucacuguaaguug

SEQ ID NO: 483074 - RNA, 22 nt, Human
cagggccugagggcugcucugc

SEQ ID NO: 483075 - RNA, 22 nt, Human
ucauuucuaucuaugcagcuuc

SEQ ID NO: 483076 - RNA, 22 nt, Human
aaggaagagucuagaacaggca

SEQ ID NO: 483077 - RNA, 22 nt, Human
ucaugacaacuauauuauucca

SEQ ID NO: 483078 - RNA, 18 nt, Human
cugaggcuggcaggagcc

SEQ ID NO: 483079 - RNA, 22 nt, Human
agcaagcuaccuagauagucua

SEQ ID NO: 483080 - RNA, 22 nt, Human
gacaggggucccucugggcugu

SEQ ID NO: 483081 - RNA, 22 nt, Human
uugaaagggauauaucuuucug

SEQ ID NO: 483082 - RNA, 22 nt, Human
auagugguuggauaugucagag

SEQ ID NO: 483083 - RNA, 22 nt, Human
augaggcaucugcagucacuag

SEQ ID NO: 483084 - RNA, 22 nt, Human
cuggagccgcauggagcaggga

SEQ ID NO: 483085 - RNA, 22 nt, Human
acccagcuaacccuacccugga

SEQ ID NO: 483086 - RNA, 20 nt, Human
acuggagccaucucagccua

SEQ ID NO: 483087 - RNA, 22 nt, Human
gccuccccugcaauuguccuug

SEQ ID NO: 483088 - RNA, 19 nt, Human
acacugaauguagaauugg

SEQ ID NO: 483089 - RNA, 22 nt, Human
gccaccagggggugcaaggucc

SEQ ID NO: 483090 - RNA, 22 nt, Human
aaaggccacuugaaggauuuuu

SEQ ID NO: 483091 - RNA, 22 nt, Human
gagagucuagugcaccuaguuu

SEQ ID NO: 483092 - RNA, 22 nt, Human
cuguguccucccgcugcaccca

SEQ ID NO: 483093 - RNA, 22 nt, Human
ccaggcaggcgauggugcagug

SEQ ID NO: 483094 - RNA, 22 nt, Human
ggcacugagaggcucuuccuaa

SEQ ID NO: 483095 - RNA, 22 nt, Human
aagaaugucguugguauuuuaa

SEQ ID NO: 483096 - RNA, 20 nt, Human
uguggcaggaugagggcgga

SEQ ID NO: 483097 - RNA, 22 nt, Human
ugggggagauugugcaucucua

SEQ ID NO: 483098 - RNA, 22 nt, Human
gccuggcaaggcccuguugacu

SEQ ID NO: 483099 - RNA, 23 nt, Human
agcagggccagaauacuugcugu

SEQ ID NO: 483100 - RNA, 22 nt, Human
gcugaaggcccggaggacaggg

SEQ ID NO: 483101 - RNA, 22 nt, Human
uggcugccuagugucugagcag

SEQ ID NO: 483102 - RNA, 22 nt, Human
ccagccuccauguagauagcug

SEQ ID NO: 483103 - RNA, 22 nt, Human
caggccugugaguugaggcccc

SEQ ID NO: 483104 - RNA, 22 nt, Human
agggccagagucuguguagaua

SEQ ID NO: 483105 - RNA, 22 nt, Human
caagcccaggauuccccaguua

SEQ ID NO: 483106 - RNA, 22 nt, Human
gagcaacaguuuaugguuuuuc

SEQ ID NO: 483107 - RNA, 22 nt, Human
ucccagagucagagguggggcc

SEQ ID NO: 483108 - RNA, 22 nt, Human
cucuuaaaaacuugauauauuu

SEQ ID NO: 483109 - RNA, 22 nt, Human
gcuggcugcgucaucacagggc

SEQ ID NO: 483110 - RNA, 22 nt, Human
acagaggaaggcugagcugccc

SEQ ID NO: 483111 - RNA, 22 nt, Human
aaaaaucacuuuuauaggcagc

SEQ ID NO: 483112 - RNA, 22 nt, Human
aucuggcuuuuacugaauugcu

SEQ ID NO: 483113 - RNA, 22 nt, Human
augaggcaguacacacaaagcc

SEQ ID NO: 483114 - RNA, 22 nt, Human
gcugccugcacagagcugcuuu

SEQ ID NO: 483115 - RNA, 22 nt, Human
ucagagccaaucauggugcauu

SEQ ID NO: 483116 - RNA, 22 nt, Human
gaccagagaaaggcacuggaag

SEQ ID NO: 483117 - RNA, 17 nt, Human
ucuuuccugccaugcuc

SEQ ID NO: 483118 - RNA, 22 nt, Human
gcugcagcaagcccuccagggg

SEQ ID NO: 483119 - RNA, 22 nt, Human
aagaugauguuguguuuucacu

SEQ ID NO: 483120 - RNA, 22 nt, Human
aggcaguuguagagagggcucu

SEQ ID NO: 483121 - RNA, 22 nt, Human
cugaaggauuagagagcacuua

SEQ ID NO: 483122 - RNA, 22 nt, Human
uccuggagagugggcgagcaca

SEQ ID NO: 483123 - RNA, 22 nt, Human
gauuucaaguaucuugggcgag

SEQ ID NO: 483124 - RNA, 22 nt, Human
uucagagacagcaaccaggaca

SEQ ID NO: 483125 - RNA, 22 nt, Human
ugcugcacucaccaacagauaa

SEQ ID NO: 483126 - RNA, 22 nt, Human
cacagguggcuccaaguuagag

SEQ ID NO: 483127 - RNA, 22 nt, Human
guguuuccuaguuuaaugaaug

SEQ ID NO: 483128 - RNA, 22 nt, Human
gagccagguuggaggcugcagu

SEQ ID NO: 483129 - RNA, 18 nt, Human
gguggcaggucagaugcc

SEQ ID NO: 483130 - RNA, 22 nt, Human
auuucacaucuaucucagauuu

SEQ ID NO: 483131 - RNA, 22 nt, Human
aucuggcuuacgaagcacuggu

SEQ ID NO: 483132 - RNA, 22 nt, Human
ucacauuuuaucuauuuuaagu

SEQ ID NO: 483133 - RNA, 22 nt, Human
cauuuucucaaugaacccucuu

SEQ ID NO: 483134 - RNA, 22 nt, Human
auaguuguguggggauucuggu

SEQ ID NO: 483135 - RNA, 22 nt, Human
ucaagagauugaauaauaacug

SEQ ID NO: 483136 - RNA, 22 nt, Human
cccagggcccuggacagcuaca

SEQ ID NO: 483137 - RNA, 22 nt, Human
gcacugcagccucagauggugg

SEQ ID NO: 483138 - RNA, 22 nt, Human
cagcuuggcuuccgcuuuacug

SEQ ID NO: 483139 - RNA, 22 nt, Human
uccucugccccagaugaaauuu

SEQ ID NO: 483140 - RNA, 22 nt, Human
gccuccugaaaggaagagcucc

SEQ ID NO: 483141 - RNA, 22 nt, Human
auuuaacaagacagagaacugg

SEQ ID NO: 483142 - RNA, 22 nt, Human
uccucagaaaccccugugaggu

SEQ ID NO: 483143 - RNA, 19 nt, Human
agacagagacugaaauaga

SEQ ID NO: 483144 - RNA, 22 nt, Human
agaagccagaauauucauggau

SEQ ID NO: 483145 - RNA, 22 nt, Human
ugcagggcacggugcgcguggg

SEQ ID NO: 483146 - RNA, 22 nt, Human
cugcccuguggcucugagucau

SEQ ID NO: 483147 - RNA, 22 nt, Human
gucauugcaguggcaaaucaca

SEQ ID NO: 483148 - RNA, 22 nt, Human
caguccugugucccuugguggg

SEQ ID NO: 483149 - RNA, 22 nt, Human
uucuuuccucccagccuuugga

SEQ ID NO: 483150 - RNA, 22 nt, Human
aaaugccucugcuguacacaau

SEQ ID NO: 483151 - RNA, 22 nt, Human
ccagggugaggaggcucccacg

SEQ ID NO: 483152 - RNA, 20 nt, Human
cagcugccuggcucugggau

SEQ ID NO: 483153 - RNA, 22 nt, Human
gaggcucagagugguuaaauaa

SEQ ID NO: 483154 - RNA, 22 nt, Human
uuaugggagcaauuggggaggu

SEQ ID NO: 483155 - RNA, 22 nt, Human
ucacauuuguucuugaaucuaa

SEQ ID NO: 483156 - RNA, 22 nt, Human
uacuguauuugauaagugaagu

SEQ ID NO: 483157 - RNA, 22 nt, Human
cuguacaggucaaugauaagau

SEQ ID NO: 483158 - RNA, 22 nt, Human
ccaaagugcugagauuacaggu

SEQ ID NO: 483159 - RNA, 22 nt, Human
agaggaugauuuuaaggacacu

SEQ ID NO: 483160 - RNA, 22 nt, Human
gagcagcuggacaggccucccu

SEQ ID NO: 483161 - RNA, 22 nt, Human
ugcccuuggguaacuugcugau

SEQ ID NO: 483162 - RNA, 22 nt, Human
cuguaaaacugcuuaaguaugc

SEQ ID NO: 483163 - RNA, 22 nt, Human
ccagguguagcacugcucacag

SEQ ID NO: 483164 - RNA, 22 nt, Human
accaucuuaaggggacuucuua

SEQ ID NO: 483165 - RNA, 22 nt, Human
gcagagcccuggggguauggug

SEQ ID NO: 483166 - RNA, 22 nt, Human
gcugcucuggcucugcaguguc

SEQ ID NO: 483167 - RNA, 22 nt, Human
agugcaauguguacagaaaaau

SEQ ID NO: 483168 - RNA, 22 nt, Human
cagacagcugcuuucuugcugu

SEQ ID NO: 483169 - RNA, 22 nt, Human
augucuuucaaauucugccuag

SEQ ID NO: 483170 - RNA, 22 nt, Human
ugcaauaaagugcuauaaaucc

SEQ ID NO: 483171 - RNA, 22 nt, Human
ugcccauguuucucuguauccc

SEQ ID NO: 483172 - RNA, 22 nt, Human
agcccagcaaagggagguucag

SEQ ID NO: 483173 - RNA, 22 nt, Human
gaggcagagucacaaagagucu

SEQ ID NO: 483174 - RNA, 22 nt, Human
ucacaggcuugugaacauugca

SEQ ID NO: 483175 - RNA, 22 nt, Human
cugcagggaccacaagcagguu

SEQ ID NO: 483176 - RNA, 22 nt, Human
uggcugggggugcuauagcugc

SEQ ID NO: 483177 - RNA, 22 nt, Human
cugggccauggaagucucugcc

SEQ ID NO: 483178 - RNA, 22 nt, Human
aaugauggucauggcaacuuuu

SEQ ID NO: 483179 - RNA, 22 nt, Human
auacuaagcucauuacauuuug

SEQ ID NO: 483180 - RNA, 21 nt, Human
ggccucugucauccugggaag

SEQ ID NO: 483181 - RNA, 22 nt, Human
aggagguggcugaacuugaggg

SEQ ID NO: 483182 - RNA, 22 nt, Human
uccacauucucuguuacagaua

SEQ ID NO: 483183 - RNA, 22 nt, Human
agagacagaggcaauauagcuu

SEQ ID NO: 483184 - RNA, 22 nt, Human
caaaagaagcucuuggggcuag

SEQ ID NO: 483185 - RNA, 23 nt, Human
gcccaugcuguugggcccgagca

SEQ ID NO: 483186 - RNA, 22 nt, Human
ugcucauuggcgaucugaggga

SEQ ID NO: 483187 - RNA, 22 nt, Human
ugugaaggcagagccagugaaa

SEQ ID NO: 483188 - RNA, 23 nt, Human
agugagcagcuguagggcaagga

SEQ ID NO: 483189 - RNA, 22 nt, Human
cugcaggguuuuucaaggacaa

SEQ ID NO: 483190 - RNA, 22 nt, Human
uguggccuugcagccuggaggu

SEQ ID NO: 483191 - RNA, 22 nt, Human
auacuuuggucacuauuauugg

SEQ ID NO: 483192 - RNA, 17 nt, Human
ucagagggaugagcagg

SEQ ID NO: 483193 - RNA, 22 nt, Human
cccaagaucuuucgugcacuaa

SEQ ID NO: 483194 - RNA, 22 nt, Human
auggagugggccaauuuuagug

SEQ ID NO: 483195 - RNA, 22 nt, Human
acauaugcucaucugcauuccc

SEQ ID NO: 483196 - RNA, 22 nt, Human
ggcuucuccagguacugagcau

SEQ ID NO: 483197 - RNA, 22 nt, Human
uccuugaauggacauuacacug

SEQ ID NO: 483198 - RNA, 22 nt, Human
aauggacaggagagcauaguca

SEQ ID NO: 483199 - RNA, 22 nt, Human
ucaggcagagcuguggagcucu

SEQ ID NO: 483200 - RNA, 22 nt, Human
ucagggcauggcugcacuuggc

SEQ ID NO: 483201 - RNA, 22 nt, Human
ggcugggagcuggacaggccgg

SEQ ID NO: 483202 - RNA, 22 nt, Human
ucagagaguuuucacuagggug

SEQ ID NO: 483203 - RNA, 22 nt, Human
gaugugagugguagcugggauu

SEQ ID NO: 483204 - RNA, 22 nt, Human
aaguucaaggaagccuccaguu

SEQ ID NO: 483205 - RNA, 20 nt, Human
uggagccacagucagguucc

SEQ ID NO: 483206 - RNA, 22 nt, Human
uguguacaagaguguuuacugu

SEQ ID NO: 483207 - RNA, 22 nt, Human
uggcucaggauaauuuucccaa

SEQ ID NO: 483208 - RNA, 22 nt, Human
ccucacuggccagccaggggug

SEQ ID NO: 483209 - RNA, 22 nt, Human
ucacagacaauuguuuuggugu

SEQ ID NO: 483210 - RNA, 22 nt, Human
uuccagagaaaagguuuauuuc

SEQ ID NO: 483211 - RNA, 22 nt, Human
ucagugcagaauagugaugcau

SEQ ID NO: 483212 - RNA, 22 nt, Human
cucaucugauaaaucacucuua

SEQ ID NO: 483213 - RNA, 22 nt, Human
uggcacagacagaucaggaguc

SEQ ID NO: 483214 - RNA, 22 nt, Human
ccuggcaggcuggggacagugc

SEQ ID NO: 483215 - RNA, 22 nt, Human
ucuggcuccuggcuccacugcc

SEQ ID NO: 483216 - RNA, 22 nt, Human
agggcagaaaucgauuacaccu

SEQ ID NO: 483217 - RNA, 22 nt, Human
ucuuccugaaacccuguuccag

SEQ ID NO: 483218 - RNA, 22 nt, Human
acaaaugcagcauaaagugaac

SEQ ID NO: 483219 - RNA, 22 nt, Human
gugugcagggcugccugugccg

SEQ ID NO: 483220 - RNA, 22 nt, Human
aggaagccuggcauuaaaaagc

SEQ ID NO: 483221 - RNA, 22 nt, Human
auuuguuccacacauauuuacu

SEQ ID NO: 483222 - RNA, 22 nt, Human
uugccaggagcucaucugaggg

SEQ ID NO: 483223 - RNA, 22 nt, Human
ccuguacauggccaucuuuacc

SEQ ID NO: 483224 - RNA, 22 nt, Human
ugucccagacauaaguggacau

SEQ ID NO: 483225 - RNA, 22 nt, Human
cucccuggaggugagcuggcac

SEQ ID NO: 483226 - RNA, 21 nt, Human
auccuugaucagaagagugcu

SEQ ID NO: 483227 - RNA, 20 nt, Human
ugcagggcucugcuucucuc

SEQ ID NO: 483228 - RNA, 23 nt, Human
uggcagcagaucuuaaagugacc

SEQ ID NO: 483229 - RNA, 22 nt, Human
gcuuuaaauggcuugcccaagu

SEQ ID NO: 483230 - RNA, 22 nt, Human
acagcacaaucugagucccaga

SEQ ID NO: 483231 - RNA, 22 nt, Human
aguccaguguguucuggcagca

SEQ ID NO: 483232 - RNA, 22 nt, Human
ugccaggcgugguggugcgcac

SEQ ID NO: 483233 - RNA, 20 nt, Human
gcauugaguauagacagaug

SEQ ID NO: 483234 - RNA, 22 nt, Human
uucaggauccccuugaugggcu

SEQ ID NO: 483235 - RNA, 22 nt, Human
uccugggcuguggccccgggca

SEQ ID NO: 483236 - RNA, 22 nt, Human
ccagggcaacgcugucucagag

SEQ ID NO: 483237 - RNA, 22 nt, Human
ugcucagacaagcugaacagua

SEQ ID NO: 483238 - RNA, 22 nt, Human
gcagggcaaauguggaaaggag

SEQ ID NO: 483239 - RNA, 22 nt, Human
caguagcacucugucagugaag

SEQ ID NO: 483240 - RNA, 22 nt, Human
cuggugccauucuguggccuag

SEQ ID NO: 483241 - RNA, 22 nt, Human
agcagcuggggccugugacgau

SEQ ID NO: 483242 - RNA, 22 nt, Human
gugcgccagcucaaggggaggc

SEQ ID NO: 483243 - RNA, 22 nt, Human
ugcuucaggagaugucaccaug

SEQ ID NO: 483244 - RNA, 23 nt, Human
ucugagagaacaaugccuccuau

SEQ ID NO: 483245 - RNA, 22 nt, Human
uuccucagacccucauugugag

SEQ ID NO: 483246 - RNA, 22 nt, Human
uaauccaauggcacaauguaug

SEQ ID NO: 483247 - RNA, 22 nt, Human
uuuauguaaguggaaugaugcc

SEQ ID NO: 483248 - RNA, 22 nt, Human
gggcagaggcucuggcccaucc

SEQ ID NO: 483249 - RNA, 22 nt, Human
ccuguggcacaugcagggauuc

SEQ ID NO: 483250 - RNA, 22 nt, Human
ucuauaaauuaugcagucucag

SEQ ID NO: 483251 - RNA, 22 nt, Human
ugcagaggagcuggaaggcugg

SEQ ID NO: 483252 - RNA, 22 nt, Human
cuuccugcaggacagccaucug

SEQ ID NO: 483253 - RNA, 22 nt, Human
aggccuggccuuuauguucaag

SEQ ID NO: 483254 - RNA, 22 nt, Human
uaaaugcagauuccugagccua

SEQ ID NO: 483255 - RNA, 17 nt, Human
ggaaaaggaugauacag

SEQ ID NO: 483256 - RNA, 22 nt, Human
caagaugggcaccccagcaccu

SEQ ID NO: 483257 - RNA, 22 nt, Human
agagaagggccuguauguaauc

SEQ ID NO: 483258 - RNA, 17 nt, Human
gcaguggagggguaguu

SEQ ID NO: 483259 - RNA, 22 nt, Human
cauuaugugggaaaauguucuu

SEQ ID NO: 483260 - RNA, 22 nt, Human
uagggcugugucuccaggacca

SEQ ID NO: 483261 - RNA, 22 nt, Human
gccagcagcccagaaggacuuu

SEQ ID NO: 483262 - RNA, 22 nt, Human
agaggccuaaccaagauguccu

SEQ ID NO: 483263 - RNA, 22 nt, Human
aacaaguaaguuuauauauauu

SEQ ID NO: 483264 - RNA, 22 nt, Human
agcauaaaggucaacguuuuag

SEQ ID NO: 483265 - RNA, 23 nt, Human
cauguacagaguuugauaaagug

SEQ ID NO: 483266 - RNA, 22 nt, Human
caugugucaaaugauguagcug

SEQ ID NO: 483267 - RNA, 22 nt, Human
ucuucaaagaauuuuaguaauu

SEQ ID NO: 483268 - RNA, 22 nt, Human
ucacauucucagcaucuauaca

SEQ ID NO: 483269 - RNA, 22 nt, Human
agugaaauuccuggucuuuguu

SEQ ID NO: 483270 - RNA, 22 nt, Human
cagggcucugccuugagggaug

SEQ ID NO: 483271 - RNA, 22 nt, Human
acccagcuggaugcauggaggc

SEQ ID NO: 483272 - RNA, 22 nt, Human
cuccugaguaguagcauuguca

SEQ ID NO: 483273 - RNA, 22 nt, Human
ccacugagaccuuuuggaggag

SEQ ID NO: 483274 - RNA, 22 nt, Human
gaugcugaagugaagugaucuu

SEQ ID NO: 483275 - RNA, 22 nt, Human
ggcugcagcggauuggggauug

SEQ ID NO: 483276 - RNA, 22 nt, Human
agcugagcugcagaugacugua

SEQ ID NO: 483277 - RNA, 22 nt, Human
cagagccagcccacuguucccg

SEQ ID NO: 483278 - RNA, 22 nt, Human
gaaacaaucaucaugugauuug

SEQ ID NO: 483279 - RNA, 22 nt, Human
ucagcuuucucagaggccuaac

SEQ ID NO: 483280 - RNA, 22 nt, Human
agggagacacaugaggaaguca

SEQ ID NO: 483281 - RNA, 22 nt, Human
ucccagaguucaaugggaaggu

SEQ ID NO: 483282 - RNA, 22 nt, Human
ugagccuggagucguggagggg

SEQ ID NO: 483283 - RNA, 22 nt, Human
uggcagcaauuugugauguuga

SEQ ID NO: 483284 - RNA, 22 nt, Human
cauuucuacagcuucuucagaa

SEQ ID NO: 483285 - RNA, 21 nt, Human
gucagcagauccagcacuugu

SEQ ID NO: 483286 - RNA, 22 nt, Human
uuucacaucagagguagauuag

SEQ ID NO: 483287 - RNA, 18 nt, Human
uucagcagcagacacacu

SEQ ID NO: 483288 - RNA, 22 nt, Human
gagccagcugagcugcacuguc

SEQ ID NO: 483289 - RNA, 22 nt, Human
gcucucugguuccagucaggaa

SEQ ID NO: 483290 - RNA, 22 nt, Human
uugcuuccucgaggccagcgug

SEQ ID NO: 483291 - RNA, 22 nt, Human
ucccaggcugggggccugaagu

SEQ ID NO: 483292 - RNA, 22 nt, Human
aaauugugcucacacugauauu

SEQ ID NO: 483293 - RNA, 22 nt, Human
aggcaguuuauccccagagccu

SEQ ID NO: 483294 - RNA, 23 nt, Human
agcaggaaaccgagggugauguu

SEQ ID NO: 483295 - RNA, 22 nt, Human
ugcauguuaagaaaauauugag

SEQ ID NO: 483296 - RNA, 22 nt, Human
caggccucuauggucagcugag

SEQ ID NO: 483297 - RNA, 22 nt, Human
ugcacacacucugcauauacuu

SEQ ID NO: 483298 - RNA, 18 nt, Human
gagaggagccagaauuuu

SEQ ID NO: 483299 - RNA, 22 nt, Human
ugaggcucagaaauguaaguuu

SEQ ID NO: 483300 - RNA, 19 nt, Human
ugccugucaguagaucuca

SEQ ID NO: 483301 - RNA, 22 nt, Human
accugccuaguugguucugccc

SEQ ID NO: 483302 - RNA, 22 nt, Human
ugggcaggggcccugcuuccgu

SEQ ID NO: 483303 - RNA, 22 nt, Human
cacagaggcaaccuucuggggu

SEQ ID NO: 483304 - RNA, 22 nt, Human
ggcuucucucccccagcuccac

SEQ ID NO: 483305 - RNA, 21 nt, Human
gccacguuucagucuucucag

SEQ ID NO: 483306 - RNA, 22 nt, Human
ucccagggacucucugccuucc

SEQ ID NO: 483307 - RNA, 22 nt, Human
ggucugagcuugagcccaugcu

SEQ ID NO: 483308 - RNA, 21 nt, Human
ggcagccucuguggaagggga

SEQ ID NO: 483309 - RNA, 22 nt, Human
gcagugaacauaacacagaagg

SEQ ID NO: 483310 - RNA, 22 nt, Human
ggcugccucuggaagcuggaga

SEQ ID NO: 483311 - RNA, 22 nt, Human
agcaccugcacaguggaggaaa

SEQ ID NO: 483312 - RNA, 22 nt, Human
ugucccagauacuggacauaga

SEQ ID NO: 483313 - RNA, 20 nt, Human
aggcacuggggauagguaag

SEQ ID NO: 483314 - RNA, 22 nt, Human
auuuccacauaagggaaauaag

SEQ ID NO: 483315 - RNA, 22 nt, Human
ucucccuggagcccugaagcau

SEQ ID NO: 483316 - RNA, 22 nt, Human
gagcuuuaagggauaaaaugau

SEQ ID NO: 483317 - RNA, 18 nt, Human
ggacaucaucaggugcuu

SEQ ID NO: 483318 - RNA, 22 nt, Human
gcugagcugaggcagggcuggg

SEQ ID NO: 483319 - RNA, 22 nt, Human
ucccagagugugggcaucaagg

SEQ ID NO: 483320 - RNA, 21 nt, Human
aacauuucaggauccaaauug

SEQ ID NO: 483321 - RNA, 21 nt, Human
ccagagagagggaaguggguu

SEQ ID NO: 483322 - RNA, 22 nt, Human
gccaggcacugcucuaagcccu

SEQ ID NO: 483323 - RNA, 22 nt, Human
aggcacagcacaccuggccccc

SEQ ID NO: 483324 - RNA, 22 nt, Human
ucuaguucuagaucccugagga

SEQ ID NO: 483325 - RNA, 22 nt, Human
ggugcagcugcagccugggagc

SEQ ID NO: 483326 - RNA, 22 nt, Human
cuccagugcgcaggacagcccc

SEQ ID NO: 483327 - RNA, 22 nt, Human
cauuuauuggcauguaguaggu

SEQ ID NO: 483328 - RNA, 16 nt, Human
uagggcugggaaggag

SEQ ID NO: 483329 - RNA, 22 nt, Human
guggcugggcuccgagcggcuu

SEQ ID NO: 483330 - RNA, 22 nt, Human
uccaggcauaagccuugagugu

SEQ ID NO: 483331 - RNA, 22 nt, Human
agccuggaccaggggccucaga

SEQ ID NO: 483332 - RNA, 22 nt, Human
aggaccugccaggugcaaagca

SEQ ID NO: 483333 - RNA, 22 nt, Human
cagcugccacaccucuuucucu

SEQ ID NO: 483334 - RNA, 18 nt, Human
gaucgggggcgccccaag

SEQ ID NO: 483335 - RNA, 22 nt, Human
agcagguguagggcucuuugua

SEQ ID NO: 483336 - RNA, 22 nt, Human
auaauucagguuuucuggcaca

SEQ ID NO: 483337 - RNA, 23 nt, Human
ggcagagagcauggcuggggccc

SEQ ID NO: 483338 - RNA, 22 nt, Human
agccuguccagaggacagggcu

SEQ ID NO: 483339 - RNA, 22 nt, Human
agcugcuguggggcucggccug

SEQ ID NO: 483340 - RNA, 18 nt, Human
gucuggaggucaggagcu

SEQ ID NO: 483341 - RNA, 22 nt, Human
uccaggagguagugcuuaauuu

SEQ ID NO: 483342 - RNA, 16 nt, Human
uggcugagagaggguu

SEQ ID NO: 483343 - RNA, 22 nt, Human
augccagucaaagaagaugaca

SEQ ID NO: 483344 - RNA, 22 nt, Human
caguggauuagccagagcugga

SEQ ID NO: 483345 - RNA, 19 nt, Human
ucuggagcugaugcaggug

SEQ ID NO: 483346 - RNA, 22 nt, Human
aagcagaaaaacugagcuccaa

SEQ ID NO: 483347 - RNA, 22 nt, Human
ucaggggacagccagcuggagg

SEQ ID NO: 483348 - RNA, 22 nt, Human
ugucucaggcccaagccaguaa

SEQ ID NO: 483349 - RNA, 22 nt, Human
auauuaggcaaggagauuauuu

SEQ ID NO: 483350 - RNA, 22 nt, Human
uguaggccuauguccagcaauu

SEQ ID NO: 483351 - RNA, 22 nt, Human
uuaaacagacaguaaaugaaac

SEQ ID NO: 483352 - RNA, 22 nt, Human
ccuaugccugucacucugcgcu

SEQ ID NO: 483353 - RNA, 20 nt, Human
gcauccagacacccagcugc

SEQ ID NO: 483354 - RNA, 22 nt, Human
cuuuauguucaguacaaugcuu

SEQ ID NO: 483355 - RNA, 18 nt, Human
aagccagagaccacugcc

SEQ ID NO: 483356 - RNA, 22 nt, Human
ugguuuaccccuguccuauauc

SEQ ID NO: 483357 - RNA, 22 nt, Human
uuuacauugcauuagguauuau

SEQ ID NO: 483358 - RNA, 21 nt, Human
agagaagaggacuuucucaca

SEQ ID NO: 483359 - RNA, 22 nt, Human
gaaucauuuagcucugcaugga

SEQ ID NO: 483360 - RNA, 22 nt, Human
ucucaggcuaccuugcacaagg

SEQ ID NO: 483361 - RNA, 22 nt, Human
acccuuucuuacucacacgcuc

SEQ ID NO: 483362 - RNA, 22 nt, Human
cagggcccagucccugcuguca

SEQ ID NO: 483363 - RNA, 22 nt, Human
aaacuguaaauacuaguaagug

SEQ ID NO: 483364 - RNA, 20 nt, Human
ucauccaggacaggaguggc

SEQ ID NO: 483365 - RNA, 22 nt, Human
gccaggaguucagaugcauguu

SEQ ID NO: 483366 - RNA, 19 nt, Human
gacucacaccuuccgcugu

SEQ ID NO: 483367 - RNA, 22 nt, Human
ucucuucuugauuuucacugga

SEQ ID NO: 483368 - RNA, 22 nt, Human
gagccagcuacauggucugcaa

SEQ ID NO: 483369 - RNA, 22 nt, Human
ucccagggucaguggugaggcc

SEQ ID NO: 483370 - RNA, 22 nt, Human
acccaggcugcuucucaguggc

SEQ ID NO: 483371 - RNA, 22 nt, Human
ugcagucuggauguccucagau

SEQ ID NO: 483372 - RNA, 22 nt, Human
uggucaacaggcagggaugaaa

SEQ ID NO: 483373 - RNA, 22 nt, Human
ucauuuccucaaauucaagguu

SEQ ID NO: 483374 - RNA, 22 nt, Human
uagaauaugugguaggaucugg

SEQ ID NO: 483375 - RNA, 22 nt, Human
ugaugcuucacgcugaauaugc

SEQ ID NO: 483376 - RNA, 20 nt, Human
uccuugaaagugggguauau

SEQ ID NO: 483377 - RNA, 20 nt, Human
gcaggcagggaaugggggug

SEQ ID NO: 483378 - RNA, 22 nt, Human
aaaugcagguucuugagccaag

SEQ ID NO: 483379 - RNA, 22 nt, Human
gggggcaguaaggauauggaaa

SEQ ID NO: 483380 - RNA, 22 nt, Human
gugcagauccugauugcaguuc

SEQ ID NO: 483381 - RNA, 22 nt, Human
aaguguuuacuuaaagucaugg

SEQ ID NO: 483382 - RNA, 22 nt, Human
ucuggagcuggcagggcccugg

SEQ ID NO: 483383 - RNA, 23 nt, Human
agcacagacuagaaaggucuuuc

SEQ ID NO: 483384 - RNA, 17 nt, Human
aggcaggagauuggaga

SEQ ID NO: 483385 - RNA, 22 nt, Human
cagagguacaagcuaaguuggg

SEQ ID NO: 483386 - RNA, 23 nt, Human
gaguguucauagcaggcucuugc

SEQ ID NO: 483387 - RNA, 22 nt, Human
accugagccuagggagguugag

SEQ ID NO: 483388 - RNA, 22 nt, Human
cucaggaggaggaaguucauug

SEQ ID NO: 483389 - RNA, 22 nt, Human
uuagauauguuuuugcuaaugc

SEQ ID NO: 483390 - RNA, 20 nt, Human
cccuggccuguuucaugccc

SEQ ID NO: 483391 - RNA, 22 nt, Human
uucaauucuaaacuaauauucu

SEQ ID NO: 483392 - RNA, 22 nt, Human
ggaggagacccugugucaguuu

SEQ ID NO: 483393 - RNA, 22 nt, Human
ggagcagccgcgucucagggca

SEQ ID NO: 483394 - RNA, 22 nt, Human
cuuggucauuuggggcugcuau

SEQ ID NO: 483395 - RNA, 22 nt, Human
caguuauuaugaggucauuagg

SEQ ID NO: 483396 - RNA, 22 nt, Human
acuuaaaaacagauccagcagg

SEQ ID NO: 483397 - RNA, 23 nt, Human
gcucugagggcuuaucccuccca

SEQ ID NO: 483398 - RNA, 22 nt, Human
uacaaacuuguuuuaaguaagu

SEQ ID NO: 483399 - RNA, 22 nt, Human
agauguggauccuaggguagaa

SEQ ID NO: 483400 - RNA, 22 nt, Human
agccucugugacucacagguca

SEQ ID NO: 483401 - RNA, 21 nt, Human
gcagccacagccaccaagcua

SEQ ID NO: 483402 - RNA, 22 nt, Human
caggugggccgggguuuguucu

SEQ ID NO: 483403 - RNA, 22 nt, Human
cagggugcgccacucagaugua

SEQ ID NO: 483404 - RNA, 22 nt, Human
aaaucugguucaguaaguccuc

SEQ ID NO: 483405 - RNA, 20 nt, Human
cugcugugugugccucagcc

SEQ ID NO: 483406 - RNA, 22 nt, Human
aaaaugugaucuacaaaugcaa

SEQ ID NO: 483407 - RNA, 22 nt, Human
ccuggagauuauuugguccaau

SEQ ID NO: 483408 - RNA, 22 nt, Human
uuuauacuccacucugcaagcg

SEQ ID NO: 483409 - RNA, 22 nt, Human
gggccuguguguucaggagccu

SEQ ID NO: 483410 - RNA, 22 nt, Human
ugcccaagcagaggagugauuc

SEQ ID NO: 483411 - RNA, 22 nt, Human
uggcaggguggcaacuuuuggu

SEQ ID NO: 483412 - RNA, 22 nt, Human
uaaagccacuucauucuagucu

SEQ ID NO: 483413 - RNA, 22 nt, Human
uauguacacauacacuuguaau

SEQ ID NO: 483414 - RNA, 22 nt, Human
ucuucuuccucauuuauacaua

SEQ ID NO: 483415 - RNA, 21 nt, Human
agagcugggacuugccugaga

SEQ ID NO: 483416 - RNA, 19 nt, Human
gcuguacaguaaggagaca

SEQ ID NO: 483417 - RNA, 22 nt, Human
cagugaggaguccagggcagag

SEQ ID NO: 483418 - RNA, 22 nt, Human
cucaggagcuuccucagcccau

SEQ ID NO: 483419 - RNA, 22 nt, Human
cgucccaguuccagccgcgcug

SEQ ID NO: 483420 - RNA, 22 nt, Human
cugcccugggaguaccuguccu

SEQ ID NO: 483421 - RNA, 22 nt, Human
agggagaagguuuagcugugag

SEQ ID NO: 483422 - RNA, 22 nt, Human
ucuauuugcugguugcuucugu

SEQ ID NO: 483423 - RNA, 22 nt, Human
ggugcugguucaggguggcugu

SEQ ID NO: 483424 - RNA, 22 nt, Human
aaguccagaacuccugugauag

SEQ ID NO: 483425 - RNA, 22 nt, Human
gacuucaaaggucaaacaucgc

SEQ ID NO: 483426 - RNA, 19 nt, Human
ggaggccuggguauuugcc

SEQ ID NO: 483427 - RNA, 22 nt, Human
acuguacauauggauucuaaga

SEQ ID NO: 483428 - RNA, 22 nt, Human
ggaggccaccugaccugcuguu

SEQ ID NO: 483429 - RNA, 22 nt, Human
ccucucccacguggcagaggcu

SEQ ID NO: 483430 - RNA, 23 nt, Human
ucccagggaaggugagcgaggcu

SEQ ID NO: 483431 - RNA, 22 nt, Human
cagccuguagaauacaguaaau

SEQ ID NO: 483432 - RNA, 17 nt, Human
acagagguuauacagac

SEQ ID NO: 483433 - RNA, 22 nt, Human
caaaagauacuugcaucuaacu

SEQ ID NO: 483434 - RNA, 22 nt, Human
ggagccagaggcugcugcugug

SEQ ID NO: 483435 - RNA, 22 nt, Human
gaaaauuauugaaaauggcucu

SEQ ID NO: 483436 - RNA, 22 nt, Human
cccugccuugggguccacaccg

SEQ ID NO: 483437 - RNA, 22 nt, Human
gucccauaaguagugcaacuug

SEQ ID NO: 483438 - RNA, 22 nt, Human
cagcccaaagccccaggcuaga

SEQ ID NO: 483439 - RNA, 22 nt, Human
ccucucaucauuaucgcuuugu

SEQ ID NO: 483440 - RNA, 22 nt, Human
agacuguagggauagaggucuu

SEQ ID NO: 483441 - RNA, 22 nt, Human
cauuugcagagggugacacucu

SEQ ID NO: 483442 - RNA, 22 nt, Human
aaaaugaacagaacaaugggga

SEQ ID NO: 483443 - RNA, 22 nt, Human
gucaggauuaaugggaguaugc

SEQ ID NO: 483444 - RNA, 22 nt, Human
ggccucagugggccgcugcagg

SEQ ID NO: 483445 - RNA, 20 nt, Human
uucuuaaagaccucacuuug

SEQ ID NO: 483446 - RNA, 22 nt, Human
aguucuagaagacuuuuccauu

SEQ ID NO: 483447 - RNA, 22 nt, Human
aggcucugcagaccccagcugu

SEQ ID NO: 483448 - RNA, 22 nt, Human
uacauaauugucuuuguccuca

SEQ ID NO: 483449 - RNA, 22 nt, Human
gcucagagauggggaaugaaaa

SEQ ID NO: 483450 - RNA, 22 nt, Human
gcaugggcaagaggacuggggg

SEQ ID NO: 483451 - RNA, 19 nt, Human
aguagcagaaagugcagug

SEQ ID NO: 483452 - RNA, 22 nt, Human
cuauuauuagauaaucuacuug

SEQ ID NO: 483453 - RNA, 22 nt, Human
cuggguggaaagugcugagaau

SEQ ID NO: 483454 - RNA, 22 nt, Human
cugggugguucuaacuguugau

SEQ ID NO: 483455 - RNA, 22 nt, Human
cacagggcuucucauggggugc

SEQ ID NO: 483456 - RNA, 22 nt, Human
gcugucuggaggcucugaggga

SEQ ID NO: 483457 - RNA, 22 nt, Human
gggcaggaggcuaauucugcau

SEQ ID NO: 483458 - RNA, 22 nt, Human
ggcgcucaguguugccccagag

SEQ ID NO: 483459 - RNA, 21 nt, Human
gcaggaugcaucuuggugucu

SEQ ID NO: 483460 - RNA, 22 nt, Human
ucagagaugcagugccaccuac

SEQ ID NO: 483461 - RNA, 22 nt, Human
cugugcuugcggguguggagcc

SEQ ID NO: 483462 - RNA, 22 nt, Human
agggccugucagcgguguccug

SEQ ID NO: 483463 - RNA, 22 nt, Human
uucaucuugauggcuuccuaau

SEQ ID NO: 483464 - RNA, 22 nt, Human
aggcuccuugcucacaggcuca

SEQ ID NO: 483465 - RNA, 22 nt, Human
aucuaagaguuaacaucaagaa

SEQ ID NO: 483466 - RNA, 22 nt, Human
uuuaaagaaauuccucaucuuu

SEQ ID NO: 483467 - RNA, 22 nt, Human
ccaggaggcagagguuacagug

SEQ ID NO: 483468 - RNA, 22 nt, Human
aaauaauguuaggccuuugcuc

SEQ ID NO: 483469 - RNA, 22 nt, Human
gugccagggaguggaggagcuu

SEQ ID NO: 483470 - RNA, 22 nt, Human
cauugucacccaaagcucauag

SEQ ID NO: 483471 - RNA, 22 nt, Human
cagcucuguaaauuccuucauc

SEQ ID NO: 483472 - RNA, 22 nt, Human
caccaggugcuggaggacauca

SEQ ID NO: 483473 - RNA, 22 nt, Human
guuagggagggugcauaugugu

SEQ ID NO: 483474 - RNA, 22 nt, Human
caacagagagaccagaaacagg

SEQ ID NO: 483475 - RNA, 22 nt, Human
cuggcuuuuagugugaagacuu

SEQ ID NO: 483476 - RNA, 22 nt, Human
gaauuagguaauagaacuagua

SEQ ID NO: 483477 - RNA, 22 nt, Human
ucaaagagcuauucaguugugg

SEQ ID NO: 483478 - RNA, 22 nt, Human
uccaggcaguuuuccagguugu

SEQ ID NO: 483479 - RNA, 21 nt, Human
ccuggcuucagggugcacugg

SEQ ID NO: 483480 - RNA, 22 nt, Human
acuggcagcuguaggaugcaug

SEQ ID NO: 483481 - RNA, 22 nt, Human
acuguccaagcaugccuggcuu

SEQ ID NO: 483482 - RNA, 22 nt, Human
ggaagggccucgggcgugggac

SEQ ID NO: 483483 - RNA, 22 nt, Human
ccauuugucaccucugcacucc

SEQ ID NO: 483484 - RNA, 22 nt, Human
ucuaggagaaccaucagggagg

SEQ ID NO: 483485 - RNA, 22 nt, Human
cacuguguaagaagaugggcuu

SEQ ID NO: 483486 - RNA, 22 nt, Human
gggcuucucuuaugcuaacugg

SEQ ID NO: 483487 - RNA, 22 nt, Human
aacaaauguguuuuguaauuaa

SEQ ID NO: 483488 - RNA, 22 nt, Human
uaagacacaugcguacaagaua

SEQ ID NO: 483489 - RNA, 22 nt, Human
uuucaauguaugucuuucugag

SEQ ID NO: 483490 - RNA, 22 nt, Human
caugcacuuaccugaaauucaa

SEQ ID NO: 483491 - RNA, 22 nt, Human
auuugauuagcuguguaauuuu

SEQ ID NO: 483492 - RNA, 22 nt, Human
cagcuuugcaggcuggucagug

SEQ ID NO: 483493 - RNA, 22 nt, Human
uacugccuggagcauuggugcu

SEQ ID NO: 483494 - RNA, 22 nt, Human
uaauacuuuugccuuguauuca

SEQ ID NO: 483495 - RNA, 22 nt, Human
aaaugcauguagaauaauagag

SEQ ID NO: 483496 - RNA, 22 nt, Human
ggccucagaccggagcuggcca

SEQ ID NO: 483497 - RNA, 22 nt, Human
cugggaggcggagguuguagug

SEQ ID NO: 483498 - RNA, 22 nt, Human
gagagcuggauucuggauaggu

SEQ ID NO: 483499 - RNA, 22 nt, Human
uaggacaggugaggggcugugg

SEQ ID NO: 483500 - RNA, 22 nt, Human
accaugaugcauccuuaaggaa

SEQ ID NO: 483501 - RNA, 22 nt, Human
ccuaagaauuaaugaauacacc

SEQ ID NO: 483502 - RNA, 22 nt, Human
acuguggcucaucaggcuggug

SEQ ID NO: 483503 - RNA, 22 nt, Human
ugcaguggcgccaucucagcuc

SEQ ID NO: 483504 - RNA, 22 nt, Human
ccagcuuucugggugguuucug

SEQ ID NO: 483505 - RNA, 22 nt, Human
ugaggcagcaauuguauuguau

SEQ ID NO: 483506 - RNA, 22 nt, Human
ccugucugaaggcagggggaug

SEQ ID NO: 483507 - RNA, 20 nt, Human
ggguggaguugcggucugug

SEQ ID NO: 483508 - RNA, 19 nt, Human
ucuaacagaagugucgucc

SEQ ID NO: 483509 - RNA, 22 nt, Human
uccugagauucugcauuucuaa

SEQ ID NO: 483510 - RNA, 22 nt, Human
gccugagagucugcauuucuaa

SEQ ID NO: 483511 - RNA, 22 nt, Human
aggagcuggaguccaggcaagu

SEQ ID NO: 483512 - RNA, 22 nt, Human
uagggcucagcucuagcuccug

SEQ ID NO: 483513 - RNA, 22 nt, Human
aggccuggugugccggaugcag

SEQ ID NO: 483514 - RNA, 22 nt, Human
aauaaacugcucaauugcauca

SEQ ID NO: 483515 - RNA, 22 nt, Human
cugucugcuagaacaucuauac

SEQ ID NO: 483516 - RNA, 22 nt, Human
ugcagucuuccagcugcacaaa

SEQ ID NO: 483517 - RNA, 22 nt, Human
agcuuuaucagaggagucucua

SEQ ID NO: 483518 - RNA, 22 nt, Human
cugcagggcagaagggcauaga

SEQ ID NO: 483519 - RNA, 22 nt, Human
agguggcaggaggucagagaaa

SEQ ID NO: 483520 - RNA, 22 nt, Human
guaggcagucucucaggugauc

SEQ ID NO: 483521 - RNA, 22 nt, Human
auucaagagcccauguuuccug

SEQ ID NO: 483522 - RNA, 22 nt, Human
uaaggccaaggggccauagucu

SEQ ID NO: 483523 - RNA, 22 nt, Human
ugcagggccgcuggaggucaug

SEQ ID NO: 483524 - RNA, 22 nt, Human
uuccucaucugugcaccucacu

SEQ ID NO: 483525 - RNA, 22 nt, Human
agugaguggguuacagauggga

SEQ ID NO: 483526 - RNA, 17 nt, Human
uuauuuuuugggcugag

SEQ ID NO: 483527 - RNA, 22 nt, Human
aguggccagugcugcucugggg

SEQ ID NO: 483528 - RNA, 22 nt, Human
aagaagaaguguuauuuuuaga

SEQ ID NO: 483529 - RNA, 22 nt, Human
ggaggcagaauagagugugggu

SEQ ID NO: 483530 - RNA, 21 nt, Human
ggcacugagccagauggacuc

SEQ ID NO: 483531 - RNA, 22 nt, Human
uuuagaaauucaucuauggccu

SEQ ID NO: 483532 - RNA, 21 nt, Human
uuacuuuugcagcaaccuaau

SEQ ID NO: 483533 - RNA, 19 nt, Human
acuuugcaugugugucuaa

SEQ ID NO: 483534 - RNA, 21 nt, Human
ucacaugcccauuacuggagc

SEQ ID NO: 483535 - RNA, 22 nt, Human
cugccuggucucaggcaugggg

SEQ ID NO: 483536 - RNA, 22 nt, Human
guaacugaggcagcuuuuaaga

SEQ ID NO: 483537 - RNA, 22 nt, Human
acugggaggcaaagagcaagga

SEQ ID NO: 483538 - RNA, 22 nt, Human
agugagggaugaagaacugcgg

SEQ ID NO: 483539 - RNA, 22 nt, Human
ugggggugacuaucucgggaau

SEQ ID NO: 483540 - RNA, 22 nt, Human
ggaccugaacauaaaacgaggc

SEQ ID NO: 483541 - RNA, 22 nt, Human
gcuggcagucccaucagcuggg

SEQ ID NO: 483542 - RNA, 22 nt, Human
uguguacauaucuauccuagau

SEQ ID NO: 483543 - RNA, 22 nt, Human
aaauggauggaauugacauuua

SEQ ID NO: 483544 - RNA, 22 nt, Human
ucucccagugucuggcagucag

SEQ ID NO: 483545 - RNA, 22 nt, Human
uaaaugugaccuucauuuuaua

SEQ ID NO: 483546 - RNA, 22 nt, Human
accaggcaguauggugcugcaa

SEQ ID NO: 483547 - RNA, 22 nt, Human
aacaucuuuuuguuugcugaaa

SEQ ID NO: 483548 - RNA, 22 nt, Human
ggcuccacugcugaccacucca

SEQ ID NO: 483549 - RNA, 18 nt, Human
gugccaggaggcgcagcc

SEQ ID NO: 483550 - RNA, 22 nt, Human
augggcagaguggggacaggaa

SEQ ID NO: 483551 - RNA, 22 nt, Human
caagggccuccaccuugcucgu

SEQ ID NO: 483552 - RNA, 22 nt, Human
gaggcagcugaaggagugacag

SEQ ID NO: 483553 - RNA, 21 nt, Human
ccugugugucugacugggcua

SEQ ID NO: 483554 - RNA, 22 nt, Human
gugauuccuauuaguacaugca

SEQ ID NO: 483555 - RNA, 22 nt, Human
agagaacaaauuaaaggugguu

SEQ ID NO: 483556 - RNA, 22 nt, Human
caccaggcuggagugcagaggu

SEQ ID NO: 483557 - RNA, 22 nt, Human
caguagcaggcaggugcuuuug

SEQ ID NO: 483558 - RNA, 22 nt, Human
gccuucugaucgcuggacugac

SEQ ID NO: 483559 - RNA, 22 nt, Human
cagagggagcccuccaggagca

SEQ ID NO: 483560 - RNA, 19 nt, Human
gcugugugaccuugggcaa

SEQ ID NO: 483561 - RNA, 22 nt, Human
guguccagggccguguugucuu

SEQ ID NO: 483562 - RNA, 22 nt, Human
aaugcuguauaucuuagcuaau

SEQ ID NO: 483563 - RNA, 22 nt, Human
gaggcugauucggggaacagca

SEQ ID NO: 483564 - RNA, 22 nt, Human
ggauuucuuccuuccucagaag

SEQ ID NO: 483565 - RNA, 22 nt, Human
ccaguuuuuccagugcuuucug

SEQ ID NO: 483566 - RNA, 22 nt, Human
aagauuuagggccaguuuacau

SEQ ID NO: 483567 - RNA, 22 nt, Human
gaggggcucuuuaauaguaaca

SEQ ID NO: 483568 - RNA, 22 nt, Human
cugggcagcuguaucagggagu

SEQ ID NO: 483569 - RNA, 22 nt, Human
ggagccugcgggagcucccauu

SEQ ID NO: 483570 - RNA, 22 nt, Human
gaaggcugaguggguacggagg

SEQ ID NO: 483571 - RNA, 22 nt, Human
aggcacugaaagguggccagag

SEQ ID NO: 483572 - RNA, 22 nt, Human
gucauuucuguuucuucagugc

SEQ ID NO: 483573 - RNA, 22 nt, Human
ccagugcacagccaggcaggug

SEQ ID NO: 483574 - RNA, 22 nt, Human
ggagccuuccagacugcccaca

SEQ ID NO: 483575 - RNA, 22 nt, Human
uaguggagaguuguuuugugca

SEQ ID NO: 483576 - RNA, 22 nt, Human
gggcuggcaucaguugccgaga

SEQ ID NO: 483577 - RNA, 22 nt, Human
cuuguccuuuacuugagacuca

SEQ ID NO: 483578 - RNA, 19 nt, Human
ccuuugaaucaggacacuu

SEQ ID NO: 483579 - RNA, 22 nt, Human
uuugcauuuguucaaguauuga

SEQ ID NO: 483580 - RNA, 22 nt, Human
ccuggcugcuauagcagcaugu

SEQ ID NO: 483581 - RNA, 21 nt, Human
uguggcagauguugggaggca

SEQ ID NO: 483582 - RNA, 22 nt, Human
augcacaagaggcuagaaaaga

SEQ ID NO: 483583 - RNA, 22 nt, Human
gcagcauuuguggaaugggccc

SEQ ID NO: 483584 - RNA, 21 nt, Human
uggcucugagccucauggcug

SEQ ID NO: 483585 - RNA, 22 nt, Human
agcaggagagcagugcgugguc

SEQ ID NO: 483586 - RNA, 22 nt, Human
cagagcaguccuugucaaucag

SEQ ID NO: 483587 - RNA, 22 nt, Human
cauucugugauucuaaaucccu

SEQ ID NO: 483588 - RNA, 22 nt, Human
ggccuggcucuugcccagccug

SEQ ID NO: 483589 - RNA, 22 nt, Human
caggagcuacucagguuggguu

SEQ ID NO: 483590 - RNA, 22 nt, Human
cuguacaaguccuucaucaggg

SEQ ID NO: 483591 - RNA, 22 nt, Human
ucagaggaacacuguuucaugc

SEQ ID NO: 483592 - RNA, 22 nt, Human
agcaggaaagaaaaaucugugu

SEQ ID NO: 483593 - RNA, 22 nt, Human
ggagggagcauccccuugcuga

SEQ ID NO: 483594 - RNA, 22 nt, Human
gucugcugcagagcauggcuuu

SEQ ID NO: 483595 - RNA, 22 nt, Human
acugagcugcaagucagggagg

SEQ ID NO: 483596 - RNA, 22 nt, Human
uggccucuuacgacauagccuu

SEQ ID NO: 483597 - RNA, 22 nt, Human
aagggcugaaugaaggguugaa

SEQ ID NO: 483598 - RNA, 22 nt, Human
caggagcaugcugaugccagaa

SEQ ID NO: 483599 - RNA, 22 nt, Human
uugauaaaaugauaucuucuuu

SEQ ID NO: 483600 - RNA, 23 nt, Human
acacaaggguaacugccagccau

SEQ ID NO: 483601 - RNA, 22 nt, Human
aggggcuguggaaaccaacucu

SEQ ID NO: 483602 - RNA, 22 nt, Human
auuuccauacacccauuucuga

SEQ ID NO: 483603 - RNA, 22 nt, Human
ugugucccuuggaaccucagcu

SEQ ID NO: 483604 - RNA, 21 nt, Human
cagugcucaaucugacagugg

SEQ ID NO: 483605 - RNA, 22 nt, Human
aaagcaaugggucuaagguaaa

SEQ ID NO: 483606 - RNA, 22 nt, Human
cucagaguucuccugggaggug

SEQ ID NO: 483607 - RNA, 22 nt, Human
gccuuugccugcgacguggcug

SEQ ID NO: 483608 - RNA, 22 nt, Human
uagaaacugauagucuugugcu

SEQ ID NO: 483609 - RNA, 22 nt, Human
cacacaugagucuccccauugg

SEQ ID NO: 483610 - RNA, 22 nt, Human
ucaucacauguguagucauccc

SEQ ID NO: 483611 - RNA, 22 nt, Human
acagauugaucuugagaauuau

SEQ ID NO: 483612 - RNA, 22 nt, Human
ugguggccaauucacagggcuc

SEQ ID NO: 483613 - RNA, 22 nt, Human
ucacugcucuccaauguggagu

SEQ ID NO: 483614 - RNA, 22 nt, Human
gagugagggcagcaggggcugc

SEQ ID NO: 483615 - RNA, 22 nt, Human
uuugaaagaaaccagugaguga

SEQ ID NO: 483616 - RNA, 22 nt, Human
ucaaguauaucuagucauuagg

SEQ ID NO: 483617 - RNA, 19 nt, Human
ccagcagacacagcugccc

SEQ ID NO: 483618 - RNA, 22 nt, Human
gcucugugccacaugcaguguu

SEQ ID NO: 483619 - RNA, 22 nt, Human
cagccaggccuggugaccaaag

SEQ ID NO: 483620 - RNA, 22 nt, Human
caugaauauacauccugauggc

SEQ ID NO: 483621 - RNA, 22 nt, Human
ucugggagauccaagcagaacu

SEQ ID NO: 483622 - RNA, 22 nt, Human
ggcagagcugcaugagcacuca

SEQ ID NO: 483623 - RNA, 20 nt, Human
cagggcucugggccuggccu

SEQ ID NO: 483624 - RNA, 22 nt, Human
cacccagcauuggcuaagagag

SEQ ID NO: 483625 - RNA, 22 nt, Human
ggagcacccugcucagccaagc

SEQ ID NO: 483626 - RNA, 22 nt, Human
ugaagcaggugaauggaugucg

SEQ ID NO: 483627 - RNA, 22 nt, Human
cgaggcaggcaggcggaggaua

SEQ ID NO: 483628 - RNA, 18 nt, Human
aguaguggguuuagcuuc

SEQ ID NO: 483629 - RNA, 22 nt, Human
ugggccaggcaugugaucagca

SEQ ID NO: 483630 - RNA, 22 nt, Human
uuugcauuguuucaaaagugaa

SEQ ID NO: 483631 - RNA, 22 nt, Human
caaugauugcuauuuacauaaa

SEQ ID NO: 483632 - RNA, 21 nt, Human
auugaaagucaacaaucaguu

SEQ ID NO: 483633 - RNA, 23 nt, Human
ucacaggggccagcgcucugugg

SEQ ID NO: 483634 - RNA, 22 nt, Human
uuuacuuugugucaagucaaga

SEQ ID NO: 483635 - RNA, 22 nt, Human
uacuuuaaaaacugauaauuca

SEQ ID NO: 483636 - RNA, 22 nt, Human
uaacagaagagcaggcagcccu

SEQ ID NO: 483637 - RNA, 22 nt, Human
cccugaggggaguggugaggug

SEQ ID NO: 483638 - RNA, 22 nt, Human
cugaagagcucuccuguccccu

SEQ ID NO: 483639 - RNA, 22 nt, Human
gguggagcuguggacaggaagg

SEQ ID NO: 483640 - RNA, 20 nt, Human
gcugucuggauuagaagccu

SEQ ID NO: 483641 - RNA, 22 nt, Human
cugagagucagcuucuccuccu

SEQ ID NO: 483642 - RNA, 22 nt, Human
uugaaaggugcugugugcugau

SEQ ID NO: 483643 - RNA, 22 nt, Human
auucugucuuuuuaaaauaaua

SEQ ID NO: 483644 - RNA, 22 nt, Human
ucugggugaugaaaugcacugu

SEQ ID NO: 483645 - RNA, 22 nt, Human
aucagcaaucaaauugcagagu

SEQ ID NO: 483646 - RNA, 22 nt, Human
uuucuucucacccaggacagag

SEQ ID NO: 483647 - RNA, 18 nt, Human
gggaucaggcugccuagg

SEQ ID NO: 483648 - RNA, 22 nt, Human
cugagaggcacaaggcauuucg

SEQ ID NO: 483649 - RNA, 22 nt, Human
gccugugcuuaacugacgugag

SEQ ID NO: 483650 - RNA, 22 nt, Human
auauuagggucucuaaauucua

SEQ ID NO: 483651 - RNA, 19 nt, Human
aggugcaggucacagggga

SEQ ID NO: 483652 - RNA, 22 nt, Human
acacaugagaaacaucaguugu

SEQ ID NO: 483653 - RNA, 22 nt, Human
uggcucagcuuuccccaucugg

SEQ ID NO: 483654 - RNA, 22 nt, Human
gagcugucuggggacucugggu

SEQ ID NO: 483655 - RNA, 22 nt, Human
uuaacagagaacauagaaguag

SEQ ID NO: 483656 - RNA, 22 nt, Human
aggcugugcaauuaggguaaga

SEQ ID NO: 483657 - RNA, 20 nt, Human
cuaucuccuggcgugccuuc

SEQ ID NO: 483658 - RNA, 22 nt, Human
cacacaggagagugcuggaggu

SEQ ID NO: 483659 - RNA, 22 nt, Human
agugcauauaugaagaguauga

SEQ ID NO: 483660 - RNA, 22 nt, Human
ucagggcagccuaaggcaccuc

SEQ ID NO: 483661 - RNA, 22 nt, Human
uaaggccagccagcaaaucugu

SEQ ID NO: 483662 - RNA, 22 nt, Human
cagcugaguuuccaagucugcc

SEQ ID NO: 483663 - RNA, 22 nt, Human
aucuggcuccuacacuugaaga

SEQ ID NO: 483664 - RNA, 22 nt, Human
ucucccagaggaucccagugga

SEQ ID NO: 483665 - RNA, 22 nt, Human
agcuuuauuugucauucacggc

SEQ ID NO: 483666 - RNA, 22 nt, Human
ucccugggccuccugcuaugca

SEQ ID NO: 483667 - RNA, 22 nt, Human
aaggacagaaacagauugcugg

SEQ ID NO: 483668 - RNA, 22 nt, Human
accagagcuggcagaguaucaa

SEQ ID NO: 483669 - RNA, 22 nt, Human
augcuuuuccaggagaaauaua

SEQ ID NO: 483670 - RNA, 22 nt, Human
uuggauccaucucaggcauagg

SEQ ID NO: 483671 - RNA, 22 nt, Human
agcagcuccugccaugagugcu

SEQ ID NO: 483672 - RNA, 22 nt, Human
acaugauuuuaguaucauaaua

SEQ ID NO: 483673 - RNA, 22 nt, Human
gcacagggaggcuggccuggcc

SEQ ID NO: 483674 - RNA, 22 nt, Human
caauuucuggaacuaauucuga

SEQ ID NO: 483675 - RNA, 22 nt, Human
ggcuucugccacgagagggaag

SEQ ID NO: 483676 - RNA, 22 nt, Human
uugcagagcaguaggaauauag

SEQ ID NO: 483677 - RNA, 22 nt, Human
cagagcugguaagugguagagg

SEQ ID NO: 483678 - RNA, 22 nt, Human
agcuggccuccgggugccuggg

SEQ ID NO: 483679 - RNA, 22 nt, Human
agucccagaucuacaggaggga

SEQ ID NO: 483680 - RNA, 22 nt, Human
auauuugucaauucacuguuca

SEQ ID NO: 483681 - RNA, 22 nt, Human
uaggcaggcugaauguagauuu

SEQ ID NO: 483682 - RNA, 22 nt, Human
aagggaggccagagguuuugca

SEQ ID NO: 483683 - RNA, 22 nt, Human
gcucccuguucucagccaugau

SEQ ID NO: 483684 - RNA, 22 nt, Human
agaggccagguccagaguuugu

SEQ ID NO: 483685 - RNA, 22 nt, Human
ucccagacaaucauuggccacc

SEQ ID NO: 483686 - RNA, 22 nt, Human
ggcugcaguuugucuuuugcuu

SEQ ID NO: 483687 - RNA, 22 nt, Human
caguggcuguuucuggaaggca

SEQ ID NO: 483688 - RNA, 22 nt, Human
aggcagguguuaccucugguuu

SEQ ID NO: 483689 - RNA, 22 nt, Human
ugucaugccaggaaauaguccc

SEQ ID NO: 483690 - RNA, 22 nt, Human
gagcaugguuccauagguuggu

SEQ ID NO: 483691 - RNA, 20 nt, Human
accuugaacccgccagccau

SEQ ID NO: 483692 - RNA, 22 nt, Human
cauuuguaucauauguaucuua

SEQ ID NO: 483693 - RNA, 22 nt, Human
cugugccuggggggcagagcug

SEQ ID NO: 483694 - RNA, 22 nt, Human
ugccagagaagacccagucacu

SEQ ID NO: 483695 - RNA, 22 nt, Human
cugccucuguugggcauggucu

SEQ ID NO: 483696 - RNA, 22 nt, Human
uucacauuauaaucaguucugc

SEQ ID NO: 483697 - RNA, 22 nt, Human
cucuugggagugcucuggagaa

SEQ ID NO: 483698 - RNA, 23 nt, Human
uccugcagauaagcugguugaca

SEQ ID NO: 483699 - RNA, 22 nt, Human
ucuggccugaaaguccaugcuu

SEQ ID NO: 483700 - RNA, 23 nt, Human
cuagggcaguauuucacagacac

SEQ ID NO: 483701 - RNA, 22 nt, Human
cagcuugggaguuugguuuuau

SEQ ID NO: 483702 - RNA, 22 nt, Human
cccccagccagcagugcucagc

SEQ ID NO: 483703 - RNA, 22 nt, Human
uuauuuauucauucugucuguc

SEQ ID NO: 483704 - RNA, 22 nt, Human
gcugucccgcugacuuccagcu

SEQ ID NO: 483705 - RNA, 22 nt, Human
ggaugcugacuuuggagcaugg

SEQ ID NO: 483706 - RNA, 22 nt, Human
cuacaagauuuuuaaaacugua

SEQ ID NO: 483707 - RNA, 22 nt, Human
agcacagauucugaagaguccu

SEQ ID NO: 483708 - RNA, 22 nt, Human
gccucucucuacccaguaugau

SEQ ID NO: 483709 - RNA, 22 nt, Human
ggcuucccaaggagccaggaug

SEQ ID NO: 483710 - RNA, 18 nt, Human
uccugccugcgggcuccc

SEQ ID NO: 483711 - RNA, 22 nt, Human
auggaguucugccagcgcugcu

SEQ ID NO: 483712 - RNA, 22 nt, Human
ggcucaggagaggggcuaaaag

SEQ ID NO: 483713 - RNA, 22 nt, Human
aucuacagugcacaggacagcc

SEQ ID NO: 483714 - RNA, 20 nt, Human
cagaaggucuaagcuuuaga

SEQ ID NO: 483715 - RNA, 22 nt, Human
cucagggcaguauggcugagag

SEQ ID NO: 483716 - RNA, 22 nt, Human
gagugugggcacgggggccuug

SEQ ID NO: 483717 - RNA, 22 nt, Human
ugucagagagcaggcaguagaa

SEQ ID NO: 483718 - RNA, 22 nt, Human
gcucucugaggugcuggcagag

SEQ ID NO: 483719 - RNA, 22 nt, Human
cgaggcagacaaaaguuggaag

SEQ ID NO: 483720 - RNA, 18 nt, Human
acauuucuaggugaaagc

SEQ ID NO: 483721 - RNA, 22 nt, Human
cugcugggcagaggcugcauga

SEQ ID NO: 483722 - RNA, 22 nt, Human
gaggccuggcugggaggaggug

SEQ ID NO: 483723 - RNA, 22 nt, Human
ugguggccuugauggcaucugc

SEQ ID NO: 483724 - RNA, 22 nt, Human
cagacaggcuagccagacucac

SEQ ID NO: 483725 - RNA, 22 nt, Human
gggcacuguacacugugcaugg

SEQ ID NO: 483726 - RNA, 22 nt, Human
auguguuuguaccuuuaaauau

SEQ ID NO: 483727 - RNA, 22 nt, Human
aguccuucaagaaaucuggaaa

SEQ ID NO: 483728 - RNA, 22 nt, Human
caagugucuauaucagugcuug

SEQ ID NO: 483729 - RNA, 22 nt, Human
ggcaggagcucuccaguuugcc

SEQ ID NO: 483730 - RNA, 22 nt, Human
aaguuguauauaccgcuuuaag

SEQ ID NO: 483731 - RNA, 22 nt, Human
cagaggcaggauaagaacugcg

SEQ ID NO: 483732 - RNA, 22 nt, Human
gugugcaugcauagacaccaca

SEQ ID NO: 483733 - RNA, 22 nt, Human
cacacuagucuauccauuagcu

SEQ ID NO: 483734 - RNA, 22 nt, Human
ggagaggaaaugccagcacuuc

SEQ ID NO: 483735 - RNA, 22 nt, Human
cuggccaacuugcuuguuggca

SEQ ID NO: 483736 - RNA, 19 nt, Human
gcuggcagauguggccgug

SEQ ID NO: 483737 - RNA, 22 nt, Human
ugcugcucucagccaccaggaa

SEQ ID NO: 483738 - RNA, 20 nt, Human
ucacaucuggcagcugauga

SEQ ID NO: 483739 - RNA, 22 nt, Human
gagagcugcauucucagacaca

SEQ ID NO: 483740 - RNA, 22 nt, Human
caggguagacaguaggugucug

SEQ ID NO: 483741 - RNA, 21 nt, Human
aagagcugucaggaaggcugc

SEQ ID NO: 483742 - RNA, 21 nt, Human
uccauuguuuucccaggguuu

SEQ ID NO: 483743 - RNA, 22 nt, Human
cugaaggauucaaaauggcagg

SEQ ID NO: 483744 - RNA, 22 nt, Human
augcaguacagauaauucuaca

SEQ ID NO: 483745 - RNA, 20 nt, Human
aagagcugacucacaguggu

SEQ ID NO: 483746 - RNA, 20 nt, Human
uggagcuguaaucuugucug

SEQ ID NO: 483747 - RNA, 23 nt, Human
caguggagacucaugcuuccuua

SEQ ID NO: 483748 - RNA, 21 nt, Human
gcaugccugcaucuuaguguu

SEQ ID NO: 483749 - RNA, 22 nt, Human
uuguuacagcagugauuucaga

SEQ ID NO: 483750 - RNA, 22 nt, Human
gcucagaggagcaucauaagga

SEQ ID NO: 483751 - RNA, 21 nt, Human
aucagaaguuuuggucaguag

SEQ ID NO: 483752 - RNA, 23 nt, Human
aacaccaaggcucagagagauaa

SEQ ID NO: 483753 - RNA, 22 nt, Human
caggguugcaugcaucuguggg

SEQ ID NO: 483754 - RNA, 22 nt, Human
uggaggaaguugcuggaaguca

SEQ ID NO: 483755 - RNA, 22 nt, Human
gagggaaagguuaauacaugau

SEQ ID NO: 483756 - RNA, 18 nt, Human
ggaaaaggagugucuagc

SEQ ID NO: 483757 - RNA, 22 nt, Human
uggacucagugcugccauuccc

SEQ ID NO: 483758 - RNA, 22 nt, Human
ucaggcugcaucuguaagggug

SEQ ID NO: 483759 - RNA, 22 nt, Human
acuuuauuuccuauugcaucca

SEQ ID NO: 483760 - RNA, 22 nt, Human
aaaggucagacuuaggcugggc

SEQ ID NO: 483761 - RNA, 22 nt, Human
aggcaggcuagucgcuugagcc

SEQ ID NO: 483762 - RNA, 21 nt, Human
cagagcagcguucugcugugg

SEQ ID NO: 483763 - RNA, 22 nt, Human
ucauggagacuuugagccuguu

SEQ ID NO: 483764 - RNA, 22 nt, Human
acuuaaaaccagacagcgucau

SEQ ID NO: 483765 - RNA, 22 nt, Human
cccagcucucugcucuuagccu

SEQ ID NO: 483766 - RNA, 22 nt, Human
gccaggcuggaaagaacagaca

SEQ ID NO: 483767 - RNA, 22 nt, Human
uaaaaucauucuggugucagua

SEQ ID NO: 483768 - RNA, 22 nt, Human
cuauuuaucuauuucugaauga

SEQ ID NO: 483769 - RNA, 22 nt, Human
cugugacuagaccugcaggaga

SEQ ID NO: 483770 - RNA, 22 nt, Human
uagaacagaggguugcccagau

SEQ ID NO: 483771 - RNA, 22 nt, Human
ucaggccacggcucacugagac

SEQ ID NO: 483772 - RNA, 22 nt, Human
aguggcaguagaugagcugguu

SEQ ID NO: 483773 - RNA, 22 nt, Human
uucugucugauggugccagaac

SEQ ID NO: 483774 - RNA, 22 nt, Human
auugacaaggaaacuauaccag

SEQ ID NO: 483775 - RNA, 22 nt, Human
ggcacagggagccgcaguugca

SEQ ID NO: 483776 - RNA, 22 nt, Human
ggagaaggaagaaagcuacuau

SEQ ID NO: 483777 - RNA, 22 nt, Human
gguggagcuggaccaggagagg

SEQ ID NO: 483778 - RNA, 22 nt, Human
ucaccaggauuccuaucaguag

SEQ ID NO: 483779 - RNA, 22 nt, Human
cucaggguaaugaaagacgaau

SEQ ID NO: 483780 - RNA, 22 nt, Human
ggcugucucugugacugccacc

SEQ ID NO: 483781 - RNA, 22 nt, Human
gugcccugaguggguaggagag

SEQ ID NO: 483782 - RNA, 22 nt, Human
aagagccagcuagugaagaggc

SEQ ID NO: 483783 - RNA, 22 nt, Human
cuacagcagagcuacacuaacu

SEQ ID NO: 483784 - RNA, 22 nt, Human
gaaggaaaucugugauuuaugc

SEQ ID NO: 483785 - RNA, 19 nt, Human
auaaggcaggaggaaauuu

SEQ ID NO: 483786 - RNA, 22 nt, Human
uggcacuggcgcaggauggcgg

SEQ ID NO: 483787 - RNA, 19 nt, Human
agugcagggagcacccuca

SEQ ID NO: 483788 - RNA, 22 nt, Human
gggcaagcacagcgagcgugcg

SEQ ID NO: 483789 - RNA, 22 nt, Human
augucuuuauaaauguauaaug

SEQ ID NO: 483790 - RNA, 22 nt, Human
auugacaauuagcccuuaggug

SEQ ID NO: 483791 - RNA, 22 nt, Human
gagccuggauugaagugggugg

SEQ ID NO: 483792 - RNA, 22 nt, Human
uccagacccaugacccugggga

SEQ ID NO: 483793 - RNA, 22 nt, Human
cugagccagagggagucggguc

SEQ ID NO: 483794 - RNA, 22 nt, Human
agagccacggcaggccuaggaa

SEQ ID NO: 483795 - RNA, 22 nt, Human
ccagucugaggccuggugaggg

SEQ ID NO: 483796 - RNA, 22 nt, Human
agguagaggccuccaggcagca

SEQ ID NO: 483797 - RNA, 22 nt, Human
ugguccugagcaccagccugac

SEQ ID NO: 483798 - RNA, 22 nt, Human
gcugcccauuccacuggauggu

SEQ ID NO: 483799 - RNA, 22 nt, Human
caggauggucucgaucuccuga

SEQ ID NO: 483800 - RNA, 22 nt, Human
gaaagccaucuggcugcuggga

SEQ ID NO: 483801 - RNA, 22 nt, Human
aguacuuuacuucuuacaguuu

SEQ ID NO: 483802 - RNA, 22 nt, Human
ugauuucccuguagccucugaa

SEQ ID NO: 483803 - RNA, 22 nt, Human
uucuuacuaguauguuucagca

SEQ ID NO: 483804 - RNA, 22 nt, Human
caaggccacugcucagguuucc

SEQ ID NO: 483805 - RNA, 22 nt, Human
ucaucugucccaggcuuuuuuc

SEQ ID NO: 483806 - RNA, 22 nt, Human
uaggcagaaaggaaggcaaguu

SEQ ID NO: 483807 - RNA, 22 nt, Human
uccugcagcucugagaagcauc

SEQ ID NO: 483808 - RNA, 22 nt, Human
auuaauuuuaccuuuguaaaca

SEQ ID NO: 483809 - RNA, 22 nt, Human
uaucuauuccaaauaucagcgu

SEQ ID NO: 483810 - RNA, 22 nt, Human
cugggccagucucggccgcucu

SEQ ID NO: 483811 - RNA, 22 nt, Human
aauguguacaugacagauagaa

SEQ ID NO: 483812 - RNA, 22 nt, Human
uuagauaaauuaagacuuuaca

SEQ ID NO: 483813 - RNA, 17 nt, Human
aaucuguuuacagucag

SEQ ID NO: 483814 - RNA, 22 nt, Human
ugcuauugugaacagugccaca

SEQ ID NO: 483815 - RNA, 22 nt, Human
caagggcagcagccucaagcgg

SEQ ID NO: 483816 - RNA, 22 nt, Human
gcuccuggucuggagcuucaag

SEQ ID NO: 483817 - RNA, 22 nt, Human
cagagccaugguaugggcuugu

SEQ ID NO: 483818 - RNA, 22 nt, Human
gcaccaggcuuagagccccagg

SEQ ID NO: 483819 - RNA, 22 nt, Human
cuggcucauagagcagcuccaa

SEQ ID NO: 483820 - RNA, 22 nt, Human
cucacuguccaacaggcuuuac

SEQ ID NO: 483821 - RNA, 22 nt, Human
cuggcagcucuacucagagccu

SEQ ID NO: 483822 - RNA, 22 nt, Human
gccugcuguuaacugcaggaau

SEQ ID NO: 483823 - RNA, 22 nt, Human
cauguuauuuauccauuaaaca

SEQ ID NO: 483824 - RNA, 22 nt, Human
cagccagguucaaguccuuaua

SEQ ID NO: 483825 - RNA, 21 nt, Human
caguguggugaccagggucuc

SEQ ID NO: 483826 - RNA, 22 nt, Human
caggacaguauaggcuuuagga

SEQ ID NO: 483827 - RNA, 22 nt, Human
uaagcauaacuaaaaaugauuu

SEQ ID NO: 483828 - RNA, 22 nt, Human
gaaaugcagaaccugagaccau

SEQ ID NO: 483829 - RNA, 22 nt, Human
cucagccccaauucuccccauu

SEQ ID NO: 483830 - RNA, 22 nt, Human
gagagcuggguucaaguagcug

SEQ ID NO: 483831 - RNA, 22 nt, Human
cccagcuccuuacagggccgaa

SEQ ID NO: 483832 - RNA, 22 nt, Human
caggaacaauguaagucucauu

SEQ ID NO: 483833 - RNA, 22 nt, Human
acaggugguaaaauggacuguc

SEQ ID NO: 483834 - RNA, 22 nt, Human
guggccaggacauugccaggca

SEQ ID NO: 483835 - RNA, 22 nt, Human
uuuccucugggcccugccaccc

SEQ ID NO: 483836 - RNA, 20 nt, Human
guggccuguccuguuguggg

SEQ ID NO: 483837 - RNA, 22 nt, Human
cagagcuggccugugauuuuug

SEQ ID NO: 483838 - RNA, 16 nt, Human
agccaggcugccucgg

SEQ ID NO: 483839 - RNA, 22 nt, Human
uguacaugugucuguauaucuu

SEQ ID NO: 483840 - RNA, 22 nt, Human
gcguaaggccucuggucucgga

SEQ ID NO: 483841 - RNA, 22 nt, Human
cagucccaugagcccagaacau

SEQ ID NO: 483842 - RNA, 22 nt, Human
guauccuuugcggaaauuucua

SEQ ID NO: 483843 - RNA, 22 nt, Human
uauuuguauguguguacauaua

SEQ ID NO: 483844 - RNA, 22 nt, Human
accucccagcucugagcuuggg

SEQ ID NO: 483845 - RNA, 22 nt, Human
gcaggagagucugugccagguu

SEQ ID NO: 483846 - RNA, 22 nt, Human
acaggcagagaacucagccaga

SEQ ID NO: 483847 - RNA, 22 nt, Human
agccaucauuucugucacuggc

SEQ ID NO: 483848 - RNA, 22 nt, Human
gcagccucaaacuccccagcuc

SEQ ID NO: 483849 - RNA, 16 nt, Human
cagccugcagugguca

SEQ ID NO: 483850 - RNA, 22 nt, Human
cuggagagauccuccugaaaaa

SEQ ID NO: 483851 - RNA, 22 nt, Human
gagugcaguaucuucugugucc

SEQ ID NO: 483852 - RNA, 22 nt, Human
ccuggaagauucaccacuacca

SEQ ID NO: 483853 - RNA, 23 nt, Human
uuuuccagaaucgacucuguaga

SEQ ID NO: 483854 - RNA, 22 nt, Human
uuucagauggagguuuaggaca

SEQ ID NO: 483855 - RNA, 22 nt, Human
agagcuggacgucugagcccua

SEQ ID NO: 483856 - RNA, 22 nt, Human
cugggccucauccucagaguuu

SEQ ID NO: 483857 - RNA, 22 nt, Human
uuuccucuuuguaccuugacua

SEQ ID NO: 483858 - RNA, 18 nt, Human
cuuucagauggauaugcu

SEQ ID NO: 483859 - RNA, 22 nt, Human
uuuacacauaccucuuuaaagu

SEQ ID NO: 483860 - RNA, 22 nt, Human
ccaggcagcucugauuuauguc

SEQ ID NO: 483861 - RNA, 22 nt, Human
gugucauuaaccaccaugcaaa

SEQ ID NO: 483862 - RNA, 22 nt, Human
ccuuccaggugcaggcaagccu

SEQ ID NO: 483863 - RNA, 22 nt, Human
agaauguagucuuggagauuua

SEQ ID NO: 483864 - RNA, 22 nt, Human
ugggcuguccagcaccugggcu

SEQ ID NO: 483865 - RNA, 19 nt, Human
ggcugucucggcccagcca

SEQ ID NO: 483866 - RNA, 22 nt, Human
ucugggcugggagcguguggac

SEQ ID NO: 483867 - RNA, 22 nt, Human
ccaggcugcagucaaggggcau

SEQ ID NO: 483868 - RNA, 22 nt, Human
aggucagcugcugauaggcagc

SEQ ID NO: 483869 - RNA, 22 nt, Human
aggcccagcccguccucgugcu

SEQ ID NO: 483870 - RNA, 22 nt, Human
ugccugggccuucccaccucug

SEQ ID NO: 483871 - RNA, 22 nt, Human
uuacuuuggauggucaagaaag

SEQ ID NO: 483872 - RNA, 22 nt, Human
ucagaggguggcugggagcauc

SEQ ID NO: 483873 - RNA, 19 nt, Human
acagggcagcaauaggaua

SEQ ID NO: 483874 - RNA, 20 nt, Human
ggaccagguggggcgguggc

SEQ ID NO: 483875 - RNA, 22 nt, Human
cccagaggugcuucagaggugc

SEQ ID NO: 483876 - RNA, 18 nt, Human
ggccugaggauuucagca

SEQ ID NO: 483877 - RNA, 22 nt, Human
ugcagugggccggaggccaggg

SEQ ID NO: 483878 - RNA, 22 nt, Human
auaaacagcuccauuuagugcc

SEQ ID NO: 483879 - RNA, 22 nt, Human
gaggucagucagaccaggguuu

SEQ ID NO: 483880 - RNA, 22 nt, Human
gucagcugucuccccagagugg

SEQ ID NO: 483881 - RNA, 17 nt, Human
aggagucucagaugagc

SEQ ID NO: 483882 - RNA, 20 nt, Human
gcugccuuguccugcuuggu

SEQ ID NO: 483883 - RNA, 22 nt, Human
gaaugcacuuccaacaucuauu

SEQ ID NO: 483884 - RNA, 22 nt, Human
cuccucacuuuccagacugggc

SEQ ID NO: 483885 - RNA, 22 nt, Human
aauucugugcaggcagagcuau

SEQ ID NO: 483886 - RNA, 22 nt, Human
ugggcagagucguggggaauag

SEQ ID NO: 483887 - RNA, 22 nt, Human
guaacacagaaaugaaauucca

SEQ ID NO: 483888 - RNA, 22 nt, Human
cagacuuucaaggagugaaggc

SEQ ID NO: 483889 - RNA, 22 nt, Human
agaggcugaaugaugucaucau

SEQ ID NO: 483890 - RNA, 21 nt, Human
ucugggcccaugcugccucac

SEQ ID NO: 483891 - RNA, 22 nt, Human
cuucuugcaauuuucaucuuau

SEQ ID NO: 483892 - RNA, 22 nt, Human
auacuuacuuuucuucagacua

SEQ ID NO: 483893 - RNA, 22 nt, Human
auacaaguugugauaauguaaa

SEQ ID NO: 483894 - RNA, 22 nt, Human
auaaggcagaaauagggaaagu

SEQ ID NO: 483895 - RNA, 22 nt, Human
cuggccuguccugacccagccu

SEQ ID NO: 483896 - RNA, 22 nt, Human
ccugcccagcuucccgagugca

SEQ ID NO: 483897 - RNA, 21 nt, Human
ucagagagucacagugaacug

SEQ ID NO: 483898 - RNA, 20 nt, Human
gcuuuuucuaauagcagucc

SEQ ID NO: 483899 - RNA, 22 nt, Human
caagagcugcaaauagcgugac

SEQ ID NO: 483900 - RNA, 22 nt, Human
aauuucaaacuaauaggaacca

SEQ ID NO: 483901 - RNA, 22 nt, Human
gagcugcuggcuccucagguua

SEQ ID NO: 483902 - RNA, 21 nt, Human
auuuucauuuccaggggagga

SEQ ID NO: 483903 - RNA, 22 nt, Human
ucaguuuuuacggucacaggga

SEQ ID NO: 483904 - RNA, 22 nt, Human
gggauggggagcuggaaagggg

SEQ ID NO: 483905 - RNA, 22 nt, Human
cagcaggacauggaggaguaaa

SEQ ID NO: 483906 - RNA, 20 nt, Human
uauuuguauuugggaaaguu

SEQ ID NO: 483907 - RNA, 22 nt, Human
gcaggcagagagggguuuccag

SEQ ID NO: 483908 - RNA, 22 nt, Human
ucauuuguugcuguuaccugag

SEQ ID NO: 483909 - RNA, 22 nt, Human
aucugccuggcuccaggugagc

SEQ ID NO: 483910 - RNA, 22 nt, Human
ugaagcagaggggucuugagcu

SEQ ID NO: 483911 - RNA, 22 nt, Human
ccugagacaugaaccaggcucc

SEQ ID NO: 483912 - RNA, 19 nt, Human
ucagaggauuuggcuauga

SEQ ID NO: 483913 - RNA, 22 nt, Human
caggaccuggaaugcuugugaa

SEQ ID NO: 483914 - RNA, 20 nt, Human
uaucaaucagaaagaagacu

SEQ ID NO: 483915 - RNA, 22 nt, Human
caccagcuuugcccacugccca

SEQ ID NO: 483916 - RNA, 22 nt, Human
ucaaaaguuucacauagagaua

SEQ ID NO: 483917 - RNA, 23 nt, Human
ugagcugguauuguccaucucca

SEQ ID NO: 483918 - RNA, 22 nt, Human
ggcaucuguccaucucuccagc

SEQ ID NO: 483919 - RNA, 22 nt, Human
aaguaacaaugcuguugaauug

SEQ ID NO: 483920 - RNA, 22 nt, Human
cacauaauacauguuccacuua

SEQ ID NO: 483921 - RNA, 22 nt, Human
acuucauuguaauauuauagca

SEQ ID NO: 483922 - RNA, 22 nt, Human
aacaaucaaguuucuaaaugac

SEQ ID NO: 483923 - RNA, 22 nt, Human
ggucucagacuggcaggcagug

SEQ ID NO: 483924 - RNA, 22 nt, Human
gacauaaaauucaauaauuugu

SEQ ID NO: 483925 - RNA, 22 nt, Human
ucagccagugccuugaucuugc

SEQ ID NO: 483926 - RNA, 22 nt, Human
ucacugucugaaagaaauggcc

SEQ ID NO: 483927 - RNA, 22 nt, Human
uguuaggguccugugcaggggc

SEQ ID NO: 483928 - RNA, 20 nt, Human
uccucagaagacauuugggg

SEQ ID NO: 483929 - RNA, 22 nt, Human
uuucucaaguucagauauuuga

SEQ ID NO: 483930 - RNA, 22 nt, Human
agugagcauucguuuggaaccc

SEQ ID NO: 483931 - RNA, 22 nt, Human
ggugcagaggagccagcugggg

SEQ ID NO: 483932 - RNA, 22 nt, Human
caguccugagccaaucaugaug

SEQ ID NO: 483933 - RNA, 22 nt, Human
cagggcaggacagauacauuac

SEQ ID NO: 483934 - RNA, 22 nt, Human
cucaggauagauuguccucuca

SEQ ID NO: 483935 - RNA, 22 nt, Human
caggauggucuucauuuggcuc

SEQ ID NO: 483936 - RNA, 22 nt, Human
cagccagggagggcaaaugaga

SEQ ID NO: 483937 - RNA, 22 nt, Human
ugggagcaagcuggugcuggag

SEQ ID NO: 483938 - RNA, 22 nt, Human
agaggccggccgagcccauggg

SEQ ID NO: 483939 - RNA, 22 nt, Human
agcccuggcccggcugugcuuu

SEQ ID NO: 483940 - RNA, 23 nt, Human
gugcaugugucuuuacaguagca

SEQ ID NO: 483941 - RNA, 22 nt, Human
ccugaagggacuccagagagca

SEQ ID NO: 483942 - RNA, 22 nt, Human
cagagcugggcauggugaaagg

SEQ ID NO: 483943 - RNA, 22 nt, Human
ucucccacuggccuuguaugau

SEQ ID NO: 483944 - RNA, 22 nt, Human
aggggagaguuaaugugaaugu

SEQ ID NO: 483945 - RNA, 22 nt, Human
ucccuuaaaacucauguguugu

SEQ ID NO: 483946 - RNA, 22 nt, Human
agagcagaggcauggccguggg

SEQ ID NO: 483947 - RNA, 22 nt, Human
cugggacacccaaggaaagagc

SEQ ID NO: 483948 - RNA, 22 nt, Human
ugccugcucuuaccacucuccc

SEQ ID NO: 483949 - RNA, 22 nt, Human
aaggcacucauucaaggagaua

SEQ ID NO: 483950 - RNA, 20 nt, Human
gcagggcaagggauaugaaa

SEQ ID NO: 483951 - RNA, 22 nt, Human
ucaagagaaggggaaauagacu

SEQ ID NO: 483952 - RNA, 22 nt, Human
uggcagagcuggcugcggauga

SEQ ID NO: 483953 - RNA, 22 nt, Human
ucugagccaauuucugugucca

SEQ ID NO: 483954 - RNA, 19 nt, Human
agcaaauauaauaguguuc

SEQ ID NO: 483955 - RNA, 22 nt, Human
uuugacagcuuguuacaaaguu

SEQ ID NO: 483956 - RNA, 21 nt, Human
ccugagggugguugugaagau

SEQ ID NO: 483957 - RNA, 22 nt, Human
ggagagcagggaggcugcucug

SEQ ID NO: 483958 - RNA, 22 nt, Human
gcauggaauucccuuaugggcc

SEQ ID NO: 483959 - RNA, 22 nt, Human
uuuauguaauuucauaggugug

SEQ ID NO: 483960 - RNA, 22 nt, Human
caagagcuggagaggcagucua

SEQ ID NO: 483961 - RNA, 22 nt, Human
ugaaccaggaggcagccagcac

SEQ ID NO: 483962 - RNA, 22 nt, Human
uccugcugagcgucugucauuu

SEQ ID NO: 483963 - RNA, 22 nt, Human
agugugggugagggaggcccuc

SEQ ID NO: 483964 - RNA, 22 nt, Human
gccugugacucgucuugggcca

SEQ ID NO: 483965 - RNA, 22 nt, Human
aaaacuguaucuucuugggacu

SEQ ID NO: 483966 - RNA, 22 nt, Human
cagaggcauauaauugcugggg

SEQ ID NO: 483967 - RNA, 22 nt, Human
gcuggcagccaagugaagaggg

SEQ ID NO: 483968 - RNA, 22 nt, Human
gccuucugauaucucuuggcau

SEQ ID NO: 483969 - RNA, 22 nt, Human
uugauuuauagaauguucaagc

SEQ ID NO: 483970 - RNA, 22 nt, Human
cugcagagcagccaguccccca

SEQ ID NO: 483971 - RNA, 22 nt, Human
uacaaagugugcccaugcugag

SEQ ID NO: 483972 - RNA, 22 nt, Human
ugcccaaguguuuggcugaguc

SEQ ID NO: 483973 - RNA, 21 nt, Human
agaguaauuccugcuggaaag

SEQ ID NO: 483974 - RNA, 22 nt, Human
cccuuucccuucuggcucaggg

SEQ ID NO: 483975 - RNA, 22 nt, Human
accaaaggcagagcugaacacu

SEQ ID NO: 483976 - RNA, 22 nt, Human
aagaaucauccugcaagagucu

SEQ ID NO: 483977 - RNA, 22 nt, Human
uccauccauguaggaagauggu

SEQ ID NO: 483978 - RNA, 21 nt, Human
aaaaugugagcgugaugcuua

SEQ ID NO: 483979 - RNA, 22 nt, Human
uggcuucaucugcagcacugcc

SEQ ID NO: 483980 - RNA, 22 nt, Human
ugcaggccucacaccuggcacc

SEQ ID NO: 483981 - RNA, 22 nt, Human
cuccagugagugagcaggcgac

SEQ ID NO: 483982 - RNA, 22 nt, Human
gccucugcaauuacauugugcc

SEQ ID NO: 483983 - RNA, 22 nt, Human
caucugcuguuccuuggacuca

SEQ ID NO: 483984 - RNA, 20 nt, Human
auacacauauucuugcaacu

SEQ ID NO: 483985 - RNA, 22 nt, Human
acacaugcauaagccuucccuu

SEQ ID NO: 483986 - RNA, 22 nt, Human
ucagcaguuuuauaugcagcuu

SEQ ID NO: 483987 - RNA, 22 nt, Human
ugccucugugggccuuccuggc

SEQ ID NO: 483988 - RNA, 22 nt, Human
gcaaaaaccacaauuacuuuug

SEQ ID NO: 483989 - RNA, 22 nt, Human
cuggggugagcagaaacagggg

SEQ ID NO: 483990 - RNA, 22 nt, Human
gaaauucugugucccagagugc

SEQ ID NO: 483991 - RNA, 22 nt, Human
cugcucugaguauuaacggagg

SEQ ID NO: 483992 - RNA, 22 nt, Human
cagcauggggcuuggagucagc

SEQ ID NO: 483993 - RNA, 20 nt, Human
accccagccccucuaucuga

SEQ ID NO: 483994 - RNA, 22 nt, Human
gugcuuuccauccucccugcug

SEQ ID NO: 483995 - RNA, 22 nt, Human
cuguauuuaguuaaaaugcuaa

SEQ ID NO: 483996 - RNA, 22 nt, Human
auuguauuagcacaauacaauu

SEQ ID NO: 483997 - RNA, 20 nt, Human
ugccaggcacggagugcaug

SEQ ID NO: 483998 - RNA, 22 nt, Human
ccaaaggcggaacugagucucu

SEQ ID NO: 483999 - RNA, 22 nt, Human
cuggucugagggcucuugaggc

SEQ ID NO: 484000 - RNA, 22 nt, Human
ggagccuggcaaugcugcgucc

SEQ ID NO: 484001 - RNA, 22 nt, Human
uauaacaguuuaggugguguca

SEQ ID NO: 484002 - RNA, 22 nt, Human
aaagucauguaaugauaugauu

SEQ ID NO: 484003 - RNA, 22 nt, Human
uuuaguagaaugauacagggca

SEQ ID NO: 484004 - RNA, 22 nt, Human
uaacagaaguuguucauugugg

SEQ ID NO: 484005 - RNA, 22 nt, Human
gccuggguccacugaucaugcu

SEQ ID NO: 484006 - RNA, 22 nt, Human
cuacauuucccagcugccuucc

SEQ ID NO: 484007 - RNA, 22 nt, Human
cugggccugggaggccaggucu

SEQ ID NO: 484008 - RNA, 22 nt, Human
agagccugugauugucaucacc

SEQ ID NO: 484009 - RNA, 22 nt, Human
gagccugcccagcccuguccac

SEQ ID NO: 484010 - RNA, 22 nt, Human
caggccugacccugagcuucac

SEQ ID NO: 484011 - RNA, 19 nt, Human
cacaucagcagggcugugg

SEQ ID NO: 484012 - RNA, 22 nt, Human
agggccagaugaagccacaagc

SEQ ID NO: 484013 - RNA, 20 nt, Human
aagggagaauaaugauugua

SEQ ID NO: 484014 - RNA, 22 nt, Human
uuuuagauugggaaauguaaag

SEQ ID NO: 484015 - RNA, 22 nt, Human
cccucuggcucuucucaggccg

SEQ ID NO: 484016 - RNA, 22 nt, Human
uggcagcaaaaccagaaucaga

SEQ ID NO: 484017 - RNA, 22 nt, Human
cucccugggccucaguuucucu

SEQ ID NO: 484018 - RNA, 22 nt, Human
gucccagggaugcagacaugag

SEQ ID NO: 484019 - RNA, 20 nt, Human
aagcagaagcugcucucagc

SEQ ID NO: 484020 - RNA, 22 nt, Human
gcagugcugaucccauggcaga

SEQ ID NO: 484021 - RNA, 22 nt, Human
uucaacacaggaacaugauaua

SEQ ID NO: 484022 - RNA, 22 nt, Human
ccaggaugacccccacuuuccu

SEQ ID NO: 484023 - RNA, 22 nt, Human
cccagacuccucuggcuggugg

SEQ ID NO: 484024 - RNA, 22 nt, Human
ucucacugggucacagcagagg

SEQ ID NO: 484025 - RNA, 22 nt, Human
aaaucugggucaagguggagug

SEQ ID NO: 484026 - RNA, 22 nt, Human
caguuuauaugucagagcugua

SEQ ID NO: 484027 - RNA, 22 nt, Human
ucuauuucgcauauaaguuuug

SEQ ID NO: 484028 - RNA, 22 nt, Human
cacaugcaucugucauguuugg

SEQ ID NO: 484029 - RNA, 22 nt, Human
accugcaggcacaggugugcgc

SEQ ID NO: 484030 - RNA, 22 nt, Human
acuggcucagaguuccuagaga

SEQ ID NO: 484031 - RNA, 22 nt, Human
ggcugcaggcaggguauccacu

SEQ ID NO: 484032 - RNA, 22 nt, Human
uacauuccacuagugacuggcg

SEQ ID NO: 484033 - RNA, 22 nt, Human
cucagggacguuagaggacagg

SEQ ID NO: 484034 - RNA, 18 nt, Human
caggucagccuggccuca

SEQ ID NO: 484035 - RNA, 22 nt, Human
ggaggaggggugacugaaugcu

SEQ ID NO: 484036 - RNA, 22 nt, Human
uucuaccuacccucugcauaca

SEQ ID NO: 484037 - RNA, 22 nt, Human
cugagcugcggcaggcaccugg

SEQ ID NO: 484038 - RNA, 22 nt, Human
gagucugagucuaauggcccca

SEQ ID NO: 484039 - RNA, 22 nt, Human
cuggggcugcggacgggagccc

SEQ ID NO: 484040 - RNA, 22 nt, Human
ugccagaagauucucuaucaga

SEQ ID NO: 484041 - RNA, 23 nt, Human
agaccugcaucugauaggcccug

SEQ ID NO: 484042 - RNA, 22 nt, Human
aaaaaugaauucuucaguggca

SEQ ID NO: 484043 - RNA, 22 nt, Human
acuggcaguuugagaaugcauu

SEQ ID NO: 484044 - RNA, 22 nt, Human
ugugacagaucuuuaaauaaug

SEQ ID NO: 484045 - RNA, 22 nt, Human
ugcaugcagcuggugauaagaa

SEQ ID NO: 484046 - RNA, 23 nt, Human
uggcugagguccagguaguuuca

SEQ ID NO: 484047 - RNA, 22 nt, Human
ugagacaguucugcagcugggu

SEQ ID NO: 484048 - RNA, 22 nt, Human
ucauuuguucaucugcucuucu

SEQ ID NO: 484049 - RNA, 22 nt, Human
uuacucagucucccauacauug

SEQ ID NO: 484050 - RNA, 19 nt, Human
gaguuauugccagggcaug

SEQ ID NO: 484051 - RNA, 20 nt, Human
ugggcagcacugcuggcugg

SEQ ID NO: 484052 - RNA, 21 nt, Human
agacagaacaacugcucucca

SEQ ID NO: 484053 - RNA, 22 nt, Human
uccagggagauggcagaggcug

SEQ ID NO: 484054 - RNA, 22 nt, Human
gcagcuuugucacggagugucg

SEQ ID NO: 484055 - RNA, 22 nt, Human
uggggcugugagacuacaggau

SEQ ID NO: 484056 - RNA, 22 nt, Human
cugcuuuguggaaucacacugg

SEQ ID NO: 484057 - RNA, 22 nt, Human
ucagggcaucaucaugaauaua

SEQ ID NO: 484058 - RNA, 22 nt, Human
aaggcuuuuaacuacuguuuua

SEQ ID NO: 484059 - RNA, 22 nt, Human
gaauccaggguuguuugagcua

SEQ ID NO: 484060 - RNA, 22 nt, Human
uaccugcaaaguuccuuuugcc

SEQ ID NO: 484061 - RNA, 22 nt, Human
cucccaggggaacuaucaagua

SEQ ID NO: 484062 - RNA, 22 nt, Human
uggugugggcguggcaggcaag

SEQ ID NO: 484063 - RNA, 22 nt, Human
aggagucacucagggcuucauc

SEQ ID NO: 484064 - RNA, 22 nt, Human
ucacaguaucacacaaggauua

SEQ ID NO: 484065 - RNA, 22 nt, Human
ggucagggggaucugugaggua

SEQ ID NO: 484066 - RNA, 22 nt, Human
cagagcaucgcgcagagagccu

SEQ ID NO: 484067 - RNA, 22 nt, Human
ucaggcagcauuaaacuucagc

SEQ ID NO: 484068 - RNA, 22 nt, Human
aguggcagaucucuggucugga

SEQ ID NO: 484069 - RNA, 22 nt, Human
agucaauucuuuucaacucaag

SEQ ID NO: 484070 - RNA, 22 nt, Human
aguaaacauaauuuaccuguag

SEQ ID NO: 484071 - RNA, 22 nt, Human
ugaggcuuagagaagaugggau

SEQ ID NO: 484072 - RNA, 22 nt, Human
cgggcuggcugcagcugcugga

SEQ ID NO: 484073 - RNA, 22 nt, Human
agcugccuguccuaggccauca

SEQ ID NO: 484074 - RNA, 22 nt, Human
gcagcugcuguggcaucaagcu

SEQ ID NO: 484075 - RNA, 22 nt, Human
uccugccuguuuaccuguacuu

SEQ ID NO: 484076 - RNA, 22 nt, Human
ccagggccaagagaccucgagg

SEQ ID NO: 484077 - RNA, 22 nt, Human
gagguggccucaagcagucuuc

SEQ ID NO: 484078 - RNA, 22 nt, Human
ggcccagccggcgagucucgcg

SEQ ID NO: 484079 - RNA, 22 nt, Human
cccagcagccagaaugaggagc

SEQ ID NO: 484080 - RNA, 22 nt, Human
agacaucaaugaucagagguag

SEQ ID NO: 484081 - RNA, 18 nt, Human
guucaaggucaagagaga

SEQ ID NO: 484082 - RNA, 17 nt, Human
acaggccugcuugcacu

SEQ ID NO: 484083 - RNA, 22 nt, Human
ccuuuggguucaaucucggucu

SEQ ID NO: 484084 - RNA, 22 nt, Human
cuuagaaauuguuacucauuca

SEQ ID NO: 484085 - RNA, 22 nt, Human
ugucagaacucuauugaugucc

SEQ ID NO: 484086 - RNA, 22 nt, Human
ugaggcaguucuuacuuguauu

SEQ ID NO: 484087 - RNA, 18 nt, Human
ucagcuuuugaaaaccaa

SEQ ID NO: 484088 - RNA, 22 nt, Human
uuuguuuucaaugugucauuca

SEQ ID NO: 484089 - RNA, 22 nt, Human
aguccagggcucucugugggau

SEQ ID NO: 484090 - RNA, 22 nt, Human
guuggccugaauggucaagagg

SEQ ID NO: 484091 - RNA, 22 nt, Human
ugguccuggggaucugcaguga

SEQ ID NO: 484092 - RNA, 21 nt, Human
aaggcagaagcauggaaugag

SEQ ID NO: 484093 - RNA, 22 nt, Human
cucuggaguucuucaagcuacu

SEQ ID NO: 484094 - RNA, 22 nt, Human
uccaucagauucccuccugaga

SEQ ID NO: 484095 - RNA, 22 nt, Human
aagugacacauggcacuucuau

SEQ ID NO: 484096 - RNA, 22 nt, Human
agcagcaucuucuguucuccgc

SEQ ID NO: 484097 - RNA, 22 nt, Human
guaguucugcagugucaccuga

SEQ ID NO: 484098 - RNA, 22 nt, Human
aaaccaucagauaauucauacu

SEQ ID NO: 484099 - RNA, 22 nt, Human
ccaguggguaggccauggugag

SEQ ID NO: 484100 - RNA, 22 nt, Human
gcagacagacugcagugauuuu

SEQ ID NO: 484101 - RNA, 22 nt, Human
gcugucugucucugugacuuaa

SEQ ID NO: 484102 - RNA, 18 nt, Human
gcagcugcaguuguagcu

SEQ ID NO: 484103 - RNA, 22 nt, Human
cuggguggaucgcagccccagg

SEQ ID NO: 484104 - RNA, 22 nt, Human
guggagccaggaucuccgcaca

SEQ ID NO: 484105 - RNA, 22 nt, Human
gugccugcagcaauccauggca

SEQ ID NO: 484106 - RNA, 21 nt, Human
gggcgaggccugauguggcuc

SEQ ID NO: 484107 - RNA, 22 nt, Human
aaaugcauaucaaagacuugaa

SEQ ID NO: 484108 - RNA, 22 nt, Human
ucagagugugacuuggucauga

SEQ ID NO: 484109 - RNA, 22 nt, Human
uucuuugaguuaguacagucca

SEQ ID NO: 484110 - RNA, 22 nt, Human
caagcugguaucagcuagagcg

SEQ ID NO: 484111 - RNA, 22 nt, Human
uacuuagagcgauaauuuauac

SEQ ID NO: 484112 - RNA, 22 nt, Human
gagcagcuuaugucaagccaga

SEQ ID NO: 484113 - RNA, 22 nt, Human
cugacucagcagcugaugaucc

SEQ ID NO: 484114 - RNA, 22 nt, Human
gcacccagagggcagggucucc

SEQ ID NO: 484115 - RNA, 22 nt, Human
gaggggcagagguagagaacaa

SEQ ID NO: 484116 - RNA, 22 nt, Human
cagcaggauuggauacaucuca

SEQ ID NO: 484117 - RNA, 21 nt, Human
ugaaaucugaugggacaaaug

SEQ ID NO: 484118 - RNA, 22 nt, Human
ugauuuccaaaaggcuucuaag

SEQ ID NO: 484119 - RNA, 22 nt, Human
gacccaggguggucaccugaaa

SEQ ID NO: 484120 - RNA, 22 nt, Human
gugcaugugucuuuauaguaga

SEQ ID NO: 484121 - RNA, 19 nt, Human
gcugugccucucuccugcu

SEQ ID NO: 484122 - RNA, 22 nt, Human
ugaggaugacgauggcaauggc

SEQ ID NO: 484123 - RNA, 17 nt, Human
gaaagguccuagaaauc

SEQ ID NO: 484124 - RNA, 22 nt, Human
aaagccagaguguguuagagac

SEQ ID NO: 484125 - RNA, 19 nt, Human
acauuuagaauguacuugc

SEQ ID NO: 484126 - RNA, 22 nt, Human
cacuguacccauuuaaauaaau

SEQ ID NO: 484127 - RNA, 22 nt, Human
aggcucuggcaacagcuggugu

SEQ ID NO: 484128 - RNA, 22 nt, Human
cauuucugugacacuuccaucu

SEQ ID NO: 484129 - RNA, 22 nt, Human
uuuccucuccggggccuccagg

SEQ ID NO: 484130 - RNA, 22 nt, Human
ccuucagaccuagacaggaauc

SEQ ID NO: 484131 - RNA, 22 nt, Human
ccagugcaggugagcaccaggu

SEQ ID NO: 484132 - RNA, 22 nt, Human
uacauguaggugacauuuuaau

SEQ ID NO: 484133 - RNA, 22 nt, Human
aagccagauagaagaacucauu

SEQ ID NO: 484134 - RNA, 22 nt, Human
uggcaggguuggccaccuuacc

SEQ ID NO: 484135 - RNA, 18 nt, Human
cugccuguugcugagagg

SEQ ID NO: 484136 - RNA, 22 nt, Human
agccuggccacucagggccuga

SEQ ID NO: 484137 - RNA, 22 nt, Human
ugggagagugcucaaugugcaa

SEQ ID NO: 484138 - RNA, 22 nt, Human
uauuuucuguggaggaccagau

SEQ ID NO: 484139 - RNA, 22 nt, Human
ugccugccaugcagaaagcuga

SEQ ID NO: 484140 - RNA, 22 nt, Human
ugcugggggugucucaccaggc

SEQ ID NO: 484141 - RNA, 22 nt, Human
ugggcugccagcucuccagaug

SEQ ID NO: 484142 - RNA, 22 nt, Human
cugugcuuaccugcccagguga

SEQ ID NO: 484143 - RNA, 22 nt, Human
cugaaggauguguggugggagu

SEQ ID NO: 484144 - RNA, 22 nt, Human
uuugcaauuugugcugcaaaug

SEQ ID NO: 484145 - RNA, 22 nt, Human
gcccacagcucguuccucuccu

SEQ ID NO: 484146 - RNA, 22 nt, Human
acuguguguuugucuagcacag

SEQ ID NO: 484147 - RNA, 20 nt, Human
uaugaagauaugugaacagc

SEQ ID NO: 484148 - RNA, 22 nt, Human
aguguuucccaguaggaugaaa

SEQ ID NO: 484149 - RNA, 22 nt, Human
caguacuuugcaucauuccacu

SEQ ID NO: 484150 - RNA, 19 nt, Human
aagggcugggcaccucacu

SEQ ID NO: 484151 - RNA, 22 nt, Human
cagagcucagagcagggcacuc

SEQ ID NO: 484152 - RNA, 22 nt, Human
aggagcugcauggauaccuggu

SEQ ID NO: 484153 - RNA, 22 nt, Human
agacucugauaagcaacucuug

SEQ ID NO: 484154 - RNA, 22 nt, Human
gcagggccagggcucaggcugu

SEQ ID NO: 484155 - RNA, 22 nt, Human
ugaaaucuuauacuuugguagu

SEQ ID NO: 484156 - RNA, 22 nt, Human
gccucgaggcugagaaggcaca

SEQ ID NO: 484157 - RNA, 22 nt, Human
gggcugagaaguugaucccaag

SEQ ID NO: 484158 - RNA, 22 nt, Human
uacauucaacaugucacuaugu

SEQ ID NO: 484159 - RNA, 22 nt, Human
ugaaagguuaaaaguaguauug

SEQ ID NO: 484160 - RNA, 22 nt, Human
ggcuccuguccccucagcugcu

SEQ ID NO: 484161 - RNA, 22 nt, Human
ggcucaagcagucugccugccu

SEQ ID NO: 484162 - RNA, 22 nt, Human
agcaggugagcacagccaggcu

SEQ ID NO: 484163 - RNA, 22 nt, Human
uucaagucaaggaaagaggucu

SEQ ID NO: 484164 - RNA, 19 nt, Human
ucugcuggcagaauucccu

SEQ ID NO: 484165 - RNA, 22 nt, Human
ccaggcugccgaggaaagaaag

SEQ ID NO: 484166 - RNA, 22 nt, Human
agagcccugaagcagagcuaaa

SEQ ID NO: 484167 - RNA, 21 nt, Human
aaggagccuaggaggcucagg

SEQ ID NO: 484168 - RNA, 22 nt, Human
uggcugagaaaaaagagcuaua

SEQ ID NO: 484169 - RNA, 22 nt, Human
cagcaauaagccagguuagaca

SEQ ID NO: 484170 - RNA, 23 nt, Human
agaguccacaagauuuuccagug

SEQ ID NO: 484171 - RNA, 18 nt, Human
uggccuggagacaacucu

SEQ ID NO: 484172 - RNA, 22 nt, Human
ccuagagcucugcuuuaucuaa

SEQ ID NO: 484173 - RNA, 22 nt, Human
aaagauuucagaagccugugcc

SEQ ID NO: 484174 - RNA, 22 nt, Human
aaaucuggccccuugccuauuu

SEQ ID NO: 484175 - RNA, 20 nt, Human
aggcagacaaggagucuguu

SEQ ID NO: 484176 - RNA, 22 nt, Human
gcccagcugcacccuggugggu

SEQ ID NO: 484177 - RNA, 22 nt, Human
gcugaguguaaugauggcagag

SEQ ID NO: 484178 - RNA, 22 nt, Human
ugguccagacauuucugaggua

SEQ ID NO: 484179 - RNA, 22 nt, Human
ccuggguggcagagguugcagu

SEQ ID NO: 484180 - RNA, 22 nt, Human
ccuggagcacucucccuggcug

SEQ ID NO: 484181 - RNA, 22 nt, Human
aucuggcugacuuugugggaca

SEQ ID NO: 484182 - RNA, 22 nt, Human
ggcuagaacuuuacacuuugca

SEQ ID NO: 484183 - RNA, 17 nt, Human
ugaaggaaggaugaugu

SEQ ID NO: 484184 - RNA, 21 nt, Human
ggucagggggugccuccaggu

SEQ ID NO: 484185 - RNA, 22 nt, Human
agccacagugcaagagagaaaa

SEQ ID NO: 484186 - RNA, 22 nt, Human
acuguacuguguauuguagaau

SEQ ID NO: 484187 - RNA, 22 nt, Human
auggcagagggauugaacagcu

SEQ ID NO: 484188 - RNA, 22 nt, Human
auuuccuauagauauggugagu

SEQ ID NO: 484189 - RNA, 22 nt, Human
aggcugagccugggcguggugg

SEQ ID NO: 484190 - RNA, 22 nt, Human
caguggcugugaccagggaccu

SEQ ID NO: 484191 - RNA, 22 nt, Human
gugcagugaaaaaagaaugucc

SEQ ID NO: 484192 - RNA, 19 nt, Human
gugauuucuuuccacaagc

SEQ ID NO: 484193 - RNA, 22 nt, Human
guauacauagaugaugaacaag

SEQ ID NO: 484194 - RNA, 22 nt, Human
cacaggaggaggugcccgggcc

SEQ ID NO: 484195 - RNA, 20 nt, Human
ugucagugccugaggcacag

SEQ ID NO: 484196 - RNA, 22 nt, Human
gucaccagugcuaagaggugga

SEQ ID NO: 484197 - RNA, 22 nt, Human
ggcugaaguguaguggcucacu

SEQ ID NO: 484198 - RNA, 22 nt, Human
acagcaagccagcuugucacug

SEQ ID NO: 484199 - RNA, 22 nt, Human
cuucccacagaauucaaucagu

SEQ ID NO: 484200 - RNA, 22 nt, Human
acagggccucagccagggcaga

SEQ ID NO: 484201 - RNA, 22 nt, Human
cccagcuugcgggcggcaggag

SEQ ID NO: 484202 - RNA, 22 nt, Human
accaggggaugguuggcacugu

SEQ ID NO: 484203 - RNA, 22 nt, Human
uccugggccuguacuccauccg

SEQ ID NO: 484204 - RNA, 22 nt, Human
cucccagguuccgacgccucuu

SEQ ID NO: 484205 - RNA, 22 nt, Human
ucucaagaucucaagauggccc

SEQ ID NO: 484206 - RNA, 22 nt, Human
ccaaaguccuuucuccaccugc

SEQ ID NO: 484207 - RNA, 21 nt, Human
gccauuguuuucuaccuggag

SEQ ID NO: 484208 - RNA, 20 nt, Human
aauuuacucacagaaugaau

SEQ ID NO: 484209 - RNA, 22 nt, Human
ggcagcucugcuccacaugagu

SEQ ID NO: 484210 - RNA, 22 nt, Human
ucagagugugagacauauugga

SEQ ID NO: 484211 - RNA, 21 nt, Human
uccucugcagugagguggccu

SEQ ID NO: 484212 - RNA, 22 nt, Human
ggcugcugggaauaugccagcu

SEQ ID NO: 484213 - RNA, 22 nt, Human
gagcacugauuuauuuuugucu

SEQ ID NO: 484214 - RNA, 22 nt, Human
aauguguguauuucuaggcgag

SEQ ID NO: 484215 - RNA, 21 nt, Human
caaagccaggcaacucucucc

SEQ ID NO: 484216 - RNA, 22 nt, Human
gggcagauggggcacaggcuga

SEQ ID NO: 484217 - RNA, 22 nt, Human
cacacaugucucuccaugcucu

SEQ ID NO: 484218 - RNA, 22 nt, Human
augcugaauugaugcgagggag

SEQ ID NO: 484219 - RNA, 22 nt, Human
uccugagauaaaucucauguga

SEQ ID NO: 484220 - RNA, 22 nt, Human
ucauuugugugagugauuugac

SEQ ID NO: 484221 - RNA, 21 nt, Human
ucacuagugccuucugucauu

SEQ ID NO: 484222 - RNA, 22 nt, Human
gugcugcucacaucuggaggua

SEQ ID NO: 484223 - RNA, 23 nt, Human
ugauuuccagugagucaguggga

SEQ ID NO: 484224 - RNA, 22 nt, Human
aagcugccauagaacgagaggu

SEQ ID NO: 484225 - RNA, 23 nt, Human
aaucuggcugauguuuuuucucu

SEQ ID NO: 484226 - RNA, 22 nt, Human
cgagaguuagcuaggagucaca

SEQ ID NO: 484227 - RNA, 22 nt, Human
aagugaagaaauacaugagaau

SEQ ID NO: 484228 - RNA, 22 nt, Human
cauuauguucaguagcuuaaaa

SEQ ID NO: 484229 - RNA, 22 nt, Human
guggagcaaucagagggucagu

SEQ ID NO: 484230 - RNA, 19 nt, Human
ucccuuccugucgggcucc

SEQ ID NO: 484231 - RNA, 22 nt, Human
ucagggacuuacaaaccagaag

SEQ ID NO: 484232 - RNA, 21 nt, Human
agcuuccugcagugggagguc

SEQ ID NO: 484233 - RNA, 22 nt, Human
ggaggagacaguaaaaagcacg

SEQ ID NO: 484234 - RNA, 22 nt, Human
agaccagcugccucccagggcc

SEQ ID NO: 484235 - RNA, 22 nt, Human
aucccugcccucauggagcuua

SEQ ID NO: 484236 - RNA, 22 nt, Human
caagagcucagaaacccuugcu

SEQ ID NO: 484237 - RNA, 22 nt, Human
ugggccacggggguggagagcu

SEQ ID NO: 484238 - RNA, 22 nt, Human
augucacagcucccauuccucc

SEQ ID NO: 484239 - RNA, 17 nt, Human
cagcuuuaugcuacugu

SEQ ID NO: 484240 - RNA, 22 nt, Human
ucauuuuucacacagggucacc

SEQ ID NO: 484241 - RNA, 22 nt, Human
uggccuggcccugaggcccugu

SEQ ID NO: 484242 - RNA, 21 nt, Human
gcccagcaaggugagaaggcc

SEQ ID NO: 484243 - RNA, 22 nt, Human
gaugauuuuaugucuugucauu

SEQ ID NO: 484244 - RNA, 22 nt, Human
ggagaaggugcuggucacugug

SEQ ID NO: 484245 - RNA, 22 nt, Human
ugaaaucuucacuaagucucuu

SEQ ID NO: 484246 - RNA, 22 nt, Human
ccacagggacuguuaaaacccu

SEQ ID NO: 484247 - RNA, 22 nt, Human
cccucugccugggaccaagucc

SEQ ID NO: 484248 - RNA, 22 nt, Human
ugggccuggcccuguggaggag

SEQ ID NO: 484249 - RNA, 21 nt, Human
uagcacuucgcuguaauuggg

SEQ ID NO: 484250 - RNA, 22 nt, Human
uaagaacaguguuucaucucua

SEQ ID NO: 484251 - RNA, 22 nt, Human
gauacaaauucaugucugaauu

SEQ ID NO: 484252 - RNA, 22 nt, Human
uuagaaaucaccucugaagauc

SEQ ID NO: 484253 - RNA, 22 nt, Human
ggcugagcucaggggcagcagg

SEQ ID NO: 484254 - RNA, 22 nt, Human
auaaggcaucucucaguuagca

SEQ ID NO: 484255 - RNA, 20 nt, Human
uauuuacaacuuagagccuc

SEQ ID NO: 484256 - RNA, 22 nt, Human
gaacagcugcuagagaucugug

SEQ ID NO: 484257 - RNA, 22 nt, Human
acacacaauuaguuuuaugcuu

SEQ ID NO: 484258 - RNA, 22 nt, Human
ugccaggcaacugcccagccau

SEQ ID NO: 484259 - RNA, 23 nt, Human
aaaaaaccauguaggcacucagu

SEQ ID NO: 484260 - RNA, 22 nt, Human
auugucuguacuuuaaaaaugu

SEQ ID NO: 484261 - RNA, 22 nt, Human
augggggccugaacaggcaaaa

SEQ ID NO: 484262 - RNA, 22 nt, Human
cgacccuacagacagugcugag

SEQ ID NO: 484263 - RNA, 22 nt, Human
gcagagcuguuaauggagcuga

SEQ ID NO: 484264 - RNA, 22 nt, Human
acaguggaauuuguagaugugu

SEQ ID NO: 484265 - RNA, 22 nt, Human
uggacucagaaguguucuuuua

SEQ ID NO: 484266 - RNA, 20 nt, Human
aguggggagucaggagugcc

SEQ ID NO: 484267 - RNA, 22 nt, Human
gcagcaggcacggucucgacau

SEQ ID NO: 484268 - RNA, 22 nt, Human
ucauuuguggaagugauugugg

SEQ ID NO: 484269 - RNA, 22 nt, Human
aauguuacgaucaacaacacau

SEQ ID NO: 484270 - RNA, 22 nt, Human
aagccaggaagagagccuucac

SEQ ID NO: 484271 - RNA, 22 nt, Human
ggugaggcagguggcugcugag

SEQ ID NO: 484272 - RNA, 22 nt, Human
ugggcuggugagggaucauuua

SEQ ID NO: 484273 - RNA, 22 nt, Human
augagcuguaagguggcuuccu

SEQ ID NO: 484274 - RNA, 22 nt, Human
agcaaagucaguggaaccaucc

SEQ ID NO: 484275 - RNA, 22 nt, Human
gagacugcauagauggccacaa

SEQ ID NO: 484276 - RNA, 22 nt, Human
aggaggcuguggagcacuccau

SEQ ID NO: 484277 - RNA, 22 nt, Human
agcauuuaugacuaauguaaaa

SEQ ID NO: 484278 - RNA, 22 nt, Human
aggcucaguucuguggugagcc

SEQ ID NO: 484279 - RNA, 22 nt, Human
cagaagagaugaaauaguauua

SEQ ID NO: 484280 - RNA, 22 nt, Human
uguacacaauucuuaacauaca

SEQ ID NO: 484281 - RNA, 17 nt, Human
aagauuucauuagcuga

SEQ ID NO: 484282 - RNA, 22 nt, Human
aggccagacagcuagaaacagg

SEQ ID NO: 484283 - RNA, 22 nt, Human
cagccagcuggcacugugagua

SEQ ID NO: 484284 - RNA, 22 nt, Human
uggcucagcuuacuuuugaggg

SEQ ID NO: 484285 - RNA, 22 nt, Human
ggcucugguugaccaugauggc

SEQ ID NO: 484286 - RNA, 22 nt, Human
uauauguaagcuauguaagagu

SEQ ID NO: 484287 - RNA, 22 nt, Human
gcagggucuugagaggcagcca

SEQ ID NO: 484288 - RNA, 22 nt, Human
gcagcuuuuuggaugucaguua

SEQ ID NO: 484289 - RNA, 22 nt, Human
ggcucaccauggccucccugcu

SEQ ID NO: 484290 - RNA, 22 nt, Human
aaaugcaaggccaugugaagga

SEQ ID NO: 484291 - RNA, 22 nt, Human
cauugcacugcagcccgggcaa

SEQ ID NO: 484292 - RNA, 19 nt, Human
agugucaucagcuacucag

SEQ ID NO: 484293 - RNA, 22 nt, Human
agcuugauuucucugcagugug

SEQ ID NO: 484294 - RNA, 22 nt, Human
cugucaccuguucacugcagca

SEQ ID NO: 484295 - RNA, 22 nt, Human
cuuguaauuauaauguacuguu

SEQ ID NO: 484296 - RNA, 22 nt, Human
gggucaggcucagcagggcagc

SEQ ID NO: 484297 - RNA, 22 nt, Human
uucuacuuuagcaugcucauuc

SEQ ID NO: 484298 - RNA, 22 nt, Human
uugaagauggaucgccacucuc

SEQ ID NO: 484299 - RNA, 22 nt, Human
cccuggcauaaaacuucuccag

SEQ ID NO: 484300 - RNA, 20 nt, Human
acauugauuauguuuguaga

SEQ ID NO: 484301 - RNA, 22 nt, Human
cucucaggcuugggucguggca

SEQ ID NO: 484302 - RNA, 22 nt, Human
cagggacaugacuggucucugu

SEQ ID NO: 484303 - RNA, 21 nt, Human
uggcagagugcagucuauaca

SEQ ID NO: 484304 - RNA, 22 nt, Human
uuugacagauccuuaacucagc

SEQ ID NO: 484305 - RNA, 22 nt, Human
cuccuuccccuacucagcaucc

SEQ ID NO: 484306 - RNA, 22 nt, Human
acucacuuuccauucaagcacc

SEQ ID NO: 484307 - RNA, 22 nt, Human
caagacaagaucuaagcaugcu

SEQ ID NO: 484308 - RNA, 22 nt, Human
cugcucugugguccaugagaca

SEQ ID NO: 484309 - RNA, 22 nt, Human
agccagggauggcagugcccag

SEQ ID NO: 484310 - RNA, 22 nt, Human
uuucauaugggcauuggcaaua

SEQ ID NO: 484311 - RNA, 22 nt, Human
uacauucuggaaaggcacagac

SEQ ID NO: 484312 - RNA, 22 nt, Human
gaaguggaauuacugggucaua

SEQ ID NO: 484313 - RNA, 19 nt, Human
cagagcagugguuccugaa

SEQ ID NO: 484314 - RNA, 22 nt, Human
gaaggaaaaauacucuguaagg

SEQ ID NO: 484315 - RNA, 22 nt, Human
agggcagccaugagccuucagg

SEQ ID NO: 484316 - RNA, 22 nt, Human
agggcucccgugaggugacugc

SEQ ID NO: 484317 - RNA, 22 nt, Human
agcuaggacagguagagauggg

SEQ ID NO: 484318 - RNA, 19 nt, Human
ccaguagagacagcugcag

SEQ ID NO: 484319 - RNA, 22 nt, Human
gaucaaaagcuggguucuaaaa

SEQ ID NO: 484320 - RNA, 22 nt, Human
ccacagggcacaagggagguug

SEQ ID NO: 484321 - RNA, 22 nt, Human
agggacacugaugagaaauucu

SEQ ID NO: 484322 - RNA, 22 nt, Human
augauugaccaucugcugggcu

SEQ ID NO: 484323 - RNA, 22 nt, Human
ugucaccaguuccaggaaauaa

SEQ ID NO: 484324 - RNA, 22 nt, Human
ccugggagguggagguugcagc

SEQ ID NO: 484325 - RNA, 22 nt, Human
acuguguggaaauuugugaggg

SEQ ID NO: 484326 - RNA, 22 nt, Human
agccagaguugaaugugagucu

SEQ ID NO: 484327 - RNA, 22 nt, Human
uuccaguuaaggaagcuauucu

SEQ ID NO: 484328 - RNA, 22 nt, Human
gcaccugcaggaugagccaggg

SEQ ID NO: 484329 - RNA, 22 nt, Human
auggacagugugucuguuucca

SEQ ID NO: 484330 - RNA, 22 nt, Human
gugguaauagagcuccaaacua

SEQ ID NO: 484331 - RNA, 22 nt, Human
aggcucagggacucccucccuc

SEQ ID NO: 484332 - RNA, 19 nt, Human
ucaaaugccaaugucacag

SEQ ID NO: 484333 - RNA, 23 nt, Human
ggcucugugcugggccugcagga

SEQ ID NO: 484334 - RNA, 22 nt, Human
gccuggugcuaugagggccagc

SEQ ID NO: 484335 - RNA, 22 nt, Human
acagacagauuuugucugaugu

SEQ ID NO: 484336 - RNA, 22 nt, Human
ggaggccaaggcagguggauca

SEQ ID NO: 484337 - RNA, 22 nt, Human
gugucacaugguuuacugcagc

SEQ ID NO: 484338 - RNA, 22 nt, Human
gacagggcgcccagccuguuuc

SEQ ID NO: 484339 - RNA, 22 nt, Human
aaggccagaguacuagaggcug

SEQ ID NO: 484340 - RNA, 22 nt, Human
ucagaggacuaccuucuccagu

SEQ ID NO: 484341 - RNA, 22 nt, Human
agcaaggcagucagcuggcugg

SEQ ID NO: 484342 - RNA, 22 nt, Human
cggcagagacggcgcuuugaac

SEQ ID NO: 484343 - RNA, 22 nt, Human
aggagugggggcgagaaguuaa

SEQ ID NO: 484344 - RNA, 22 nt, Human
acagagcuaauguugcauaggc

SEQ ID NO: 484345 - RNA, 22 nt, Human
ugggguggauagaaagugaugu

SEQ ID NO: 484346 - RNA, 22 nt, Human
aagggcucucugcauugaaauu

SEQ ID NO: 484347 - RNA, 22 nt, Human
ggcgcuggccacgguggcucug

SEQ ID NO: 484348 - RNA, 22 nt, Human
ucagagucauugcaaguagaag

SEQ ID NO: 484349 - RNA, 22 nt, Human
gcuggcucuucaguggagauag

SEQ ID NO: 484350 - RNA, 22 nt, Human
aaugagcuagaccugcuuccuc

SEQ ID NO: 484351 - RNA, 22 nt, Human
ccaggcagagggaauagcaagu

SEQ ID NO: 484352 - RNA, 20 nt, Human
ccugaggguuuguguucuuu

SEQ ID NO: 484353 - RNA, 22 nt, Human
caggaggagcauuagcgucuca

SEQ ID NO: 484354 - RNA, 22 nt, Human
ucugucuuagcaucuuugcuca

SEQ ID NO: 484355 - RNA, 22 nt, Human
accucuggccuucaggcaucau

SEQ ID NO: 484356 - RNA, 22 nt, Human
cauuuauucauuugcuagggcu

SEQ ID NO: 484357 - RNA, 22 nt, Human
ccucagcugcuucccuggagcc

SEQ ID NO: 484358 - RNA, 22 nt, Human
ccuccugggccuugcucuguga

SEQ ID NO: 484359 - RNA, 22 nt, Human
gggcugacaguuuccccugaaa

SEQ ID NO: 484360 - RNA, 22 nt, Human
uccauggguagcccugguugag

SEQ ID NO: 484361 - RNA, 22 nt, Human
cuggcagcgcagcaugaagucg

SEQ ID NO: 484362 - RNA, 22 nt, Human
uggcccuguggaggucagugag

SEQ ID NO: 484363 - RNA, 22 nt, Human
ugaggcaggaguuaaugugcuc

SEQ ID NO: 484364 - RNA, 17 nt, Human
gcuuccucaugcaguuc

SEQ ID NO: 484365 - RNA, 22 nt, Human
gcacacaguauaugcucauuaa

SEQ ID NO: 484366 - RNA, 22 nt, Human
uggcagcagggccccuggagga

SEQ ID NO: 484367 - RNA, 22 nt, Human
caggccuggcugcagcucgccu

SEQ ID NO: 484368 - RNA, 22 nt, Human
acacuaauuaagcugcuuuacu

SEQ ID NO: 484369 - RNA, 22 nt, Human
agaguuaagacguacaugagug

SEQ ID NO: 484370 - RNA, 22 nt, Human
aggacaggauugagcugaacug

SEQ ID NO: 484371 - RNA, 22 nt, Human
gcagacaauuuauuagcagauu

SEQ ID NO: 484372 - RNA, 22 nt, Human
agggcuccgggcaggcgaugga

SEQ ID NO: 484373 - RNA, 22 nt, Human
aggccaggcaacauucugaagu

SEQ ID NO: 484374 - RNA, 22 nt, Human
caaggagaaaacggcuucugaa

SEQ ID NO: 484375 - RNA, 22 nt, Human
agacuuugagcucuuagagaag

SEQ ID NO: 484376 - RNA, 22 nt, Human
aaaguucaugguguuauagaaa

SEQ ID NO: 484377 - RNA, 22 nt, Human
gcuguauuccugcacuguauag

SEQ ID NO: 484378 - RNA, 17 nt, Human
gccugcaggcccgcaga

SEQ ID NO: 484379 - RNA, 22 nt, Human
auuuauuaugggauuuggcaca

SEQ ID NO: 484380 - RNA, 22 nt, Human
agcaggagcugugggaagaugg

SEQ ID NO: 484381 - RNA, 22 nt, Human
uuaaacauuuauggaggcagca

SEQ ID NO: 484382 - RNA, 22 nt, Human
ccagagagaaauggauuugagu

SEQ ID NO: 484383 - RNA, 22 nt, Human
gcugucagugaggugagacaug

SEQ ID NO: 484384 - RNA, 22 nt, Human
cugaaugaggaaaagagugagg

SEQ ID NO: 484385 - RNA, 22 nt, Human
gggaaauugugugagaucuuug

SEQ ID NO: 484386 - RNA, 22 nt, Human
gaggccugcagcguggucccug

SEQ ID NO: 484387 - RNA, 23 nt, Human
ccaggccucucagagggugugcc

SEQ ID NO: 484388 - RNA, 22 nt, Human
ugcaugcauaaauguacacaca

SEQ ID NO: 484389 - RNA, 22 nt, Human
ugcagcugaggccagcuaugcc

SEQ ID NO: 484390 - RNA, 22 nt, Human
ccugcagaccacacucaguccu

SEQ ID NO: 484391 - RNA, 22 nt, Human
cugaaggagaaggccacuguuc

SEQ ID NO: 484392 - RNA, 22 nt, Human
ucaaugauaucagcaggaugug

SEQ ID NO: 484393 - RNA, 22 nt, Human
acauuucucauaggagagccac

SEQ ID NO: 484394 - RNA, 22 nt, Human
ccucauggccuugagcugaggg

SEQ ID NO: 484395 - RNA, 22 nt, Human
agaccaagaaaggaugaggauc

SEQ ID NO: 484396 - RNA, 20 nt, Human
ugaagcagccuugauucugu

SEQ ID NO: 484397 - RNA, 22 nt, Human
ugccuacauuccuugcuuaugg

SEQ ID NO: 484398 - RNA, 22 nt, Human
accaggaggccuggagcacaaa

SEQ ID NO: 484399 - RNA, 22 nt, Human
aaugcacauaaauauggucuua

SEQ ID NO: 484400 - RNA, 23 nt, Human
aggcuuccuaucuuagagcuggg

SEQ ID NO: 484401 - RNA, 22 nt, Human
ggcagaaggccucccagcuccu

SEQ ID NO: 484402 - RNA, 22 nt, Human
uggggcuggggaucuugagccu

SEQ ID NO: 484403 - RNA, 22 nt, Human
agcacccucagccuuauccaga

SEQ ID NO: 484404 - RNA, 22 nt, Human
gacaggcuuccuaagugccaga

SEQ ID NO: 484405 - RNA, 23 nt, Human
ccagcucccaggucugaggacug

SEQ ID NO: 484406 - RNA, 22 nt, Human
ggcugcagagcugggugggccu

SEQ ID NO: 484407 - RNA, 22 nt, Human
cagagccucagaauccugugga

SEQ ID NO: 484408 - RNA, 22 nt, Human
caccagcuacagacuacugugu

SEQ ID NO: 484409 - RNA, 22 nt, Human
uggcagcaguagccaccccagc

SEQ ID NO: 484410 - RNA, 22 nt, Human
aaggagugcaugacucagagua

SEQ ID NO: 484411 - RNA, 22 nt, Human
gcccucucggcauagcaggggc

SEQ ID NO: 484412 - RNA, 17 nt, Human
cccagcuggcagugccg

SEQ ID NO: 484413 - RNA, 22 nt, Human
uagggcaggggaggaaucugaa

SEQ ID NO: 484414 - RNA, 22 nt, Human
ucugaggcuaagagacagaggc

SEQ ID NO: 484415 - RNA, 22 nt, Human
acaggcugcccgcuccccaccu

SEQ ID NO: 484416 - RNA, 17 nt, Human
agguggguggaucaccu

SEQ ID NO: 484417 - RNA, 22 nt, Human
ugccaaauugcccuauaaauga

SEQ ID NO: 484418 - RNA, 22 nt, Human
gcagagaccccgcagugaggcc

SEQ ID NO: 484419 - RNA, 21 nt, Human
ucuuguccuugcucucccacu

SEQ ID NO: 484420 - RNA, 22 nt, Human
auuccauuguguaaggauaucg

SEQ ID NO: 484421 - RNA, 23 nt, Human
gcugagguacauuuacaggaaga

SEQ ID NO: 484422 - RNA, 22 nt, Human
caggaucccuggccuccgccca

SEQ ID NO: 484423 - RNA, 22 nt, Human
gugggagcuuuggcaucaggcu

SEQ ID NO: 484424 - RNA, 22 nt, Human
uuuuuaagcuccuuugauguca

SEQ ID NO: 484425 - RNA, 22 nt, Human
uauuccuauuucuaaacauaug

SEQ ID NO: 484426 - RNA, 22 nt, Human
ugcugggggcuuucuggauacc

SEQ ID NO: 484427 - RNA, 22 nt, Human
gcuggaaggcuaggcucaguug

SEQ ID NO: 484428 - RNA, 22 nt, Human
acagcagcauaaacugacuaag

SEQ ID NO: 484429 - RNA, 22 nt, Human
acuucuugggacccuggcaccg

SEQ ID NO: 484430 - RNA, 22 nt, Human
agagcauccaucggccaggacc

SEQ ID NO: 484431 - RNA, 22 nt, Human
uccagccaccaccuugauugcc

SEQ ID NO: 484432 - RNA, 22 nt, Human
cagcagagcuuauguuggguca

SEQ ID NO: 484433 - RNA, 22 nt, Human
gccaccucggcuuucucugcuc

SEQ ID NO: 484434 - RNA, 22 nt, Human
acagaaauugggcaaauggaag

SEQ ID NO: 484435 - RNA, 22 nt, Human
ucccagagcaguacuccaggag

SEQ ID NO: 484436 - RNA, 22 nt, Human
gcagauggugccaugucuugug

SEQ ID NO: 484437 - RNA, 22 nt, Human
gacuguacgucauugaaggcca

SEQ ID NO: 484438 - RNA, 22 nt, Human
uggcucaggaucuaagcagaau

SEQ ID NO: 484439 - RNA, 21 nt, Human
ugcucacagaugugcucagug

SEQ ID NO: 484440 - RNA, 22 nt, Human
gaaaggagggaaacagagcggu

SEQ ID NO: 484441 - RNA, 22 nt, Human
aaacagaaauuuccucaugcuc

SEQ ID NO: 484442 - RNA, 23 nt, Human
aguuuuucugcaugguucuguau

SEQ ID NO: 484443 - RNA, 22 nt, Human
ugggaguggggcauagaaggua

SEQ ID NO: 484444 - RNA, 22 nt, Human
gcugccuucaguucugauucau

SEQ ID NO: 484445 - RNA, 22 nt, Human
acuuuuaugauaaucaauguuc

SEQ ID NO: 484446 - RNA, 22 nt, Human
auuuaaaugcuuaagaggguuu

SEQ ID NO: 484447 - RNA, 22 nt, Human
ucccagccuuccuuguggugaa

SEQ ID NO: 484448 - RNA, 22 nt, Human
gcagcccagguguagcucuuug

SEQ ID NO: 484449 - RNA, 19 nt, Human
gcagccaccgcggcggccg

SEQ ID NO: 484450 - RNA, 22 nt, Human
ccagcuggcacuguggcugccc

SEQ ID NO: 484451 - RNA, 22 nt, Human
gcugccugggcaggaggcgcug

SEQ ID NO: 484452 - RNA, 22 nt, Human
aaggcacuacgcugcuggggcg

SEQ ID NO: 484453 - RNA, 22 nt, Human
uaacugauauugaaaaacauca

SEQ ID NO: 484454 - RNA, 22 nt, Human
gagacacaggugguuccuguca

SEQ ID NO: 484455 - RNA, 16 nt, Human
gagaagagcccggcag

SEQ ID NO: 484456 - RNA, 22 nt, Human
ugcagggacaggcucuggggau

SEQ ID NO: 484457 - RNA, 22 nt, Human
uccugcagagucccacugauuu

SEQ ID NO: 484458 - RNA, 22 nt, Human
ugcuccuuccucauccugugca

SEQ ID NO: 484459 - RNA, 22 nt, Human
cuguuuaucuaggaguugcagg

SEQ ID NO: 484460 - RNA, 22 nt, Human
cugccaaggcuggggaggacaa

SEQ ID NO: 484461 - RNA, 22 nt, Human
gcugccucugcgacucugggcg

SEQ ID NO: 484462 - RNA, 20 nt, Human
uuccagagaucugcauuuua

SEQ ID NO: 484463 - RNA, 23 nt, Human
cugcagucgccggccugggugcc

SEQ ID NO: 484464 - RNA, 22 nt, Human
uuucucuaaauagggaggcuua

SEQ ID NO: 484465 - RNA, 22 nt, Human
gcaccaggcagcugagcaggcc

SEQ ID NO: 484466 - RNA, 23 nt, Human
ugcucccaggugacgcugcuguu

SEQ ID NO: 484467 - RNA, 22 nt, Human
caucaucaaaacaaauggaguc

SEQ ID NO: 484468 - RNA, 22 nt, Human
ugaagacagaccaaggagaaug

SEQ ID NO: 484469 - RNA, 22 nt, Human
gaguccaguguuuaccaggggu

SEQ ID NO: 484470 - RNA, 22 nt, Human
ucuggcuccaggaccgggcaca

SEQ ID NO: 484471 - RNA, 22 nt, Human
auguucuguuuuguaauucaua

SEQ ID NO: 484472 - RNA, 22 nt, Human
ccacccuuggguucggaggccg

SEQ ID NO: 484473 - RNA, 22 nt, Human
gccuggagggucccucucugga

SEQ ID NO: 484474 - RNA, 22 nt, Human
caagagcuacccugugccauau

SEQ ID NO: 484475 - RNA, 20 nt, Human
cagcccuccaguggaggcag

SEQ ID NO: 484476 - RNA, 22 nt, Human
ggcugagccuggagcaucuggu

SEQ ID NO: 484477 - RNA, 22 nt, Human
cucaguuucuucauauuguagg

SEQ ID NO: 484478 - RNA, 22 nt, Human
agagucuuccaggcagccugag

SEQ ID NO: 484479 - RNA, 20 nt, Human
ggagaugcagcccaggugcc

SEQ ID NO: 484480 - RNA, 22 nt, Human
agccucugcuggcccuggcacu

SEQ ID NO: 484481 - RNA, 22 nt, Human
ccagagucuuuauauuccugaa

SEQ ID NO: 484482 - RNA, 22 nt, Human
aagacccacaaggcugaauguu

SEQ ID NO: 484483 - RNA, 22 nt, Human
cauugaaaccuaacauaggcug

SEQ ID NO: 484484 - RNA, 20 nt, Human
ugagugauggaggcggguca

SEQ ID NO: 484485 - RNA, 22 nt, Human
acucagaguuugcguuccauac

SEQ ID NO: 484486 - RNA, 22 nt, Human
gcuggggagcuagaccucagca

SEQ ID NO: 484487 - RNA, 22 nt, Human
agggccaccagagcagggcagu

SEQ ID NO: 484488 - RNA, 22 nt, Human
ucagaggagggacucagaccca

SEQ ID NO: 484489 - RNA, 22 nt, Human
gcugucaccaaagcaggcacug

SEQ ID NO: 484490 - RNA, 22 nt, Human
ugucagagcaaggccaggccag

SEQ ID NO: 484491 - RNA, 22 nt, Human
ugcaggcuguaaucugaggcua

SEQ ID NO: 484492 - RNA, 22 nt, Human
uucuaguuuucaguccaccagg

SEQ ID NO: 484493 - RNA, 21 nt, Human
agcugccacccuagcuucuga

SEQ ID NO: 484494 - RNA, 22 nt, Human
ggcucaggacugcagcguagag

SEQ ID NO: 484495 - RNA, 22 nt, Human
cccugcaggggaccugcagccu

SEQ ID NO: 484496 - RNA, 22 nt, Human
gggcugcuuccuggggaaugcu

SEQ ID NO: 484497 - RNA, 22 nt, Human
cagucucuugcuucauuaguug

SEQ ID NO: 484498 - RNA, 22 nt, Human
uguuuuucaaauauugcucugu

SEQ ID NO: 484499 - RNA, 22 nt, Human
aauuaacagagggcuuauuacu

SEQ ID NO: 484500 - RNA, 22 nt, Human
cacucccuucaggagccuagga

SEQ ID NO: 484501 - RNA, 22 nt, Human
cugaaauuccauuucagccaca

SEQ ID NO: 484502 - RNA, 20 nt, Human
gcagcugcccccagucccug

SEQ ID NO: 484503 - RNA, 22 nt, Human
uuucuguagggauuucacaguu

SEQ ID NO: 484504 - RNA, 19 nt, Human
cugagcagcggcagcacuu

SEQ ID NO: 484505 - RNA, 22 nt, Human
gacaggcuuugagucccagaac

SEQ ID NO: 484506 - RNA, 22 nt, Human
auaaaaguuuccaaucaugccu

SEQ ID NO: 484507 - RNA, 22 nt, Human
ugccaggcuccggaacgacagu

SEQ ID NO: 484508 - RNA, 22 nt, Human
agcagggcuccugaaagccgcg

SEQ ID NO: 484509 - RNA, 22 nt, Human
gaugcaggauagcuucacccag

SEQ ID NO: 484510 - RNA, 22 nt, Human
caggagcccagaguccucagcu

SEQ ID NO: 484511 - RNA, 22 nt, Human
cacugcagcaccaugcagggcu

SEQ ID NO: 484512 - RNA, 22 nt, Human
cagcugaagagaggugcugagu

SEQ ID NO: 484513 - RNA, 22 nt, Human
ccucagaggugaacaucagugc

SEQ ID NO: 484514 - RNA, 22 nt, Human
gaggcucagagacuuuaaguuu

SEQ ID NO: 484515 - RNA, 22 nt, Human
ccaccagcuucagcagccgcgg

SEQ ID NO: 484516 - RNA, 22 nt, Human
gcagaggaucaggcucuggaaa

SEQ ID NO: 484517 - RNA, 22 nt, Human
ugggcagaguagcucagaagaa

SEQ ID NO: 484518 - RNA, 22 nt, Human
uccauuuuagaagaaaauccac

SEQ ID NO: 484519 - RNA, 22 nt, Human
guguccuuauaagaagagaugc

SEQ ID NO: 484520 - RNA, 22 nt, Human
uagggcucuggugggcucuguu

SEQ ID NO: 484521 - RNA, 22 nt, Human
gccuuggcugaugugcgaauga

SEQ ID NO: 484522 - RNA, 22 nt, Human
aaauauaauuucugccucaaua

SEQ ID NO: 484523 - RNA, 22 nt, Human
guguacauagaauugugcuuug

SEQ ID NO: 484524 - RNA, 22 nt, Human
uccagggcuggguuggcucagc

SEQ ID NO: 484525 - RNA, 22 nt, Human
caaaacugucuagagagagaag

SEQ ID NO: 484526 - RNA, 17 nt, Human
gguucaguucugcauuc

SEQ ID NO: 484527 - RNA, 22 nt, Human
uagaauaugauuaauuuucuua

SEQ ID NO: 484528 - RNA, 22 nt, Human
caaggccaguuucuccuaguca

SEQ ID NO: 484529 - RNA, 22 nt, Human
uauuucugaauccaaaagguca

SEQ ID NO: 484530 - RNA, 22 nt, Human
uauaucuuauaugugcagguac

SEQ ID NO: 484531 - RNA, 22 nt, Human
cuccuguauguugggcuucaca

SEQ ID NO: 484532 - RNA, 22 nt, Human
gcucugcuggaaguucucugga

SEQ ID NO: 484533 - RNA, 22 nt, Human
uggcagugggaagcuggaaguc

SEQ ID NO: 484534 - RNA, 22 nt, Human
uugaagcauuugcuauagcauu

SEQ ID NO: 484535 - RNA, 22 nt, Human
gggaagggagggaccucagucu

SEQ ID NO: 484536 - RNA, 22 nt, Human
ucuggcucacuucaggcuucac

SEQ ID NO: 484537 - RNA, 22 nt, Human
gagggucccugcucagggccag

SEQ ID NO: 484538 - RNA, 22 nt, Human
uaaauguguuagucaugguuuu

SEQ ID NO: 484539 - RNA, 22 nt, Human
uauugaugcuuggauugggcca

SEQ ID NO: 484540 - RNA, 22 nt, Human
ugcauuaugcuacccagaagcu

SEQ ID NO: 484541 - RNA, 21 nt, Human
cuccugggcuaagauauagug

SEQ ID NO: 484542 - RNA, 22 nt, Human
ggaggcugcugccucacguggg

SEQ ID NO: 484543 - RNA, 22 nt, Human
uuauuuacaacucuucucuucc

SEQ ID NO: 484544 - RNA, 22 nt, Human
cagcccuuuccuucucagcuuu

SEQ ID NO: 484545 - RNA, 22 nt, Human
agagugcaaccgaaacaagcag

SEQ ID NO: 484546 - RNA, 22 nt, Human
gcaaggagacuguagggccaag

SEQ ID NO: 484547 - RNA, 22 nt, Human
ugcucuggagggugaagcuuuu

SEQ ID NO: 484548 - RNA, 20 nt, Human
aaaauauguauaacucuucu

SEQ ID NO: 484549 - RNA, 22 nt, Human
ggcacugagaacaggcugacuu

SEQ ID NO: 484550 - RNA, 22 nt, Human
ccagagcugauuccugggacuu

SEQ ID NO: 484551 - RNA, 22 nt, Human
aggugccagugcuguggucccc

SEQ ID NO: 484552 - RNA, 22 nt, Human
cucagaauuuagggcucugagg

SEQ ID NO: 484553 - RNA, 22 nt, Human
gcagguggagcaguagucuggu

SEQ ID NO: 484554 - RNA, 22 nt, Human
guggggggacguuggucacuuu

SEQ ID NO: 484555 - RNA, 22 nt, Human
gaggagcacaugaggcugaggg

SEQ ID NO: 484556 - RNA, 22 nt, Human
cauuuagaaacuguuuuuaaca

SEQ ID NO: 484557 - RNA, 22 nt, Human
ccagcuggugacauccccaacc

SEQ ID NO: 484558 - RNA, 22 nt, Human
cagggcugaaaucaagguguag

SEQ ID NO: 484559 - RNA, 22 nt, Human
acaugaaaagacuaucugauua

SEQ ID NO: 484560 - RNA, 22 nt, Human
agugaagaggaaguggggcaca

SEQ ID NO: 484561 - RNA, 22 nt, Human
gcccggcagucacacacccagg

SEQ ID NO: 484562 - RNA, 21 nt, Human
agacagagugcagucuacaua

SEQ ID NO: 484563 - RNA, 21 nt, Human
agaaaaguagaguuuucagag

SEQ ID NO: 484564 - RNA, 22 nt, Human
uucauucauuacgugccaggca

SEQ ID NO: 484565 - RNA, 22 nt, Human
uggcucagaggggaagugguuu

SEQ ID NO: 484566 - RNA, 22 nt, Human
agggacuggcucucugagcagg

SEQ ID NO: 484567 - RNA, 22 nt, Human
ucagcuuucucaaagaagcugg

SEQ ID NO: 484568 - RNA, 22 nt, Human
gcuggcugggucccugagaggc

SEQ ID NO: 484569 - RNA, 22 nt, Human
cuggcucaggaaaguugcugcu

SEQ ID NO: 484570 - RNA, 22 nt, Human
gggguggauuccuacaggucca

SEQ ID NO: 484571 - RNA, 22 nt, Human
acucugagcaucccaagucuua

SEQ ID NO: 484572 - RNA, 22 nt, Human
agaagugcuccagugaguuggg

SEQ ID NO: 484573 - RNA, 23 nt, Human
ucuguacacaucagcaucuccca

SEQ ID NO: 484574 - RNA, 22 nt, Human
aaaguuugagugauuugacaca

SEQ ID NO: 484575 - RNA, 22 nt, Human
caaagucccagcugcuuagaga

SEQ ID NO: 484576 - RNA, 22 nt, Human
guagcccaccuggggagggcga

SEQ ID NO: 484577 - RNA, 21 nt, Human
ucagcuuugcaacugcacauc

SEQ ID NO: 484578 - RNA, 22 nt, Human
caagaugccccugguagggauc

SEQ ID NO: 484579 - RNA, 22 nt, Human
aaaggaagauugagcuuuucca

SEQ ID NO: 484580 - RNA, 22 nt, Human
cccagcaucuccaggcauggcc

SEQ ID NO: 484581 - RNA, 22 nt, Human
ucuuuccuuagaauaauucuuu

SEQ ID NO: 484582 - RNA, 22 nt, Human
cauuuacuguugaaucccuagc

SEQ ID NO: 484583 - RNA, 22 nt, Human
agccagggacgcugcaggcuac

SEQ ID NO: 484584 - RNA, 22 nt, Human
aaggcacuugcccagagcugca

SEQ ID NO: 484585 - RNA, 22 nt, Human
guuauuuucauuggcucagacu

SEQ ID NO: 484586 - RNA, 22 nt, Human
cagggcucagggacugcagaaa

SEQ ID NO: 484587 - RNA, 22 nt, Human
uauaacacucagaaagaaucau

SEQ ID NO: 484588 - RNA, 22 nt, Human
ucuggauggucagcucuuccug

SEQ ID NO: 484589 - RNA, 22 nt, Human
gagccaggucgggccgcggcga

SEQ ID NO: 484590 - RNA, 22 nt, Human
uuccgcuggggccgccuggcgg

SEQ ID NO: 484591 - RNA, 22 nt, Human
aagcagccaccucaucuccacu

SEQ ID NO: 484592 - RNA, 22 nt, Human
gagagguccauuccccugucag

SEQ ID NO: 484593 - RNA, 22 nt, Human
uggacagguugaguaggaggag

SEQ ID NO: 484594 - RNA, 22 nt, Human
uccucacagucaacacuuugag

SEQ ID NO: 484595 - RNA, 22 nt, Human
ugcuaaauaaguggaauagaca

SEQ ID NO: 484596 - RNA, 22 nt, Human
ucuaugaaaagucuauucauuc

SEQ ID NO: 484597 - RNA, 22 nt, Human
aagcuggagaguuaggugaaua

SEQ ID NO: 484598 - RNA, 22 nt, Human
ggcugccucaaagcucaagcuc

SEQ ID NO: 484599 - RNA, 22 nt, Human
aaggccuggauuuagguuguga

SEQ ID NO: 484600 - RNA, 18 nt, Human
uuucacaaccuccagagg

SEQ ID NO: 484601 - RNA, 22 nt, Human
acaaagucuuuuacaacaguca

SEQ ID NO: 484602 - RNA, 23 nt, Human
uccagggauuaaugaagucaguc

SEQ ID NO: 484603 - RNA, 22 nt, Human
gcugagaggcacuaucuccgga

SEQ ID NO: 484604 - RNA, 22 nt, Human
aggcuuuaauuaucuacaggag

SEQ ID NO: 484605 - RNA, 22 nt, Human
ucuuuggauaucgcuagaccgu

SEQ ID NO: 484606 - RNA, 22 nt, Human
uucaagauggcugcaaauacuu

SEQ ID NO: 484607 - RNA, 22 nt, Human
aggucauuccuugucuucuugc

SEQ ID NO: 484608 - RNA, 22 nt, Human
uuuuuccuagugcuuucuggua

SEQ ID NO: 484609 - RNA, 22 nt, Human
uggccacagccucugccaguuc

SEQ ID NO: 484610 - RNA, 22 nt, Human
gcauucaucuuccuccaugcag

SEQ ID NO: 484611 - RNA, 22 nt, Human
ugcuuccuugagcucuccaauc

SEQ ID NO: 484612 - RNA, 22 nt, Human
aauuagggaaguauuuaguagu

SEQ ID NO: 484613 - RNA, 17 nt, Human
agcagcuggcacaggag

SEQ ID NO: 484614 - RNA, 22 nt, Human
uuauuuuuaaaaguucacacag

SEQ ID NO: 484615 - RNA, 22 nt, Human
ggccaagauggaaggagagaug

SEQ ID NO: 484616 - RNA, 22 nt, Human
cagagaccccgcugcccuucug

SEQ ID NO: 484617 - RNA, 22 nt, Human
cucugggcaaagaugccucauc

SEQ ID NO: 484618 - RNA, 22 nt, Human
gcauaauauacaugcuugaucc

SEQ ID NO: 484619 - RNA, 21 nt, Human
cugcaucucauagaacauguc

SEQ ID NO: 484620 - RNA, 22 nt, Human
guguacaugagaaaucaacuuu

SEQ ID NO: 484621 - RNA, 22 nt, Human
ucugaaaugcaaauuugacuga

SEQ ID NO: 484622 - RNA, 23 nt, Human
uggcuccaugaaaauuacgagga

SEQ ID NO: 484623 - RNA, 22 nt, Human
augauggugggagaugacccag

SEQ ID NO: 484624 - RNA, 22 nt, Human
uucuaucauacuugaauacauu

SEQ ID NO: 484625 - RNA, 22 nt, Human
ucacaggguguacaucaccuau

SEQ ID NO: 484626 - RNA, 22 nt, Human
cucagagaaaaggagcaagggu

SEQ ID NO: 484627 - RNA, 22 nt, Human
cugucuguuucugauucaaccu

SEQ ID NO: 484628 - RNA, 22 nt, Human
ugagaugaauaacuccugcuaa

SEQ ID NO: 484629 - RNA, 22 nt, Human
gggagaaggaggacugugcugu

SEQ ID NO: 484630 - RNA, 22 nt, Human
agcccucauggaacagcuccua

SEQ ID NO: 484631 - RNA, 22 nt, Human
agguggguaucaugagagauua

SEQ ID NO: 484632 - RNA, 22 nt, Human
ugcuuccuucccguucuucucc

SEQ ID NO: 484633 - RNA, 22 nt, Human
ugaggcucaaggucugguggag

SEQ ID NO: 484634 - RNA, 22 nt, Human
uccauguggccagacacuggca

SEQ ID NO: 484635 - RNA, 22 nt, Human
uuuccucuucuucccaugucau

SEQ ID NO: 484636 - RNA, 20 nt, Human
ggagcugcccugggcuggag

SEQ ID NO: 484637 - RNA, 22 nt, Human
gaagccaagugcaaaugccuua

SEQ ID NO: 484638 - RNA, 22 nt, Human
cccagcuccagagccagaaaca

SEQ ID NO: 484639 - RNA, 22 nt, Human
gaggcugcaggcaaugcugccc

SEQ ID NO: 484640 - RNA, 22 nt, Human
ucagaggauugccucagcgagc

SEQ ID NO: 484641 - RNA, 22 nt, Human
gccauccucugagcacuaggca

SEQ ID NO: 484642 - RNA, 22 nt, Human
gacagggcgagacucagucuca

SEQ ID NO: 484643 - RNA, 22 nt, Human
cuggguggcagagccugcagug

SEQ ID NO: 484644 - RNA, 22 nt, Human
cagcucccuauggugaggcgac

SEQ ID NO: 484645 - RNA, 22 nt, Human
ucauuuguaccauuuuuuaaga

SEQ ID NO: 484646 - RNA, 22 nt, Human
ucagaacagaagaaggaacacg

SEQ ID NO: 484647 - RNA, 22 nt, Human
agcagcauuaagggaacugcag

SEQ ID NO: 484648 - RNA, 20 nt, Human
accauaauguuaauuacaaa

SEQ ID NO: 484649 - RNA, 22 nt, Human
uuaaacagguuuuugaauggcc

SEQ ID NO: 484650 - RNA, 22 nt, Human
uuucagaucauuuuuuaaguac

SEQ ID NO: 484651 - RNA, 22 nt, Human
caguauuuauggcuugaguauu

SEQ ID NO: 484652 - RNA, 22 nt, Human
uguauuuaagcuuuaccuaaaa

SEQ ID NO: 484653 - RNA, 22 nt, Human
agcaggugacagggcuguggug

SEQ ID NO: 484654 - RNA, 22 nt, Human
ccuccugggacaggcuggcaca

SEQ ID NO: 484655 - RNA, 22 nt, Human
gaggggcugggcagucccugga

SEQ ID NO: 484656 - RNA, 22 nt, Human
ugugaaagucaaauuaauugaa

SEQ ID NO: 484657 - RNA, 22 nt, Human
cuggccucaccucagacuuacu

SEQ ID NO: 484658 - RNA, 22 nt, Human
auggggugaccaugagcauuua

SEQ ID NO: 484659 - RNA, 22 nt, Human
ggccugagaaccauggggccaa

SEQ ID NO: 484660 - RNA, 22 nt, Human
guuuaauuuuagguugucaagc

SEQ ID NO: 484661 - RNA, 22 nt, Human
ugcagggaauccagucuagggu

SEQ ID NO: 484662 - RNA, 20 nt, Human
auguccagugacuggaccau

SEQ ID NO: 484663 - RNA, 22 nt, Human
aucuucaaagcacaucguuugu

SEQ ID NO: 484664 - RNA, 22 nt, Human
agggggcaucagguccuggcuc

SEQ ID NO: 484665 - RNA, 22 nt, Human
gcagagccaggagagacccuug

SEQ ID NO: 484666 - RNA, 22 nt, Human
ugcagaccucccauggcugccu

SEQ ID NO: 484667 - RNA, 22 nt, Human
ugaaaggugacauuucuuggau

SEQ ID NO: 484668 - RNA, 22 nt, Human
gcugccuguguggccacucacu

SEQ ID NO: 484669 - RNA, 22 nt, Human
ucacugcaaucucugccuucca

SEQ ID NO: 484670 - RNA, 22 nt, Human
auccaguucucagugcuuacag

SEQ ID NO: 484671 - RNA, 22 nt, Human
ugccacacagcuguaugaggga

SEQ ID NO: 484672 - RNA, 18 nt, Human
uagggcucuagggaguga

SEQ ID NO: 484673 - RNA, 22 nt, Human
agcuucuggaaggcaaggcuug

SEQ ID NO: 484674 - RNA, 22 nt, Human
aaggcccuggccccagcuucuu

SEQ ID NO: 484675 - RNA, 22 nt, Human
gcucccagcauugcugcugaau

SEQ ID NO: 484676 - RNA, 22 nt, Human
uagaaaugcaguguacuguguc

SEQ ID NO: 484677 - RNA, 22 nt, Human
uguccucacaggaaugaacuuu

SEQ ID NO: 484678 - RNA, 22 nt, Human
gcagcuggagccagccagacac

SEQ ID NO: 484679 - RNA, 22 nt, Human
ucagagucucccccaguuuggg

SEQ ID NO: 484680 - RNA, 22 nt, Human
auauuaggugcucaauacaugc

SEQ ID NO: 484681 - RNA, 23 nt, Human
uugugggcagauuccauggggag

SEQ ID NO: 484682 - RNA, 22 nt, Human
ugggcaggugcuauuuuccaug

SEQ ID NO: 484683 - RNA, 22 nt, Human
cuggcucuucagugcuugguuc

SEQ ID NO: 484684 - RNA, 22 nt, Human
aguuucuguuaccauauuugac

SEQ ID NO: 484685 - RNA, 22 nt, Human
gcagagcucuguucuuaucucc

SEQ ID NO: 484686 - RNA, 22 nt, Human
gcuggcagaauuucuucuugcu

SEQ ID NO: 484687 - RNA, 22 nt, Human
cuccaggguuccccgauccacu

SEQ ID NO: 484688 - RNA, 22 nt, Human
caggugggagccacagcguaca

SEQ ID NO: 484689 - RNA, 22 nt, Human
caggcuggaguuaccuuuaggg

SEQ ID NO: 484690 - RNA, 22 nt, Human
ugcuagaauaccuaccuggagg

SEQ ID NO: 484691 - RNA, 22 nt, Human
uccugcaggcuugaguccucag

SEQ ID NO: 484692 - RNA, 22 nt, Human
aucuggaauccuuguggacaau

SEQ ID NO: 484693 - RNA, 22 nt, Human
aaggaaaggaugagcaugcauu

SEQ ID NO: 484694 - RNA, 17 nt, Human
gcugagugcagggaguc

SEQ ID NO: 484695 - RNA, 22 nt, Human
aguuaacaaguuggcaaucaac

SEQ ID NO: 484696 - RNA, 22 nt, Human
gggggcuggacuuucccacaca

SEQ ID NO: 484697 - RNA, 20 nt, Human
uccugcagucgcuagcgccc

SEQ ID NO: 484698 - RNA, 22 nt, Human
gucaggaucucccaguacauau

SEQ ID NO: 484699 - RNA, 22 nt, Human
ugucacauaauuuaucuguagg

SEQ ID NO: 484700 - RNA, 22 nt, Human
cagugcaguggcugagcuggag

SEQ ID NO: 484701 - RNA, 22 nt, Human
cacacaugaaucccuaguaccu

SEQ ID NO: 484702 - RNA, 22 nt, Human
cugggguggaggagcuccccug

SEQ ID NO: 484703 - RNA, 20 nt, Human
aggagccauugacugcagca

SEQ ID NO: 484704 - RNA, 22 nt, Human
ccugagagagaagcgaccuggu

SEQ ID NO: 484705 - RNA, 22 nt, Human
uuugugcagauguauauuugug

SEQ ID NO: 484706 - RNA, 22 nt, Human
agugcauuauauguuucaaugg

SEQ ID NO: 484707 - RNA, 22 nt, Human
aaaguucucuaugguguaaaaa

SEQ ID NO: 484708 - RNA, 22 nt, Human
caguggaauauauaggggauuu

SEQ ID NO: 484709 - RNA, 18 nt, Human
aaugcacacauuuacucc

SEQ ID NO: 484710 - RNA, 22 nt, Human
uggagcuggaauuucugggccu

SEQ ID NO: 484711 - RNA, 22 nt, Human
ucucuuaauuuuggaauagugu

SEQ ID NO: 484712 - RNA, 22 nt, Human
ucugccuggguguggagcagag

SEQ ID NO: 484713 - RNA, 22 nt, Human
ugugcucuggaguugccuucac

SEQ ID NO: 484714 - RNA, 22 nt, Human
cagcccugagagaaccaucuau

SEQ ID NO: 484715 - RNA, 22 nt, Human
aggccuccugcagggaugagug

SEQ ID NO: 484716 - RNA, 22 nt, Human
gggcugagugaccucaggccaa

SEQ ID NO: 484717 - RNA, 22 nt, Human
uccuccuucgggacugcuugac

SEQ ID NO: 484718 - RNA, 19 nt, Human
cacacccaugcuugccaag

SEQ ID NO: 484719 - RNA, 22 nt, Human
uguugauuugugggcugcaaaa

SEQ ID NO: 484720 - RNA, 22 nt, Human
gagugcaggccugagcaccauc

SEQ ID NO: 484721 - RNA, 22 nt, Human
cagggagggacaauugucaccu

SEQ ID NO: 484722 - RNA, 22 nt, Human
uauuucaugugcaccauaauuc

SEQ ID NO: 484723 - RNA, 22 nt, Human
ccugggaagagcugacaggagg

SEQ ID NO: 484724 - RNA, 22 nt, Human
ugcugaaggcaggggagguggc

SEQ ID NO: 484725 - RNA, 22 nt, Human
ugugaaaggggucacagggaaa

SEQ ID NO: 484726 - RNA, 22 nt, Human
augccaggccccacgcugggca

SEQ ID NO: 484727 - RNA, 22 nt, Human
ugugugcagccucugucuuugg

SEQ ID NO: 484728 - RNA, 22 nt, Human
auucaguuaaaaacuguacuuc

SEQ ID NO: 484729 - RNA, 22 nt, Human
uugcagcuucgagucuaucugu

SEQ ID NO: 484730 - RNA, 22 nt, Human
acuguacacgugucauuuacag

SEQ ID NO: 484731 - RNA, 20 nt, Human
cacaagagaauacacacugg

SEQ ID NO: 484732 - RNA, 22 nt, Human
gcagcccagagcgcaggacccc

SEQ ID NO: 484733 - RNA, 22 nt, Human
cagaggcugcucuggguggcau

SEQ ID NO: 484734 - RNA, 22 nt, Human
uucacaaagcuggagcauuucc

SEQ ID NO: 484735 - RNA, 22 nt, Human
cauguacacucauguaacuaua

SEQ ID NO: 484736 - RNA, 20 nt, Human
uacagaaacaggacuuuugg

SEQ ID NO: 484737 - RNA, 22 nt, Human
ccuggaggcucugggagggcag

SEQ ID NO: 484738 - RNA, 22 nt, Human
agucucagggccacccggggaa

SEQ ID NO: 484739 - RNA, 22 nt, Human
ucugucaggagauuggcagcug

SEQ ID NO: 484740 - RNA, 22 nt, Human
ccucaggaaccacauugcugcu

SEQ ID NO: 484741 - RNA, 22 nt, Human
ucagcuuucucuucuaucgaua

SEQ ID NO: 484742 - RNA, 22 nt, Human
aggcugcguuagccucacuccc

SEQ ID NO: 484743 - RNA, 22 nt, Human
gaggcagcagaacauggaagag

SEQ ID NO: 484744 - RNA, 22 nt, Human
ucugucugcgcuugcccuggug

SEQ ID NO: 484745 - RNA, 22 nt, Human
gucaggauuauuuuauuaaaag

SEQ ID NO: 484746 - RNA, 22 nt, Human
ccuggagguggagguugcagug

SEQ ID NO: 484747 - RNA, 22 nt, Human
caaggcugcugcgggucgcacc

SEQ ID NO: 484748 - RNA, 21 nt, Human
ugauuuccagaaaauuggccc

SEQ ID NO: 484749 - RNA, 22 nt, Human
caggcagauuugcugcccucca

SEQ ID NO: 484750 - RNA, 22 nt, Human
uacaaagugagcaaccucuuuu

SEQ ID NO: 484751 - RNA, 16 nt, Human
gggagggaguuggugg

SEQ ID NO: 484752 - RNA, 22 nt, Human
agaggaggcuggguccagauaa

SEQ ID NO: 484753 - RNA, 22 nt, Human
aaugcuagugugauauguaagg

SEQ ID NO: 484754 - RNA, 22 nt, Human
ucccagagugagccaggggcag

SEQ ID NO: 484755 - RNA, 22 nt, Human
caggaugcacuaggaaccaggg

SEQ ID NO: 484756 - RNA, 22 nt, Human
auucaguuucauggcacagcua

SEQ ID NO: 484757 - RNA, 22 nt, Human
ggcacugagcgggcucugagcg

SEQ ID NO: 484758 - RNA, 22 nt, Human
ccuggagcucacugggagccgg

SEQ ID NO: 484759 - RNA, 18 nt, Human
ucagaggagauaccuaaa

SEQ ID NO: 484760 - RNA, 22 nt, Human
uuacaugguuguuggaaaugcu

SEQ ID NO: 484761 - RNA, 22 nt, Human
ccagcuccucuucccaguguca

SEQ ID NO: 484762 - RNA, 22 nt, Human
cuggagcaggcuugucccagcu

SEQ ID NO: 484763 - RNA, 22 nt, Human
uggagccaaggccaguucucag

SEQ ID NO: 484764 - RNA, 22 nt, Human
caugagaaguggccuucaaaaa

SEQ ID NO: 484765 - RNA, 22 nt, Human
ccagcagguguagggcucaugg

SEQ ID NO: 484766 - RNA, 22 nt, Human
gcugccuggaauaacggcuggc

SEQ ID NO: 484767 - RNA, 22 nt, Human
ggcagugaacagaaaugcagaa

SEQ ID NO: 484768 - RNA, 22 nt, Human
agaacagcagcacgucaagcug

SEQ ID NO: 484769 - RNA, 22 nt, Human
augcaagauguauagaagacuu

SEQ ID NO: 484770 - RNA, 18 nt, Human
guccugagcucugcugua

SEQ ID NO: 484771 - RNA, 21 nt, Human
auuauuauuucuguguccagc

SEQ ID NO: 484772 - RNA, 22 nt, Human
uggcacugggaugcuacuguua

SEQ ID NO: 484773 - RNA, 22 nt, Human
gucccuggucuaccguggcuuc

SEQ ID NO: 484774 - RNA, 22 nt, Human
cagggagaucuuggcuccuggu

SEQ ID NO: 484775 - RNA, 21 nt, Human
uaucuacuggugucuuucaga

SEQ ID NO: 484776 - RNA, 22 nt, Human
ugcauuguuuagaacucuuugg

SEQ ID NO: 484777 - RNA, 21 nt, Human
agccuggcccagggggaggcu

SEQ ID NO: 484778 - RNA, 21 nt, Human
uacaagaccggauucgggccc

SEQ ID NO: 484779 - RNA, 21 nt, Human
guggccugauuaugaaugggu

SEQ ID NO: 484780 - RNA, 22 nt, Human
aucacauucuuucaaagcaguc

SEQ ID NO: 484781 - RNA, 22 nt, Human
gggaagggacuuguuuaagguc

SEQ ID NO: 484782 - RNA, 22 nt, Human
aaagucaaugauuucuccugga

SEQ ID NO: 484783 - RNA, 23 nt, Human
ggagugcaauggcgccaucucgg

SEQ ID NO: 484784 - RNA, 22 nt, Human
cuccagggagcugcgggagcca

SEQ ID NO: 484785 - RNA, 22 nt, Human
cagaggcucagauggcccuggc

SEQ ID NO: 484786 - RNA, 22 nt, Human
ggaagccaguugcuuggugugg

SEQ ID NO: 484787 - RNA, 22 nt, Human
ucaggcaggcagagggcaaaug

SEQ ID NO: 484788 - RNA, 17 nt, Human
uuucuccuuccaucuca

SEQ ID NO: 484789 - RNA, 22 nt, Human
uggccaggggaguuccccucca

SEQ ID NO: 484790 - RNA, 22 nt, Human
ggucccaguugcccaggucagg

SEQ ID NO: 484791 - RNA, 23 nt, Human
ugcagggcaaguuagagacccca

SEQ ID NO: 484792 - RNA, 22 nt, Human
acauuucucagguaagucauuu

SEQ ID NO: 484793 - RNA, 22 nt, Human
ucacuuauaaaaugcaagaucu

SEQ ID NO: 484794 - RNA, 22 nt, Human
auguacaguggaaacuaacaaa

SEQ ID NO: 484795 - RNA, 23 nt, Human
uccuuccuuugagaggcuccauc

SEQ ID NO: 484796 - RNA, 22 nt, Human
ccacaggcugcugcaggucccg

SEQ ID NO: 484797 - RNA, 22 nt, Human
aaggccaggagacuuggaguca

SEQ ID NO: 484798 - RNA, 22 nt, Human
uggaaacuaagacuagagagac

SEQ ID NO: 484799 - RNA, 23 nt, Human
agggcccaagccuggacagcagg

SEQ ID NO: 484800 - RNA, 22 nt, Human
ggaugcugggagacagcaggca

SEQ ID NO: 484801 - RNA, 22 nt, Human
cccacagguccccaugaacucg

SEQ ID NO: 484802 - RNA, 22 nt, Human
ggugggcagcucuuggcaggca

SEQ ID NO: 484803 - RNA, 22 nt, Human
aaggcuuuuguuccuauuuagu

SEQ ID NO: 484804 - RNA, 22 nt, Human
cccaggagguggagguugcagu

SEQ ID NO: 484805 - RNA, 22 nt, Human
ucccuguccugggcaaucccag

SEQ ID NO: 484806 - RNA, 22 nt, Human
agaggcaggagguugacuugag

SEQ ID NO: 484807 - RNA, 22 nt, Human
ugagcaguaacagcucacaggg

SEQ ID NO: 484808 - RNA, 22 nt, Human
cuauuacaauucugcaaggagu

SEQ ID NO: 484809 - RNA, 22 nt, Human
ccuggaguuuuuugguugacuc

SEQ ID NO: 484810 - RNA, 22 nt, Human
ccagcucuuuuggcugagugag

SEQ ID NO: 484811 - RNA, 21 nt, Human
uuugagaauuggucagagugc

SEQ ID NO: 484812 - RNA, 19 nt, Human
aauuagggagucgguuaag

SEQ ID NO: 484813 - RNA, 22 nt, Human
cacugaaggcuaggauuagaug

SEQ ID NO: 484814 - RNA, 21 nt, Human
aggcagccagucaugcucccu

SEQ ID NO: 484815 - RNA, 22 nt, Human
gagcacagaaucuucccaugca

SEQ ID NO: 484816 - RNA, 22 nt, Human
agauggggcagaauggagccau

SEQ ID NO: 484817 - RNA, 22 nt, Human
acagggcagaaauguugcaucu

SEQ ID NO: 484818 - RNA, 22 nt, Human
aagagcuggaguuugcagcccu

SEQ ID NO: 484819 - RNA, 22 nt, Human
uguuuuaaucucccauugcucu

SEQ ID NO: 484820 - RNA, 22 nt, Human
uccucccugaguggggacagcu

SEQ ID NO: 484821 - RNA, 22 nt, Human
cauggcugcgagaagagugggu

SEQ ID NO: 484822 - RNA, 20 nt, Human
cugaacacagaauaagcaca

SEQ ID NO: 484823 - RNA, 22 nt, Human
gugaggcagagaugccaaaacu

SEQ ID NO: 484824 - RNA, 20 nt, Human
aguaggggaaugcaagagca

SEQ ID NO: 484825 - RNA, 22 nt, Human
gggcuggcgggaaaggcaauuc

SEQ ID NO: 484826 - RNA, 22 nt, Human
ugaagccaccgaaccagaagag

SEQ ID NO: 484827 - RNA, 22 nt, Human
gcaguggcaugaugugggcuca

SEQ ID NO: 484828 - RNA, 22 nt, Human
aaauccuaaggagaauaugauu

SEQ ID NO: 484829 - RNA, 22 nt, Human
ucagaggaauuugcuuuucaug

SEQ ID NO: 484830 - RNA, 22 nt, Human
gccuggagcagacgugucccgg

SEQ ID NO: 484831 - RNA, 22 nt, Human
uccaggcaaagggacuagcagg

SEQ ID NO: 484832 - RNA, 22 nt, Human
cugucugucaaguucaucucca

SEQ ID NO: 484833 - RNA, 22 nt, Human
cuuuggaagugaccacaauccu

SEQ ID NO: 484834 - RNA, 22 nt, Human
acucaggaagaaagcagcuggu

SEQ ID NO: 484835 - RNA, 22 nt, Human
guuuuuccugcugacuuggguc

SEQ ID NO: 484836 - RNA, 22 nt, Human
ucccuagucgcaucuguggaga

SEQ ID NO: 484837 - RNA, 22 nt, Human
caggagugagaugcgaucacuu

SEQ ID NO: 484838 - RNA, 22 nt, Human
aggacuucuccgauaagucaga

SEQ ID NO: 484839 - RNA, 22 nt, Human
ugaggcaggacuugcauaaagu

SEQ ID NO: 484840 - RNA, 22 nt, Human
ugcaggaauagcuacagagcug

SEQ ID NO: 484841 - RNA, 22 nt, Human
ccaggugguucaggucaccaua

SEQ ID NO: 484842 - RNA, 22 nt, Human
augcuuuauuauuuugcaggga

SEQ ID NO: 484843 - RNA, 22 nt, Human
caccaggcugcccaggacaggg

SEQ ID NO: 484844 - RNA, 22 nt, Human
ucagagaggcaauacuguuuaa

SEQ ID NO: 484845 - RNA, 23 nt, Human
cccuggccuuggggcacaggcug

SEQ ID NO: 484846 - RNA, 22 nt, Human
gcugcccugugguccagcaggu

SEQ ID NO: 484847 - RNA, 22 nt, Human
uuccuccacgugacaggagcca

SEQ ID NO: 484848 - RNA, 22 nt, Human
uguggccuggaaggggcugcuc

SEQ ID NO: 484849 - RNA, 22 nt, Human
guaggcagauaggagugcagcc

SEQ ID NO: 484850 - RNA, 22 nt, Human
ucauuuguugaacuuuagugcg

SEQ ID NO: 484851 - RNA, 20 nt, Human
auacaaagagauugauguau

SEQ ID NO: 484852 - RNA, 22 nt, Human
acuguacaaauauugcaaaaua

SEQ ID NO: 484853 - RNA, 22 nt, Human
ugucccucauugacgcugugcc

SEQ ID NO: 484854 - RNA, 22 nt, Human
aggggcugccuggcuuggcacu

SEQ ID NO: 484855 - RNA, 22 nt, Human
gccaggcugacucccccggccu

SEQ ID NO: 484856 - RNA, 22 nt, Human
gaggggcuggguagggcaaccc

SEQ ID NO: 484857 - RNA, 20 nt, Human
gcuuccuucccagcccccac

SEQ ID NO: 484858 - RNA, 22 nt, Human
aggccagggucccacacucgca

SEQ ID NO: 484859 - RNA, 21 nt, Human
ucuggagcccuaagcugagaa

SEQ ID NO: 484860 - RNA, 22 nt, Human
guaaaguucuauuugaauuuag

SEQ ID NO: 484861 - RNA, 22 nt, Human
acaaaggugagcagaagacaca

SEQ ID NO: 484862 - RNA, 22 nt, Human
ugcauugcaguuaacucaguau

SEQ ID NO: 484863 - RNA, 22 nt, Human
agagccaguuacaacuguggag

SEQ ID NO: 484864 - RNA, 22 nt, Human
agaauucuggaguugggaggaa

SEQ ID NO: 484865 - RNA, 17 nt, Human
cccugccaccaggaagc

SEQ ID NO: 484866 - RNA, 22 nt, Human
agggcuggaggguacuaguuua

SEQ ID NO: 484867 - RNA, 19 nt, Human
ugcucauggggacuucucc

SEQ ID NO: 484868 - RNA, 22 nt, Human
gguuugguuuuggccaucuucc

SEQ ID NO: 484869 - RNA, 22 nt, Human
cauuaucucuucuauaugcuag

SEQ ID NO: 484870 - RNA, 20 nt, Human
cuuggccuacuuagcuuugu

SEQ ID NO: 484871 - RNA, 22 nt, Human
uggcccugcuguaucaucugcu

SEQ ID NO: 484872 - RNA, 22 nt, Human
ucaguuuuuguuugccagauag

SEQ ID NO: 484873 - RNA, 22 nt, Human
gauuuucugagccuucaaauuu

SEQ ID NO: 484874 - RNA, 22 nt, Human
acucccagguugccuggcaggc

SEQ ID NO: 484875 - RNA, 22 nt, Human
ugggugggagcgcccugucugg

SEQ ID NO: 484876 - RNA, 22 nt, Human
ggagagaauuccauggacaugu

SEQ ID NO: 484877 - RNA, 20 nt, Human
ggcagcaggaguuuccucuu

SEQ ID NO: 484878 - RNA, 22 nt, Human
uggccagcccuucagccaugcc

SEQ ID NO: 484879 - RNA, 22 nt, Human
gcugugagcugccugugucaca

SEQ ID NO: 484880 - RNA, 21 nt, Human
cagagguggccugaccucuga

SEQ ID NO: 484881 - RNA, 22 nt, Human
gcccugucggaacugcgaccuc

SEQ ID NO: 484882 - RNA, 22 nt, Human
uggagcaggugccaggugugug

SEQ ID NO: 484883 - RNA, 22 nt, Human
auacauacguacauacguaugu

SEQ ID NO: 484884 - RNA, 22 nt, Human
cuugaaagcacuccuuugacug

SEQ ID NO: 484885 - RNA, 22 nt, Human
guuucaaagcacagcucacauu

SEQ ID NO: 484886 - RNA, 22 nt, Human
gagaagcaaucgugacaucucc

SEQ ID NO: 484887 - RNA, 22 nt, Human
acuguguggaccacucugaggc

SEQ ID NO: 484888 - RNA, 22 nt, Human
acacaccaugauuuauuuaccc

SEQ ID NO: 484889 - RNA, 22 nt, Human
ugggccuguugggguugaguua

SEQ ID NO: 484890 - RNA, 21 nt, Human
ugcaggaaagugcugcgaccc

SEQ ID NO: 484891 - RNA, 22 nt, Human
gccagaaacauacacaucacuu

SEQ ID NO: 484892 - RNA, 20 nt, Human
aggccaggaaauguaguucu

SEQ ID NO: 484893 - RNA, 22 nt, Human
gaugcagggcuggcaggagcuu

SEQ ID NO: 484894 - RNA, 22 nt, Human
cauguuuucuaggcuuucacaa

SEQ ID NO: 484895 - RNA, 22 nt, Human
acaucuguuugagaaaaagaag

SEQ ID NO: 484896 - RNA, 22 nt, Human
caaggccaagucucugugaaga

SEQ ID NO: 484897 - RNA, 20 nt, Human
cccaggcagagcuagcggca

SEQ ID NO: 484898 - RNA, 22 nt, Human
agagcuggcugguagcccugau

SEQ ID NO: 484899 - RNA, 22 nt, Human
gcguccagggaaggcccagcug

SEQ ID NO: 484900 - RNA, 22 nt, Human
cucugcuuggaacuggacagaa

SEQ ID NO: 484901 - RNA, 22 nt, Human
ccucaggauccgcaggugcagu

SEQ ID NO: 484902 - RNA, 22 nt, Human
aaguucaagcucugccuaaaau

SEQ ID NO: 484903 - RNA, 22 nt, Human
agccucugcuuaugcaaaggua

SEQ ID NO: 484904 - RNA, 20 nt, Human
ucagaugggagugagccauc

SEQ ID NO: 484905 - RNA, 22 nt, Human
uacaggcauguagcauggugau

SEQ ID NO: 484906 - RNA, 22 nt, Human
ugggcugcuuccucagcugaga

SEQ ID NO: 484907 - RNA, 21 nt, Human
ucacuuauaauguauuugcug

SEQ ID NO: 484908 - RNA, 22 nt, Human
gggucuggacggcugcaggaag

SEQ ID NO: 484909 - RNA, 22 nt, Human
gaggcugggaaguccaagauca

SEQ ID NO: 484910 - RNA, 22 nt, Human
acagauauaaacuauaguagug

SEQ ID NO: 484911 - RNA, 22 nt, Human
uccucucagugugguuguggga

SEQ ID NO: 484912 - RNA, 22 nt, Human
ucuggagaacuugcaagaggau

SEQ ID NO: 484913 - RNA, 17 nt, Human
ucuggccuuccugaacu

SEQ ID NO: 484914 - RNA, 22 nt, Human
ccaggcagagggauccccaucc

SEQ ID NO: 484915 - RNA, 22 nt, Human
ugagcaguaggucugaauagug

SEQ ID NO: 484916 - RNA, 22 nt, Human
uucuggaaguguuagaaucugg

SEQ ID NO: 484917 - RNA, 22 nt, Human
gcugagggcuguaacagcagag

SEQ ID NO: 484918 - RNA, 22 nt, Human
cugaggcucccucgggucugcu

SEQ ID NO: 484919 - RNA, 20 nt, Human
uccugagauuuaagggguuc

SEQ ID NO: 484920 - RNA, 22 nt, Human
agccccacacucucucugagaa

SEQ ID NO: 484921 - RNA, 23 nt, Human
gggcagguuuuuauaggcuucag

SEQ ID NO: 484922 - RNA, 22 nt, Human
ugggcugcuucuauuggugguc

SEQ ID NO: 484923 - RNA, 20 nt, Human
uguacacaguacuuuacaau

SEQ ID NO: 484924 - RNA, 22 nt, Human
agcuuccuguugagagagggag

SEQ ID NO: 484925 - RNA, 20 nt, Human
ccagucccugagcaccaggg

SEQ ID NO: 484926 - RNA, 22 nt, Human
gcuucucuggccugcagggcau

SEQ ID NO: 484927 - RNA, 22 nt, Human
uagaaaucuacuuagacuuucu

SEQ ID NO: 484928 - RNA, 22 nt, Human
aggaagcucggagagggcaaau

SEQ ID NO: 484929 - RNA, 22 nt, Human
gugcugucguggaacugggcug

SEQ ID NO: 484930 - RNA, 21 nt, Human
agaauaaugguaucauuugcu

SEQ ID NO: 484931 - RNA, 22 nt, Human
ggcucagaccucccagcuccag

SEQ ID NO: 484932 - RNA, 22 nt, Human
uucuaauuguguuugcauaucu

SEQ ID NO: 484933 - RNA, 22 nt, Human
accaggcagcugggggugaugu

SEQ ID NO: 484934 - RNA, 19 nt, Human
aucugccuguuaucacaua

SEQ ID NO: 484935 - RNA, 22 nt, Human
aucuggcucucucauuuacaaa

SEQ ID NO: 484936 - RNA, 22 nt, Human
ugucuuuagagucacaaaacca

SEQ ID NO: 484937 - RNA, 22 nt, Human
augguuuguaacccaauacucc

SEQ ID NO: 484938 - RNA, 22 nt, Human
gguuccaccuggcgagggguau

SEQ ID NO: 484939 - RNA, 22 nt, Human
cugggagcuagcucugagcuga

SEQ ID NO: 484940 - RNA, 22 nt, Human
uccuucagauuccugcuucugg

SEQ ID NO: 484941 - RNA, 22 nt, Human
cccuucccuucugggagaucca

SEQ ID NO: 484942 - RNA, 22 nt, Human
agucaguguagaaagcccaggc

SEQ ID NO: 484943 - RNA, 21 nt, Human
aggccucuucauggccaugau

SEQ ID NO: 484944 - RNA, 22 nt, Human
agaggcucugccgccucaggua

SEQ ID NO: 484945 - RNA, 22 nt, Human
uagcugcccaucuuuccuuuag

SEQ ID NO: 484946 - RNA, 22 nt, Human
ucagggcacugucaccugauau

SEQ ID NO: 484947 - RNA, 22 nt, Human
cuggagcuggcuuccuuccacu

SEQ ID NO: 484948 - RNA, 22 nt, Human
uaccuugggcuauuaucuuuga

SEQ ID NO: 484949 - RNA, 19 nt, Human
cauaauacaguggaucuga

SEQ ID NO: 484950 - RNA, 22 nt, Human
cagagcugcucaugguggccag

SEQ ID NO: 484951 - RNA, 22 nt, Human
ggcugugggaugcauaggagcu

SEQ ID NO: 484952 - RNA, 22 nt, Human
ggagggugcauuuuacccugug

SEQ ID NO: 484953 - RNA, 22 nt, Human
ugggcaggaugcguugauucuu

SEQ ID NO: 484954 - RNA, 22 nt, Human
caaaugcuggcccugcuacuua

SEQ ID NO: 484955 - RNA, 22 nt, Human
ugcaggcugggaagagggacaa

SEQ ID NO: 484956 - RNA, 22 nt, Human
acagucuugcuguauggucagg

SEQ ID NO: 484957 - RNA, 22 nt, Human
uggcucaggagggaucuuugcu

SEQ ID NO: 484958 - RNA, 22 nt, Human
ugucaugcagguuuguuauaga

SEQ ID NO: 484959 - RNA, 22 nt, Human
agucucugugagcucccaaugg

SEQ ID NO: 484960 - RNA, 22 nt, Human
ggaagggcaauaaaaucucagg

SEQ ID NO: 484961 - RNA, 22 nt, Human
gccaggcuccaggcccuccuga

SEQ ID NO: 484962 - RNA, 22 nt, Human
ugcagcauucuuggccacuacu

SEQ ID NO: 484963 - RNA, 22 nt, Human
ucaaggcuaaacuuucagagua

SEQ ID NO: 484964 - RNA, 22 nt, Human
ucugucuuugagaucucagccu

SEQ ID NO: 484965 - RNA, 22 nt, Human
ggucaggggcugcucuacagag

SEQ ID NO: 484966 - RNA, 22 nt, Human
ucaaagcuuagauaauuucuuu

SEQ ID NO: 484967 - RNA, 22 nt, Human
uggcuggcaguaggcuaguggc

SEQ ID NO: 484968 - RNA, 22 nt, Human
gugcccaggcccaaggcaccac

SEQ ID NO: 484969 - RNA, 22 nt, Human
agauacauuaguaguuacuugu

SEQ ID NO: 484970 - RNA, 22 nt, Human
caggcccagcccagcccuucga

SEQ ID NO: 484971 - RNA, 22 nt, Human
aucagcaagauugugucuugua

SEQ ID NO: 484972 - RNA, 22 nt, Human
ugcuuuaucaaagcuauaguga

SEQ ID NO: 484973 - RNA, 20 nt, Human
cuggcaggagcgagucuacc

SEQ ID NO: 484974 - RNA, 22 nt, Human
cugcagggaugugaggcccguu

SEQ ID NO: 484975 - RNA, 22 nt, Human
cugggcuggagugcaauggcgc

SEQ ID NO: 484976 - RNA, 22 nt, Human
uguauuuucuucuggaagcuua

SEQ ID NO: 484977 - RNA, 22 nt, Human
aaacaaguguaaacuagucugu

SEQ ID NO: 484978 - RNA, 22 nt, Human
cccagacauaacagcagagagg

SEQ ID NO: 484979 - RNA, 21 nt, Human
agcaggaggcagucacagcuc

SEQ ID NO: 484980 - RNA, 22 nt, Human
cuccagugagcgcggggcaugg

SEQ ID NO: 484981 - RNA, 22 nt, Human
ucucagaguaauucuuuaaggu

SEQ ID NO: 484982 - RNA, 22 nt, Human
agggcugacaguggcguggcgu

SEQ ID NO: 484983 - RNA, 22 nt, Human
gagccaggcaccuucuguguug

SEQ ID NO: 484984 - RNA, 22 nt, Human
agcuggagaucaugcugauacu

SEQ ID NO: 484985 - RNA, 22 nt, Human
acagggcauuuccucuaugugu

SEQ ID NO: 484986 - RNA, 22 nt, Human
agaagccaugguaugcaacuac

SEQ ID NO: 484987 - RNA, 22 nt, Human
acaacaggguaaggcaggccau

SEQ ID NO: 484988 - RNA, 22 nt, Human
aaugauuuggcaaaggaaucca

SEQ ID NO: 484989 - RNA, 22 nt, Human
cugccuggaaugccagcuucuc

SEQ ID NO: 484990 - RNA, 22 nt, Human
uggagaagcuguagguggacuc

SEQ ID NO: 484991 - RNA, 22 nt, Human
uaaaucacuccuaauaaucagu

SEQ ID NO: 484992 - RNA, 22 nt, Human
uuucagaugugugucucugaag

SEQ ID NO: 484993 - RNA, 22 nt, Human
gaaaguuuauagguuauauaau

SEQ ID NO: 484994 - RNA, 22 nt, Human
agaaauguuuauggcugccuau

SEQ ID NO: 484995 - RNA, 22 nt, Human
uggcccuguguccugcugccag

SEQ ID NO: 484996 - RNA, 22 nt, Human
aggcagcaaagaaaugaugcug

SEQ ID NO: 484997 - RNA, 22 nt, Human
cacuuggaggcccccugugccc

SEQ ID NO: 484998 - RNA, 21 nt, Human
ugauccuuucccccauguugc

SEQ ID NO: 484999 - RNA, 22 nt, Human
aaggcugcuuuuaacaugcaua

SEQ ID NO: 485000 - RNA, 22 nt, Human
cccaggcagaauuaguguuuca

SEQ ID NO: 485001 - RNA, 22 nt, Human
ggagugaaucacuagaugcaga

SEQ ID NO: 485002 - RNA, 22 nt, Human
auggcucauuuaucuugcagcc

SEQ ID NO: 485003 - RNA, 22 nt, Human
aagaaaagaaaccugaggcuuu

SEQ ID NO: 485004 - RNA, 22 nt, Human
uuauuagcugggcuucagggug

SEQ ID NO: 485005 - RNA, 22 nt, Human
aauguacaaaccuucuuuguag

SEQ ID NO: 485006 - RNA, 22 nt, Human
caggcacagaguuauucauuua

SEQ ID NO: 485007 - RNA, 22 nt, Human
cagggcagugaagaacacacgu

SEQ ID NO: 485008 - RNA, 22 nt, Human
ggccucacccaucggugccuuu

SEQ ID NO: 485009 - RNA, 22 nt, Human
agggcagcauugccuuucucca

SEQ ID NO: 485010 - RNA, 22 nt, Human
uccucugcuccaucuuuacugu

SEQ ID NO: 485011 - RNA, 20 nt, Human
gagauuuccaaucaugccca

SEQ ID NO: 485012 - RNA, 22 nt, Human
uccaggcugauccaugaagaau

SEQ ID NO: 485013 - RNA, 22 nt, Human
ugcaggugguuuggacacugcu

SEQ ID NO: 485014 - RNA, 22 nt, Human
cuccagcuucccucagcugugg

SEQ ID NO: 485015 - RNA, 22 nt, Human
ucucagagcucacaccuccugg

SEQ ID NO: 485016 - RNA, 22 nt, Human
uuugcauuucucguaaggaaac

SEQ ID NO: 485017 - RNA, 20 nt, Human
aagcaauauagugcaaaugu

SEQ ID NO: 485018 - RNA, 22 nt, Human
agagugaaggccagguuacagu

SEQ ID NO: 485019 - RNA, 22 nt, Human
cauuuguuggucagauuguagu

SEQ ID NO: 485020 - RNA, 22 nt, Human
ucucucugccaacucacagcca

SEQ ID NO: 485021 - RNA, 22 nt, Human
ugcuuuauaucucucuucuuag

SEQ ID NO: 485022 - RNA, 22 nt, Human
ucauccaguaccauggaaggca

SEQ ID NO: 485023 - RNA, 22 nt, Human
uacuuguuaucaucuuuuccuu

SEQ ID NO: 485024 - RNA, 22 nt, Human
ccagcuuuugcacuggacuggg

SEQ ID NO: 485025 - RNA, 22 nt, Human
ccagccaggcuggcuguggagg

SEQ ID NO: 485026 - RNA, 22 nt, Human
cagaaauggagcccaggaaucu

SEQ ID NO: 485027 - RNA, 22 nt, Human
caggguuucaccauguuagcag

SEQ ID NO: 485028 - RNA, 22 nt, Human
gaguccaguuguucacagaggc

SEQ ID NO: 485029 - RNA, 22 nt, Human
ugcaggaauuuuuugcagaaag

SEQ ID NO: 485030 - RNA, 22 nt, Human
accaaggagaaggugcaagcuu

SEQ ID NO: 485031 - RNA, 20 nt, Human
ucucaggguucagcaaagua

SEQ ID NO: 485032 - RNA, 22 nt, Human
aggccuagaggaauggccaggg

SEQ ID NO: 485033 - RNA, 22 nt, Human
ugcaaacaggagaguaaguaua

SEQ ID NO: 485034 - RNA, 22 nt, Human
ucagguguuagaagaaauuuca

SEQ ID NO: 485035 - RNA, 22 nt, Human
gagccaggcccguacuugcugu

SEQ ID NO: 485036 - RNA, 22 nt, Human
acugaaggcuuaacucuuucau

SEQ ID NO: 485037 - RNA, 22 nt, Human
gaggggcuugaggcccugaugg

SEQ ID NO: 485038 - RNA, 22 nt, Human
uacaguaaagcugcuaugaauu

SEQ ID NO: 485039 - RNA, 19 nt, Human
uggcagggagugauauuag

SEQ ID NO: 485040 - RNA, 22 nt, Human
ugcccaaguccuccaccgaggu

SEQ ID NO: 485041 - RNA, 22 nt, Human
ggacagcccauacacaugucug

SEQ ID NO: 485042 - RNA, 22 nt, Human
uagugauuaaaggcagaauguu

SEQ ID NO: 485043 - RNA, 22 nt, Human
gggugaagcuccugcaggggcc

SEQ ID NO: 485044 - RNA, 22 nt, Human
cccaggaggcagagguugcagu

SEQ ID NO: 485045 - RNA, 22 nt, Human
uagagaaauaagcuuugccuug

SEQ ID NO: 485046 - RNA, 22 nt, Human
aagagcuggcucuugcagcagc

SEQ ID NO: 485047 - RNA, 22 nt, Human
ugucccagggaaggcccagcac

SEQ ID NO: 485048 - RNA, 22 nt, Human
agggacccauagagagaccagu

SEQ ID NO: 485049 - RNA, 22 nt, Human
agcagcauagaagcugggagga

SEQ ID NO: 485050 - RNA, 22 nt, Human
cuuuccuagauggccaucuuuc

SEQ ID NO: 485051 - RNA, 22 nt, Human
ucccaggaaaacacucgaggac

SEQ ID NO: 485052 - RNA, 22 nt, Human
uauuuaaaaagaggccagcugg

SEQ ID NO: 485053 - RNA, 22 nt, Human
uaaaaguuuuaguuguacauaa

SEQ ID NO: 485054 - RNA, 22 nt, Human
uauucacaaaaugagguccuca

SEQ ID NO: 485055 - RNA, 22 nt, Human
uuagauaaauugcaacuugauu

SEQ ID NO: 485056 - RNA, 22 nt, Human
cccuggcaugcaugucccuggc

SEQ ID NO: 485057 - RNA, 22 nt, Human
uggccucuuaggacauccucua

SEQ ID NO: 485058 - RNA, 22 nt, Human
ucaggcugguggucagauggcu

SEQ ID NO: 485059 - RNA, 20 nt, Human
cuguagggugcagcaggcuc

SEQ ID NO: 485060 - RNA, 18 nt, Human
uggcagggaggaaauaua

SEQ ID NO: 485061 - RNA, 22 nt, Human
agcagggcagcuuuuuucagaa

SEQ ID NO: 485062 - RNA, 22 nt, Human
ugaagcagcuucuuucugucaa

SEQ ID NO: 485063 - RNA, 22 nt, Human
aagauggaguaguguaaugguu

SEQ ID NO: 485064 - RNA, 22 nt, Human
uccaauaacaucuaaaaacuua

SEQ ID NO: 485065 - RNA, 23 nt, Human
agggcuccuuguugauuagcauu

SEQ ID NO: 485066 - RNA, 22 nt, Human
cacugaagaugcgacuagugcu

SEQ ID NO: 485067 - RNA, 22 nt, Human
ccugggugaaaucucuccugca

SEQ ID NO: 485068 - RNA, 22 nt, Human
ccaguucugacacaagcacagu

SEQ ID NO: 485069 - RNA, 22 nt, Human
ugagcuucaaaauaugugaauc

SEQ ID NO: 485070 - RNA, 22 nt, Human
ggagagugggagcaacuguugc

SEQ ID NO: 485071 - RNA, 22 nt, Human
gggcaugccugcgcagugcaug

SEQ ID NO: 485072 - RNA, 22 nt, Human
cagaggcucuuccucacugccc

SEQ ID NO: 485073 - RNA, 22 nt, Human
uuuccauauuuggucuuuggga

SEQ ID NO: 485074 - RNA, 22 nt, Human
augaaggauggcuggcugcccu

SEQ ID NO: 485075 - RNA, 22 nt, Human
augaacacauguacacauuucu

SEQ ID NO: 485076 - RNA, 22 nt, Human
uggccuggcugcccugucugga

SEQ ID NO: 485077 - RNA, 22 nt, Human
ccagggcacguugggacaguac

SEQ ID NO: 485078 - RNA, 22 nt, Human
uggaagagggagcuggguggcc

SEQ ID NO: 485079 - RNA, 22 nt, Human
caggugggcguggcgagaaggc

SEQ ID NO: 485080 - RNA, 22 nt, Human
aagggcaggugggcauuucugg

SEQ ID NO: 485081 - RNA, 22 nt, Human
aaguguagauuauggagugucu

SEQ ID NO: 485082 - RNA, 22 nt, Human
aaguucaagucuccugaguaua

SEQ ID NO: 485083 - RNA, 22 nt, Human
caggagugcagguggugaggca

SEQ ID NO: 485084 - RNA, 21 nt, Human
uuugaaagugggugauucuuu

SEQ ID NO: 485085 - RNA, 22 nt, Human
aaagcugcugccaaucaggcuu

SEQ ID NO: 485086 - RNA, 22 nt, Human
aagauuuccuucaguagagcua

SEQ ID NO: 485087 - RNA, 22 nt, Human
aggcuuguggauuggagcgagu

SEQ ID NO: 485088 - RNA, 22 nt, Human
gaugguuuggaaugaaguagcu

SEQ ID NO: 485089 - RNA, 22 nt, Human
caggccagguggcaggcaaaac

SEQ ID NO: 485090 - RNA, 22 nt, Human
ccucagaugucuuaaggcacug

SEQ ID NO: 485091 - RNA, 22 nt, Human
ggggugggguuacucauugugc

SEQ ID NO: 485092 - RNA, 22 nt, Human
uacaacauguaaagugguuuaa

SEQ ID NO: 485093 - RNA, 22 nt, Human
aauuucuccaagaaugcuuaga

SEQ ID NO: 485094 - RNA, 22 nt, Human
ugccucuguugagccuuggcug

SEQ ID NO: 485095 - RNA, 22 nt, Human
aagggaaaucauauggugcagu

SEQ ID NO: 485096 - RNA, 22 nt, Human
uuucuauuuacagugcuaggua

SEQ ID NO: 485097 - RNA, 22 nt, Human
ucuggagccacaaaccucagcu

SEQ ID NO: 485098 - RNA, 22 nt, Human
ccuguguggccaggcuggaguc

SEQ ID NO: 485099 - RNA, 22 nt, Human
uggccucuggcugaggacuaac

SEQ ID NO: 485100 - RNA, 22 nt, Human
accaggcagagcugggccuuaa

SEQ ID NO: 485101 - RNA, 22 nt, Human
ccaguggaguuuuuauacccag

SEQ ID NO: 485102 - RNA, 22 nt, Human
ggcugccauaacagaguaccac

SEQ ID NO: 485103 - RNA, 22 nt, Human
cauuucuauggcaaugggaaaa

SEQ ID NO: 485104 - RNA, 22 nt, Human
gguugccggggcaggacuggaa

SEQ ID NO: 485105 - RNA, 22 nt, Human
cagagcugacccaaggauugaa

SEQ ID NO: 485106 - RNA, 22 nt, Human
ccucccagugccuccagagcag

SEQ ID NO: 485107 - RNA, 22 nt, Human
uggucgaccaguuggaaaguaa

SEQ ID NO: 485108 - RNA, 17 nt, Human
agccgggcauggaccag

SEQ ID NO: 485109 - RNA, 22 nt, Human
gggcaggagagaacagucaugg

SEQ ID NO: 485110 - RNA, 20 nt, Human
ugaaggccauuuguuccaga

SEQ ID NO: 485111 - RNA, 22 nt, Human
accugcagcugagaaaaugacu

SEQ ID NO: 485112 - RNA, 22 nt, Human
ucaucuucuauuaauagggaga

SEQ ID NO: 485113 - RNA, 22 nt, Human
agaaaucaauaucuauauguug

SEQ ID NO: 485114 - RNA, 22 nt, Human
ccuggcagcgugccgagcugcg

SEQ ID NO: 485115 - RNA, 22 nt, Human
uauuuugagguauuuuugagcu

SEQ ID NO: 485116 - RNA, 22 nt, Human
cagcagggcccccgggugcgcc

SEQ ID NO: 485117 - RNA, 22 nt, Human
agcugcugcggaaagaugccac

SEQ ID NO: 485118 - RNA, 22 nt, Human
auucauuccaggucagucagac

SEQ ID NO: 485119 - RNA, 22 nt, Human
aaaugcacagaaaggaugugga

SEQ ID NO: 485120 - RNA, 22 nt, Human
cagaagcagugagagaugugca

SEQ ID NO: 485121 - RNA, 21 nt, Human
gagacagacuuucguccccug

SEQ ID NO: 485122 - RNA, 22 nt, Human
gcugccacucugagcuugcuuc

SEQ ID NO: 485123 - RNA, 21 nt, Human
uuuauuuauauaggacacaug

SEQ ID NO: 485124 - RNA, 22 nt, Human
aaaugcacacaccaggaaacua

SEQ ID NO: 485125 - RNA, 22 nt, Human
aaaucaaaagacauguguuuua

SEQ ID NO: 485126 - RNA, 22 nt, Human
ugcuggggauccguaccaaccc

SEQ ID NO: 485127 - RNA, 22 nt, Human
cccucugcucaggugcauaggc

SEQ ID NO: 485128 - RNA, 22 nt, Human
uuaguaauguguuaauaugaau

SEQ ID NO: 485129 - RNA, 22 nt, Human
aaauguguuccuuugcuacaga

SEQ ID NO: 485130 - RNA, 22 nt, Human
guugaaagagcauggacuugaa

SEQ ID NO: 485131 - RNA, 22 nt, Human
aucuggguucaccaugcuccug

SEQ ID NO: 485132 - RNA, 23 nt, Human
cugucuccugggcuagguggaau

SEQ ID NO: 485133 - RNA, 22 nt, Human
ccacaggggcccacgagccgcu

SEQ ID NO: 485134 - RNA, 22 nt, Human
aaguggaggccgaguucacgca

SEQ ID NO: 485135 - RNA, 22 nt, Human
cuguaaaacacuguaguaucug

SEQ ID NO: 485136 - RNA, 22 nt, Human
gcagggcagaccuccagccuau

SEQ ID NO: 485137 - RNA, 19 nt, Human
uugcauuguaguuggacug

SEQ ID NO: 485138 - RNA, 22 nt, Human
augggaugcauggcuguggcca

SEQ ID NO: 485139 - RNA, 22 nt, Human
ggcagggcagcgcugauuaggg

SEQ ID NO: 485140 - RNA, 20 nt, Human
gcugaccccugcugucaugc

SEQ ID NO: 485141 - RNA, 22 nt, Human
agcuuuaucccuugcccaucga

SEQ ID NO: 485142 - RNA, 22 nt, Human
cagaccuggaaaacaggcuugc

SEQ ID NO: 485143 - RNA, 22 nt, Human
agcagcauggcugacuaaagac

SEQ ID NO: 485144 - RNA, 22 nt, Human
acacagaaccucauagccucuc

SEQ ID NO: 485145 - RNA, 22 nt, Human
ucaggcugaggucaucugcauc

SEQ ID NO: 485146 - RNA, 22 nt, Human
ggccaggccaagaggguuggaa

SEQ ID NO: 485147 - RNA, 22 nt, Human
gcccauggcagaacugugagca

SEQ ID NO: 485148 - RNA, 18 nt, Human
uuccauaauguauguaac

SEQ ID NO: 485149 - RNA, 22 nt, Human
aaggaaagacauauaaaugacu

SEQ ID NO: 485150 - RNA, 22 nt, Human
uuguccuuaccucaaucuggaa

SEQ ID NO: 485151 - RNA, 22 nt, Human
cagccagggagcaaagaguuga

SEQ ID NO: 485152 - RNA, 22 nt, Human
aaaugugucaguuucauucucu

SEQ ID NO: 485153 - RNA, 22 nt, Human
uugugcaauuuaaaaucuuccu

SEQ ID NO: 485154 - RNA, 22 nt, Human
aagcagcauucagugaaaugug

SEQ ID NO: 485155 - RNA, 22 nt, Human
aggccagagaggggaccagccu

SEQ ID NO: 485156 - RNA, 22 nt, Human
ugaggcaggagguugagaacug

SEQ ID NO: 485157 - RNA, 22 nt, Human
uagggacaaagagcugaggccu

SEQ ID NO: 485158 - RNA, 22 nt, Human
ucugcagcgugcaggcuggugc

SEQ ID NO: 485159 - RNA, 22 nt, Human
ugcuuuauaggggauugcaggc

SEQ ID NO: 485160 - RNA, 22 nt, Human
gaauucugguuuugaaaugaau

SEQ ID NO: 485161 - RNA, 22 nt, Human
gcuggccugaccugaggcuggg

SEQ ID NO: 485162 - RNA, 22 nt, Human
ggaggugaggccguagggugug

SEQ ID NO: 485163 - RNA, 22 nt, Human
ccagagcccagcacacggugcu

SEQ ID NO: 485164 - RNA, 22 nt, Human
gcuguacaggguuauccuuucc

SEQ ID NO: 485165 - RNA, 22 nt, Human
uccugggguccugacugcuucc

SEQ ID NO: 485166 - RNA, 22 nt, Human
aguguuguaugggaugacugcu

SEQ ID NO: 485167 - RNA, 22 nt, Human
uacaguagaauuuuuaguaacu

SEQ ID NO: 485168 - RNA, 22 nt, Human
cugaaggaagcagguggccugu

SEQ ID NO: 485169 - RNA, 22 nt, Human
caaggcaggcaguucacuugag

SEQ ID NO: 485170 - RNA, 22 nt, Human
ggcuccuggggaggugagcuug

SEQ ID NO: 485171 - RNA, 22 nt, Human
ucacugggagaugugggaaggg

SEQ ID NO: 485172 - RNA, 19 nt, Human
uggcuuccaucucucucau

SEQ ID NO: 485173 - RNA, 23 nt, Human
auggagcugguacuagcuaccuc

SEQ ID NO: 485174 - RNA, 22 nt, Human
gggagcugguuccugcccucca

SEQ ID NO: 485175 - RNA, 20 nt, Human
uuguuucugcuauuuucuaa

SEQ ID NO: 485176 - RNA, 22 nt, Human
agcuggaggggccagcaggugu

SEQ ID NO: 485177 - RNA, 22 nt, Human
aaauacagauuccagggucuua

SEQ ID NO: 485178 - RNA, 22 nt, Human
gcaagcuggcuguuagaggaug

SEQ ID NO: 485179 - RNA, 22 nt, Human
cucaggauuuacuaauuucaag

SEQ ID NO: 485180 - RNA, 22 nt, Human
agggcccuaaggaaggcacaca

SEQ ID NO: 485181 - RNA, 22 nt, Human
agaauuagucacaauuauagga

SEQ ID NO: 485182 - RNA, 22 nt, Human
gggcugaccaaugccuugcuuu

SEQ ID NO: 485183 - RNA, 18 nt, Human
acagggagggcgcugggg

SEQ ID NO: 485184 - RNA, 21 nt, Human
gcacagugccaggcacacagu

SEQ ID NO: 485185 - RNA, 22 nt, Human
aggagcugcuuaaaugguuggu

SEQ ID NO: 485186 - RNA, 22 nt, Human
gucaggauuggggucaugaguc

SEQ ID NO: 485187 - RNA, 22 nt, Human
ucuccuuugaaaguuaggacug

SEQ ID NO: 485188 - RNA, 20 nt, Human
uuugagaccagucugcccaa

SEQ ID NO: 485189 - RNA, 22 nt, Human
ucucagaggucuucagccucug

SEQ ID NO: 485190 - RNA, 19 nt, Human
uccugcagguggcuugcag

SEQ ID NO: 485191 - RNA, 22 nt, Human
ccagcacugcucucagacugag

SEQ ID NO: 485192 - RNA, 22 nt, Human
cacucugagaaguacaagcucc

SEQ ID NO: 485193 - RNA, 22 nt, Human
gcucccugcacucugcagcccu

SEQ ID NO: 485194 - RNA, 22 nt, Human
acagcuuuaguguggguggugc

SEQ ID NO: 485195 - RNA, 22 nt, Human
uaugcacaccuggguccuuguc

SEQ ID NO: 485196 - RNA, 22 nt, Human
cuaguucuuaacuguuaugauu

SEQ ID NO: 485197 - RNA, 23 nt, Human
cagugcagggcaacucagacucc

SEQ ID NO: 485198 - RNA, 22 nt, Human
aagaugauagaucugucaaugu

SEQ ID NO: 485199 - RNA, 22 nt, Human
uggaggagaauuuauggucgaa

SEQ ID NO: 485200 - RNA, 22 nt, Human
aggcagcagagguugaggaaag

SEQ ID NO: 485201 - RNA, 23 nt, Human
ucguugaauagcaauagcacaac

SEQ ID NO: 485202 - RNA, 22 nt, Human
auauucacugagcauaaagcca

SEQ ID NO: 485203 - RNA, 22 nt, Human
ggggaggaagcuggaacacggg

SEQ ID NO: 485204 - RNA, 22 nt, Human
gggcgccgugggaaacagccgg

SEQ ID NO: 485205 - RNA, 19 nt, Human
ccagagacauuggcaucuu

SEQ ID NO: 485206 - RNA, 22 nt, Human
uacaaaugaccauagccacuua

SEQ ID NO: 485207 - RNA, 22 nt, Human
ccacuguuuuucaguuaacuuu

SEQ ID NO: 485208 - RNA, 22 nt, Human
ugagggaggcccuuugagcaga

SEQ ID NO: 485209 - RNA, 22 nt, Human
gaugccugcauuucaggagagu

SEQ ID NO: 485210 - RNA, 22 nt, Human
uccagggaucuuuagagucuuu

SEQ ID NO: 485211 - RNA, 19 nt, Human
ggagccuggagcacgugcc

SEQ ID NO: 485212 - RNA, 22 nt, Human
gcaugugucuccccaguggagg

SEQ ID NO: 485213 - RNA, 23 nt, Human
cccagaccuugugcugcccuugg

SEQ ID NO: 485214 - RNA, 22 nt, Human
agcccggcuuccccgguugcua

SEQ ID NO: 485215 - RNA, 22 nt, Human
auggggugagacuaggauuaaa

SEQ ID NO: 485216 - RNA, 22 nt, Human
cugccacuuucacccagugcuc

SEQ ID NO: 485217 - RNA, 22 nt, Human
agcagggcugcagugugucuuu

SEQ ID NO: 485218 - RNA, 22 nt, Human
ugaguaauaaacugucuugcuc

SEQ ID NO: 485219 - RNA, 21 nt, Human
ucucacaauaugaugccagau

SEQ ID NO: 485220 - RNA, 22 nt, Human
acauucuguuuccccaaagaga

SEQ ID NO: 485221 - RNA, 22 nt, Human
aacccagccguguagcugccgc

SEQ ID NO: 485222 - RNA, 22 nt, Human
agauguguuucuaguuccugca

SEQ ID NO: 485223 - RNA, 16 nt, Human
cagcuuuaugucagug

SEQ ID NO: 485224 - RNA, 22 nt, Human
agcagagaagacacaggcuuca

SEQ ID NO: 485225 - RNA, 22 nt, Human
acaggggauugauuggaagucu

SEQ ID NO: 485226 - RNA, 22 nt, Human
ccccuuccacagugcuuccuaa

SEQ ID NO: 485227 - RNA, 22 nt, Human
gcugauccuuuuaugucuagcu

SEQ ID NO: 485228 - RNA, 22 nt, Human
ggucccaguccucucccugcua

SEQ ID NO: 485229 - RNA, 22 nt, Human
ugccagcuccgaggagcugcag

SEQ ID NO: 485230 - RNA, 22 nt, Human
cugagggcaugaacauuccaua

SEQ ID NO: 485231 - RNA, 22 nt, Human
aggcugccucgugagcucgcug

SEQ ID NO: 485232 - RNA, 22 nt, Human
uuaagucacuuaucuaaagaca

SEQ ID NO: 485233 - RNA, 22 nt, Human
ggguggggcccaggaaaucuau

SEQ ID NO: 485234 - RNA, 22 nt, Human
gggcagggguagcauuccaagu

SEQ ID NO: 485235 - RNA, 22 nt, Human
ugcagggacacgaagacaaaua

SEQ ID NO: 485236 - RNA, 22 nt, Human
auugaaagcacaaagaacaagu

SEQ ID NO: 485237 - RNA, 22 nt, Human
cccagcuccaagggacagcgaa

SEQ ID NO: 485238 - RNA, 22 nt, Human
uaagcugugggagauuggcaua

SEQ ID NO: 485239 - RNA, 22 nt, Human
auuccaaacagugcugcagacu

SEQ ID NO: 485240 - RNA, 22 nt, Human
acagguggcuuauuggcugauu

SEQ ID NO: 485241 - RNA, 22 nt, Human
gccucugcugcaagccugguug

SEQ ID NO: 485242 - RNA, 22 nt, Human
aaaggucaaaaucgugacauug

SEQ ID NO: 485243 - RNA, 22 nt, Human
uugucugucccagcuugugcau

SEQ ID NO: 485244 - RNA, 22 nt, Human
agcugccagggacugggcaugg

SEQ ID NO: 485245 - RNA, 18 nt, Human
uccugccugugccccagg

SEQ ID NO: 485246 - RNA, 22 nt, Human
ucugagcuggagcccaucaccu

SEQ ID NO: 485247 - RNA, 22 nt, Human
gagcugcagcggcugacgcaac

SEQ ID NO: 485248 - RNA, 22 nt, Human
gccacaugcaauugcagcacgu

SEQ ID NO: 485249 - RNA, 22 nt, Human
uccuuucaccaaaaaguguugu

SEQ ID NO: 485250 - RNA, 22 nt, Human
uguccugcaacugaaggagaag

SEQ ID NO: 485251 - RNA, 22 nt, Human
accaugggucagccaccucagc

SEQ ID NO: 485252 - RNA, 21 nt, Human
uggagcugaauuuuuggcauc

SEQ ID NO: 485253 - RNA, 22 nt, Human
aagcugccagauucagucugcu

SEQ ID NO: 485254 - RNA, 22 nt, Human
gaaggcacugaacuccuucugg

SEQ ID NO: 485255 - RNA, 22 nt, Human
ccugaggcccuggcugugcuga

SEQ ID NO: 485256 - RNA, 21 nt, Human
gggcaggucucugaugucaac

SEQ ID NO: 485257 - RNA, 22 nt, Human
ugagccagaguggagugugccu

SEQ ID NO: 485258 - RNA, 22 nt, Human
ccugggcuugcaucugugcugg

SEQ ID NO: 485259 - RNA, 22 nt, Human
aucaggaugcugucaguuacca

SEQ ID NO: 485260 - RNA, 22 nt, Human
caucucaugggcaugccaagcu

SEQ ID NO: 485261 - RNA, 22 nt, Human
agugucugaaccaccggggcau

SEQ ID NO: 485262 - RNA, 22 nt, Human
cccuggugguacggcacuggca

SEQ ID NO: 485263 - RNA, 22 nt, Human
agcugccauccgaggugucaga

SEQ ID NO: 485264 - RNA, 22 nt, Human
uuugauuuacuggauauucuca

SEQ ID NO: 485265 - RNA, 22 nt, Human
accuuucacgguaucagacauc

SEQ ID NO: 485266 - RNA, 22 nt, Human
uccagccaugcaugacaaucac

SEQ ID NO: 485267 - RNA, 22 nt, Human
aaaugcauugguuucuacuugu

SEQ ID NO: 485268 - RNA, 22 nt, Human
acaggugauucaggcucuggga

SEQ ID NO: 485269 - RNA, 22 nt, Human
ccagagagguagcuuacccucu

SEQ ID NO: 485270 - RNA, 22 nt, Human
cuucaucaacucuaacaaaugu

SEQ ID NO: 485271 - RNA, 22 nt, Human
acauugaucagccucccaugca

SEQ ID NO: 485272 - RNA, 21 nt, Human
aaggccugcuuacugcuaguu

SEQ ID NO: 485273 - RNA, 22 nt, Human
auguguauacuugugcuuacuc

SEQ ID NO: 485274 - RNA, 22 nt, Human
uccaggcaggguuaaggguccu

SEQ ID NO: 485275 - RNA, 21 nt, Human
aaauuucugcaagccucaacu

SEQ ID NO: 485276 - RNA, 22 nt, Human
uagcugucaccagaaauggcca

SEQ ID NO: 485277 - RNA, 22 nt, Human
agucagcagugaaagcacagcc

SEQ ID NO: 485278 - RNA, 23 nt, Human
aggaggccugaaacugaggcuga

SEQ ID NO: 485279 - RNA, 22 nt, Human
agcagagccagaauuggaccag

SEQ ID NO: 485280 - RNA, 22 nt, Human
cuggagcucuguguguuccuga

SEQ ID NO: 485281 - RNA, 22 nt, Human
ggagaaggaauauuggaguagg

SEQ ID NO: 485282 - RNA, 23 nt, Human
agaggcaggaguggcuugcccgg

SEQ ID NO: 485283 - RNA, 22 nt, Human
aacugcauucagaaagcucacu

SEQ ID NO: 485284 - RNA, 19 nt, Human
ucagggcaguccggucccc

SEQ ID NO: 485285 - RNA, 22 nt, Human
aaacugaauucccaagggcaug

SEQ ID NO: 485286 - RNA, 19 nt, Human
cuggcucuuggguggagga

SEQ ID NO: 485287 - RNA, 22 nt, Human
aucuggcucaccuggguaaaua

SEQ ID NO: 485288 - RNA, 22 nt, Human
ugcucuccggcuuccguggccu

SEQ ID NO: 485289 - RNA, 22 nt, Human
gcuggagcugcagccugggccu

SEQ ID NO: 485290 - RNA, 22 nt, Human
ugagcagggacuuugaguguag

SEQ ID NO: 485291 - RNA, 17 nt, Human
ccugucuuguuucugcc

SEQ ID NO: 485292 - RNA, 22 nt, Human
auguuucaaauauauagaguug

SEQ ID NO: 485293 - RNA, 22 nt, Human
gaggcugcacuggcuaaaggcu

SEQ ID NO: 485294 - RNA, 21 nt, Human
ggagucagggucuggcugggg

SEQ ID NO: 485295 - RNA, 22 nt, Human
gaaaaugugccuuuggguauug

SEQ ID NO: 485296 - RNA, 22 nt, Human
uuuaaaauuuagaccucuccac

SEQ ID NO: 485297 - RNA, 22 nt, Human
gaggggcagaaugugaucaggg

SEQ ID NO: 485298 - RNA, 22 nt, Human
ucucccaggucauacacagaga

SEQ ID NO: 485299 - RNA, 22 nt, Human
cagaauuuagcacaauguaugg

SEQ ID NO: 485300 - RNA, 22 nt, Human
cuuccaaagcacuuuauggacc

SEQ ID NO: 485301 - RNA, 22 nt, Human
ggcaggcaagucugcucuguga

SEQ ID NO: 485302 - RNA, 22 nt, Human
gcagcccaaaaaagagguagau

SEQ ID NO: 485303 - RNA, 22 nt, Human
uggcagcacuugaacuugagcc

SEQ ID NO: 485304 - RNA, 22 nt, Human
ugcaggcuggaggagggacuaa

SEQ ID NO: 485305 - RNA, 22 nt, Human
agcuguggcagcacuuuggagu

SEQ ID NO: 485306 - RNA, 19 nt, Human
uugaggggccaggggagau

SEQ ID NO: 485307 - RNA, 22 nt, Human
ggccucugguucguggugaccu

SEQ ID NO: 485308 - RNA, 22 nt, Human
accuggagucauuugaggagua

SEQ ID NO: 485309 - RNA, 22 nt, Human
gagaaaauagcauguguaguau

SEQ ID NO: 485310 - RNA, 22 nt, Human
ggaccagagaagugagcaccug

SEQ ID NO: 485311 - RNA, 22 nt, Human
aauaauuauuugagagcagacc

SEQ ID NO: 485312 - RNA, 22 nt, Human
gagccuggccuccugccucagc

SEQ ID NO: 485313 - RNA, 22 nt, Human
guccucugggcuuugagcaguc

SEQ ID NO: 485314 - RNA, 22 nt, Human
uuucuuguaagauguuuauuaa

SEQ ID NO: 485315 - RNA, 22 nt, Human
auuaaauuagcaaacugugaaa

SEQ ID NO: 485316 - RNA, 22 nt, Human
ucuggcucccagccugcucuca

SEQ ID NO: 485317 - RNA, 22 nt, Human
gagggcuccucacauucucuau

SEQ ID NO: 485318 - RNA, 22 nt, Human
gaagcagcagcuggggacaguu

SEQ ID NO: 485319 - RNA, 22 nt, Human
ggagaugccagaauugcaaauu

SEQ ID NO: 485320 - RNA, 18 nt, Human
cagggcuguggggucacu

SEQ ID NO: 485321 - RNA, 22 nt, Human
cuuucuuauaccugucagggcc

SEQ ID NO: 485322 - RNA, 22 nt, Human
uucuaguuuugccuuaucaaca

SEQ ID NO: 485323 - RNA, 22 nt, Human
aagacugucugggacaagauga

SEQ ID NO: 485324 - RNA, 22 nt, Human
gcugaagcugcagcaggaggaa

SEQ ID NO: 485325 - RNA, 22 nt, Human
cacagguguaugaauaugucca

SEQ ID NO: 485326 - RNA, 19 nt, Human
cugcucaggucagucuguc

SEQ ID NO: 485327 - RNA, 20 nt, Human
caguagcaauaauuagaagc

SEQ ID NO: 485328 - RNA, 22 nt, Human
gaaggagcuaaagggagcccug

SEQ ID NO: 485329 - RNA, 22 nt, Human
ugguggcaauguccuggagaag

SEQ ID NO: 485330 - RNA, 22 nt, Human
acuucucuucauagguggcaau

SEQ ID NO: 485331 - RNA, 22 nt, Human
cugcucuggggaagccagaugu

SEQ ID NO: 485332 - RNA, 22 nt, Human
aggagugaguguccucagcaga

SEQ ID NO: 485333 - RNA, 22 nt, Human
gcagugggcaacaagagcugga

SEQ ID NO: 485334 - RNA, 22 nt, Human
uucuuaaaacuuauggacaggu

SEQ ID NO: 485335 - RNA, 22 nt, Human
cagcugccccuccagggcuggg

SEQ ID NO: 485336 - RNA, 23 nt, Human
uguagcaucucuuauuucucagc

SEQ ID NO: 485337 - RNA, 21 nt, Human
uuuguucaggggcaaaguuaa

SEQ ID NO: 485338 - RNA, 22 nt, Human
ccacagagagugucagccuuug

SEQ ID NO: 485339 - RNA, 22 nt, Human
gagaaacuaacaucugaaggug

SEQ ID NO: 485340 - RNA, 22 nt, Human
caucuggcuagcuaucauugug

SEQ ID NO: 485341 - RNA, 22 nt, Human
uccagugguacauggagacacu

SEQ ID NO: 485342 - RNA, 22 nt, Human
gaggaggcuggcgccgccugcc

SEQ ID NO: 485343 - RNA, 22 nt, Human
cagacagaaggcuccuugaggu

SEQ ID NO: 485344 - RNA, 22 nt, Human
gauuucaaccuaacaguaugac

SEQ ID NO: 485345 - RNA, 22 nt, Human
cucugagcagaggccguggcua

SEQ ID NO: 485346 - RNA, 22 nt, Human
uguauuuuuaggaaugcgcuau

SEQ ID NO: 485347 - RNA, 22 nt, Human
gccccagcucugccacaacuag

SEQ ID NO: 485348 - RNA, 22 nt, Human
ggcaggcaggucuucauggccc

SEQ ID NO: 485349 - RNA, 22 nt, Human
cugcagagcauaaaucugaaua

SEQ ID NO: 485350 - RNA, 22 nt, Human
uugcucuguaauaaucuggggu

SEQ ID NO: 485351 - RNA, 22 nt, Human
ucuauuuuauacucaaaucuuc

SEQ ID NO: 485352 - RNA, 22 nt, Human
aagacugugucuauggcuacuc

SEQ ID NO: 485353 - RNA, 22 nt, Human
cuccccagguucaggagguggg

SEQ ID NO: 485354 - RNA, 22 nt, Human
cagggagaggcaucauagggaa

SEQ ID NO: 485355 - RNA, 19 nt, Human
uuugaaagaguuuuauugg

SEQ ID NO: 485356 - RNA, 19 nt, Human
cugguccugacugaggggu

SEQ ID NO: 485357 - RNA, 22 nt, Human
gcgaaaaauguguaaauauguu

SEQ ID NO: 485358 - RNA, 22 nt, Human
gggcugacaccacccaggcgca

SEQ ID NO: 485359 - RNA, 22 nt, Human
ggugauuuucgaguuucauguu

SEQ ID NO: 485360 - RNA, 21 nt, Human
ccucugcucgggcaugcguuu

SEQ ID NO: 485361 - RNA, 22 nt, Human
cuaucuuucgauucuagcuuaa

SEQ ID NO: 485362 - RNA, 22 nt, Human
gguggccuuucaguggaucagg

SEQ ID NO: 485363 - RNA, 22 nt, Human
cugccuuggaaaaugugguaau

SEQ ID NO: 485364 - RNA, 22 nt, Human
agcaccuggucuccuggcgcug

SEQ ID NO: 485365 - RNA, 22 nt, Human
ugaaagcucugucaucauuccu

SEQ ID NO: 485366 - RNA, 22 nt, Human
cagagaaagggugaauuccuuc

SEQ ID NO: 485367 - RNA, 22 nt, Human
cccaggcagucuggcucuaaag

SEQ ID NO: 485368 - RNA, 20 nt, Human
acugcuucuuucucugaccu

SEQ ID NO: 485369 - RNA, 22 nt, Human
ucaggaugaccacgagccucua

SEQ ID NO: 485370 - RNA, 22 nt, Human
ggaugcugcuaucaggcuucga

SEQ ID NO: 485371 - RNA, 22 nt, Human
acagacagggcaccugccuccu

SEQ ID NO: 485372 - RNA, 20 nt, Human
aaagucuuaugguuaauuuu

SEQ ID NO: 485373 - RNA, 17 nt, Human
aggaagggcaaguuucu

SEQ ID NO: 485374 - RNA, 22 nt, Human
gcacccagccagcaucucagag

SEQ ID NO: 485375 - RNA, 22 nt, Human
ccugcagagccacgugccagcg

SEQ ID NO: 485376 - RNA, 22 nt, Human
ugcagaagcagagaguugccaa

SEQ ID NO: 485377 - RNA, 22 nt, Human
ucauuuucacacauaaauagca

SEQ ID NO: 485378 - RNA, 22 nt, Human
uuugacaguaauaaagcacaag

SEQ ID NO: 485379 - RNA, 22 nt, Human
cuggcugcuggccugaggaugc

SEQ ID NO: 485380 - RNA, 22 nt, Human
gaccauuugcuaguaaauugca

SEQ ID NO: 485381 - RNA, 22 nt, Human
gccuggugguauccuggcaaga

SEQ ID NO: 485382 - RNA, 22 nt, Human
uucgaguuggcuuuauuaaacu

SEQ ID NO: 485383 - RNA, 22 nt, Human
acagauuuaggacuguagcgau

SEQ ID NO: 485384 - RNA, 22 nt, Human
gcagcuggggaggucgugggga

SEQ ID NO: 485385 - RNA, 21 nt, Human
gccagccuguuuaccuguggu

SEQ ID NO: 485386 - RNA, 21 nt, Human
gugguucuagagaaacagaau

SEQ ID NO: 485387 - RNA, 19 nt, Human
agucccaggcccgaaagag

SEQ ID NO: 485388 - RNA, 22 nt, Human
ucugcucuccauacuuccgcac

SEQ ID NO: 485389 - RNA, 20 nt, Human
uugcauuggaugugcaggug

SEQ ID NO: 485390 - RNA, 22 nt, Human
ucaucacauaugucaugauuug

SEQ ID NO: 485391 - RNA, 22 nt, Human
agaccgagaaguucuccaggcc

SEQ ID NO: 485392 - RNA, 22 nt, Human
auacauuagcucauaugauuaa

SEQ ID NO: 485393 - RNA, 22 nt, Human
cggcagagcuuccugcucagcg

SEQ ID NO: 485394 - RNA, 22 nt, Human
ccagcuuucauaucaugaggua

SEQ ID NO: 485395 - RNA, 22 nt, Human
aguacauuuauuaaugguaaaa

SEQ ID NO: 485396 - RNA, 22 nt, Human
aguggacucuucccagugcuug

SEQ ID NO: 485397 - RNA, 22 nt, Human
ugcugccacugguagucucauu

SEQ ID NO: 485398 - RNA, 21 nt, Human
ucagcagcaucugccuagagu

SEQ ID NO: 485399 - RNA, 22 nt, Human
ccagcccugccagagagagcug

SEQ ID NO: 485400 - RNA, 22 nt, Human
uugaccuauguuucuucaucug

SEQ ID NO: 485401 - RNA, 22 nt, Human
agcugcccugggucuugcugcu

SEQ ID NO: 485402 - RNA, 22 nt, Human
uauucacauucucaggccuggu

SEQ ID NO: 485403 - RNA, 22 nt, Human
accuggccauccagcuggcauc

SEQ ID NO: 485404 - RNA, 22 nt, Human
gggacugggagauccuccuggc

SEQ ID NO: 485405 - RNA, 22 nt, Human
gagcacugagcuggaauuggag

SEQ ID NO: 485406 - RNA, 22 nt, Human
gcaggcagagaaggaacauuua

SEQ ID NO: 485407 - RNA, 22 nt, Human
cacagcugccauggcugcacuu

SEQ ID NO: 485408 - RNA, 17 nt, Human
gccuggcccagccuggc

SEQ ID NO: 485409 - RNA, 22 nt, Human
uguaggacauguacuuguaaca

SEQ ID NO: 485410 - RNA, 22 nt, Human
uacccagcaaucccuagagguu

SEQ ID NO: 485411 - RNA, 22 nt, Human
gaaugugucacccugucccaug

SEQ ID NO: 485412 - RNA, 23 nt, Human
ugcagagggacugaagccagcuu

SEQ ID NO: 485413 - RNA, 22 nt, Human
ccugagccugaguggugcaggg

SEQ ID NO: 485414 - RNA, 22 nt, Human
ucagggcaucucuuaaguggug

SEQ ID NO: 485415 - RNA, 22 nt, Human
auucccaucgucaacuucacug

SEQ ID NO: 485416 - RNA, 22 nt, Human
gaaccucagugaaacuggaggu

SEQ ID NO: 485417 - RNA, 22 nt, Human
ugcuuuauuaagagagaaauuu

SEQ ID NO: 485418 - RNA, 22 nt, Human
uauguacaccggggaagguggg

SEQ ID NO: 485419 - RNA, 22 nt, Human
aucacugucgucaucugagauu

SEQ ID NO: 485420 - RNA, 22 nt, Human
ucaucaguguccuuaucacuua

SEQ ID NO: 485421 - RNA, 22 nt, Human
auguccaguuucuacacacaua

SEQ ID NO: 485422 - RNA, 22 nt, Human
uguuauugagguuacuuauaag

SEQ ID NO: 485423 - RNA, 21 nt, Human
ccuauugaauauaggaagauu

SEQ ID NO: 485424 - RNA, 21 nt, Human
ggccugagcaccuguccaccu

SEQ ID NO: 485425 - RNA, 22 nt, Human
gcaugggcuuucucagaguucu

SEQ ID NO: 485426 - RNA, 22 nt, Human
agcagggcuuuggcuggcuuuc

SEQ ID NO: 485427 - RNA, 22 nt, Human
ccucagggaaugggaggcuggg

SEQ ID NO: 485428 - RNA, 22 nt, Human
ugaaggaaugaguauacuguuu

SEQ ID NO: 485429 - RNA, 22 nt, Human
aauuagggagccaucauaaggu

SEQ ID NO: 485430 - RNA, 21 nt, Human
guuauuuuaagugagcuuugc

SEQ ID NO: 485431 - RNA, 22 nt, Human
cacucugcgcugggcgccagcg

SEQ ID NO: 485432 - RNA, 22 nt, Human
uguuuuguuuaugagagcacag

SEQ ID NO: 485433 - RNA, 22 nt, Human
aaggaaccauuugugugcaugg

SEQ ID NO: 485434 - RNA, 20 nt, Human
caggaggcaaggucaagguc

SEQ ID NO: 485435 - RNA, 22 nt, Human
gcugugcaguaguagguacagu

SEQ ID NO: 485436 - RNA, 18 nt, Human
agagaugguguagaguuu

SEQ ID NO: 485437 - RNA, 22 nt, Human
gaggcugaauggccagaagcca

SEQ ID NO: 485438 - RNA, 22 nt, Human
uggggcagcuccaucuauucca

SEQ ID NO: 485439 - RNA, 22 nt, Human
uuuuagaaauacugauuuagug

SEQ ID NO: 485440 - RNA, 22 nt, Human
cauuuauucaugaucuguagcu

SEQ ID NO: 485441 - RNA, 22 nt, Human
gagugugucggucagcguggcg

SEQ ID NO: 485442 - RNA, 22 nt, Human
ucauacauaacuuguacaguga

SEQ ID NO: 485443 - RNA, 22 nt, Human
gaaaagggcaagagagagggca

SEQ ID NO: 485444 - RNA, 17 nt, Human
agcagaagucagaggga

SEQ ID NO: 485445 - RNA, 22 nt, Human
uuuaccaaauagauuaugucag

SEQ ID NO: 485446 - RNA, 22 nt, Human
gaaggccugugguagugagacg

SEQ ID NO: 485447 - RNA, 22 nt, Human
ugcauuauaacugaauguuguu

SEQ ID NO: 485448 - RNA, 21 nt, Human
gguugguguguccaguggcca

SEQ ID NO: 485449 - RNA, 22 nt, Human
cagaggcacaagaaagcaaggc

SEQ ID NO: 485450 - RNA, 22 nt, Human
uccugguggcuuucccugccuu

SEQ ID NO: 485451 - RNA, 22 nt, Human
ucucugaguucuccuccagccc

SEQ ID NO: 485452 - RNA, 22 nt, Human
aggcagggugaugauaaugauu

SEQ ID NO: 485453 - RNA, 22 nt, Human
aauuaugagguagauaucacau

SEQ ID NO: 485454 - RNA, 23 nt, Human
ccagggccccuacaccacugucc

SEQ ID NO: 485455 - RNA, 22 nt, Human
ugcaccugagaggucucugagg

SEQ ID NO: 485456 - RNA, 22 nt, Human
aaaaacugguaacuauucccca

SEQ ID NO: 485457 - RNA, 22 nt, Human
gggcugagacgauggggucuuc

SEQ ID NO: 485458 - RNA, 23 nt, Human
ucugucacuuucugcuguggagu

SEQ ID NO: 485459 - RNA, 22 nt, Human
auccacagucuuagccaucaaa

SEQ ID NO: 485460 - RNA, 22 nt, Human
gucaggauuuacaaacuucagu

SEQ ID NO: 485461 - RNA, 22 nt, Human
aaaugguaagacaacacauuau

SEQ ID NO: 485462 - RNA, 22 nt, Human
gccuggagugcaguggcgugau

SEQ ID NO: 485463 - RNA, 22 nt, Human
aauguacaucucaguguaguac

SEQ ID NO: 485464 - RNA, 22 nt, Human
gcaggaguuaggcgucguggau

SEQ ID NO: 485465 - RNA, 22 nt, Human
uuuccacugggcacggggccag

SEQ ID NO: 485466 - RNA, 22 nt, Human
gagagugauucccucccauaga

SEQ ID NO: 485467 - RNA, 22 nt, Human
cagcuuuaccuuuaggaguaac

SEQ ID NO: 485468 - RNA, 22 nt, Human
agaagccaacagggcaggagag

SEQ ID NO: 485469 - RNA, 18 nt, Human
ucauuuguuuugcaugaa

SEQ ID NO: 485470 - RNA, 22 nt, Human
acuggcaguggcagcagaaaga

SEQ ID NO: 485471 - RNA, 22 nt, Human
aggcacugaauauccaguaaaa

SEQ ID NO: 485472 - RNA, 22 nt, Human
caaagagcuguucagugucgcu

SEQ ID NO: 485473 - RNA, 22 nt, Human
uuuuccucugagcuuugaauaa

SEQ ID NO: 485474 - RNA, 22 nt, Human
ugccaggcagugucagauugag

SEQ ID NO: 485475 - RNA, 22 nt, Human
aaaauccugcugacucgagaug

SEQ ID NO: 485476 - RNA, 22 nt, Human
uguggugagaaacugguagauu

SEQ ID NO: 485477 - RNA, 22 nt, Human
aguccagugucaaggugccauu

SEQ ID NO: 485478 - RNA, 22 nt, Human
aagggcugaaagaccuugggca

SEQ ID NO: 485479 - RNA, 22 nt, Human
aagaauuauugcaauacuagau

SEQ ID NO: 485480 - RNA, 22 nt, Human
gagcagugacuggagcaugaga

SEQ ID NO: 485481 - RNA, 22 nt, Human
ugagccugaguucaaggcugca

SEQ ID NO: 485482 - RNA, 22 nt, Human
acagagcaugcucaguguguga

SEQ ID NO: 485483 - RNA, 22 nt, Human
ccaggguggcguagaugcuggg

SEQ ID NO: 485484 - RNA, 22 nt, Human
cucucugggggccaugccaaga

SEQ ID NO: 485485 - RNA, 22 nt, Human
aucagugcuaaagcaaaugccc

SEQ ID NO: 485486 - RNA, 22 nt, Human
gugcccugguccccagcauaua

SEQ ID NO: 485487 - RNA, 22 nt, Human
uuugcauuacuugacuuuaguu

SEQ ID NO: 485488 - RNA, 22 nt, Human
uggccaggcagguagaacggcc

SEQ ID NO: 485489 - RNA, 22 nt, Human
agccucugacugucagcaaggu

SEQ ID NO: 485490 - RNA, 18 nt, Human
cugucuuuuuucucucca

SEQ ID NO: 485491 - RNA, 22 nt, Human
gggggaagaaagaacauggcau

SEQ ID NO: 485492 - RNA, 22 nt, Human
cagcugagaagugauagcugca

SEQ ID NO: 485493 - RNA, 22 nt, Human
gucacacucagaaugacuagag

SEQ ID NO: 485494 - RNA, 22 nt, Human
cugggcacaaguggcccuggau

SEQ ID NO: 485495 - RNA, 22 nt, Human
uccaggcagagcaacaaaauau

SEQ ID NO: 485496 - RNA, 22 nt, Human
agccauugaauuuagugccuuu

SEQ ID NO: 485497 - RNA, 22 nt, Human
ugcagggcaguggagguugagu

SEQ ID NO: 485498 - RNA, 19 nt, Human
ggcuggcaagugacagugu

SEQ ID NO: 485499 - RNA, 22 nt, Human
gagcagaacuacucacauaucg

SEQ ID NO: 485500 - RNA, 21 nt, Human
uucaaaguuugccuaaagauu

SEQ ID NO: 485501 - RNA, 22 nt, Human
uauugaaaugaaugacagugau

SEQ ID NO: 485502 - RNA, 22 nt, Human
gccaggcugaggcucuggaaga

SEQ ID NO: 485503 - RNA, 22 nt, Human
agccugcaggaugggcagcacc

SEQ ID NO: 485504 - RNA, 22 nt, Human
guucuccauucagcuuccugug

SEQ ID NO: 485505 - RNA, 22 nt, Human
uguucuuucaguuagacacagu

SEQ ID NO: 485506 - RNA, 21 nt, Human
ugcauaaagaaauacaaauac

SEQ ID NO: 485507 - RNA, 22 nt, Human
gagcaggcauucuaguggcuga

SEQ ID NO: 485508 - RNA, 22 nt, Human
uauuucuguaacucagggucug

SEQ ID NO: 485509 - RNA, 22 nt, Human
gcuggugccuuguuguuguuac

SEQ ID NO: 485510 - RNA, 22 nt, Human
cugcccuggcagccuaccaugg

SEQ ID NO: 485511 - RNA, 22 nt, Human
aggcuucuaggguuggcagcgg

SEQ ID NO: 485512 - RNA, 22 nt, Human
augcaguaaauguucuaguuug

SEQ ID NO: 485513 - RNA, 22 nt, Human
agggcagagggugccucaccug

SEQ ID NO: 485514 - RNA, 22 nt, Human
aaguccagcucuaaauaucuga

SEQ ID NO: 485515 - RNA, 22 nt, Human
ugugaggagaggcccagcuccc

SEQ ID NO: 485516 - RNA, 19 nt, Human
gagcugccuuuugaagacc

SEQ ID NO: 485517 - RNA, 22 nt, Human
gcccagaaguugaggcugcagu

SEQ ID NO: 485518 - RNA, 22 nt, Human
ccaguguucauaauuuuacacu

SEQ ID NO: 485519 - RNA, 20 nt, Human
uccuggccucccuggggcuc

SEQ ID NO: 485520 - RNA, 22 nt, Human
uguguuuugaacucaucuacug

SEQ ID NO: 485521 - RNA, 22 nt, Human
aagauuuccuggauguaauucc

SEQ ID NO: 485522 - RNA, 22 nt, Human
gagaaagauggaaucuuacagg

SEQ ID NO: 485523 - RNA, 22 nt, Human
ugucucaguauacgaaacacuu

SEQ ID NO: 485524 - RNA, 22 nt, Human
uuauguauggauggcugaaagu

SEQ ID NO: 485525 - RNA, 22 nt, Human
ugaauccagagcuauuucgucc

SEQ ID NO: 485526 - RNA, 23 nt, Human
acuuuagauaaauuaugugcaca

SEQ ID NO: 485527 - RNA, 22 nt, Human
guuucuuuugugaucaccaacc

SEQ ID NO: 485528 - RNA, 22 nt, Human
agggguggagaguguugccagu

SEQ ID NO: 485529 - RNA, 22 nt, Human
ucagggcagguuaacuugggug

SEQ ID NO: 485530 - RNA, 22 nt, Human
agcucugggccaggaacccuaa

SEQ ID NO: 485531 - RNA, 23 nt, Human
ucaugcccaggcuccagauguca

SEQ ID NO: 485532 - RNA, 22 nt, Human
ugaggcaggagaauggcgggaa

SEQ ID NO: 485533 - RNA, 22 nt, Human
gggcaggaugcaguuucagaga

SEQ ID NO: 485534 - RNA, 22 nt, Human
cugccaucugagccaaaagugc

SEQ ID NO: 485535 - RNA, 21 nt, Human
ccagcagcucaaggaucucuu

SEQ ID NO: 485536 - RNA, 22 nt, Human
gcuggagcugaguucccugggc

SEQ ID NO: 485537 - RNA, 22 nt, Human
gcugccacuuggucaugucaug

SEQ ID NO: 485538 - RNA, 22 nt, Human
ccuuccuggagcccaugcagau

SEQ ID NO: 485539 - RNA, 22 nt, Human
ccacagccauuccagggaggcu

SEQ ID NO: 485540 - RNA, 22 nt, Human
uauagagguggaaacugagguu

SEQ ID NO: 485541 - RNA, 22 nt, Human
ucccagagucuucuccuguaau

SEQ ID NO: 485542 - RNA, 22 nt, Human
uuuuccuuucaucaggacaaag

SEQ ID NO: 485543 - RNA, 23 nt, Human
gcugggcuuacucuuucagugag

SEQ ID NO: 485544 - RNA, 22 nt, Human
ugacaccacaacuagccauuga

SEQ ID NO: 485545 - RNA, 22 nt, Human
gccagggaaacugcagaccagc

SEQ ID NO: 485546 - RNA, 22 nt, Human
agcagaggacaguucuuaggaa

SEQ ID NO: 485547 - RNA, 22 nt, Human
uaaguucaaugaacucaguucu

SEQ ID NO: 485548 - RNA, 22 nt, Human
ccagcccugccucucagggccc

SEQ ID NO: 485549 - RNA, 22 nt, Human
uaaauguggagacucaggaguc

SEQ ID NO: 485550 - RNA, 22 nt, Human
cuucuaggcuucucagggggca

SEQ ID NO: 485551 - RNA, 20 nt, Human
uuucauugucagaaucuuau

SEQ ID NO: 485552 - RNA, 23 nt, Human
ucagagagcuguugagagcugcc

SEQ ID NO: 485553 - RNA, 20 nt, Human
ugugaaagcaguagaaugac

SEQ ID NO: 485554 - RNA, 22 nt, Human
agcuuuauuaacucuccaggug

SEQ ID NO: 485555 - RNA, 22 nt, Human
uggcucugugcuucuaguaucu

SEQ ID NO: 485556 - RNA, 22 nt, Human
uuauuauagauuaugcaagauu

SEQ ID NO: 485557 - RNA, 22 nt, Human
aggucauugaaguuauuuucuu

SEQ ID NO: 485558 - RNA, 22 nt, Human
agacaacaccaaaugcuagugu

SEQ ID NO: 485559 - RNA, 22 nt, Human
ucacauaaauuauacaauuuca

SEQ ID NO: 485560 - RNA, 22 nt, Human
acccugggcuuggccugcucag

SEQ ID NO: 485561 - RNA, 23 nt, Human
agggccacugggaaggauuacug

SEQ ID NO: 485562 - RNA, 21 nt, Human
gugucaugguugacuuuggca

SEQ ID NO: 485563 - RNA, 22 nt, Human
ccacagaaaguugucuagagua

SEQ ID NO: 485564 - RNA, 22 nt, Human
gaaggagaggauugugaggcug

SEQ ID NO: 485565 - RNA, 18 nt, Human
uuaagagcugaaagggga

SEQ ID NO: 485566 - RNA, 22 nt, Human
ugccuggcaagaggggcuggcu

SEQ ID NO: 485567 - RNA, 22 nt, Human
ucagagagcuggugggcagagg

SEQ ID NO: 485568 - RNA, 22 nt, Human
uuucccaagaaaaauaauugga

SEQ ID NO: 485569 - RNA, 22 nt, Human
guggccuggaugagcuucgaca

SEQ ID NO: 485570 - RNA, 22 nt, Human
ggcugcagaaguacuuccggau

SEQ ID NO: 485571 - RNA, 22 nt, Human
cuagggacugggaccuuaguua

SEQ ID NO: 485572 - RNA, 22 nt, Human
cuggccuggagccucugggugg

SEQ ID NO: 485573 - RNA, 22 nt, Human
acuguccauaauauuggugaac

SEQ ID NO: 485574 - RNA, 22 nt, Human
ucacaguaaaagcauggaagag

SEQ ID NO: 485575 - RNA, 22 nt, Human
acuguacacauucgucaagacu

SEQ ID NO: 485576 - RNA, 22 nt, Human
agggaguuagaaauccaggaua

SEQ ID NO: 485577 - RNA, 22 nt, Human
aguaacuaugcuugagaaucag

SEQ ID NO: 485578 - RNA, 18 nt, Human
gagcagaggcucaacugg

SEQ ID NO: 485579 - RNA, 21 nt, Human
guggcccugccgcagugucca

SEQ ID NO: 485580 - RNA, 22 nt, Human
ucuccuggucaccucagaaguc

SEQ ID NO: 485581 - RNA, 22 nt, Human
cucucugaggcaggccuguggg

SEQ ID NO: 485582 - RNA, 22 nt, Human
acuguguccucauguggcagaa

SEQ ID NO: 485583 - RNA, 22 nt, Human
gagagugaaggcuucccagcaa

SEQ ID NO: 485584 - RNA, 22 nt, Human
acagauuuguucuuuugggcua

SEQ ID NO: 485585 - RNA, 17 nt, Human
ucagcaggggccaagcu

SEQ ID NO: 485586 - RNA, 22 nt, Human
uuaacagacauauauauuugua

SEQ ID NO: 485587 - RNA, 22 nt, Human
uaggcagauguuaacaggaaaa

SEQ ID NO: 485588 - RNA, 22 nt, Human
gggcucucgauuagacccuggg

SEQ ID NO: 485589 - RNA, 22 nt, Human
aggcugggaaaccugaaguugu

SEQ ID NO: 485590 - RNA, 21 nt, Human
aaagagguuaauauuguaagu

SEQ ID NO: 485591 - RNA, 22 nt, Human
cagagcuggagcuugaauggag

SEQ ID NO: 485592 - RNA, 22 nt, Human
aagggcagagggaaucccacau

SEQ ID NO: 485593 - RNA, 22 nt, Human
ucugcugcacaaauucaucucu

SEQ ID NO: 485594 - RNA, 22 nt, Human
ugauuuccaugaagcugaaggc

SEQ ID NO: 485595 - RNA, 20 nt, Human
gucaggauuaguaaacucug

SEQ ID NO: 485596 - RNA, 22 nt, Human
ggaccugcauuuuaacaagauc

SEQ ID NO: 485597 - RNA, 22 nt, Human
auuuguagugaagugaaaauaa

SEQ ID NO: 485598 - RNA, 23 nt, Human
gacacaggagcacccagcugagc

SEQ ID NO: 485599 - RNA, 22 nt, Human
gaggcugcccaacuggagugga

SEQ ID NO: 485600 - RNA, 22 nt, Human
gagggggagaugugcacacacu

SEQ ID NO: 485601 - RNA, 22 nt, Human
uuuaugaacuacagauauaacu

SEQ ID NO: 485602 - RNA, 20 nt, Human
acagcagauaccacaacuau

SEQ ID NO: 485603 - RNA, 22 nt, Human
agcucccagaguccucugccca

SEQ ID NO: 485604 - RNA, 22 nt, Human
gggcugugagaguggggcugcu

SEQ ID NO: 485605 - RNA, 18 nt, Human
ucugggcuucccgaggcu

SEQ ID NO: 485606 - RNA, 22 nt, Human
uucaagauccagcacaacagug

SEQ ID NO: 485607 - RNA, 22 nt, Human
cugcugcauuacucuucucaag

SEQ ID NO: 485608 - RNA, 22 nt, Human
ugagccuggggccugggcagcg

SEQ ID NO: 485609 - RNA, 19 nt, Human
ucccagagucuagagguug

SEQ ID NO: 485610 - RNA, 22 nt, Human
uagccucucuccuccacaaccu

SEQ ID NO: 485611 - RNA, 22 nt, Human
cagagcccagggccuacguccc

SEQ ID NO: 485612 - RNA, 22 nt, Human
cauaauuucuguaucagcacca

SEQ ID NO: 485613 - RNA, 22 nt, Human
aagggccuccuggggagccugg

SEQ ID NO: 485614 - RNA, 22 nt, Human
accagagaaaacacagcaggcu

SEQ ID NO: 485615 - RNA, 22 nt, Human
acacagccgugaaucugcuucu

SEQ ID NO: 485616 - RNA, 20 nt, Human
ccagacagcaccugccuggu

SEQ ID NO: 485617 - RNA, 22 nt, Human
uggcagcaguggagguagaaag

SEQ ID NO: 485618 - RNA, 22 nt, Human
agccaggaaccagcuacagucu

SEQ ID NO: 485619 - RNA, 22 nt, Human
agggagaacaguugcagcagac

SEQ ID NO: 485620 - RNA, 19 nt, Human
aacuagaaagguuuugaga

SEQ ID NO: 485621 - RNA, 22 nt, Human
guuugcauuuauuagucuucug

SEQ ID NO: 485622 - RNA, 22 nt, Human
uggcucuggugcgggcuccugc

SEQ ID NO: 485623 - RNA, 18 nt, Human
ugagaggcuauuuuuugc

SEQ ID NO: 485624 - RNA, 22 nt, Human
agcagugaaacagcugcauaug

SEQ ID NO: 485625 - RNA, 22 nt, Human
ggccuugggauguggcugcagc

SEQ ID NO: 485626 - RNA, 22 nt, Human
auaacagaguugggaagugaaa

SEQ ID NO: 485627 - RNA, 22 nt, Human
gcuggcuguaucaccuggccag

SEQ ID NO: 485628 - RNA, 22 nt, Human
cagcauuuucuuaauguaggug

SEQ ID NO: 485629 - RNA, 22 nt, Human
ucuguagcaagugagaggcauu

SEQ ID NO: 485630 - RNA, 17 nt, Human
aggccucccuccaggcc

SEQ ID NO: 485631 - RNA, 22 nt, Human
auauguguacgugcaguauaua

SEQ ID NO: 485632 - RNA, 19 nt, Human
acauuuaaauucagaucuc

SEQ ID NO: 485633 - RNA, 22 nt, Human
ccuggcugucguuuugugaaau

SEQ ID NO: 485634 - RNA, 22 nt, Human
uguaugcuuguguauaauauaa

SEQ ID NO: 485635 - RNA, 19 nt, Human
ggcugggucuggcagguuc

SEQ ID NO: 485636 - RNA, 22 nt, Human
uuuuccuucugauacuccauuu

SEQ ID NO: 485637 - RNA, 22 nt, Human
agcacaggaccaaggaagcugu

SEQ ID NO: 485638 - RNA, 22 nt, Human
gcagagcugggucuguauccaa

SEQ ID NO: 485639 - RNA, 22 nt, Human
aaguucaagucugcaucuuuuu

SEQ ID NO: 485640 - RNA, 22 nt, Human
cagcuccuauuagacacugaau

SEQ ID NO: 485641 - RNA, 23 nt, Human
ucagagaggcccccugcagagau

SEQ ID NO: 485642 - RNA, 22 nt, Human
gcccaucaucacuguggaggcu

SEQ ID NO: 485643 - RNA, 22 nt, Human
augggguggaguccgggcagcg

SEQ ID NO: 485644 - RNA, 22 nt, Human
uguggccuccccacuucugggg

SEQ ID NO: 485645 - RNA, 22 nt, Human
ucagaggucccuagcaggagug

SEQ ID NO: 485646 - RNA, 22 nt, Human
uucuaugccauguucagcuacu

SEQ ID NO: 485647 - RNA, 22 nt, Human
cacauaaguggguuccauugca

SEQ ID NO: 485648 - RNA, 19 nt, Human
uaaaaugucuguggucagu

SEQ ID NO: 485649 - RNA, 22 nt, Human
uggguggcacuucuggggucca

SEQ ID NO: 485650 - RNA, 22 nt, Human
uaguggaggggaugcaaagcuu

SEQ ID NO: 485651 - RNA, 22 nt, Human
aggucauuacaauuaucauuuu

SEQ ID NO: 485652 - RNA, 22 nt, Human
ggucucagaucuuuauuaaggc

SEQ ID NO: 485653 - RNA, 22 nt, Human
ucauuuguacuugugugcuugu

SEQ ID NO: 485654 - RNA, 22 nt, Human
ucugcucagugcuuaucucuaa

SEQ ID NO: 485655 - RNA, 22 nt, Human
agaauucuccuucagggcagga

SEQ ID NO: 485656 - RNA, 19 nt, Human
ucucccagcugagaagggc

SEQ ID NO: 485657 - RNA, 22 nt, Human
cagcaggcccagaguuucaugg

SEQ ID NO: 485658 - RNA, 22 nt, Human
cugggagcugucaggagcgugu

SEQ ID NO: 485659 - RNA, 22 nt, Human
cccuggagggauuucucaauca

SEQ ID NO: 485660 - RNA, 23 nt, Human
agacagaggcugaggcuggccgc

SEQ ID NO: 485661 - RNA, 22 nt, Human
cucucugagugagggacaagcu

SEQ ID NO: 485662 - RNA, 22 nt, Human
uuuuaucaaucauuaagacauu

SEQ ID NO: 485663 - RNA, 22 nt, Human
gcagcccaauggacugagacag

SEQ ID NO: 485664 - RNA, 22 nt, Human
ugccuuccuggagcugaaggcu

SEQ ID NO: 485665 - RNA, 22 nt, Human
gucccuaguggaaagacaugau

SEQ ID NO: 485666 - RNA, 20 nt, Human
gugcaauggcucagucucag

SEQ ID NO: 485667 - RNA, 22 nt, Human
uggcaguguauagguggcuccu

SEQ ID NO: 485668 - RNA, 22 nt, Human
gagagggcucuguguggguacu

SEQ ID NO: 485669 - RNA, 17 nt, Human
cauuuguugaucaguug

SEQ ID NO: 485670 - RNA, 22 nt, Human
ugggacacccucacgccugcac

SEQ ID NO: 485671 - RNA, 22 nt, Human
aggcacugacagauucuguguc

SEQ ID NO: 485672 - RNA, 22 nt, Human
acauuuaaugauccuacuguga

SEQ ID NO: 485673 - RNA, 22 nt, Human
caauuucuaacauuccauggau

SEQ ID NO: 485674 - RNA, 22 nt, Human
agacucugauucccucauguca

SEQ ID NO: 485675 - RNA, 22 nt, Human
agcagccaaaugaagauuuuac

SEQ ID NO: 485676 - RNA, 19 nt, Human
ucugaaguccagggcauac

SEQ ID NO: 485677 - RNA, 20 nt, Human
ggucccugcccucugucauc

SEQ ID NO: 485678 - RNA, 22 nt, Human
acuacuuugggccauuuguuua

SEQ ID NO: 485679 - RNA, 22 nt, Human
aaagguuugcauggaauuuacc

SEQ ID NO: 485680 - RNA, 22 nt, Human
caggauagaaaggccauggagu

SEQ ID NO: 485681 - RNA, 22 nt, Human
uguuuauucauggcuaaugaaa

SEQ ID NO: 485682 - RNA, 22 nt, Human
cagaagaguagcugaacaaguu

SEQ ID NO: 485683 - RNA, 22 nt, Human
agcagcuggugagcaagcucag

SEQ ID NO: 485684 - RNA, 22 nt, Human
auuguaauuuuagagaaagugg

SEQ ID NO: 485685 - RNA, 22 nt, Human
augaguaaaaccacuauuuaca

SEQ ID NO: 485686 - RNA, 22 nt, Human
ugagagugaaaugucacauguc

SEQ ID NO: 485687 - RNA, 22 nt, Human
uccagcaguccaugugagacac

SEQ ID NO: 485688 - RNA, 22 nt, Human
ggagccuugggcgcucucccau

SEQ ID NO: 485689 - RNA, 22 nt, Human
aaacucuguagcuaaacauaau

SEQ ID NO: 485690 - RNA, 22 nt, Human
cugucaggggcggguggagcgg

SEQ ID NO: 485691 - RNA, 22 nt, Human
cacccagccuucacacaggagu

SEQ ID NO: 485692 - RNA, 22 nt, Human
uauuuugacuauuaaaccaaca

SEQ ID NO: 485693 - RNA, 22 nt, Human
cugggcacuugcucacagcucu

SEQ ID NO: 485694 - RNA, 22 nt, Human
uuauccaacaugacuuaugucc

SEQ ID NO: 485695 - RNA, 22 nt, Human
agauaacuuuuggguauucaug

SEQ ID NO: 485696 - RNA, 22 nt, Human
cacucugcagcugaagggcugg

SEQ ID NO: 485697 - RNA, 22 nt, Human
auguccagggcacacagcagug

SEQ ID NO: 485698 - RNA, 17 nt, Human
uucaagauauugaaaug

SEQ ID NO: 485699 - RNA, 22 nt, Human
ucaguggaacugucugggugag

SEQ ID NO: 485700 - RNA, 22 nt, Human
uggggcuguccuuagucugaga

SEQ ID NO: 485701 - RNA, 22 nt, Human
ccucugggugggaggccgggcg

SEQ ID NO: 485702 - RNA, 20 nt, Human
uuggucagugguucaguuug

SEQ ID NO: 485703 - RNA, 22 nt, Human
ccagccaguccagcauuggugu

SEQ ID NO: 485704 - RNA, 22 nt, Human
uucauuacugcgguagucacac

SEQ ID NO: 485705 - RNA, 19 nt, Human
aagcagcccuggcaagagc

SEQ ID NO: 485706 - RNA, 22 nt, Human
cucuggaauuaaggaagccugu

SEQ ID NO: 485707 - RNA, 22 nt, Human
ggcugucugugguggagcguug

SEQ ID NO: 485708 - RNA, 22 nt, Human
uggguaggccaggaagcagugu

SEQ ID NO: 485709 - RNA, 22 nt, Human
gcugugcagccaagugccucug

SEQ ID NO: 485710 - RNA, 22 nt, Human
gccugucucuuggaacuuggua

SEQ ID NO: 485711 - RNA, 22 nt, Human
caggcagcugcuggguucagcc

SEQ ID NO: 485712 - RNA, 22 nt, Human
cuggagcugucuucacaggccu

SEQ ID NO: 485713 - RNA, 22 nt, Human
cuccagggggcauccacacagc

SEQ ID NO: 485714 - RNA, 22 nt, Human
cugccucuauucacugaggcag

SEQ ID NO: 485715 - RNA, 22 nt, Human
ucccagaggucucugcugguuc

SEQ ID NO: 485716 - RNA, 22 nt, Human
uccaggcaaagugcugggcugc

SEQ ID NO: 485717 - RNA, 22 nt, Human
cugggagucuggccucuggucc

SEQ ID NO: 485718 - RNA, 22 nt, Human
ggcagaggaaggaugaauucac

SEQ ID NO: 485719 - RNA, 22 nt, Human
aaauggaucuguggaauacauu

SEQ ID NO: 485720 - RNA, 22 nt, Human
uggccuuguguuuuagagaaag

SEQ ID NO: 485721 - RNA, 22 nt, Human
gcugagcuagcuaucucagucu

SEQ ID NO: 485722 - RNA, 22 nt, Human
cuggacagaaaccaguccuggg

SEQ ID NO: 485723 - RNA, 22 nt, Human
ugggccugccccaggcuucagc

SEQ ID NO: 485724 - RNA, 22 nt, Human
agggacccugaugacugaggag

SEQ ID NO: 485725 - RNA, 22 nt, Human
agccccaggcccggacgccucu

SEQ ID NO: 485726 - RNA, 22 nt, Human
augguguagcaugugauaugac

SEQ ID NO: 485727 - RNA, 22 nt, Human
aucaggaucacagaaacuuuua

SEQ ID NO: 485728 - RNA, 22 nt, Human
caggccagugugcuucccaggc

SEQ ID NO: 485729 - RNA, 22 nt, Human
uccagggcuuggcugggacggu

SEQ ID NO: 485730 - RNA, 22 nt, Human
cugaggugcuauggaggauacg

SEQ ID NO: 485731 - RNA, 22 nt, Human
cagccugcucucagauguugag

SEQ ID NO: 485732 - RNA, 22 nt, Human
augaggcaaucaugguccaguu

SEQ ID NO: 485733 - RNA, 21 nt, Human
aggagggcacaaggccaggaa

SEQ ID NO: 485734 - RNA, 22 nt, Human
agagcuuauaucuuggccaucc

SEQ ID NO: 485735 - RNA, 22 nt, Human
agcucuggaauaaugaugugau

SEQ ID NO: 485736 - RNA, 22 nt, Human
gccaaaucuugcacacucuugu

SEQ ID NO: 485737 - RNA, 22 nt, Human
ccuggaugauccaugucaugga

SEQ ID NO: 485738 - RNA, 22 nt, Human
ggagggcaucaaucaggccugg

SEQ ID NO: 485739 - RNA, 21 nt, Human
agggucaggaaccaggguacc

SEQ ID NO: 485740 - RNA, 22 nt, Human
gucccacugggcaacuagaaaa

SEQ ID NO: 485741 - RNA, 22 nt, Human
agaaaguucugugaguuguuca

SEQ ID NO: 485742 - RNA, 22 nt, Human
ucacuguauuugcugaugcaua

SEQ ID NO: 485743 - RNA, 22 nt, Human
aaaucaguucacguucugaggu

SEQ ID NO: 485744 - RNA, 19 nt, Human
ggagaggcuggagggaugc

SEQ ID NO: 485745 - RNA, 22 nt, Human
aagagcaucuauuucacagugg

SEQ ID NO: 485746 - RNA, 22 nt, Human
uggggaagggcacccuggagac

SEQ ID NO: 485747 - RNA, 22 nt, Human
gugggaugcaguggugaguggc

SEQ ID NO: 485748 - RNA, 22 nt, Human
agcagcugagaugguaagauuc

SEQ ID NO: 485749 - RNA, 22 nt, Human
uccagaccauggauggcugcaa

SEQ ID NO: 485750 - RNA, 22 nt, Human
uauuuuguuaauaauccagucc

SEQ ID NO: 485751 - RNA, 22 nt, Human
cccagcucucgcacuuacuagc

SEQ ID NO: 485752 - RNA, 19 nt, Human
agggaaggauucugucauu

SEQ ID NO: 485753 - RNA, 22 nt, Human
guacaugucaaaaaaugcauaa

SEQ ID NO: 485754 - RNA, 22 nt, Human
ucucagggcagcaaggaagcau

SEQ ID NO: 485755 - RNA, 21 nt, Human
uuucaauguguucuuuguagu

SEQ ID NO: 485756 - RNA, 22 nt, Human
aggcugaggaucguacuuucca

SEQ ID NO: 485757 - RNA, 22 nt, Human
uggagaaggccggccaggagug

SEQ ID NO: 485758 - RNA, 22 nt, Human
uaauuauaacaguuacaucuua

SEQ ID NO: 485759 - RNA, 19 nt, Human
gcauuucucuuuacagcca

SEQ ID NO: 485760 - RNA, 22 nt, Human
gaagcccagcaaacugugauca

SEQ ID NO: 485761 - RNA, 22 nt, Human
ccagagcuaaacacacaggcug

SEQ ID NO: 485762 - RNA, 22 nt, Human
uccuggccuugcuccugaugcc

SEQ ID NO: 485763 - RNA, 22 nt, Human
uuuucaagggcagggaaaucau

SEQ ID NO: 485764 - RNA, 22 nt, Human
ggggacccucaggacugcgucu

SEQ ID NO: 485765 - RNA, 21 nt, Human
uggcucaguugcugggcacag

SEQ ID NO: 485766 - RNA, 22 nt, Human
ucaguguccggagccugagugc

SEQ ID NO: 485767 - RNA, 22 nt, Human
agagcagugcugaagaguaggg

SEQ ID NO: 485768 - RNA, 22 nt, Human
uuuaaauuuagaagaaacacug

SEQ ID NO: 485769 - RNA, 22 nt, Human
caucaguguggcaguucacugu

SEQ ID NO: 485770 - RNA, 20 nt, Human
gauuacaaaaugaaaugcau

SEQ ID NO: 485771 - RNA, 22 nt, Human
agucccagcuacucaagaggcu

SEQ ID NO: 485772 - RNA, 22 nt, Human
uauuucuauuccccaggcaagu

SEQ ID NO: 485773 - RNA, 19 nt, Human
ugcaagugucuuggacaag

SEQ ID NO: 485774 - RNA, 22 nt, Human
agcuggccuucggugucacugg

SEQ ID NO: 485775 - RNA, 22 nt, Human
ccagaggaugcuggucagccuc

SEQ ID NO: 485776 - RNA, 22 nt, Human
auguucaaacuuuuuacacacc

SEQ ID NO: 485777 - RNA, 22 nt, Human
ucacauuuucuacuacuguacg

SEQ ID NO: 485778 - RNA, 22 nt, Human
uagggcuauucugaguaauaau

SEQ ID NO: 485779 - RNA, 22 nt, Human
ucuuugcagaauuuaacuuugc

SEQ ID NO: 485780 - RNA, 22 nt, Human
caggcugcagcagcaguggccc

SEQ ID NO: 485781 - RNA, 22 nt, Human
cagggugccuguccucagcaaa

SEQ ID NO: 485782 - RNA, 22 nt, Human
ugccaggaggaggugggacaga

SEQ ID NO: 485783 - RNA, 22 nt, Human
acacaguaccccaaggcugggc

SEQ ID NO: 485784 - RNA, 22 nt, Human
ccaucagcaugggagcaugggc

SEQ ID NO: 485785 - RNA, 22 nt, Human
uccaggaggaggaaggcugcca

SEQ ID NO: 485786 - RNA, 21 nt, Human
ccaaaggcuauguaucuucug

SEQ ID NO: 485787 - RNA, 22 nt, Human
caggccucuccuuagucuggca

SEQ ID NO: 485788 - RNA, 22 nt, Human
gugccuggagcuaauguguaua

SEQ ID NO: 485789 - RNA, 22 nt, Human
gggugggguguaucggauccua

SEQ ID NO: 485790 - RNA, 22 nt, Human
agcagcucuguuuaccuggagg

SEQ ID NO: 485791 - RNA, 22 nt, Human
aguucaggcauaaggcaugaac

SEQ ID NO: 485792 - RNA, 22 nt, Human
caguucagcuagaagaaacaaa

SEQ ID NO: 485793 - RNA, 22 nt, Human
gcagagccagaauggccaggac

SEQ ID NO: 485794 - RNA, 22 nt, Human
gccuguuggugacuuucuguug

SEQ ID NO: 485795 - RNA, 22 nt, Human
ugaaacaaauuuggaaaaucua

SEQ ID NO: 485796 - RNA, 22 nt, Human
ccugagguggcugcagcacugc

SEQ ID NO: 485797 - RNA, 22 nt, Human
gguacaaggagugaagguuugg

SEQ ID NO: 485798 - RNA, 22 nt, Human
cagaggccuauccaguguccau

SEQ ID NO: 485799 - RNA, 22 nt, Human
cauucauuuacuuucaacagcu

SEQ ID NO: 485800 - RNA, 22 nt, Human
cuccucugucuggcccugagcc

SEQ ID NO: 485801 - RNA, 22 nt, Human
aaucaggaugacugucauuuca

SEQ ID NO: 485802 - RNA, 22 nt, Human
agccucaguuucaggccuccuc

SEQ ID NO: 485803 - RNA, 22 nt, Human
cuggcuggccggagcgaggcgg

SEQ ID NO: 485804 - RNA, 21 nt, Human
aaugugugcuauuuaucuuuu

SEQ ID NO: 485805 - RNA, 22 nt, Human
cauguuuuguguacagaauauu

SEQ ID NO: 485806 - RNA, 22 nt, Human
ugucuuuagccagcagucuucu

SEQ ID NO: 485807 - RNA, 22 nt, Human
aguaaugucccuuaaauguggu

SEQ ID NO: 485808 - RNA, 22 nt, Human
gcugccugccuaguuccacagu

SEQ ID NO: 485809 - RNA, 22 nt, Human
agagccugggaauuugcauguu

SEQ ID NO: 485810 - RNA, 19 nt, Human
ucccuggcgccucucgggc

SEQ ID NO: 485811 - RNA, 22 nt, Human
agagccuggacuuuucugagcc

SEQ ID NO: 485812 - RNA, 22 nt, Human
cucccuggaggcccagaccugg

SEQ ID NO: 485813 - RNA, 22 nt, Human
auaaaauuugcuacuguuaaau

SEQ ID NO: 485814 - RNA, 22 nt, Human
aacaguaacgagauguccuaac

SEQ ID NO: 485815 - RNA, 22 nt, Human
agggucugacuccucuggcaag

SEQ ID NO: 485816 - RNA, 22 nt, Human
guagcuuauuagggauaauagu

SEQ ID NO: 485817 - RNA, 22 nt, Human
agcuaagacuuagugacuuagu

SEQ ID NO: 485818 - RNA, 20 nt, Human
aguguuccggaagacuggca

SEQ ID NO: 485819 - RNA, 22 nt, Human
uuagaaaggagcuuauuucuuu

SEQ ID NO: 485820 - RNA, 22 nt, Human
cccagguggcagaagcugcagu

SEQ ID NO: 485821 - RNA, 22 nt, Human
gcagugguccaguucacaccca

SEQ ID NO: 485822 - RNA, 23 nt, Human
ccagccucugggucuucauccag

SEQ ID NO: 485823 - RNA, 22 nt, Human
auucacaauuagaaguagauaa

SEQ ID NO: 485824 - RNA, 22 nt, Human
uguggaaaauuggaacguuccu

SEQ ID NO: 485825 - RNA, 22 nt, Human
guauucuugguuaucaaaauac

SEQ ID NO: 485826 - RNA, 22 nt, Human
agccagccgggggaccacagug

SEQ ID NO: 485827 - RNA, 22 nt, Human
cuuagaaaugcagauucucagg

SEQ ID NO: 485828 - RNA, 21 nt, Human
cagaggcugagagggcaaucu

SEQ ID NO: 485829 - RNA, 22 nt, Human
ucauggcacuuagcacaguccu

SEQ ID NO: 485830 - RNA, 22 nt, Human
cucccuggcacagcgagagguu

SEQ ID NO: 485831 - RNA, 22 nt, Human
ggggcagagcauagcuccaauu

SEQ ID NO: 485832 - RNA, 21 nt, Human
aagaagcaauuuauuggaagg

SEQ ID NO: 485833 - RNA, 22 nt, Human
ucugugcucuucucaguaucac

SEQ ID NO: 485834 - RNA, 22 nt, Human
ggagccugugcccaagcccaga

SEQ ID NO: 485835 - RNA, 21 nt, Human
ggcagccugacccccagagag

SEQ ID NO: 485836 - RNA, 22 nt, Human
aaggcacuagcaagcugccugg

SEQ ID NO: 485837 - RNA, 22 nt, Human
gggcagugacaaaggggaugaa

SEQ ID NO: 485838 - RNA, 22 nt, Human
aacuguaaagguugagugguaa

SEQ ID NO: 485839 - RNA, 22 nt, Human
agggaaggaaaagcugucgcuu

SEQ ID NO: 485840 - RNA, 22 nt, Human
gagccuccuccuggugugccga

SEQ ID NO: 485841 - RNA, 22 nt, Human
gcuggccaggugcuuugguucu

SEQ ID NO: 485842 - RNA, 22 nt, Human
cggcuggguagaggugccgggu

SEQ ID NO: 485843 - RNA, 22 nt, Human
agcccuucaaccugccuacucc

SEQ ID NO: 485844 - RNA, 22 nt, Human
ggcauccaguucugaucaacaa

SEQ ID NO: 485845 - RNA, 22 nt, Human
aaugggagguaguaugggaggu

SEQ ID NO: 485846 - RNA, 22 nt, Human
agcaucuggugagggccuaguu

SEQ ID NO: 485847 - RNA, 22 nt, Human
gugcauuugugcaugcacaugu

SEQ ID NO: 485848 - RNA, 22 nt, Human
auguaucagaaauagcauuggc

SEQ ID NO: 485849 - RNA, 22 nt, Human
agccacagcgaaccucucuucc

SEQ ID NO: 485850 - RNA, 22 nt, Human
cccagcuugcccaggacugagg

SEQ ID NO: 485851 - RNA, 22 nt, Human
uguauagaguuggaagaugacu

SEQ ID NO: 485852 - RNA, 22 nt, Human
gcucucugucguuaugcuucau

SEQ ID NO: 485853 - RNA, 22 nt, Human
gggcugagcuguucugaguuua

SEQ ID NO: 485854 - RNA, 22 nt, Human
uauaauccugcuucacauugaa

SEQ ID NO: 485855 - RNA, 22 nt, Human
gcagcagaugcuuucauggaca

SEQ ID NO: 485856 - RNA, 22 nt, Human
agcuuuaccugccuuggggcac

SEQ ID NO: 485857 - RNA, 22 nt, Human
gccccuggcuggccagcuccuc

SEQ ID NO: 485858 - RNA, 22 nt, Human
acagauauaugauuguguaaau

SEQ ID NO: 485859 - RNA, 22 nt, Human
uuaauaaaguaugaauuggaaa

SEQ ID NO: 485860 - RNA, 22 nt, Human
agggccagcugcagaauuagca

SEQ ID NO: 485861 - RNA, 22 nt, Human
agggccugggccagcacccuuu

SEQ ID NO: 485862 - RNA, 22 nt, Human
uagggcagccacccaggcugcu

SEQ ID NO: 485863 - RNA, 22 nt, Human
agcucccagagcucgagaguaa

SEQ ID NO: 485864 - RNA, 22 nt, Human
aucagagauuguaguaugugca

SEQ ID NO: 485865 - RNA, 22 nt, Human
caguaaaagauggaaauagaau

SEQ ID NO: 485866 - RNA, 22 nt, Human
auuauaaaccuuugaggguggg

SEQ ID NO: 485867 - RNA, 21 nt, Human
aaaguucaugcuuuaauauuc

SEQ ID NO: 485868 - RNA, 22 nt, Human
ccagucacagguguguuuauau

SEQ ID NO: 485869 - RNA, 22 nt, Human
cagggcccaagacacaaugagg

SEQ ID NO: 485870 - RNA, 22 nt, Human
gcagugggaagguuggcacaug

SEQ ID NO: 485871 - RNA, 22 nt, Human
ucucuucuuguguuuuccugcc

SEQ ID NO: 485872 - RNA, 22 nt, Human
cccaggcuggauuucgguggca

SEQ ID NO: 485873 - RNA, 22 nt, Human
ugcagcagguuccaaaggguua

SEQ ID NO: 485874 - RNA, 22 nt, Human
gaagaaggugcuacacagggca

SEQ ID NO: 485875 - RNA, 22 nt, Human
ccuuaaaagaacuaucucuucu

SEQ ID NO: 485876 - RNA, 22 nt, Human
aguggcagaagucacuggguag

SEQ ID NO: 485877 - RNA, 19 nt, Human
ugucccagacuccgugucu

SEQ ID NO: 485878 - RNA, 22 nt, Human
aggcagcagggccacuggcuga

SEQ ID NO: 485879 - RNA, 22 nt, Human
gcagauggugggggaggaguac

SEQ ID NO: 485880 - RNA, 22 nt, Human
ccagcagagcauggggaggaag

SEQ ID NO: 485881 - RNA, 22 nt, Human
agggcuccgggccaccggccug

SEQ ID NO: 485882 - RNA, 22 nt, Human
agggaggugguuccccagugga

SEQ ID NO: 485883 - RNA, 22 nt, Human
ucagucucaucaacucuauucc

SEQ ID NO: 485884 - RNA, 22 nt, Human
auguccuuugcuucucuggucc

SEQ ID NO: 485885 - RNA, 22 nt, Human
gcuggccagggcugcucgcgga

SEQ ID NO: 485886 - RNA, 22 nt, Human
gguggggccugcuccagcggcc

SEQ ID NO: 485887 - RNA, 22 nt, Human
ggucaggguuccagguaucuuc

SEQ ID NO: 485888 - RNA, 22 nt, Human
auccaaagauggaaagaacuuu

SEQ ID NO: 485889 - RNA, 22 nt, Human
cacagggcuuugauggcugagu

SEQ ID NO: 485890 - RNA, 20 nt, Human
gcccaagguccagaaggggg

SEQ ID NO: 485891 - RNA, 19 nt, Human
ccucccacggauuccuucc

SEQ ID NO: 485892 - RNA, 22 nt, Human
gggcagguuauuggaguaggga

SEQ ID NO: 485893 - RNA, 22 nt, Human
caagcuggcugggagaggcacg

SEQ ID NO: 485894 - RNA, 22 nt, Human
cccagcuccgagcuccgagccg

SEQ ID NO: 485895 - RNA, 22 nt, Human
gagcuuccauggacgccaucug

SEQ ID NO: 485896 - RNA, 22 nt, Human
cuuucacagcugugcuuaugau

SEQ ID NO: 485897 - RNA, 22 nt, Human
caauuucucgaacucuaaucca

SEQ ID NO: 485898 - RNA, 22 nt, Human
agcagccacagucugggacagg

SEQ ID NO: 485899 - RNA, 22 nt, Human
ggcugugccucaaggcuacuca

SEQ ID NO: 485900 - RNA, 22 nt, Human
ucuggccuuaucuguccaagcc

SEQ ID NO: 485901 - RNA, 22 nt, Human
aaggucauuguugcauguucuc

SEQ ID NO: 485902 - RNA, 22 nt, Human
cucccagagagcaggugggccg

SEQ ID NO: 485903 - RNA, 16 nt, Human
aggcagagauuuaccc

SEQ ID NO: 485904 - RNA, 22 nt, Human
ggaggaagagguuguucucuca

SEQ ID NO: 485905 - RNA, 17 nt, Human
uuccaguuuaguauugu

SEQ ID NO: 485906 - RNA, 22 nt, Human
guuuccauggcucuguuaaugg

SEQ ID NO: 485907 - RNA, 22 nt, Human
acaaaugcaaguuuuaugucaa

SEQ ID NO: 485908 - RNA, 22 nt, Human
gccucugcccuccugggacugc

SEQ ID NO: 485909 - RNA, 22 nt, Human
cagggcucccuugcaaggaggg

SEQ ID NO: 485910 - RNA, 20 nt, Human
aggaagccaaaggcugucuu

SEQ ID NO: 485911 - RNA, 22 nt, Human
ccagcaugagacgaugaugaag

SEQ ID NO: 485912 - RNA, 22 nt, Human
cuucaagauccauagauauugc

SEQ ID NO: 485913 - RNA, 22 nt, Human
acuggcagagguuggacaccau

SEQ ID NO: 485914 - RNA, 22 nt, Human
augcuuuuccuaaaaugaugcc

SEQ ID NO: 485915 - RNA, 22 nt, Human
uacauacacaaauauacuguuu

SEQ ID NO: 485916 - RNA, 22 nt, Human
cucccacuccuggcucaccaca

SEQ ID NO: 485917 - RNA, 22 nt, Human
gguagcacauugcauuaggaga

SEQ ID NO: 485918 - RNA, 22 nt, Human
ugucaccucuuuggcugcagcu

SEQ ID NO: 485919 - RNA, 22 nt, Human
uguaggaguccaaucaggagac

SEQ ID NO: 485920 - RNA, 22 nt, Human
ucaguggauuguagaaggcuua

SEQ ID NO: 485921 - RNA, 22 nt, Human
aggucaaggccaaaagaguggu

SEQ ID NO: 485922 - RNA, 22 nt, Human
gaaaugcaaauucucucucgcu

SEQ ID NO: 485923 - RNA, 22 nt, Human
ggcuuucuaugaacucaaaggc

SEQ ID NO: 485924 - RNA, 22 nt, Human
acaugcaugucuaugggcaggu

SEQ ID NO: 485925 - RNA, 22 nt, Human
cugagggagggacuuugagacu

SEQ ID NO: 485926 - RNA, 22 nt, Human
ugugccuucucaguccugcuca

SEQ ID NO: 485927 - RNA, 22 nt, Human
aaacaaacauagguuugaaagu

SEQ ID NO: 485928 - RNA, 22 nt, Human
cagcccuggaacagcugacuca

SEQ ID NO: 485929 - RNA, 22 nt, Human
aaaucacuaaguuauagugugg

SEQ ID NO: 485930 - RNA, 22 nt, Human
ccuuucucuuggauaccgauug

SEQ ID NO: 485931 - RNA, 20 nt, Human
cccaggagugagcagcuuua

SEQ ID NO: 485932 - RNA, 22 nt, Human
gcagaggagcaaguugcuacag

SEQ ID NO: 485933 - RNA, 22 nt, Human
gagaaagauguaggcugggagg

SEQ ID NO: 485934 - RNA, 22 nt, Human
uccugcagcauccgucgucugu

SEQ ID NO: 485935 - RNA, 22 nt, Human
ccagagccggauugugaagugc

SEQ ID NO: 485936 - RNA, 21 nt, Human
cauuagggcagaagcaggaag

SEQ ID NO: 485937 - RNA, 23 nt, Human
uggcccugugcaugcugcuuccc

SEQ ID NO: 485938 - RNA, 22 nt, Human
cccaggcauuuucaacuuuagu

SEQ ID NO: 485939 - RNA, 21 nt, Human
ugucagagcuuguaggacauu

SEQ ID NO: 485940 - RNA, 22 nt, Human
ccucagagguuuucauucugua

SEQ ID NO: 485941 - RNA, 22 nt, Human
uagagcauuuagaggggcagga

SEQ ID NO: 485942 - RNA, 22 nt, Human
agccuggccugggcaggcacau

SEQ ID NO: 485943 - RNA, 22 nt, Human
uugaggagucaggggcacggaa

SEQ ID NO: 485944 - RNA, 22 nt, Human
uggccugcccagagcagcucug

SEQ ID NO: 485945 - RNA, 22 nt, Human
cuugaaagcuuugcgucuucua

SEQ ID NO: 485946 - RNA, 22 nt, Human
cagugcugggcagaggagagcg

SEQ ID NO: 485947 - RNA, 22 nt, Human
uagagcugauaaugaggccaag

SEQ ID NO: 485948 - RNA, 22 nt, Human
cauuaucugccauugacaccau

SEQ ID NO: 485949 - RNA, 22 nt, Human
aguuuuauuccaaugugcagca

SEQ ID NO: 485950 - RNA, 22 nt, Human
ucucauugguauauacaugugu

SEQ ID NO: 485951 - RNA, 19 nt, Human
ccagcagcuuugauucucu

SEQ ID NO: 485952 - RNA, 22 nt, Human
gaggaggcacuugagcagaugu

SEQ ID NO: 485953 - RNA, 23 nt, Human
aaacaugcagcacaugaaugcua

SEQ ID NO: 485954 - RNA, 22 nt, Human
gcugcagcuuuaggauccagug

SEQ ID NO: 485955 - RNA, 22 nt, Human
cagggugacugcccuggccacu

SEQ ID NO: 485956 - RNA, 22 nt, Human
agcagcuguacuuucaucuguu

SEQ ID NO: 485957 - RNA, 22 nt, Human
gaagccacccuccuuccagccc

SEQ ID NO: 485958 - RNA, 22 nt, Human
agcugccacugagggugcacag

SEQ ID NO: 485959 - RNA, 22 nt, Human
ugccugugucacagugauguuu

SEQ ID NO: 485960 - RNA, 22 nt, Human
gcuggccucuacaggccggcca

SEQ ID NO: 485961 - RNA, 22 nt, Human
cagggcaggaugcugugauuau

SEQ ID NO: 485962 - RNA, 22 nt, Human
acagaauucucucugcagaggc

SEQ ID NO: 485963 - RNA, 22 nt, Human
ucagggcaagauugguuaauaa

SEQ ID NO: 485964 - RNA, 22 nt, Human
guuauguaugggggccuuauga

SEQ ID NO: 485965 - RNA, 22 nt, Human
gugagggcagcuuggucagugu

SEQ ID NO: 485966 - RNA, 22 nt, Human
gggaccuggacaugugugugcu

SEQ ID NO: 485967 - RNA, 22 nt, Human
gcagggcuaauggggcaaguag

SEQ ID NO: 485968 - RNA, 19 nt, Human
cucagagaggggcagugcc

SEQ ID NO: 485969 - RNA, 22 nt, Human
gaggccugguagccgagcccca

SEQ ID NO: 485970 - RNA, 22 nt, Human
uguggcugcucaggugcagacc

SEQ ID NO: 485971 - RNA, 22 nt, Human
agcugugggauuugggugugcc

SEQ ID NO: 485972 - RNA, 22 nt, Human
cagcaguggaacuacccaggga

SEQ ID NO: 485973 - RNA, 22 nt, Human
acugccauuggucaaaugagug

SEQ ID NO: 485974 - RNA, 22 nt, Human
acaggagugaaucuggcacuua

SEQ ID NO: 485975 - RNA, 22 nt, Human
uucacagggccacuggcaggag

SEQ ID NO: 485976 - RNA, 22 nt, Human
gccucugggcucugccccuggc

SEQ ID NO: 485977 - RNA, 22 nt, Human
uggcucugggaaucuguugcuu

SEQ ID NO: 485978 - RNA, 22 nt, Human
cuguuuauacgacagguggagg

SEQ ID NO: 485979 - RNA, 22 nt, Human
uuuuaaucaugcuucuaugucc

SEQ ID NO: 485980 - RNA, 22 nt, Human
ccugucaguugcugucagggau

SEQ ID NO: 485981 - RNA, 22 nt, Human
ucuccugguuuguuaaauaauu

SEQ ID NO: 485982 - RNA, 22 nt, Human
ccagguggcuucugcccgaugu

SEQ ID NO: 485983 - RNA, 22 nt, Human
uggcugagaccaucagggugua

SEQ ID NO: 485984 - RNA, 22 nt, Human
uaugcacacaggcuuaauucau

SEQ ID NO: 485985 - RNA, 22 nt, Human
agcagugaugcaugacagccua

SEQ ID NO: 485986 - RNA, 22 nt, Human
aaaggccacacagagcagggag

SEQ ID NO: 485987 - RNA, 22 nt, Human
cagagcauuaaaaccagcucug

SEQ ID NO: 485988 - RNA, 22 nt, Human
cuggagccccagacagggagag

SEQ ID NO: 485989 - RNA, 22 nt, Human
ucuccuggauggaccuucucuu

SEQ ID NO: 485990 - RNA, 22 nt, Human
ugcugucugauucagggugauu

SEQ ID NO: 485991 - RNA, 22 nt, Human
cagucccagacccagaaggugg

SEQ ID NO: 485992 - RNA, 22 nt, Human
cagugcauagauccugaggccu

SEQ ID NO: 485993 - RNA, 22 nt, Human
ucucuguaguugggcagcugcu

SEQ ID NO: 485994 - RNA, 23 nt, Human
gaggccacauuccccugcuugag

SEQ ID NO: 485995 - RNA, 22 nt, Human
ggugcuggacacguggcacucc

SEQ ID NO: 485996 - RNA, 22 nt, Human
cagacacaccaggcccauucug

SEQ ID NO: 485997 - RNA, 22 nt, Human
aggcugagguaggaggaucgcu

SEQ ID NO: 485998 - RNA, 22 nt, Human
ggggcagcucccgagggcagga

SEQ ID NO: 485999 - RNA, 22 nt, Human
caagggcucacggucugcuggg

SEQ ID NO: 486000 - RNA, 22 nt, Human
uggaggaaaauuacuggggucu

SEQ ID NO: 486001 - RNA, 22 nt, Human
ccagcugucugguuccagagcc

SEQ ID NO: 486002 - RNA, 22 nt, Human
gcagggaccucacuacccccag

SEQ ID NO: 486003 - RNA, 22 nt, Human
ggggcagaaguagugccccuga

SEQ ID NO: 486004 - RNA, 22 nt, Human
caggggcucuaaugcaugauca

SEQ ID NO: 486005 - RNA, 17 nt, Human
uuugaaaggaugucagu

SEQ ID NO: 486006 - RNA, 20 nt, Human
ugaggcaggagaauggcaug

SEQ ID NO: 486007 - RNA, 22 nt, Human
acacauuucucuuuuuguaagu

SEQ ID NO: 486008 - RNA, 22 nt, Human
cauaauuuuuuuaagucagaac

SEQ ID NO: 486009 - RNA, 22 nt, Human
gcagccugaugaucuggguugu

SEQ ID NO: 486010 - RNA, 20 nt, Human
ugaggcucagagagguugag

SEQ ID NO: 486011 - RNA, 22 nt, Human
gagggcucacugagaaagcagu

SEQ ID NO: 486012 - RNA, 22 nt, Human
augaaggcuguguggagccccc

SEQ ID NO: 486013 - RNA, 22 nt, Human
ugaggaagggugugacggcacc

SEQ ID NO: 486014 - RNA, 21 nt, Human
ugcaggagucugugagucagg

SEQ ID NO: 486015 - RNA, 22 nt, Human
ugucaccaugccagcuucugcc

SEQ ID NO: 486016 - RNA, 22 nt, Human
caggaaccuaaagagacauuac

SEQ ID NO: 486017 - RNA, 19 nt, Human
accaggccucagaggcccu

SEQ ID NO: 486018 - RNA, 22 nt, Human
ugaggcaggagaaucacaugaa

SEQ ID NO: 486019 - RNA, 22 nt, Human
ugcagggccagacuggguugga

SEQ ID NO: 486020 - RNA, 22 nt, Human
accccagaggcggaggcugcag

SEQ ID NO: 486021 - RNA, 20 nt, Human
accaauguuagcuuaguacu

SEQ ID NO: 486022 - RNA, 22 nt, Human
ccaggaaugaaauguagauaaa

SEQ ID NO: 486023 - RNA, 22 nt, Human
aaagcagggaugaggcuagagg

SEQ ID NO: 486024 - RNA, 22 nt, Human
cugcccugugaggguccuuggg

SEQ ID NO: 486025 - RNA, 22 nt, Human
cugaggcucaagggcagguggg

SEQ ID NO: 486026 - RNA, 22 nt, Human
ucuccgaucacagguuuucaau

SEQ ID NO: 486027 - RNA, 22 nt, Human
agggaggaguccucaaagucau

SEQ ID NO: 486028 - RNA, 22 nt, Human
uuuuuccuaagcaguggagcug

SEQ ID NO: 486029 - RNA, 22 nt, Human
ucuucacaugaccuucaugucu

SEQ ID NO: 486030 - RNA, 20 nt, Human
guggccucucacauucugag

SEQ ID NO: 486031 - RNA, 22 nt, Human
guggccaggccgacugccaggc

SEQ ID NO: 486032 - RNA, 22 nt, Human
uuaaaaugcagauucugauuca

SEQ ID NO: 486033 - RNA, 22 nt, Human
gggcacagaagucuaagacauc

SEQ ID NO: 486034 - RNA, 22 nt, Human
ccagcuuuucagaaucugccug

SEQ ID NO: 486035 - RNA, 20 nt, Human
uagauuucauacuucucuuu

SEQ ID NO: 486036 - RNA, 22 nt, Human
cagcagcaaggugaggguggag

SEQ ID NO: 486037 - RNA, 22 nt, Human
acacaggggcucggcugggugc

SEQ ID NO: 486038 - RNA, 22 nt, Human
guggcacagugggagagcccca

SEQ ID NO: 486039 - RNA, 22 nt, Human
cauuacaugguccaggauauau

SEQ ID NO: 486040 - RNA, 22 nt, Human
cagaguucaaagccugcuggga

SEQ ID NO: 486041 - RNA, 22 nt, Human
uauucacauguacauaugcuca

SEQ ID NO: 486042 - RNA, 22 nt, Human
ccagagccuaagaucugauccu

SEQ ID NO: 486043 - RNA, 22 nt, Human
cccagcauuucugggcugcacu

SEQ ID NO: 486044 - RNA, 22 nt, Human
acauuucuuugcuagacagcag

SEQ ID NO: 486045 - RNA, 22 nt, Human
cucaggagacaguguccacaug

SEQ ID NO: 486046 - RNA, 22 nt, Human
ucuguacaaaggcuauuuggag

SEQ ID NO: 486047 - RNA, 22 nt, Human
ccccuuccaggaagcagaaucg

SEQ ID NO: 486048 - RNA, 22 nt, Human
uuagcuaaacuguaacuagaau

SEQ ID NO: 486049 - RNA, 22 nt, Human
cugcuccacaccuccauuuccu

SEQ ID NO: 486050 - RNA, 20 nt, Human
cagcuuuagaucuuugauua

SEQ ID NO: 486051 - RNA, 22 nt, Human
uugucccaggacuugcauagau

SEQ ID NO: 486052 - RNA, 22 nt, Human
aggccugggucucgugccuacc

SEQ ID NO: 486053 - RNA, 22 nt, Human
cugauuccaaagccaaagcuau

SEQ ID NO: 486054 - RNA, 22 nt, Human
aaauguauccuacuuccugagu

SEQ ID NO: 486055 - RNA, 17 nt, Human
agcacuaaaaugcuucc

SEQ ID NO: 486056 - RNA, 22 nt, Human
agagcugaggauccagcugagc

SEQ ID NO: 486057 - RNA, 23 nt, Human
cccauuuucauguuaacuccugg

SEQ ID NO: 486058 - RNA, 23 nt, Human
agaugagccaacaccuccaugcc

SEQ ID NO: 486059 - RNA, 22 nt, Human
cagugcccaagaugugccaugc

SEQ ID NO: 486060 - RNA, 22 nt, Human
ugcuuuauaacuuaguuuaugg

SEQ ID NO: 486061 - RNA, 22 nt, Human
caugaaaaauuuacuguuaaca

SEQ ID NO: 486062 - RNA, 18 nt, Human
gcagagugcgucucugug

SEQ ID NO: 486063 - RNA, 22 nt, Human
acugaaggaaacuuuuguguuu

SEQ ID NO: 486064 - RNA, 22 nt, Human
ggcucuggugaggguaggagau

SEQ ID NO: 486065 - RNA, 22 nt, Human
ucauuucuccgaccugcugucc

SEQ ID NO: 486066 - RNA, 22 nt, Human
gagauggggaauaggagcaagc

SEQ ID NO: 486067 - RNA, 21 nt, Human
uuuuuucuugcgugaggccug

SEQ ID NO: 486068 - RNA, 22 nt, Human
ugucccaggccucauguugcca

SEQ ID NO: 486069 - RNA, 22 nt, Human
cacugucuuuugugaagacaau

SEQ ID NO: 486070 - RNA, 22 nt, Human
agguggggccaaaugcuacagu

SEQ ID NO: 486071 - RNA, 22 nt, Human
uugcauugauguuccuucuugc

SEQ ID NO: 486072 - RNA, 22 nt, Human
aaggcccuggcaggaagcagga

SEQ ID NO: 486073 - RNA, 22 nt, Human
uccaggcacuauauauacuuuu

SEQ ID NO: 486074 - RNA, 22 nt, Human
aaugagacacgugaagcagaug

SEQ ID NO: 486075 - RNA, 22 nt, Human
ugucugagugugccugggcauu

SEQ ID NO: 486076 - RNA, 22 nt, Human
aagauucucagagugaaagaau

SEQ ID NO: 486077 - RNA, 22 nt, Human
gggcaguagcuucguaggcauc

SEQ ID NO: 486078 - RNA, 22 nt, Human
gugccugguuuggggaguguuc

SEQ ID NO: 486079 - RNA, 22 nt, Human
cugcagcuguagaggacagugg

SEQ ID NO: 486080 - RNA, 22 nt, Human
gccuggagaggaagccggugga

SEQ ID NO: 486081 - RNA, 22 nt, Human
gggagggaagguaccuguguga

SEQ ID NO: 486082 - RNA, 20 nt, Human
uacuugaauguugcagcagu

SEQ ID NO: 486083 - RNA, 22 nt, Human
agucucugggcaugguugugac

SEQ ID NO: 486084 - RNA, 22 nt, Human
ucuuuccuacuuuauugugaac

SEQ ID NO: 486085 - RNA, 22 nt, Human
uccucugcuguucugguucuuu

SEQ ID NO: 486086 - RNA, 22 nt, Human
ggcagggucuggacugaaagcu

SEQ ID NO: 486087 - RNA, 22 nt, Human
cugcuguguuccuccugcaucu

SEQ ID NO: 486088 - RNA, 22 nt, Human
agggcccauagaucgucagcuu

SEQ ID NO: 486089 - RNA, 22 nt, Human
aucaaaguccaucagaagguag

SEQ ID NO: 486090 - RNA, 22 nt, Human
acucucagaggguggcagcaau

SEQ ID NO: 486091 - RNA, 22 nt, Human
gaaaugugcagaauguguuaga

SEQ ID NO: 486092 - RNA, 22 nt, Human
uugcauugggagugaggagacc

SEQ ID NO: 486093 - RNA, 22 nt, Human
gcugcagcagaaguucucagag

SEQ ID NO: 486094 - RNA, 22 nt, Human
gagcaggcuugcagagaagggg

SEQ ID NO: 486095 - RNA, 22 nt, Human
gguuucaacuaaaucaagaagg

SEQ ID NO: 486096 - RNA, 22 nt, Human
ccuggccuccuggccuucucau

SEQ ID NO: 486097 - RNA, 22 nt, Human
ugaggugaagaguggagcucag

SEQ ID NO: 486098 - RNA, 22 nt, Human
uccuuuccaugcuucuagaggc

SEQ ID NO: 486099 - RNA, 22 nt, Human
guuuagaauucuaacuuuaagg

SEQ ID NO: 486100 - RNA, 22 nt, Human
aaagguuaguucuuagaagugc

SEQ ID NO: 486101 - RNA, 23 nt, Human
ggggccugcaccggucugcgcgg

SEQ ID NO: 486102 - RNA, 22 nt, Human
ggcacagggaggcccuggugug

SEQ ID NO: 486103 - RNA, 22 nt, Human
aagucuguuugagugucacacu

SEQ ID NO: 486104 - RNA, 22 nt, Human
ucccaggaucugagggcagaga

SEQ ID NO: 486105 - RNA, 22 nt, Human
ccacccagcagaggaggcaaga

SEQ ID NO: 486106 - RNA, 20 nt, Human
ugcagcugcaggaggguggg

SEQ ID NO: 486107 - RNA, 22 nt, Human
aggcccaguagugcugccuuua

SEQ ID NO: 486108 - RNA, 22 nt, Human
aagucaauuaguaaacuuggaa

SEQ ID NO: 486109 - RNA, 22 nt, Human
uucauaguguuuccuuccagug

SEQ ID NO: 486110 - RNA, 20 nt, Human
gggagaagggcugaugagag

SEQ ID NO: 486111 - RNA, 22 nt, Human
gcaaagguagccaaggagcuca

SEQ ID NO: 486112 - RNA, 22 nt, Human
ucacaugcuacugagccagacc

SEQ ID NO: 486113 - RNA, 20 nt, Human
uccuuuggccuuagagcugu

SEQ ID NO: 486114 - RNA, 18 nt, Human
aaaaugcaggcgacaugg

SEQ ID NO: 486115 - RNA, 22 nt, Human
uuccugaugcacacagucauuu

SEQ ID NO: 486116 - RNA, 22 nt, Human
aaagagcuaacauugccgagau

SEQ ID NO: 486117 - RNA, 22 nt, Human
aauuuuaucucuaagcaggcuu

SEQ ID NO: 486118 - RNA, 22 nt, Human
ugacauuuuaucaauaucacag

SEQ ID NO: 486119 - RNA, 22 nt, Human
cagugggaagggcagaggcuuu

SEQ ID NO: 486120 - RNA, 17 nt, Human
ucauuuguugugacuag

SEQ ID NO: 486121 - RNA, 22 nt, Human
uugaaaguagcagcugcauaug

SEQ ID NO: 486122 - RNA, 22 nt, Human
aggcugaggcuuuccuuggaga

SEQ ID NO: 486123 - RNA, 22 nt, Human
aguacuuugcacuuugcucaga

SEQ ID NO: 486124 - RNA, 22 nt, Human
gccugcagccucagagaauuuu

SEQ ID NO: 486125 - RNA, 17 nt, Human
cugagcauccgugcucu

SEQ ID NO: 486126 - RNA, 22 nt, Human
ugagaaagugggugccuagcaa

SEQ ID NO: 486127 - RNA, 22 nt, Human
ugccuugguucucuacuuggag

SEQ ID NO: 486128 - RNA, 22 nt, Human
gugaggugggcuggccagagac

SEQ ID NO: 486129 - RNA, 22 nt, Human
uugaaaggaauacagaggccua

SEQ ID NO: 486130 - RNA, 18 nt, Human
agcagagcccaugcauuc

SEQ ID NO: 486131 - RNA, 22 nt, Human
aggccugcagcaggagcaaacc

SEQ ID NO: 486132 - RNA, 21 nt, Human
agccugggaggcggagguugc

SEQ ID NO: 486133 - RNA, 22 nt, Human
guucucucugcuuccaagaugg

SEQ ID NO: 486134 - RNA, 21 nt, Human
uagagaaaagaagcuguuccu

SEQ ID NO: 486135 - RNA, 22 nt, Human
acuccuggggcugccaucacag

SEQ ID NO: 486136 - RNA, 22 nt, Human
augaggcucucaggggagcugu

SEQ ID NO: 486137 - RNA, 19 nt, Human
cagugcccgacgcaggucu

SEQ ID NO: 486138 - RNA, 22 nt, Human
gcugucaguuuuacccacagac

SEQ ID NO: 486139 - RNA, 22 nt, Human
cuggcuggccggaggcaucccu

SEQ ID NO: 486140 - RNA, 22 nt, Human
cucagagucugcauuucuguca

SEQ ID NO: 486141 - RNA, 19 nt, Human
cucuccagcuccaguagcu

SEQ ID NO: 486142 - RNA, 21 nt, Human
aaaaagcuggggcaugcaugc

SEQ ID NO: 486143 - RNA, 19 nt, Human
agugguagaugagcaggag

SEQ ID NO: 486144 - RNA, 22 nt, Human
cuccaggggccagaagccuggc

SEQ ID NO: 486145 - RNA, 22 nt, Human
cagggcccaggccacuggguug

SEQ ID NO: 486146 - RNA, 22 nt, Human
cucuggagaacuccuugugucu

SEQ ID NO: 486147 - RNA, 22 nt, Human
agaaaauuagauuuuacugugu

SEQ ID NO: 486148 - RNA, 17 nt, Human
uuuucucucuuggauuc

SEQ ID NO: 486149 - RNA, 22 nt, Human
gcucccacugcagcccugagcc

SEQ ID NO: 486150 - RNA, 22 nt, Human
agggggaggcugugcugcgucu

SEQ ID NO: 486151 - RNA, 22 nt, Human
ggacucuguuuuccugaucacu

SEQ ID NO: 486152 - RNA, 22 nt, Human
agcagcugguaggaguggccac

SEQ ID NO: 486153 - RNA, 22 nt, Human
ccauccuaucugaccuacuugu

SEQ ID NO: 486154 - RNA, 22 nt, Human
ggcagaggagcuggaaacaugg

SEQ ID NO: 486155 - RNA, 22 nt, Human
gacagaguuguugauguaugcu

SEQ ID NO: 486156 - RNA, 22 nt, Human
caggccugcaggaaaggcuccc

SEQ ID NO: 486157 - RNA, 22 nt, Human
ugugaugguucacugggcauga

SEQ ID NO: 486158 - RNA, 19 nt, Human
gggcaguggcacuagggag

SEQ ID NO: 486159 - RNA, 22 nt, Human
gcugucacauuuggagcacugg

SEQ ID NO: 486160 - RNA, 22 nt, Human
gccuggcuccuaagagcacaac

SEQ ID NO: 486161 - RNA, 22 nt, Human
auggggcugggauucuccucgg

SEQ ID NO: 486162 - RNA, 22 nt, Human
cccagccucuggguucugccgg

SEQ ID NO: 486163 - RNA, 22 nt, Human
ucaggagagaaagaauacaauu

SEQ ID NO: 486164 - RNA, 22 nt, Human
gugacagaguuuuagaucucau

SEQ ID NO: 486165 - RNA, 22 nt, Human
agcuggggcugcagagaacagg

SEQ ID NO: 486166 - RNA, 22 nt, Human
uugggcugaacccugcagcuga

SEQ ID NO: 486167 - RNA, 18 nt, Human
gcuccuggaccaggucac

SEQ ID NO: 486168 - RNA, 22 nt, Human
guggccucaugucuauaaagag

SEQ ID NO: 486169 - RNA, 22 nt, Human
gacaagacugguuuauuuaagg

SEQ ID NO: 486170 - RNA, 22 nt, Human
gaagcccuauccucuccuggga

SEQ ID NO: 486171 - RNA, 20 nt, Human
gcugaagauucccaugcaag

SEQ ID NO: 486172 - RNA, 23 nt, Human
ggccuccuggucuaggcuagacu

SEQ ID NO: 486173 - RNA, 22 nt, Human
cacauaauaaauguuccugaug

SEQ ID NO: 486174 - RNA, 22 nt, Human
auuuuucucucacacuuaccag

SEQ ID NO: 486175 - RNA, 21 nt, Human
ucuuugcaucaguuguuuucu

SEQ ID NO: 486176 - RNA, 22 nt, Human
gaggagaaauuuggggaccuga

SEQ ID NO: 486177 - RNA, 22 nt, Human
uccauuuucaucucauguauaa

SEQ ID NO: 486178 - RNA, 22 nt, Human
ccaguugguuucaaugggacag

SEQ ID NO: 486179 - RNA, 22 nt, Human
uuucauuacguguuugacuugu

SEQ ID NO: 486180 - RNA, 22 nt, Human
cucuccagaauaugccgccgug

SEQ ID NO: 486181 - RNA, 22 nt, Human
gcugucuugcucacucuugcag

SEQ ID NO: 486182 - RNA, 23 nt, Human
uaguuauuuucucuguaauuugc

SEQ ID NO: 486183 - RNA, 22 nt, Human
cagccugacaccagcuuugggc

SEQ ID NO: 486184 - RNA, 22 nt, Human
ugccaggcaggacccuagaacc

SEQ ID NO: 486185 - RNA, 22 nt, Human
agcagggcucuguggagggugg

SEQ ID NO: 486186 - RNA, 22 nt, Human
acagaaggcggggacaaggcgg

SEQ ID NO: 486187 - RNA, 22 nt, Human
augggagugacagggccacugg

SEQ ID NO: 486188 - RNA, 22 nt, Human
aguaaugugccugaaauacuug

SEQ ID NO: 486189 - RNA, 22 nt, Human
cuuauaguaugauguugagaau

SEQ ID NO: 486190 - RNA, 22 nt, Human
ucucuuccaguaagagucuuua

SEQ ID NO: 486191 - RNA, 22 nt, Human
cacagaaaaaggcuugaaaauc

SEQ ID NO: 486192 - RNA, 22 nt, Human
cugcagagcaaguaacauccuc

SEQ ID NO: 486193 - RNA, 22 nt, Human
cguguacagucuaucuuuuuuc

SEQ ID NO: 486194 - RNA, 22 nt, Human
uauuacugagguuuuauggagu

SEQ ID NO: 486195 - RNA, 22 nt, Human
cucagggcuugaguguccagga

SEQ ID NO: 486196 - RNA, 22 nt, Human
aagaaauuaaugugccauuacu

SEQ ID NO: 486197 - RNA, 22 nt, Human
cagcugucuaaguugagcagga

SEQ ID NO: 486198 - RNA, 22 nt, Human
ucugagagguuaagcaauuuga

SEQ ID NO: 486199 - RNA, 22 nt, Human
gggugggccugucuggccaugu

SEQ ID NO: 486200 - RNA, 22 nt, Human
uuaggaaaaucaugagagauga

SEQ ID NO: 486201 - RNA, 20 nt, Human
ugcagaagaacguucugguu

SEQ ID NO: 486202 - RNA, 18 nt, Human
ucugagggugcgggagcu

SEQ ID NO: 486203 - RNA, 18 nt, Human
gcugcugguggagggagc

SEQ ID NO: 486204 - RNA, 20 nt, Human
ucagggcaugggacagcccc

SEQ ID NO: 486205 - RNA, 22 nt, Human
ggggcaggagguguucucuuuu

SEQ ID NO: 486206 - RNA, 18 nt, Human
gggaagccgggaagccgg

SEQ ID NO: 486207 - RNA, 22 nt, Human
gaaacaugucugacaauuuacc

SEQ ID NO: 486208 - RNA, 22 nt, Human
ggcugccugugcccaggcacac

SEQ ID NO: 486209 - RNA, 22 nt, Human
uuucauugucaauaaacuguau

SEQ ID NO: 486210 - RNA, 23 nt, Human
acaaaugcccauacaucuaguuc

SEQ ID NO: 486211 - RNA, 22 nt, Human
ugcagaagaauguaggcauaag

SEQ ID NO: 486212 - RNA, 22 nt, Human
uggucucuucuuccaagauggc

SEQ ID NO: 486213 - RNA, 22 nt, Human
agggccagggaaacgaucagca

SEQ ID NO: 486214 - RNA, 22 nt, Human
ucuuuauuuuaugcuugugcaa

SEQ ID NO: 486215 - RNA, 19 nt, Human
uaaggccaaaaguaagugu

SEQ ID NO: 486216 - RNA, 22 nt, Human
uggagauggguuaauggagaga

SEQ ID NO: 486217 - RNA, 22 nt, Human
uuccauaaugagauucccagcc

SEQ ID NO: 486218 - RNA, 22 nt, Human
ggucucagcccucgccagcagc

SEQ ID NO: 486219 - RNA, 21 nt, Human
ucagggcagugggagguuccu

SEQ ID NO: 486220 - RNA, 22 nt, Human
augggugugaaaauggucaucu

SEQ ID NO: 486221 - RNA, 21 nt, Human
ccagcuuucccaagucccuuu

SEQ ID NO: 486222 - RNA, 22 nt, Human
agauaauuugaguaaauuaauu

SEQ ID NO: 486223 - RNA, 22 nt, Human
cuuuggaauaauuuccuggagu

SEQ ID NO: 486224 - RNA, 22 nt, Human
uguaaaaccaaaucaaucuagu

SEQ ID NO: 486225 - RNA, 22 nt, Human
ggcuuccuggagaaggucugag

SEQ ID NO: 486226 - RNA, 22 nt, Human
cagccucucuguaucucaggau

SEQ ID NO: 486227 - RNA, 19 nt, Human
gggcuucugggaucaagag

SEQ ID NO: 486228 - RNA, 22 nt, Human
gcagcuguguaaugagcccaca

SEQ ID NO: 486229 - RNA, 22 nt, Human
uaguaucuauuaguaacaagag

SEQ ID NO: 486230 - RNA, 22 nt, Human
gcagaggccaggccaccagcaa

SEQ ID NO: 486231 - RNA, 21 nt, Human
agcagaggcugccuggugacu

SEQ ID NO: 486232 - RNA, 22 nt, Human
aaacagcugucauuguuuuaaa

SEQ ID NO: 486233 - RNA, 22 nt, Human
cugccucugguuuuggucccug

SEQ ID NO: 486234 - RNA, 22 nt, Human
ucauuguuauguuuugcugucu

SEQ ID NO: 486235 - RNA, 22 nt, Human
uguacaguaggaacuuguuauu

SEQ ID NO: 486236 - RNA, 22 nt, Human
ccagggcaauaggaacacuuuu

SEQ ID NO: 486237 - RNA, 22 nt, Human
guccuggguccccgcaggucag

SEQ ID NO: 486238 - RNA, 22 nt, Human
ggcagcagggcugucucccuac

SEQ ID NO: 486239 - RNA, 22 nt, Human
cggggacacacuggcagcuccu

SEQ ID NO: 486240 - RNA, 22 nt, Human
cuguggugagcaacugacugaa

SEQ ID NO: 486241 - RNA, 22 nt, Human
auguagcaucuauccugauaaa

SEQ ID NO: 486242 - RNA, 22 nt, Human
agauuugcggcuuuacuuugca

SEQ ID NO: 486243 - RNA, 22 nt, Human
ugggcaggauaauaucucaugu

SEQ ID NO: 486244 - RNA, 22 nt, Human
aguccccucuaacccaacuuua

SEQ ID NO: 486245 - RNA, 22 nt, Human
uguggccaccagagcugcuauu

SEQ ID NO: 486246 - RNA, 22 nt, Human
uggaccugaagaauaggaagua

SEQ ID NO: 486247 - RNA, 21 nt, Human
gggccuggcugcgcaggacgg

SEQ ID NO: 486248 - RNA, 22 nt, Human
gaacuguaguuaauacuacaca

SEQ ID NO: 486249 - RNA, 22 nt, Human
ucagcugaguucuagagcacuc

SEQ ID NO: 486250 - RNA, 22 nt, Human
gcacacaggcaguuuccagcca

SEQ ID NO: 486251 - RNA, 22 nt, Human
uggcagaguuggagguggaaga

SEQ ID NO: 486252 - RNA, 23 nt, Human
aaauauucuuuuuuaguaagugc

SEQ ID NO: 486253 - RNA, 22 nt, Human
caggccucaggggcucaggcug

SEQ ID NO: 486254 - RNA, 22 nt, Human
ucagaggacgcacuaggguugu

SEQ ID NO: 486255 - RNA, 22 nt, Human
agggcuccuccccggccuccac

SEQ ID NO: 486256 - RNA, 22 nt, Human
gagggugguggcuuaaggugcu

SEQ ID NO: 486257 - RNA, 20 nt, Human
agcaggaaaagugccagucu

SEQ ID NO: 486258 - RNA, 22 nt, Human
uacaguagacaauguuaguaug

SEQ ID NO: 486259 - RNA, 22 nt, Human
caagaacaguuugccaaauugg

SEQ ID NO: 486260 - RNA, 22 nt, Human
ugacaugcuuguuuuccuugaa

SEQ ID NO: 486261 - RNA, 22 nt, Human
gcucucuggaggccauggacag

SEQ ID NO: 486262 - RNA, 22 nt, Human
gagagcugcagccgagaggggg

SEQ ID NO: 486263 - RNA, 22 nt, Human
ucagagagaaauaguuuuugac

SEQ ID NO: 486264 - RNA, 22 nt, Human
ucccagggacaccaagcuguuu

SEQ ID NO: 486265 - RNA, 22 nt, Human
gcccugugcgacucuagagguu

SEQ ID NO: 486266 - RNA, 22 nt, Human
agagccugucugccuuucuacc

SEQ ID NO: 486267 - RNA, 23 nt, Human
aggcagcagguuguccaggguga

SEQ ID NO: 486268 - RNA, 22 nt, Human
caguuucuguuuuaaauagcag

SEQ ID NO: 486269 - RNA, 22 nt, Human
uggaagugcucuucugaccaac

SEQ ID NO: 486270 - RNA, 22 nt, Human
ugcaggugcguuuucaagccuc

SEQ ID NO: 486271 - RNA, 22 nt, Human
gcaugagggggguuaggaaguu

SEQ ID NO: 486272 - RNA, 22 nt, Human
ccuccuggugggcgcuucuggc

SEQ ID NO: 486273 - RNA, 22 nt, Human
gugcaugugcauccauguguac

SEQ ID NO: 486274 - RNA, 22 nt, Human
gcaggggcuaaggacacagaga

SEQ ID NO: 486275 - RNA, 22 nt, Human
gaauuguacgcuuuacauaggu

SEQ ID NO: 486276 - RNA, 22 nt, Human
cauuuguaggaugcuucuuguu

SEQ ID NO: 486277 - RNA, 19 nt, Human
accaggcuuauggucagug

SEQ ID NO: 486278 - RNA, 22 nt, Human
cuccucacacccacugcaacca

SEQ ID NO: 486279 - RNA, 22 nt, Human
ugcagcccuuccuuccucuggg

SEQ ID NO: 486280 - RNA, 22 nt, Human
uucacauaaugauacaaagcuu

SEQ ID NO: 486281 - RNA, 22 nt, Human
ugaggaagcaaaggcuugugug

SEQ ID NO: 486282 - RNA, 22 nt, Human
cagagcuguccaaacccugaca

SEQ ID NO: 486283 - RNA, 22 nt, Human
cuuccucugcggcgccgggcgc

SEQ ID NO: 486284 - RNA, 22 nt, Human
ucccaaggugcucggcaacagg

SEQ ID NO: 486285 - RNA, 22 nt, Human
gggcacagcugcuacccagugc

SEQ ID NO: 486286 - RNA, 22 nt, Human
gaguuauuuguagggauuauau

SEQ ID NO: 486287 - RNA, 22 nt, Human
uccugcagaccucagucagguc

SEQ ID NO: 486288 - RNA, 22 nt, Human
caaaggcaacauauacuuguuu

SEQ ID NO: 486289 - RNA, 22 nt, Human
cucaaggacuuauucaugccug

SEQ ID NO: 486290 - RNA, 22 nt, Human
cucagagcaaugaacaugcaaa

SEQ ID NO: 486291 - RNA, 22 nt, Human
uuacaaguauuuaagaugcugu

SEQ ID NO: 486292 - RNA, 22 nt, Human
gcccagcuuuuugaggcaggca

SEQ ID NO: 486293 - RNA, 22 nt, Human
ccccagccagcaggaccucuga

SEQ ID NO: 486294 - RNA, 18 nt, Human
agaaggagcuaugggcag

SEQ ID NO: 486295 - RNA, 22 nt, Human
ucugucacccaggcuggagugc

SEQ ID NO: 486296 - RNA, 22 nt, Human
cugcagaguggagccucggcug

SEQ ID NO: 486297 - RNA, 22 nt, Human
ugccacacuccccugcugcagu

SEQ ID NO: 486298 - RNA, 22 nt, Human
gcagagcuccccaagacaccaa

SEQ ID NO: 486299 - RNA, 22 nt, Human
ucagggcauccauugccuguug

SEQ ID NO: 486300 - RNA, 22 nt, Human
ucagggcauucaagaggccugg

SEQ ID NO: 486301 - RNA, 22 nt, Human
uggagcagggcaucacugugcg

SEQ ID NO: 486302 - RNA, 22 nt, Human
gaaaucugaacucuguauccuu

SEQ ID NO: 486303 - RNA, 22 nt, Human
gcaggcaguugcaguuuucuag

SEQ ID NO: 486304 - RNA, 22 nt, Human
ggagcagagcucuucaucugca

SEQ ID NO: 486305 - RNA, 22 nt, Human
gaaaugcagauucugauucugu

SEQ ID NO: 486306 - RNA, 22 nt, Human
aagcagggugucuugacccaug

SEQ ID NO: 486307 - RNA, 22 nt, Human
uauuucugucagccagauaugg

SEQ ID NO: 486308 - RNA, 22 nt, Human
ggcccugugguuuugcaaaguc

SEQ ID NO: 486309 - RNA, 22 nt, Human
gcuggcagagagcuggugagga

SEQ ID NO: 486310 - RNA, 22 nt, Human
cugccucugcgucccacagagu

SEQ ID NO: 486311 - RNA, 22 nt, Human
gaagccaguacugugcucugca

SEQ ID NO: 486312 - RNA, 22 nt, Human
cugagccauccauaccagcuua

SEQ ID NO: 486313 - RNA, 22 nt, Human
ugaaagcacucacuucugcucu

SEQ ID NO: 486314 - RNA, 22 nt, Human
guggcgcagaggguggcagaga

SEQ ID NO: 486315 - RNA, 22 nt, Human
ucagaagcauguggggagccug

SEQ ID NO: 486316 - RNA, 22 nt, Human
augaggcacaucacagccaaug

SEQ ID NO: 486317 - RNA, 22 nt, Human
ucagagagguuggugauaagaa

SEQ ID NO: 486318 - RNA, 22 nt, Human
agcugcugaaugacacugcaag

SEQ ID NO: 486319 - RNA, 22 nt, Human
uucuacuuuggacauaaaggac

SEQ ID NO: 486320 - RNA, 22 nt, Human
ucccaggcuggggccaggugac

SEQ ID NO: 486321 - RNA, 22 nt, Human
guuauugcaguauagaggucua

SEQ ID NO: 486322 - RNA, 22 nt, Human
agugccuugugugugggcagcc

SEQ ID NO: 486323 - RNA, 22 nt, Human
ucaccagucuuucuuaccauug

SEQ ID NO: 486324 - RNA, 22 nt, Human
gcagcuggagcaucuucucauc

SEQ ID NO: 486325 - RNA, 22 nt, Human
acagaggaagcauauagcacaa

SEQ ID NO: 486326 - RNA, 17 nt, Human
gcuuuggaaggguagac

SEQ ID NO: 486327 - RNA, 22 nt, Human
augcacccagugucuggacuau

SEQ ID NO: 486328 - RNA, 22 nt, Human
ucagagcugcccaugcaagggg

SEQ ID NO: 486329 - RNA, 22 nt, Human
acuuuggggaacuuuucuccuc

SEQ ID NO: 486330 - RNA, 22 nt, Human
gugucccaaucuacuuuucccu

SEQ ID NO: 486331 - RNA, 22 nt, Human
accagagcuuacaugcuagaaa

SEQ ID NO: 486332 - RNA, 21 nt, Human
ucauuugugaucugauuucca

SEQ ID NO: 486333 - RNA, 22 nt, Human
cagcuggcgggcagagccgcca

SEQ ID NO: 486334 - RNA, 22 nt, Human
gccagcucagaugcaggaagga

SEQ ID NO: 486335 - RNA, 22 nt, Human
gcuggucacucugggagcugcu

SEQ ID NO: 486336 - RNA, 22 nt, Human
uuugggaaacuuaggggucaga

SEQ ID NO: 486337 - RNA, 22 nt, Human
agcagggccuggcacuccuggg

SEQ ID NO: 486338 - RNA, 22 nt, Human
aaagaaauagauggcauuuaaa

SEQ ID NO: 486339 - RNA, 22 nt, Human
cagugauggauauggagaaguc

SEQ ID NO: 486340 - RNA, 22 nt, Human
gggccuccggggugagcugugg

SEQ ID NO: 486341 - RNA, 22 nt, Human
gcucacugccauucucuagaug

SEQ ID NO: 486342 - RNA, 22 nt, Human
gacagggcaagacucugucuaa

SEQ ID NO: 486343 - RNA, 22 nt, Human
uccagggaugguaaugagcagu

SEQ ID NO: 486344 - RNA, 22 nt, Human
ugucccaguuuugcagguuaga

SEQ ID NO: 486345 - RNA, 23 nt, Human
aagcugccuucgcaguuggucug

SEQ ID NO: 486346 - RNA, 21 nt, Human
agcucagccgggcacaguggc

SEQ ID NO: 486347 - RNA, 22 nt, Human
aguuauucauuuauucuguaca

SEQ ID NO: 486348 - RNA, 22 nt, Human
uuucuacaguacugauuucaua

SEQ ID NO: 486349 - RNA, 22 nt, Human
gugcaugugucuuuauaguagc

SEQ ID NO: 486350 - RNA, 22 nt, Human
uugcagggaccugcagaaagcu

SEQ ID NO: 486351 - RNA, 22 nt, Human
cuggcugcaggaaggagugggc

SEQ ID NO: 486352 - RNA, 21 nt, Human
ugucagaaauaagcaugugau

SEQ ID NO: 486353 - RNA, 22 nt, Human
gaaggagagggucaaggauaau

SEQ ID NO: 486354 - RNA, 22 nt, Human
agcugaggcucugagagggaag

SEQ ID NO: 486355 - RNA, 22 nt, Human
guugaaaguggagaaccugguu

SEQ ID NO: 486356 - RNA, 22 nt, Human
uacaguaucuucuggcaagcau

SEQ ID NO: 486357 - RNA, 22 nt, Human
agcgggugcugugucagcccuc

SEQ ID NO: 486358 - RNA, 20 nt, Human
uuacucaguuccugccaugc

SEQ ID NO: 486359 - RNA, 22 nt, Human
cuuccugguuugaagcucgccg

SEQ ID NO: 486360 - RNA, 22 nt, Human
agggcugguauguccaugaaag

SEQ ID NO: 486361 - RNA, 22 nt, Human
gagacauggcaaaagcacuggu

SEQ ID NO: 486362 - RNA, 22 nt, Human
acuuagaacaggcagaauucca

SEQ ID NO: 486363 - RNA, 22 nt, Human
auacagaaaaugaugcagaguu

SEQ ID NO: 486364 - RNA, 22 nt, Human
ugucaugccaccguuucccaga

SEQ ID NO: 486365 - RNA, 22 nt, Human
guuauguauugggaaauccaag

SEQ ID NO: 486366 - RNA, 22 nt, Human
ucugaggcauacccaggccccc

SEQ ID NO: 486367 - RNA, 22 nt, Human
aggcugcuucagcugcagggag

SEQ ID NO: 486368 - RNA, 19 nt, Human
ggcucagggcgcugccgcc

SEQ ID NO: 486369 - RNA, 22 nt, Human
uuguuuguaugcugagaagaau

SEQ ID NO: 486370 - RNA, 22 nt, Human
gucacuguuuccuauuauauuu

SEQ ID NO: 486371 - RNA, 22 nt, Human
aacagaauugcugcugccaaug

SEQ ID NO: 486372 - RNA, 22 nt, Human
ugagccaggcucaagugauccu

SEQ ID NO: 486373 - RNA, 22 nt, Human
aggggagccccugguccuggug

SEQ ID NO: 486374 - RNA, 22 nt, Human
agacuguacuuucugcagcucu

SEQ ID NO: 486375 - RNA, 22 nt, Human
agaggccuuucuguugagugaa

SEQ ID NO: 486376 - RNA, 22 nt, Human
cuccagggcagcauggcagugg

SEQ ID NO: 486377 - RNA, 22 nt, Human
ggggcugggauuugaacccagg

SEQ ID NO: 486378 - RNA, 22 nt, Human
gggagccaugcuggucuucuuu

SEQ ID NO: 486379 - RNA, 22 nt, Human
agaacugguggugaucaguuau

SEQ ID NO: 486380 - RNA, 22 nt, Human
gaggaagcugcguggcauuuca

SEQ ID NO: 486381 - RNA, 22 nt, Human
aaguuuuaacaaguacuuacua

SEQ ID NO: 486382 - RNA, 22 nt, Human
gagcucccaggccccagcaagg

SEQ ID NO: 486383 - RNA, 22 nt, Human
aucuggcuggauucuuagcguu

SEQ ID NO: 486384 - RNA, 22 nt, Human
ugucaugcuuauguuacauacu

SEQ ID NO: 486385 - RNA, 22 nt, Human
gacagguggggaaacuaaggua

SEQ ID NO: 486386 - RNA, 22 nt, Human
ggcuuccuuucacuacccucag

SEQ ID NO: 486387 - RNA, 22 nt, Human
cugaaacauugcaauaacaaag

SEQ ID NO: 486388 - RNA, 22 nt, Human
cagcagcuucuguugaucagaa

SEQ ID NO: 486389 - RNA, 23 nt, Human
aguuccagaaaaaugcucaagca

SEQ ID NO: 486390 - RNA, 22 nt, Human
uucuggagcuaaaguccacucu

SEQ ID NO: 486391 - RNA, 22 nt, Human
uugaauucauuucucauugagu

SEQ ID NO: 486392 - RNA, 22 nt, Human
gcucaggaaauaguuuaguguu

SEQ ID NO: 486393 - RNA, 22 nt, Human
ugaaaucugcaugcaaaguccu

SEQ ID NO: 486394 - RNA, 22 nt, Human
ggaggaugagcuacgaggagcu

SEQ ID NO: 486395 - RNA, 22 nt, Human
gaagcagcugccagagaugucu

SEQ ID NO: 486396 - RNA, 22 nt, Human
ggagcuggcuacagagaacucc

SEQ ID NO: 486397 - RNA, 22 nt, Human
caguacuugggggguucuaagu

SEQ ID NO: 486398 - RNA, 22 nt, Human
uggggcuccuccuggcaggagg

SEQ ID NO: 486399 - RNA, 22 nt, Human
ucaggacagccagggugcagac

SEQ ID NO: 486400 - RNA, 22 nt, Human
cugaggcagagggcagaccaga

SEQ ID NO: 486401 - RNA, 22 nt, Human
uucaagaugucuucacaauagu

SEQ ID NO: 486402 - RNA, 22 nt, Human
cugggccuggcguuccaggcug

SEQ ID NO: 486403 - RNA, 22 nt, Human
gggaggcuggcucuggccacag

SEQ ID NO: 486404 - RNA, 22 nt, Human
uccugagauguggagcuccaug

SEQ ID NO: 486405 - RNA, 22 nt, Human
aagcagaauuucccacuaguug

SEQ ID NO: 486406 - RNA, 22 nt, Human
cagggcugcuggccgugcccuc

SEQ ID NO: 486407 - RNA, 22 nt, Human
cucucugguacauagaguuugg

SEQ ID NO: 486408 - RNA, 22 nt, Human
aguggcagagugcacucaggca

SEQ ID NO: 486409 - RNA, 22 nt, Human
ccuccaaguuugacucaggaca

SEQ ID NO: 486410 - RNA, 20 nt, Human
aaaggaauauaugaaguaua

SEQ ID NO: 486411 - RNA, 22 nt, Human
gccagcugguaggcaccuagcc

SEQ ID NO: 486412 - RNA, 22 nt, Human
cuggccucauagccaagcugug

SEQ ID NO: 486413 - RNA, 23 nt, Human
cauggcagcaagagcucauggcc

SEQ ID NO: 486414 - RNA, 22 nt, Human
ugaggccagucucaucacaggc

SEQ ID NO: 486415 - RNA, 21 nt, Human
aggucccagguuugggcagca

SEQ ID NO: 486416 - RNA, 22 nt, Human
aaagauuugaaauuaggcauca

SEQ ID NO: 486417 - RNA, 22 nt, Human
guccagggaaauagcgacaggg

SEQ ID NO: 486418 - RNA, 22 nt, Human
gccagguguaguggccacaccu

SEQ ID NO: 486419 - RNA, 22 nt, Human
aggugucuucagggugagacag

SEQ ID NO: 486420 - RNA, 22 nt, Human
agccagcaggugagugcagccu

SEQ ID NO: 486421 - RNA, 22 nt, Human
uugaagcagcucaggaggcuua

SEQ ID NO: 486422 - RNA, 22 nt, Human
gcuggcuguguuucaucucuga

SEQ ID NO: 486423 - RNA, 22 nt, Human
ggcagauggaagaggcuggguc

SEQ ID NO: 486424 - RNA, 22 nt, Human
guugaaugaaucauucuaugua

SEQ ID NO: 486425 - RNA, 17 nt, Human
agggucaggugaaguuc

SEQ ID NO: 486426 - RNA, 22 nt, Human
uacagaaaucacaucgcuuuga

SEQ ID NO: 486427 - RNA, 22 nt, Human
ggccaggcugguuccuugaccu

SEQ ID NO: 486428 - RNA, 22 nt, Human
gguaacaguauguagaguaaga

SEQ ID NO: 486429 - RNA, 20 nt, Human
agcuggagaagggcccuucc

SEQ ID NO: 486430 - RNA, 22 nt, Human
caagaugaucccugaaggcagc

SEQ ID NO: 486431 - RNA, 22 nt, Human
gccagcccagcuccaggggaaa

SEQ ID NO: 486432 - RNA, 22 nt, Human
ccagcuucucucugaugcagcu

SEQ ID NO: 486433 - RNA, 22 nt, Human
gagccugagugcugccuccccu

SEQ ID NO: 486434 - RNA, 22 nt, Human
ccaguccagugccaugcauggc

SEQ ID NO: 486435 - RNA, 22 nt, Human
aggcugaggcggguagaucacc

SEQ ID NO: 486436 - RNA, 22 nt, Human
acaggcagguaauuuacauauu

SEQ ID NO: 486437 - RNA, 22 nt, Human
gcugucuggguugagggcccug

SEQ ID NO: 486438 - RNA, 22 nt, Human
gcagccagccccucugaccucu

SEQ ID NO: 486439 - RNA, 22 nt, Human
accugccuauggagccacaugg

SEQ ID NO: 486440 - RNA, 22 nt, Human
cuauugaaaguguacaauucaa

SEQ ID NO: 486441 - RNA, 22 nt, Human
gcaguggauggccagcaggggc

SEQ ID NO: 486442 - RNA, 22 nt, Human
ugaaggccagcucuuuaucagc

SEQ ID NO: 486443 - RNA, 23 nt, Human
gaggcagcuccugcagugcccug

SEQ ID NO: 486444 - RNA, 22 nt, Human
gccaggcuggucuugaacuccu

SEQ ID NO: 486445 - RNA, 22 nt, Human
gcuggccuccugcuagauggaa

SEQ ID NO: 486446 - RNA, 22 nt, Human
gggagccaaggagagaggccuu

SEQ ID NO: 486447 - RNA, 22 nt, Human
ucagaggauagaaauacuuauu

SEQ ID NO: 486448 - RNA, 22 nt, Human
ugucucagaauggcucauaaua

SEQ ID NO: 486449 - RNA, 22 nt, Human
caggcagaaggaaguaccaggc

SEQ ID NO: 486450 - RNA, 22 nt, Human
caggccuccacuccacgcagac

SEQ ID NO: 486451 - RNA, 22 nt, Human
ucccuggagauaacuucuggga

SEQ ID NO: 486452 - RNA, 22 nt, Human
caagcuccuuacauccacaggg

SEQ ID NO: 486453 - RNA, 22 nt, Human
gaggcucagggaaacagcgcag

SEQ ID NO: 486454 - RNA, 22 nt, Human
agggcagaaauauugauacugu

SEQ ID NO: 486455 - RNA, 22 nt, Human
acucaggagggaucagcuauca

SEQ ID NO: 486456 - RNA, 22 nt, Human
caggguggggaaauagcgcccu

SEQ ID NO: 486457 - RNA, 20 nt, Human
uucuggaggcuacaagucug

SEQ ID NO: 486458 - RNA, 22 nt, Human
acauuuaaauaccuauguuucu

SEQ ID NO: 486459 - RNA, 22 nt, Human
ugcugaggagguggcugugcuu

SEQ ID NO: 486460 - RNA, 22 nt, Human
ucaggaucggccuuuuuuuaag

SEQ ID NO: 486461 - RNA, 22 nt, Human
aguuuccaaauauuguuuuagc

SEQ ID NO: 486462 - RNA, 22 nt, Human
aucuggcugcugugcuuaagcu

SEQ ID NO: 486463 - RNA, 22 nt, Human
gcaggccuccccugcuggagcu

SEQ ID NO: 486464 - RNA, 22 nt, Human
uucaaugagcccaagaacguga

SEQ ID NO: 486465 - RNA, 22 nt, Human
aucuggcuuuuaccccacggcc

SEQ ID NO: 486466 - RNA, 21 nt, Human
ucucugggcccuccugugggg

SEQ ID NO: 486467 - RNA, 22 nt, Human
aagaggcagcccgcugaggcug

SEQ ID NO: 486468 - RNA, 22 nt, Human
uuaacagauguuuauggagcau

SEQ ID NO: 486469 - RNA, 22 nt, Human
ugaaaucuacccuauucagggu

SEQ ID NO: 486470 - RNA, 22 nt, Human
aagggcucugugugccucccca

SEQ ID NO: 486471 - RNA, 22 nt, Human
ucuggcucuaacuaggcaucag

SEQ ID NO: 486472 - RNA, 22 nt, Human
agcagggguaacagaaggaaag

SEQ ID NO: 486473 - RNA, 21 nt, Human
gccugccugcgugacccucuu

SEQ ID NO: 486474 - RNA, 22 nt, Human
auaugcaagcacauagaauacu

SEQ ID NO: 486475 - RNA, 22 nt, Human
cauugcuuugugcauauuuaaa

SEQ ID NO: 486476 - RNA, 21 nt, Human
ugaggcaggggugcuuuuguc

SEQ ID NO: 486477 - RNA, 22 nt, Human
gaggcagcgggucaggaccgug

SEQ ID NO: 486478 - RNA, 22 nt, Human
ccacugucuuuuccaggcugaa

SEQ ID NO: 486479 - RNA, 22 nt, Human
gcucuccaaacccuguggcuuu

SEQ ID NO: 486480 - RNA, 21 nt, Human
aggcuguccuuugccagcccu

SEQ ID NO: 486481 - RNA, 21 nt, Human
gcugcucgagauccagugcuu

SEQ ID NO: 486482 - RNA, 22 nt, Human
cagaggguugaugugaggcuua

SEQ ID NO: 486483 - RNA, 22 nt, Human
uagcuuuaggaugguucucuug

SEQ ID NO: 486484 - RNA, 22 nt, Human
auugcagcuggucaggguaauu

SEQ ID NO: 486485 - RNA, 19 nt, Human
acacagggcuagaguuaca

SEQ ID NO: 486486 - RNA, 22 nt, Human
gccugccucaaaaucccaguuc

SEQ ID NO: 486487 - RNA, 22 nt, Human
aaggcaggagcuguaucuuauu

SEQ ID NO: 486488 - RNA, 19 nt, Human
caugagcugcucacuuccc

SEQ ID NO: 486489 - RNA, 22 nt, Human
cagggcucuucaucacacagua

SEQ ID NO: 486490 - RNA, 22 nt, Human
gcugucacacauggccccagcu

SEQ ID NO: 486491 - RNA, 22 nt, Human
caugggcaguuggcagggcuca

SEQ ID NO: 486492 - RNA, 22 nt, Human
gccuuaggggucagacagagcu

SEQ ID NO: 486493 - RNA, 22 nt, Human
auggauaauggugauaguugca

SEQ ID NO: 486494 - RNA, 22 nt, Human
aauuaggaauaaaugaguacuu

SEQ ID NO: 486495 - RNA, 22 nt, Human
auccagggauaaaaguaagguu

SEQ ID NO: 486496 - RNA, 22 nt, Human
uauuucugauugcucaugaggc

SEQ ID NO: 486497 - RNA, 22 nt, Human
caggggcuguggcacauggugu

SEQ ID NO: 486498 - RNA, 21 nt, Human
uccuucaguucugcacuuucu

SEQ ID NO: 486499 - RNA, 22 nt, Human
cagagagagucaaaucuuugcu

SEQ ID NO: 486500 - RNA, 22 nt, Human
gggcuggaucuccugcaggcag

SEQ ID NO: 486501 - RNA, 22 nt, Human
gggcuggcucugucuagaaagg

SEQ ID NO: 486502 - RNA, 22 nt, Human
uuccucucaacaugccugccgg

SEQ ID NO: 486503 - RNA, 18 nt, Human
acaguaaagaaaggaauu

SEQ ID NO: 486504 - RNA, 22 nt, Human
auuuuccagccuuucuagaacu

SEQ ID NO: 486505 - RNA, 22 nt, Human
uugauuucuuacucuuccaagg

SEQ ID NO: 486506 - RNA, 22 nt, Human
gccaggcagagccccgugcagc

SEQ ID NO: 486507 - RNA, 22 nt, Human
ugggcaaguaucggacucugag

SEQ ID NO: 486508 - RNA, 22 nt, Human
ggcugcagggcagcuggugugg

SEQ ID NO: 486509 - RNA, 22 nt, Human
gcaggaugggagcuucacuuug

SEQ ID NO: 486510 - RNA, 22 nt, Human
gagccugccucuagucucuaga

SEQ ID NO: 486511 - RNA, 22 nt, Human
caggaaugaggucguaaguguc

SEQ ID NO: 486512 - RNA, 23 nt, Human
agccacuucuaucuugcuccugg

SEQ ID NO: 486513 - RNA, 22 nt, Human
agccagagcugaugucauucuc

SEQ ID NO: 486514 - RNA, 22 nt, Human
ccagagacgucggucagggcgc

SEQ ID NO: 486515 - RNA, 20 nt, Human
uccaggcagcucagaguguc

SEQ ID NO: 486516 - RNA, 22 nt, Human
uggaaggggagcuggaaagggg

SEQ ID NO: 486517 - RNA, 22 nt, Human
agagguagagguugcagugagc

SEQ ID NO: 486518 - RNA, 22 nt, Human
uagaaaugcccagauucugcua

SEQ ID NO: 486519 - RNA, 22 nt, Human
cacccacauggaaauucacagu

SEQ ID NO: 486520 - RNA, 22 nt, Human
ggccugcucugcagccucuaca

SEQ ID NO: 486521 - RNA, 22 nt, Human
caggcagcaucagucugcugua

SEQ ID NO: 486522 - RNA, 22 nt, Human
agccaggcgcaguggcuuaugc

SEQ ID NO: 486523 - RNA, 22 nt, Human
uuagugucuucuucauccucug

SEQ ID NO: 486524 - RNA, 22 nt, Human
cucaugauguagcgaaugagaa

SEQ ID NO: 486525 - RNA, 22 nt, Human
gggacuucauagcuaggcacuu

SEQ ID NO: 486526 - RNA, 22 nt, Human
aagaaauguagagccuaguaaa

SEQ ID NO: 486527 - RNA, 22 nt, Human
agcugcccccagggcugugcuu

SEQ ID NO: 486528 - RNA, 20 nt, Human
gaggccucagccucagcucc

SEQ ID NO: 486529 - RNA, 22 nt, Human
ucucugagcaugccauauugcu

SEQ ID NO: 486530 - RNA, 22 nt, Human
caguggcaugguugacugcagu

SEQ ID NO: 486531 - RNA, 21 nt, Human
ccagccucagaucagggagcu

SEQ ID NO: 486532 - RNA, 18 nt, Human
agcuggcccuggcugccg

SEQ ID NO: 486533 - RNA, 22 nt, Human
caguauuuucaggauuuggaag

SEQ ID NO: 486534 - RNA, 22 nt, Human
auguagcagauauuugugcaca

SEQ ID NO: 486535 - RNA, 22 nt, Human
cagcagagcugugugggaaggg

SEQ ID NO: 486536 - RNA, 22 nt, Human
uauguacauaacaugaaaugca

SEQ ID NO: 486537 - RNA, 22 nt, Human
guaucuuucccaccaaucacaa

SEQ ID NO: 486538 - RNA, 22 nt, Human
ugaggcagcuuuuucugugugu

SEQ ID NO: 486539 - RNA, 22 nt, Human
cagguaagagacggauuggccc

SEQ ID NO: 486540 - RNA, 22 nt, Human
uccuuccuggggucucugcugc

SEQ ID NO: 486541 - RNA, 20 nt, Human
aucagcaacugccacucagu

SEQ ID NO: 486542 - RNA, 22 nt, Human
uggcugucagcugccuggugcg

SEQ ID NO: 486543 - RNA, 23 nt, Human
caguacuuaguguagcguuaauu

SEQ ID NO: 486544 - RNA, 23 nt, Human
gccucuggagccccagugcucag

SEQ ID NO: 486545 - RNA, 22 nt, Human
ccuggcaguggugaagaagagg

SEQ ID NO: 486546 - RNA, 22 nt, Human
caguccuggggaccaggcugag

SEQ ID NO: 486547 - RNA, 22 nt, Human
aaagaacaauguggaaucuccu

SEQ ID NO: 486548 - RNA, 22 nt, Human
guguguccucaguaguggcaug

SEQ ID NO: 486549 - RNA, 22 nt, Human
gcaggguccauggaggcagccc

SEQ ID NO: 486550 - RNA, 19 nt, Human
gggcagaauggcaucucag

SEQ ID NO: 486551 - RNA, 22 nt, Human
guuauguaucuugauugggugg

SEQ ID NO: 486552 - RNA, 22 nt, Human
caggugggcuugggagaacacu

SEQ ID NO: 486553 - RNA, 22 nt, Human
cuggcuuccaugcuguaguggc

SEQ ID NO: 486554 - RNA, 22 nt, Human
ucugguuagccaauaaugccaa

SEQ ID NO: 486555 - RNA, 22 nt, Human
uauaaaguuucgaaagauguau

SEQ ID NO: 486556 - RNA, 22 nt, Human
ccuggagcuuggucacgcugcg

SEQ ID NO: 486557 - RNA, 22 nt, Human
aggcuggcuuggcucuccugug

SEQ ID NO: 486558 - RNA, 22 nt, Human
ccaccagcuuugccacccugcu

SEQ ID NO: 486559 - RNA, 22 nt, Human
gguuccacgguguuuggaggca

SEQ ID NO: 486560 - RNA, 22 nt, Human
agucccagccuaggcugugcug

SEQ ID NO: 486561 - RNA, 22 nt, Human
augaggcagauguugcaugagg

SEQ ID NO: 486562 - RNA, 22 nt, Human
ggucucaggagacuggagagca

SEQ ID NO: 486563 - RNA, 19 nt, Human
uagucuuuauucuuaauuu

SEQ ID NO: 486564 - RNA, 22 nt, Human
cccuggagcaucucugcugucu

SEQ ID NO: 486565 - RNA, 19 nt, Human
uuacaucugcaacacuggu

SEQ ID NO: 486566 - RNA, 22 nt, Human
gggaaggagccugcuugcuaga

SEQ ID NO: 486567 - RNA, 22 nt, Human
gcagaugaggaagcuaaugcug

SEQ ID NO: 486568 - RNA, 22 nt, Human
uguacuuccccaaugacagcac

SEQ ID NO: 486569 - RNA, 22 nt, Human
aaguugagaugucauaggagac

SEQ ID NO: 486570 - RNA, 22 nt, Human
gcugcaggcgccugcggucucu

SEQ ID NO: 486571 - RNA, 22 nt, Human
gaggcagagacuccaccuucag

SEQ ID NO: 486572 - RNA, 23 nt, Human
ugcuucucugcuugacaguucug

SEQ ID NO: 486573 - RNA, 22 nt, Human
uuagaaaggaaucuucauuuca

SEQ ID NO: 486574 - RNA, 22 nt, Human
gaauuaguguugaaaucagggc

SEQ ID NO: 486575 - RNA, 22 nt, Human
accccagcccugcuucugggag

SEQ ID NO: 486576 - RNA, 22 nt, Human
caggggcuagcacuuaauguuu

SEQ ID NO: 486577 - RNA, 22 nt, Human
cucauggauauaagaacuguuu

SEQ ID NO: 486578 - RNA, 18 nt, Human
ccugcagcccaggaggcc

SEQ ID NO: 486579 - RNA, 22 nt, Human
gcagggcucaacaggacacccc

SEQ ID NO: 486580 - RNA, 22 nt, Human
uugaauaguguuuucaguauac

SEQ ID NO: 486581 - RNA, 22 nt, Human
aaaugucuuuaucucauguaac

SEQ ID NO: 486582 - RNA, 21 nt, Human
uccucagggccccagagcacu

SEQ ID NO: 486583 - RNA, 20 nt, Human
cagaccugcacccacuucga

SEQ ID NO: 486584 - RNA, 22 nt, Human
cagcaaucgggugauaugcaau

SEQ ID NO: 486585 - RNA, 22 nt, Human
gcucccagaaccaaggcugggg

SEQ ID NO: 486586 - RNA, 17 nt, Human
ucucuuucccuuucugc

SEQ ID NO: 486587 - RNA, 22 nt, Human
ucaggugguccuaagugccauc

SEQ ID NO: 486588 - RNA, 22 nt, Human
gagacaaaaguuggagugcaag

SEQ ID NO: 486589 - RNA, 22 nt, Human
aucagagacaaaaccagcacuu

SEQ ID NO: 486590 - RNA, 22 nt, Human
ugccacacagucugguagaaua

SEQ ID NO: 486591 - RNA, 22 nt, Human
aguggcaggcggagauguagga

SEQ ID NO: 486592 - RNA, 22 nt, Human
gcucuccacugaccacggggca

SEQ ID NO: 486593 - RNA, 18 nt, Human
cagcugccagcucaugga

SEQ ID NO: 486594 - RNA, 22 nt, Human
cugcccugcuugaugacagcga

SEQ ID NO: 486595 - RNA, 22 nt, Human
aggcucugcagugcuggaggac

SEQ ID NO: 486596 - RNA, 22 nt, Human
gccuuccugcagcucugagcgu

SEQ ID NO: 486597 - RNA, 22 nt, Human
uggagcugguaaacagugacau

SEQ ID NO: 486598 - RNA, 22 nt, Human
gaaucauuggaaccacauccaa

SEQ ID NO: 486599 - RNA, 22 nt, Human
cuuggcagauccaaaaaugaca

SEQ ID NO: 486600 - RNA, 22 nt, Human
gaagcagcuuucuggugaggag

SEQ ID NO: 486601 - RNA, 23 nt, Human
agcagccauagggaagcaauaca

SEQ ID NO: 486602 - RNA, 22 nt, Human
aguacagaccugucucuuccug

SEQ ID NO: 486603 - RNA, 22 nt, Human
gaguguggugaacaggagcacc

SEQ ID NO: 486604 - RNA, 22 nt, Human
caagauggagaagcagcaaggg

SEQ ID NO: 486605 - RNA, 22 nt, Human
guugaaaguagaugcuauuugg

SEQ ID NO: 486606 - RNA, 22 nt, Human
agaaaauauucauugagaggcu

SEQ ID NO: 486607 - RNA, 18 nt, Human
gaggccugagaaccaggu

SEQ ID NO: 486608 - RNA, 22 nt, Human
gaggcucauugcauugugcauu

SEQ ID NO: 486609 - RNA, 22 nt, Human
aaaggccacacugcucuuucuc

SEQ ID NO: 486610 - RNA, 22 nt, Human
cagggguggcugcagcagaggu

SEQ ID NO: 486611 - RNA, 22 nt, Human
agagcugagcaccaagcauggu

SEQ ID NO: 486612 - RNA, 22 nt, Human
agugggcaggcagggugcgcag

SEQ ID NO: 486613 - RNA, 22 nt, Human
agcaaucaccaccucuauauuu

SEQ ID NO: 486614 - RNA, 23 nt, Human
uggcucugagagguucagaugcu

SEQ ID NO: 486615 - RNA, 22 nt, Human
gcagggugccgacuucagggau

SEQ ID NO: 486616 - RNA, 22 nt, Human
uuccaggaauucagcucucagu

SEQ ID NO: 486617 - RNA, 22 nt, Human
uggcccugacacgugguacugg

SEQ ID NO: 486618 - RNA, 21 nt, Human
ugcugccauagaccugaggga

SEQ ID NO: 486619 - RNA, 22 nt, Human
cucugaacucuugggcagcaug

SEQ ID NO: 486620 - RNA, 22 nt, Human
cagaguguuucuuugggugggu

SEQ ID NO: 486621 - RNA, 17 nt, Human
agccaggcauaugaagu

SEQ ID NO: 486622 - RNA, 22 nt, Human
cagagcagcagagcuuccaugg

SEQ ID NO: 486623 - RNA, 22 nt, Human
gcucugagauugagccuuuggu

SEQ ID NO: 486624 - RNA, 19 nt, Human
ugcagggcugcgccugggg

SEQ ID NO: 486625 - RNA, 22 nt, Human
uuggcagggccaggcucucucu

SEQ ID NO: 486626 - RNA, 22 nt, Human
gaagcagccacggggagacaga

SEQ ID NO: 486627 - RNA, 22 nt, Human
aggcccugggcaguucuguagc

SEQ ID NO: 486628 - RNA, 22 nt, Human
agacuguaauuuguggccuccu

SEQ ID NO: 486629 - RNA, 22 nt, Human
aaaaaugucauuauggaacuga

SEQ ID NO: 486630 - RNA, 22 nt, Human
auaugcauguacgugugcacaa

SEQ ID NO: 486631 - RNA, 19 nt, Human
gcgaggaagucacuguggc

SEQ ID NO: 486632 - RNA, 22 nt, Human
ucugcugcugagcacacuccua

SEQ ID NO: 486633 - RNA, 22 nt, Human
ccagcucucagcgggagacuca

SEQ ID NO: 486634 - RNA, 22 nt, Human
cacagggccuugugugacugca

SEQ ID NO: 486635 - RNA, 22 nt, Human
uagcuguguagacacucagagc

SEQ ID NO: 486636 - RNA, 22 nt, Human
uaauccaggguauucuaguuuc

SEQ ID NO: 486637 - RNA, 20 nt, Human
agggucagagagcgugagug

SEQ ID NO: 486638 - RNA, 22 nt, Human
gcaaggcagcgcggaguagcua

SEQ ID NO: 486639 - RNA, 22 nt, Human
ugagccagucugucugggugaa

SEQ ID NO: 486640 - RNA, 22 nt, Human
uucaggauccccaccgcguuua

SEQ ID NO: 486641 - RNA, 22 nt, Human
uggcucagaguucaucuuuuag

SEQ ID NO: 486642 - RNA, 22 nt, Human
uggagaagauuggucaccauuc

SEQ ID NO: 486643 - RNA, 22 nt, Human
gcauagucaguaggauucucaa

SEQ ID NO: 486644 - RNA, 22 nt, Human
agaagccauagucugggaggca

SEQ ID NO: 486645 - RNA, 22 nt, Human
ucugggagguaaccaugcugau

SEQ ID NO: 486646 - RNA, 22 nt, Human
uuucacauaucaacucuauccu

SEQ ID NO: 486647 - RNA, 22 nt, Human
cuccaguggcaaguccgggcgg

SEQ ID NO: 486648 - RNA, 19 nt, Human
gguagaagggaaguguuuu

SEQ ID NO: 486649 - RNA, 22 nt, Human
uguguauuucuggaacagacua

SEQ ID NO: 486650 - RNA, 22 nt, Human
gagcuuuaggagaaggagguca

SEQ ID NO: 486651 - RNA, 22 nt, Human
ccagcccugaacccugcugcau

SEQ ID NO: 486652 - RNA, 22 nt, Human
aggcccugcuuuccagagcuca

SEQ ID NO: 486653 - RNA, 22 nt, Human
acugcaggagacacagcugcug

SEQ ID NO: 486654 - RNA, 22 nt, Human
ugguuugcccacucgagugauu

SEQ ID NO: 486655 - RNA, 22 nt, Human
gucagaggggcagcugccaggc

SEQ ID NO: 486656 - RNA, 22 nt, Human
cagcagaggaaagcaaaucuaa

SEQ ID NO: 486657 - RNA, 22 nt, Human
cagggccacccucugcugggug

SEQ ID NO: 486658 - RNA, 22 nt, Human
ggaguucacugugcaggcucug

SEQ ID NO: 486659 - RNA, 20 nt, Human
acaauagauuugagcaaagu

SEQ ID NO: 486660 - RNA, 22 nt, Human
uuacaguaugaucaacuuuuca

SEQ ID NO: 486661 - RNA, 22 nt, Human
aaggaaccuggaguagagggag

SEQ ID NO: 486662 - RNA, 22 nt, Human
uagcauuucccaaaugcauuug

SEQ ID NO: 486663 - RNA, 22 nt, Human
gccuucaguagugucagcugua

SEQ ID NO: 486664 - RNA, 22 nt, Human
ucucuggagggcuccaggcggg

SEQ ID NO: 486665 - RNA, 22 nt, Human
acagaguaggugcugucgacug

SEQ ID NO: 486666 - RNA, 23 nt, Human
uuuauuuauuuaggcugagggau

SEQ ID NO: 486667 - RNA, 22 nt, Human
uuccauaauuaaguggagagaa

SEQ ID NO: 486668 - RNA, 20 nt, Human
agggucaguagcacagagcu

SEQ ID NO: 486669 - RNA, 18 nt, Human
guaggucaguaccaagca

SEQ ID NO: 486670 - RNA, 22 nt, Human
agccugcuucccuuugugcccc

SEQ ID NO: 486671 - RNA, 22 nt, Human
aaggcagaaagggaugugagug

SEQ ID NO: 486672 - RNA, 22 nt, Human
ccagcgcuucccaucagggagg

SEQ ID NO: 486673 - RNA, 22 nt, Human
ccagcagagucuaggaaggagg

SEQ ID NO: 486674 - RNA, 22 nt, Human
gagugucugaauuagagcacaa

SEQ ID NO: 486675 - RNA, 22 nt, Human
ggcucuggugcccuggcuccca

SEQ ID NO: 486676 - RNA, 19 nt, Human
uccuccuuacuuccucuug

SEQ ID NO: 486677 - RNA, 17 nt, Human
gagagcugcugcuuccg

SEQ ID NO: 486678 - RNA, 22 nt, Human
uggaaagaaaaacaggccauga

SEQ ID NO: 486679 - RNA, 22 nt, Human
acagcuuuguguuaaugggaag

SEQ ID NO: 486680 - RNA, 22 nt, Human
ggcuggagauaugucuggaaca

SEQ ID NO: 486681 - RNA, 22 nt, Human
gaaaaaugcuccaaaucugugg

SEQ ID NO: 486682 - RNA, 22 nt, Human
cagaggcauacucccagucuug

SEQ ID NO: 486683 - RNA, 22 nt, Human
aguggggacuuaugccagcauu

SEQ ID NO: 486684 - RNA, 22 nt, Human
auacaaagacaaaucucaaucu

SEQ ID NO: 486685 - RNA, 22 nt, Human
aggggugugcauccuggaggau

SEQ ID NO: 486686 - RNA, 22 nt, Human
uacaggcacugaaaugcuuauu

SEQ ID NO: 486687 - RNA, 22 nt, Human
agauggagaccuuggaugaacu

SEQ ID NO: 486688 - RNA, 22 nt, Human
ccagggcagggaccacgugucu

SEQ ID NO: 486689 - RNA, 22 nt, Human
uuggcugaagguuaagugcugg

SEQ ID NO: 486690 - RNA, 22 nt, Human
cagcagugcuucagugugagau

SEQ ID NO: 486691 - RNA, 22 nt, Human
augaugguuguccuaggugcau

SEQ ID NO: 486692 - RNA, 22 nt, Human
ugccugucucugacugccauua

SEQ ID NO: 486693 - RNA, 22 nt, Human
uuagccauuaaauuacaaggug

SEQ ID NO: 486694 - RNA, 22 nt, Human
uccuugaauauaauaacaguag

SEQ ID NO: 486695 - RNA, 22 nt, Human
uggcucugaucagauguccagu

SEQ ID NO: 486696 - RNA, 22 nt, Human
ucggggucuuugacacgcucug

SEQ ID NO: 486697 - RNA, 22 nt, Human
auccuugacacacuccaguacu

SEQ ID NO: 486698 - RNA, 22 nt, Human
agccagcaugaagacagaggcc

SEQ ID NO: 486699 - RNA, 22 nt, Human
ggaggagcacuucugagcucag

SEQ ID NO: 486700 - RNA, 22 nt, Human
ucuuccagcaaugugaaaucac

SEQ ID NO: 486701 - RNA, 22 nt, Human
ucuuuucuggacucugcaugga

SEQ ID NO: 486702 - RNA, 20 nt, Human
ucccaggcuccacccuagac

SEQ ID NO: 486703 - RNA, 22 nt, Human
aaugucugaaaaucagacugca

SEQ ID NO: 486704 - RNA, 20 nt, Human
augugagggguugaaguggg

SEQ ID NO: 486705 - RNA, 22 nt, Human
aaaaagguugauccagauuagg

SEQ ID NO: 486706 - RNA, 22 nt, Human
uuuccuaagguagugauaauuu

SEQ ID NO: 486707 - RNA, 22 nt, Human
cuggaaggucuguccccacugc

SEQ ID NO: 486708 - RNA, 22 nt, Human
uuuuucaugagacuagaaguca

SEQ ID NO: 486709 - RNA, 21 nt, Human
aucccagcacccaggagugca

SEQ ID NO: 486710 - RNA, 22 nt, Human
caggcuggagugaguguagugg

SEQ ID NO: 486711 - RNA, 22 nt, Human
gaguccuucuggcuggcaggau

SEQ ID NO: 486712 - RNA, 22 nt, Human
aaguguauauaugacuuauaaa

SEQ ID NO: 486713 - RNA, 22 nt, Human
ggaggccaaggagggcggauca

SEQ ID NO: 486714 - RNA, 22 nt, Human
ugaugauguuuaucuugguauu

SEQ ID NO: 486715 - RNA, 22 nt, Human
ggcuggccuguguggccgccac

SEQ ID NO: 486716 - RNA, 22 nt, Human
uaugcacagaaguuugcugaau

SEQ ID NO: 486717 - RNA, 22 nt, Human
aaacagaaggguagguaaacau

SEQ ID NO: 486718 - RNA, 22 nt, Human
cagggccacuguagaugaggag

SEQ ID NO: 486719 - RNA, 22 nt, Human
ggcucaggaugagccuucucau

SEQ ID NO: 486720 - RNA, 22 nt, Human
acaggcagguugagaaacauuu

SEQ ID NO: 486721 - RNA, 21 nt, Human
cugcucugacagugaggccag

SEQ ID NO: 486722 - RNA, 22 nt, Human
uggagccaugccuggccuuucc

SEQ ID NO: 486723 - RNA, 22 nt, Human
cuccuuccugccccagugauaa

SEQ ID NO: 486724 - RNA, 22 nt, Human
aggccugaaggaagaugagcug

SEQ ID NO: 486725 - RNA, 23 nt, Human
ugcagccacucaggagcucagug

SEQ ID NO: 486726 - RNA, 22 nt, Human
agaagccacuggagguugagau

SEQ ID NO: 486727 - RNA, 23 nt, Human
ucuccuccuagauacagucaugg

SEQ ID NO: 486728 - RNA, 22 nt, Human
ugcagaguaaaagcagaugcua

SEQ ID NO: 486729 - RNA, 19 nt, Human
cugagagaugcuucacaca

SEQ ID NO: 486730 - RNA, 22 nt, Human
gagggagugccagagggccagc

SEQ ID NO: 486731 - RNA, 22 nt, Human
aaacaugcauucaagaaaaucu

SEQ ID NO: 486732 - RNA, 22 nt, Human
ggcauccaaauaccaagaugua

SEQ ID NO: 486733 - RNA, 22 nt, Human
auagugggaauuacgauauacu

SEQ ID NO: 486734 - RNA, 22 nt, Human
cuguacauauacauuuuuuucc

SEQ ID NO: 486735 - RNA, 22 nt, Human
ggccucucuggcauggcugccc

SEQ ID NO: 486736 - RNA, 22 nt, Human
gcacagaagagcuuuggaauga

SEQ ID NO: 486737 - RNA, 22 nt, Human
cugggcuguucugccccugggu

SEQ ID NO: 486738 - RNA, 22 nt, Human
auuaaauuaaguggcuaauuua

SEQ ID NO: 486739 - RNA, 22 nt, Human
agacccucuccaugcccacugc

SEQ ID NO: 486740 - RNA, 22 nt, Human
gcagggcagggcaagaacuggg

SEQ ID NO: 486741 - RNA, 22 nt, Human
ggcaggugcucugugggccugg

SEQ ID NO: 486742 - RNA, 22 nt, Human
cagcuuuaguaacccacugcuc

SEQ ID NO: 486743 - RNA, 22 nt, Human
agaggaggcagcuuaacucagu

SEQ ID NO: 486744 - RNA, 22 nt, Human
ugaaauauuuagagaguaaguu

SEQ ID NO: 486745 - RNA, 22 nt, Human
aggcccagagagccaguuagug

SEQ ID NO: 486746 - RNA, 22 nt, Human
gaggagggagcuggaagcucuu

SEQ ID NO: 486747 - RNA, 22 nt, Human
ucaaugaugcugaagguagcgu

SEQ ID NO: 486748 - RNA, 21 nt, Human
ucugucucuccacugcccugc

SEQ ID NO: 486749 - RNA, 22 nt, Human
gcagagcacccugcagugguau

SEQ ID NO: 486750 - RNA, 22 nt, Human
aauguguagcauuuaaugcagu

SEQ ID NO: 486751 - RNA, 22 nt, Human
gcagcacauauaaacaaagaga

SEQ ID NO: 486752 - RNA, 19 nt, Human
ggacacagaaagcugcauu

SEQ ID NO: 486753 - RNA, 19 nt, Human
agggaguuuauauuugcac

SEQ ID NO: 486754 - RNA, 22 nt, Human
uaacacacugaaggugagaugg

SEQ ID NO: 486755 - RNA, 22 nt, Human
aucagcaaucucguguauuagg

SEQ ID NO: 486756 - RNA, 22 nt, Human
cagcaucuaaucuucaugccgg

SEQ ID NO: 486757 - RNA, 22 nt, Human
aagcagcagaccugauuuugaa

SEQ ID NO: 486758 - RNA, 22 nt, Human
caguguggugugcacagcuuag

SEQ ID NO: 486759 - RNA, 22 nt, Human
ccggcucggcgaccaggcugaa

SEQ ID NO: 486760 - RNA, 18 nt, Human
ugacucacccugucagug

SEQ ID NO: 486761 - RNA, 22 nt, Human
caaagcucaugcucuuagccau

SEQ ID NO: 486762 - RNA, 22 nt, Human
gcauuccugagaaugcagagug

SEQ ID NO: 486763 - RNA, 22 nt, Human
cacugcaguuccccagugcgca

SEQ ID NO: 486764 - RNA, 22 nt, Human
agaucucaccucuguguauuau

SEQ ID NO: 486765 - RNA, 22 nt, Human
cagucaccaccagguggcagua

SEQ ID NO: 486766 - RNA, 22 nt, Human
gggagcugaauggcaauggaga

SEQ ID NO: 486767 - RNA, 23 nt, Human
acagacaacacugaugagagaaa

SEQ ID NO: 486768 - RNA, 22 nt, Human
cagagccaacgccaccugccca

SEQ ID NO: 486769 - RNA, 22 nt, Human
uggccugcagaggcuguggggc

SEQ ID NO: 486770 - RNA, 22 nt, Human
uagcagagcagggaucagagcc

SEQ ID NO: 486771 - RNA, 21 nt, Human
agaggccuuacaggauagacc

SEQ ID NO: 486772 - RNA, 22 nt, Human
uagaaguuaaaggaauacagaa

SEQ ID NO: 486773 - RNA, 22 nt, Human
ucucuuaauaaguaaauacuga

SEQ ID NO: 486774 - RNA, 22 nt, Human
ucccuggcagcuaagggugguc

SEQ ID NO: 486775 - RNA, 22 nt, Human
uaaagaacacagggaauagcac

SEQ ID NO: 486776 - RNA, 22 nt, Human
ccagggugugagaaggaaguag

SEQ ID NO: 486777 - RNA, 22 nt, Human
ccagggugggguccaggaacca

SEQ ID NO: 486778 - RNA, 22 nt, Human
gugaggggaguaaagccauguu

SEQ ID NO: 486779 - RNA, 22 nt, Human
aaaucaguuggaacacaagcag

SEQ ID NO: 486780 - RNA, 22 nt, Human
acauagcuuaaaugagaagaua

SEQ ID NO: 486781 - RNA, 23 nt, Human
aaccagauaaauggcuccagggc

SEQ ID NO: 486782 - RNA, 22 nt, Human
ucugucacugagcucaggauuc

SEQ ID NO: 486783 - RNA, 22 nt, Human
aucaggauagugguuaccuggg

SEQ ID NO: 486784 - RNA, 22 nt, Human
guuugcauggaagacagugagu

SEQ ID NO: 486785 - RNA, 22 nt, Human
aaauguuccauuauuguguaau

SEQ ID NO: 486786 - RNA, 18 nt, Human
acagaggcagacauguau

SEQ ID NO: 486787 - RNA, 22 nt, Human
cugaugcuauaagccacagugg

SEQ ID NO: 486788 - RNA, 22 nt, Human
ugcagccaccaccucugcugaa

SEQ ID NO: 486789 - RNA, 22 nt, Human
agaccugcagggccaggccugc

SEQ ID NO: 486790 - RNA, 22 nt, Human
accacugcccauggugaaaacu

SEQ ID NO: 486791 - RNA, 22 nt, Human
gacaagacaugugaugacauca

SEQ ID NO: 486792 - RNA, 21 nt, Human
ugcagaggcacaaacaagccc

SEQ ID NO: 486793 - RNA, 22 nt, Human
cacugaaggaaggacuacugca

SEQ ID NO: 486794 - RNA, 22 nt, Human
gcucccaccuuugcuaucagua

SEQ ID NO: 486795 - RNA, 20 nt, Human
ucauuacagugcuaagaugu

SEQ ID NO: 486796 - RNA, 22 nt, Human
gcuggggcugggcugaggaaga

SEQ ID NO: 486797 - RNA, 22 nt, Human
ugacacaggcagcucccagcac

SEQ ID NO: 486798 - RNA, 22 nt, Human
ccaggcugugguuuagauagag

SEQ ID NO: 486799 - RNA, 20 nt, Human
ggcagagcuaugucuguugc

SEQ ID NO: 486800 - RNA, 22 nt, Human
uaacagaaaagaacugaguuug

SEQ ID NO: 486801 - RNA, 20 nt, Human
uucugcuugcaaauaucaag

SEQ ID NO: 486802 - RNA, 22 nt, Human
aacaggcaacaguugacucuga

SEQ ID NO: 486803 - RNA, 22 nt, Human
gcagggcagugugucugugggg

SEQ ID NO: 486804 - RNA, 22 nt, Human
acagugugugcuuucccuuacg

SEQ ID NO: 486805 - RNA, 22 nt, Human
cuggggccacaacggcgcacgc

SEQ ID NO: 486806 - RNA, 22 nt, Human
gcaagcaagcagguagagcuga

SEQ ID NO: 486807 - RNA, 22 nt, Human
uccaggcucucaggugucagca

SEQ ID NO: 486808 - RNA, 22 nt, Human
uggacaacauagugagaccuca

SEQ ID NO: 486809 - RNA, 22 nt, Human
ugccugcuaggcccugcugggu

SEQ ID NO: 486810 - RNA, 22 nt, Human
ggggggugcugaucaguggagc

SEQ ID NO: 486811 - RNA, 22 nt, Human
guccucuguagggcugggccac

SEQ ID NO: 486812 - RNA, 22 nt, Human
aagcucugcucagcagacuagg

SEQ ID NO: 486813 - RNA, 22 nt, Human
uugauagguuuuauguauaguu

SEQ ID NO: 486814 - RNA, 22 nt, Human
uuucuuauacuauauugucauc

SEQ ID NO: 486815 - RNA, 22 nt, Human
gucucccaucguuugugaggaa

SEQ ID NO: 486816 - RNA, 22 nt, Human
gagaggcugacuggcuguccug

SEQ ID NO: 486817 - RNA, 22 nt, Human
acagagauggcacagagaaggu

SEQ ID NO: 486818 - RNA, 20 nt, Human
uccaagcccuccuuccauuc

SEQ ID NO: 486819 - RNA, 22 nt, Human
cccaggcaguagaaagaagagg

SEQ ID NO: 486820 - RNA, 22 nt, Human
gcagauggaaagugcuugaggg

SEQ ID NO: 486821 - RNA, 22 nt, Human
caccagcagaagacugagggug

SEQ ID NO: 486822 - RNA, 22 nt, Human
aggcagcaugggccccagcucc

SEQ ID NO: 486823 - RNA, 22 nt, Human
ccuggagcaaaaaucuaaggag

SEQ ID NO: 486824 - RNA, 22 nt, Human
cagagacauuaagugccaugau

SEQ ID NO: 486825 - RNA, 22 nt, Human
acucugaaugugcauguaaauc

SEQ ID NO: 486826 - RNA, 22 nt, Human
aggcuggcuggcaggggacaca

SEQ ID NO: 486827 - RNA, 22 nt, Human
gaggcagaggaagguggucucu

SEQ ID NO: 486828 - RNA, 22 nt, Human
gaggcagcagggcugguuccuu

SEQ ID NO: 486829 - RNA, 18 nt, Human
ugcucuggucucacuugg

SEQ ID NO: 486830 - RNA, 22 nt, Human
uuugucagucaugucugcuuuu

SEQ ID NO: 486831 - RNA, 22 nt, Human
uccuucaguuaucacaguacug

SEQ ID NO: 486832 - RNA, 22 nt, Human
cccagcuugcaaauggguugcu

SEQ ID NO: 486833 - RNA, 22 nt, Human
aaggaagauauaucaagcuuaa

SEQ ID NO: 486834 - RNA, 22 nt, Human
gggcaggucugggucagccuga

SEQ ID NO: 486835 - RNA, 22 nt, Human
gcaggaagccuuaccaagccca

SEQ ID NO: 486836 - RNA, 22 nt, Human
uauccaauucaccauugauggg

SEQ ID NO: 486837 - RNA, 22 nt, Human
uuuuuguagucauuagaagagg

SEQ ID NO: 486838 - RNA, 22 nt, Human
gcccagcugucuggcagggaug

SEQ ID NO: 486839 - RNA, 22 nt, Human
aauaauuuuagcucagaguugu

SEQ ID NO: 486840 - RNA, 22 nt, Human
aaaggccagguuggcugguauu

SEQ ID NO: 486841 - RNA, 22 nt, Human
augaguucaauuguuucaguca

SEQ ID NO: 486842 - RNA, 22 nt, Human
gaaaggccagcucacagaugag

SEQ ID NO: 486843 - RNA, 22 nt, Human
aucacaggugguaggaaaagaa

SEQ ID NO: 486844 - RNA, 22 nt, Human
uagcagcucugauucugggccc

SEQ ID NO: 486845 - RNA, 21 nt, Human
uagggcucuauuuuuauuuca

SEQ ID NO: 486846 - RNA, 22 nt, Human
gucagcacuuuuccgaggcaga

SEQ ID NO: 486847 - RNA, 22 nt, Human
cugggaggugaacagaaaaacu

SEQ ID NO: 486848 - RNA, 22 nt, Human
acuuuugguucuguaacuguga

SEQ ID NO: 486849 - RNA, 22 nt, Human
agcaguggaccucagugcuauu

SEQ ID NO: 486850 - RNA, 22 nt, Human
cugggcugcaucaaagaggcau

SEQ ID NO: 486851 - RNA, 22 nt, Human
cugugcuucgcaacuccaaggu

SEQ ID NO: 486852 - RNA, 22 nt, Human
aaggcagcccuggcucagccug

SEQ ID NO: 486853 - RNA, 22 nt, Human
acuguggccugcuguaugggcu

SEQ ID NO: 486854 - RNA, 22 nt, Human
cagaaauggaauuuuccaucac

SEQ ID NO: 486855 - RNA, 22 nt, Human
uucacuuauagggauguuauug

SEQ ID NO: 486856 - RNA, 22 nt, Human
uaaugugugucaucaguagagu

SEQ ID NO: 486857 - RNA, 22 nt, Human
aguguccaacucagcuugucaa

SEQ ID NO: 486858 - RNA, 22 nt, Human
aaaggucauugaaaaggaggaa

SEQ ID NO: 486859 - RNA, 22 nt, Human
uaacagcucuguguggcuguaa

SEQ ID NO: 486860 - RNA, 22 nt, Human
aaauugugagcuauagaucuag

SEQ ID NO: 486861 - RNA, 22 nt, Human
agacccugucaguguuaggaaa

SEQ ID NO: 486862 - RNA, 22 nt, Human
ccagcuuuuagugggcuuauua

SEQ ID NO: 486863 - RNA, 21 nt, Human
gccucugcugucuuauuguga

SEQ ID NO: 486864 - RNA, 22 nt, Human
agaauaauacugaaaugcugaa

SEQ ID NO: 486865 - RNA, 22 nt, Human
gaagaagguggcccagggguag

SEQ ID NO: 486866 - RNA, 22 nt, Human
gucaggauuauaauccccaugg

SEQ ID NO: 486867 - RNA, 22 nt, Human
ucacaacuugaagcugauuuaa

SEQ ID NO: 486868 - RNA, 22 nt, Human
uaaaugugcacagguuagaagg

SEQ ID NO: 486869 - RNA, 22 nt, Human
aaaaaugcugugguagcugugu

SEQ ID NO: 486870 - RNA, 22 nt, Human
cugccugcugccuguggagggu

SEQ ID NO: 486871 - RNA, 22 nt, Human
ucaaaggcauugccaauaagua

SEQ ID NO: 486872 - RNA, 22 nt, Human
gccugcagaacugugaggcaau

SEQ ID NO: 486873 - RNA, 23 nt, Human
ugacacauuuccuuuccacugca

SEQ ID NO: 486874 - RNA, 22 nt, Human
uggcagagucaucacaucugga

SEQ ID NO: 486875 - RNA, 22 nt, Human
ggugaccucaccuggucccacc

SEQ ID NO: 486876 - RNA, 22 nt, Human
ggcagcaguggcugcuauuguc

SEQ ID NO: 486877 - RNA, 21 nt, Human
agcugcuuucagcuccuagag

SEQ ID NO: 486878 - RNA, 22 nt, Human
acuuggagagcauugcugggga

SEQ ID NO: 486879 - RNA, 22 nt, Human
caagaaauuucuuaagaacuaa

SEQ ID NO: 486880 - RNA, 22 nt, Human
ucugagagcuguagaagccuau

SEQ ID NO: 486881 - RNA, 22 nt, Human
uccaggagguuuggaggaagca

SEQ ID NO: 486882 - RNA, 22 nt, Human
ccugcaggcugcaggccaguuc

SEQ ID NO: 486883 - RNA, 22 nt, Human
cugggccucaaucucagaguuu

SEQ ID NO: 486884 - RNA, 22 nt, Human
agccucugguccucccucagcu

SEQ ID NO: 486885 - RNA, 22 nt, Human
cacaagacuuauuuguguagaa

SEQ ID NO: 486886 - RNA, 22 nt, Human
guggugcaggccagcaggggcg

SEQ ID NO: 486887 - RNA, 22 nt, Human
cccugagcccauaguugacauu

SEQ ID NO: 486888 - RNA, 22 nt, Human
aggcugagacugugcauuagug

SEQ ID NO: 486889 - RNA, 22 nt, Human
auaucuuuguuuuugccaagau

SEQ ID NO: 486890 - RNA, 22 nt, Human
ccucacuuuccuuucuccuggg

SEQ ID NO: 486891 - RNA, 22 nt, Human
ugcagggcuauaacuccauucu

SEQ ID NO: 486892 - RNA, 22 nt, Human
uaauuuuacuuccugagcaccu

SEQ ID NO: 486893 - RNA, 22 nt, Human
uuugaaaggaaguuaauacuuu

SEQ ID NO: 486894 - RNA, 17 nt, Human
uuucagauucacuuucu

SEQ ID NO: 486895 - RNA, 22 nt, Human
ucccaggcaaaggcagcucauu

SEQ ID NO: 486896 - RNA, 22 nt, Human
cacaggugcuccucggggagcu

SEQ ID NO: 486897 - RNA, 22 nt, Human
caagagagaugcagcucacuca

SEQ ID NO: 486898 - RNA, 21 nt, Human
agagucugcauuucugacaag

SEQ ID NO: 486899 - RNA, 22 nt, Human
ggcugagcaauuuugaugacau

SEQ ID NO: 486900 - RNA, 23 nt, Human
agaggccaacuucuugccccucc

SEQ ID NO: 486901 - RNA, 22 nt, Human
aagggcugcuguagaagcagag

SEQ ID NO: 486902 - RNA, 19 nt, Human
aauguaguguuaugucaac

SEQ ID NO: 486903 - RNA, 22 nt, Human
uacccaggaggaaacugaggcu

SEQ ID NO: 486904 - RNA, 22 nt, Human
aggaagccaugguggacgucua

SEQ ID NO: 486905 - RNA, 22 nt, Human
cagagcagaagcgguccucaca

SEQ ID NO: 486906 - RNA, 22 nt, Human
auaaagauuucuuuuucucuac

SEQ ID NO: 486907 - RNA, 22 nt, Human
ucucuggggauggaccugggag

SEQ ID NO: 486908 - RNA, 21 nt, Human
ggcaggauggcaguggacccc

SEQ ID NO: 486909 - RNA, 22 nt, Human
cugccuggcuaaacucaagucg

SEQ ID NO: 486910 - RNA, 22 nt, Human
gacuucuauuaauaccucuacu

SEQ ID NO: 486911 - RNA, 22 nt, Human
gcugcccucccagggcaagcuu

SEQ ID NO: 486912 - RNA, 22 nt, Human
ugggggugaaagucuggacagu

SEQ ID NO: 486913 - RNA, 22 nt, Human
acagacauuuucuguauugccu

SEQ ID NO: 486914 - RNA, 22 nt, Human
cugagcugggcucucuugaggg

SEQ ID NO: 486915 - RNA, 22 nt, Human
auccugugcaaugacugcaucu

SEQ ID NO: 486916 - RNA, 22 nt, Human
ccagguggugaaagugggcccu

SEQ ID NO: 486917 - RNA, 19 nt, Human
cagaggcaccagguauaga

SEQ ID NO: 486918 - RNA, 22 nt, Human
ucugcagcuugcacaggcaggc

SEQ ID NO: 486919 - RNA, 22 nt, Human
auggccuggccagagcucugcu

SEQ ID NO: 486920 - RNA, 23 nt, Human
ugcagcugccucuggcgggccgg

SEQ ID NO: 486921 - RNA, 20 nt, Human
ugcuuccuggccacugcggg

SEQ ID NO: 486922 - RNA, 22 nt, Human
ucaugcccagagcaguaaauua

SEQ ID NO: 486923 - RNA, 22 nt, Human
aggacugacuuuugccaugaaa

SEQ ID NO: 486924 - RNA, 22 nt, Human
uauuucuuucagguauguguug

SEQ ID NO: 486925 - RNA, 22 nt, Human
acagccauagaugcuuauguaa

SEQ ID NO: 486926 - RNA, 21 nt, Human
uggcucugcucagagcagucc

SEQ ID NO: 486927 - RNA, 22 nt, Human
cacuguacuggguugaaggacg

SEQ ID NO: 486928 - RNA, 22 nt, Human
ucugucacccagagugcagugg

SEQ ID NO: 486929 - RNA, 22 nt, Human
cagagacagggcagggagugug

SEQ ID NO: 486930 - RNA, 22 nt, Human
ggcucuggagcacagacgucug

SEQ ID NO: 486931 - RNA, 22 nt, Human
ucauugcacuccagccugggca

SEQ ID NO: 486932 - RNA, 22 nt, Human
uuauuaggaaaaggucagaugu

SEQ ID NO: 486933 - RNA, 21 nt, Human
ucacagacuggucagugaggc

SEQ ID NO: 486934 - RNA, 22 nt, Human
cuggagcugcuguccuugggug

SEQ ID NO: 486935 - RNA, 22 nt, Human
gcagagugagccgaggcugcuc

SEQ ID NO: 486936 - RNA, 22 nt, Human
ggucagguuuuuaggagugacc

SEQ ID NO: 486937 - RNA, 22 nt, Human
ugcuggcccuggcucagggaac

SEQ ID NO: 486938 - RNA, 22 nt, Human
agagccagcauuugggcccugc

SEQ ID NO: 486939 - RNA, 22 nt, Human
gccuucaguaguauccucauga

SEQ ID NO: 486940 - RNA, 22 nt, Human
ggcagugagucccggagaggcc

SEQ ID NO: 486941 - RNA, 22 nt, Human
ugcucugguccucccucggcgc

SEQ ID NO: 486942 - RNA, 22 nt, Human
uccuggaguugugcagugcaca

SEQ ID NO: 486943 - RNA, 22 nt, Human
cucaggggaccuggcuccgagu

SEQ ID NO: 486944 - RNA, 19 nt, Human
gcaucagagcagaaggggu

SEQ ID NO: 486945 - RNA, 22 nt, Human
ugagagugauugguucgaaugu

SEQ ID NO: 486946 - RNA, 22 nt, Human
ugguccaggguguaguacagag

SEQ ID NO: 486947 - RNA, 22 nt, Human
agggaggaaggauguuccaaag

SEQ ID NO: 486948 - RNA, 19 nt, Human
guagggacagugguucuga

SEQ ID NO: 486949 - RNA, 22 nt, Human
uugaggagcacuagucagguau

SEQ ID NO: 486950 - RNA, 22 nt, Human
cccaggagguggagguugcagc

SEQ ID NO: 486951 - RNA, 22 nt, Human
ugcagaagaaugagcuuggagu

SEQ ID NO: 486952 - RNA, 22 nt, Human
agugacugggcagggcagggcc

SEQ ID NO: 486953 - RNA, 22 nt, Human
caagauggguguugugaugguu

SEQ ID NO: 486954 - RNA, 22 nt, Human
agggcagaccacgugcaaggau

SEQ ID NO: 486955 - RNA, 20 nt, Human
uccaugaguuagagacuaua

SEQ ID NO: 486956 - RNA, 22 nt, Human
uucaaugauuuuuagggaucau

SEQ ID NO: 486957 - RNA, 22 nt, Human
accaggcaugauguggagcaca

SEQ ID NO: 486958 - RNA, 22 nt, Human
agcacagaguugcagagagcgu

SEQ ID NO: 486959 - RNA, 22 nt, Human
aggaggaauacaauccagcagc

SEQ ID NO: 486960 - RNA, 22 nt, Human
uacuuugucauucuaaccuucc

SEQ ID NO: 486961 - RNA, 18 nt, Human
acucaggaaaugaugaca

SEQ ID NO: 486962 - RNA, 22 nt, Human
uggcucagagccuugagagcug

SEQ ID NO: 486963 - RNA, 22 nt, Human
agcagcauucucugguaugggg

SEQ ID NO: 486964 - RNA, 22 nt, Human
uuaggaaauuaugguuucagau

SEQ ID NO: 486965 - RNA, 22 nt, Human
uggcagagagacucuccuugau

SEQ ID NO: 486966 - RNA, 22 nt, Human
agcugccaaguuucucaguuua

SEQ ID NO: 486967 - RNA, 22 nt, Human
gcccacacaccagcucaggagg

SEQ ID NO: 486968 - RNA, 22 nt, Human
cagccagugguugaagaugcag

SEQ ID NO: 486969 - RNA, 22 nt, Human
cccuggaggcggagcuugcagu

SEQ ID NO: 486970 - RNA, 22 nt, Human
augaggcauuccacucaaacuc

SEQ ID NO: 486971 - RNA, 22 nt, Human
uuccucagccagcacuuagggg

SEQ ID NO: 486972 - RNA, 22 nt, Human
ucagaagagcuggugcugccug

SEQ ID NO: 486973 - RNA, 22 nt, Human
cacccagcacagagggaggcga

SEQ ID NO: 486974 - RNA, 22 nt, Human
gccugagaaggacacagcaggu

SEQ ID NO: 486975 - RNA, 22 nt, Human
cacaggagauugaucuauuggu

SEQ ID NO: 486976 - RNA, 22 nt, Human
aauuccugucuuaacaguucug

SEQ ID NO: 486977 - RNA, 19 nt, Human
aauucuguuucagcagauc

SEQ ID NO: 486978 - RNA, 22 nt, Human
ccagcuggugggucuuucucug

SEQ ID NO: 486979 - RNA, 23 nt, Human
ggccucuguguucugcccacaug

SEQ ID NO: 486980 - RNA, 22 nt, Human
gcccugggauuggguggaggcu

SEQ ID NO: 486981 - RNA, 22 nt, Human
agaggccaucugcucugugggg

SEQ ID NO: 486982 - RNA, 22 nt, Human
uuagggcaggcaugagagaacu

SEQ ID NO: 486983 - RNA, 22 nt, Human
acagagguaggacaugagauau

SEQ ID NO: 486984 - RNA, 22 nt, Human
cuggggggagcugcguccagca

SEQ ID NO: 486985 - RNA, 22 nt, Human
gagugguaggcaguguuaggaa

SEQ ID NO: 486986 - RNA, 22 nt, Human
cccagcagggucucugugucua

SEQ ID NO: 486987 - RNA, 22 nt, Human
aagcuuuagagaugaguuccuu

SEQ ID NO: 486988 - RNA, 23 nt, Human
uugcuucugugcaauucaguacu

SEQ ID NO: 486989 - RNA, 22 nt, Human
ugguacacauguccaaggucag

SEQ ID NO: 486990 - RNA, 22 nt, Human
cagaaauguuuauauguggugu

SEQ ID NO: 486991 - RNA, 22 nt, Human
uaauccaaaacugaaucugugg

SEQ ID NO: 486992 - RNA, 22 nt, Human
ugguaaauauguccauucucuu

SEQ ID NO: 486993 - RNA, 22 nt, Human
agcugagcauuugauccaccuc

SEQ ID NO: 486994 - RNA, 22 nt, Human
gcagccuguuguaccagccugu

SEQ ID NO: 486995 - RNA, 22 nt, Human
auacaucuuccuuuuaaaaugc

SEQ ID NO: 486996 - RNA, 22 nt, Human
gcuguggccaacaaaccacuuu

SEQ ID NO: 486997 - RNA, 20 nt, Human
ucaaaggcaaaggugggugu

SEQ ID NO: 486998 - RNA, 22 nt, Human
ugcugugcuggcggcagaggcc

SEQ ID NO: 486999 - RNA, 22 nt, Human
gcugaggccccagggugauggg

SEQ ID NO: 487000 - RNA, 22 nt, Human
uuugaaaguguuuacuugggaa

SEQ ID NO: 487001 - RNA, 22 nt, Human
uucauuccuucccuaagcaacu

SEQ ID NO: 487002 - RNA, 20 nt, Human
ggggcagguuuuuauggcua

SEQ ID NO: 487003 - RNA, 22 nt, Human
cagaacauuccaugugcccugc

SEQ ID NO: 487004 - RNA, 22 nt, Human
cugagagguaagcagcgcagug

SEQ ID NO: 487005 - RNA, 22 nt, Human
agaaaugacacacaugagacau

SEQ ID NO: 487006 - RNA, 22 nt, Human
guuaauuugcagcuuucgagcu

SEQ ID NO: 487007 - RNA, 22 nt, Human
uggccuguggcuuaaggucugu

SEQ ID NO: 487008 - RNA, 22 nt, Human
aggcucagccugggccuagagc

SEQ ID NO: 487009 - RNA, 22 nt, Human
gacaauuucucaauauagaaac

SEQ ID NO: 487010 - RNA, 22 nt, Human
cagugcauaaucuaaauggggg

SEQ ID NO: 487011 - RNA, 20 nt, Human
uguugauuggugucaucuca

SEQ ID NO: 487012 - RNA, 22 nt, Human
ugggcugcggauaggccucgga

SEQ ID NO: 487013 - RNA, 22 nt, Human
uggcagaguaggauggcccugu

SEQ ID NO: 487014 - RNA, 23 nt, Human
uucuuucaagaaguucacagugc

SEQ ID NO: 487015 - RNA, 22 nt, Human
cagcccuggccccagguggucu

SEQ ID NO: 487016 - RNA, 22 nt, Human
agacuucucaguuuuauuagua

SEQ ID NO: 487017 - RNA, 22 nt, Human
ccagcugacgaugccuggucuc

SEQ ID NO: 487018 - RNA, 21 nt, Human
uucuuuccccagaggacuaaa

SEQ ID NO: 487019 - RNA, 22 nt, Human
ccucugccaccucccacgaggc

SEQ ID NO: 487020 - RNA, 22 nt, Human
ccaggagcuggagggugcagug

SEQ ID NO: 487021 - RNA, 20 nt, Human
uccugguggauacugcuuaa

SEQ ID NO: 487022 - RNA, 22 nt, Human
gggcugagccacagcuuuuguu

SEQ ID NO: 487023 - RNA, 22 nt, Human
cucaggaugcaggucacaggac

SEQ ID NO: 487024 - RNA, 22 nt, Human
ucccaggguuacagccagggca

SEQ ID NO: 487025 - RNA, 22 nt, Human
ggccucugguucacagggagga

SEQ ID NO: 487026 - RNA, 20 nt, Human
acagaaagagagaaugucag

SEQ ID NO: 487027 - RNA, 22 nt, Human
agcagugggggaguguuaguuu

SEQ ID NO: 487028 - RNA, 22 nt, Human
agaauuguaagcaauuugauua

SEQ ID NO: 487029 - RNA, 22 nt, Human
caggcagcugggucaccguccc

SEQ ID NO: 487030 - RNA, 22 nt, Human
uuugaaagaauuuauguacuuu

SEQ ID NO: 487031 - RNA, 22 nt, Human
uucuugauuucaugcaguuaag

SEQ ID NO: 487032 - RNA, 22 nt, Human
auaagaaacauuauucuuucca

SEQ ID NO: 487033 - RNA, 22 nt, Human
aagagggcugcaaucuuauugc

SEQ ID NO: 487034 - RNA, 20 nt, Human
cuccaggggaagagccuucc

SEQ ID NO: 487035 - RNA, 22 nt, Human
ccugccucaucaacuugucgug

SEQ ID NO: 487036 - RNA, 20 nt, Human
ucccaggcugggcuccagcu

SEQ ID NO: 487037 - RNA, 22 nt, Human
ugaaggagggaagaaggcucug

SEQ ID NO: 487038 - RNA, 22 nt, Human
gccuggagaauuaaaaggaagg

SEQ ID NO: 487039 - RNA, 22 nt, Human
cagccacguagcccuuggccgu

SEQ ID NO: 487040 - RNA, 22 nt, Human
ccaggccugauugggaaucuug

SEQ ID NO: 487041 - RNA, 22 nt, Human
caggugccucaggaugagacaa

SEQ ID NO: 487042 - RNA, 22 nt, Human
aaguaaaagcuuuaccaugcgc

SEQ ID NO: 487043 - RNA, 22 nt, Human
ucaggagucugugcaguuccac

SEQ ID NO: 487044 - RNA, 22 nt, Human
caggaggaggguacaccaucag

SEQ ID NO: 487045 - RNA, 22 nt, Human
agcaggaaggucugugugaguc

SEQ ID NO: 487046 - RNA, 20 nt, Human
agucccagaucaaauuucug

SEQ ID NO: 487047 - RNA, 22 nt, Human
ggaaccaguggaaugauaugcu

SEQ ID NO: 487048 - RNA, 22 nt, Human
aaagcagguugcaauuacagug

SEQ ID NO: 487049 - RNA, 22 nt, Human
cuggccugaucucaugcugucc

SEQ ID NO: 487050 - RNA, 22 nt, Human
agcugccaggccccugagaacc

SEQ ID NO: 487051 - RNA, 22 nt, Human
aaaucagucccucuuggaauuu

SEQ ID NO: 487052 - RNA, 22 nt, Human
gccagccugugggggcucugug

SEQ ID NO: 487053 - RNA, 22 nt, Human
agcagcagauccaaaaaaugug

SEQ ID NO: 487054 - RNA, 22 nt, Human
auuccaaaaggauguuagaaug

SEQ ID NO: 487055 - RNA, 22 nt, Human
ccaggcucaggugcgagagaca

SEQ ID NO: 487056 - RNA, 22 nt, Human
cagugcuguuguaagcucauug

SEQ ID NO: 487057 - RNA, 22 nt, Human
uaccucaugcuguacagcacgu

SEQ ID NO: 487058 - RNA, 22 nt, Human
uagggcuauaagagaauaagac

SEQ ID NO: 487059 - RNA, 22 nt, Human
uguucuugagccuuuagaccua

SEQ ID NO: 487060 - RNA, 22 nt, Human
cagacacagcaauucuguguug

SEQ ID NO: 487061 - RNA, 22 nt, Human
ggccccugcggacugccuagag

SEQ ID NO: 487062 - RNA, 22 nt, Human
aggcucagccccugggaggaga

SEQ ID NO: 487063 - RNA, 22 nt, Human
cagcuuugauucuuucugccau

SEQ ID NO: 487064 - RNA, 22 nt, Human
ucucuuuuauguacacccugac

SEQ ID NO: 487065 - RNA, 22 nt, Human
auucuccacacauccagaccuu

SEQ ID NO: 487066 - RNA, 22 nt, Human
ggucccaggcucccucuugucc

SEQ ID NO: 487067 - RNA, 22 nt, Human
uuugaacaagagcuucacauua

SEQ ID NO: 487068 - RNA, 22 nt, Human
ccugggugucaugggcagcugg

SEQ ID NO: 487069 - RNA, 22 nt, Human
ugaaaaaccucaguccgcuuua

SEQ ID NO: 487070 - RNA, 22 nt, Human
aggagagagcugagcuuugcug

SEQ ID NO: 487071 - RNA, 17 nt, Human
agcagcugaagcagcca

SEQ ID NO: 487072 - RNA, 22 nt, Human
ugcagaggaccauuguccugga

SEQ ID NO: 487073 - RNA, 22 nt, Human
uggcugaggagagggcggaagu

SEQ ID NO: 487074 - RNA, 22 nt, Human
aaauucuuucauggcuaauaag

SEQ ID NO: 487075 - RNA, 22 nt, Human
gcuggguggaucggaggcucug

SEQ ID NO: 487076 - RNA, 22 nt, Human
uggguggaauaaaucaguucug

SEQ ID NO: 487077 - RNA, 22 nt, Human
ccugggucacucaggcaggcgg

SEQ ID NO: 487078 - RNA, 22 nt, Human
agcucucaagauaagaaagaac

SEQ ID NO: 487079 - RNA, 22 nt, Human
agggaggucuuugaggggcuua

SEQ ID NO: 487080 - RNA, 21 nt, Human
cuggacugaggagacagucgc

SEQ ID NO: 487081 - RNA, 22 nt, Human
uagcccagagucccaauuccag

SEQ ID NO: 487082 - RNA, 22 nt, Human
aggggacacggcuucuccaggg

SEQ ID NO: 487083 - RNA, 22 nt, Human
aaggcugugucagaagcucccu

SEQ ID NO: 487084 - RNA, 22 nt, Human
uauuuccugcauggugauguaa

SEQ ID NO: 487085 - RNA, 22 nt, Human
ugaggaagccaaacagcuacac

SEQ ID NO: 487086 - RNA, 22 nt, Human
agcagggcagcugaugcgcacg

SEQ ID NO: 487087 - RNA, 22 nt, Human
accaggagccauagagucaggc

SEQ ID NO: 487088 - RNA, 20 nt, Human
caagcccucuuuagccugcc

SEQ ID NO: 487089 - RNA, 22 nt, Human
aggggcuggcuuaucugagagu

SEQ ID NO: 487090 - RNA, 22 nt, Human
ccacacugaaccucagugucuu

SEQ ID NO: 487091 - RNA, 22 nt, Human
augaaauaucuugaagaaauuc

SEQ ID NO: 487092 - RNA, 22 nt, Human
agcugucuccagauacaggauu

SEQ ID NO: 487093 - RNA, 22 nt, Human
ccaggcucugagccucacucuu

SEQ ID NO: 487094 - RNA, 22 nt, Human
uucuaguucccacauaguugcc

SEQ ID NO: 487095 - RNA, 22 nt, Human
agaaaagggcaggagggauaca

SEQ ID NO: 487096 - RNA, 22 nt, Human
uguaugcaaauuuauuagcaca

SEQ ID NO: 487097 - RNA, 22 nt, Human
agaggagcugggaggcccucgu

SEQ ID NO: 487098 - RNA, 22 nt, Human
ccaucccuucucuggccagcag

SEQ ID NO: 487099 - RNA, 23 nt, Human
agcuggaggcugucuacucccaa

SEQ ID NO: 487100 - RNA, 22 nt, Human
cugagccuuauucaccagcccu

SEQ ID NO: 487101 - RNA, 19 nt, Human
ggcugccuuuccuuaccag

SEQ ID NO: 487102 - RNA, 22 nt, Human
cuggccugaggucggcuguagg

SEQ ID NO: 487103 - RNA, 22 nt, Human
uggcagcauguuauguaaggaa

SEQ ID NO: 487104 - RNA, 22 nt, Human
cagcucugugggagcguaugug

SEQ ID NO: 487105 - RNA, 22 nt, Human
ggccugugucugugccuguccu

SEQ ID NO: 487106 - RNA, 22 nt, Human
aaauagcacagcagcugaggcu

SEQ ID NO: 487107 - RNA, 22 nt, Human
agcugccagcaucccggaaggg

SEQ ID NO: 487108 - RNA, 22 nt, Human
uccucuggcucuuucccuagga

SEQ ID NO: 487109 - RNA, 22 nt, Human
ccucugcaccauagccuucagc

SEQ ID NO: 487110 - RNA, 22 nt, Human
guggaggacaaaagaagccuuu

SEQ ID NO: 487111 - RNA, 22 nt, Human
uuaacauuguccuuagcagauu

SEQ ID NO: 487112 - RNA, 18 nt, Human
aucucccauuggccaagg

SEQ ID NO: 487113 - RNA, 22 nt, Human
caguggagaggcaugcuuggca

SEQ ID NO: 487114 - RNA, 22 nt, Human
ugucaguguauacauacaguau

SEQ ID NO: 487115 - RNA, 22 nt, Human
agagcuggggccagagucaagg

SEQ ID NO: 487116 - RNA, 21 nt, Human
ccagacuggccuaugugguag

SEQ ID NO: 487117 - RNA, 22 nt, Human
aagcugccuugcugaggagaaa

SEQ ID NO: 487118 - RNA, 22 nt, Human
agcaggggcaggguuuugugcu

SEQ ID NO: 487119 - RNA, 22 nt, Human
gagcugggacauggguccucuc

SEQ ID NO: 487120 - RNA, 22 nt, Human
cagggcucagaagacagaccuc

SEQ ID NO: 487121 - RNA, 22 nt, Human
gcaggugauucacccugggccu

SEQ ID NO: 487122 - RNA, 22 nt, Human
aagagcuggucacagguccauu

SEQ ID NO: 487123 - RNA, 22 nt, Human
ugaaaucuuuaguuucuguccc

SEQ ID NO: 487124 - RNA, 22 nt, Human
ccagggcuggguuugucggugu

SEQ ID NO: 487125 - RNA, 22 nt, Human
aguuuauagcccagauucaugg

SEQ ID NO: 487126 - RNA, 22 nt, Human
gcucucugccauaugaggauac

SEQ ID NO: 487127 - RNA, 22 nt, Human
uccugcagcugauaaauacagu

SEQ ID NO: 487128 - RNA, 23 nt, Human
cugaggccugcugcguucagguu

SEQ ID NO: 487129 - RNA, 22 nt, Human
cagguccccuccccuaccaggc

SEQ ID NO: 487130 - RNA, 22 nt, Human
guuuauuauacaacaaaagcua

SEQ ID NO: 487131 - RNA, 22 nt, Human
guauuuucaugauuucagacca

SEQ ID NO: 487132 - RNA, 22 nt, Human
gggagcuggagcuggaagacuc

SEQ ID NO: 487133 - RNA, 22 nt, Human
ucacagaaauaagauaguuauu

SEQ ID NO: 487134 - RNA, 23 nt, Human
aucaagucaucagcaaaauacau

SEQ ID NO: 487135 - RNA, 22 nt, Human
auccagcuuugucuggucuucg

SEQ ID NO: 487136 - RNA, 22 nt, Human
auguuacaauucaaaaugcugc

SEQ ID NO: 487137 - RNA, 23 nt, Human
agccucuuuucuccugcccugca

SEQ ID NO: 487138 - RNA, 22 nt, Human
ugggcuccaauuuguccuuuca

SEQ ID NO: 487139 - RNA, 22 nt, Human
uggcccucagucuugcuccugc

SEQ ID NO: 487140 - RNA, 22 nt, Human
cuguccagucuuuagcaagcug

SEQ ID NO: 487141 - RNA, 22 nt, Human
ugggccagcaauugcugcucag

SEQ ID NO: 487142 - RNA, 22 nt, Human
gagauuggccuggcuugccaac

SEQ ID NO: 487143 - RNA, 23 nt, Human
cagggccaggcagcagcugucac

SEQ ID NO: 487144 - RNA, 22 nt, Human
uuccauaaucaccuuauucuuu

SEQ ID NO: 487145 - RNA, 22 nt, Human
gggcugagugggccucuuacuu

SEQ ID NO: 487146 - RNA, 22 nt, Human
uaauuucacugauaugaaguca

SEQ ID NO: 487147 - RNA, 22 nt, Human
uccaggaggguuuucugccuuc

SEQ ID NO: 487148 - RNA, 22 nt, Human
cagucccuaguggagcucacag

SEQ ID NO: 487149 - RNA, 21 nt, Human
gauugaaaccauggcagugag

SEQ ID NO: 487150 - RNA, 22 nt, Human
uccacugcagcuucugauggaa

SEQ ID NO: 487151 - RNA, 22 nt, Human
caggcuugcugcuagagcacuu

SEQ ID NO: 487152 - RNA, 22 nt, Human
ggcaggguccacaccugggaaa

SEQ ID NO: 487153 - RNA, 22 nt, Human
agcuggcauacuuugcuaggaa

SEQ ID NO: 487154 - RNA, 22 nt, Human
agccagugcaacagcagugaag

SEQ ID NO: 487155 - RNA, 22 nt, Human
uccaugagggacacuggaugcu

SEQ ID NO: 487156 - RNA, 22 nt, Human
gggcugucaugugucagugacc

SEQ ID NO: 487157 - RNA, 22 nt, Human
cuggagcuaggaaguccaagau

SEQ ID NO: 487158 - RNA, 22 nt, Human
ugcuucucccaaccagggccug

SEQ ID NO: 487159 - RNA, 22 nt, Human
ggcucugcccagguggacagca

SEQ ID NO: 487160 - RNA, 22 nt, Human
gggcuaggcuuggccagcacug

SEQ ID NO: 487161 - RNA, 22 nt, Human
acugagcugcuugaagugaacu

SEQ ID NO: 487162 - RNA, 22 nt, Human
agccccugggaguagcugcugc

SEQ ID NO: 487163 - RNA, 22 nt, Human
auucuguauuucuaauaagauc

SEQ ID NO: 487164 - RNA, 22 nt, Human
cgagaguggacagggcgcagcu

SEQ ID NO: 487165 - RNA, 22 nt, Human
gcagcuuuagaaacaagggcug

SEQ ID NO: 487166 - RNA, 22 nt, Human
uagggcucgggcacaggacagg

SEQ ID NO: 487167 - RNA, 22 nt, Human
uccaggcaugguguaauuuugc

SEQ ID NO: 487168 - RNA, 22 nt, Human
agucaccaucuguggcagccug

SEQ ID NO: 487169 - RNA, 22 nt, Human
ggcagggagagcaugcugauaa

SEQ ID NO: 487170 - RNA, 22 nt, Human
aauaauuuugagagccuggaaa

SEQ ID NO: 487171 - RNA, 22 nt, Human
agcugggcagacugcagugguu

SEQ ID NO: 487172 - RNA, 22 nt, Human
cuucacauguuggaguccuuug

SEQ ID NO: 487173 - RNA, 22 nt, Human
uggagcucaaaggccuguggga

SEQ ID NO: 487174 - RNA, 22 nt, Human
ucugccuuggcaaccacagcuu

SEQ ID NO: 487175 - RNA, 20 nt, Human
uuuacauuuugaaacaguga

SEQ ID NO: 487176 - RNA, 22 nt, Human
ugucauuuucuaaucuguuguc

SEQ ID NO: 487177 - RNA, 19 nt, Human
gcugucugaugcugagguc

SEQ ID NO: 487178 - RNA, 22 nt, Human
caugaagcacagcucucuuuuu

SEQ ID NO: 487179 - RNA, 22 nt, Human
gaccaaggaagaggggagccag

SEQ ID NO: 487180 - RNA, 22 nt, Human
agcugcuacugcucugccagag

SEQ ID NO: 487181 - RNA, 19 nt, Human
gagcugagaguagcacugg

SEQ ID NO: 487182 - RNA, 22 nt, Human
caggccuggcccccggcacacc

SEQ ID NO: 487183 - RNA, 22 nt, Human
ugcuguuauacuuagcugguua

SEQ ID NO: 487184 - RNA, 22 nt, Human
gagggcucugucuggaagggaa

SEQ ID NO: 487185 - RNA, 22 nt, Human
gaaaaagugaccuugguagcua

SEQ ID NO: 487186 - RNA, 22 nt, Human
cucagaauuacaucccauuuua

SEQ ID NO: 487187 - RNA, 22 nt, Human
cuggaaugagcagggcuuaugg

SEQ ID NO: 487188 - RNA, 23 nt, Human
ucugcucugaaguucggcugagc

SEQ ID NO: 487189 - RNA, 22 nt, Human
ucccagcacgucugcuguuucu

SEQ ID NO: 487190 - RNA, 22 nt, Human
ucagcagucacauguuguccca

SEQ ID NO: 487191 - RNA, 18 nt, Human
cgaggcaggcggaucacg

SEQ ID NO: 487192 - RNA, 21 nt, Human
aggcucagcagguguauaaag

SEQ ID NO: 487193 - RNA, 22 nt, Human
gcaguggauccaaugguaucuu

SEQ ID NO: 487194 - RNA, 22 nt, Human
cagcauggggaucacuguaggc

SEQ ID NO: 487195 - RNA, 22 nt, Human
caguacuuguccucagguguua

SEQ ID NO: 487196 - RNA, 22 nt, Human
aguuggagugaacaugagauug

SEQ ID NO: 487197 - RNA, 19 nt, Human
ucaaagucugagucacuuu

SEQ ID NO: 487198 - RNA, 22 nt, Human
auguaucaacaaauuguacagu

SEQ ID NO: 487199 - RNA, 22 nt, Human
uggcugagaccuucccaaauuc

SEQ ID NO: 487200 - RNA, 19 nt, Human
cugucaggggcuggauguu

SEQ ID NO: 487201 - RNA, 22 nt, Human
ugaccugcagucaagaggggaa

SEQ ID NO: 487202 - RNA, 19 nt, Human
cugaggcccauguaccaug

SEQ ID NO: 487203 - RNA, 19 nt, Human
auuuacugccuaaaaucuc

SEQ ID NO: 487204 - RNA, 22 nt, Human
agccuggcacugaggcagggcg

SEQ ID NO: 487205 - RNA, 20 nt, Human
auuuggcaugaaguauugau

SEQ ID NO: 487206 - RNA, 22 nt, Human
cagagccugccaccuuucuccc

SEQ ID NO: 487207 - RNA, 20 nt, Human
ugaaaaggucaggagacaug

SEQ ID NO: 487208 - RNA, 22 nt, Human
ucacagugaugacgugggagca

SEQ ID NO: 487209 - RNA, 23 nt, Human
cuacaagagcaagcauggacaag

SEQ ID NO: 487210 - RNA, 22 nt, Human
agacaggcuuugcuguauauca

SEQ ID NO: 487211 - RNA, 19 nt, Human
gccugagccagccaugcaa

SEQ ID NO: 487212 - RNA, 22 nt, Human
acugcuuacaaaaggaaagaau

SEQ ID NO: 487213 - RNA, 22 nt, Human
aggcacugaagaacucuuuuug

SEQ ID NO: 487214 - RNA, 22 nt, Human
cuuaacagauacaucugugguu

SEQ ID NO: 487215 - RNA, 22 nt, Human
aacugcauuugcauaaguccau

SEQ ID NO: 487216 - RNA, 22 nt, Human
gccuggaggaauguagcugagg

SEQ ID NO: 487217 - RNA, 22 nt, Human
ucagggaccccucugaguggag

SEQ ID NO: 487218 - RNA, 22 nt, Human
acacagggucuagaguuaggcc

SEQ ID NO: 487219 - RNA, 22 nt, Human
uuauucuucuucucuugccagg

SEQ ID NO: 487220 - RNA, 22 nt, Human
gacacauagaucuaucucacuc

SEQ ID NO: 487221 - RNA, 22 nt, Human
gcucugugggugaguagaaucu

SEQ ID NO: 487222 - RNA, 22 nt, Human
acaguguuuuagaaaagcuuga

SEQ ID NO: 487223 - RNA, 19 nt, Human
ggcuccuguggcugcagcc

SEQ ID NO: 487224 - RNA, 22 nt, Human
accuuuuuucagaacucuaaag

SEQ ID NO: 487225 - RNA, 22 nt, Human
gacacagcacuguacaaggaau

SEQ ID NO: 487226 - RNA, 22 nt, Human
acuaagaccuagauacuagggg

SEQ ID NO: 487227 - RNA, 22 nt, Human
uuugaaaauuuaagugcuacac

SEQ ID NO: 487228 - RNA, 22 nt, Human
cugggccugucagggcuuuuug

SEQ ID NO: 487229 - RNA, 22 nt, Human
ccagccuggagggcaguggugg

SEQ ID NO: 487230 - RNA, 22 nt, Human
aaagccuuggucaucugguucc

SEQ ID NO: 487231 - RNA, 22 nt, Human
aguuccagcugugaccagaaaa

SEQ ID NO: 487232 - RNA, 16 nt, Human
uccaggcauaucugag

SEQ ID NO: 487233 - RNA, 21 nt, Human
gcugugcacauaguagaagug

SEQ ID NO: 487234 - RNA, 23 nt, Human
gcauugucuccccacuucugggc

SEQ ID NO: 487235 - RNA, 19 nt, Human
gcugcuggcucuggcugga

SEQ ID NO: 487236 - RNA, 22 nt, Human
ugggcuguggagcaccuuugca

SEQ ID NO: 487237 - RNA, 22 nt, Human
aaguguuuggggaucauuuuaa

SEQ ID NO: 487238 - RNA, 22 nt, Human
cuccugagcucugaggaagcuu

SEQ ID NO: 487239 - RNA, 22 nt, Human
cugggcugagccugggcugugu

SEQ ID NO: 487240 - RNA, 22 nt, Human
uauacagaaccgccugaagucu

SEQ ID NO: 487241 - RNA, 22 nt, Human
acaggcugcugggcuccgugcu

SEQ ID NO: 487242 - RNA, 22 nt, Human
gccagcucccaagugagccccu

SEQ ID NO: 487243 - RNA, 22 nt, Human
uaggagaggugaauggcacacu

SEQ ID NO: 487244 - RNA, 22 nt, Human
gccuaggaguacagaaugguuu

SEQ ID NO: 487245 - RNA, 22 nt, Human
uguccucuuccagugcuccuuc

SEQ ID NO: 487246 - RNA, 20 nt, Human
cagcaggaaaagugccucag

SEQ ID NO: 487247 - RNA, 23 nt, Human
agccagggcacugguggagauug

SEQ ID NO: 487248 - RNA, 22 nt, Human
gcuuucuugguucugcaggggc

SEQ ID NO: 487249 - RNA, 22 nt, Human
gcagggaagacccggagcagcg

SEQ ID NO: 487250 - RNA, 22 nt, Human
cuuucacaguccugacugagcg

SEQ ID NO: 487251 - RNA, 22 nt, Human
uuagaaaaaggcuguggucuua

SEQ ID NO: 487252 - RNA, 22 nt, Human
cagugagggcccccuuccaggu

SEQ ID NO: 487253 - RNA, 22 nt, Human
aaagccagcucugagcugcacc

SEQ ID NO: 487254 - RNA, 22 nt, Human
ggccucugaggacagccuuggc

SEQ ID NO: 487255 - RNA, 22 nt, Human
cucaggauuaaggaaucuaaau

SEQ ID NO: 487256 - RNA, 20 nt, Human
ucucaggccccaguuuucuu

SEQ ID NO: 487257 - RNA, 22 nt, Human
cagagcagaaaccugggugauu

SEQ ID NO: 487258 - RNA, 22 nt, Human
gcagccaccucccauggcgggg

SEQ ID NO: 487259 - RNA, 22 nt, Human
ucucugcucugugccucaguuu

SEQ ID NO: 487260 - RNA, 22 nt, Human
ucucccaggcugcccuguggac

SEQ ID NO: 487261 - RNA, 22 nt, Human
uugaagcaugguacuuguucaa

SEQ ID NO: 487262 - RNA, 22 nt, Human
uuucaaugacacaaaagagaaa

SEQ ID NO: 487263 - RNA, 22 nt, Human
cacaaaaguaggaggcaggcgg

SEQ ID NO: 487264 - RNA, 22 nt, Human
uggcccugccacucacugcuga

SEQ ID NO: 487265 - RNA, 22 nt, Human
aagggcuggaucucucugagca

SEQ ID NO: 487266 - RNA, 22 nt, Human
aauguguauacuggcaauuaag

SEQ ID NO: 487267 - RNA, 22 nt, Human
ucucacugcaaauauuauguau

SEQ ID NO: 487268 - RNA, 23 nt, Human
gagugcagaauagacaugcagug

SEQ ID NO: 487269 - RNA, 22 nt, Human
ccugucuguccucucaugagcc

SEQ ID NO: 487270 - RNA, 22 nt, Human
gccugcaggcuguaguuuguga

SEQ ID NO: 487271 - RNA, 22 nt, Human
uucauaaugagguccuagaggc

SEQ ID NO: 487272 - RNA, 22 nt, Human
ccugagggcgccgagcucccag

SEQ ID NO: 487273 - RNA, 22 nt, Human
cagcagcaaaucuagaagagga

SEQ ID NO: 487274 - RNA, 18 nt, Human
cuguccaguagacucugc

SEQ ID NO: 487275 - RNA, 23 nt, Human
acagggcauugcuggccucgagg

SEQ ID NO: 487276 - RNA, 22 nt, Human
ccugggagugucagacuugcuu

SEQ ID NO: 487277 - RNA, 22 nt, Human
ugucuuuucuacuguaagcaua

SEQ ID NO: 487278 - RNA, 22 nt, Human
ucccagggugcgccugcccucg

SEQ ID NO: 487279 - RNA, 22 nt, Human
agaaaucuaagaugcucaagga

SEQ ID NO: 487280 - RNA, 22 nt, Human
aagaugcaugcugaagcuggcu

SEQ ID NO: 487281 - RNA, 22 nt, Human
cagguggguguaugaaugcaaa

SEQ ID NO: 487282 - RNA, 22 nt, Human
cccaggcacaccccgaacggaa

SEQ ID NO: 487283 - RNA, 22 nt, Human
guggcccucugauagggucagg

SEQ ID NO: 487284 - RNA, 22 nt, Human
caggaaggcgcggcugugccug

SEQ ID NO: 487285 - RNA, 22 nt, Human
cacagacccagaagggaugaag

SEQ ID NO: 487286 - RNA, 22 nt, Human
agcagggcuguguagguaauga

SEQ ID NO: 487287 - RNA, 22 nt, Human
cagggcuggcucaugaaaaguu

SEQ ID NO: 487288 - RNA, 19 nt, Human
ucaggacugacuugaaguc

SEQ ID NO: 487289 - RNA, 22 nt, Human
uggcagagaaccugggcuuugu

SEQ ID NO: 487290 - RNA, 22 nt, Human
gucaaguuaagauaaggucaug

SEQ ID NO: 487291 - RNA, 22 nt, Human
caagagcuagaaauugguuaga

SEQ ID NO: 487292 - RNA, 22 nt, Human
cuguggcaggaagggacuagca

SEQ ID NO: 487293 - RNA, 22 nt, Human
auggccuggggagcaugggaag

SEQ ID NO: 487294 - RNA, 22 nt, Human
cagcuuugccaaguaaggucuu

SEQ ID NO: 487295 - RNA, 22 nt, Human
gaaggcuggaaggcaaguagga

SEQ ID NO: 487296 - RNA, 22 nt, Human
uuuucauuguuacuaugagcua

SEQ ID NO: 487297 - RNA, 22 nt, Human
ccugcagcuccggauuucuggg

SEQ ID NO: 487298 - RNA, 22 nt, Human
ugagccuggcggaagcagcgug

SEQ ID NO: 487299 - RNA, 18 nt, Human
ucucugaauauuuuaugu

SEQ ID NO: 487300 - RNA, 22 nt, Human
agugaaaugauucugagcaaga

SEQ ID NO: 487301 - RNA, 22 nt, Human
ggucagcagugcagggcagagc

SEQ ID NO: 487302 - RNA, 20 nt, Human
ccagagcagccacugaaguu

SEQ ID NO: 487303 - RNA, 22 nt, Human
ugggcugcugagaaugagagag

SEQ ID NO: 487304 - RNA, 22 nt, Human
aauguacaauaagacaaagagg

SEQ ID NO: 487305 - RNA, 20 nt, Human
cagagaccaggccagguguc

SEQ ID NO: 487306 - RNA, 22 nt, Human
gggcaguggcucacgccuguaa

SEQ ID NO: 487307 - RNA, 22 nt, Human
acugccuuauaugcugugugug

SEQ ID NO: 487308 - RNA, 22 nt, Human
cuguguggacugguugaggccc

SEQ ID NO: 487309 - RNA, 22 nt, Human
gggcuccaccuagggacacugg

SEQ ID NO: 487310 - RNA, 22 nt, Human
uccuucagcucucuauuuagau

SEQ ID NO: 487311 - RNA, 22 nt, Human
cagaggaagagauacaagcccu

SEQ ID NO: 487312 - RNA, 22 nt, Human
ggcuggccucaggguccucgcu

SEQ ID NO: 487313 - RNA, 18 nt, Human
cucugcuaaugggcagcu

SEQ ID NO: 487314 - RNA, 22 nt, Human
cgcagggccgcgagcgggacca

SEQ ID NO: 487315 - RNA, 22 nt, Human
gagccugaauuugaccugcuua

SEQ ID NO: 487316 - RNA, 22 nt, Human
aaauccuaagcagaggaauuua

SEQ ID NO: 487317 - RNA, 22 nt, Human
guuguacagcauccagugcaga

SEQ ID NO: 487318 - RNA, 22 nt, Human
aaugcacauauauguguauaca

SEQ ID NO: 487319 - RNA, 22 nt, Human
uggccagguguggguucucaga

SEQ ID NO: 487320 - RNA, 22 nt, Human
ggcuggucacaccacugcaggg

SEQ ID NO: 487321 - RNA, 22 nt, Human
caaugauguuuagauaaaaucc

SEQ ID NO: 487322 - RNA, 22 nt, Human
uagcagcucacagccucccauu

SEQ ID NO: 487323 - RNA, 22 nt, Human
acucugccccgaguucugggaa

SEQ ID NO: 487324 - RNA, 22 nt, Human
ugcuggcuggccuggccuggac

SEQ ID NO: 487325 - RNA, 22 nt, Human
gauuucaagcccccagagauuc

SEQ ID NO: 487326 - RNA, 22 nt, Human
ucaggagauggucuuuauaggc

SEQ ID NO: 487327 - RNA, 22 nt, Human
aagaacugugcuccaggcucca

SEQ ID NO: 487328 - RNA, 19 nt, Human
uggcucugucgaaggcaca

SEQ ID NO: 487329 - RNA, 17 nt, Human
uggacccuugggccucc

SEQ ID NO: 487330 - RNA, 22 nt, Human
uugcauuguugcaaugaaguau

SEQ ID NO: 487331 - RNA, 22 nt, Human
caaauccagaucccagucguag

SEQ ID NO: 487332 - RNA, 22 nt, Human
gaguaagagcuggcuuuggugu

SEQ ID NO: 487333 - RNA, 22 nt, Human
cagggccaaguuggugccuuuu

SEQ ID NO: 487334 - RNA, 22 nt, Human
aagagagagcauucuucuguua

SEQ ID NO: 487335 - RNA, 22 nt, Human
ugcucugguaacucacuuccau

SEQ ID NO: 487336 - RNA, 22 nt, Human
ucucagggccucccucuguuuc

SEQ ID NO: 487337 - RNA, 22 nt, Human
gauuuuucaguauaaaauauau

SEQ ID NO: 487338 - RNA, 22 nt, Human
cugagagccuccuguuggcuag

SEQ ID NO: 487339 - RNA, 22 nt, Human
uuucuggcagcgggacaggggu

SEQ ID NO: 487340 - RNA, 22 nt, Human
gucccagaggacagggucacau

SEQ ID NO: 487341 - RNA, 22 nt, Human
gccuggagcucggcugagggcg

SEQ ID NO: 487342 - RNA, 22 nt, Human
uucaagauggcaccagugagug

SEQ ID NO: 487343 - RNA, 19 nt, Human
cagcugccuuuucuuugca

SEQ ID NO: 487344 - RNA, 22 nt, Human
accaggcagcaccaaagccggu

SEQ ID NO: 487345 - RNA, 21 nt, Human
ggagcugcaggagccgaaggc

SEQ ID NO: 487346 - RNA, 22 nt, Human
agauuucagaugcucggcaguu

SEQ ID NO: 487347 - RNA, 22 nt, Human
gagcucauccccaugguccguc

SEQ ID NO: 487348 - RNA, 22 nt, Human
gcuggcagaagagcugguucaa

SEQ ID NO: 487349 - RNA, 22 nt, Human
agcagcugcagagggcuccccc

SEQ ID NO: 487350 - RNA, 19 nt, Human
uacauuuguguacacuugu

SEQ ID NO: 487351 - RNA, 22 nt, Human
gugcucacugugagacguccug

SEQ ID NO: 487352 - RNA, 22 nt, Human
cagagcucagagcugccaggca

SEQ ID NO: 487353 - RNA, 22 nt, Human
agggagagguugaaaccucagu

SEQ ID NO: 487354 - RNA, 22 nt, Human
aggggcugggacagagccaagc

SEQ ID NO: 487355 - RNA, 22 nt, Human
aggugaguugguaggaaguuug

SEQ ID NO: 487356 - RNA, 22 nt, Human
ggugaaggucagagcaggaaaa

SEQ ID NO: 487357 - RNA, 22 nt, Human
uucucucauucaaauuaaagug

SEQ ID NO: 487358 - RNA, 22 nt, Human
gaggaggaggaaguggaaccca

SEQ ID NO: 487359 - RNA, 22 nt, Human
aggcugagaaagugggaagaug

SEQ ID NO: 487360 - RNA, 22 nt, Human
ccugccugcaaaaugggacaag

SEQ ID NO: 487361 - RNA, 22 nt, Human
gggcuggaggagauccagaggc

SEQ ID NO: 487362 - RNA, 22 nt, Human
aagggcucugggcuacgcacug

SEQ ID NO: 487363 - RNA, 22 nt, Human
ucuuaagcagagaagaaguuga

SEQ ID NO: 487364 - RNA, 22 nt, Human
uuuauccagaaucaggauuuuu

SEQ ID NO: 487365 - RNA, 22 nt, Human
ugcagggcuuccucuuggaguu

SEQ ID NO: 487366 - RNA, 20 nt, Human
gaagcagcuucauguagaca

SEQ ID NO: 487367 - RNA, 17 nt, Human
acacagggagagggagc

SEQ ID NO: 487368 - RNA, 22 nt, Human
gacagggccgcagauggagacu

SEQ ID NO: 487369 - RNA, 22 nt, Human
uggagaauucuauguugagggg

SEQ ID NO: 487370 - RNA, 22 nt, Human
gcagggcagcugaagcuaggug

SEQ ID NO: 487371 - RNA, 22 nt, Human
ucugggcucugucagcaccucu

SEQ ID NO: 487372 - RNA, 22 nt, Human
aaguccuuggagaauagaaagg

SEQ ID NO: 487373 - RNA, 22 nt, Human
agggcgacaauggagagcguuu

SEQ ID NO: 487374 - RNA, 22 nt, Human
agaaauguuguggguuuuguua

SEQ ID NO: 487375 - RNA, 22 nt, Human
ccuggcagcauugguagagauu

SEQ ID NO: 487376 - RNA, 22 nt, Human
gaacaguaaauuuaugcagcac

SEQ ID NO: 487377 - RNA, 22 nt, Human
ugggccuggguuccuccugggc

SEQ ID NO: 487378 - RNA, 22 nt, Human
cuauuagguaugugguugcuau

SEQ ID NO: 487379 - RNA, 22 nt, Human
uagaaacagaaaacuguaauag

SEQ ID NO: 487380 - RNA, 22 nt, Human
ucuggagcaacagagcaggaca

SEQ ID NO: 487381 - RNA, 22 nt, Human
cagggcuccccagagagccucu

SEQ ID NO: 487382 - RNA, 22 nt, Human
uagcugucagcaaucaaguggu

SEQ ID NO: 487383 - RNA, 22 nt, Human
uggccugacugucaggcuguau

SEQ ID NO: 487384 - RNA, 22 nt, Human
gcugagagaaaagugagguucu

SEQ ID NO: 487385 - RNA, 22 nt, Human
gggcugggauugcuugcuguga

SEQ ID NO: 487386 - RNA, 22 nt, Human
agggacuauuuacccaucucac

SEQ ID NO: 487387 - RNA, 22 nt, Human
cagcugccaugacauguccugc

SEQ ID NO: 487388 - RNA, 22 nt, Human
cagccaucaguaaagacagcuu

SEQ ID NO: 487389 - RNA, 22 nt, Human
ggugaggcccagugaucugugu

SEQ ID NO: 487390 - RNA, 22 nt, Human
aggugcugccccgagaaggaug

SEQ ID NO: 487391 - RNA, 22 nt, Human
caguggguccuaaguacaguuc

SEQ ID NO: 487392 - RNA, 22 nt, Human
ggucccugcugaagccuuggug

SEQ ID NO: 487393 - RNA, 22 nt, Human
ucuucuccagugcuucugcaca

SEQ ID NO: 487394 - RNA, 22 nt, Human
agugcagccgagaucaggugcu

SEQ ID NO: 487395 - RNA, 22 nt, Human
aucaggauccaccuugagccug

SEQ ID NO: 487396 - RNA, 22 nt, Human
ugggugagugggaaaagcccag

SEQ ID NO: 487397 - RNA, 16 nt, Human
uggaaggggucuccgg

SEQ ID NO: 487398 - RNA, 22 nt, Human
cggggcaggagucccuguagag

SEQ ID NO: 487399 - RNA, 22 nt, Human
uggcucagucauggaugaguaa

SEQ ID NO: 487400 - RNA, 22 nt, Human
uacaguucacaguaucauaaau

SEQ ID NO: 487401 - RNA, 22 nt, Human
uagccucuggaauccuuucucu

SEQ ID NO: 487402 - RNA, 22 nt, Human
ugggcucauggcccagcacugg

SEQ ID NO: 487403 - RNA, 22 nt, Human
cuccucuggaaauuccucugcc

SEQ ID NO: 487404 - RNA, 22 nt, Human
caaggcaggaagccugucuuau

SEQ ID NO: 487405 - RNA, 22 nt, Human
aaauuucuggaagugucagagu

SEQ ID NO: 487406 - RNA, 22 nt, Human
uaaacauggauucugaucacag

SEQ ID NO: 487407 - RNA, 22 nt, Human
ucugagcuacgaugccugucac

SEQ ID NO: 487408 - RNA, 22 nt, Human
ggcuuuauguuuuucauguggu

SEQ ID NO: 487409 - RNA, 22 nt, Human
uggcugagcucccuguguguug

SEQ ID NO: 487410 - RNA, 22 nt, Human
cuggagccccaggcugugcaga

SEQ ID NO: 487411 - RNA, 22 nt, Human
ucuaggagcaugaagggaaggc

SEQ ID NO: 487412 - RNA, 22 nt, Human
ucuccucugcgcggcagugccc

SEQ ID NO: 487413 - RNA, 22 nt, Human
aggcugaggcuggcagcuccag

SEQ ID NO: 487414 - RNA, 22 nt, Human
ccacacagggggaugaguuauu

SEQ ID NO: 487415 - RNA, 22 nt, Human
agggugcauguuugcaagagug

SEQ ID NO: 487416 - RNA, 22 nt, Human
cccaggcacauccacucuguga

SEQ ID NO: 487417 - RNA, 23 nt, Human
ugccagaggcagucacaguggug

SEQ ID NO: 487418 - RNA, 22 nt, Human
gacagggaggagcagagcuucu

SEQ ID NO: 487419 - RNA, 22 nt, Human
ggcgaggccgggacaggcugga

SEQ ID NO: 487420 - RNA, 22 nt, Human
gaggcgagaagcuggagauggu

SEQ ID NO: 487421 - RNA, 22 nt, Human
uggcugggcccccaccugccuc

SEQ ID NO: 487422 - RNA, 22 nt, Human
auggcccaggccuccuguggcu

SEQ ID NO: 487423 - RNA, 22 nt, Human
cauuucugggagacaugcuaga

SEQ ID NO: 487424 - RNA, 22 nt, Human
gggaucagaaacauagcccuga

SEQ ID NO: 487425 - RNA, 17 nt, Human
uguuuucauucauugcu

SEQ ID NO: 487426 - RNA, 22 nt, Human
ccagcaggaaagugacguuuga

SEQ ID NO: 487427 - RNA, 22 nt, Human
ccagaccacccuggccaugcac

SEQ ID NO: 487428 - RNA, 22 nt, Human
cagggguguuuuuggccaggag

SEQ ID NO: 487429 - RNA, 22 nt, Human
uggucaguugcaucagagaagu

SEQ ID NO: 487430 - RNA, 22 nt, Human
ugcagcugcuugauucaucuug

SEQ ID NO: 487431 - RNA, 22 nt, Human
agccuccuggaguuucugggau

SEQ ID NO: 487432 - RNA, 22 nt, Human
ucucaggaagugauauugagac

SEQ ID NO: 487433 - RNA, 22 nt, Human
gugugccaggaacuggcugcug

SEQ ID NO: 487434 - RNA, 22 nt, Human
gcaagauguuaacauagggaga

SEQ ID NO: 487435 - RNA, 22 nt, Human
cugggccuagaggaagcugaca

SEQ ID NO: 487436 - RNA, 22 nt, Human
uugaaucauuacaauagauaag

SEQ ID NO: 487437 - RNA, 22 nt, Human
caaaugugacuuuugggcuucu

SEQ ID NO: 487438 - RNA, 22 nt, Human
agggcugggcugcuuguuguca

SEQ ID NO: 487439 - RNA, 22 nt, Human
uuucacaacguuguggugagag

SEQ ID NO: 487440 - RNA, 22 nt, Human
agaagcagacucugaggcaagg

SEQ ID NO: 487441 - RNA, 22 nt, Human
uccugguggugccagcugcagg

SEQ ID NO: 487442 - RNA, 22 nt, Human
cugucucugucuuaacucccag

SEQ ID NO: 487443 - RNA, 22 nt, Human
ggcagggguccugguguugacu

SEQ ID NO: 487444 - RNA, 22 nt, Human
aucaguuuaacugucaagagcc

SEQ ID NO: 487445 - RNA, 22 nt, Human
ccucccuggccagagcagcagc

SEQ ID NO: 487446 - RNA, 22 nt, Human
ggcugcuguacugaugucaguu

SEQ ID NO: 487447 - RNA, 20 nt, Human
agggcagcuugaggagccgg

SEQ ID NO: 487448 - RNA, 22 nt, Human
uccugagggcgauucagcaggu

SEQ ID NO: 487449 - RNA, 22 nt, Human
gccugagcaggcguggaccaug

SEQ ID NO: 487450 - RNA, 22 nt, Human
gggcuucucuuuagugagcuga

SEQ ID NO: 487451 - RNA, 19 nt, Human
caguggagauuggaggagg

SEQ ID NO: 487452 - RNA, 22 nt, Human
ccugaagcaaggguaggcaggu

SEQ ID NO: 487453 - RNA, 22 nt, Human
caguggggaggccaggauagaa

SEQ ID NO: 487454 - RNA, 22 nt, Human
uuaacaugucuugacuucaucu

SEQ ID NO: 487455 - RNA, 22 nt, Human
ggcagagguagcuggaaccagg

SEQ ID NO: 487456 - RNA, 22 nt, Human
uuuccucugaugcugacuugga

SEQ ID NO: 487457 - RNA, 22 nt, Human
auuuucugguugagguuuaaca

SEQ ID NO: 487458 - RNA, 22 nt, Human
uggccugggcaugaagcaucgu

SEQ ID NO: 487459 - RNA, 22 nt, Human
cccugcaggcucagacuggagu

SEQ ID NO: 487460 - RNA, 22 nt, Human
uuaauuuucucaucugugaaau

SEQ ID NO: 487461 - RNA, 22 nt, Human
gcugagcucccagcaguaucug

SEQ ID NO: 487462 - RNA, 22 nt, Human
cuggagccggaccagggacggu

SEQ ID NO: 487463 - RNA, 18 nt, Human
ugaggcagucagugaugg

SEQ ID NO: 487464 - RNA, 22 nt, Human
gagaagucauuugaccaccuag

SEQ ID NO: 487465 - RNA, 22 nt, Human
cccagcucugcagaccugcccu

SEQ ID NO: 487466 - RNA, 22 nt, Human
uggcagagugcagaagaggcau

SEQ ID NO: 487467 - RNA, 22 nt, Human
acagggucaagggugcuacaag

SEQ ID NO: 487468 - RNA, 22 nt, Human
agcagcauuccuggcuucuauc

SEQ ID NO: 487469 - RNA, 22 nt, Human
ccucccaccguaucucaguggc

SEQ ID NO: 487470 - RNA, 22 nt, Human
aagaauguggguggauaugaug

SEQ ID NO: 487471 - RNA, 18 nt, Human
cccagccucuccuuucua

SEQ ID NO: 487472 - RNA, 22 nt, Human
cuucugugcuucacaguugcca

SEQ ID NO: 487473 - RNA, 21 nt, Human
aaguaaaucagagaaauaacc

SEQ ID NO: 487474 - RNA, 22 nt, Human
gcagagcugucuaagucacuuc

SEQ ID NO: 487475 - RNA, 22 nt, Human
augcaguacugauacaugccac

SEQ ID NO: 487476 - RNA, 22 nt, Human
cagcaucuuucucuucuggagu

SEQ ID NO: 487477 - RNA, 22 nt, Human
uuaaacagucccagaggcugac

SEQ ID NO: 487478 - RNA, 22 nt, Human
uguauuuugugaggaucacucu

SEQ ID NO: 487479 - RNA, 22 nt, Human
cucuggccgcagcucagcucug

SEQ ID NO: 487480 - RNA, 22 nt, Human
ccugggucuugguucaugcucu

SEQ ID NO: 487481 - RNA, 22 nt, Human
ucagagagugcaaaauauagcu

SEQ ID NO: 487482 - RNA, 22 nt, Human
uuauggcauauuccucauugua

SEQ ID NO: 487483 - RNA, 22 nt, Human
agcagcauuaugauauaucuua

SEQ ID NO: 487484 - RNA, 22 nt, Human
agucucugcacaguaagaagca

SEQ ID NO: 487485 - RNA, 22 nt, Human
gcacagggcccugugcguaggu

SEQ ID NO: 487486 - RNA, 19 nt, Human
ugaaauggcaguugcuaaa

SEQ ID NO: 487487 - RNA, 22 nt, Human
aaaugguguuucuaaugcuaga

SEQ ID NO: 487488 - RNA, 22 nt, Human
ugcagaaguauuccaggcccca

SEQ ID NO: 487489 - RNA, 22 nt, Human
gcauugucaaaagugguaugac

SEQ ID NO: 487490 - RNA, 22 nt, Human
gagaggucaucucccaucagca

SEQ ID NO: 487491 - RNA, 22 nt, Human
ccuguacagugaaugaauguga

SEQ ID NO: 487492 - RNA, 22 nt, Human
uaguacuuaucucugucauugu

SEQ ID NO: 487493 - RNA, 22 nt, Human
gccugucugcgucacgcuuauu

SEQ ID NO: 487494 - RNA, 22 nt, Human
uuccuaaaagaauacacuggau

SEQ ID NO: 487495 - RNA, 22 nt, Human
gcccccucuuuggagccagcca

SEQ ID NO: 487496 - RNA, 22 nt, Human
uagucaaaccucagaauacccc

SEQ ID NO: 487497 - RNA, 22 nt, Human
augcaccugaacuccaucagcu

SEQ ID NO: 487498 - RNA, 22 nt, Human
cagcugcccugccuugcccuua

SEQ ID NO: 487499 - RNA, 22 nt, Human
cuggcccagucucagaguguca

SEQ ID NO: 487500 - RNA, 22 nt, Human
gccugccuuuuggaggcacauu

SEQ ID NO: 487501 - RNA, 22 nt, Human
cagggacaauggcagagccuga

SEQ ID NO: 487502 - RNA, 22 nt, Human
agaguguuauuugcucuguauu

SEQ ID NO: 487503 - RNA, 22 nt, Human
gucuuuauuugagauugucauu

SEQ ID NO: 487504 - RNA, 18 nt, Human
uaaaugcauguuaauaac

SEQ ID NO: 487505 - RNA, 22 nt, Human
ucagcagugcagggugaggcag

SEQ ID NO: 487506 - RNA, 22 nt, Human
augcccaaugucacaauuuuug

SEQ ID NO: 487507 - RNA, 22 nt, Human
gaaggcugcugggaaguguggu

SEQ ID NO: 487508 - RNA, 22 nt, Human
agacacaggauucugcauuucu

SEQ ID NO: 487509 - RNA, 22 nt, Human
aggccagcucacccuggcuccu

SEQ ID NO: 487510 - RNA, 21 nt, Human
ccugccaggaaacugaguguc

SEQ ID NO: 487511 - RNA, 20 nt, Human
cauauauaccuagaagugga

SEQ ID NO: 487512 - RNA, 22 nt, Human
uucaaauuaccacauuugcuua

SEQ ID NO: 487513 - RNA, 22 nt, Human
agaagugccauacuguggucca

SEQ ID NO: 487514 - RNA, 22 nt, Human
agccuggaauuaaggaaaugca

SEQ ID NO: 487515 - RNA, 22 nt, Human
uaaggccaccguuauagaacca

SEQ ID NO: 487516 - RNA, 22 nt, Human
uacacuuuuuacuacagauucu

SEQ ID NO: 487517 - RNA, 22 nt, Human
uucagagccacuucaagucuaa

SEQ ID NO: 487518 - RNA, 22 nt, Human
caaggccaaagggccacuguca

SEQ ID NO: 487519 - RNA, 22 nt, Human
aucacauuguuagcauagacug

SEQ ID NO: 487520 - RNA, 22 nt, Human
guacauguugguuguuuccagu

SEQ ID NO: 487521 - RNA, 22 nt, Human
acaugauucuugauaggcauug

SEQ ID NO: 487522 - RNA, 22 nt, Human
ugacauuuaucuucuacaauga

SEQ ID NO: 487523 - RNA, 18 nt, Human
ugcuggcaacuacuauug

SEQ ID NO: 487524 - RNA, 19 nt, Human
ucucugcuucucuuggcau

SEQ ID NO: 487525 - RNA, 20 nt, Human
ccuggcuuugcaucugugau

SEQ ID NO: 487526 - RNA, 22 nt, Human
ccucucuguguggccucuccau

SEQ ID NO: 487527 - RNA, 22 nt, Human
ucagggcucaccagccucugcc

SEQ ID NO: 487528 - RNA, 22 nt, Human
agcagagcugcaguggccugcu

SEQ ID NO: 487529 - RNA, 22 nt, Human
cucaggaggccauucucaaggu

SEQ ID NO: 487530 - RNA, 22 nt, Human
ggggagugacgcagggccauag

SEQ ID NO: 487531 - RNA, 22 nt, Human
aaaagguaguugccaaauaagg

SEQ ID NO: 487532 - RNA, 22 nt, Human
uauugaaauccauuacguucuu

SEQ ID NO: 487533 - RNA, 17 nt, Human
ucaggauccaggguucu

SEQ ID NO: 487534 - RNA, 22 nt, Human
gagaaggggugauguggguaau

SEQ ID NO: 487535 - RNA, 22 nt, Human
gcugagugagguccagagcuug

SEQ ID NO: 487536 - RNA, 22 nt, Human
aaacaguagaaguguauuuuau

SEQ ID NO: 487537 - RNA, 22 nt, Human
ggaggugguggcagugacaauu

SEQ ID NO: 487538 - RNA, 22 nt, Human
cacauguaguaagcaggcaaug

SEQ ID NO: 487539 - RNA, 22 nt, Human
ggagccuguggcugcuugaagc

SEQ ID NO: 487540 - RNA, 22 nt, Human
cuggcccauggugagcucuggg

SEQ ID NO: 487541 - RNA, 22 nt, Human
cugucuccagggcaggugcagg

SEQ ID NO: 487542 - RNA, 22 nt, Human
cuacuucugugaugaaacuaca

SEQ ID NO: 487543 - RNA, 22 nt, Human
caaaaacugcaauuacuuuuac

SEQ ID NO: 487544 - RNA, 22 nt, Human
uguacaaugccgagacuaacuc

SEQ ID NO: 487545 - RNA, 22 nt, Human
ucccagcccagauuugugugac

SEQ ID NO: 487546 - RNA, 22 nt, Human
gccaggggacgcggagcgacga

SEQ ID NO: 487547 - RNA, 22 nt, Human
cagaaaaccugacucuagaacu

SEQ ID NO: 487548 - RNA, 17 nt, Human
cugaggcccagggccca

SEQ ID NO: 487549 - RNA, 19 nt, Human
cugccuguuauggagagaa

SEQ ID NO: 487550 - RNA, 22 nt, Human
aggcuggguaccugucauaugc

SEQ ID NO: 487551 - RNA, 22 nt, Human
gagcuuggugaugccuccuggu

SEQ ID NO: 487552 - RNA, 22 nt, Human
guacaaaguggaccugauagua

SEQ ID NO: 487553 - RNA, 22 nt, Human
aaugcaguuucauuuguagaau

SEQ ID NO: 487554 - RNA, 22 nt, Human
uccacagaauguaagauccaca

SEQ ID NO: 487555 - RNA, 22 nt, Human
guuuucauuacugcugugauuu

SEQ ID NO: 487556 - RNA, 22 nt, Human
caauaugcaagcuauuaaguau

SEQ ID NO: 487557 - RNA, 22 nt, Human
ccagcucugccaagcgucagcu

SEQ ID NO: 487558 - RNA, 22 nt, Human
uugcagagaucagcagguuuga

SEQ ID NO: 487559 - RNA, 22 nt, Human
gaggagguuccggguggagaag

SEQ ID NO: 487560 - RNA, 22 nt, Human
ugaaggugaaugucuaugggga

SEQ ID NO: 487561 - RNA, 22 nt, Human
cgccugggaguccacaccugcu

SEQ ID NO: 487562 - RNA, 21 nt, Human
cccugcaggccagggcugagc

SEQ ID NO: 487563 - RNA, 22 nt, Human
uccugcaguuacaucccagcca

SEQ ID NO: 487564 - RNA, 19 nt, Human
aagaagcaauaagcuguga

SEQ ID NO: 487565 - RNA, 22 nt, Human
agagcuguucaacguagcaaug

SEQ ID NO: 487566 - RNA, 22 nt, Human
ccaaagucagugcucagucguc

SEQ ID NO: 487567 - RNA, 19 nt, Human
ggccaggcugacugugguc

SEQ ID NO: 487568 - RNA, 22 nt, Human
ggggaccuaggcucugucucuu

SEQ ID NO: 487569 - RNA, 22 nt, Human
uaacagaaaggggacagaaaua

SEQ ID NO: 487570 - RNA, 22 nt, Human
cugccucuggccucaggcccag

SEQ ID NO: 487571 - RNA, 21 nt, Human
ccagcugucuguccuuaggca

SEQ ID NO: 487572 - RNA, 22 nt, Human
ugcauuccuccaccuccugcac

SEQ ID NO: 487573 - RNA, 22 nt, Human
agucuucagagaaauuaacucu

SEQ ID NO: 487574 - RNA, 22 nt, Human
auguuauuuuggaaaauacaaa

SEQ ID NO: 487575 - RNA, 22 nt, Human
gggagagagaaaacguggcgca

SEQ ID NO: 487576 - RNA, 22 nt, Human
acucaggaaaugagaggcucuc

SEQ ID NO: 487577 - RNA, 22 nt, Human
uggcagcauuuuuuccagaaca

SEQ ID NO: 487578 - RNA, 22 nt, Human
ugcugcucaaugagaugccauc

SEQ ID NO: 487579 - RNA, 17 nt, Human
uauguaguacuuauaaa

SEQ ID NO: 487580 - RNA, 22 nt, Human
ucauuuaauaauuuuugaguag

SEQ ID NO: 487581 - RNA, 22 nt, Human
cuagaaaaauacuuuauuguga

SEQ ID NO: 487582 - RNA, 22 nt, Human
acugcuuuucagagucugccug

SEQ ID NO: 487583 - RNA, 22 nt, Human
uucuccgcuaaguucucugcag

SEQ ID NO: 487584 - RNA, 22 nt, Human
ccaaggcaggggaucaaaguuu

SEQ ID NO: 487585 - RNA, 22 nt, Human
aggcccuguuaugagccacugu

SEQ ID NO: 487586 - RNA, 22 nt, Human
uggaaugacagagagucugaau

SEQ ID NO: 487587 - RNA, 22 nt, Human
ggaggccaucagggagggcauu

SEQ ID NO: 487588 - RNA, 22 nt, Human
agcugccccaugagaggcaggu

SEQ ID NO: 487589 - RNA, 22 nt, Human
uccuccucuaucagacagugcc

SEQ ID NO: 487590 - RNA, 22 nt, Human
guccaguguguuuaucuuggau

SEQ ID NO: 487591 - RNA, 22 nt, Human
agcagccacccagcugcucauu

SEQ ID NO: 487592 - RNA, 21 nt, Human
agggccugugcucuccagguc

SEQ ID NO: 487593 - RNA, 22 nt, Human
uucuaccauugggaaaacagcc

SEQ ID NO: 487594 - RNA, 22 nt, Human
cucugguguccuuuagaauuua

SEQ ID NO: 487595 - RNA, 22 nt, Human
cuucaggauuuaggaagaugaa

SEQ ID NO: 487596 - RNA, 22 nt, Human
uucuaccagaccccagacuugu

SEQ ID NO: 487597 - RNA, 22 nt, Human
ucuggcucggauuugucuagca

SEQ ID NO: 487598 - RNA, 22 nt, Human
gccauuuagggaggcaagguga

SEQ ID NO: 487599 - RNA, 22 nt, Human
uuucacauacaguguauaguag

SEQ ID NO: 487600 - RNA, 22 nt, Human
aacauuucagcaaauaagaaca

SEQ ID NO: 487601 - RNA, 22 nt, Human
ugacacagauuagagacauacc

SEQ ID NO: 487602 - RNA, 22 nt, Human
cccuccagccauggacccaggu

SEQ ID NO: 487603 - RNA, 20 nt, Human
cuuagaaauuuuuacccugg

SEQ ID NO: 487604 - RNA, 19 nt, Human
ugagacagggauucaggug

SEQ ID NO: 487605 - RNA, 22 nt, Human
ccuuuugcucucccauccagaa

SEQ ID NO: 487606 - RNA, 22 nt, Human
uauuagggaacugcaagacuaa

SEQ ID NO: 487607 - RNA, 22 nt, Human
ggaggcucccacgcagcucaca

SEQ ID NO: 487608 - RNA, 22 nt, Human
cuggccugugggcugucuccgg

SEQ ID NO: 487609 - RNA, 22 nt, Human
agcagcauuuaaggauccaagu

SEQ ID NO: 487610 - RNA, 22 nt, Human
aagcaagacagaaguuacugcc

SEQ ID NO: 487611 - RNA, 22 nt, Human
cagaauaugacaagauuuuccu

SEQ ID NO: 487612 - RNA, 23 nt, Human
ccuucagaagaaguaacaggggc

SEQ ID NO: 487613 - RNA, 19 nt, Human
augucccaccgccccugag

SEQ ID NO: 487614 - RNA, 22 nt, Human
gcaugguggccuuaggguagcc

SEQ ID NO: 487615 - RNA, 22 nt, Human
cugaggagagaucacguggugu

SEQ ID NO: 487616 - RNA, 22 nt, Human
gccagagcugagugagguucuu

SEQ ID NO: 487617 - RNA, 22 nt, Human
auaaaaacugacccauccuuug

SEQ ID NO: 487618 - RNA, 22 nt, Human
cacaggcagccuuguagaagaa

SEQ ID NO: 487619 - RNA, 22 nt, Human
agccuucagcaguucaggugcc

SEQ ID NO: 487620 - RNA, 22 nt, Human
agauacaaaagauaagauuuag

SEQ ID NO: 487621 - RNA, 22 nt, Human
uguugaagauaaaguucucauu

SEQ ID NO: 487622 - RNA, 22 nt, Human
ugucacauugaauaugauuuau

SEQ ID NO: 487623 - RNA, 22 nt, Human
cuucuugcugggggccucagug

SEQ ID NO: 487624 - RNA, 22 nt, Human
aagggcuggaauaucucuuaga

SEQ ID NO: 487625 - RNA, 22 nt, Human
agggcagagacaugcuuccuga

SEQ ID NO: 487626 - RNA, 22 nt, Human
ccagagagucgaugggggacac

SEQ ID NO: 487627 - RNA, 22 nt, Human
ggcuucccuuuccgagaggaga

SEQ ID NO: 487628 - RNA, 22 nt, Human
gaaaggccauuucugaggguuu

SEQ ID NO: 487629 - RNA, 22 nt, Human
cugggugaguugaugaaggaga

SEQ ID NO: 487630 - RNA, 22 nt, Human
uccugcagccuugggcuggagc

SEQ ID NO: 487631 - RNA, 22 nt, Human
uuucacacuagucagaauacca

SEQ ID NO: 487632 - RNA, 22 nt, Human
cagucuggaggucagcuggcuu

SEQ ID NO: 487633 - RNA, 22 nt, Human
caggcagcuagauuuauaacaa

SEQ ID NO: 487634 - RNA, 22 nt, Human
aggccuguuccaggccccuuuu

SEQ ID NO: 487635 - RNA, 22 nt, Human
uuugugaagggaacagaagugu

SEQ ID NO: 487636 - RNA, 22 nt, Human
aagaugcgguugaccauggugu

SEQ ID NO: 487637 - RNA, 22 nt, Human
uagucucugcuuugcccuuggc

SEQ ID NO: 487638 - RNA, 22 nt, Human
ccugccaggagcuggugcugca

SEQ ID NO: 487639 - RNA, 22 nt, Human
cugaggcaguuuaauuuuugaa

SEQ ID NO: 487640 - RNA, 22 nt, Human
gagccuggggacccuccugagu

SEQ ID NO: 487641 - RNA, 22 nt, Human
cuauugaauuaacuauuaaagu

SEQ ID NO: 487642 - RNA, 22 nt, Human
aucaggaucaugcuggguggga

SEQ ID NO: 487643 - RNA, 22 nt, Human
auugcacaaacacagucagacu

SEQ ID NO: 487644 - RNA, 22 nt, Human
cccuggaggcggauguugcagu

SEQ ID NO: 487645 - RNA, 22 nt, Human
ggcauguuucaucacaucaaga

SEQ ID NO: 487646 - RNA, 22 nt, Human
gaggcccaguccugcaagcacg

SEQ ID NO: 487647 - RNA, 22 nt, Human
ccacagcugaccgcaggugagc

SEQ ID NO: 487648 - RNA, 22 nt, Human
ucacaguuauagucuguagaau

SEQ ID NO: 487649 - RNA, 22 nt, Human
ccacagcaugcaggccugacac

SEQ ID NO: 487650 - RNA, 22 nt, Human
ucaggagaaucagggcuguccu

SEQ ID NO: 487651 - RNA, 22 nt, Human
acauuuuaauaugcuuagugug

SEQ ID NO: 487652 - RNA, 22 nt, Human
gucccugcccuccugggacuca

SEQ ID NO: 487653 - RNA, 22 nt, Human
uucacauuucauaccacagcuu

SEQ ID NO: 487654 - RNA, 22 nt, Human
uacagagacuuuauggcacaaa

SEQ ID NO: 487655 - RNA, 22 nt, Human
aagcuuccugaaugcucauuua

SEQ ID NO: 487656 - RNA, 22 nt, Human
cugcuggagguuggagcaugca

SEQ ID NO: 487657 - RNA, 22 nt, Human
cagguacauucguagacccauu

SEQ ID NO: 487658 - RNA, 17 nt, Human
cuggagccuccaacucc

SEQ ID NO: 487659 - RNA, 22 nt, Human
ccugagugaauucccucacugu

SEQ ID NO: 487660 - RNA, 22 nt, Human
cuggcuggcaaguagaacacaa

SEQ ID NO: 487661 - RNA, 22 nt, Human
uccugaggcacaauccuagaau

SEQ ID NO: 487662 - RNA, 22 nt, Human
auuucacucuuaauugcuuccu

SEQ ID NO: 487663 - RNA, 22 nt, Human
ggcccugggcagaggagugggc

SEQ ID NO: 487664 - RNA, 22 nt, Human
uugcucagcacuggagccagcu

SEQ ID NO: 487665 - RNA, 22 nt, Human
uugcauaaaagaguauaucuua

SEQ ID NO: 487666 - RNA, 22 nt, Human
uugugaaacauucauggauuug

SEQ ID NO: 487667 - RNA, 22 nt, Human
uucucagauccaucagaagucc

SEQ ID NO: 487668 - RNA, 22 nt, Human
ccauggagcgggugagugagug

SEQ ID NO: 487669 - RNA, 22 nt, Human
ucacauuuguguuuuauuagag

SEQ ID NO: 487670 - RNA, 20 nt, Human
guauuagguguuccucuuuc

SEQ ID NO: 487671 - RNA, 20 nt, Human
cuguggcaucugucauggug

SEQ ID NO: 487672 - RNA, 22 nt, Human
acaggccugacacacagagggc

SEQ ID NO: 487673 - RNA, 20 nt, Human
ccucaguguccuggacuggg

SEQ ID NO: 487674 - RNA, 22 nt, Human
cccugccugugggcaucaacau

SEQ ID NO: 487675 - RNA, 22 nt, Human
ggcuccuggcaucuggugggua

SEQ ID NO: 487676 - RNA, 22 nt, Human
ggucaugcugugaaucagugcu

SEQ ID NO: 487677 - RNA, 22 nt, Human
gagcucugggaaacaaagugua

SEQ ID NO: 487678 - RNA, 22 nt, Human
ucugucuccugccagugccucu

SEQ ID NO: 487679 - RNA, 22 nt, Human
ucuguacauuuguguugugaau

SEQ ID NO: 487680 - RNA, 22 nt, Human
ugcaagagguaaaaugaaagga

SEQ ID NO: 487681 - RNA, 22 nt, Human
uaggaaaagucuagauugauga

SEQ ID NO: 487682 - RNA, 22 nt, Human
ccccaccugugcgucugccgca

SEQ ID NO: 487683 - RNA, 23 nt, Human
ugggaccuguuugcccacagaug

SEQ ID NO: 487684 - RNA, 22 nt, Human
agucccagcucagaaccacuag

SEQ ID NO: 487685 - RNA, 22 nt, Human
gggccugggaacuugcauuuag

SEQ ID NO: 487686 - RNA, 22 nt, Human
cugaagaggacgcagcagcaag

SEQ ID NO: 487687 - RNA, 17 nt, Human
aauagcugcucagagag

SEQ ID NO: 487688 - RNA, 23 nt, Human
gcucagagguuuuucucuggaug

SEQ ID NO: 487689 - RNA, 22 nt, Human
gagcugcuucugugugccgggu

SEQ ID NO: 487690 - RNA, 22 nt, Human
gggcagugucggggcccaggga

SEQ ID NO: 487691 - RNA, 22 nt, Human
ugucagugaguuaguugcaagu

SEQ ID NO: 487692 - RNA, 22 nt, Human
uagcuuuaagacauggugaaug

SEQ ID NO: 487693 - RNA, 23 nt, Human
cuggaagugcuuuuauagcuuug

SEQ ID NO: 487694 - RNA, 22 nt, Human
gacuguguccaugugcuggauu

SEQ ID NO: 487695 - RNA, 22 nt, Human
uacagggguaacaguggggaau

SEQ ID NO: 487696 - RNA, 22 nt, Human
cucugagcccgcugcagcccca

SEQ ID NO: 487697 - RNA, 22 nt, Human
ccucagggucugaggagaccgu

SEQ ID NO: 487698 - RNA, 22 nt, Human
aacuguaaggcuuagaacagca

SEQ ID NO: 487699 - RNA, 22 nt, Human
gcucccagggcagcgcagaaga

SEQ ID NO: 487700 - RNA, 22 nt, Human
uaccuuggguugaguucauucu

SEQ ID NO: 487701 - RNA, 22 nt, Human
ggaagggcaaaagagaugaacu

SEQ ID NO: 487702 - RNA, 22 nt, Human
ugaagcugugggcaguggagcc

SEQ ID NO: 487703 - RNA, 22 nt, Human
uuguaacagcugcuuaauagag

SEQ ID NO: 487704 - RNA, 22 nt, Human
auuuccaaaaccacuuauugcc

SEQ ID NO: 487705 - RNA, 22 nt, Human
uuucuguauuuaaaagaucugg

SEQ ID NO: 487706 - RNA, 22 nt, Human
ggauccuuaacuaucacaguga

SEQ ID NO: 487707 - RNA, 22 nt, Human
uggcugagaaaaugguuuuagg

SEQ ID NO: 487708 - RNA, 22 nt, Human
agagugaagguugacacuucac

SEQ ID NO: 487709 - RNA, 22 nt, Human
gaugcacagugacccugccagu

SEQ ID NO: 487710 - RNA, 22 nt, Human
uggcaggagacacauggcauag

SEQ ID NO: 487711 - RNA, 22 nt, Human
cagcuggcuggucagugcacaa

SEQ ID NO: 487712 - RNA, 22 nt, Human
aggcaggccccugagaauagac

SEQ ID NO: 487713 - RNA, 22 nt, Human
acacuucuauucccugcacaaa

SEQ ID NO: 487714 - RNA, 22 nt, Human
agggccugagcuggcugaccuc

SEQ ID NO: 487715 - RNA, 19 nt, Human
gcacugaagaguuggucac

SEQ ID NO: 487716 - RNA, 21 nt, Human
agcuggugucagagcucuggg

SEQ ID NO: 487717 - RNA, 22 nt, Human
ucuggcuuucauuuguuuaaag

SEQ ID NO: 487718 - RNA, 22 nt, Human
agcaguggagcgagauguuuaa

SEQ ID NO: 487719 - RNA, 22 nt, Human
uggcccugcagaacuagccugg

SEQ ID NO: 487720 - RNA, 22 nt, Human
ggcaguggcuccucucuacucc

SEQ ID NO: 487721 - RNA, 19 nt, Human
uggcuucuguuuucauguu

SEQ ID NO: 487722 - RNA, 22 nt, Human
gcagggcuguucaggagggugg

SEQ ID NO: 487723 - RNA, 22 nt, Human
gcuccucucccagagcugcagg

SEQ ID NO: 487724 - RNA, 22 nt, Human
agcacccuccaacuucccugua

SEQ ID NO: 487725 - RNA, 22 nt, Human
ucagguggcuuggagggggacg

SEQ ID NO: 487726 - RNA, 22 nt, Human
agucauauguggcauuuucuaa

SEQ ID NO: 487727 - RNA, 22 nt, Human
aggacuccauguguccuggaga

SEQ ID NO: 487728 - RNA, 22 nt, Human
cuacauaaauauuuaugugucu

SEQ ID NO: 487729 - RNA, 22 nt, Human
cagggcucacucggcuggcguc

SEQ ID NO: 487730 - RNA, 20 nt, Human
agccaggcucaagcuccccc

SEQ ID NO: 487731 - RNA, 22 nt, Human
uaaagguaacaugaacugcuuu

SEQ ID NO: 487732 - RNA, 20 nt, Human
ccagcugagccaaggggaga

SEQ ID NO: 487733 - RNA, 22 nt, Human
uuugcauucuagaaaaauuucu

SEQ ID NO: 487734 - RNA, 22 nt, Human
accucugccaagaugugcuccc

SEQ ID NO: 487735 - RNA, 22 nt, Human
cagcugugcuguauuaagcucu

SEQ ID NO: 487736 - RNA, 22 nt, Human
cagcauggcuugaguguuuccu

SEQ ID NO: 487737 - RNA, 22 nt, Human
uccucaggaucuaggagugcuu

SEQ ID NO: 487738 - RNA, 22 nt, Human
gcugggcuugguuucccugcuu

SEQ ID NO: 487739 - RNA, 22 nt, Human
ccagagcagggcagcagggcuc

SEQ ID NO: 487740 - RNA, 22 nt, Human
ggugcccaccugucuuccugga

SEQ ID NO: 487741 - RNA, 22 nt, Human
acuuuuuuauaaggaagaagau

SEQ ID NO: 487742 - RNA, 22 nt, Human
cugagcugaaacuugagaggcu

SEQ ID NO: 487743 - RNA, 22 nt, Human
aguuucuagccucacuguuuag

SEQ ID NO: 487744 - RNA, 22 nt, Human
gagaaccucuccacaagucugg

SEQ ID NO: 487745 - RNA, 22 nt, Human
aguagaaagaaggcacugggcc

SEQ ID NO: 487746 - RNA, 22 nt, Human
ccucccuuggccauagccagcc

SEQ ID NO: 487747 - RNA, 22 nt, Human
gagagugaggcaucaggggcag

SEQ ID NO: 487748 - RNA, 22 nt, Human
aaagguaguacuucuagaaggg

SEQ ID NO: 487749 - RNA, 22 nt, Human
aagcugccacacggugaguacu

SEQ ID NO: 487750 - RNA, 22 nt, Human
ugugaaagauacuaggcagagg

SEQ ID NO: 487751 - RNA, 22 nt, Human
uacuguuuucuauaauggcugu

SEQ ID NO: 487752 - RNA, 22 nt, Human
cugcaggcaucuaacugugggc

SEQ ID NO: 487753 - RNA, 22 nt, Human
uuugaaaguccuaggagagucc

SEQ ID NO: 487754 - RNA, 22 nt, Human
agggcagagaaauguaguugag

SEQ ID NO: 487755 - RNA, 22 nt, Human
auacaaagcuuucugucuggua

SEQ ID NO: 487756 - RNA, 22 nt, Human
agauguaguagugggucuuuua

SEQ ID NO: 487757 - RNA, 22 nt, Human
caggguggaauggaaugcuggc

SEQ ID NO: 487758 - RNA, 22 nt, Human
ggcagaguggagugcggccucc

SEQ ID NO: 487759 - RNA, 22 nt, Human
aaagaacuuauccuagaauuug

SEQ ID NO: 487760 - RNA, 22 nt, Human
ugaggcucagagaagugcuguu

SEQ ID NO: 487761 - RNA, 22 nt, Human
uagaaaucauuuagaaguauug

SEQ ID NO: 487762 - RNA, 19 nt, Human
ggagaagcaucuagaaaua

SEQ ID NO: 487763 - RNA, 22 nt, Human
uucuuaaagaggcaaaacacag

SEQ ID NO: 487764 - RNA, 22 nt, Human
auguccagaguaaagcacauuc

SEQ ID NO: 487765 - RNA, 22 nt, Human
acagaaauauucguggugcuug

SEQ ID NO: 487766 - RNA, 22 nt, Human
cagagcauugagggucugccaa

SEQ ID NO: 487767 - RNA, 21 nt, Human
ccugcagcaccagaaggagau

SEQ ID NO: 487768 - RNA, 22 nt, Human
cauggcagugauucagccuuug

SEQ ID NO: 487769 - RNA, 22 nt, Human
ggagggcucaauugacuccuga

SEQ ID NO: 487770 - RNA, 22 nt, Human
uugcagcuuagugauguuaucu

SEQ ID NO: 487771 - RNA, 22 nt, Human
cagagcuggguuugggaaaccu

SEQ ID NO: 487772 - RNA, 22 nt, Human
cuacauuuuaauaagcugcuua

SEQ ID NO: 487773 - RNA, 22 nt, Human
ucugugacuugcgggaggagaa

SEQ ID NO: 487774 - RNA, 20 nt, Human
ucagagucaucaaagauggu

SEQ ID NO: 487775 - RNA, 18 nt, Human
ggcuguggacaagauuag

SEQ ID NO: 487776 - RNA, 22 nt, Human
gcugaagggagugcugagucug

SEQ ID NO: 487777 - RNA, 22 nt, Human
ggugaagguggaacgcagagca

SEQ ID NO: 487778 - RNA, 22 nt, Human
ccucuccuugcacccgucccgc

SEQ ID NO: 487779 - RNA, 22 nt, Human
gcagcuuggauuucuguaguuu

SEQ ID NO: 487780 - RNA, 22 nt, Human
aagccaguccucuacugggcac

SEQ ID NO: 487781 - RNA, 22 nt, Human
cuguggcauugugaggacugca

SEQ ID NO: 487782 - RNA, 22 nt, Human
ccagagccucaacacagguccu

SEQ ID NO: 487783 - RNA, 22 nt, Human
gccuggcccagggcucuuguug

SEQ ID NO: 487784 - RNA, 22 nt, Human
ggcacugauuccauucaugaag

SEQ ID NO: 487785 - RNA, 22 nt, Human
ugaaggcccuaucuccauauac

SEQ ID NO: 487786 - RNA, 22 nt, Human
gccacugcacuccagcccaggc

SEQ ID NO: 487787 - RNA, 22 nt, Human
ggccaggcugcccugggagcag

SEQ ID NO: 487788 - RNA, 22 nt, Human
uugcacuccagcccgagcaaca

SEQ ID NO: 487789 - RNA, 22 nt, Human
uuauuuauuguguaccuacugu

SEQ ID NO: 487790 - RNA, 22 nt, Human
ucugcaggacugaggccuguuu

SEQ ID NO: 487791 - RNA, 22 nt, Human
caggcugcagaggccuuucaug

SEQ ID NO: 487792 - RNA, 21 nt, Human
uugaagcaaggguggcucuga

SEQ ID NO: 487793 - RNA, 19 nt, Human
uccugggcugggccagguc

SEQ ID NO: 487794 - RNA, 22 nt, Human
ugcagggccuugggucuuucuu

SEQ ID NO: 487795 - RNA, 22 nt, Human
uuaguaaauaaagucuacuuuc

SEQ ID NO: 487796 - RNA, 22 nt, Human
uagggcagccuuauagcuccca

SEQ ID NO: 487797 - RNA, 22 nt, Human
ucucagagggaggauuacugcc

SEQ ID NO: 487798 - RNA, 22 nt, Human
ggcuguggccagcggggcugag

SEQ ID NO: 487799 - RNA, 22 nt, Human
gccagcuggagugagagugggc

SEQ ID NO: 487800 - RNA, 22 nt, Human
uacaagacgagggaaguucuuu

SEQ ID NO: 487801 - RNA, 22 nt, Human
agcaggaaguagucuguaagca

SEQ ID NO: 487802 - RNA, 22 nt, Human
gaggcucacuuucauccucuuc

SEQ ID NO: 487803 - RNA, 22 nt, Human
gcugccaugccacagcacucac

SEQ ID NO: 487804 - RNA, 22 nt, Human
uaaugcacaugacugaacuauu

SEQ ID NO: 487805 - RNA, 22 nt, Human
guuuuauaggcuguugcuauau

SEQ ID NO: 487806 - RNA, 22 nt, Human
agaaauguuacaguuguuauuu

SEQ ID NO: 487807 - RNA, 23 nt, Human
augcucugggcugugggaccugc

SEQ ID NO: 487808 - RNA, 22 nt, Human
ccaggacuuauuacaguauaac

SEQ ID NO: 487809 - RNA, 22 nt, Human
cagcccugcacgcugccuccgc

SEQ ID NO: 487810 - RNA, 22 nt, Human
uugagggucuggaucugcugcu

SEQ ID NO: 487811 - RNA, 20 nt, Human
aguaccuuuuguauguuacc

SEQ ID NO: 487812 - RNA, 20 nt, Human
gucuccacuggggguuaacc

SEQ ID NO: 487813 - RNA, 22 nt, Human
ggaggcucgcuggucgcacagc

SEQ ID NO: 487814 - RNA, 20 nt, Human
agaagccaagugacauguuu

SEQ ID NO: 487815 - RNA, 22 nt, Human
ccagaauagaaggcagcuguca

SEQ ID NO: 487816 - RNA, 22 nt, Human
uaggcagagguaugguaaggac

SEQ ID NO: 487817 - RNA, 22 nt, Human
gaguccagacaccauaccugau

SEQ ID NO: 487818 - RNA, 22 nt, Human
uaagaaauuuaguuauagaaug

SEQ ID NO: 487819 - RNA, 22 nt, Human
aaacucuggagauguuuaugca

SEQ ID NO: 487820 - RNA, 22 nt, Human
ucaggcagaugcagggauggau

SEQ ID NO: 487821 - RNA, 18 nt, Human
gaugggagcaagagaaga

SEQ ID NO: 487822 - RNA, 22 nt, Human
gaggccuggguuggaggugcau

SEQ ID NO: 487823 - RNA, 22 nt, Human
guguuuccaguucagaaagcaa

SEQ ID NO: 487824 - RNA, 22 nt, Human
aggacaguguggaagagggugc

SEQ ID NO: 487825 - RNA, 22 nt, Human
cagaggugcauacaggucauua

SEQ ID NO: 487826 - RNA, 22 nt, Human
uuugcauuucuaaugagcuccg

SEQ ID NO: 487827 - RNA, 22 nt, Human
uuugcauuuguuuagaaccuga

SEQ ID NO: 487828 - RNA, 20 nt, Human
gugugaagcccucaggagga

SEQ ID NO: 487829 - RNA, 22 nt, Human
ccaggcuggagugcaauggugc

SEQ ID NO: 487830 - RNA, 22 nt, Human
uggcaagagggaugcaagguuu

SEQ ID NO: 487831 - RNA, 19 nt, Human
auagaaaggguuaaagaca

SEQ ID NO: 487832 - RNA, 22 nt, Human
gagagcugcaagguagggcggg

SEQ ID NO: 487833 - RNA, 22 nt, Human
aaaaucugguaauuugaaugug

SEQ ID NO: 487834 - RNA, 22 nt, Human
ugucucaggggcauugaaauaa

SEQ ID NO: 487835 - RNA, 22 nt, Human
ggggcuccagucuucacauuuu

SEQ ID NO: 487836 - RNA, 20 nt, Human
gagccugggaagucuaaggu

SEQ ID NO: 487837 - RNA, 22 nt, Human
ugugcagggaagggcaugcuau

SEQ ID NO: 487838 - RNA, 22 nt, Human
ugugccugucacccucagagag

SEQ ID NO: 487839 - RNA, 22 nt, Human
ugggcaggcaagugaauaccuu

SEQ ID NO: 487840 - RNA, 22 nt, Human
cacccagcagcacuuaagacua

SEQ ID NO: 487841 - RNA, 22 nt, Human
uauauguguggauucuuguaga

SEQ ID NO: 487842 - RNA, 22 nt, Human
ucugaaggucugagaaccagga

SEQ ID NO: 487843 - RNA, 22 nt, Human
uggcugagugaacauguccauu

SEQ ID NO: 487844 - RNA, 22 nt, Human
auuuauuaccucggaguuucug

SEQ ID NO: 487845 - RNA, 22 nt, Human
aacagcaugcuggguaacauug

SEQ ID NO: 487846 - RNA, 19 nt, Human
acuuucuccaggaccuguu

SEQ ID NO: 487847 - RNA, 22 nt, Human
ucauguuauugacucauaauau

SEQ ID NO: 487848 - RNA, 22 nt, Human
gcagaggcuccauuuuacagau

SEQ ID NO: 487849 - RNA, 22 nt, Human
ggggcagaaagcccacagagug

SEQ ID NO: 487850 - RNA, 20 nt, Human
cucuggcuccgcgugaccgc

SEQ ID NO: 487851 - RNA, 22 nt, Human
uauuggugggggcagagagaga

SEQ ID NO: 487852 - RNA, 22 nt, Human
agugcugucccgacaacugagg

SEQ ID NO: 487853 - RNA, 22 nt, Human
gaggcucacugggcaaagacuc

SEQ ID NO: 487854 - RNA, 22 nt, Human
cugagagaaucaugcugcaggu

SEQ ID NO: 487855 - RNA, 20 nt, Human
cgcccaggagggcccaugug

SEQ ID NO: 487856 - RNA, 22 nt, Human
cgugucaucugagccuugggcg

SEQ ID NO: 487857 - RNA, 22 nt, Human
augggaugaacuugaucugcuu

SEQ ID NO: 487858 - RNA, 22 nt, Human
agggaaaggcugaugcuguggg

SEQ ID NO: 487859 - RNA, 17 nt, Human
gcugagaggcagcacag

SEQ ID NO: 487860 - RNA, 22 nt, Human
aggcucagcaucugauucauau

SEQ ID NO: 487861 - RNA, 22 nt, Human
cugcucuggcuguguacuucag

SEQ ID NO: 487862 - RNA, 22 nt, Human
uuuuauuggagugauaccaagc

SEQ ID NO: 487863 - RNA, 22 nt, Human
caggaagauuagaccaagagcu

SEQ ID NO: 487864 - RNA, 22 nt, Human
gcccaugcacuuucugugaugg

SEQ ID NO: 487865 - RNA, 22 nt, Human
cagcagagacgguaagcagaac

SEQ ID NO: 487866 - RNA, 22 nt, Human
agcagaacauuuucagggcugu

SEQ ID NO: 487867 - RNA, 22 nt, Human
cucacugacgaggaagcugaga

SEQ ID NO: 487868 - RNA, 22 nt, Human
caggcaggucagugaagaagga

SEQ ID NO: 487869 - RNA, 22 nt, Human
aggagcugacuuguaaagcauu

SEQ ID NO: 487870 - RNA, 22 nt, Human
cugccuuugcccuugacacugu

SEQ ID NO: 487871 - RNA, 22 nt, Human
cacauggaagagauacagugag

SEQ ID NO: 487872 - RNA, 22 nt, Human
uggagggcucuuucaccuggua

SEQ ID NO: 487873 - RNA, 22 nt, Human
uucuuugcccuuaaugaaauaa

SEQ ID NO: 487874 - RNA, 22 nt, Human
auccaguuuaugucauauucuu

SEQ ID NO: 487875 - RNA, 22 nt, Human
uggaaagagguagaggaucugg

SEQ ID NO: 487876 - RNA, 22 nt, Human
guggccuggcgagcuggcgcgg

SEQ ID NO: 487877 - RNA, 22 nt, Human
aaaugcacaauaaaguaaaggc

SEQ ID NO: 487878 - RNA, 22 nt, Human
cagcccuggcuagggcgagggc

SEQ ID NO: 487879 - RNA, 22 nt, Human
cagggagcuggugccagccgac

SEQ ID NO: 487880 - RNA, 22 nt, Human
ggcccagcccgagucagccuuc

SEQ ID NO: 487881 - RNA, 22 nt, Human
acaucacagagcccagauaaag

SEQ ID NO: 487882 - RNA, 22 nt, Human
uggugcaagucucugaggaggg

SEQ ID NO: 487883 - RNA, 22 nt, Human
gcuguggcuugcagcuggggcu

SEQ ID NO: 487884 - RNA, 22 nt, Human
aagcagccagccaucaugcccg

SEQ ID NO: 487885 - RNA, 22 nt, Human
agaugaagacucaggagcaggu

SEQ ID NO: 487886 - RNA, 22 nt, Human
gcugugcuauaucucugagugu

SEQ ID NO: 487887 - RNA, 20 nt, Human
uucacagaggacucagguca

SEQ ID NO: 487888 - RNA, 22 nt, Human
ucauuguuucugcuuuucauga

SEQ ID NO: 487889 - RNA, 19 nt, Human
caucuggaugauucuccug

SEQ ID NO: 487890 - RNA, 22 nt, Human
uggcagaggaaaaagucacugg

SEQ ID NO: 487891 - RNA, 19 nt, Human
agacucugccacucuucuc

SEQ ID NO: 487892 - RNA, 22 nt, Human
ucaucuaagagucuuacauuua

SEQ ID NO: 487893 - RNA, 22 nt, Human
uuugcaaauaccaugaaacuug

SEQ ID NO: 487894 - RNA, 22 nt, Human
ugauuuccuggcuuuggaguuc

SEQ ID NO: 487895 - RNA, 22 nt, Human
ugagaagcaguuucaguaagaa

SEQ ID NO: 487896 - RNA, 22 nt, Human
gugccugccccacuccucagca

SEQ ID NO: 487897 - RNA, 22 nt, Human
gaggaggaaacccuguuccucu

SEQ ID NO: 487898 - RNA, 22 nt, Human
guccucugggcagcugccccac

SEQ ID NO: 487899 - RNA, 22 nt, Human
uggcagcuccggguaggggcug

SEQ ID NO: 487900 - RNA, 20 nt, Human
aguuauaguaucuagccaug

SEQ ID NO: 487901 - RNA, 22 nt, Human
uggcucugcugaaccuagugca

SEQ ID NO: 487902 - RNA, 22 nt, Human
uuauucagauuggcuacaggau

SEQ ID NO: 487903 - RNA, 22 nt, Human
ccaggggaaacagggagcacuc

SEQ ID NO: 487904 - RNA, 22 nt, Human
gucaggauuuuaaaaucccagu

SEQ ID NO: 487905 - RNA, 22 nt, Human
ccugagagcagcuuccugcuua

SEQ ID NO: 487906 - RNA, 22 nt, Human
agagggcugcugcacagugcuc

SEQ ID NO: 487907 - RNA, 22 nt, Human
gccuggccugaacuaggaggug

SEQ ID NO: 487908 - RNA, 22 nt, Human
ggagugggcagcacugcccugu

SEQ ID NO: 487909 - RNA, 22 nt, Human
cagacaugauguaagcagaggc

SEQ ID NO: 487910 - RNA, 22 nt, Human
agcaucuggucaugagugagaa

SEQ ID NO: 487911 - RNA, 22 nt, Human
ggccagagagccgcuguuagga

SEQ ID NO: 487912 - RNA, 22 nt, Human
auaugauuccacuauuguaugg

SEQ ID NO: 487913 - RNA, 21 nt, Human
cugcuuuacuucagaggaucu

SEQ ID NO: 487914 - RNA, 22 nt, Human
caguacuucuuggaaacuggau

SEQ ID NO: 487915 - RNA, 22 nt, Human
gccuggaguggacuuggccccu

SEQ ID NO: 487916 - RNA, 22 nt, Human
uuauucagucugucuagggagu

SEQ ID NO: 487917 - RNA, 22 nt, Human
ccugucugaggaggugcucuuu

SEQ ID NO: 487918 - RNA, 22 nt, Human
aaaugcacucugcuucugugac

SEQ ID NO: 487919 - RNA, 22 nt, Human
aaggaggagcggaggcuuguug

SEQ ID NO: 487920 - RNA, 22 nt, Human
cagggccucauccucagagauu

SEQ ID NO: 487921 - RNA, 22 nt, Human
ccucugcucugguccaugugcu

SEQ ID NO: 487922 - RNA, 22 nt, Human
agggccugggauguccuccuag

SEQ ID NO: 487923 - RNA, 22 nt, Human
gagagggccagggugagaacua

SEQ ID NO: 487924 - RNA, 22 nt, Human
gggcugccuuucuucugggagc

SEQ ID NO: 487925 - RNA, 22 nt, Human
gcucaagagagaugcaguucuu

SEQ ID NO: 487926 - RNA, 23 nt, Human
ugucacauuuaguuggcauuguu

SEQ ID NO: 487927 - RNA, 22 nt, Human
gauggcacacagacauccccgc

SEQ ID NO: 487928 - RNA, 22 nt, Human
agccagcuggugggucagcugg

SEQ ID NO: 487929 - RNA, 22 nt, Human
agggaggauaguagucaguuua

SEQ ID NO: 487930 - RNA, 22 nt, Human
cuuguagaauugaaauggucuc

SEQ ID NO: 487931 - RNA, 20 nt, Human
agaguaacuggcacauaggg

SEQ ID NO: 487932 - RNA, 22 nt, Human
uaguaaaaguuuaguugaaagu

SEQ ID NO: 487933 - RNA, 22 nt, Human
cuggcucucugagauauugagu

SEQ ID NO: 487934 - RNA, 22 nt, Human
uaguggagaaguggagucugug

SEQ ID NO: 487935 - RNA, 22 nt, Human
aaaugcaucagcucauaagaga

SEQ ID NO: 487936 - RNA, 22 nt, Human
ggauccuucuuugaccucacag

SEQ ID NO: 487937 - RNA, 22 nt, Human
aagucuggaagucucaguuuuc

SEQ ID NO: 487938 - RNA, 22 nt, Human
cagcuugaaauauuaggagaug

SEQ ID NO: 487939 - RNA, 22 nt, Human
uugauguacagaauuguucaca

SEQ ID NO: 487940 - RNA, 22 nt, Human
agaagccauugaagcagaccuc

SEQ ID NO: 487941 - RNA, 19 nt, Human
uuugugaagaaaaugaugc

SEQ ID NO: 487942 - RNA, 22 nt, Human
aguucuuuugugaacauaugcu

SEQ ID NO: 487943 - RNA, 22 nt, Human
gcuggggaggcagcagagaaca

SEQ ID NO: 487944 - RNA, 22 nt, Human
ugcgcaggagcucugccaggag

SEQ ID NO: 487945 - RNA, 22 nt, Human
caggucagagucccccuguccu

SEQ ID NO: 487946 - RNA, 22 nt, Human
uaguccaguaaaacagcuaacg

SEQ ID NO: 487947 - RNA, 22 nt, Human
aggccugagccccagguuuguu

SEQ ID NO: 487948 - RNA, 20 nt, Human
acuggacacugaggugagcu

SEQ ID NO: 487949 - RNA, 22 nt, Human
ggauggcaggacaaggacccag

SEQ ID NO: 487950 - RNA, 22 nt, Human
cagagccuuccuagcagacucu

SEQ ID NO: 487951 - RNA, 22 nt, Human
aucaggaucagggcuagcagag

SEQ ID NO: 487952 - RNA, 22 nt, Human
aauccagguggcggagguugug

SEQ ID NO: 487953 - RNA, 22 nt, Human
aaagaggauggaguagucagcu

SEQ ID NO: 487954 - RNA, 21 nt, Human
ucuccaguauccuucucugag

SEQ ID NO: 487955 - RNA, 19 nt, Human
gcucagagggcccugugcu

SEQ ID NO: 487956 - RNA, 22 nt, Human
ccaggagcaaagaucacuggga

SEQ ID NO: 487957 - RNA, 22 nt, Human
cuucugggcauucagcugcaca

SEQ ID NO: 487958 - RNA, 22 nt, Human
cucacugugaccucagcagaca

SEQ ID NO: 487959 - RNA, 19 nt, Human
uccaaaggacccaccucca

SEQ ID NO: 487960 - RNA, 22 nt, Human
ccuggauucaagucuuucuuuc

SEQ ID NO: 487961 - RNA, 22 nt, Human
ggggccagcacugugccuuugu

SEQ ID NO: 487962 - RNA, 22 nt, Human
aaaguucagugccuucuauaca

SEQ ID NO: 487963 - RNA, 22 nt, Human
acugcagggcauccuggccaag

SEQ ID NO: 487964 - RNA, 22 nt, Human
acagagcugggugcccccugga

SEQ ID NO: 487965 - RNA, 22 nt, Human
cuggggcugcagcgaucuucau

SEQ ID NO: 487966 - RNA, 22 nt, Human
aggccagguggucaugcuugcu

SEQ ID NO: 487967 - RNA, 22 nt, Human
gcagcuuucuacuuccuacagc

SEQ ID NO: 487968 - RNA, 22 nt, Human
guccuggggauacagaagugaa

SEQ ID NO: 487969 - RNA, 22 nt, Human
cauggccugccuccuccuggug

SEQ ID NO: 487970 - RNA, 22 nt, Human
ccagccaggcauugcaaacuga

SEQ ID NO: 487971 - RNA, 22 nt, Human
gcugcagugagccaagaucgug

SEQ ID NO: 487972 - RNA, 22 nt, Human
ugucugguggguugacaggcag

SEQ ID NO: 487973 - RNA, 22 nt, Human
ccagcagcccacaggcgucccu

SEQ ID NO: 487974 - RNA, 22 nt, Human
ucugagagagggucagaugcua

SEQ ID NO: 487975 - RNA, 22 nt, Human
cacauaauugaacgugaugagu

SEQ ID NO: 487976 - RNA, 22 nt, Human
ugaggcucaagaaucugcauuu

SEQ ID NO: 487977 - RNA, 22 nt, Human
ucagaggaugcuguucuuuaau

SEQ ID NO: 487978 - RNA, 22 nt, Human
aagcgccaugguuccugcgcag

SEQ ID NO: 487979 - RNA, 20 nt, Human
cuggguggcaagcaaggggg

SEQ ID NO: 487980 - RNA, 22 nt, Human
cagaggcugccagccaugugca

SEQ ID NO: 487981 - RNA, 22 nt, Human
ccagcucuuggugcacuuacau

SEQ ID NO: 487982 - RNA, 22 nt, Human
ucuggcucaggucagacaggga

SEQ ID NO: 487983 - RNA, 22 nt, Human
ccaggacuucgaggcuacagug

SEQ ID NO: 487984 - RNA, 22 nt, Human
ugaauggucacugagcaucugu

SEQ ID NO: 487985 - RNA, 22 nt, Human
cagaaccaggaacugauggaga

SEQ ID NO: 487986 - RNA, 22 nt, Human
cauuguuaccaucuuuuaccua

SEQ ID NO: 487987 - RNA, 22 nt, Human
gagcagagacaguacaacuggc

SEQ ID NO: 487988 - RNA, 22 nt, Human
caggauccccaggucgccgucc

SEQ ID NO: 487989 - RNA, 22 nt, Human
uuugcauuuuagauuuaggccu

SEQ ID NO: 487990 - RNA, 22 nt, Human
cuauuagguaugcagccuauuu

SEQ ID NO: 487991 - RNA, 22 nt, Human
uccucagacuucccuuugugua

SEQ ID NO: 487992 - RNA, 22 nt, Human
uggagagcaagucgcagacaug

SEQ ID NO: 487993 - RNA, 22 nt, Human
guagggacuuguuuuacuagua

SEQ ID NO: 487994 - RNA, 22 nt, Human
ccugccuggaucagccauccug

SEQ ID NO: 487995 - RNA, 22 nt, Human
accaggcaacugugaaugggcu

SEQ ID NO: 487996 - RNA, 22 nt, Human
aaggucauugguucugaauucu

SEQ ID NO: 487997 - RNA, 22 nt, Human
ggucagggcucuuccaguggcu

SEQ ID NO: 487998 - RNA, 22 nt, Human
uuguuucaaauauuucagaaua

SEQ ID NO: 487999 - RNA, 22 nt, Human
caggcagccaggggaccugucc

SEQ ID NO: 488000 - RNA, 22 nt, Human
acaggcagcgucauugcugcuc

SEQ ID NO: 488001 - RNA, 22 nt, Human
ugauuuccucuacuagcaauua

SEQ ID NO: 488002 - RNA, 22 nt, Human
acacacuguugcucauccaggc

SEQ ID NO: 488003 - RNA, 22 nt, Human
uuuuaucugcuucauuaguuga

SEQ ID NO: 488004 - RNA, 22 nt, Human
caccuggcuggaagugcuccgg

SEQ ID NO: 488005 - RNA, 22 nt, Human
aggaccuguagggccugcaucc

SEQ ID NO: 488006 - RNA, 22 nt, Human
acaaaggcagagaauucaacau

SEQ ID NO: 488007 - RNA, 22 nt, Human
uaaaugcaaugugcuuuaccag

SEQ ID NO: 488008 - RNA, 22 nt, Human
ucuggccagugaaaugcagaau

SEQ ID NO: 488009 - RNA, 22 nt, Human
gcagcaggagaguuuguccugc

SEQ ID NO: 488010 - RNA, 22 nt, Human
ggggccagcuucgcgugcucuu

SEQ ID NO: 488011 - RNA, 22 nt, Human
uggcagcugucuguggggucuc

SEQ ID NO: 488012 - RNA, 22 nt, Human
agugucauaugccacugcaucc

SEQ ID NO: 488013 - RNA, 22 nt, Human
guaggaaagggagugaagggaa

SEQ ID NO: 488014 - RNA, 23 nt, Human
uggcugagauccuacuguuugcu

SEQ ID NO: 488015 - RNA, 22 nt, Human
ccucuggggguccucagagucu

SEQ ID NO: 488016 - RNA, 22 nt, Human
cucacuggcaagacuacaggug

SEQ ID NO: 488017 - RNA, 22 nt, Human
aagugguagacaaagauaauug

SEQ ID NO: 488018 - RNA, 22 nt, Human
ccugugucagccccugccucca

SEQ ID NO: 488019 - RNA, 22 nt, Human
aggugucuggauggguguccuu

SEQ ID NO: 488020 - RNA, 22 nt, Human
agcaccuguggcucaugcucgu

SEQ ID NO: 488021 - RNA, 22 nt, Human
uccugccugcaaucccagcacu

SEQ ID NO: 488022 - RNA, 22 nt, Human
gaggcagagugcaccccaggag

SEQ ID NO: 488023 - RNA, 22 nt, Human
gcagcagaguuugggagauggu

SEQ ID NO: 488024 - RNA, 22 nt, Human
cugaaggacuuggugauaguug

SEQ ID NO: 488025 - RNA, 22 nt, Human
uguaacaguaagccugugagcu

SEQ ID NO: 488026 - RNA, 22 nt, Human
uuuauuugucuugccauuuagu

SEQ ID NO: 488027 - RNA, 22 nt, Human
aagacuguaugagacaauauaa

SEQ ID NO: 488028 - RNA, 22 nt, Human
ucaggggagguugaaucgucuc

SEQ ID NO: 488029 - RNA, 22 nt, Human
ccugucaggguuugccucagaa

SEQ ID NO: 488030 - RNA, 22 nt, Human
agcugagcuaguaguuccagug

SEQ ID NO: 488031 - RNA, 22 nt, Human
ucuguaucacccguucccagaa

SEQ ID NO: 488032 - RNA, 22 nt, Human
cacccuagcugucauuucaguu

SEQ ID NO: 488033 - RNA, 19 nt, Human
auacacauacguaaacuga

SEQ ID NO: 488034 - RNA, 22 nt, Human
ggcucagggaaugaggaagaau

SEQ ID NO: 488035 - RNA, 22 nt, Human
ucucaggggccuggaguccugg

SEQ ID NO: 488036 - RNA, 22 nt, Human
agguacagaugaaagucuaguu

SEQ ID NO: 488037 - RNA, 22 nt, Human
uuucucaucuggaaacagugcu

SEQ ID NO: 488038 - RNA, 22 nt, Human
ccagggcauguaacuaauggug

SEQ ID NO: 488039 - RNA, 22 nt, Human
caggcagcagccacucugguau

SEQ ID NO: 488040 - RNA, 22 nt, Human
uccuuugguucucuaagaugcu

SEQ ID NO: 488041 - RNA, 22 nt, Human
gcugcucugcuguguaagcagg

SEQ ID NO: 488042 - RNA, 22 nt, Human
uucagagaagcaaaggcagauu

SEQ ID NO: 488043 - RNA, 22 nt, Human
cuggcucaauaaauauuagcug

SEQ ID NO: 488044 - RNA, 22 nt, Human
gcuggccacauugugccguccu

SEQ ID NO: 488045 - RNA, 21 nt, Human
uuagaagcuaaugcagcuggu

SEQ ID NO: 488046 - RNA, 20 nt, Human
ggagagcagggaagacagua

SEQ ID NO: 488047 - RNA, 22 nt, Human
uagggcagagcuuguacacgau

SEQ ID NO: 488048 - RNA, 22 nt, Human
uuacaaagagugccagagugug

SEQ ID NO: 488049 - RNA, 22 nt, Human
acagcuuuugaaaaauuacugg

SEQ ID NO: 488050 - RNA, 22 nt, Human
agggcuccaaggaaguguagcu

SEQ ID NO: 488051 - RNA, 22 nt, Human
ccauggaguuccucuggucuau

SEQ ID NO: 488052 - RNA, 22 nt, Human
acaguggaugacauccuuuugc

SEQ ID NO: 488053 - RNA, 23 nt, Human
ggcaccaggccauggagcgggag

SEQ ID NO: 488054 - RNA, 22 nt, Human
ugagcccuaagggucaagcagg

SEQ ID NO: 488055 - RNA, 22 nt, Human
aguggcaguggcugggcagagc

SEQ ID NO: 488056 - RNA, 22 nt, Human
auaauacaugguugaucuuuuc

SEQ ID NO: 488057 - RNA, 22 nt, Human
cagccagaaccuaggaugagcu

SEQ ID NO: 488058 - RNA, 22 nt, Human
cauucauuagaauagauaugua

SEQ ID NO: 488059 - RNA, 22 nt, Human
cagcugccccauaaaucacagu

SEQ ID NO: 488060 - RNA, 22 nt, Human
uuauuauugugaccugagaaug

SEQ ID NO: 488061 - RNA, 22 nt, Human
ccgggccucgggacaccgggua

SEQ ID NO: 488062 - RNA, 22 nt, Human
auaauuuacaacugcuuuuaau

SEQ ID NO: 488063 - RNA, 22 nt, Human
cccaaggccuucaagccagcuc

SEQ ID NO: 488064 - RNA, 22 nt, Human
cagggccuccccggcagucuuu

SEQ ID NO: 488065 - RNA, 22 nt, Human
uaauuuaauuucaugccagccu

SEQ ID NO: 488066 - RNA, 20 nt, Human
cuccagggaacagacuggag

SEQ ID NO: 488067 - RNA, 22 nt, Human
agaaguuaccacauacuucucu

SEQ ID NO: 488068 - RNA, 22 nt, Human
aagggcucccaacucaucuuuu

SEQ ID NO: 488069 - RNA, 22 nt, Human
ucccagagguugagucacuuau

SEQ ID NO: 488070 - RNA, 22 nt, Human
uggcagggccugaaucuuauac

SEQ ID NO: 488071 - RNA, 22 nt, Human
uggaagccaggcccgcuccuaa

SEQ ID NO: 488072 - RNA, 23 nt, Human
uggcucucucagugcugcagagg

SEQ ID NO: 488073 - RNA, 22 nt, Human
ggcugccugaggcugaggcccg

SEQ ID NO: 488074 - RNA, 22 nt, Human
aauuaguauugcgauucauuag

SEQ ID NO: 488075 - RNA, 22 nt, Human
acuaaggaauaugacaaacuca

SEQ ID NO: 488076 - RNA, 22 nt, Human
gcugggagcccuggucugcucc

SEQ ID NO: 488077 - RNA, 21 nt, Human
aaagaacaggcagauguucuu

SEQ ID NO: 488078 - RNA, 22 nt, Human
cucuggagcauuucaccuacau

SEQ ID NO: 488079 - RNA, 22 nt, Human
cuuagggaaucuuagagcugga

SEQ ID NO: 488080 - RNA, 22 nt, Human
cagcaauauacacagucuaugg

SEQ ID NO: 488081 - RNA, 21 nt, Human
cucuggaggcaagggagagug

SEQ ID NO: 488082 - RNA, 22 nt, Human
uacuuuuuagcacagugugugc

SEQ ID NO: 488083 - RNA, 22 nt, Human
uucauugugauucuuggcuagc

SEQ ID NO: 488084 - RNA, 22 nt, Human
gaggaagaauugguuauuggag

SEQ ID NO: 488085 - RNA, 21 nt, Human
guggcccugguguggcugcac

SEQ ID NO: 488086 - RNA, 22 nt, Human
agccuggcuaaauucucccaug

SEQ ID NO: 488087 - RNA, 22 nt, Human
ugcuuuaucugugagaaccuga

SEQ ID NO: 488088 - RNA, 22 nt, Human
gucugucaucugagauggagug

SEQ ID NO: 488089 - RNA, 22 nt, Human
ucucugaagauauuuauuauua

SEQ ID NO: 488090 - RNA, 22 nt, Human
ugcccugcagugagugcgucug

SEQ ID NO: 488091 - RNA, 22 nt, Human
aaccaggacaauuugaauagaa

SEQ ID NO: 488092 - RNA, 22 nt, Human
aaaugucuuucaauagagaaau

SEQ ID NO: 488093 - RNA, 22 nt, Human
cuggaagguucuuugugugccu

SEQ ID NO: 488094 - RNA, 22 nt, Human
ugagccaggaguuugaggcugu

SEQ ID NO: 488095 - RNA, 22 nt, Human
agcugccagaugacagugcuau

SEQ ID NO: 488096 - RNA, 21 nt, Human
ccucuggcuugugcugugccc

SEQ ID NO: 488097 - RNA, 22 nt, Human
ggagccuguuaguugagugcuc

SEQ ID NO: 488098 - RNA, 23 nt, Human
auaauaacgucugucuugucucu

SEQ ID NO: 488099 - RNA, 22 nt, Human
ugggcagggucucuguuaucag

SEQ ID NO: 488100 - RNA, 22 nt, Human
gcugucagcgcccaaggagcuc

SEQ ID NO: 488101 - RNA, 22 nt, Human
ccaaggagaaugacaccaugga

SEQ ID NO: 488102 - RNA, 22 nt, Human
guccagagauggacgagcagau

SEQ ID NO: 488103 - RNA, 22 nt, Human
gcucaggaucccaggggugugc

SEQ ID NO: 488104 - RNA, 22 nt, Human
uccugcagccaagggucaucga

SEQ ID NO: 488105 - RNA, 22 nt, Human
aagcaguguucccagcuggccc

SEQ ID NO: 488106 - RNA, 22 nt, Human
agggcucugagugggaaagagg

SEQ ID NO: 488107 - RNA, 22 nt, Human
ggccagaggccacagcuguguc

SEQ ID NO: 488108 - RNA, 22 nt, Human
caggcacuucugcugcuugucu

SEQ ID NO: 488109 - RNA, 20 nt, Human
agugccagggcaggugagag

SEQ ID NO: 488110 - RNA, 22 nt, Human
agcuugaguuuuggaugaagug

SEQ ID NO: 488111 - RNA, 22 nt, Human
ugcagaggagucagccugggca

SEQ ID NO: 488112 - RNA, 22 nt, Human
uaauccacaauagagauuaucu

SEQ ID NO: 488113 - RNA, 22 nt, Human
ucagcuggcaguucagaggcug

SEQ ID NO: 488114 - RNA, 22 nt, Human
aaugagcugcugcuguuccacc

SEQ ID NO: 488115 - RNA, 22 nt, Human
gggugggccacugagcagcgug

SEQ ID NO: 488116 - RNA, 22 nt, Human
aguguguguuugggcgguuuau

SEQ ID NO: 488117 - RNA, 22 nt, Human
uagugaaacaguuaucaaucug

SEQ ID NO: 488118 - RNA, 22 nt, Human
ugggcucugcaucagugcccau

SEQ ID NO: 488119 - RNA, 19 nt, Human
ucucuggggacacuuucac

SEQ ID NO: 488120 - RNA, 22 nt, Human
gaagcagcaaguauaggacagg

SEQ ID NO: 488121 - RNA, 22 nt, Human
gcagggcauagaggcacggagg

SEQ ID NO: 488122 - RNA, 22 nt, Human
agggccagccaggcccuacaaa

SEQ ID NO: 488123 - RNA, 21 nt, Human
guagggacagagaguugguga

SEQ ID NO: 488124 - RNA, 22 nt, Human
agcuuuauagaaaggaucagug

SEQ ID NO: 488125 - RNA, 22 nt, Human
uguucccaagauaagauuauga

SEQ ID NO: 488126 - RNA, 22 nt, Human
ugucuucaucuccaugcacaga

SEQ ID NO: 488127 - RNA, 22 nt, Human
ccagucugugugccagccugcg

SEQ ID NO: 488128 - RNA, 23 nt, Human
agaaaagcuuggacacauggccu

SEQ ID NO: 488129 - RNA, 22 nt, Human
ggggcagagaauaaaaaccuaa

SEQ ID NO: 488130 - RNA, 22 nt, Human
gcccagcuuuucacuuccacac

SEQ ID NO: 488131 - RNA, 22 nt, Human
agaggaaaaugaguuccagaau

SEQ ID NO: 488132 - RNA, 22 nt, Human
aucuggcugagcgaggcccaca

SEQ ID NO: 488133 - RNA, 22 nt, Human
gagccugaaauacaggucacug

SEQ ID NO: 488134 - RNA, 22 nt, Human
cagcaaaagccagcauaagcuc

SEQ ID NO: 488135 - RNA, 22 nt, Human
uucauauauaugcacuacguac

SEQ ID NO: 488136 - RNA, 22 nt, Human
aauauuucuccuucguuauagc

SEQ ID NO: 488137 - RNA, 22 nt, Human
cuuuucauuguuuguacaugca

SEQ ID NO: 488138 - RNA, 17 nt, Human
ugcugccaagucccaac

SEQ ID NO: 488139 - RNA, 22 nt, Human
cagaagcacuaggaggaaacgu

SEQ ID NO: 488140 - RNA, 22 nt, Human
cuuugcaauagaggcacacaug

SEQ ID NO: 488141 - RNA, 21 nt, Human
agccugcaauguagguaccgg

SEQ ID NO: 488142 - RNA, 22 nt, Human
ugcauauuuuauaaagauggaa

SEQ ID NO: 488143 - RNA, 22 nt, Human
gccugcagugagugcagaaggu

SEQ ID NO: 488144 - RNA, 22 nt, Human
ugggcuggcugaggcauucacu

SEQ ID NO: 488145 - RNA, 22 nt, Human
aggacuuagaacauuauguacu

SEQ ID NO: 488146 - RNA, 22 nt, Human
ucuggcccagccccugagguca

SEQ ID NO: 488147 - RNA, 22 nt, Human
aagaaacuguugcgugacagcg

SEQ ID NO: 488148 - RNA, 22 nt, Human
gcccagcaggacagagugguuu

SEQ ID NO: 488149 - RNA, 22 nt, Human
ggagcugcuuugaucugaagaa

SEQ ID NO: 488150 - RNA, 22 nt, Human
ggucccugguucccucugagcu

SEQ ID NO: 488151 - RNA, 22 nt, Human
cuggaagugggguuggcuugaa

SEQ ID NO: 488152 - RNA, 22 nt, Human
uacaguaaccagucuacuuaga

SEQ ID NO: 488153 - RNA, 22 nt, Human
guuugucuuaauuaggcaucga

SEQ ID NO: 488154 - RNA, 22 nt, Human
aucaguuuuguucacuacuaua

SEQ ID NO: 488155 - RNA, 22 nt, Human
cucaggcccacagcagacccac

SEQ ID NO: 488156 - RNA, 22 nt, Human
gagcagcucugggugacccagu

SEQ ID NO: 488157 - RNA, 22 nt, Human
acauauuuccaugcagcauguc

SEQ ID NO: 488158 - RNA, 22 nt, Human
cguuggagacacuugaggacuu

SEQ ID NO: 488159 - RNA, 22 nt, Human
ggcaguggguggaucucaggga

SEQ ID NO: 488160 - RNA, 22 nt, Human
uuugcauuuauaaguuggugga

SEQ ID NO: 488161 - RNA, 22 nt, Human
aggcugccaaagcuucugucuc

SEQ ID NO: 488162 - RNA, 22 nt, Human
acauuucucuuagaguuggacu

SEQ ID NO: 488163 - RNA, 22 nt, Human
gaacaguaucaguagugccagu

SEQ ID NO: 488164 - RNA, 22 nt, Human
cagauggccagaggcagcugca

SEQ ID NO: 488165 - RNA, 22 nt, Human
cauuuguaauacugacuugcag

SEQ ID NO: 488166 - RNA, 22 nt, Human
ugagagggcccagagcacacca

SEQ ID NO: 488167 - RNA, 22 nt, Human
uugcauaaaugcuuaaaauuug

SEQ ID NO: 488168 - RNA, 22 nt, Human
aagauguaucaguuaagucuuc

SEQ ID NO: 488169 - RNA, 22 nt, Human
uugaacaguuuugucagguuca

SEQ ID NO: 488170 - RNA, 22 nt, Human
ccaaaggccaagcucagguaaa

SEQ ID NO: 488171 - RNA, 22 nt, Human
gaagccagcaguggagaaagga

SEQ ID NO: 488172 - RNA, 22 nt, Human
ucucaggccccugaguuucucu

SEQ ID NO: 488173 - RNA, 22 nt, Human
ucaucacucauuggacaacaga

SEQ ID NO: 488174 - RNA, 22 nt, Human
gccaccaggagcccaguccaaa

SEQ ID NO: 488175 - RNA, 22 nt, Human
ugaggaagaacaagaauuuaga

SEQ ID NO: 488176 - RNA, 22 nt, Human
cagcuugcuaauuuugacuuca

SEQ ID NO: 488177 - RNA, 22 nt, Human
cugggaggauucauugagguga

SEQ ID NO: 488178 - RNA, 22 nt, Human
ucagcagauggguuguguuggc

SEQ ID NO: 488179 - RNA, 22 nt, Human
agcugccuccauggucaaagau

SEQ ID NO: 488180 - RNA, 22 nt, Human
gcugccuccugaaagcgcucug

SEQ ID NO: 488181 - RNA, 22 nt, Human
uccaucaccacagaggacagag

SEQ ID NO: 488182 - RNA, 22 nt, Human
gccugcagggccugggccuacc

SEQ ID NO: 488183 - RNA, 22 nt, Human
gggcagagagcuggaacuccuu

SEQ ID NO: 488184 - RNA, 22 nt, Human
ugggcugcugcggugcucuugg

SEQ ID NO: 488185 - RNA, 21 nt, Human
cucuggagucaagagcuucca

SEQ ID NO: 488186 - RNA, 22 nt, Human
ccagccacugggccacugccag

SEQ ID NO: 488187 - RNA, 22 nt, Human
cuccuugguguaguacugagca

SEQ ID NO: 488188 - RNA, 22 nt, Human
ugcaccccauuuuacauuuaca

SEQ ID NO: 488189 - RNA, 22 nt, Human
uaucaacauuaauauuuucugg

SEQ ID NO: 488190 - RNA, 22 nt, Human
cauugcacuccagcuugggcaa

SEQ ID NO: 488191 - RNA, 21 nt, Human
guuuuaagggagaaaaccuag

SEQ ID NO: 488192 - RNA, 22 nt, Human
gcagacuguaucaaugucagua

SEQ ID NO: 488193 - RNA, 22 nt, Human
caaacuguucucugugggauuc

SEQ ID NO: 488194 - RNA, 22 nt, Human
acacugcucacuucuucccuug

SEQ ID NO: 488195 - RNA, 22 nt, Human
agggcgaggagacggaggcaca

SEQ ID NO: 488196 - RNA, 22 nt, Human
agaacuuaggaacaacagcuua

SEQ ID NO: 488197 - RNA, 22 nt, Human
uucuccccugacccugaugagg

SEQ ID NO: 488198 - RNA, 17 nt, Human
accaggcaacacgccca

SEQ ID NO: 488199 - RNA, 22 nt, Human
agucccuguacuuuccacugcc

SEQ ID NO: 488200 - RNA, 22 nt, Human
gcaggaguguggugggacaucc

SEQ ID NO: 488201 - RNA, 22 nt, Human
aggcagagagcaguggccgucu

SEQ ID NO: 488202 - RNA, 22 nt, Human
uccaggcauagaaggcacgcac

SEQ ID NO: 488203 - RNA, 22 nt, Human
gccaggcauucuagaaguagug

SEQ ID NO: 488204 - RNA, 22 nt, Human
acagcagagugugagauagcca

SEQ ID NO: 488205 - RNA, 22 nt, Human
aaaucuaggcucauccuggucc

SEQ ID NO: 488206 - RNA, 22 nt, Human
gucccagaugucuggaacuccc

SEQ ID NO: 488207 - RNA, 23 nt, Human
agagcuuucuaaaauguaaaucu

SEQ ID NO: 488208 - RNA, 22 nt, Human
ucuguaaucaagauauuugaga

SEQ ID NO: 488209 - RNA, 22 nt, Human
guguauaacuaucuaucuagua

SEQ ID NO: 488210 - RNA, 22 nt, Human
uuuauuagugcuuguaucacug

SEQ ID NO: 488211 - RNA, 22 nt, Human
uaaaguuuggcagacaauaaca

SEQ ID NO: 488212 - RNA, 22 nt, Human
agguaaagacagugaaagaggg

SEQ ID NO: 488213 - RNA, 22 nt, Human
cagggccaggcugauggccugg

SEQ ID NO: 488214 - RNA, 22 nt, Human
ggcaggcuggcuuuguuccagg

SEQ ID NO: 488215 - RNA, 22 nt, Human
agcagcucaaagccugcaagga

SEQ ID NO: 488216 - RNA, 21 nt, Human
gcaaguacuaucaucauuauc

SEQ ID NO: 488217 - RNA, 23 nt, Human
gccucugcagccuaguuaguguc

SEQ ID NO: 488218 - RNA, 22 nt, Human
uccugggcugcagggaagagca

SEQ ID NO: 488219 - RNA, 22 nt, Human
agccuggccaggccugcccagg

SEQ ID NO: 488220 - RNA, 18 nt, Human
ucagagagaauaguaauu

SEQ ID NO: 488221 - RNA, 22 nt, Human
cagugucuccagaugcuccaau

SEQ ID NO: 488222 - RNA, 22 nt, Human
aggaaacuguccccucauccua

SEQ ID NO: 488223 - RNA, 22 nt, Human
agaguguaauaagggcaagggc

SEQ ID NO: 488224 - RNA, 22 nt, Human
guuccuauauagccuuaaggau

SEQ ID NO: 488225 - RNA, 22 nt, Human
gggaccuggcgagggucacaca

SEQ ID NO: 488226 - RNA, 22 nt, Human
uguuucuuuguagauauucuuu

SEQ ID NO: 488227 - RNA, 20 nt, Human
acauccuggugacuagaacu

SEQ ID NO: 488228 - RNA, 22 nt, Human
ucagcagggccuccuugugcag

SEQ ID NO: 488229 - RNA, 22 nt, Human
ccagaggacuugggggcugaau

SEQ ID NO: 488230 - RNA, 22 nt, Human
gcucacuggccugaagaggacg

SEQ ID NO: 488231 - RNA, 20 nt, Human
ccugucuccucuuaccuggc

SEQ ID NO: 488232 - RNA, 22 nt, Human
gagcagugagugaauguugccu

SEQ ID NO: 488233 - RNA, 22 nt, Human
caguacuugggaaugcugggga

SEQ ID NO: 488234 - RNA, 22 nt, Human
acccaggaugauaauguucaca

SEQ ID NO: 488235 - RNA, 22 nt, Human
gcugagacuggcagcaggaagu

SEQ ID NO: 488236 - RNA, 22 nt, Human
uggguacuccuauuaguucagu

SEQ ID NO: 488237 - RNA, 22 nt, Human
ucaagcaucuuggucuacgauc

SEQ ID NO: 488238 - RNA, 22 nt, Human
ccuccuuuccuguuuuccugag

SEQ ID NO: 488239 - RNA, 22 nt, Human
cagguggggagaguguggagca

SEQ ID NO: 488240 - RNA, 18 nt, Human
agaagccacgaggagucc

SEQ ID NO: 488241 - RNA, 22 nt, Human
ccagcuuuuccucucauugcuu

SEQ ID NO: 488242 - RNA, 22 nt, Human
uccugccuaccuugcggaggug

SEQ ID NO: 488243 - RNA, 22 nt, Human
uuuaugagcaaugcugagggga

SEQ ID NO: 488244 - RNA, 22 nt, Human
acuuucucaggaauucacagac

SEQ ID NO: 488245 - RNA, 22 nt, Human
gcucagaggcacgaccucuugg

SEQ ID NO: 488246 - RNA, 23 nt, Human
ccugcucaggcgugugcccugcu

SEQ ID NO: 488247 - RNA, 22 nt, Human
cugggcagugguggcaucuuug

SEQ ID NO: 488248 - RNA, 19 nt, Human
caagugaagccugggaugg

SEQ ID NO: 488249 - RNA, 20 nt, Human
ucagugauuuugaagaggaa

SEQ ID NO: 488250 - RNA, 22 nt, Human
cagcucugcugggaggaugcag

SEQ ID NO: 488251 - RNA, 22 nt, Human
uagaaaagauaacauucugugc

SEQ ID NO: 488252 - RNA, 22 nt, Human
ugaaggcccagccacagaaugg

SEQ ID NO: 488253 - RNA, 22 nt, Human
agaggcugggaaggguccccgg

SEQ ID NO: 488254 - RNA, 22 nt, Human
ugaggccagugacauauauuaa

SEQ ID NO: 488255 - RNA, 22 nt, Human
ggagaguggauuccagcuguau

SEQ ID NO: 488256 - RNA, 21 nt, Human
agguggggcugcaccucugcu

SEQ ID NO: 488257 - RNA, 22 nt, Human
ucucagggagggcgagucagcg

SEQ ID NO: 488258 - RNA, 22 nt, Human
cuuggggcugucacucuggcau

SEQ ID NO: 488259 - RNA, 22 nt, Human
gcagaagaccaugguggaaaga

SEQ ID NO: 488260 - RNA, 22 nt, Human
aaaugucuguuagucauaucau

SEQ ID NO: 488261 - RNA, 17 nt, Human
uauacacagacagacug

SEQ ID NO: 488262 - RNA, 23 nt, Human
agcauggaauaggaaagaggcag

SEQ ID NO: 488263 - RNA, 22 nt, Human
acccuggggguggccagugcca

SEQ ID NO: 488264 - RNA, 22 nt, Human
ucuugggauugcccugcaguuc

SEQ ID NO: 488265 - RNA, 22 nt, Human
agugaccaaucaugguuagauu

SEQ ID NO: 488266 - RNA, 19 nt, Human
ucaguuuuagucaucaguu

SEQ ID NO: 488267 - RNA, 22 nt, Human
agacagcaggggagucugguuu

SEQ ID NO: 488268 - RNA, 22 nt, Human
ucugagccguauggcuuggcua

SEQ ID NO: 488269 - RNA, 22 nt, Human
gcccagaguucaaggcugcagu

SEQ ID NO: 488270 - RNA, 22 nt, Human
aaacaacuucugcacuaugggu

SEQ ID NO: 488271 - RNA, 22 nt, Human
gaaaguuugccucucucuugag

SEQ ID NO: 488272 - RNA, 22 nt, Human
gcuggccauggccugcgccauc

SEQ ID NO: 488273 - RNA, 22 nt, Human
agcuccuccugugccaggccag

SEQ ID NO: 488274 - RNA, 22 nt, Human
ucuuuauugcuacugguuuguc

SEQ ID NO: 488275 - RNA, 22 nt, Human
cuguagcaaguuauucaauaaa

SEQ ID NO: 488276 - RNA, 22 nt, Human
ugaagcaggcauugacugauga

SEQ ID NO: 488277 - RNA, 22 nt, Human
gguggaaggccuggaaggaggc

SEQ ID NO: 488278 - RNA, 17 nt, Human
auuucacuuagcaugag

SEQ ID NO: 488279 - RNA, 22 nt, Human
cuggauuuaauuaacuguugcu

SEQ ID NO: 488280 - RNA, 22 nt, Human
cugcuuuguaaaauagacauaa

SEQ ID NO: 488281 - RNA, 22 nt, Human
acagagcuuaggaugacuccca

SEQ ID NO: 488282 - RNA, 20 nt, Human
ugccagggccagcagaggcu

SEQ ID NO: 488283 - RNA, 22 nt, Human
uggcaggauuugcccggaagga

SEQ ID NO: 488284 - RNA, 22 nt, Human
cucucugaggaaggagcaucug

SEQ ID NO: 488285 - RNA, 22 nt, Human
cugacccauauaagaguggagg

SEQ ID NO: 488286 - RNA, 20 nt, Human
cccagccccuaccuguugcc

SEQ ID NO: 488287 - RNA, 22 nt, Human
agcugcucucacuggacgccug

SEQ ID NO: 488288 - RNA, 22 nt, Human
cugagccaguagucagggacaa

SEQ ID NO: 488289 - RNA, 22 nt, Human
caggcugaggcaguaggguuug

SEQ ID NO: 488290 - RNA, 22 nt, Human
ccucccacuucuugcugagguc

SEQ ID NO: 488291 - RNA, 22 nt, Human
agaguggagagaaacaacucug

SEQ ID NO: 488292 - RNA, 22 nt, Human
ucucugcugagaagggcuggca

SEQ ID NO: 488293 - RNA, 22 nt, Human
aaagaacaaauuagcuguuuua

SEQ ID NO: 488294 - RNA, 22 nt, Human
ccagccuggacugggucuugug

SEQ ID NO: 488295 - RNA, 22 nt, Human
ccaggccucaccugcccaccua

SEQ ID NO: 488296 - RNA, 22 nt, Human
gaggggcugggguugacuccaa

SEQ ID NO: 488297 - RNA, 22 nt, Human
ggggauggugggaaggcaaucu

SEQ ID NO: 488298 - RNA, 22 nt, Human
aggcagcaauugaaaucauugu

SEQ ID NO: 488299 - RNA, 23 nt, Human
auguuauuauuagcagucuugcc

SEQ ID NO: 488300 - RNA, 22 nt, Human
ucugcagcuuuuugguggggug

SEQ ID NO: 488301 - RNA, 22 nt, Human
agcaccugcuuaaugugcagug

SEQ ID NO: 488302 - RNA, 22 nt, Human
gaagccccaaacccucgccauc

SEQ ID NO: 488303 - RNA, 22 nt, Human
cacucaggcugugucaggagga

SEQ ID NO: 488304 - RNA, 22 nt, Human
cccagccucagcuuuacuucca

SEQ ID NO: 488305 - RNA, 22 nt, Human
cuggcagcucugagucccuucu

SEQ ID NO: 488306 - RNA, 22 nt, Human
caaggccaugagcagcgagugu

SEQ ID NO: 488307 - RNA, 22 nt, Human
cugccaggacugacgucuucag

SEQ ID NO: 488308 - RNA, 22 nt, Human
acaguggauauauuaaaugaga

SEQ ID NO: 488309 - RNA, 22 nt, Human
uuggcuucuggcagucuggacg

SEQ ID NO: 488310 - RNA, 22 nt, Human
cuguuauuuagaacauggaauc

SEQ ID NO: 488311 - RNA, 22 nt, Human
agggcacaucugcugggaaugg

SEQ ID NO: 488312 - RNA, 22 nt, Human
uggggcuggcuauugucucccu

SEQ ID NO: 488313 - RNA, 22 nt, Human
uagagcuguaucaaagagccuu

SEQ ID NO: 488314 - RNA, 22 nt, Human
ucccuggacagccuugccuggg

SEQ ID NO: 488315 - RNA, 22 nt, Human
ccuuagagaguacugggcugcc

SEQ ID NO: 488316 - RNA, 22 nt, Human
gcagcuuuaaaggaggcucuga

SEQ ID NO: 488317 - RNA, 22 nt, Human
gagccugaugaaacaggcagac

SEQ ID NO: 488318 - RNA, 22 nt, Human
uaguggagaggauguggagaaa

SEQ ID NO: 488319 - RNA, 22 nt, Human
aggcugagggcuccugagggca

SEQ ID NO: 488320 - RNA, 22 nt, Human
gaaggccauuuuuagguagaau

SEQ ID NO: 488321 - RNA, 22 nt, Human
cugcucucuguuccccuggauc

SEQ ID NO: 488322 - RNA, 22 nt, Human
uguauacauuuaacuagauaga

SEQ ID NO: 488323 - RNA, 22 nt, Human
agcugggucuugggccaggaga

SEQ ID NO: 488324 - RNA, 22 nt, Human
ugcaccauguaaguggccacgu

SEQ ID NO: 488325 - RNA, 22 nt, Human
uuuucuuauggugaagcacaaa

SEQ ID NO: 488326 - RNA, 22 nt, Human
ccagggcagcagaauuggggca

SEQ ID NO: 488327 - RNA, 22 nt, Human
gagauuggauuuaauggccaaa

SEQ ID NO: 488328 - RNA, 22 nt, Human
ucuggcuccguguccgcuccca

SEQ ID NO: 488329 - RNA, 22 nt, Human
ugauuucccucaucauaacaga

SEQ ID NO: 488330 - RNA, 22 nt, Human
cagggcucgcucgcucgcucgc

SEQ ID NO: 488331 - RNA, 22 nt, Human
cacaggcugcccgcagcuggga

SEQ ID NO: 488332 - RNA, 22 nt, Human
uggagccaggagccugggaguc

SEQ ID NO: 488333 - RNA, 22 nt, Human
agggacagucuacuguucacug

SEQ ID NO: 488334 - RNA, 22 nt, Human
ccagggugaccagcuggccuag

SEQ ID NO: 488335 - RNA, 20 nt, Human
cuguggcucaugcaucugcc

SEQ ID NO: 488336 - RNA, 22 nt, Human
ccucaggguggcaucagaucuu

SEQ ID NO: 488337 - RNA, 20 nt, Human
ccagagaguagguuagugau

SEQ ID NO: 488338 - RNA, 22 nt, Human
guccucuguguaggcugcagac

SEQ ID NO: 488339 - RNA, 22 nt, Human
uucacagggcagcagcugagcc

SEQ ID NO: 488340 - RNA, 22 nt, Human
auccucagaccucagcaaagcc

SEQ ID NO: 488341 - RNA, 22 nt, Human
auuguacaugcagugagucauc

SEQ ID NO: 488342 - RNA, 19 nt, Human
auaaggcaauuggauuugg

SEQ ID NO: 488343 - RNA, 22 nt, Human
cacguuuuaugacagaagaagc

SEQ ID NO: 488344 - RNA, 22 nt, Human
cuggccuuuaaaaugaccuuau

SEQ ID NO: 488345 - RNA, 22 nt, Human
uuuucuaacaucuaguaauuug

SEQ ID NO: 488346 - RNA, 22 nt, Human
guccagcugaucuugacccagc

SEQ ID NO: 488347 - RNA, 22 nt, Human
cagaggcacagcuucuuuuaau

SEQ ID NO: 488348 - RNA, 22 nt, Human
agauacauagcugugagcacac

SEQ ID NO: 488349 - RNA, 22 nt, Human
guggugcauccuugaguaagcu

SEQ ID NO: 488350 - RNA, 22 nt, Human
cucagggcuggaaagccaggaa

SEQ ID NO: 488351 - RNA, 22 nt, Human
ggucccaggauugguugcgcag

SEQ ID NO: 488352 - RNA, 20 nt, Human
aacacagauaccaaagguug

SEQ ID NO: 488353 - RNA, 22 nt, Human
gaaaacuaacggaaaaguuagg

SEQ ID NO: 488354 - RNA, 22 nt, Human
gggcucagccccauugaaccag

SEQ ID NO: 488355 - RNA, 22 nt, Human
cuccagggagcuuggaaagacc

SEQ ID NO: 488356 - RNA, 22 nt, Human
uggacucaaguccaaguucacg

SEQ ID NO: 488357 - RNA, 22 nt, Human
uggaggaugccauccaggauac

SEQ ID NO: 488358 - RNA, 22 nt, Human
cagggacugagauccagacugu

SEQ ID NO: 488359 - RNA, 22 nt, Human
ucacaugcucaccuaagccaca

SEQ ID NO: 488360 - RNA, 22 nt, Human
uuauuagggugguuuauguucu

SEQ ID NO: 488361 - RNA, 22 nt, Human
uuugaaagcaggugugggaggg

SEQ ID NO: 488362 - RNA, 21 nt, Human
accaggcuugugggagggagc

SEQ ID NO: 488363 - RNA, 22 nt, Human
gccaguggcuugccaggcagga

SEQ ID NO: 488364 - RNA, 22 nt, Human
agccagagagccccagguucua

SEQ ID NO: 488365 - RNA, 22 nt, Human
ccaggcaucacgggcauguggc

SEQ ID NO: 488366 - RNA, 22 nt, Human
aagagcugauuaagucaugagg

SEQ ID NO: 488367 - RNA, 19 nt, Human
gcaggcacagcccugggug

SEQ ID NO: 488368 - RNA, 22 nt, Human
ggcagugaugucaaacagugaa

SEQ ID NO: 488369 - RNA, 22 nt, Human
cagcugcccaagccccagaugu

SEQ ID NO: 488370 - RNA, 22 nt, Human
uugaaggacaucuuguuucuag

SEQ ID NO: 488371 - RNA, 22 nt, Human
gcagugaaacaauaggaucaaa

SEQ ID NO: 488372 - RNA, 22 nt, Human
agucccagagaggucggggcca

SEQ ID NO: 488373 - RNA, 22 nt, Human
gcuggggagcaagaguagugag

SEQ ID NO: 488374 - RNA, 22 nt, Human
ucaucaaagcgcuuggaguagg

SEQ ID NO: 488375 - RNA, 20 nt, Human
cagggccacgcuccaaggca

SEQ ID NO: 488376 - RNA, 17 nt, Human
uuagcaaaauagcacuu

SEQ ID NO: 488377 - RNA, 22 nt, Human
agagauucauguuuacuguagg

SEQ ID NO: 488378 - RNA, 22 nt, Human
gcccuuccuuagacagcaggau

SEQ ID NO: 488379 - RNA, 22 nt, Human
ccuuggagcggucagcacuggu

SEQ ID NO: 488380 - RNA, 22 nt, Human
auuucuucaggucagaaauaga

SEQ ID NO: 488381 - RNA, 19 nt, Human
aggcucugagcuccuggag

SEQ ID NO: 488382 - RNA, 22 nt, Human
acugucucucuagcaguucagg

SEQ ID NO: 488383 - RNA, 18 nt, Human
gagacacaagggccugga

SEQ ID NO: 488384 - RNA, 19 nt, Human
caggaaugagguaauggcu

SEQ ID NO: 488385 - RNA, 22 nt, Human
uucaaucauuagaaucucaggc

SEQ ID NO: 488386 - RNA, 21 nt, Human
uuucugaaggcaacaucuauc

SEQ ID NO: 488387 - RNA, 22 nt, Human
ggcucagagaccugcgaucuga

SEQ ID NO: 488388 - RNA, 22 nt, Human
cccaggcuggagugcaauggug

SEQ ID NO: 488389 - RNA, 22 nt, Human
ggccugaggcaauagucagaca

SEQ ID NO: 488390 - RNA, 22 nt, Human
augucuuucgcaucaguagcua

SEQ ID NO: 488391 - RNA, 22 nt, Human
ugcagaagaaaacagcugugug

SEQ ID NO: 488392 - RNA, 22 nt, Human
auuuuuccaugauacuuaucug

SEQ ID NO: 488393 - RNA, 22 nt, Human
aucaaaguggaaguuuacuagg

SEQ ID NO: 488394 - RNA, 22 nt, Human
uagggacacugcucaugaguuc

SEQ ID NO: 488395 - RNA, 22 nt, Human
aaguugaaugcguacgugacau

SEQ ID NO: 488396 - RNA, 22 nt, Human
uggccugccugggagcagcagg

SEQ ID NO: 488397 - RNA, 22 nt, Human
gcagggugauagugaggcucag

SEQ ID NO: 488398 - RNA, 22 nt, Human
ucuggcucuauaacuccuagcu

SEQ ID NO: 488399 - RNA, 22 nt, Human
uucucuggaacugaaacaagau

SEQ ID NO: 488400 - RNA, 22 nt, Human
aacucaguucuuuccacaaugc

SEQ ID NO: 488401 - RNA, 22 nt, Human
agagcucaagacgcucacagua

SEQ ID NO: 488402 - RNA, 22 nt, Human
caggccacaaguuggguucaag

SEQ ID NO: 488403 - RNA, 22 nt, Human
uuuguuagagugugggaggcug

SEQ ID NO: 488404 - RNA, 22 nt, Human
ucagaagccggaagugcuccuc

SEQ ID NO: 488405 - RNA, 22 nt, Human
ucucagaggugcccuggcaucu

SEQ ID NO: 488406 - RNA, 22 nt, Human
gaggaaccacucugagaagcca

SEQ ID NO: 488407 - RNA, 22 nt, Human
ucccagcagggccgaccagccu

SEQ ID NO: 488408 - RNA, 22 nt, Human
uggcaggagguuuucuccagga

SEQ ID NO: 488409 - RNA, 22 nt, Human
agccacaggaaacagagacagc

SEQ ID NO: 488410 - RNA, 19 nt, Human
uuagccauccacagugaaa

SEQ ID NO: 488411 - RNA, 22 nt, Human
auaaggcagucacuggaauguu

SEQ ID NO: 488412 - RNA, 22 nt, Human
agaccaagugcaggugccacua

SEQ ID NO: 488413 - RNA, 18 nt, Human
uucacaggaaaugucuuu

SEQ ID NO: 488414 - RNA, 22 nt, Human
ucagagagccucaggcacugcc

SEQ ID NO: 488415 - RNA, 22 nt, Human
ucaccgccuugcccggccgggc

SEQ ID NO: 488416 - RNA, 19 nt, Human
ucucaauguucagaaagcu

SEQ ID NO: 488417 - RNA, 20 nt, Human
ugggcugaggaucaggugcc

SEQ ID NO: 488418 - RNA, 22 nt, Human
ccuuuuucaauauagaauugca

SEQ ID NO: 488419 - RNA, 22 nt, Human
agcccaagcuaugaggugaccu

SEQ ID NO: 488420 - RNA, 22 nt, Human
cagcuguggagauggggugcau

SEQ ID NO: 488421 - RNA, 22 nt, Human
agugcugacucugggcacagug

SEQ ID NO: 488422 - RNA, 22 nt, Human
ugugcugguacaugugaggaug

SEQ ID NO: 488423 - RNA, 23 nt, Human
guggccuccccggaaugccucgc

SEQ ID NO: 488424 - RNA, 22 nt, Human
aguaacaagugccaacguuaga

SEQ ID NO: 488425 - RNA, 22 nt, Human
ggggagaguccuuuccaguucc

SEQ ID NO: 488426 - RNA, 22 nt, Human
ggugccagccuagugcaguggu

SEQ ID NO: 488427 - RNA, 22 nt, Human
ugcugcuccccagcacacagca

SEQ ID NO: 488428 - RNA, 22 nt, Human
agcucacaguguccuuccucaa

SEQ ID NO: 488429 - RNA, 22 nt, Human
uaugcacacauguaugcaugug

SEQ ID NO: 488430 - RNA, 20 nt, Human
uggaccugucucuuuaggga

SEQ ID NO: 488431 - RNA, 22 nt, Human
cuggagggugagccucaucucu

SEQ ID NO: 488432 - RNA, 19 nt, Human
uggcugggcgugccuccgu

SEQ ID NO: 488433 - RNA, 22 nt, Human
ucccagagaagagcuggaugga

SEQ ID NO: 488434 - RNA, 22 nt, Human
gugcugaguagaaugaaugccu

SEQ ID NO: 488435 - RNA, 22 nt, Human
uaauuucuucaucucugcagcu

SEQ ID NO: 488436 - RNA, 22 nt, Human
gacucagugauuugacaugccu

SEQ ID NO: 488437 - RNA, 22 nt, Human
aaauuauuacaagcuaguuggc

SEQ ID NO: 488438 - RNA, 22 nt, Human
gcagccacugggagugcuuaua

SEQ ID NO: 488439 - RNA, 22 nt, Human
cccugcagaucuaggguccuuc

SEQ ID NO: 488440 - RNA, 21 nt, Human
cugugcuucuuccuaagccag

SEQ ID NO: 488441 - RNA, 22 nt, Human
gcagagccaggcuggggcaggu

SEQ ID NO: 488442 - RNA, 22 nt, Human
agagccaggaucuguuuugggg

SEQ ID NO: 488443 - RNA, 22 nt, Human
uaagauaugguaggaaguuugg

SEQ ID NO: 488444 - RNA, 17 nt, Human
ugagcaguagaagaugc

SEQ ID NO: 488445 - RNA, 22 nt, Human
ucugaaggugcuagagaaagcu

SEQ ID NO: 488446 - RNA, 22 nt, Human
agguccagcuguugcagccucc

SEQ ID NO: 488447 - RNA, 22 nt, Human
uaguuaggaauagcagcgacuc

SEQ ID NO: 488448 - RNA, 22 nt, Human
uggcagcagggaggccaguguu

SEQ ID NO: 488449 - RNA, 22 nt, Human
gaggcugccccuuccucagcug

SEQ ID NO: 488450 - RNA, 22 nt, Human
aacaacugaaaagcuuuuucug

SEQ ID NO: 488451 - RNA, 22 nt, Human
ucacguuuuacugagugagaua

SEQ ID NO: 488452 - RNA, 22 nt, Human
gggaaauugucaacacucucaa

SEQ ID NO: 488453 - RNA, 22 nt, Human
caggcagcucgaugccuuguug

SEQ ID NO: 488454 - RNA, 21 nt, Human
gcagagccggggcgagaaggc

SEQ ID NO: 488455 - RNA, 22 nt, Human
ccuccuagaggaaccccagggc

SEQ ID NO: 488456 - RNA, 22 nt, Human
ccagucccagcucugccaugcu

SEQ ID NO: 488457 - RNA, 22 nt, Human
uaggccagcccuuaguccuguc

SEQ ID NO: 488458 - RNA, 22 nt, Human
gaaaggcaguacagcugagccu

SEQ ID NO: 488459 - RNA, 22 nt, Human
cagcugcuguucaguuuuguuu

SEQ ID NO: 488460 - RNA, 22 nt, Human
uccaugucuucaugugucuaac

SEQ ID NO: 488461 - RNA, 22 nt, Human
ccaggagguggagauugcagug

SEQ ID NO: 488462 - RNA, 22 nt, Human
gauuucaccugaucuugucauc

SEQ ID NO: 488463 - RNA, 22 nt, Human
gcccugugccagucacgcugug

SEQ ID NO: 488464 - RNA, 23 nt, Human
uugaaagguagcuggcagcuaga

SEQ ID NO: 488465 - RNA, 22 nt, Human
aguguuugucccguuagaaaug

SEQ ID NO: 488466 - RNA, 22 nt, Human
gaauucugucgcuuacuagaug

SEQ ID NO: 488467 - RNA, 22 nt, Human
uucagugugugauaccugcugu

SEQ ID NO: 488468 - RNA, 22 nt, Human
gauuuauuuuuaaucagcaggg

SEQ ID NO: 488469 - RNA, 22 nt, Human
uuugcauugccucugacuuaug

SEQ ID NO: 488470 - RNA, 22 nt, Human
cccuggagugccggaaucaaga

SEQ ID NO: 488471 - RNA, 22 nt, Human
agugacugacaccuguaauccc

SEQ ID NO: 488472 - RNA, 22 nt, Human
ugggagcacccugaggagcuuc

SEQ ID NO: 488473 - RNA, 23 nt, Human
aggagccaggugcagcccuugug

SEQ ID NO: 488474 - RNA, 22 nt, Human
uccugugccuccaccugcuccg

SEQ ID NO: 488475 - RNA, 22 nt, Human
gcgguagcucaagcuuguaauc

SEQ ID NO: 488476 - RNA, 22 nt, Human
ucugucucaaguucuugcacuc

SEQ ID NO: 488477 - RNA, 22 nt, Human
uuucuacauucaaaaacuacca

SEQ ID NO: 488478 - RNA, 22 nt, Human
gcagccacucucauuccacgug

SEQ ID NO: 488479 - RNA, 22 nt, Human
aagcugcccucauucccagugc

SEQ ID NO: 488480 - RNA, 22 nt, Human
gcucugcucuaacauuccugac

SEQ ID NO: 488481 - RNA, 22 nt, Human
uggagccagagcgcagccuggg

SEQ ID NO: 488482 - RNA, 22 nt, Human
aggucacacuuggaucauagaa

SEQ ID NO: 488483 - RNA, 22 nt, Human
ggaaggaggaugcucuggccuu

SEQ ID NO: 488484 - RNA, 22 nt, Human
agcugccacaugcccaagggca

SEQ ID NO: 488485 - RNA, 22 nt, Human
uauguacaaucagcaguucaua

SEQ ID NO: 488486 - RNA, 21 nt, Human
agccaggcaagcacccccacu

SEQ ID NO: 488487 - RNA, 22 nt, Human
agcaccaucagaugcaauaucu

SEQ ID NO: 488488 - RNA, 22 nt, Human
cccagacugcagagcgggcaga

SEQ ID NO: 488489 - RNA, 22 nt, Human
uccaggcuagguuuacaggaca

SEQ ID NO: 488490 - RNA, 22 nt, Human
acugauacaucuguggaagugg

SEQ ID NO: 488491 - RNA, 22 nt, Human
uggcagagccuugccaaacucc

SEQ ID NO: 488492 - RNA, 22 nt, Human
ugcagaagcugcaggucagugg

SEQ ID NO: 488493 - RNA, 22 nt, Human
caggaggccaacugugggacuu

SEQ ID NO: 488494 - RNA, 22 nt, Human
agguaaggcuguaagcuaagcc

SEQ ID NO: 488495 - RNA, 22 nt, Human
cagcuuuauugagguauaauug

SEQ ID NO: 488496 - RNA, 22 nt, Human
guacaaaaguuauugcgguuuu

SEQ ID NO: 488497 - RNA, 22 nt, Human
ucacaugcccuguauuuaccag

SEQ ID NO: 488498 - RNA, 22 nt, Human
cuccucccugcgauugcucugc

SEQ ID NO: 488499 - RNA, 22 nt, Human
gcucagagcacucagacucagc

SEQ ID NO: 488500 - RNA, 22 nt, Human
auuuagaaguuggagggcaaga

SEQ ID NO: 488501 - RNA, 22 nt, Human
agcaggugcauggcgagcgcgg

SEQ ID NO: 488502 - RNA, 19 nt, Human
gggcuuggggcugaagccu

SEQ ID NO: 488503 - RNA, 22 nt, Human
gcagaagcugggcagcgaggug

SEQ ID NO: 488504 - RNA, 22 nt, Human
acauuucuugaugccucuguga

SEQ ID NO: 488505 - RNA, 22 nt, Human
ggcucugcuucagaaggcucau

SEQ ID NO: 488506 - RNA, 19 nt, Human
ugcagcucagggcaggggc

SEQ ID NO: 488507 - RNA, 20 nt, Human
ugcagcugguuucacaggga

SEQ ID NO: 488508 - RNA, 22 nt, Human
agggcagacuaggauggaagug

SEQ ID NO: 488509 - RNA, 22 nt, Human
ccaggcucugucuggucagaag

SEQ ID NO: 488510 - RNA, 22 nt, Human
gggagucugggcuagacuccuu

SEQ ID NO: 488511 - RNA, 22 nt, Human
aguggagaagaggauggucucc

SEQ ID NO: 488512 - RNA, 22 nt, Human
ugcagggccccucugcaugagu

SEQ ID NO: 488513 - RNA, 22 nt, Human
ggagauaguccaggugaaggga

SEQ ID NO: 488514 - RNA, 22 nt, Human
acagcuggaggucugugagcac

SEQ ID NO: 488515 - RNA, 18 nt, Human
gggcccuggcguccgccc

SEQ ID NO: 488516 - RNA, 22 nt, Human
ucccagaaaaaggaggcuauga

SEQ ID NO: 488517 - RNA, 22 nt, Human
ggcucuggcguccaauggagcg

SEQ ID NO: 488518 - RNA, 22 nt, Human
gaggaguguauuccacaccacu

SEQ ID NO: 488519 - RNA, 21 nt, Human
uucaagauauuuaaaaggugg

SEQ ID NO: 488520 - RNA, 22 nt, Human
ucucccaggugggugccuggag

SEQ ID NO: 488521 - RNA, 22 nt, Human
cagagaaacucagauagcugau

SEQ ID NO: 488522 - RNA, 22 nt, Human
ugagagugguucagcucagaag

SEQ ID NO: 488523 - RNA, 22 nt, Human
ugaagaugucagcagggguggu

SEQ ID NO: 488524 - RNA, 22 nt, Human
cucuguagaaacagggcagaag

SEQ ID NO: 488525 - RNA, 22 nt, Human
uuauuaggaacucaggauuuuu

SEQ ID NO: 488526 - RNA, 21 nt, Human
guuuucaugauagagucugua

SEQ ID NO: 488527 - RNA, 23 nt, Human
uggcccugaaucuguccuggagg

SEQ ID NO: 488528 - RNA, 22 nt, Human
ugcaggugugguuccucagcca

SEQ ID NO: 488529 - RNA, 22 nt, Human
gcugcucuuuucagagaugaga

SEQ ID NO: 488530 - RNA, 22 nt, Human
gacaugcaugaaugcaggucuc

SEQ ID NO: 488531 - RNA, 22 nt, Human
uacauugugauguuucaauaca

SEQ ID NO: 488532 - RNA, 18 nt, Human
cacaggcucccagugagg

SEQ ID NO: 488533 - RNA, 22 nt, Human
ugcagugguguccagguguacu

SEQ ID NO: 488534 - RNA, 22 nt, Human
aaaugcaggaaauuaugcuuuu

SEQ ID NO: 488535 - RNA, 22 nt, Human
ucuagaaaaaaacugcugugga

SEQ ID NO: 488536 - RNA, 22 nt, Human
guccugggaaggaagccaggga

SEQ ID NO: 488537 - RNA, 22 nt, Human
acagagagaggcccgaggcugc

SEQ ID NO: 488538 - RNA, 20 nt, Human
ggggcaguggcucaugccug

SEQ ID NO: 488539 - RNA, 19 nt, Human
aggcagcaggccagggaug

SEQ ID NO: 488540 - RNA, 22 nt, Human
gagcuuuaagggcacuggucuu

SEQ ID NO: 488541 - RNA, 19 nt, Human
ucaaaggcaaggaggaacu

SEQ ID NO: 488542 - RNA, 22 nt, Human
ucuuugcaucccuuccauaguu

SEQ ID NO: 488543 - RNA, 22 nt, Human
ucagagaguuacacaaauuguu

SEQ ID NO: 488544 - RNA, 22 nt, Human
acccaggccugagagacaggag

SEQ ID NO: 488545 - RNA, 22 nt, Human
ccaucagcuccaguaucuucug

SEQ ID NO: 488546 - RNA, 22 nt, Human
ucucccaggcuggagugcagug

SEQ ID NO: 488547 - RNA, 22 nt, Human
gcaccacaucaaugaggggagc

SEQ ID NO: 488548 - RNA, 22 nt, Human
gaguuauuggguggaaagguag

SEQ ID NO: 488549 - RNA, 22 nt, Human
cugagaauuacucugaugagua

SEQ ID NO: 488550 - RNA, 21 nt, Human
acagccugucaucucaugguc

SEQ ID NO: 488551 - RNA, 22 nt, Human
cuggcagguggauggggacucc

SEQ ID NO: 488552 - RNA, 22 nt, Human
agaaauacuuuguaaaucucac

SEQ ID NO: 488553 - RNA, 22 nt, Human
agacaaagaaaccguagaagca

SEQ ID NO: 488554 - RNA, 22 nt, Human
guccucaguaagagggccucug

SEQ ID NO: 488555 - RNA, 22 nt, Human
gagcucauucauucauugccug

SEQ ID NO: 488556 - RNA, 22 nt, Human
agcugcagagguuugugcaaca

SEQ ID NO: 488557 - RNA, 22 nt, Human
cuuaacagcaagaucuguguca

SEQ ID NO: 488558 - RNA, 22 nt, Human
ggggcagccuccaggaaagcug

SEQ ID NO: 488559 - RNA, 22 nt, Human
ucugagaggcagaccuuccuaa

SEQ ID NO: 488560 - RNA, 22 nt, Human
agcagcauaucagagaaaguca

SEQ ID NO: 488561 - RNA, 22 nt, Human
ugucagagcaaugagguucagc

SEQ ID NO: 488562 - RNA, 22 nt, Human
agaaacugaauuauuucugagg

SEQ ID NO: 488563 - RNA, 22 nt, Human
cagguggguacaucacagagac

SEQ ID NO: 488564 - RNA, 22 nt, Human
gcacagaacuucucuuaguagg

SEQ ID NO: 488565 - RNA, 22 nt, Human
aagcugcccaagacugaagcau

SEQ ID NO: 488566 - RNA, 22 nt, Human
ggcucccugccuguccucaguc

SEQ ID NO: 488567 - RNA, 22 nt, Human
ucacuucacacccacuaucaug

SEQ ID NO: 488568 - RNA, 22 nt, Human
uacauagcaaggaaaugacaga

SEQ ID NO: 488569 - RNA, 22 nt, Human
ccagcuccaaguuugggcauca

SEQ ID NO: 488570 - RNA, 20 nt, Human
agcauuugaaauaugacuau

SEQ ID NO: 488571 - RNA, 22 nt, Human
agagcagauggagcuggaagag

SEQ ID NO: 488572 - RNA, 19 nt, Human
cccagagcauccugaacuu

SEQ ID NO: 488573 - RNA, 22 nt, Human
ggacagagcccugguggccuaa

SEQ ID NO: 488574 - RNA, 22 nt, Human
aaagccuugagauccuauaguu

SEQ ID NO: 488575 - RNA, 22 nt, Human
agugcacaccuuaguacaaagu

SEQ ID NO: 488576 - RNA, 22 nt, Human
ccaggguguagggauuccagau

SEQ ID NO: 488577 - RNA, 22 nt, Human
agagcagagggcucugggacaa

SEQ ID NO: 488578 - RNA, 22 nt, Human
uucacaauaggagcaugcaaau

SEQ ID NO: 488579 - RNA, 22 nt, Human
aggagccaguuccaccccagga

SEQ ID NO: 488580 - RNA, 22 nt, Human
ugcuucugggcaaaugugugug

SEQ ID NO: 488581 - RNA, 22 nt, Human
agccaggauuggcugagccuua

SEQ ID NO: 488582 - RNA, 22 nt, Human
aaggcuuucagcuaacuugauu

SEQ ID NO: 488583 - RNA, 23 nt, Human
agucaguguaaguuuggaaugca

SEQ ID NO: 488584 - RNA, 22 nt, Human
uuccagcaggcagacaggagau

SEQ ID NO: 488585 - RNA, 22 nt, Human
acuuucauuuguaauaaacuuc

SEQ ID NO: 488586 - RNA, 22 nt, Human
cuggagugaagucuggcagcuu

SEQ ID NO: 488587 - RNA, 22 nt, Human
cauuucuguucucuuccuguac

SEQ ID NO: 488588 - RNA, 22 nt, Human
ggcucuggguucugcaaugcgu

SEQ ID NO: 488589 - RNA, 20 nt, Human
acaggggcagcacaauaaug

SEQ ID NO: 488590 - RNA, 22 nt, Human
gagcacagggaauagacagaua

SEQ ID NO: 488591 - RNA, 22 nt, Human
gaggaugugucuggucugggca

SEQ ID NO: 488592 - RNA, 22 nt, Human
cagcuggggcagccacgugcgg

SEQ ID NO: 488593 - RNA, 22 nt, Human
augaggcaaggaucagguaagg

SEQ ID NO: 488594 - RNA, 20 nt, Human
gcagagccucacugcaaggg

SEQ ID NO: 488595 - RNA, 22 nt, Human
ggcugggccagggccuguggac

SEQ ID NO: 488596 - RNA, 22 nt, Human
cagugagguggauggauggccu

SEQ ID NO: 488597 - RNA, 23 nt, Human
acagcugcaccuggccgccuggc

SEQ ID NO: 488598 - RNA, 22 nt, Human
acagcugugaaaauccacagga

SEQ ID NO: 488599 - RNA, 22 nt, Human
ccuggagcacagcccaguccca

SEQ ID NO: 488600 - RNA, 22 nt, Human
aauuaacaaauguagcugugau

SEQ ID NO: 488601 - RNA, 20 nt, Human
ccuggagccuggaaggaguc

SEQ ID NO: 488602 - RNA, 22 nt, Human
cagaaguggccucagagggagu

SEQ ID NO: 488603 - RNA, 22 nt, Human
guaugcaucgacucaagucuga

SEQ ID NO: 488604 - RNA, 22 nt, Human
aggcugcuuccuuacguggcug

SEQ ID NO: 488605 - RNA, 22 nt, Human
gggcuggagccagcuguggcug

SEQ ID NO: 488606 - RNA, 22 nt, Human
gagcagggagacaacucuggug

SEQ ID NO: 488607 - RNA, 22 nt, Human
gugggaugguagguagguaaua

SEQ ID NO: 488608 - RNA, 22 nt, Human
cauggcaggaggcugcuggcag

SEQ ID NO: 488609 - RNA, 22 nt, Human
gcauggcauuaacaagauggaa

SEQ ID NO: 488610 - RNA, 22 nt, Human
aggcaagggggcgccaccuucc

SEQ ID NO: 488611 - RNA, 22 nt, Human
ugccaggcccugcgggguccca

SEQ ID NO: 488612 - RNA, 22 nt, Human
ugggcuccuugggagcaaguga

SEQ ID NO: 488613 - RNA, 22 nt, Human
ggggccagguccagcuuccaaa

SEQ ID NO: 488614 - RNA, 22 nt, Human
ggucacaggggagaagagugau

SEQ ID NO: 488615 - RNA, 22 nt, Human
aagcacuuagaagagugccugc

SEQ ID NO: 488616 - RNA, 22 nt, Human
gcagggacaccuuugugaagcu

SEQ ID NO: 488617 - RNA, 22 nt, Human
aagggcaggcagagaucauaua

SEQ ID NO: 488618 - RNA, 22 nt, Human
ggcaggguggcagaggcucaga

SEQ ID NO: 488619 - RNA, 22 nt, Human
guccucagagugggcagguccu

SEQ ID NO: 488620 - RNA, 22 nt, Human
ggcccuguuagagcucccacaa

SEQ ID NO: 488621 - RNA, 22 nt, Human
uggagggaacccaggcugcucu

SEQ ID NO: 488622 - RNA, 22 nt, Human
uguagaaagaauauguuucaua

SEQ ID NO: 488623 - RNA, 22 nt, Human
ucuuuacaguccucugucaauc

SEQ ID NO: 488624 - RNA, 22 nt, Human
ugagcuuacuucuguacacaga

SEQ ID NO: 488625 - RNA, 22 nt, Human
gaaggaagugcucauacuaguu

SEQ ID NO: 488626 - RNA, 22 nt, Human
uggcuggggagccccgacuccc

SEQ ID NO: 488627 - RNA, 22 nt, Human
guuuggggucugcagagcggcg

SEQ ID NO: 488628 - RNA, 18 nt, Human
ccuggagcuccacagcaa

SEQ ID NO: 488629 - RNA, 22 nt, Human
uggcucaguuccaucaucugga

SEQ ID NO: 488630 - RNA, 18 nt, Human
agucucagcggaggagua

SEQ ID NO: 488631 - RNA, 22 nt, Human
uauugaguuacagaaaauacuu

SEQ ID NO: 488632 - RNA, 22 nt, Human
agaacagaggccuuauguuuca

SEQ ID NO: 488633 - RNA, 22 nt, Human
auuguuaugaaaauaagauguu

SEQ ID NO: 488634 - RNA, 22 nt, Human
caggauggugugagugugagga

SEQ ID NO: 488635 - RNA, 22 nt, Human
gcagugauuggaucagagaugg

SEQ ID NO: 488636 - RNA, 22 nt, Human
gggcuggaggugagcaggacag

SEQ ID NO: 488637 - RNA, 22 nt, Human
cagaugagaguggccaggguuc

SEQ ID NO: 488638 - RNA, 22 nt, Human
uuguaacaggcacucugugcca

SEQ ID NO: 488639 - RNA, 22 nt, Human
augggaggaaggaggcccuuga

SEQ ID NO: 488640 - RNA, 22 nt, Human
guguccacggcugagaaugauu

SEQ ID NO: 488641 - RNA, 19 nt, Human
guccaguguuuuccaguca

SEQ ID NO: 488642 - RNA, 21 nt, Human
aagcaggacauaugaugcccu

SEQ ID NO: 488643 - RNA, 22 nt, Human
caggcagcauuuacucugauga

SEQ ID NO: 488644 - RNA, 22 nt, Human
ucacaggaaccaucagagaaau

SEQ ID NO: 488645 - RNA, 22 nt, Human
gcugagagcaaagcaugucuag

SEQ ID NO: 488646 - RNA, 22 nt, Human
ugcagcugauuaaagggcagac

SEQ ID NO: 488647 - RNA, 22 nt, Human
aggacuucaucaccuguauaaa

SEQ ID NO: 488648 - RNA, 22 nt, Human
ccugccugcagaaaguaucucc

SEQ ID NO: 488649 - RNA, 22 nt, Human
ccaggcugggcggggaaccugg

SEQ ID NO: 488650 - RNA, 22 nt, Human
uccuucaggguugaggccgacu

SEQ ID NO: 488651 - RNA, 22 nt, Human
ccaagggcugcugaggugucca

SEQ ID NO: 488652 - RNA, 22 nt, Human
gcagccacuuugcaaccaagag

SEQ ID NO: 488653 - RNA, 22 nt, Human
aggcaauccccugaggauacuu

SEQ ID NO: 488654 - RNA, 22 nt, Human
uaaaggcucacuggcuuggggu

SEQ ID NO: 488655 - RNA, 22 nt, Human
aagcaggcauuccagagacaau

SEQ ID NO: 488656 - RNA, 22 nt, Human
gcagccacccucaaggcugaau

SEQ ID NO: 488657 - RNA, 22 nt, Human
ugcugccaccugguggcugaag

SEQ ID NO: 488658 - RNA, 22 nt, Human
ucccagccggugccuggguccc

SEQ ID NO: 488659 - RNA, 22 nt, Human
aauuagggaaaacauuugcuuu

SEQ ID NO: 488660 - RNA, 22 nt, Human
agcuguggaguaggggguugga

SEQ ID NO: 488661 - RNA, 22 nt, Human
aagaaauauugggccuuauaaa

SEQ ID NO: 488662 - RNA, 22 nt, Human
auuuccucaugaucauaaugca

SEQ ID NO: 488663 - RNA, 17 nt, Human
accagccucuccugggg

SEQ ID NO: 488664 - RNA, 22 nt, Human
cugcccuggucccauggcugau

SEQ ID NO: 488665 - RNA, 22 nt, Human
ggaggcacuucccgucucagcc

SEQ ID NO: 488666 - RNA, 22 nt, Human
gccuccugguugcuucuccaac

SEQ ID NO: 488667 - RNA, 18 nt, Human
gcugccugcauuccucac

SEQ ID NO: 488668 - RNA, 22 nt, Human
caggaagcugagcugcacugca

SEQ ID NO: 488669 - RNA, 22 nt, Human
ucaccagggcuccagccagccu

SEQ ID NO: 488670 - RNA, 22 nt, Human
cccuucucuuucacucacuauu

SEQ ID NO: 488671 - RNA, 21 nt, Human
aggugcaggccucaagcccca

SEQ ID NO: 488672 - RNA, 22 nt, Human
guuauuaguaagacucgcacau

SEQ ID NO: 488673 - RNA, 22 nt, Human
agaagauuuagguugacgcuau

SEQ ID NO: 488674 - RNA, 22 nt, Human
cuuucagagguuacucaggaaa

SEQ ID NO: 488675 - RNA, 22 nt, Human
acugaaggaaagccuuugcaug

SEQ ID NO: 488676 - RNA, 22 nt, Human
cggcagggcuccaugcauuucu

SEQ ID NO: 488677 - RNA, 19 nt, Human
uccugcagaccagaccugu

SEQ ID NO: 488678 - RNA, 22 nt, Human
caugcacagugauaucugaaga

SEQ ID NO: 488679 - RNA, 22 nt, Human
ucaguuuucucaucugugaaau

SEQ ID NO: 488680 - RNA, 16 nt, Human
ugggaccuguggccaa

SEQ ID NO: 488681 - RNA, 22 nt, Human
uucaagaucuggguuuucagcu

SEQ ID NO: 488682 - RNA, 22 nt, Human
agaggagguggugaugcuuuaa

SEQ ID NO: 488683 - RNA, 22 nt, Human
gaggugagaagggggucagaug

SEQ ID NO: 488684 - RNA, 22 nt, Human
caucagcagucacaugaugcug

SEQ ID NO: 488685 - RNA, 22 nt, Human
ggcugccacgucgaggguccaa

SEQ ID NO: 488686 - RNA, 22 nt, Human
uuacuucuuacaaaagaaauau

SEQ ID NO: 488687 - RNA, 22 nt, Human
cugccagcucaaagcgcagcua

SEQ ID NO: 488688 - RNA, 22 nt, Human
aggagugagcuuuggggucaga

SEQ ID NO: 488689 - RNA, 21 nt, Human
cacuauuuauauaugccagcu

SEQ ID NO: 488690 - RNA, 22 nt, Human
auuaaauuggaucugcauaguu

SEQ ID NO: 488691 - RNA, 20 nt, Human
agccaggccucaaguuaagu

SEQ ID NO: 488692 - RNA, 22 nt, Human
uggcagaaguacacaagcaugc

SEQ ID NO: 488693 - RNA, 22 nt, Human
ggucccaggaaucuguguucua

SEQ ID NO: 488694 - RNA, 22 nt, Human
cagcuccugccugggcagcugu

SEQ ID NO: 488695 - RNA, 20 nt, Human
accucugcaucaauccuuug

SEQ ID NO: 488696 - RNA, 22 nt, Human
uugcaaaggggaauaaagcaau

SEQ ID NO: 488697 - RNA, 22 nt, Human
gcucuggaagcaucugagagga

SEQ ID NO: 488698 - RNA, 22 nt, Human
agguaagggucacaguucauau

SEQ ID NO: 488699 - RNA, 22 nt, Human
caguguuucugaguuccagcuc

SEQ ID NO: 488700 - RNA, 22 nt, Human
ccaggcagcaaauuuucugaau

SEQ ID NO: 488701 - RNA, 22 nt, Human
aaagggcugucaaauaagcaac

SEQ ID NO: 488702 - RNA, 22 nt, Human
cugucccucaucaccucugggu

SEQ ID NO: 488703 - RNA, 22 nt, Human
agagcaggcauaaagcuuugaa

SEQ ID NO: 488704 - RNA, 22 nt, Human
ugcagccaauucauucauucuu

SEQ ID NO: 488705 - RNA, 22 nt, Human
uuugacaaaggaaaaaugcaca

SEQ ID NO: 488706 - RNA, 22 nt, Human
ccugggugaugugcugcccucg

SEQ ID NO: 488707 - RNA, 22 nt, Human
cagucccaggguugguucagcu

SEQ ID NO: 488708 - RNA, 22 nt, Human
cagcuucuucaguccuggagcu

SEQ ID NO: 488709 - RNA, 22 nt, Human
cagaggaagcuggguguggagu

SEQ ID NO: 488710 - RNA, 22 nt, Human
cucuccaggacuuuggcccaau

SEQ ID NO: 488711 - RNA, 19 nt, Human
ccuggaggugaagguucuc

SEQ ID NO: 488712 - RNA, 22 nt, Human
gcucugaggcugugaggugcug

SEQ ID NO: 488713 - RNA, 22 nt, Human
uugauacaggcucuauuucauc

SEQ ID NO: 488714 - RNA, 22 nt, Human
ugccuggguccaggccaagccu

SEQ ID NO: 488715 - RNA, 22 nt, Human
gggaccugaggagggguuucag

SEQ ID NO: 488716 - RNA, 22 nt, Human
ggagagagaugccgccuugcuc

SEQ ID NO: 488717 - RNA, 22 nt, Human
caggcacuguguuaggcacugu

SEQ ID NO: 488718 - RNA, 17 nt, Human
gcagccagugcagcagg

SEQ ID NO: 488719 - RNA, 22 nt, Human
gggcugacaaccaucugacaag

SEQ ID NO: 488720 - RNA, 22 nt, Human
cagccuccugggacacucaccg

SEQ ID NO: 488721 - RNA, 22 nt, Human
caucagagugguggccuggugu

SEQ ID NO: 488722 - RNA, 22 nt, Human
gcugccagcucacucuccugag

SEQ ID NO: 488723 - RNA, 22 nt, Human
gcagagcucaagguguucagcu

SEQ ID NO: 488724 - RNA, 22 nt, Human
ucaggaaagaagaugcucagug

SEQ ID NO: 488725 - RNA, 22 nt, Human
gaguccaguaguuaggacagag

SEQ ID NO: 488726 - RNA, 21 nt, Human
cagaggccucaugcucugugc

SEQ ID NO: 488727 - RNA, 22 nt, Human
cagcagcuacuuggagcagcag

SEQ ID NO: 488728 - RNA, 22 nt, Human
uguacacugcaggaugcauugc

SEQ ID NO: 488729 - RNA, 22 nt, Human
gaggagaaagcagugauuugug

SEQ ID NO: 488730 - RNA, 20 nt, Human
gcugaggucauuaugccuca

SEQ ID NO: 488731 - RNA, 22 nt, Human
gacagcagggacauguaggaag

SEQ ID NO: 488732 - RNA, 22 nt, Human
gauuuccucacuaacauccauc

SEQ ID NO: 488733 - RNA, 20 nt, Human
acuuuggggucuuucucaga

SEQ ID NO: 488734 - RNA, 23 nt, Human
uuuuaauuuggacauaagaagau

SEQ ID NO: 488735 - RNA, 22 nt, Human
aggaaggagggcagauauuaag

SEQ ID NO: 488736 - RNA, 23 nt, Human
gacagagugagaccuugucuuac

SEQ ID NO: 488737 - RNA, 22 nt, Human
gcauccagagguagccacugug

SEQ ID NO: 488738 - RNA, 22 nt, Human
gcauguguggaggagaugugcu

SEQ ID NO: 488739 - RNA, 22 nt, Human
augugaaacugaagcauccaua

SEQ ID NO: 488740 - RNA, 19 nt, Human
uuagggacaugaauucuag

SEQ ID NO: 488741 - RNA, 22 nt, Human
ucucugggaaugggccugggua

SEQ ID NO: 488742 - RNA, 22 nt, Human
gagguagcaugcuggaagggac

SEQ ID NO: 488743 - RNA, 22 nt, Human
ggccaggcgaugaccccuccac

SEQ ID NO: 488744 - RNA, 22 nt, Human
aagccagguguugugguaagag

SEQ ID NO: 488745 - RNA, 22 nt, Human
gggagccacaguuuauagugau

SEQ ID NO: 488746 - RNA, 22 nt, Human
gugauuucaaauauagagugag

SEQ ID NO: 488747 - RNA, 22 nt, Human
ucuucagauugcacugagcaag

SEQ ID NO: 488748 - RNA, 22 nt, Human
cauuugaugacucaacucauaa

SEQ ID NO: 488749 - RNA, 22 nt, Human
aagugggaauagaaaugaaggu

SEQ ID NO: 488750 - RNA, 22 nt, Human
agggccaggaacaccugaaggg

SEQ ID NO: 488751 - RNA, 22 nt, Human
ucugaggcuucagacuguacug

SEQ ID NO: 488752 - RNA, 22 nt, Human
caaugugugcuuacaggccagu

SEQ ID NO: 488753 - RNA, 22 nt, Human
gccaccuguuucgcuugcccag

SEQ ID NO: 488754 - RNA, 22 nt, Human
uaggccaggacagagcuuccag

SEQ ID NO: 488755 - RNA, 22 nt, Human
uuaaauuagucaagcuucucug

SEQ ID NO: 488756 - RNA, 22 nt, Human
cucuccucugaaguggugaccc

SEQ ID NO: 488757 - RNA, 20 nt, Human
gugggcagaugugugcaugg

SEQ ID NO: 488758 - RNA, 22 nt, Human
ugcaggagacauaauagggacu

SEQ ID NO: 488759 - RNA, 22 nt, Human
aauaacaggcucaucagaugcu

SEQ ID NO: 488760 - RNA, 22 nt, Human
cugcugcugagagcucagccug

SEQ ID NO: 488761 - RNA, 22 nt, Human
ccagggcauguccaagacuuag

SEQ ID NO: 488762 - RNA, 22 nt, Human
aggacaguccgggguccuccac

SEQ ID NO: 488763 - RNA, 22 nt, Human
cugcugcauuccucuuuaugag

SEQ ID NO: 488764 - RNA, 22 nt, Human
ccagaggagggcucugaugagg

SEQ ID NO: 488765 - RNA, 22 nt, Human
uccugcagagacagaggccuca

SEQ ID NO: 488766 - RNA, 17 nt, Human
agugacuuggaaagagc

SEQ ID NO: 488767 - RNA, 21 nt, Human
aaaggccauaaucacggagca

SEQ ID NO: 488768 - RNA, 22 nt, Human
uucaaguucauguguagucagu

SEQ ID NO: 488769 - RNA, 22 nt, Human
agucccaggcagccgagccggu

SEQ ID NO: 488770 - RNA, 22 nt, Human
gcaggguauaauacuuagguga

SEQ ID NO: 488771 - RNA, 22 nt, Human
agggagcucaguuggaagcggu

SEQ ID NO: 488772 - RNA, 22 nt, Human
ucagaguguggugagaugugca

SEQ ID NO: 488773 - RNA, 22 nt, Human
gaggccugcuuuggcacucugg

SEQ ID NO: 488774 - RNA, 22 nt, Human
caugagcugcugggagccuguc

SEQ ID NO: 488775 - RNA, 22 nt, Human
uggcuccuucauucuccugcca

SEQ ID NO: 488776 - RNA, 21 nt, Human
ucuuuccugcccaguugcccu

SEQ ID NO: 488777 - RNA, 22 nt, Human
ugugggcucccccucacucugu

SEQ ID NO: 488778 - RNA, 19 nt, Human
agggccugcagcucaagcu

SEQ ID NO: 488779 - RNA, 22 nt, Human
cuuuggaacauacugcugagcu

SEQ ID NO: 488780 - RNA, 22 nt, Human
ccuggccugugaaucugagagc

SEQ ID NO: 488781 - RNA, 22 nt, Human
uugaaaggccuguuuauccagc

SEQ ID NO: 488782 - RNA, 22 nt, Human
acagcagcuaaaggugucuccu

SEQ ID NO: 488783 - RNA, 22 nt, Human
ugggcagauguccucugaagug

SEQ ID NO: 488784 - RNA, 22 nt, Human
auagaaaacagauguccuuaaa

SEQ ID NO: 488785 - RNA, 22 nt, Human
gagcccuccauggagccaggca

SEQ ID NO: 488786 - RNA, 22 nt, Human
ucaaggagcccacagucuaaug

SEQ ID NO: 488787 - RNA, 22 nt, Human
gggaagggagggccuccaguca

SEQ ID NO: 488788 - RNA, 22 nt, Human
aggagaaguaaggcuagaugau

SEQ ID NO: 488789 - RNA, 22 nt, Human
ugaaagaacuagcaucuucaag

SEQ ID NO: 488790 - RNA, 22 nt, Human
cagagcugagucuucaagguug

SEQ ID NO: 488791 - RNA, 23 nt, Human
gagggcucugagugcuugggcca

SEQ ID NO: 488792 - RNA, 22 nt, Human
agcagccauagauagcaugcaa

SEQ ID NO: 488793 - RNA, 22 nt, Human
auucuccaucaccacuggcacu

SEQ ID NO: 488794 - RNA, 22 nt, Human
ccucagagguguggcaucucug

SEQ ID NO: 488795 - RNA, 22 nt, Human
aagaacaguguccugggacucg

SEQ ID NO: 488796 - RNA, 22 nt, Human
agagaaggucacuaaggaccca

SEQ ID NO: 488797 - RNA, 22 nt, Human
uacuguacucaacaugugaguu

SEQ ID NO: 488798 - RNA, 22 nt, Human
ucagccugcgucauggugacac

SEQ ID NO: 488799 - RNA, 22 nt, Human
gggacuggcacagggcugggag

SEQ ID NO: 488800 - RNA, 22 nt, Human
ucuguuuaggcaaaauagcuac

SEQ ID NO: 488801 - RNA, 22 nt, Human
cucaggacccgguccagguggg

SEQ ID NO: 488802 - RNA, 22 nt, Human
gauaugaaguggcauugugaag

SEQ ID NO: 488803 - RNA, 22 nt, Human
acaguggagcucagaugaaaau

SEQ ID NO: 488804 - RNA, 22 nt, Human
ccacccuggacaggccucugag

SEQ ID NO: 488805 - RNA, 22 nt, Human
gggcucagacaucccuccugga

SEQ ID NO: 488806 - RNA, 22 nt, Human
aggaaacagugaacuuggcagg

SEQ ID NO: 488807 - RNA, 22 nt, Human
uaaagguagcaugaaacugcaa

SEQ ID NO: 488808 - RNA, 22 nt, Human
accaaggagccacauacaaccu

SEQ ID NO: 488809 - RNA, 22 nt, Human
cacugaagccugggaguaagac

SEQ ID NO: 488810 - RNA, 22 nt, Human
cugugcauugucuugucuguag

SEQ ID NO: 488811 - RNA, 22 nt, Human
cagcacacagugacucgcaccu

SEQ ID NO: 488812 - RNA, 23 nt, Human
gagcugggauacaggcuuacugc

SEQ ID NO: 488813 - RNA, 22 nt, Human
acacuuuguuguggcauauacg

SEQ ID NO: 488814 - RNA, 22 nt, Human
aagcugccaccagcccagggca

SEQ ID NO: 488815 - RNA, 22 nt, Human
uccuuccugcaggccaaguccu

SEQ ID NO: 488816 - RNA, 22 nt, Human
uggcugagagaagacggggaag

SEQ ID NO: 488817 - RNA, 22 nt, Human
guggcuucugcggugugcgcag

SEQ ID NO: 488818 - RNA, 22 nt, Human
cacauaaucaccaaguccuuuc

SEQ ID NO: 488819 - RNA, 22 nt, Human
uacuuuuugucucuuugaaugu

SEQ ID NO: 488820 - RNA, 22 nt, Human
cagguccuggcaucaggcaggu

SEQ ID NO: 488821 - RNA, 22 nt, Human
aaguguguauuguuuaugcugc

SEQ ID NO: 488822 - RNA, 22 nt, Human
auacuguuuugugacuuaucuu

SEQ ID NO: 488823 - RNA, 22 nt, Human
gggcagcagagcccugccgagu

SEQ ID NO: 488824 - RNA, 22 nt, Human
cccuggaggagcuuagagcuug

SEQ ID NO: 488825 - RNA, 22 nt, Human
aagggaggggauguaagccugg

SEQ ID NO: 488826 - RNA, 22 nt, Human
aauaauuuccagccaacuggaa

SEQ ID NO: 488827 - RNA, 22 nt, Human
gucaugccagcggagcucggga

SEQ ID NO: 488828 - RNA, 22 nt, Human
guccugggccugcugaggcuga

SEQ ID NO: 488829 - RNA, 22 nt, Human
uuguucaugguuguaaguuuga

SEQ ID NO: 488830 - RNA, 22 nt, Human
cagggccaccguguuugcugcu

SEQ ID NO: 488831 - RNA, 22 nt, Human
agagccagcaagugaauaguga

SEQ ID NO: 488832 - RNA, 22 nt, Human
cugaggccucucuccugggcuu

SEQ ID NO: 488833 - RNA, 22 nt, Human
uuucugaauaacucuaugauau

SEQ ID NO: 488834 - RNA, 22 nt, Human
cucagaguggggcucccugagg

SEQ ID NO: 488835 - RNA, 22 nt, Human
uccugcaggccagaggggugag

SEQ ID NO: 488836 - RNA, 22 nt, Human
cccagcagugacccagugauac

SEQ ID NO: 488837 - RNA, 22 nt, Human
ugaggcagugcugggaagccug

SEQ ID NO: 488838 - RNA, 22 nt, Human
gguggcagcgucuaucugacau

SEQ ID NO: 488839 - RNA, 21 nt, Human
acaugucucuaaucucaguga

SEQ ID NO: 488840 - RNA, 22 nt, Human
gcugggagccguaccugucacg

SEQ ID NO: 488841 - RNA, 22 nt, Human
agugguaacuaaguccugcuua

SEQ ID NO: 488842 - RNA, 22 nt, Human
acugccaaugguaguuugaugg

SEQ ID NO: 488843 - RNA, 22 nt, Human
ugccaggcucagccccuaucuu

SEQ ID NO: 488844 - RNA, 22 nt, Human
ggcagccuccagggcacuggug

SEQ ID NO: 488845 - RNA, 22 nt, Human
aggcacugugcagucccaagca

SEQ ID NO: 488846 - RNA, 23 nt, Human
ucagugauguugaaccuagcagu

SEQ ID NO: 488847 - RNA, 22 nt, Human
auaaacugaagggaacacugag

SEQ ID NO: 488848 - RNA, 22 nt, Human
uccuugaaaaucuugguuuaga

SEQ ID NO: 488849 - RNA, 22 nt, Human
ugagggaguuggguguauagga

SEQ ID NO: 488850 - RNA, 19 nt, Human
agacagagcucaguggguu

SEQ ID NO: 488851 - RNA, 22 nt, Human
uggcucugaccagguagaggag

SEQ ID NO: 488852 - RNA, 22 nt, Human
acaguggaaagaacauggauuu

SEQ ID NO: 488853 - RNA, 22 nt, Human
aggcuauuuccacucuucucau

SEQ ID NO: 488854 - RNA, 22 nt, Human
acagaaugcguagugcauguug

SEQ ID NO: 488855 - RNA, 22 nt, Human
ucugguaaccuuuaucccuccu

SEQ ID NO: 488856 - RNA, 22 nt, Human
uugggggaagaggauagacagu

SEQ ID NO: 488857 - RNA, 22 nt, Human
gccagggaacccaagggccuca

SEQ ID NO: 488858 - RNA, 23 nt, Human
ucuuuacauacugaugaguucuc

SEQ ID NO: 488859 - RNA, 22 nt, Human
gugcaggggaucagguugcagc

SEQ ID NO: 488860 - RNA, 22 nt, Human
auuucuuuucaagagggugcuu

SEQ ID NO: 488861 - RNA, 22 nt, Human
auuucagcccaguaugagcccc

SEQ ID NO: 488862 - RNA, 22 nt, Human
aucuggaagccagauacucagu

SEQ ID NO: 488863 - RNA, 22 nt, Human
ucuugccucuuccccuuuccau

SEQ ID NO: 488864 - RNA, 22 nt, Human
ugcuuuggccacuagaauucag

SEQ ID NO: 488865 - RNA, 22 nt, Human
ugcagccuugccuccucccagc

SEQ ID NO: 488866 - RNA, 22 nt, Human
agccaggggauucaucagggac

SEQ ID NO: 488867 - RNA, 18 nt, Human
gaggauggaaggagaugc

SEQ ID NO: 488868 - RNA, 22 nt, Human
acagggcccuugccagcacaag

SEQ ID NO: 488869 - RNA, 22 nt, Human
agagccuggucugagauaggac

SEQ ID NO: 488870 - RNA, 22 nt, Human
aaacuguaaagcaggugaguag

SEQ ID NO: 488871 - RNA, 19 nt, Human
caggaugaucccaugacac

SEQ ID NO: 488872 - RNA, 22 nt, Human
gagcaggcucugccuguguguc

SEQ ID NO: 488873 - RNA, 22 nt, Human
aaaugcacagagccuuagagau

SEQ ID NO: 488874 - RNA, 23 nt, Human
gccugccugaccugugcaaaguc

SEQ ID NO: 488875 - RNA, 22 nt, Human
aggugcagcugacaccaugugg

SEQ ID NO: 488876 - RNA, 22 nt, Human
gccagacacuccccugggcagg

SEQ ID NO: 488877 - RNA, 22 nt, Human
acagggucauuuuaugaucugu

SEQ ID NO: 488878 - RNA, 22 nt, Human
gcagccccaggagacgcccagg

SEQ ID NO: 488879 - RNA, 22 nt, Human
uuucuccaauguaucagcacac

SEQ ID NO: 488880 - RNA, 23 nt, Human
cagcugaagcagccugggcugga

SEQ ID NO: 488881 - RNA, 22 nt, Human
cuaaaauuaucaagauaauucc

SEQ ID NO: 488882 - RNA, 22 nt, Human
uuuagaguugaguauucauugg

SEQ ID NO: 488883 - RNA, 22 nt, Human
ggagaggcgaugagucacagcc

SEQ ID NO: 488884 - RNA, 22 nt, Human
aaaggccaagcaugagguggac

SEQ ID NO: 488885 - RNA, 22 nt, Human
cuccucugucuaccacgagggu

SEQ ID NO: 488886 - RNA, 19 nt, Human
uccaggcauccuucaggcu

SEQ ID NO: 488887 - RNA, 22 nt, Human
cagcaggaaguacuagcuuuga

SEQ ID NO: 488888 - RNA, 22 nt, Human
augaagucuagcaagcauugaa

SEQ ID NO: 488889 - RNA, 22 nt, Human
agcagggcuuugcagacuuggg

SEQ ID NO: 488890 - RNA, 22 nt, Human
ucagacaguuugcagugugccu

SEQ ID NO: 488891 - RNA, 22 nt, Human
cuagggacagaaagaggguaga

SEQ ID NO: 488892 - RNA, 22 nt, Human
ucaggcagaaaaaucacuaauu

SEQ ID NO: 488893 - RNA, 22 nt, Human
cauuuguuuagaagucuuuaua

SEQ ID NO: 488894 - RNA, 23 nt, Human
ugagcccaggaggucaaggcugc

SEQ ID NO: 488895 - RNA, 22 nt, Human
aagauuuacuagcauaauagcu

SEQ ID NO: 488896 - RNA, 22 nt, Human
uugaaaggugacauuguuagag

SEQ ID NO: 488897 - RNA, 22 nt, Human
ggcuggaaaagacaaagcuauu

SEQ ID NO: 488898 - RNA, 22 nt, Human
aguuacuugagacguuuaugaa

SEQ ID NO: 488899 - RNA, 23 nt, Human
uugauacagaagaaucaguuugu

SEQ ID NO: 488900 - RNA, 22 nt, Human
guuuuauaugucucugcugaca

SEQ ID NO: 488901 - RNA, 22 nt, Human
cugagcugguggaagcaugcag

SEQ ID NO: 488902 - RNA, 22 nt, Human
gaaaucugucuuuguuugaaua

SEQ ID NO: 488903 - RNA, 22 nt, Human
guggcucucgccagccugcggg

SEQ ID NO: 488904 - RNA, 22 nt, Human
caugccaguuuugagaugcacc

SEQ ID NO: 488905 - RNA, 22 nt, Human
agucccagcccaguccuguaag

SEQ ID NO: 488906 - RNA, 22 nt, Human
aggcugaggugugcugugaucg

SEQ ID NO: 488907 - RNA, 22 nt, Human
agccugagugcuuaggacuguu

SEQ ID NO: 488908 - RNA, 22 nt, Human
ggcuccugggaugggacugagc

SEQ ID NO: 488909 - RNA, 22 nt, Human
agcccugggaggccagcuugua

SEQ ID NO: 488910 - RNA, 22 nt, Human
agaguccagaaaacagugugcu

SEQ ID NO: 488911 - RNA, 22 nt, Human
agaggccaugcuagaggccugg

SEQ ID NO: 488912 - RNA, 22 nt, Human
uggagacugugcuaagggaguu

SEQ ID NO: 488913 - RNA, 22 nt, Human
agagccugcaucaggcuugggg

SEQ ID NO: 488914 - RNA, 22 nt, Human
gaugguuuaugauagaugggaa

SEQ ID NO: 488915 - RNA, 22 nt, Human
guuugaaaaaagcaguauguaa

SEQ ID NO: 488916 - RNA, 22 nt, Human
ucaguaacuuacuuauucaccu

SEQ ID NO: 488917 - RNA, 22 nt, Human
gcugcccuaauaucacauguua

SEQ ID NO: 488918 - RNA, 22 nt, Human
ugcagggagcucuggggugcag

SEQ ID NO: 488919 - RNA, 22 nt, Human
ggcuucuguccucuggaucugu

SEQ ID NO: 488920 - RNA, 22 nt, Human
cccugcagagggaugggggcag

SEQ ID NO: 488921 - RNA, 22 nt, Human
gguucaguuuacauuaaaaucu

SEQ ID NO: 488922 - RNA, 22 nt, Human
uggcugagguuaugcugguugu

SEQ ID NO: 488923 - RNA, 22 nt, Human
acaauguaggauauguacuugu

SEQ ID NO: 488924 - RNA, 22 nt, Human
ccugcagggaaucgaggcagaa

SEQ ID NO: 488925 - RNA, 23 nt, Human
uggcagcuguguaagagaaagca

SEQ ID NO: 488926 - RNA, 22 nt, Human
aagacagagggaagcaaugaug

SEQ ID NO: 488927 - RNA, 18 nt, Human
agcagaauucuaggguuc

SEQ ID NO: 488928 - RNA, 22 nt, Human
ucagagugcagcgggaggcugg

SEQ ID NO: 488929 - RNA, 22 nt, Human
ccucccucuuucagucccacag

SEQ ID NO: 488930 - RNA, 22 nt, Human
gccuuccuuacaccugcucagc

SEQ ID NO: 488931 - RNA, 22 nt, Human
ccuggcagaauauuaaagugca

SEQ ID NO: 488932 - RNA, 22 nt, Human
agcagggcuggauuuggcaaga

SEQ ID NO: 488933 - RNA, 19 nt, Human
gcuggggccugaccagaca

SEQ ID NO: 488934 - RNA, 22 nt, Human
gaggaagaagcaaaccagcuaa

SEQ ID NO: 488935 - RNA, 22 nt, Human
caggacagguguucuagaucag

SEQ ID NO: 488936 - RNA, 22 nt, Human
ccugccuggagcugagugugga

SEQ ID NO: 488937 - RNA, 22 nt, Human
ugcagugugaccuguagcgagc

SEQ ID NO: 488938 - RNA, 22 nt, Human
cagcuggcauaccugggcccgg

SEQ ID NO: 488939 - RNA, 22 nt, Human
agugggggccaacgagggcagc

SEQ ID NO: 488940 - RNA, 22 nt, Human
uccaggcaagggaggagcaugg

SEQ ID NO: 488941 - RNA, 22 nt, Human
agccaaagaucagugugcaagu

SEQ ID NO: 488942 - RNA, 22 nt, Human
auacuguaucacuugugaguga

SEQ ID NO: 488943 - RNA, 22 nt, Human
gcuuggccagcagccgggaugc

SEQ ID NO: 488944 - RNA, 22 nt, Human
ucuucaaauccuacagugucug

SEQ ID NO: 488945 - RNA, 20 nt, Human
gcuguugccaguacagaugg

SEQ ID NO: 488946 - RNA, 20 nt, Human
gaaauucucguauuaguuua

SEQ ID NO: 488947 - RNA, 23 nt, Human
gccagccuugcucuccugcagcc

SEQ ID NO: 488948 - RNA, 22 nt, Human
cucugcaggggaggcaugcacu

SEQ ID NO: 488949 - RNA, 22 nt, Human
agggcugcaggcaagauauggc

SEQ ID NO: 488950 - RNA, 22 nt, Human
aggagccuccuucucaugugca

SEQ ID NO: 488951 - RNA, 22 nt, Human
ucugaggcauaaccuguucugc

SEQ ID NO: 488952 - RNA, 22 nt, Human
ucagggcaggacaguguaggcc

SEQ ID NO: 488953 - RNA, 22 nt, Human
uuuccuuccagguuccuaaggc

SEQ ID NO: 488954 - RNA, 22 nt, Human
ugucccaguuuaucugggacug

SEQ ID NO: 488955 - RNA, 22 nt, Human
ucuguggcacgauugcacugca

SEQ ID NO: 488956 - RNA, 22 nt, Human
caagggcucuuuugaggaaugu

SEQ ID NO: 488957 - RNA, 22 nt, Human
ccaaggcuccucagcuggucuu

SEQ ID NO: 488958 - RNA, 22 nt, Human
uuuugaaagggugauuuggcuu

SEQ ID NO: 488959 - RNA, 22 nt, Human
aaagccuugcccgucacuggga

SEQ ID NO: 488960 - RNA, 22 nt, Human
ucagauggguuuugaaggaugu

SEQ ID NO: 488961 - RNA, 22 nt, Human
gugcaugucggggugcauguca

SEQ ID NO: 488962 - RNA, 22 nt, Human
uggguggcggccugguucugag

SEQ ID NO: 488963 - RNA, 21 nt, Human
ggcagcacuaccugaagcaua

SEQ ID NO: 488964 - RNA, 21 nt, Human
ccagcuccaggaccuuggauc

SEQ ID NO: 488965 - RNA, 22 nt, Human
caguguggugagauuccaggug

SEQ ID NO: 488966 - RNA, 22 nt, Human
ucuuuuauuaggcugaaauggg

SEQ ID NO: 488967 - RNA, 22 nt, Human
cacaggggcaaacuguagggga

SEQ ID NO: 488968 - RNA, 22 nt, Human
cagucacuggaauagcugagga

SEQ ID NO: 488969 - RNA, 22 nt, Human
gugccagcaguuauggugauuu

SEQ ID NO: 488970 - RNA, 22 nt, Human
aaaggaagaugccaggacucug

SEQ ID NO: 488971 - RNA, 22 nt, Human
uaugcauaugaccccaagcuug

SEQ ID NO: 488972 - RNA, 22 nt, Human
uuuccucuccaccaggaggucu

SEQ ID NO: 488973 - RNA, 22 nt, Human
cagcugcccaggccaccuggag

SEQ ID NO: 488974 - RNA, 22 nt, Human
uacauaauaaggggcauggugu

SEQ ID NO: 488975 - RNA, 22 nt, Human
aucaaguuuucuuaguugacug

SEQ ID NO: 488976 - RNA, 22 nt, Human
caugcagugacucagacacagg

SEQ ID NO: 488977 - RNA, 22 nt, Human
ugggcagagucauacaggagac

SEQ ID NO: 488978 - RNA, 22 nt, Human
cuggcaggucucgcugacgugu

SEQ ID NO: 488979 - RNA, 22 nt, Human
aguuuguaucaauuugcuuuau

SEQ ID NO: 488980 - RNA, 22 nt, Human
cagcaggcucugaguggcugcc

SEQ ID NO: 488981 - RNA, 19 nt, Human
agggcuaggcacauagggc

SEQ ID NO: 488982 - RNA, 22 nt, Human
agguggaacguucaggugcuag

SEQ ID NO: 488983 - RNA, 22 nt, Human
aagcugccugggaggaagggcu

SEQ ID NO: 488984 - RNA, 22 nt, Human
cuggagccacuuuuuauccuuu

SEQ ID NO: 488985 - RNA, 22 nt, Human
aagggagguaaagcuauuuaaa

SEQ ID NO: 488986 - RNA, 22 nt, Human
uucuggagagaaaccuuacaaa

SEQ ID NO: 488987 - RNA, 22 nt, Human
ugacagaaagaauaugucaauc

SEQ ID NO: 488988 - RNA, 22 nt, Human
augcagcaguuuacaaagcaau

SEQ ID NO: 488989 - RNA, 22 nt, Human
guuauguacuuuuuaaaucuug

SEQ ID NO: 488990 - RNA, 22 nt, Human
ggucucagcuggaguccuuggu

SEQ ID NO: 488991 - RNA, 22 nt, Human
gaaugcuaagcaugugggaguu

SEQ ID NO: 488992 - RNA, 22 nt, Human
aucugacaaccuauugacuuga

SEQ ID NO: 488993 - RNA, 22 nt, Human
ucagaaugaaauuucuuucaga

SEQ ID NO: 488994 - RNA, 22 nt, Human
acagccagggcauugucgccga

SEQ ID NO: 488995 - RNA, 22 nt, Human
ugggacaguuguccuccacucu

SEQ ID NO: 488996 - RNA, 22 nt, Human
agcagcugaccagugaguccug

SEQ ID NO: 488997 - RNA, 22 nt, Human
cuguggcuuucucugccuccuu

SEQ ID NO: 488998 - RNA, 22 nt, Human
agcagagcccuuccauggccuu

SEQ ID NO: 488999 - RNA, 22 nt, Human
uugauuaaacaggcauauucaa

SEQ ID NO: 489000 - RNA, 20 nt, Human
agcagcuguguuuucauccu

SEQ ID NO: 489001 - RNA, 22 nt, Human
uccaggcaucuguauuuuuuaa

SEQ ID NO: 489002 - RNA, 22 nt, Human
uagggcaggugaagaaaagcua

SEQ ID NO: 489003 - RNA, 22 nt, Human
uaagaacauuuucggaaagaua

SEQ ID NO: 489004 - RNA, 22 nt, Human
cugggaguguucuaggucacau

SEQ ID NO: 489005 - RNA, 22 nt, Human
cugcugugcagacagacucucu

SEQ ID NO: 489006 - RNA, 21 nt, Human
cagcuuugucugucuucgggg

SEQ ID NO: 489007 - RNA, 23 nt, Human
ugggccuggaaagccuuagagag

SEQ ID NO: 489008 - RNA, 20 nt, Human
uccugcaguuccuaggaggg

SEQ ID NO: 489009 - RNA, 22 nt, Human
caggguggcacaucacagcauu

SEQ ID NO: 489010 - RNA, 22 nt, Human
aacaugauuuaguauaaugcag

SEQ ID NO: 489011 - RNA, 22 nt, Human
ugcauauuauguguaucugucu

SEQ ID NO: 489012 - RNA, 23 nt, Human
ugggcaucuccucugugccaggc

SEQ ID NO: 489013 - RNA, 22 nt, Human
cucuuucaguucugauagucuc

SEQ ID NO: 489014 - RNA, 22 nt, Human
agaaaucagaacccugaaguuc

SEQ ID NO: 489015 - RNA, 22 nt, Human
aaucuggcucagaagaagauga

SEQ ID NO: 489016 - RNA, 22 nt, Human
ggagcagacauaaccuuacaga

SEQ ID NO: 489017 - RNA, 22 nt, Human
cagagccaggucuaggagucuc

SEQ ID NO: 489018 - RNA, 22 nt, Human
ggagaugcuauguaguuugguu

SEQ ID NO: 489019 - RNA, 22 nt, Human
ggagcugggaauuggaucaucu

SEQ ID NO: 489020 - RNA, 22 nt, Human
acugucuguccugcucuccgug

SEQ ID NO: 489021 - RNA, 22 nt, Human
ugggcagcagcaaagccagacu

SEQ ID NO: 489022 - RNA, 21 nt, Human
cagaggggcuagccuggcugc

SEQ ID NO: 489023 - RNA, 22 nt, Human
uggcucagcagguuagaaacua

SEQ ID NO: 489024 - RNA, 22 nt, Human
acaguggaaagaaacgaauuag

SEQ ID NO: 489025 - RNA, 22 nt, Human
ugcccugugugugcaagcacug

SEQ ID NO: 489026 - RNA, 22 nt, Human
uaggccaguggcagguugugug

SEQ ID NO: 489027 - RNA, 22 nt, Human
ugugaaggcagcagcucugucc

SEQ ID NO: 489028 - RNA, 22 nt, Human
ggggcacacuuuugguagauau

SEQ ID NO: 489029 - RNA, 22 nt, Human
acagggccucagcugauucugg

SEQ ID NO: 489030 - RNA, 22 nt, Human
acccagcucuuugauggucuug

SEQ ID NO: 489031 - RNA, 22 nt, Human
ggcagugaaucugagagccugg

SEQ ID NO: 489032 - RNA, 22 nt, Human
agcucccagaagccagagucgg

SEQ ID NO: 489033 - RNA, 22 nt, Human
agcugcagugaacuguuuuguc

SEQ ID NO: 489034 - RNA, 22 nt, Human
gcuggccauagaagccaaagag

SEQ ID NO: 489035 - RNA, 20 nt, Human
uugcagcagugaggugaagg

SEQ ID NO: 489036 - RNA, 22 nt, Human
uaucuuuaacuugcaguauuua

SEQ ID NO: 489037 - RNA, 22 nt, Human
gugaauggggcaggaaggaugg

SEQ ID NO: 489038 - RNA, 22 nt, Human
cauuaagauuuuuuucuacugg

SEQ ID NO: 489039 - RNA, 22 nt, Human
aaaucuguaagcaauugcucag

SEQ ID NO: 489040 - RNA, 22 nt, Human
cagggcucuuccggagcaggga

SEQ ID NO: 489041 - RNA, 22 nt, Human
cugggagcccugacuagccugg

SEQ ID NO: 489042 - RNA, 22 nt, Human
ugggaccugcucuuggaaugag

SEQ ID NO: 489043 - RNA, 22 nt, Human
uggagaagucaaagugaacagg

SEQ ID NO: 489044 - RNA, 22 nt, Human
gauuuccuagacauggggcaga

SEQ ID NO: 489045 - RNA, 22 nt, Human
caaaugcaaaauauaacccugu

SEQ ID NO: 489046 - RNA, 22 nt, Human
caccaucagcagcaggugucaa

SEQ ID NO: 489047 - RNA, 22 nt, Human
aagggcuccauccuuauaaaug

SEQ ID NO: 489048 - RNA, 22 nt, Human
guuagaaacacauucuuauuga

SEQ ID NO: 489049 - RNA, 22 nt, Human
cuggggcucucuggaaugcuug

SEQ ID NO: 489050 - RNA, 22 nt, Human
aagugagauuauauguacggga

SEQ ID NO: 489051 - RNA, 19 nt, Human
cuggaaugauagagaccuc

SEQ ID NO: 489052 - RNA, 22 nt, Human
caggagcaguuagaagcccacu

SEQ ID NO: 489053 - RNA, 22 nt, Human
ccacccagccagaugcaggaag

SEQ ID NO: 489054 - RNA, 22 nt, Human
cucugggcaaguaugauagaaa

SEQ ID NO: 489055 - RNA, 22 nt, Human
cacuguacagcauuaacaaggc

SEQ ID NO: 489056 - RNA, 22 nt, Human
ucaguggagagcuuccaggauu

SEQ ID NO: 489057 - RNA, 22 nt, Human
cuuacauugucuuaguuuucaa

SEQ ID NO: 489058 - RNA, 22 nt, Human
caaaguauauuggauugaaugg

SEQ ID NO: 489059 - RNA, 21 nt, Human
uccaaaucccauucuguaguc

SEQ ID NO: 489060 - RNA, 19 nt, Human
agacucugugugagacuuu

SEQ ID NO: 489061 - RNA, 22 nt, Human
aagggagacaguugugugagga

SEQ ID NO: 489062 - RNA, 22 nt, Human
uaagaagcuucugcuaaugccu

SEQ ID NO: 489063 - RNA, 22 nt, Human
aaguucuacuguggguaaaaug

SEQ ID NO: 489064 - RNA, 22 nt, Human
cagaggcuguguaggcagacug

SEQ ID NO: 489065 - RNA, 22 nt, Human
ugacagaaauaguucuuaauuu

SEQ ID NO: 489066 - RNA, 22 nt, Human
caagaauuguacaaacugggug

SEQ ID NO: 489067 - RNA, 22 nt, Human
uguguauucagcaagcgaaaca

SEQ ID NO: 489068 - RNA, 22 nt, Human
acagugucugacacauuguagc

SEQ ID NO: 489069 - RNA, 22 nt, Human
guuuauuaacugucaagugauu

SEQ ID NO: 489070 - RNA, 22 nt, Human
agagacuggagaugggcagugu

SEQ ID NO: 489071 - RNA, 21 nt, Human
ugcuggccucaagggugacuu

SEQ ID NO: 489072 - RNA, 23 nt, Human
ccagcuccgugagccucgggcuc

SEQ ID NO: 489073 - RNA, 22 nt, Human
gcagauggacuguaugaccuga

SEQ ID NO: 489074 - RNA, 22 nt, Human
ucauguaaguauagaaagcagu

SEQ ID NO: 489075 - RNA, 21 nt, Human
gcagcuggucucagagcuugc

SEQ ID NO: 489076 - RNA, 22 nt, Human
ugaccaaagaguugcuuguauu

SEQ ID NO: 489077 - RNA, 22 nt, Human
cccucuacagggaagcgcuuuc

SEQ ID NO: 489078 - RNA, 18 nt, Human
uccauuguucuacuguga

SEQ ID NO: 489079 - RNA, 22 nt, Human
ugacacagaaauuaagcuguca

SEQ ID NO: 489080 - RNA, 22 nt, Human
acuguacuuuucuuggcuagau

SEQ ID NO: 489081 - RNA, 22 nt, Human
aggcagcagccacaaggccuga

SEQ ID NO: 489082 - RNA, 22 nt, Human
ccagggagccuggugugucagc

SEQ ID NO: 489083 - RNA, 19 nt, Human
guggccugcgcugggugcg

SEQ ID NO: 489084 - RNA, 22 nt, Human
augucuuuuaugauuacgggau

SEQ ID NO: 489085 - RNA, 22 nt, Human
gccaggcauuuauugauugaau

SEQ ID NO: 489086 - RNA, 18 nt, Human
gugacugccccaaaaggc

SEQ ID NO: 489087 - RNA, 22 nt, Human
aauguuaaguuuagauuauaac

SEQ ID NO: 489088 - RNA, 23 nt, Human
agguggagcugugcagccggggc

SEQ ID NO: 489089 - RNA, 22 nt, Human
cucugguuucgcaggaaauaga

SEQ ID NO: 489090 - RNA, 22 nt, Human
ugucaaguuguuaaguucuggg

SEQ ID NO: 489091 - RNA, 22 nt, Human
gcggggggcagcagucgcucag

SEQ ID NO: 489092 - RNA, 22 nt, Human
ugauuuacaguagugucuaaac

SEQ ID NO: 489093 - RNA, 19 nt, Human
auacacguguauacauaca

SEQ ID NO: 489094 - RNA, 22 nt, Human
cuccagagagaaaggaggccgc

SEQ ID NO: 489095 - RNA, 22 nt, Human
acaguguuacuugauaguguau

SEQ ID NO: 489096 - RNA, 22 nt, Human
ucaauuuauguggcuauucauu

SEQ ID NO: 489097 - RNA, 22 nt, Human
cacaguuuuaucuuauacugau

SEQ ID NO: 489098 - RNA, 22 nt, Human
gucuugcacuuaccuaagaacu

SEQ ID NO: 489099 - RNA, 22 nt, Human
cuccagaggcgacuugcaucac

SEQ ID NO: 489100 - RNA, 22 nt, Human
acccggagucggagguugcagu

SEQ ID NO: 489101 - RNA, 22 nt, Human
ucugcuguuuacugugugauau

SEQ ID NO: 489102 - RNA, 22 nt, Human
caacuguaauauuggaagauca

SEQ ID NO: 489103 - RNA, 22 nt, Human
gaauguuaaugcacuucuagcu

SEQ ID NO: 489104 - RNA, 18 nt, Human
ggaaaaggagugucuagc

SEQ ID NO: 489105 - RNA, 22 nt, Human
guuuauuggguauuguggagcc

SEQ ID NO: 489106 - RNA, 22 nt, Human
acacacagaaggaagccccacu

SEQ ID NO: 489107 - RNA, 22 nt, Human
aaauugcaaaaguacuuuuagg

SEQ ID NO: 489108 - RNA, 22 nt, Human
uagagcucuccuuccucugugg

SEQ ID NO: 489109 - RNA, 22 nt, Human
ugcucuguucaguguaucuugu

SEQ ID NO: 489110 - RNA, 22 nt, Human
cagcuggcgacucuccucgaug

SEQ ID NO: 489111 - RNA, 22 nt, Human
uucuucauucccuuacuuccga

SEQ ID NO: 489112 - RNA, 22 nt, Human
cauugagcgacccugcaugacu

SEQ ID NO: 489113 - RNA, 22 nt, Human
aucaugcagcaacaagcaaggc

SEQ ID NO: 489114 - RNA, 22 nt, Human
ucucauaauuguuucccagcua

SEQ ID NO: 489115 - RNA, 22 nt, Human
aaaaugcucaucagcgauggcu

SEQ ID NO: 489116 - RNA, 20 nt, Human
acagagauccucucuuuauc

SEQ ID NO: 489117 - RNA, 22 nt, Human
aucagagcuaguacuugcaggu

SEQ ID NO: 489118 - RNA, 22 nt, Human
cucagagaagauggaugaggua

SEQ ID NO: 489119 - RNA, 22 nt, Human
gcucuggcuacuguggcuaccg

SEQ ID NO: 489120 - RNA, 22 nt, Human
uuccaaggcugcuauuuguuuc

SEQ ID NO: 489121 - RNA, 22 nt, Human
auagacgcggccgcugaugcag

SEQ ID NO: 489122 - RNA, 22 nt, Human
cacaguuuugucuugguuucca

SEQ ID NO: 489123 - RNA, 22 nt, Human
cugggugagcuggccagagggu

SEQ ID NO: 489124 - RNA, 22 nt, Human
cuauuuucccauaugguugaca

SEQ ID NO: 489125 - RNA, 22 nt, Human
cagcaugaauguguucguaggg

SEQ ID NO: 489126 - RNA, 22 nt, Human
ugugagacguaggccaucgagg

SEQ ID NO: 489127 - RNA, 22 nt, Human
gugcuaugauuggacagaauag

SEQ ID NO: 489128 - RNA, 21 nt, Human
aauuucagacccauuuugccu

SEQ ID NO: 489129 - RNA, 22 nt, Human
uugagauagguggaaucucuuu

SEQ ID NO: 489130 - RNA, 21 nt, Human
aaacugaccuugccugagaca

SEQ ID NO: 489131 - RNA, 22 nt, Human
agccagugucgugugacaugag

SEQ ID NO: 489132 - RNA, 22 nt, Human
agagaccuuccugacuccagag

SEQ ID NO: 489133 - RNA, 22 nt, Human
gccagccccagacauccuaucg

SEQ ID NO: 489134 - RNA, 22 nt, Human
gcugggugauucauuuccauaa

SEQ ID NO: 489135 - RNA, 22 nt, Human
aggcaguggcuuuuguuguguu

SEQ ID NO: 489136 - RNA, 22 nt, Human
ugggugugagcccgggagccgc

SEQ ID NO: 489137 - RNA, 22 nt, Human
acagagggucugggcacaggac

SEQ ID NO: 489138 - RNA, 18 nt, Human
uccaccgcgugcaccucu

SEQ ID NO: 489139 - RNA, 22 nt, Human
aaauugcuugagauuagucucc

SEQ ID NO: 489140 - RNA, 22 nt, Human
aaugucaacacaagagaaaugc

SEQ ID NO: 489141 - RNA, 22 nt, Human
auguacaaucuaucacaagaag

SEQ ID NO: 489142 - RNA, 22 nt, Human
caucugcaggggaagccaguuu

SEQ ID NO: 489143 - RNA, 22 nt, Human
ugguuaaaugcuccgaucuugg

SEQ ID NO: 489144 - RNA, 22 nt, Human
guucuuaaagauucaucaagca

SEQ ID NO: 489145 - RNA, 22 nt, Human
ucagaacauccugguuuaaaau

SEQ ID NO: 489146 - RNA, 22 nt, Human
acagauccugguuacagccauu

SEQ ID NO: 489147 - RNA, 22 nt, Human
uagcuguucucuguaaauugga

SEQ ID NO: 489148 - RNA, 22 nt, Human
ggaagcaaauuccagaaccaca

SEQ ID NO: 489149 - RNA, 22 nt, Human
agaguuuacagaaauaagcugu

SEQ ID NO: 489150 - RNA, 22 nt, Human
aaauuaacuaucacuuuuguga

SEQ ID NO: 489151 - RNA, 22 nt, Human
ggugggucuuguggggcagcuu

SEQ ID NO: 489152 - RNA, 22 nt, Human
cuacagaauucaacaaaugguu

SEQ ID NO: 489153 - RNA, 22 nt, Human
aaggcaguuaauuuggcuagaa

SEQ ID NO: 489154 - RNA, 22 nt, Human
ccuuuuaagggagacuagagau

SEQ ID NO: 489155 - RNA, 22 nt, Human
gaggugggaugugugugcuacu

SEQ ID NO: 489156 - RNA, 22 nt, Human
guccuggugcuggucauugucg

SEQ ID NO: 489157 - RNA, 22 nt, Human
uauggauauaaucagacuggaa

SEQ ID NO: 489158 - RNA, 22 nt, Human
aguguuaaggcugguugcuaua

SEQ ID NO: 489159 - RNA, 22 nt, Human
aacaguaugugagauuuacaca

SEQ ID NO: 489160 - RNA, 22 nt, Human
uguuuuaagggucaacugucac

SEQ ID NO: 489161 - RNA, 22 nt, Human
acagcugggaacucacacagca

SEQ ID NO: 489162 - RNA, 22 nt, Human
guuaaugcaaagcagagggcaa

SEQ ID NO: 489163 - RNA, 22 nt, Human
cuguguccaauggccuuagcag

SEQ ID NO: 489164 - RNA, 22 nt, Human
ggccaaggcucuugagggcuga

SEQ ID NO: 489165 - RNA, 22 nt, Human
accugccagaaugcuaguccug

SEQ ID NO: 489166 - RNA, 22 nt, Human
uccagugguggcucccggaccu

SEQ ID NO: 489167 - RNA, 22 nt, Human
acaccuuuuauucgccaggcac

SEQ ID NO: 489168 - RNA, 22 nt, Human
gggaaacuuucacaauguccag

SEQ ID NO: 489169 - RNA, 22 nt, Human
uucaaacacugcuuugagaggg

SEQ ID NO: 489170 - RNA, 22 nt, Human
aucuaaagugucauaaguagcu

SEQ ID NO: 489171 - RNA, 22 nt, Human
gccagugccugcugcucagggc

SEQ ID NO: 489172 - RNA, 22 nt, Human
aagucuucagacuggagagauu

SEQ ID NO: 489173 - RNA, 22 nt, Human
auccgcuuaucucagcuggcag

SEQ ID NO: 489174 - RNA, 22 nt, Human
uugacccgaguccuucuugggg

SEQ ID NO: 489175 - RNA, 22 nt, Human
aaggcauggcaggguuuacaca

SEQ ID NO: 489176 - RNA, 22 nt, Human
uguucuggugaggccauggggu

SEQ ID NO: 489177 - RNA, 20 nt, Human
gggugugugcagggccuggu

SEQ ID NO: 489178 - RNA, 22 nt, Human
cacugguugccucuuucuguuc

SEQ ID NO: 489179 - RNA, 22 nt, Human
ggagguggagcuggaaguucca

SEQ ID NO: 489180 - RNA, 22 nt, Human
cagagcagcagagcuuccaugg

SEQ ID NO: 489181 - RNA, 22 nt, Human
cucaaaauccauaaaaucaggu

SEQ ID NO: 489182 - RNA, 22 nt, Human
gcccagcaccucucucaggguu

SEQ ID NO: 489183 - RNA, 22 nt, Human
cuguccauggcaaugaugcaga

SEQ ID NO: 489184 - RNA, 22 nt, Human
uauucacaaaaugagguccuca

SEQ ID NO: 489185 - RNA, 22 nt, Human
cucagagagacaaugugggaca

SEQ ID NO: 489186 - RNA, 22 nt, Human
uugucgggcuuacgcagggcca

SEQ ID NO: 489187 - RNA, 22 nt, Human
uguaagcuucaaauaucuguga

SEQ ID NO: 489188 - RNA, 22 nt, Human
gugggugucaguaucuuuaacg

SEQ ID NO: 489189 - RNA, 22 nt, Human
uucuccacccacucuuuuguug

SEQ ID NO: 489190 - RNA, 22 nt, Human
guuuacaacaucuuguccuuca

SEQ ID NO: 489191 - RNA, 22 nt, Human
guacauauccuuuacguuuugu

SEQ ID NO: 489192 - RNA, 22 nt, Human
auguaguauuuggaaauguaaa

SEQ ID NO: 489193 - RNA, 22 nt, Human
uaugccuaccuccaaaauauau

SEQ ID NO: 489194 - RNA, 22 nt, Human
uucccuucuaguuuugagagac

SEQ ID NO: 489195 - RNA, 22 nt, Human
cacaccuuaggccugagcgcuu

SEQ ID NO: 489196 - RNA, 22 nt, Human
ucaaaggcuugugguucuggga

SEQ ID NO: 489197 - RNA, 22 nt, Human
gccagaggggcucgaaggcgcg

SEQ ID NO: 489198 - RNA, 22 nt, Human
ggcaguggcuccucucuacucc

SEQ ID NO: 489199 - RNA, 22 nt, Human
gggcauuucuugucaauguagg

SEQ ID NO: 489200 - RNA, 22 nt, Human
gcacaguauuuaguagaaugag

SEQ ID NO: 489201 - RNA, 22 nt, Human
cuaaagucauacaaggugggag

SEQ ID NO: 489202 - RNA, 17 nt, Human
auucaugaacauguccu

SEQ ID NO: 489203 - RNA, 22 nt, Human
ucugggagaguagauaaaggaa

SEQ ID NO: 489204 - RNA, 17 nt, Human
uaagggggaaacggagc

SEQ ID NO: 489205 - RNA, 22 nt, Human
gcguuggggaccccgaagcugg

SEQ ID NO: 489206 - RNA, 20 nt, Human
gcagcagacagacaggggac

SEQ ID NO: 489207 - RNA, 20 nt, Human
ugggaucgaaucaagucugu

SEQ ID NO: 489208 - RNA, 22 nt, Human
uuugacaacugugcaguuugua

SEQ ID NO: 489209 - RNA, 22 nt, Human
gaaguauuucugaguugcccag

SEQ ID NO: 489210 - RNA, 22 nt, Human
cuucuaauucuuauguaagcuu

SEQ ID NO: 489211 - RNA, 18 nt, Human
augggcagguaagaucca

SEQ ID NO: 489212 - RNA, 20 nt, Human
ccagguggugccuggagagg

SEQ ID NO: 489213 - RNA, 22 nt, Human
uaaggagagaauuuagagguuu

SEQ ID NO: 489214 - RNA, 20 nt, Human
ggccugagcauggcuggcag

SEQ ID NO: 489215 - RNA, 22 nt, Human
gggcuguaggagcuggaauggg

SEQ ID NO: 489216 - RNA, 22 nt, Human
aggcaguugaguggcuuuuuca

SEQ ID NO: 489217 - RNA, 22 nt, Human
acuggcuuugagggaauagcua

SEQ ID NO: 489218 - RNA, 22 nt, Human
acuuuuaaggggccuugauuua

SEQ ID NO: 489219 - RNA, 18 nt, Human
uauaaacacacuuagguu

SEQ ID NO: 489220 - RNA, 22 nt, Human
aaggggaguuagugauaaaacc

SEQ ID NO: 489221 - RNA, 22 nt, Human
ggccagccuggggcucccagac

SEQ ID NO: 489222 - RNA, 22 nt, Human
uacauguuauuucacuauuggu

SEQ ID NO: 489223 - RNA, 22 nt, Human
ucguuaaucagcaccagaauuc

SEQ ID NO: 489224 - RNA, 22 nt, Human
cacauuuaugggcugggaggca

SEQ ID NO: 489225 - RNA, 22 nt, Human
uaauuuugucacagugacaugc

SEQ ID NO: 489226 - RNA, 22 nt, Human
cuggagggcugcagcgaggcug

SEQ ID NO: 489227 - RNA, 22 nt, Human
uguaaagaaagacgcagaguua

SEQ ID NO: 489228 - RNA, 22 nt, Human
gggacaauggaggccucucucc

SEQ ID NO: 489229 - RNA, 22 nt, Human
gacauuuauuggauuuuacgag

SEQ ID NO: 489230 - RNA, 22 nt, Human
gccaggaccucagaugcagggc

SEQ ID NO: 489231 - RNA, 22 nt, Human
gaggggcucuugggcaugaagg

SEQ ID NO: 489232 - RNA, 20 nt, Human
cuguuugcuaucaugagcug

SEQ ID NO: 489233 - RNA, 21 nt, Human
uaaacauaaccuuguauggcu

SEQ ID NO: 489234 - RNA, 22 nt, Human
cugugaauguuauaucucaaug

SEQ ID NO: 489235 - RNA, 22 nt, Human
cacccucaagcaguggcacgug

SEQ ID NO: 489236 - RNA, 22 nt, Human
agccaggucaggaaagguccca

SEQ ID NO: 489237 - RNA, 20 nt, Human
gaacagucuucugagccaca

SEQ ID NO: 489238 - RNA, 22 nt, Human
ugaguggacgugaggcugagua

SEQ ID NO: 489239 - RNA, 22 nt, Human
ucuauuaaugauucaauagugu

SEQ ID NO: 489240 - RNA, 22 nt, Human
uuugcuugauuaggauauggaa

SEQ ID NO: 489241 - RNA, 22 nt, Human
uucucugguuugcuguuucuga

SEQ ID NO: 489242 - RNA, 19 nt, Human
uccuggggaggggcauggc

SEQ ID NO: 489243 - RNA, 20 nt, Human
uccugggguaagccaugguc

SEQ ID NO: 489244 - RNA, 22 nt, Human
uaucuguagucucaugguuccu

SEQ ID NO: 489245 - RNA, 22 nt, Human
uuguccagcgaccaggcucugu

SEQ ID NO: 489246 - RNA, 22 nt, Human
agccagugcagcuggaaauuca

SEQ ID NO: 489247 - RNA, 22 nt, Human
uguacacauuaagcucuuuaga

SEQ ID NO: 489248 - RNA, 22 nt, Human
uaaaacuagugguugggacuaa

SEQ ID NO: 489249 - RNA, 22 nt, Human
gaggggcugggguugacuccaa

SEQ ID NO: 489250 - RNA, 22 nt, Human
ugucauuggugaucugaugccu

SEQ ID NO: 489251 - RNA, 19 nt, Human
ucaaagucugagucacuuu

SEQ ID NO: 489252 - RNA, 20 nt, Human
acuagaaagucacugggggg

SEQ ID NO: 489253 - RNA, 22 nt, Human
cgcugggcgcgcuccgaacccg

SEQ ID NO: 489254 - RNA, 20 nt, Human
aaaaacaguaaugcugaaga

SEQ ID NO: 489255 - RNA, 19 nt, Human
cugggacaaugaaagcauc

SEQ ID NO: 489256 - RNA, 22 nt, Human
guccagaguagucgaguauucu

SEQ ID NO: 489257 - RNA, 20 nt, Human
gggugugggcccggccaggc

SEQ ID NO: 489258 - RNA, 22 nt, Human
cgucauuuguaaaugaucaaga

SEQ ID NO: 489259 - RNA, 22 nt, Human
uuacuguagcuugacauauguc

SEQ ID NO: 489260 - RNA, 22 nt, Human
aacccgggagguggagguuaug

SEQ ID NO: 489261 - RNA, 22 nt, Human
gaguggggcccacugcugggug

SEQ ID NO: 489262 - RNA, 23 nt, Human
aguacauuugacccaaauaagcu

SEQ ID NO: 489263 - RNA, 20 nt, Human
ugggguccuggaggggaucc

SEQ ID NO: 489264 - RNA, 22 nt, Human
auguaacauaugugaucgcauu

SEQ ID NO: 489265 - RNA, 22 nt, Human
gggcggggcuuccguccuccac

SEQ ID NO: 489266 - RNA, 17 nt, Human
gcccgugggcuacggua

SEQ ID NO: 489267 - RNA, 22 nt, Human
uuucccaggcuggaaugcagug

SEQ ID NO: 489268 - RNA, 22 nt, Human
ucuguucagaagaggugaaagu

SEQ ID NO: 489269 - RNA, 22 nt, Human
auuguuacuggguuaauuugga

SEQ ID NO: 489270 - RNA, 22 nt, Human
uugagcagaucgggcugugggg

SEQ ID NO: 489271 - RNA, 22 nt, Human
uggugcugccaccuccucugcu

SEQ ID NO: 489272 - RNA, 22 nt, Human
ucugcuggaaaaccagggaauu

SEQ ID NO: 489273 - RNA, 22 nt, Human
acagagacaauauuuguaaagu

SEQ ID NO: 489274 - RNA, 22 nt, Human
augaacaguacaaagcacagac

SEQ ID NO: 489275 - RNA, 22 nt, Human
uauucacagcugccgcacucag

SEQ ID NO: 489276 - RNA, 22 nt, Human
ggacugucuccuugcugguagg

SEQ ID NO: 489277 - RNA, 22 nt, Human
gauuugucuauauucaaauaug

SEQ ID NO: 489278 - RNA, 22 nt, Human
ccuguauggcuauuccuuggac

SEQ ID NO: 489279 - RNA, 22 nt, Human
cuggugcuguagccugauugag

SEQ ID NO: 489280 - RNA, 19 nt, Human
agcagagcagggccguggg

SEQ ID NO: 489281 - RNA, 18 nt, Human
gggcuuuacagaguggag

SEQ ID NO: 489282 - RNA, 22 nt, Human
uccaggaggacugagggggcug

SEQ ID NO: 489283 - RNA, 22 nt, Human
uuugcagagugcagaagcaucu

SEQ ID NO: 489284 - RNA, 22 nt, Human
auguacauuauucgagugaugg

SEQ ID NO: 489285 - RNA, 22 nt, Human
gaggagcuucagaggaaucuua

SEQ ID NO: 489286 - RNA, 22 nt, Human
ccaaaauauuagugcuuaagua

SEQ ID NO: 489287 - RNA, 22 nt, Human
uguccugugaccuggcaccaca

SEQ ID NO: 489288 - RNA, 22 nt, Human
uguggaauguccucagcauccu

SEQ ID NO: 489289 - RNA, 22 nt, Human
cuugugaaaugccagauaaucu

SEQ ID NO: 489290 - RNA, 20 nt, Human
cugcuccacccggcucucag

SEQ ID NO: 489291 - RNA, 22 nt, Human
gugugcgccgacacagccaggu

SEQ ID NO: 489292 - RNA, 22 nt, Human
gcugucaggaacaugccuuggu

SEQ ID NO: 489293 - RNA, 22 nt, Human
auuguauacaagcuuaauuguu

SEQ ID NO: 489294 - RNA, 22 nt, Human
ucccugggguaucgcugaggca

SEQ ID NO: 489295 - RNA, 22 nt, Human
uuguaacaguagcugucagcuc

SEQ ID NO: 489296 - RNA, 20 nt, Human
aaagauacuuuuuguaaugg

SEQ ID NO: 489297 - RNA, 22 nt, Human
ggcaguggugggaggcucgcuc

SEQ ID NO: 489298 - RNA, 22 nt, Human
agcuuucuauauaugaguugcu

SEQ ID NO: 489299 - RNA, 22 nt, Human
aauuauguuugcuuuagaugga

SEQ ID NO: 489300 - RNA, 22 nt, Human
auggugguagaagcacuaugug

SEQ ID NO: 489301 - RNA, 22 nt, Human
aauaguguauuuuucaaaauua

SEQ ID NO: 489302 - RNA, 22 nt, Human
guaaacugaauuggauacugug

SEQ ID NO: 489303 - RNA, 22 nt, Human
aauucauacucuauauugcuuu

SEQ ID NO: 489304 - RNA, 22 nt, Human
cauggcaggugcagauucugug

SEQ ID NO: 489305 - RNA, 22 nt, Human
gaucucaaagcaguguggguug

SEQ ID NO: 489306 - RNA, 22 nt, Human
ugcugugagaccauuuguugag

SEQ ID NO: 489307 - RNA, 22 nt, Human
gaaauguuggacacuugaaauu

SEQ ID NO: 489308 - RNA, 22 nt, Human
ucuuuuaucuguuguguaacaa

SEQ ID NO: 489309 - RNA, 22 nt, Human
uuauuuuguagcucugaucuuu

SEQ ID NO: 489310 - RNA, 22 nt, Human
cuguaaccuccucuuuccauuc

SEQ ID NO: 489311 - RNA, 22 nt, Human
aaaacauuuuacugccaucuca

SEQ ID NO: 489312 - RNA, 22 nt, Human
caguggguccugcgucugccag

SEQ ID NO: 489313 - RNA, 22 nt, Human
ugguaugcuuauuaucuucaac

SEQ ID NO: 489314 - RNA, 22 nt, Human
acaguguuucacuuaaccguuu

SEQ ID NO: 489315 - RNA, 22 nt, Human
auuccucagcaggccuuuuguu

SEQ ID NO: 489316 - RNA, 22 nt, Human
acaugacagugacuuuauaaga

SEQ ID NO: 489317 - RNA, 17 nt, Human
aacaguuaaugggggaa

SEQ ID NO: 489318 - RNA, 22 nt, Human
gccccacuguggaaccuaaguc

SEQ ID NO: 489319 - RNA, 19 nt, Human
gagcagcuuccuaucuggu

SEQ ID NO: 489320 - RNA, 22 nt, Human
agcggcgccggagggaggugcg

SEQ ID NO: 489321 - RNA, 22 nt, Human
aauaaguacuuggggauaacuu

SEQ ID NO: 489322 - RNA, 22 nt, Human
uaugcgugccucugucugucug

SEQ ID NO: 489323 - RNA, 22 nt, Human
cugaaagcaaaguaauucuuaa

SEQ ID NO: 489324 - RNA, 22 nt, Human
cacggccacugcagcaccccag

SEQ ID NO: 489325 - RNA, 22 nt, Human
cucccagggucuaggcugcugg

SEQ ID NO: 489326 - RNA, 21 nt, Human
acaaauuguuuauauaggaag

SEQ ID NO: 489327 - RNA, 22 nt, Human
auguccagaguaaagcacauuc

SEQ ID NO: 489328 - RNA, 22 nt, Human
aaagucuuaauguaaguuuagu

SEQ ID NO: 489329 - RNA, 21 nt, Human
ggcagcucagcagauggggac

SEQ ID NO: 489330 - RNA, 22 nt, Human
uugcaaucagcaguguuuucac

SEQ ID NO: 489331 - RNA, 22 nt, Human
acaguucuguccuagacuucgu

SEQ ID NO: 489332 - RNA, 22 nt, Human
gcaugagacuagcucaugagca

SEQ ID NO: 489333 - RNA, 18 nt, Human
aaacauggcuuaaaggcu

SEQ ID NO: 489334 - RNA, 22 nt, Human
uccaguggugguuugaagggca

SEQ ID NO: 489335 - RNA, 19 nt, Human
gggucccacugcccgucug

SEQ ID NO: 489336 - RNA, 22 nt, Human
uguucugcaaugcugccuccuu

SEQ ID NO: 489337 - RNA, 22 nt, Human
ggcagcaggguagccauuucuc

SEQ ID NO: 489338 - RNA, 22 nt, Human
uuuaaaccuaucuaagaaauag

SEQ ID NO: 489339 - RNA, 22 nt, Human
uggggcuccuccuggcaggagg

SEQ ID NO: 489340 - RNA, 22 nt, Human
ggggucacacuguggugacugg

SEQ ID NO: 489341 - RNA, 22 nt, Human
uucagaaagugaaucuuguuau

SEQ ID NO: 489342 - RNA, 22 nt, Human
uuuacagagaauguacauaaag

SEQ ID NO: 489343 - RNA, 22 nt, Human
gaucggguggguucugccauca

SEQ ID NO: 489344 - RNA, 22 nt, Human
uguguuucugagaaucccaccu

SEQ ID NO: 489345 - RNA, 22 nt, Human
uaaauacuuuuacuccacugau

SEQ ID NO: 489346 - RNA, 20 nt, Human
cucuuuucacucucaguggu

SEQ ID NO: 489347 - RNA, 22 nt, Human
aauagcaaaugcucauuugaaa

SEQ ID NO: 489348 - RNA, 22 nt, Human
ucaggagaguguucaguggagg

SEQ ID NO: 489349 - RNA, 22 nt, Human
cacacuguccccuucuccccag

SEQ ID NO: 489350 - RNA, 22 nt, Human
uccgcgcucucacccgcucccg

SEQ ID NO: 489351 - RNA, 22 nt, Human
ucuggauggucagcucuuccug

SEQ ID NO: 489352 - RNA, 22 nt, Human
uucagaaaggcugugccagcca

SEQ ID NO: 489353 - RNA, 20 nt, Human
cugaccagcagccugucucc

SEQ ID NO: 489354 - RNA, 22 nt, Human
auugcacaucugcacuacagcc

SEQ ID NO: 489355 - RNA, 22 nt, Human
ucccacacagcccgcucaccgg

SEQ ID NO: 489356 - RNA, 22 nt, Human
ccccaacccugguuccguggcg

SEQ ID NO: 489357 - RNA, 22 nt, Human
uggggugugcucagagcagggg

SEQ ID NO: 489358 - RNA, 22 nt, Human
uuugaaauguaucaguauaggu

SEQ ID NO: 489359 - RNA, 22 nt, Human
ugaaauguggagaugguaagua

SEQ ID NO: 489360 - RNA, 22 nt, Human
uguggaagaacuucuugcuugg

SEQ ID NO: 489361 - RNA, 22 nt, Human
cauguguauuauucuuguggaa

SEQ ID NO: 489362 - RNA, 22 nt, Human
gaggcauaaguagaagagauug

SEQ ID NO: 489363 - RNA, 22 nt, Human
gguagacaacuuuguaauagcc

SEQ ID NO: 489364 - RNA, 22 nt, Human
auuuacugagguaaauaaacug

SEQ ID NO: 489365 - RNA, 22 nt, Human
gcggcccgagcaggacgggugg

SEQ ID NO: 489366 - RNA, 22 nt, Human
accaggcccuccagcugcgugg

SEQ ID NO: 489367 - RNA, 22 nt, Human
cuggagcucagcccagguucca

SEQ ID NO: 489368 - RNA, 22 nt, Human
uaagccugcaugaaccaugaga

SEQ ID NO: 489369 - RNA, 22 nt, Human
auacuucuuuagcauauugaac

SEQ ID NO: 489370 - RNA, 22 nt, Human
acagcuggccgaggcucaggga

SEQ ID NO: 489371 - RNA, 22 nt, Human
cuugaaagucagcagaguggau

SEQ ID NO: 489372 - RNA, 22 nt, Human
cuggaagcgucggaggaagggc

SEQ ID NO: 489373 - RNA, 22 nt, Human
uugcauauccuccaacacaugg

SEQ ID NO: 489374 - RNA, 22 nt, Human
aucuucaaggaaaaaauacagu

SEQ ID NO: 489375 - RNA, 20 nt, Human
auuagcuuggagacaguggc

SEQ ID NO: 489376 - RNA, 22 nt, Human
gaagcgcggcgucggcgugggu

SEQ ID NO: 489377 - RNA, 22 nt, Human
cuggagcucuguguguuccuga

SEQ ID NO: 489378 - RNA, 17 nt, Human
ucugccaguuuuagaau

SEQ ID NO: 489379 - RNA, 22 nt, Human
ugugucuuuggcgaugucugga

SEQ ID NO: 489380 - RNA, 22 nt, Human
agccuauucaucugaucuugaa

SEQ ID NO: 489381 - RNA, 22 nt, Human
uuccaaguuaggcgagcuggug

SEQ ID NO: 489382 - RNA, 22 nt, Human
uccuggggaggucgaggcugag

SEQ ID NO: 489383 - RNA, 22 nt, Human
auuauguagcuaaaaauugugu

SEQ ID NO: 489384 - RNA, 22 nt, Human
ggauguuuauccuaucuuaguu

SEQ ID NO: 489385 - RNA, 22 nt, Human
uaucacauacuucucauccagg

SEQ ID NO: 489386 - RNA, 22 nt, Human
cuaaauguuuuaucuuccuggc

SEQ ID NO: 489387 - RNA, 22 nt, Human
cacauuuaaagguugaagcuga

SEQ ID NO: 489388 - RNA, 22 nt, Human
acagcuucgaggaucucauccc

SEQ ID NO: 489389 - RNA, 22 nt, Human
ggcuucuuagaauuugacuuac

SEQ ID NO: 489390 - RNA, 22 nt, Human
ccuuuuauauggcucaucacag

SEQ ID NO: 489391 - RNA, 22 nt, Human
gaaaccuuugccgauggggucc

SEQ ID NO: 489392 - RNA, 22 nt, Human
acaaaggugagcagaagacaca

SEQ ID NO: 489393 - RNA, 22 nt, Human
aaucuguugucaggaauccaca

SEQ ID NO: 489394 - RNA, 22 nt, Human
cagaaacacuguauuuagggaa

SEQ ID NO: 489395 - RNA, 22 nt, Human
cuuucugaggagacgggcuuug

SEQ ID NO: 489396 - RNA, 18 nt, Human
ucugagggugcgggagcu

SEQ ID NO: 489397 - RNA, 22 nt, Human
uuccuuuucuucuaccacaugu

SEQ ID NO: 489398 - RNA, 18 nt, Human
cugccagugugcucuccg

SEQ ID NO: 489399 - RNA, 22 nt, Human
gauuguacuuauugagcuaaac

SEQ ID NO: 489400 - RNA, 22 nt, Human
uacaguaaccagucuacuuaga

SEQ ID NO: 489401 - RNA, 22 nt, Human
agcaauguuggccuauauaccu

SEQ ID NO: 489402 - RNA, 22 nt, Human
uguguuuuggaaggaacaugca

SEQ ID NO: 489403 - RNA, 22 nt, Human
auugaagacuugguauccgugg

SEQ ID NO: 489404 - RNA, 22 nt, Human
uccaggagcucauccacgucaa

SEQ ID NO: 489405 - RNA, 22 nt, Human
ucagcccggguucgcaaacacu

SEQ ID NO: 489406 - RNA, 22 nt, Human
ggcgcucaguguugccccagag

SEQ ID NO: 489407 - RNA, 22 nt, Human
caauguuuuuccuuccuuaaua

SEQ ID NO: 489408 - RNA, 22 nt, Human
ggccgggcuguggagaaggggu

SEQ ID NO: 489409 - RNA, 22 nt, Human
ugguuuacucuguaaaccagga

SEQ ID NO: 489410 - RNA, 22 nt, Human
guucuucaaagugacaacuaaa

SEQ ID NO: 489411 - RNA, 22 nt, Human
aaccagacucuccaaaggcaaa

SEQ ID NO: 489412 - RNA, 22 nt, Human
acagugcaaauaggacugucuu

SEQ ID NO: 489413 - RNA, 22 nt, Human
cagguguugcaguugaagacug

SEQ ID NO: 489414 - RNA, 22 nt, Human
auacaacagaaaaugauuauuc

SEQ ID NO: 489415 - RNA, 22 nt, Human
aaguccagguccucauuccauc

SEQ ID NO: 489416 - RNA, 20 nt, Human
augcacccucagggucccug

SEQ ID NO: 489417 - RNA, 22 nt, Human
uuaaaagaauccuguuauccuc

SEQ ID NO: 489418 - RNA, 17 nt, Human
uguguaaguugcauaga

SEQ ID NO: 489419 - RNA, 22 nt, Human
ugggguccucucacuuggaggg

SEQ ID NO: 489420 - RNA, 22 nt, Human
ugaaaugccuaugaagucagga

SEQ ID NO: 489421 - RNA, 22 nt, Human
uuacaauuacuugaucucagcu

SEQ ID NO: 489422 - RNA, 22 nt, Human
aauucaaggaucuguuaaaucu

SEQ ID NO: 489423 - RNA, 22 nt, Human
ucuaaugcuugacugggggcuu

SEQ ID NO: 489424 - RNA, 22 nt, Human
cuccccacgccuggacuaagag

SEQ ID NO: 489425 - RNA, 19 nt, Human
cgcacagccugccaggcgc

SEQ ID NO: 489426 - RNA, 20 nt, Human
ucagugggaaagugagagug

SEQ ID NO: 489427 - RNA, 22 nt, Human
ggacagacuuuacagccccggg

SEQ ID NO: 489428 - RNA, 22 nt, Human
ggugggugagcccugggagcug

SEQ ID NO: 489429 - RNA, 21 nt, Human
gcaauucgcuaugaugguggc

SEQ ID NO: 489430 - RNA, 22 nt, Human
aucuggcucccuuggaauccgu

SEQ ID NO: 489431 - RNA, 22 nt, Human
cugagggagcugcuggccuugg

SEQ ID NO: 489432 - RNA, 22 nt, Human
caauuuuuaaacuaugaaguug

SEQ ID NO: 489433 - RNA, 22 nt, Human
aacuuaaacaagcucccaaguu

SEQ ID NO: 489434 - RNA, 22 nt, Human
acaacuuuaauggguuucagcu

SEQ ID NO: 489435 - RNA, 22 nt, Human
caguguuuagcacagugcuugg

SEQ ID NO: 489436 - RNA, 22 nt, Human
uuuucaguuccaucucugcucu

SEQ ID NO: 489437 - RNA, 22 nt, Human
ggcagcagaacuggcccuguau

SEQ ID NO: 489438 - RNA, 22 nt, Human
ccaggacacgauuuuuagucug

SEQ ID NO: 489439 - RNA, 22 nt, Human
guuaaaugcagauucugacuca

SEQ ID NO: 489440 - RNA, 22 nt, Human
aacacaguuucugcauugguag

SEQ ID NO: 489441 - RNA, 22 nt, Human
cucuccaggcgagguccuacug

SEQ ID NO: 489442 - RNA, 22 nt, Human
aggcauuacaucuaaauauuua

SEQ ID NO: 489443 - RNA, 22 nt, Human
uaaaguucuuagaacaaggccu

SEQ ID NO: 489444 - RNA, 22 nt, Human
aauuccagcugauugacuuucc

SEQ ID NO: 489445 - RNA, 22 nt, Human
gaauuguacugcaaucagggga

SEQ ID NO: 489446 - RNA, 22 nt, Human
guuuugaauacuacuagaacuu

SEQ ID NO: 489447 - RNA, 22 nt, Human
guggcauuuuagaacagcugac

SEQ ID NO: 489448 - RNA, 22 nt, Human
aaagugacaaccauuuauuaag

SEQ ID NO: 489449 - RNA, 18 nt, Human
ucuuccaacacugacacc

SEQ ID NO: 489450 - RNA, 22 nt, Human
guuucuccucugugucuuguuu

SEQ ID NO: 489451 - RNA, 22 nt, Human
accauccuuuaguuugcguuuc

SEQ ID NO: 489452 - RNA, 22 nt, Human
augauuuguuaacagacuuaau

SEQ ID NO: 489453 - RNA, 22 nt, Human
ucuaguuagugguugauacugu

SEQ ID NO: 489454 - RNA, 22 nt, Human
ucuggaaggggaucugugguca

SEQ ID NO: 489455 - RNA, 20 nt, Human
uuugauugccccucugacuu

SEQ ID NO: 489456 - RNA, 22 nt, Human
agggaagcagcagccgccuguc

SEQ ID NO: 489457 - RNA, 18 nt, Human
auuugcaggcaugcaggc

SEQ ID NO: 489458 - RNA, 22 nt, Human
agaacagaggccuuauguuuca

SEQ ID NO: 489459 - RNA, 22 nt, Human
aaugacaguggcacagucacuu

SEQ ID NO: 489460 - RNA, 22 nt, Human
ugugacagugccagcuucauag

SEQ ID NO: 489461 - RNA, 22 nt, Human
caaguaugagaaagcuauuacc

SEQ ID NO: 489462 - RNA, 22 nt, Human
ugucauauagaauguucuauga

SEQ ID NO: 489463 - RNA, 22 nt, Human
ccaucuucucuugaaccuccuu

SEQ ID NO: 489464 - RNA, 22 nt, Human
ucauccagccucaucaggagcu

SEQ ID NO: 489465 - RNA, 22 nt, Human
uuuguguuguacuucugugcau

SEQ ID NO: 489466 - RNA, 22 nt, Human
caguauuucauucagaauuguu

SEQ ID NO: 489467 - RNA, 22 nt, Human
agcauggcuuuggaggauagca

SEQ ID NO: 489468 - RNA, 22 nt, Human
gcccaguggcaucuucacugcu

SEQ ID NO: 489469 - RNA, 22 nt, Human
ccgugugcacgcgccggugcug

SEQ ID NO: 489470 - RNA, 22 nt, Human
uaucuuaaaaaucgaagcagau

SEQ ID NO: 489471 - RNA, 22 nt, Human
aaguuacaggagaaagagauca

SEQ ID NO: 489472 - RNA, 22 nt, Human
ugcaaauauuccaugcuguuca

SEQ ID NO: 489473 - RNA, 22 nt, Human
acaagauagcuuagaagauuca

SEQ ID NO: 489474 - RNA, 22 nt, Human
ucuuauaccccuaaacugcagc

SEQ ID NO: 489475 - RNA, 22 nt, Human
uucugauugcugaugaggccca

SEQ ID NO: 489476 - RNA, 22 nt, Human
ugaagacaguuuuacucaugag

SEQ ID NO: 489477 - RNA, 22 nt, Human
uuuggagagaugaaguucugug

SEQ ID NO: 489478 - RNA, 22 nt, Human
auauaguuggguuucauucuac

SEQ ID NO: 489479 - RNA, 22 nt, Human
ucuguaaacacccguaagcuuu

SEQ ID NO: 489480 - RNA, 22 nt, Human
ccagcuggaacggcagcccagc

SEQ ID NO: 489481 - RNA, 22 nt, Human
caauguacaaaauaauuacaca

SEQ ID NO: 489482 - RNA, 22 nt, Human
uaguauuuccuguaagcuauag

SEQ ID NO: 489483 - RNA, 22 nt, Human
gacagucccccagcagcaaacc

SEQ ID NO: 489484 - RNA, 22 nt, Human
gucugcccugcagacaugccuc

SEQ ID NO: 489485 - RNA, 22 nt, Human
aucuucaaagcacaucguuugu

SEQ ID NO: 489486 - RNA, 22 nt, Human
ucucugguuauuaacuaacucc

SEQ ID NO: 489487 - RNA, 23 nt, Human
uguguucagucaaggaucagagu

SEQ ID NO: 489488 - RNA, 22 nt, Human
uuuacuucugcauuuccccuag

SEQ ID NO: 489489 - RNA, 18 nt, Human
aguaaauguuaaauauug

SEQ ID NO: 489490 - RNA, 21 nt, Human
uuucaagggacccuggggauc

SEQ ID NO: 489491 - RNA, 22 nt, Human
uucagucuuguugaaaacuugg

SEQ ID NO: 489492 - RNA, 20 nt, Human
agugauuuguuaguacauug

SEQ ID NO: 489493 - RNA, 22 nt, Human
ugaguguuguaaccauaugauu

SEQ ID NO: 489494 - RNA, 22 nt, Human
gaaacuguauguaguuuuuggg

SEQ ID NO: 489495 - RNA, 22 nt, Human
cgaggaggaaacgcggagaacu

SEQ ID NO: 489496 - RNA, 22 nt, Human
auuccaaagccugaauaaugga

SEQ ID NO: 489497 - RNA, 22 nt, Human
uuucuacacuucgugguguuuu

SEQ ID NO: 489498 - RNA, 23 nt, Human
aaacuacauuuauaguuuuucuc

SEQ ID NO: 489499 - RNA, 22 nt, Human
acagagacacggaagcuaaaga

SEQ ID NO: 489500 - RNA, 22 nt, Human
acggccgaugacuccagcaugg

SEQ ID NO: 489501 - RNA, 22 nt, Human
guugcagcaucacugcugagug

SEQ ID NO: 489502 - RNA, 22 nt, Human
gagugugucggucagcguggcg

SEQ ID NO: 489503 - RNA, 22 nt, Human
agucaguaugacuuauaguucu

SEQ ID NO: 489504 - RNA, 20 nt, Human
ugcuggaggcgccggcgcuc

SEQ ID NO: 489505 - RNA, 20 nt, Human
uucacagaggacucagguca

SEQ ID NO: 489506 - RNA, 22 nt, Human
ucuuuugagggccagaggaaga

SEQ ID NO: 489507 - RNA, 22 nt, Human
ccagguggacggcgaguacagg

SEQ ID NO: 489508 - RNA, 20 nt, Human
cuugaguucagagcugucau

SEQ ID NO: 489509 - RNA, 22 nt, Human
acccggaggcgggggaugcagu

SEQ ID NO: 489510 - RNA, 22 nt, Human
ucugaauucuuagaauuaaagg

SEQ ID NO: 489511 - RNA, 22 nt, Human
aagacacuuucuaaauagaagu

SEQ ID NO: 489512 - RNA, 22 nt, Human
gaauacaaauaauaccaaggug

SEQ ID NO: 489513 - RNA, 22 nt, Human
agacacauuuucagcucugcca

SEQ ID NO: 489514 - RNA, 22 nt, Human
guaauucugugugaaucuauua

SEQ ID NO: 489515 - RNA, 22 nt, Human
auagucuuagaaucuugagugu

SEQ ID NO: 489516 - RNA, 21 nt, Human
cccagaaguuccauggggggc

SEQ ID NO: 489517 - RNA, 22 nt, Human
guuuuaguggguggccacugau

SEQ ID NO: 489518 - RNA, 22 nt, Human
caggugggagccacagcguaca

SEQ ID NO: 489519 - RNA, 22 nt, Human
guucucugccggcaccuacccg

SEQ ID NO: 489520 - RNA, 22 nt, Human
agguggucuuguggaugccgca

SEQ ID NO: 489521 - RNA, 22 nt, Human
auguuugaaauuguaaguauau

SEQ ID NO: 489522 - RNA, 22 nt, Human
acucuguuugcagguagcucag

SEQ ID NO: 489523 - RNA, 20 nt, Human
cuuguuaaauaugcagguag

SEQ ID NO: 489524 - RNA, 22 nt, Human
uaaaucccuacaucuguguuuu

SEQ ID NO: 489525 - RNA, 16 nt, Human
ugcggcaacuugcggc

SEQ ID NO: 489526 - RNA, 22 nt, Human
gguuguaguuggagguuguaua

SEQ ID NO: 489527 - RNA, 22 nt, Human
gcggggggcaggcaguacguug

SEQ ID NO: 489528 - RNA, 22 nt, Human
agacacuguguacagaaaaaga

SEQ ID NO: 489529 - RNA, 22 nt, Human
uugauggacagggaccacuguc

SEQ ID NO: 489530 - RNA, 22 nt, Human
caagagcuggguggcaagcuag

SEQ ID NO: 489531 - RNA, 22 nt, Human
uagcugucagcaaucaaguggu

SEQ ID NO: 489532 - RNA, 23 nt, Human
agcaacagugggugaguguugcu

SEQ ID NO: 489533 - RNA, 22 nt, Human
gugcauauguguguauacaaac

SEQ ID NO: 489534 - RNA, 22 nt, Human
uuguugcaagccuggaaucugg

SEQ ID NO: 489535 - RNA, 22 nt, Human
guuguuuuugaacggugguggc

SEQ ID NO: 489536 - RNA, 21 nt, Human
aucuuaaaaggucuuaacuuu

SEQ ID NO: 489537 - RNA, 22 nt, Human
uuguauuaaaauguguuucugu

SEQ ID NO: 489538 - RNA, 19 nt, Human
cagcaaacacuguaaaugg

SEQ ID NO: 489539 - RNA, 22 nt, Human
aguuuccacuggagacacugug

SEQ ID NO: 489540 - RNA, 22 nt, Human
cuggagucggcgccccaacaga

SEQ ID NO: 489541 - RNA, 22 nt, Human
gugcuggggagauaggaagaga

SEQ ID NO: 489542 - RNA, 22 nt, Human
uauuuggauagacagggagaug

SEQ ID NO: 489543 - RNA, 22 nt, Human
gaauaauugugaugcuugaagu

SEQ ID NO: 489544 - RNA, 22 nt, Human
gucuuuuuuacaccuuacauca

SEQ ID NO: 489545 - RNA, 22 nt, Human
uacaggcucuugucagacguau

SEQ ID NO: 489546 - RNA, 22 nt, Human
agggcagagauuaauuaagaca

SEQ ID NO: 489547 - RNA, 22 nt, Human
caaauguuugguggcauuuugu

SEQ ID NO: 489548 - RNA, 22 nt, Human
uuuuaauccucuugguaucuua

SEQ ID NO: 489549 - RNA, 22 nt, Human
ggagcugcucagagccaguccc

SEQ ID NO: 489550 - RNA, 23 nt, Human
uggugggcccugcuugcucacug

SEQ ID NO: 489551 - RNA, 22 nt, Human
agaaucugcauuuuaacaagau

SEQ ID NO: 489552 - RNA, 23 nt, Human
uuguucuuggaucuuccugaagc

SEQ ID NO: 489553 - RNA, 22 nt, Human
aggcuuuugcucuggcuccucu

SEQ ID NO: 489554 - RNA, 20 nt, Human
ucauccaggacaggaguggc

SEQ ID NO: 489555 - RNA, 22 nt, Human
aaugauguuuuuaaagaacaua

SEQ ID NO: 489556 - RNA, 22 nt, Human
auggcuucugucuuggaaauuu

SEQ ID NO: 489557 - RNA, 22 nt, Human
auagcaaaggacaauagucagu

SEQ ID NO: 489558 - RNA, 22 nt, Human
uguucuuagguauuugacaguc

SEQ ID NO: 489559 - RNA, 22 nt, Human
ugcauaaauauuguugggagua

SEQ ID NO: 489560 - RNA, 22 nt, Human
uacagcgaaaauuuagcuugau

SEQ ID NO: 489561 - RNA, 17 nt, Human
ucuccuggcucuaucag

SEQ ID NO: 489562 - RNA, 21 nt, Human
uaggugggagccccaguaugc

SEQ ID NO: 489563 - RNA, 22 nt, Human
augccaucaaugacagaguuag

SEQ ID NO: 489564 - RNA, 22 nt, Human
augaaacucuagcuuucagcac

SEQ ID NO: 489565 - RNA, 22 nt, Human
aucacaguuuuaccauuuggua

SEQ ID NO: 489566 - RNA, 22 nt, Human
cccguguggaugcgcuggugcu

SEQ ID NO: 489567 - RNA, 22 nt, Human
cauggccagauucuuucuucuc

SEQ ID NO: 489568 - RNA, 22 nt, Human
uaaaaucaugacagauugacau

SEQ ID NO: 489569 - RNA, 22 nt, Human
auauacacuguuucaguugaag

SEQ ID NO: 489570 - RNA, 22 nt, Human
ugguccugagcaccagccugac

SEQ ID NO: 489571 - RNA, 22 nt, Human
uacauggauguuauccuuacug

SEQ ID NO: 489572 - RNA, 22 nt, Human
aaaagagccacuuaugaccuca

SEQ ID NO: 489573 - RNA, 22 nt, Human
gggagagcgcgcuagggccgag

SEQ ID NO: 489574 - RNA, 22 nt, Human
gccggggcuggggagagacaug

SEQ ID NO: 489575 - RNA, 16 nt, Human
ggcagcagcuccgugc

SEQ ID NO: 489576 - RNA, 22 nt, Human
gagguccacugaggcaacaggg

SEQ ID NO: 489577 - RNA, 23 nt, Human
gggaaaucaaaagauauuucuuc

SEQ ID NO: 489578 - RNA, 20 nt, Human
ggucacuguggcugcaggau

SEQ ID NO: 489579 - RNA, 22 nt, Human
auuguugacuugauuacucaac

SEQ ID NO: 489580 - RNA, 22 nt, Human
uuuccaaagguggcaggaacaa

SEQ ID NO: 489581 - RNA, 22 nt, Human
acaggacagucuaguaacagua

SEQ ID NO: 489582 - RNA, 22 nt, Human
uuuguguuggaagaaaugcuac

SEQ ID NO: 489583 - RNA, 22 nt, Human
uguaauguuagaaacaauugcu

SEQ ID NO: 489584 - RNA, 22 nt, Human
uaaaccuuauuugaauaccaac

SEQ ID NO: 489585 - RNA, 22 nt, Human
cuguuuauucucaucuaaaaug

SEQ ID NO: 489586 - RNA, 22 nt, Human
cagcacauggauggaguuagga

SEQ ID NO: 489587 - RNA, 22 nt, Human
aguacuuuuuguucaauugugc

SEQ ID NO: 489588 - RNA, 22 nt, Human
ggggucccugcaccagcauguc

SEQ ID NO: 489589 - RNA, 22 nt, Human
gcucaugggcccagagcagccc

SEQ ID NO: 489590 - RNA, 22 nt, Human
acucuguaauucugaagcaccu

SEQ ID NO: 489591 - RNA, 22 nt, Human
gcugccaccguggagaugagug

SEQ ID NO: 489592 - RNA, 22 nt, Human
agacagcgaggacagaggggug

SEQ ID NO: 489593 - RNA, 22 nt, Human
ugcuaauaaacuccaggcugag

SEQ ID NO: 489594 - RNA, 23 nt, Human
auaauaacgucugucuugucucu

SEQ ID NO: 489595 - RNA, 22 nt, Human
ggugugucugccaggaacugca

SEQ ID NO: 489596 - RNA, 22 nt, Human
ggcuggacuugguccuguuuug

SEQ ID NO: 489597 - RNA, 22 nt, Human
acagcuggaggucugugagcac

SEQ ID NO: 489598 - RNA, 22 nt, Human
aagauuuaccacuuuauucaag

SEQ ID NO: 489599 - RNA, 22 nt, Human
aucauccauggcugaucauaaa

SEQ ID NO: 489600 - RNA, 22 nt, Human
augugggccgugcggguguccu

SEQ ID NO: 489601 - RNA, 22 nt, Human
uggcauuuuguagcuguguauc

SEQ ID NO: 489602 - RNA, 22 nt, Human
gagacagagagguacucaacau

SEQ ID NO: 489603 - RNA, 22 nt, Human
aaaugcaugugcuauagaugug

SEQ ID NO: 489604 - RNA, 22 nt, Human
guucaguuauuucugaagauau

SEQ ID NO: 489605 - RNA, 19 nt, Human
ccgucauggagaguggggu

SEQ ID NO: 489606 - RNA, 22 nt, Human
gacauacagcccucucccuggu

SEQ ID NO: 489607 - RNA, 22 nt, Human
ccuguacuuguauuaaaggucc

SEQ ID NO: 489608 - RNA, 22 nt, Human
acagagccuccaggagugcugg

SEQ ID NO: 489609 - RNA, 21 nt, Human
ugcauauauaagugcauacac

SEQ ID NO: 489610 - RNA, 22 nt, Human
agcagugugggcugcacgcugg

SEQ ID NO: 489611 - RNA, 22 nt, Human
guugugcaaacacuggggucug

SEQ ID NO: 489612 - RNA, 22 nt, Human
guguuuggucagacguccgggg

SEQ ID NO: 489613 - RNA, 22 nt, Human
gaauguuauugaacuacgagcu

SEQ ID NO: 489614 - RNA, 22 nt, Human
agauguuuauaacucaugagug

SEQ ID NO: 489615 - RNA, 22 nt, Human
cacuguuuuacauguuauuuaa

SEQ ID NO: 489616 - RNA, 22 nt, Human
uuaccuuguaaaacauauuccu

SEQ ID NO: 489617 - RNA, 22 nt, Human
ugcacagagggaggcauaaaau

SEQ ID NO: 489618 - RNA, 22 nt, Human
gcaggaguguggugggacaucc

SEQ ID NO: 489619 - RNA, 22 nt, Human
gcagcccaggaggcgggagccc

SEQ ID NO: 489620 - RNA, 22 nt, Human
guguacacuugaacugacgguu

SEQ ID NO: 489621 - RNA, 22 nt, Human
uaaggcuuuggucaccauggag

SEQ ID NO: 489622 - RNA, 22 nt, Human
uacugaaagagugguggacucu

SEQ ID NO: 489623 - RNA, 22 nt, Human
aauggcagagacuguugaaaua

SEQ ID NO: 489624 - RNA, 22 nt, Human
ugggcaaaugcuuuuuagucaa

SEQ ID NO: 489625 - RNA, 18 nt, Human
ggguccccagcugcaggg

SEQ ID NO: 489626 - RNA, 22 nt, Human
auaacugagugagcagcgacuc

SEQ ID NO: 489627 - RNA, 22 nt, Human
uuauuuaaaauguagguuggga

SEQ ID NO: 489628 - RNA, 22 nt, Human
agauguuuuuccaggucuaauu

SEQ ID NO: 489629 - RNA, 22 nt, Human
ugcugcgggacccacugugggc

SEQ ID NO: 489630 - RNA, 22 nt, Human
cuccgcuuguguauaccuccaa

SEQ ID NO: 489631 - RNA, 22 nt, Human
cgccccagccaguugagcggcg

SEQ ID NO: 489632 - RNA, 22 nt, Human
ucccagaacccugccagguccu

SEQ ID NO: 489633 - RNA, 22 nt, Human
uuccauacgacugaggucucgg

SEQ ID NO: 489634 - RNA, 22 nt, Human
gugcaugucuuuggaggccucc

SEQ ID NO: 489635 - RNA, 22 nt, Human
ugacauuugagagagauauaca

SEQ ID NO: 489636 - RNA, 22 nt, Human
uggaaaauauuuaggugaauga

SEQ ID NO: 489637 - RNA, 22 nt, Human
cauuuacauuuaagguuaauau

SEQ ID NO: 489638 - RNA, 22 nt, Human
aaaacuuucagggauacagaaa

SEQ ID NO: 489639 - RNA, 22 nt, Human
ucacaauacucacucaauggcu

SEQ ID NO: 489640 - RNA, 22 nt, Human
uguaccacucuacuaaggguuc

SEQ ID NO: 489641 - RNA, 22 nt, Human
ggcucacgcaauuaucccggcc

SEQ ID NO: 489642 - RNA, 22 nt, Human
ucuccaggcuuaaucucagcuu

SEQ ID NO: 489643 - RNA, 22 nt, Human
gugacagaaacagggcuagaau

SEQ ID NO: 489644 - RNA, 22 nt, Human
uucugauuguuggaggaugcuu

SEQ ID NO: 489645 - RNA, 22 nt, Human
gcugucugcugggucgcucagg

SEQ ID NO: 489646 - RNA, 20 nt, Human
cgggacacucaagcucuggg

SEQ ID NO: 489647 - RNA, 22 nt, Human
ucagacaccgucuauuuugccu

SEQ ID NO: 489648 - RNA, 22 nt, Human
aaaccggguccagaucuucagg

SEQ ID NO: 489649 - RNA, 22 nt, Human
guugcaaaugggaagaugguua

SEQ ID NO: 489650 - RNA, 22 nt, Human
aaugaaacuaguagaaucuuug

SEQ ID NO: 489651 - RNA, 22 nt, Human
ugugaagaucaggguccuagag

SEQ ID NO: 489652 - RNA, 22 nt, Human
ggacauggaaguauggagugga

SEQ ID NO: 489653 - RNA, 22 nt, Human
agcuggguguagggcuggacaa

SEQ ID NO: 489654 - RNA, 22 nt, Human
auuuugacauugcggcauugcu

SEQ ID NO: 489655 - RNA, 22 nt, Human
aguaaaaucaccaucucuuugu

SEQ ID NO: 489656 - RNA, 22 nt, Human
ucacccuucccagcuguccgcc

SEQ ID NO: 489657 - RNA, 22 nt, Human
auacaccaccuuggaucuuuca

SEQ ID NO: 489658 - RNA, 22 nt, Human
uucucugaguacguuucagugu

SEQ ID NO: 489659 - RNA, 22 nt, Human
uaucuguauucugacagucacu

SEQ ID NO: 489660 - RNA, 22 nt, Human
aggcauuuaaagauguaagacu

SEQ ID NO: 489661 - RNA, 22 nt, Human
uaacacauagauauuuuaacuu

SEQ ID NO: 489662 - RNA, 22 nt, Human
uuuugguaauuaaguagauauu

SEQ ID NO: 489663 - RNA, 22 nt, Human
uuccggaauggcaggguagcuc

SEQ ID NO: 489664 - RNA, 18 nt, Human
ucagggaaucuuggccuu

SEQ ID NO: 489665 - RNA, 22 nt, Human
auuggagccccagaagcaaggu

SEQ ID NO: 489666 - RNA, 22 nt, Human
gcagccuccgcacugcgagucc

SEQ ID NO: 489667 - RNA, 22 nt, Human
cuguauaugugcauacacacac

SEQ ID NO: 489668 - RNA, 23 nt, Human
uuaagacuggcugaacuuaguag

SEQ ID NO: 489669 - RNA, 22 nt, Human
uuguugcugcucaaccucuaua

SEQ ID NO: 489670 - RNA, 22 nt, Human
gggcuuuaggggccagugacca

SEQ ID NO: 489671 - RNA, 17 nt, Human
gcuccagaauucuaguc

SEQ ID NO: 489672 - RNA, 22 nt, Human
uucacagaauugucuugacugg

SEQ ID NO: 489673 - RNA, 22 nt, Human
gguguuguacauucuguggauu

SEQ ID NO: 489674 - RNA, 22 nt, Human
cagaggccuggcuuggacaccu

SEQ ID NO: 489675 - RNA, 22 nt, Human
gcaguggccacauggaggagga

SEQ ID NO: 489676 - RNA, 22 nt, Human
agaccagugaguaggccuuaga

SEQ ID NO: 489677 - RNA, 22 nt, Human
cuggcuuuuuucccauuaugca

SEQ ID NO: 489678 - RNA, 22 nt, Human
uuguccuuaccucaaucuggaa

SEQ ID NO: 489679 - RNA, 22 nt, Human
aaugcugugauuuauuaaguau

SEQ ID NO: 489680 - RNA, 22 nt, Human
aucucccaaauuagccucuuga

SEQ ID NO: 489681 - RNA, 22 nt, Human
agcuggguacacguugucacaa

SEQ ID NO: 489682 - RNA, 22 nt, Human
cauuaacacuuuggauuuagac

SEQ ID NO: 489683 - RNA, 22 nt, Human
acauagcuuaaaugagaagaua

SEQ ID NO: 489684 - RNA, 22 nt, Human
ccgggagguggagauugcggug

SEQ ID NO: 489685 - RNA, 22 nt, Human
cuggagcucuccagagccccgu

SEQ ID NO: 489686 - RNA, 20 nt, Human
acagaugaggaugcggaggc

SEQ ID NO: 489687 - RNA, 22 nt, Human
gccuggcaaggcccuguugacu

SEQ ID NO: 489688 - RNA, 22 nt, Human
aaagugcugggauuacaggugu

SEQ ID NO: 489689 - RNA, 22 nt, Human
accaguuaaagaauaugaggcc

SEQ ID NO: 489690 - RNA, 22 nt, Human
auuaauaucccccgccguucug

SEQ ID NO: 489691 - RNA, 22 nt, Human
gauguauagcuuuaacugaccc

SEQ ID NO: 489692 - RNA, 22 nt, Human
ccagagacaaggagcuggaguc

SEQ ID NO: 489693 - RNA, 22 nt, Human
ugcaucauuaagguacaguugg

SEQ ID NO: 489694 - RNA, 22 nt, Human
aaacacaucauucaugucguca

SEQ ID NO: 489695 - RNA, 21 nt, Human
ugucagcaacaauacuuucuc

SEQ ID NO: 489696 - RNA, 22 nt, Human
ggagacucaccccgcauucuag

SEQ ID NO: 489697 - RNA, 22 nt, Human
uauagcagcaugauuuauaguc

SEQ ID NO: 489698 - RNA, 22 nt, Human
aauacagauggcaugugaagau

SEQ ID NO: 489699 - RNA, 22 nt, Human
agugacauuauuuuguguacua

SEQ ID NO: 489700 - RNA, 22 nt, Human
agauuucaauggauauugcaag

SEQ ID NO: 489701 - RNA, 22 nt, Human
auauuuguuuggcagaguucag

SEQ ID NO: 489702 - RNA, 22 nt, Human
ugcuggaguggcacuguguggc

SEQ ID NO: 489703 - RNA, 22 nt, Human
caaacauuuguuggaaccccug

SEQ ID NO: 489704 - RNA, 17 nt, Human
cagucacaggucuuuuc

SEQ ID NO: 489705 - RNA, 22 nt, Human
uuuguucaccuagcaaacuuuu

SEQ ID NO: 489706 - RNA, 19 nt, Human
cauaauacaguggaucuga

SEQ ID NO: 489707 - RNA, 22 nt, Human
aagcccgguugggaacguggug

SEQ ID NO: 489708 - RNA, 23 nt, Human
uguacacuuggucaagguacuua

SEQ ID NO: 489709 - RNA, 22 nt, Human
agcugggugcccgaagccacgu

SEQ ID NO: 489710 - RNA, 23 nt, Human
uccaguuaaugguucccagucug

SEQ ID NO: 489711 - RNA, 22 nt, Human
ugacaggcuugcuaagacauag

SEQ ID NO: 489712 - RNA, 22 nt, Human
uaaaugcaguacaaauuguucu

SEQ ID NO: 489713 - RNA, 22 nt, Human
aaauucuguccugaaugccauu

SEQ ID NO: 489714 - RNA, 22 nt, Human
ucugguuucccaguuccuccgu

SEQ ID NO: 489715 - RNA, 22 nt, Human
uuggaaauguagaaaagcagau

SEQ ID NO: 489716 - RNA, 22 nt, Human
ccuucuagcaaaucaacauaaa

SEQ ID NO: 489717 - RNA, 22 nt, Human
augaaaacagccuccugugaua

SEQ ID NO: 489718 - RNA, 22 nt, Human
agacccuugcagucugguuguc

SEQ ID NO: 489719 - RNA, 18 nt, Human
gccagcccuccaaccucc

SEQ ID NO: 489720 - RNA, 22 nt, Human
aggcaguguggagggcuguugc

SEQ ID NO: 489721 - RNA, 22 nt, Human
auugaacauuguucuaggaggc

SEQ ID NO: 489722 - RNA, 22 nt, Human
ugugugcucgauggcccugcag

SEQ ID NO: 489723 - RNA, 22 nt, Human
uuugaagauaaauauggagaaa

SEQ ID NO: 489724 - RNA, 22 nt, Human
ugacuuuggacuagugauuuaa

SEQ ID NO: 489725 - RNA, 22 nt, Human
uguaucauauggggaagcuuca

SEQ ID NO: 489726 - RNA, 22 nt, Human
uugggauacaucuugcugagcc

SEQ ID NO: 489727 - RNA, 22 nt, Human
ccagugugcauuaucauguguc

SEQ ID NO: 489728 - RNA, 22 nt, Human
cgggagccucugggucacacug

SEQ ID NO: 489729 - RNA, 22 nt, Human
ugaaaacacuuuaguuuagguc

SEQ ID NO: 489730 - RNA, 22 nt, Human
gagguggcugcuugcugggaaa

SEQ ID NO: 489731 - RNA, 22 nt, Human
uaagaaacauuuuuaugacagu

SEQ ID NO: 489732 - RNA, 22 nt, Human
gccccuucguggaagugcauuc

SEQ ID NO: 489733 - RNA, 22 nt, Human
auguccaggaagucuuaacuca

SEQ ID NO: 489734 - RNA, 22 nt, Human
aguucaauuguuuuguaaaagu

SEQ ID NO: 489735 - RNA, 22 nt, Human
cucugcaggcacccaggguggg

SEQ ID NO: 489736 - RNA, 22 nt, Human
uuucgggaaaaacugguaagac

SEQ ID NO: 489737 - RNA, 22 nt, Human
cuccagauuccguuuauucagg

SEQ ID NO: 489738 - RNA, 22 nt, Human
ugauaguaucugauuauuucac

SEQ ID NO: 489739 - RNA, 22 nt, Human
aggcuuucgaugaacgcuugcu

SEQ ID NO: 489740 - RNA, 22 nt, Human
uuacaguuaaugugacuaacca

SEQ ID NO: 489741 - RNA, 22 nt, Human
ggugauuuccuuuugcaaaguc

SEQ ID NO: 489742 - RNA, 22 nt, Human
gucccaggggagcucucugauu

SEQ ID NO: 489743 - RNA, 22 nt, Human
acagccaggaauucuggagaag

SEQ ID NO: 489744 - RNA, 22 nt, Human
agugaaaaccuaaucaugcagu

SEQ ID NO: 489745 - RNA, 22 nt, Human
cgcccacgaaguagguggcauu

SEQ ID NO: 489746 - RNA, 22 nt, Human
cagacguuggaggaaauauacc

SEQ ID NO: 489747 - RNA, 22 nt, Human
uaaagcauguuucaguaagguu

SEQ ID NO: 489748 - RNA, 22 nt, Human
gcugcuuugucuguaaaaugga

SEQ ID NO: 489749 - RNA, 22 nt, Human
ucucuguaagcugccuucucgu

SEQ ID NO: 489750 - RNA, 22 nt, Human
cgccaguggcagcuggaacagg

SEQ ID NO: 489751 - RNA, 22 nt, Human
ugguaaaugucuaacaaucacu

SEQ ID NO: 489752 - RNA, 22 nt, Human
gcagcagugugggcugaaccua

SEQ ID NO: 489753 - RNA, 17 nt, Human
uuuguucguuaguccgg

SEQ ID NO: 489754 - RNA, 22 nt, Human
cugggauccacgggcucccaag

SEQ ID NO: 489755 - RNA, 22 nt, Human
uuuggaaaugagaagccaccuu

SEQ ID NO: 489756 - RNA, 20 nt, Human
ucaggguuucccauucuugg

SEQ ID NO: 489757 - RNA, 22 nt, Human
uuuaaacuaacaguacacguug

SEQ ID NO: 489758 - RNA, 22 nt, Human
gauccacagcugcgguaggaga

SEQ ID NO: 489759 - RNA, 22 nt, Human
cccgaccucgcaaagcgcacuc

SEQ ID NO: 489760 - RNA, 22 nt, Human
aagcaaaagguuacacuucugg

SEQ ID NO: 489761 - RNA, 22 nt, Human
uguauauacacacucccauguu

SEQ ID NO: 489762 - RNA, 22 nt, Human
agaugguucagaauuauaaaga

SEQ ID NO: 489763 - RNA, 22 nt, Human
gcuggguggaucggaggcucug

SEQ ID NO: 489764 - RNA, 22 nt, Human
gaugauuacacuuuuaaaacag

SEQ ID NO: 489765 - RNA, 23 nt, Human
ugcaaaauuugcagaguucgaug

SEQ ID NO: 489766 - RNA, 22 nt, Human
guuuccaagucucucaacaccc

SEQ ID NO: 489767 - RNA, 22 nt, Human
cagacagagucuucccaucagu

SEQ ID NO: 489768 - RNA, 22 nt, Human
caggguggaacaggcaauacuu

SEQ ID NO: 489769 - RNA, 22 nt, Human
acauuuaaugauccuacuguga

SEQ ID NO: 489770 - RNA, 22 nt, Human
gcgagaaacuaagugcccuuug

SEQ ID NO: 489771 - RNA, 22 nt, Human
aauugguuugaauaaauaaaga

SEQ ID NO: 489772 - RNA, 22 nt, Human
agcugaaacuucccauuaauug

SEQ ID NO: 489773 - RNA, 22 nt, Human
uaaguauuggccuauagcuaga

SEQ ID NO: 489774 - RNA, 22 nt, Human
cccuucagcugagugggacagc

SEQ ID NO: 489775 - RNA, 18 nt, Human
ucaugcaaacgcuucaua

SEQ ID NO: 489776 - RNA, 22 nt, Human
gggggcuggacuuucccacaca

SEQ ID NO: 489777 - RNA, 21 nt, Human
caagacauaugaguacucugg

SEQ ID NO: 489778 - RNA, 17 nt, Human
acuuguauugugcuuua

SEQ ID NO: 489779 - RNA, 20 nt, Human
uguauuuaaugaaggcuuuu

SEQ ID NO: 489780 - RNA, 22 nt, Human
cagcgguggcaaggugacugug

SEQ ID NO: 489781 - RNA, 22 nt, Human
gcagacaucaagcacaggccca

SEQ ID NO: 489782 - RNA, 22 nt, Human
ggcacugggugagggucacugg

SEQ ID NO: 489783 - RNA, 22 nt, Human
uccguuuucacacugcuauaaa

SEQ ID NO: 489784 - RNA, 22 nt, Human
ucauuuacacuucacaaaugga

SEQ ID NO: 489785 - RNA, 22 nt, Human
aaauacaguggcagcagauaau

SEQ ID NO: 489786 - RNA, 22 nt, Human
agagcagaggcauggccguggg

SEQ ID NO: 489787 - RNA, 22 nt, Human
aggggcuuguggaguugcuggu

SEQ ID NO: 489788 - RNA, 22 nt, Human
aagcugccugggaggaagggcu

SEQ ID NO: 489789 - RNA, 22 nt, Human
guuaacaacacugugagugcug

SEQ ID NO: 489790 - RNA, 22 nt, Human
acagacacaggcguggagucgc

SEQ ID NO: 489791 - RNA, 22 nt, Human
gaagcccuggggucagugucgu

SEQ ID NO: 489792 - RNA, 22 nt, Human
ugagucaccucucagaagccac

SEQ ID NO: 489793 - RNA, 21 nt, Human
uuuguucaggggcaaaguuaa

SEQ ID NO: 489794 - RNA, 19 nt, Human
uuugauagggcauaauaua

SEQ ID NO: 489795 - RNA, 20 nt, Human
uacaauauucccacuuugcu

SEQ ID NO: 489796 - RNA, 22 nt, Human
augcaguuagguaauagucuca

SEQ ID NO: 489797 - RNA, 22 nt, Human
cuuccugcaacaccuguguugc

SEQ ID NO: 489798 - RNA, 22 nt, Human
ugagaauacugcauuguuagga

SEQ ID NO: 489799 - RNA, 20 nt, Human
aucggcuugccuggaaacaa

SEQ ID NO: 489800 - RNA, 22 nt, Human
gagggcucaacuacuacuaggc

SEQ ID NO: 489801 - RNA, 22 nt, Human
aggugggacccguggggugcga

SEQ ID NO: 489802 - RNA, 22 nt, Human
aucuaugugggaaucauaauag

SEQ ID NO: 489803 - RNA, 22 nt, Human
ugcuuuggcccaacauugaugc

SEQ ID NO: 489804 - RNA, 22 nt, Human
auauaugaagaagucuugauua

SEQ ID NO: 489805 - RNA, 22 nt, Human herpesvirus 3
acucccauuggcaugauaaacg

SEQ ID NO: 489806 - RNA, 15 nt, Human herpesvirus 3
agagcccacacaauc

SEQ ID NO: 489807 - RNA, 21 nt, Human herpesvirus 3
aaaagcagaugaugugccgau

SEQ ID NO: 489808 - RNA, 22 nt, Human herpesvirus 3
ggauacuuggcucuguauuaaa

SEQ ID NO: 489809 - RNA, 22 nt, Human herpesvirus 3
uauugcagacauuuguuucgau

SEQ ID NO: 489810 - RNA, 22 nt, Human herpesvirus 3
ucaggcgggcguaggcuagcga

SEQ ID NO: 489811 - RNA, 22 nt, Human herpesvirus 3
uggaacaauuccaucagagucu

SEQ ID NO: 489812 - RNA, 22 nt, Human herpesvirus 3
guccagccguguuacugguaau

SEQ ID NO: 489813 - RNA, 22 nt, Human herpesvirus 3
cuguuuucccuuggcucuugug

SEQ ID NO: 489814 - RNA, 22 nt, Human herpesvirus 3
aucgggguucuggaucgcggca

SEQ ID NO: 489815 - RNA, 22 nt, Human herpesvirus 3
cgccugugaaauaacggucgcg

SEQ ID NO: 489816 - RNA, 22 nt, Human herpesvirus 3
ugucucuggcgccccgguuccc

SEQ ID NO: 489817 - RNA, 22 nt, Human herpesvirus 3
uucuaggauucgaacgacgaca

SEQ ID NO: 489818 - RNA, 22 nt, Human herpesvirus 3
uuuggagacggcgguaaaggcu

SEQ ID NO: 489819 - RNA, 22 nt, Human herpesvirus 3
gcaucauguuuccuugggcggg

SEQ ID NO: 489820 - RNA, 22 nt, Human herpesvirus 3
ccgaggcugguuagagagcgcu

SEQ ID NO: 489821 - RNA, 22 nt, Human herpesvirus 3
cuaauuuaauagggcuaugucc

SEQ ID NO: 489822 - RNA, 22 nt, Human herpesvirus 3
cauauacuguguuuuuauccau

SEQ ID NO: 489823 - RNA, 22 nt, Human herpesvirus 3
ccaaguccccguucauauugca

SEQ ID NO: 489824 - RNA, 22 nt, Human herpesvirus 3
gguugugucggucucuccaagc

SEQ ID NO: 489825 - RNA, 22 nt, Human herpesvirus 3
gaguguuuuuucuagcucuugg

SEQ ID NO: 489826 - RNA, 22 nt, Human herpesvirus 3
gauuuucuuccacugacaccuc

SEQ ID NO: 489827 - RNA, 22 nt, Human herpesvirus 3
gggguuuuggauuaagaucucc

SEQ ID NO: 489828 - RNA, 22 nt, Human herpesvirus 3
uuugcuuggguuucuauguccg

SEQ ID NO: 489829 - RNA, 22 nt, Human herpesvirus 3
uggguuaacgcucuuaacacgg

SEQ ID NO: 489830 - RNA, 22 nt, Human herpesvirus 3
ugcuucuugaaaaaggccacac

SEQ ID NO: 489831 - RNA, 22 nt, Human herpesvirus 3
ugggaggggugccgauccgggc

SEQ ID NO: 489832 - RNA, 22 nt, Human herpesvirus 3
ggauccacgcgggugcacgucu

SEQ ID NO: 489833 - RNA, 22 nt, Human herpesvirus 3
ggagccacacaauauucgcgaa

SEQ ID NO: 489834 - RNA, 22 nt, Human herpesvirus 3
gcugggcuaaauguggcgaggu

SEQ ID NO: 489835 - RNA, 22 nt, Human herpesvirus 3
uccgaaccguuccaugcgucuu

SEQ ID NO: 489836 - RNA, 22 nt, Human herpesvirus 3
uccccggacgguccaaaccgca

SEQ ID NO: 489837 - RNA, 22 nt, Human herpesvirus 3
gaguguuuuuucuagcucuugg

SEQ ID NO: 489838 - RNA, 22 nt, Human herpesvirus 3
cgcguauguaaaucggugaaga

SEQ ID NO: 489839 - RNA, 22 nt, Human herpesvirus 3
cggcuauuggguaucacuguca

SEQ ID NO: 489840 - RNA, 22 nt, Human herpesvirus 3
uggaacaauuccaucagagucu

SEQ ID NO: 489841 - RNA, 22 nt, Human herpesvirus 3
acgaaacguguuuuuagcuaag

SEQ ID NO: 489842 - RNA, 22 nt, Human herpesvirus 3
uacgauucagacguuuuuucuc

SEQ ID NO: 489843 - RNA, 22 nt, Human herpesvirus 3
guguuguuguuuccaaacggaa

SEQ ID NO: 489844 - RNA, 19 nt, Human herpesvirus 3
guguuuacgugcgauggua

SEQ ID NO: 489845 - RNA, 22 nt, Human herpesvirus 3
uacaccuucucguuggcgucgc

SEQ ID NO: 489846 - RNA, 22 nt, Human herpesvirus 3
gucugacgugguaagugcggcu

SEQ ID NO: 489847 - RNA, 22 nt, Human herpesvirus 3
uuuaucaugccaaugggagugu

SEQ ID NO: 489848 - RNA, 22 nt, Human herpesvirus 3
uuagaccguuuguuaaccggag

SEQ ID NO: 489849 - RNA, 22 nt, Human herpesvirus 3
uugaagacagggauacggaggg

SEQ ID NO: 489850 - RNA, 22 nt, Human herpesvirus 3
uucuaggauucgaacgacgaca

SEQ ID NO: 489851 - RNA, 18 nt, Human herpesvirus 3
uuggacuuccguucucgg

SEQ ID NO: 489852 - RNA, 22 nt, Human herpesvirus 3
aucgggguucuggaucgcggca

SEQ ID NO: 489853 - RNA, 22 nt, Human herpesvirus 3
ccgguacuccgggucgagggug

SEQ ID NO: 489854 - RNA, 22 nt, Human herpesvirus 3
ccgaggcugguuagagagcgcu

SEQ ID NO: 489855 - RNA, 20 nt, Human herpesvirus 3
aguugcauguuaacgucgac

SEQ ID NO: 489856 - RNA, 22 nt, Human herpesvirus 3
ucguggggggcgguaugaucaa

SEQ ID NO: 489857 - RNA, 22 nt, Human herpesvirus 3
ucguaauucgaaugcagguggu

SEQ ID NO: 489858 - RNA, 22 nt, Human herpesvirus 3
ucggcgcgcugcugaugugguu

SEQ ID NO: 489859 - RNA, 22 nt, Human herpesvirus 3
gguugugucggucucuccaagc

SEQ ID NO: 489860 - RNA, 22 nt, Human herpesvirus 3
ggauacuuggcucuguauuaaa

SEQ ID NO: 489861 - RNA, 22 nt, Human herpesvirus 3
aaacguuaccgcaaaucaaucu

SEQ ID NO: 489862 - RNA, 21 nt, Human herpesvirus 3
aaaagcagaugaugugccgau

SEQ ID NO: 489863 - RNA, 22 nt, Human herpesvirus 3
aagcguuuaauuguuaugccgu

SEQ ID NO: 489864 - RNA, 19 nt, Human herpesvirus 3
ugggaauaauugugcaaac

SEQ ID NO: 489865 - RNA, 22 nt, Human herpesvirus 3
uguauguuggagauagagcgua

SEQ ID NO: 489866 - RNA, 22 nt, Human herpesvirus 3
uguauugauaccacggcggcua

SEQ ID NO: 489867 - RNA, 22 nt, Human herpesvirus 3
cagcagaugaugcuggaguccg

SEQ ID NO: 489868 - RNA, 22 nt, Human herpesvirus 3
ccaaguccccguucauauugca

SEQ ID NO: 489869 - RNA, 21 nt, Human herpesvirus 3
agacgcauggaacgguucgga

SEQ ID NO: 489870 - RNA, 22 nt, Human herpesvirus 3
agaauacguuuaaugucgucuu

SEQ ID NO: 489871 - RNA, 22 nt, Human herpesvirus 3
acucccauuggcaugauaaacg

SEQ ID NO: 489872 - RNA, 22 nt, Human herpesvirus 3
acucuuguagugugagcaaugc

SEQ ID NO: 489873 - RNA, 22 nt, Human herpesvirus 3
gccguguuacugguaauggcgg

SEQ ID NO: 489874 - RNA, 22 nt, Human herpesvirus 3
gccaagauuugcgguaaugcga

SEQ ID NO: 489875 - RNA, 22 nt, Human herpesvirus 3
gauuuucuuccacugacaccuc

SEQ ID NO: 489876 - RNA, 22 nt, Human herpesvirus 3
gcauguugcucgaagagcacau

SEQ ID NO: 489877 - RNA, 22 nt, Human herpesvirus 3
gaaccgggcgcgguaguaacag

SEQ ID NO: 489878 - RNA, 18 nt, Human herpesvirus 3
cuuauauuuuuggaagau

SEQ ID NO: 489879 - RNA, 22 nt, Human herpesvirus 3
cugaccacgagucuccgauucu

SEQ ID NO: 489880 - RNA, 22 nt, Human herpesvirus 3
cguguauaucuguccauggagu

SEQ ID NO: 489881 - RNA, 22 nt, Human herpesvirus 3
cuaauuuaauagggcuaugucc

SEQ ID NO: 489882 - RNA, 22 nt, Human
uggccuggcugcccugucugga

SEQ ID NO: 489883 - RNA, 22 nt, Human
cuguaugauuccauuucuauaa

SEQ ID NO: 489884 - RNA, 22 nt, Human
augugacaguguuugacagaug

SEQ ID NO: 489885 - RNA, 22 nt, Human
uugauguacagaauuguucaca

SEQ ID NO: 489886 - RNA, 22 nt, Human
ugagccaggcucaagugauccu

SEQ ID NO: 489887 - RNA, 22 nt, Human
aaauauagugacacuuauaguc

SEQ ID NO: 489888 - RNA, 22 nt, Human
gccguuagauaauaacaagcau

SEQ ID NO: 489889 - RNA, 22 nt, Human
uggggaaacuauuuccuugucc

SEQ ID NO: 489890 - RNA, 22 nt, Human
acugcguggggagcugugacua

SEQ ID NO: 489891 - RNA, 22 nt, Human
cugggcugcaggaguggggcaa

SEQ ID NO: 489892 - RNA, 22 nt, Human
aaugauauuuauugaauagaug

SEQ ID NO: 489893 - RNA, 23 nt, Human
ucccagccucuucucuugcauac

SEQ ID NO: 489894 - RNA, 22 nt, Human
ucugggcuauauggucucugcu

SEQ ID NO: 489895 - RNA, 21 nt, Human
uauuagcuucuggugcuguuu

SEQ ID NO: 489896 - RNA, 22 nt, Human
uucagcaccuggaauagcaccu

SEQ ID NO: 489897 - RNA, 22 nt, Human
uagcuucaugcuucaccacgcu

SEQ ID NO: 489898 - RNA, 22 nt, Human
guguacaaaaugucuccaugga

SEQ ID NO: 489899 - RNA, 22 nt, Human
guuaaauucgaugauggauaaa

SEQ ID NO: 489900 - RNA, 22 nt, Human
gcuccuggcucuggccaaggga

SEQ ID NO: 489901 - RNA, 22 nt, Human
uugcugaauugaauccuuuggu

SEQ ID NO: 489902 - RNA, 22 nt, Human
uauguacauacaugugcauacg

SEQ ID NO: 489903 - RNA, 22 nt, Human
cugauauucuuugagcugcuaa

SEQ ID NO: 489904 - RNA, 22 nt, Human
augaauugaggaaaacagucgu

SEQ ID NO: 489905 - RNA, 21 nt, Human
uguccaagguaugcacugggg

SEQ ID NO: 489906 - RNA, 22 nt, Human
cuucagcaucuuuuucuugggg

SEQ ID NO: 489907 - RNA, 22 nt, Human
cuuguuuuggaacagagugaau

SEQ ID NO: 489908 - RNA, 22 nt, Human
auuuagugaccugaacugaaac

SEQ ID NO: 489909 - RNA, 23 nt, Human
uuuagcuucccuuuaguuagggg

SEQ ID NO: 489910 - RNA, 22 nt, Human
guccugguuuucacagaccuuu

SEQ ID NO: 489911 - RNA, 22 nt, Human
cagcagcagauucagcgucugg

SEQ ID NO: 489912 - RNA, 22 nt, Human
aggacaugaagaaagggcaagg

SEQ ID NO: 489913 - RNA, 22 nt, Human
gccucuggaguugcuuguaaau

SEQ ID NO: 489914 - RNA, 22 nt, Human
agagccaguuacaacuguggag

SEQ ID NO: 489915 - RNA, 22 nt, Human
gcacuaguguucuucaguaaua

SEQ ID NO: 489916 - RNA, 22 nt, Human
aucuugugugaugaugagaaag

SEQ ID NO: 489917 - RNA, 22 nt, Human
cagcacuaggauauacauuucc

SEQ ID NO: 489918 - RNA, 22 nt, Human
gcuggcucugaugggcuccagg

SEQ ID NO: 489919 - RNA, 22 nt, Human
aggugacugguuuaucuggcag

SEQ ID NO: 489920 - RNA, 22 nt, Human
gaauuacaaagugagacaagcu

SEQ ID NO: 489921 - RNA, 22 nt, Human
gcacauguugcuaguuacuugc

SEQ ID NO: 489922 - RNA, 22 nt, Human
acugccugcuccuggcuccaca

SEQ ID NO: 489923 - RNA, 22 nt, Human
uagauauaagguccuuagaaca

SEQ ID NO: 489924 - RNA, 22 nt, Human
ugauguuuaauacuaugcuuuu

SEQ ID NO: 489925 - RNA, 22 nt, Human
auugcugacucaauaauugaag

SEQ ID NO: 489926 - RNA, 22 nt, Human
uauuucugucagccagauaugg

SEQ ID NO: 489927 - RNA, 22 nt, Human
ugcagcaccacaccuggcuaau

SEQ ID NO: 489928 - RNA, 22 nt, Human
uuguaaaugaccuuuucuaauu

SEQ ID NO: 489929 - RNA, 22 nt, Human
gcucuguggcaggaggucuugu

SEQ ID NO: 489930 - RNA, 22 nt, Human
gcacacagauuaggaaacagaa

SEQ ID NO: 489931 - RNA, 22 nt, Human
auuagcuuccuauaguaagggg

SEQ ID NO: 489932 - RNA, 22 nt, Human
ugggcaggagagaagcuaaaga

SEQ ID NO: 489933 - RNA, 22 nt, Human
acagagucugacagguaggcgc

SEQ ID NO: 489934 - RNA, 22 nt, Human
ucugggccucaccugcugcuca

SEQ ID NO: 489935 - RNA, 22 nt, Human
ucugauuagagcauucuugagu

SEQ ID NO: 489936 - RNA, 22 nt, Human
cuagucacucagcacugacaaa

SEQ ID NO: 489937 - RNA, 22 nt, Human
ccuuagcaacacuuagcaacug

SEQ ID NO: 489938 - RNA, 22 nt, Human
ccugucugaggaggugcucuuu

SEQ ID NO: 489939 - RNA, 22 nt, Human
uggcaggaaauacccugccuag

SEQ ID NO: 489940 - RNA, 22 nt, Human
uguccugggucccugcuagaag

SEQ ID NO: 489941 - RNA, 22 nt, Human
guuagcaugauuccugcucauu

SEQ ID NO: 489942 - RNA, 22 nt, Human
cuccuggaggauagugacuggg

SEQ ID NO: 489943 - RNA, 22 nt, Human
gcccuuagggccacugucacug

SEQ ID NO: 489944 - RNA, 22 nt, Human
cuauuuguacagcauuaguaau

SEQ ID NO: 489945 - RNA, 22 nt, Human
agggcuggaggguacuaguuua

SEQ ID NO: 489946 - RNA, 22 nt, Human
gcaggcaggagcccaacugccu

SEQ ID NO: 489947 - RNA, 22 nt, Human
uuguauuaauugaaaugaaugc

SEQ ID NO: 489948 - RNA, 22 nt, Human
aagacacacacauaugcugagu

SEQ ID NO: 489949 - RNA, 22 nt, Human
uauugugaguucagacuaaaaa

SEQ ID NO: 489950 - RNA, 22 nt, Human
cucugagguccuucccagcucu

SEQ ID NO: 489951 - RNA, 22 nt, Human
ugaaugaucuaguuuuguagac

SEQ ID NO: 489952 - RNA, 22 nt, Human
agagccaggugcugcuguuuga

SEQ ID NO: 489953 - RNA, 19 nt, Human
cuggccuguguccugugcu

SEQ ID NO: 489954 - RNA, 22 nt, Human
auuugugaauuaagcaugucaa

SEQ ID NO: 489955 - RNA, 19 nt, Human
ccagccucucuuccacccc

SEQ ID NO: 489956 - RNA, 22 nt, Human
cuagucacgucuuucaguuacc

SEQ ID NO: 489957 - RNA, 22 nt, Human
augaaugagugcuagguuuguc

SEQ ID NO: 489958 - RNA, 22 nt, Human
cuggcucccgucugguggccau

SEQ ID NO: 489959 - RNA, 22 nt, Human
uugcagcuucuaccacuguuuc

SEQ ID NO: 489960 - RNA, 22 nt, Human
uugugauaaaacauuagacauu

SEQ ID NO: 489961 - RNA, 22 nt, Human
cagcagcaacaauagcggucac

SEQ ID NO: 489962 - RNA, 21 nt, Human
gcuccuggugcugcguggcgc

SEQ ID NO: 489963 - RNA, 22 nt, Human
aaacacugguaugauguauagu

SEQ ID NO: 489964 - RNA, 22 nt, Human
ccagcucugcuugcccagucag

SEQ ID NO: 489965 - RNA, 19 nt, Human
uggaaacuccugauauuag

SEQ ID NO: 489966 - RNA, 22 nt, Human
gagggggcucccugaagccagu

SEQ ID NO: 489967 - RNA, 22 nt, Human
augcccugcucucgggaaggga

SEQ ID NO: 489968 - RNA, 22 nt, Human
agcagcacgaguccacaaaucc

SEQ ID NO: 489969 - RNA, 22 nt, Human
ucuuguuuugaacucaucagga

SEQ ID NO: 489970 - RNA, 18 nt, Human
guguccuggcugcggcgc

SEQ ID NO: 489971 - RNA, 22 nt, Human
agagccagaccauugccgugca

SEQ ID NO: 489972 - RNA, 22 nt, Human
cucagcaccccgacaggacauu

SEQ ID NO: 489973 - RNA, 22 nt, Human
cuagucacacaguaaggacggg

SEQ ID NO: 489974 - RNA, 22 nt, Human
acacagugguguuuacaaaauu

SEQ ID NO: 489975 - RNA, 22 nt, Human
acacauguuuguguagucaguu

SEQ ID NO: 489976 - RNA, 22 nt, Human
cucugcccacgucuugcccaga

SEQ ID NO: 489977 - RNA, 20 nt, Human
ugauauuucuggaaguggag

SEQ ID NO: 489978 - RNA, 22 nt, Human
ucaggacagccagggugcagac

SEQ ID NO: 489979 - RNA, 22 nt, Human
uauguacaucuugagcaaugaa

SEQ ID NO: 489980 - RNA, 22 nt, Human
cuucuccucugaguccugggag

SEQ ID NO: 489981 - RNA, 22 nt, Human
cugagauggucucuuuguuacu

SEQ ID NO: 489982 - RNA, 22 nt, Human
ccuuagcagggccgggccuggg

SEQ ID NO: 489983 - RNA, 22 nt, Human
guauuagcaagaguugugauuu

SEQ ID NO: 489984 - RNA, 22 nt, Human
ugucaauaguuuugaguucucu

SEQ ID NO: 489985 - RNA, 20 nt, Human
uacaggaaucaagacugcau

SEQ ID NO: 489986 - RNA, 22 nt, Human
augaaauaucuugaagaaauuc

SEQ ID NO: 489987 - RNA, 22 nt, Human
ccaaagugauaugugcuguaag

SEQ ID NO: 489988 - RNA, 22 nt, Human
auuauuagacuuauaugguagu

SEQ ID NO: 489989 - RNA, 20 nt, Human
accuggcuuccucuuggcau

SEQ ID NO: 489990 - RNA, 22 nt, Human
ccugucuguauugguuugcuau

SEQ ID NO: 489991 - RNA, 22 nt, Human
gggguuaacaguauugcucaug

SEQ ID NO: 489992 - RNA, 22 nt, Human
aagcuucaucugaugccgaacu

SEQ ID NO: 489993 - RNA, 22 nt, Human
auuagcuuauuguaaggugaaa

SEQ ID NO: 489994 - RNA, 22 nt, Human
cuuguuuuaaacuguuguggcu

SEQ ID NO: 489995 - RNA, 22 nt, Human
auuaauaaaauaccacuuuguu

SEQ ID NO: 489996 - RNA, 22 nt, Human
cuuuagaaaucuggauguauuu

SEQ ID NO: 489997 - RNA, 22 nt, Human
gcuucagcuuugucuccuuggg

SEQ ID NO: 489998 - RNA, 22 nt, Human
caggcacacauccgugagagau

SEQ ID NO: 489999 - RNA, 22 nt, Human
gcggcccgagcaggacgggugg

SEQ ID NO: 490000 - RNA, 22 nt, Human
uguguccuguccccuugcugcu

SEQ ID NO: 490001 - RNA, 22 nt, Human
uucuggcugcagucccuguaau

SEQ ID NO: 490002 - RNA, 22 nt, Human
caguaagucaacaaacaugggg

SEQ ID NO: 490003 - RNA, 22 nt, Human
ucuguacaguaccagauaguaa

SEQ ID NO: 490004 - RNA, 22 nt, Human
gccuggcuuuugccucauguuc

SEQ ID NO: 490005 - RNA, 22 nt, Human
agagccaggaaguggcgugggg

SEQ ID NO: 490006 - RNA, 22 nt, Human
uuuuauuaguggcuagaugggg

SEQ ID NO: 490007 - RNA, 22 nt, Human
uggcccugaggacccagugugg

SEQ ID NO: 490008 - RNA, 22 nt, Human
aaaugauggaaaugaggcugaa

SEQ ID NO: 490009 - RNA, 21 nt, Human
acacagaggcaucaucacuuu

SEQ ID NO: 490010 - RNA, 22 nt, Human
cugaaucauggucauuaguuua

SEQ ID NO: 490011 - RNA, 22 nt, Human
uuaauaauaaugagcccauuuu

SEQ ID NO: 490012 - RNA, 18 nt, Human
uuaauguggcuuacuaug

SEQ ID NO: 490013 - RNA, 22 nt, Human
ugcugaauugguaguacuguug

SEQ ID NO: 490014 - RNA, 22 nt, Human
gaaugaguuaauauuugcuugg

SEQ ID NO: 490015 - RNA, 22 nt, Human
uccuggcuaguuuugcugaaau

SEQ ID NO: 490016 - RNA, 22 nt, Human
uuacaaagcguugagacaagua

SEQ ID NO: 490017 - RNA, 22 nt, Human
ugcuaauguuucauuuuuagau

SEQ ID NO: 490018 - RNA, 22 nt, Human
uauuuauguggaccauaagccu

SEQ ID NO: 490019 - RNA, 22 nt, Human
acaggcacugucaagucaugaa

SEQ ID NO: 490020 - RNA, 22 nt, Human
ucauuguuucugcuuuucauga

SEQ ID NO: 490021 - RNA, 22 nt, Human
cuuguuuuuaagagauguuuac

SEQ ID NO: 490022 - RNA, 23 nt, Human
uaugugugggucuacuagaaguc

SEQ ID NO: 490023 - RNA, 22 nt, Human
cauuuguaggaugcuucuuguu

SEQ ID NO: 490024 - RNA, 22 nt, Human
uuuuagaaguucacuuggguuu

SEQ ID NO: 490025 - RNA, 22 nt, Human
cucagcacacucccaucuaauu

SEQ ID NO: 490026 - RNA, 22 nt, Human
uuaaauuccagccucauaauag

SEQ ID NO: 490027 - RNA, 22 nt, Human
ugaaugauaugugaaaaggaac

SEQ ID NO: 490028 - RNA, 22 nt, Human
uccuuagcaacacuguuauaau

SEQ ID NO: 490029 - RNA, 22 nt, Human
ugcugaaucauaugguaauucu

SEQ ID NO: 490030 - RNA, 22 nt, Human
auuacaguaacagcuacaaugc

SEQ ID NO: 490031 - RNA, 22 nt, Human
uacagaguuuuccugccaagaa

SEQ ID NO: 490032 - RNA, 17 nt, Human
cagacagauauccuggg

SEQ ID NO: 490033 - RNA, 22 nt, Human
uucagcacuggacagcgagucu

SEQ ID NO: 490034 - RNA, 22 nt, Human
gugcccugagcuuaugcauucu

SEQ ID NO: 490035 - RNA, 22 nt, Human
ucuggcuucccacucugccggg

SEQ ID NO: 490036 - RNA, 22 nt, Human
augcccuguggcaguacauauu

SEQ ID NO: 490037 - RNA, 23 nt, Human
aaauuauugcucuucaauugccu

SEQ ID NO: 490038 - RNA, 22 nt, Human
cacuaguccugguuucaugcua

SEQ ID NO: 490039 - RNA, 22 nt, Human
acaggcuuacuguuucauaggg

SEQ ID NO: 490040 - RNA, 22 nt, Human
gccugguggugugcucaagugg

SEQ ID NO: 490041 - RNA, 22 nt, Human
gugucaauaaauagcggugugg

SEQ ID NO: 490042 - RNA, 22 nt, Human
cuggccuggucuggccucucca

SEQ ID NO: 490043 - RNA, 22 nt, Human
aauuagcugucaaugaggaucu

SEQ ID NO: 490044 - RNA, 22 nt, Human
ugccaccuaguggucuuuaguc

SEQ ID NO: 490045 - RNA, 23 nt, Human
gugugccaagcacugugccagga

SEQ ID NO: 490046 - RNA, 22 nt, Human
gugaaugacuguuuucagcauu

SEQ ID NO: 490047 - RNA, 22 nt, Human
uagcuauuuggaaaauuccaau

SEQ ID NO: 490048 - RNA, 22 nt, Human
gcacaggcuccggaggagagcu

SEQ ID NO: 490049 - RNA, 22 nt, Human
uuagucacuucuuccuucauca

SEQ ID NO: 490050 - RNA, 22 nt, Human
aaacaguuucauuuucaugacc

SEQ ID NO: 490051 - RNA, 22 nt, Human
accuguuuaccugcaccuguuu

SEQ ID NO: 490052 - RNA, 22 nt, Human
guuuagaauucuaacuuuaagg

SEQ ID NO: 490053 - RNA, 22 nt, Human
auuauuuguguccacagaauac

SEQ ID NO: 490054 - RNA, 22 nt, Human
ccaggccucaccugcccaccua

SEQ ID NO: 490055 - RNA, 22 nt, Human
ggacacacaaguuaucuaauga

SEQ ID NO: 490056 - RNA, 22 nt, Human
ucacacagcuuggaguuauggu

SEQ ID NO: 490057 - RNA, 22 nt, Human
auuagcuucugugcauggacuu

SEQ ID NO: 490058 - RNA, 22 nt, Human
uugaaauggcagcagcugaccu

SEQ ID NO: 490059 - RNA, 22 nt, Human
guuuagaaugaaacuuuugagc

SEQ ID NO: 490060 - RNA, 22 nt, Human
acacacagcgccuaccaugugc

SEQ ID NO: 490061 - RNA, 22 nt, Human
gugcccugggccuucagggcca

SEQ ID NO: 490062 - RNA, 19 nt, Human
cacaacuucgcuugauucc

SEQ ID NO: 490063 - RNA, 22 nt, Human
cccuggcuuaaaaaccucauau

SEQ ID NO: 490064 - RNA, 22 nt, Human
auuagcuuuaaaccacagcagu

SEQ ID NO: 490065 - RNA, 22 nt, Human
ccugggcuccacuccaagagca

SEQ ID NO: 490066 - RNA, 22 nt, Human
accuggcugguugugauuccca

SEQ ID NO: 490067 - RNA, 22 nt, Human
uggaaacuagagaguuuguauu

SEQ ID NO: 490068 - RNA, 22 nt, Human
gccugccuuuguaugacccuga

SEQ ID NO: 490069 - RNA, 22 nt, Human
gucccuggucuaccguggcuuc

SEQ ID NO: 490070 - RNA, 22 nt, Human
ucugggccucaguuucuucauc

SEQ ID NO: 490071 - RNA, 22 nt, Human
uguguacacaaguauauauaca

SEQ ID NO: 490072 - RNA, 22 nt, Human
augguacagauaauacaugcug

SEQ ID NO: 490073 - RNA, 20 nt, Human
aauuagcuuaagucaaucag

SEQ ID NO: 490074 - RNA, 22 nt, Human
cuuuagaauuugauauaaucaa

SEQ ID NO: 490075 - RNA, 22 nt, Human
caagcagagagguuagaacaca

SEQ ID NO: 490076 - RNA, 22 nt, Human
cugggucugggccuccuggagu

SEQ ID NO: 490077 - RNA, 22 nt, Human
ucugggccgcugcguuccauga

SEQ ID NO: 490078 - RNA, 22 nt, Human
uugcugaaaguggcaagaagua

SEQ ID NO: 490079 - RNA, 23 nt, Human
acugccugugccgaucucucuca

SEQ ID NO: 490080 - RNA, 22 nt, Human
agaaaugacacacaugagacau

SEQ ID NO: 490081 - RNA, 22 nt, Human
gcugagugauugauauuuuagu

SEQ ID NO: 490082 - RNA, 22 nt, Human
uucuuacaaguauuccaggucc

SEQ ID NO: 490083 - RNA, 22 nt, Human
auugcugacuuuaauauuauau

SEQ ID NO: 490084 - RNA, 22 nt, Human
augaacaaugacuacauauuga

SEQ ID NO: 490085 - RNA, 22 nt, Human
uguugugacccagaccaagaag

SEQ ID NO: 490086 - RNA, 22 nt, Human
ggccuguccagccugccuggcu

SEQ ID NO: 490087 - RNA, 22 nt, Human
gcuggcuguguuucaucucuga

SEQ ID NO: 490088 - RNA, 22 nt, Human
ugugcugacaagaucagaaggu

SEQ ID NO: 490089 - RNA, 22 nt, Human
uucuucaaccaucuacauaaac

SEQ ID NO: 490090 - RNA, 22 nt, Human
gccucuggggcagcugagucau

SEQ ID NO: 490091 - RNA, 22 nt, Human
ucuuguuucuguauauaaugac

SEQ ID NO: 490092 - RNA, 22 nt, Human
cagagacaguuucacagggucu

SEQ ID NO: 490093 - RNA, 22 nt, Human
cagacacagauaugcauauggc

SEQ ID NO: 490094 - RNA, 19 nt, Human
uucuuacaacacccuggga

SEQ ID NO: 490095 - RNA, 22 nt, Human
uguacauacauagauauacaca

SEQ ID NO: 490096 - RNA, 22 nt, Human
acagagaugucagauuggcagc

SEQ ID NO: 490097 - RNA, 23 nt, Human
uugauuuagcugggauugcaugc

SEQ ID NO: 490098 - RNA, 22 nt, Human
ggcccugagcugaaguacugug

SEQ ID NO: 490099 - RNA, 22 nt, Human
auuuugauaaucauguuagaga

SEQ ID NO: 490100 - RNA, 22 nt, Human
aacagacagaaaaaugugaucu

SEQ ID NO: 490101 - RNA, 22 nt, Human
ccugggccucacccagcucuug

SEQ ID NO: 490102 - RNA, 22 nt, Human
uccuggcugaguucccaagucg

SEQ ID NO: 490103 - RNA, 18 nt, Human
uaaugauaagccuugaag

SEQ ID NO: 490104 - RNA, 22 nt, Human
aaaaaugaaacggcugguuggc

SEQ ID NO: 490105 - RNA, 22 nt, Human
cccagccucuggauucugcccu

SEQ ID NO: 490106 - RNA, 22 nt, Human
cagagacauguggccugcacgu

SEQ ID NO: 490107 - RNA, 22 nt, Human
ugguccugucucaaggagccuu

SEQ ID NO: 490108 - RNA, 22 nt, Human
ucuuguuucuucuaagcagcag

SEQ ID NO: 490109 - RNA, 22 nt, Human
ccacuaguuuaauaccuuccuu

SEQ ID NO: 490110 - RNA, 22 nt, Human
aaucuugaguguuacucucauu

SEQ ID NO: 490111 - RNA, 22 nt, Human
uuuagcuugaaaguuuuggagg

SEQ ID NO: 490112 - RNA, 22 nt, Human
cuuagcuucucugcaucugugu

SEQ ID NO: 490113 - RNA, 22 nt, Human
acaugcuaugagagauuacuuc

SEQ ID NO: 490114 - RNA, 22 nt, Human
accaggguugagucagcugcgu

SEQ ID NO: 490115 - RNA, 22 nt, Human
gugcccuggaugacuuuggucu

SEQ ID NO: 490116 - RNA, 22 nt, Human
gaggccuggaccagccacagag

SEQ ID NO: 490117 - RNA, 22 nt, Human
cugaguggguuucugcuuguca

SEQ ID NO: 490118 - RNA, 22 nt, Human
ugggcaaaugucacuuucuuuu

SEQ ID NO: 490119 - RNA, 23 nt, Human
ugguaauagggagcagaagguag

SEQ ID NO: 490120 - RNA, 22 nt, Human
uugauguaaagugauucauggg

SEQ ID NO: 490121 - RNA, 22 nt, Human
gcuucaugaaaaucacugguca

SEQ ID NO: 490122 - RNA, 22 nt, Human
augcuuggaugcugccauggga

SEQ ID NO: 490123 - RNA, 22 nt, Human
ugccugaacaugaauaguuuau

SEQ ID NO: 490124 - RNA, 22 nt, Human
aauuuguggccacauuguggaa

SEQ ID NO: 490125 - RNA, 22 nt, Human
gcccuuagguacuacuuauucu

SEQ ID NO: 490126 - RNA, 22 nt, Human
gccuggcuauggccucccccau

SEQ ID NO: 490127 - RNA, 20 nt, Human
aacauugaaagucuagaaga

SEQ ID NO: 490128 - RNA, 22 nt, Human
aauaauuagugggacagagaac

SEQ ID NO: 490129 - RNA, 22 nt, Human
auauuugugguaaagguaagaa

SEQ ID NO: 490130 - RNA, 22 nt, Human
cuggcugguucccugcuccagg

SEQ ID NO: 490131 - RNA, 22 nt, Human
uguaaugagaaagagagugaau

SEQ ID NO: 490132 - RNA, 22 nt, Human
auagauuagcccuauaguuuua

SEQ ID NO: 490133 - RNA, 22 nt, Human
aauaauauuccucugugugcgu

SEQ ID NO: 490134 - RNA, 22 nt, Human
auucucaauuuugccaaagggu

SEQ ID NO: 490135 - RNA, 22 nt, Human
uccuguggucuggaaggaaugg

SEQ ID NO: 490136 - RNA, 22 nt, Human
ucauuuaugcaggaauggcaua

SEQ ID NO: 490137 - RNA, 22 nt, Human
ccugggcucaagugaugguccc

SEQ ID NO: 490138 - RNA, 23 nt, Human
guuuucaacacaauaaauguaac

SEQ ID NO: 490139 - RNA, 19 nt, Human
auaaauaaaaagugggaga

SEQ ID NO: 490140 - RNA, 22 nt, Human
cugggucuggcuacugcuuccu

SEQ ID NO: 490141 - RNA, 22 nt, Human
uacuaggaagcagcugcauugg

SEQ ID NO: 490142 - RNA, 22 nt, Human
gacacagaaggucacauguuca

SEQ ID NO: 490143 - RNA, 22 nt, Human
ccuggguuaguaucuguuucca

SEQ ID NO: 490144 - RNA, 22 nt, Human
ugaugauuucauuucuagcugu

SEQ ID NO: 490145 - RNA, 22 nt, Human
cguguacacgcacacguguccu

SEQ ID NO: 490146 - RNA, 22 nt, Human
ggcugccuucauagaccauggg

SEQ ID NO: 490147 - RNA, 22 nt, Human
auuuugugaacccucaagcaau

SEQ ID NO: 490148 - RNA, 22 nt, Human
uguuccugaaugccuggcuggc

SEQ ID NO: 490149 - RNA, 22 nt, Human
uugcugaaaucuaugacauccu

SEQ ID NO: 490150 - RNA, 22 nt, Human
agucacaugggauuagaaccca

SEQ ID NO: 490151 - RNA, 22 nt, Human
gucccuggguagcucaguggcu

SEQ ID NO: 490152 - RNA, 22 nt, Human
uuaucacuuaugagcuuuuugc

SEQ ID NO: 490153 - RNA, 22 nt, Human
ugaaacuuuugagguucuucca

SEQ ID NO: 490154 - RNA, 19 nt, Human
caacaguacugguuugucc

SEQ ID NO: 490155 - RNA, 22 nt, Human
uuugugaauggaauccacagac

SEQ ID NO: 490156 - RNA, 22 nt, Human
uuacaguuuaguccaagccaga

SEQ ID NO: 490157 - RNA, 22 nt, Human
acaggacagguaggauucgcag

SEQ ID NO: 490158 - RNA, 22 nt, Human
aucuuucuaugguacuuucucc

SEQ ID NO: 490159 - RNA, 22 nt, Human
uucauguaccguguaccaggca

SEQ ID NO: 490160 - RNA, 22 nt, Human
gcuucagcccaucccaguacau

SEQ ID NO: 490161 - RNA, 22 nt, Human
gugaaugaaaggaugauucuuu

SEQ ID NO: 490162 - RNA, 19 nt, Human
cuguccugguuuggucccu

SEQ ID NO: 490163 - RNA, 22 nt, Human
uugcagcuuagugauguuaucu

SEQ ID NO: 490164 - RNA, 22 nt, Human
guccucugcuucaugcccugau

SEQ ID NO: 490165 - RNA, 22 nt, Human
ucuuuuagaaaaguugaaugua

SEQ ID NO: 490166 - RNA, 22 nt, Human
uacacagaaauuguguagggau

SEQ ID NO: 490167 - RNA, 22 nt, Human
acacauguuuccaaaagcaccc

SEQ ID NO: 490168 - RNA, 22 nt, Human
ccuggcucgcugaccucagggg

SEQ ID NO: 490169 - RNA, 19 nt, Human
ccaggccuggcgucuccgc

SEQ ID NO: 490170 - RNA, 22 nt, Human
auguccuggucuagcuuccggg

SEQ ID NO: 490171 - RNA, 22 nt, Human
aauuagcuuuccgccaucacac

SEQ ID NO: 490172 - RNA, 22 nt, Human
uccuggcuccugaucugucacu

SEQ ID NO: 490173 - RNA, 22 nt, Human
cccuuagcucaauuucuugccc

SEQ ID NO: 490174 - RNA, 22 nt, Human
acuuagcauuauguaauuacua

SEQ ID NO: 490175 - RNA, 22 nt, Human
cuggcuccaaauucugauguuc

SEQ ID NO: 490176 - RNA, 22 nt, Human
gggaaacuuucacaauguccag

SEQ ID NO: 490177 - RNA, 20 nt, Human
ucagccuugaaugcuugaaa

SEQ ID NO: 490178 - RNA, 22 nt, Human
auugugaauagugccgcaguaa

SEQ ID NO: 490179 - RNA, 18 nt, Human
gcucuggcucaccuccag

SEQ ID NO: 490180 - RNA, 22 nt, Human
ugaaacuuauucaguuucuacc

SEQ ID NO: 490181 - RNA, 22 nt, Human
cugaauaauacagacuagcuuc

SEQ ID NO: 490182 - RNA, 22 nt, Human
gcauuaauguaagacccacucc

SEQ ID NO: 490183 - RNA, 22 nt, Human
ggagccagagggaugcaguuga

SEQ ID NO: 490184 - RNA, 22 nt, Human
cuguccugcccacccugcaggg

SEQ ID NO: 490185 - RNA, 22 nt, Human
ugaucacaagucugaagaauga

SEQ ID NO: 490186 - RNA, 21 nt, Human
gcugggccuguacuugcccug

SEQ ID NO: 490187 - RNA, 22 nt, Human
uauguguaaucaaacacaugcu

SEQ ID NO: 490188 - RNA, 22 nt, Human
ucauaaaugcagugucauaaau

SEQ ID NO: 490189 - RNA, 22 nt, Human
guguccugcauuggcucugccc

SEQ ID NO: 490190 - RNA, 19 nt, Human
ccccuuagggguuaagccu

SEQ ID NO: 490191 - RNA, 22 nt, Human
cugucuuuucauacuuucccuc

SEQ ID NO: 490192 - RNA, 22 nt, Human
uaaaugauuuauguaugugaaa

SEQ ID NO: 490193 - RNA, 20 nt, Human
uuuauuggccuuucaggaac

SEQ ID NO: 490194 - RNA, 22 nt, Human
cuuguuuugaaagcaguggcca

SEQ ID NO: 490195 - RNA, 22 nt, Human
uguugaguauauaccuacaagu

SEQ ID NO: 490196 - RNA, 19 nt, Human
uguccuguccugcucugac

SEQ ID NO: 490197 - RNA, 22 nt, Human
gugaaugacauauuuuguacug

SEQ ID NO: 490198 - RNA, 22 nt, Human
gcauuuaaauuugaacuucaga

SEQ ID NO: 490199 - RNA, 22 nt, Human
gccuguggccacugcgucugca

SEQ ID NO: 490200 - RNA, 22 nt, Human
uaguuuguaaugaggagaagua

SEQ ID NO: 490201 - RNA, 22 nt, Human
acacauguuuacagucuucagu

SEQ ID NO: 490202 - RNA, 22 nt, Human
uuuuagaaauacugauuuagug

SEQ ID NO: 490203 - RNA, 22 nt, Human
acugucaccuaaauuuucauug

SEQ ID NO: 490204 - RNA, 22 nt, Human
ucagccuuugaagggcugcagg

SEQ ID NO: 490205 - RNA, 22 nt, Human
agggugaaucucacaacucuua

SEQ ID NO: 490206 - RNA, 22 nt, Human
uaaaaugaucucucauguucuu

SEQ ID NO: 490207 - RNA, 22 nt, Human
gcuuccagggcucagucacugc

SEQ ID NO: 490208 - RNA, 22 nt, Human
cugcccugcucuccgggaucuu

SEQ ID NO: 490209 - RNA, 22 nt, Human
uccuggcugucacucggguuga

SEQ ID NO: 490210 - RNA, 22 nt, Human
gaauauauuggugaaaauaguu

SEQ ID NO: 490211 - RNA, 22 nt, Human
acagagucucagggaugaaagc

SEQ ID NO: 490212 - RNA, 22 nt, Human
gggaaacuggggacugaaucug

SEQ ID NO: 490213 - RNA, 22 nt, Human
cuguaugaaauugucauuuuua

SEQ ID NO: 490214 - RNA, 21 nt, Human
uuacaugguuuaucauaugga

SEQ ID NO: 490215 - RNA, 22 nt, Human
guugcugauggcaagauuccag

SEQ ID NO: 490216 - RNA, 22 nt, Human
ugauauggcuaaagaaaguuuc

SEQ ID NO: 490217 - RNA, 20 nt, Human
cuuagcuucuaagguucugg

SEQ ID NO: 490218 - RNA, 22 nt, Human
ucuuuaauauaaaggaaugaau

SEQ ID NO: 490219 - RNA, 22 nt, Human
ggaacuccugcuccaagcagcu

SEQ ID NO: 490220 - RNA, 22 nt, Human
gcucuggcuacuguggcuaccg

SEQ ID NO: 490221 - RNA, 22 nt, Human
cccuuagcuccaagggguuugg

SEQ ID NO: 490222 - RNA, 22 nt, Human
uauuagcuucugguuuuguucu

SEQ ID NO: 490223 - RNA, 22 nt, Human
ggaaagcucagaucuuguugga

SEQ ID NO: 490224 - RNA, 20 nt, Human
ucugggcuucccccagcucc

SEQ ID NO: 490225 - RNA, 22 nt, Human
uucagcacuguuauggauuugc

SEQ ID NO: 490226 - RNA, 17 nt, Human
auuugugauguaacguc

SEQ ID NO: 490227 - RNA, 22 nt, Human
uuaaauuagucaagcuucucug

SEQ ID NO: 490228 - RNA, 22 nt, Human
uucuuacagaguuuacagagcc

SEQ ID NO: 490229 - RNA, 22 nt, Human
uccugugucucagcgugaagca

SEQ ID NO: 490230 - RNA, 22 nt, Human
auaagcuuugcuggagagaccu

SEQ ID NO: 490231 - RNA, 22 nt, Human
uuagccauuuuauucagcaggu

SEQ ID NO: 490232 - RNA, 22 nt, Human
gcugccugcacagagcugcuuu

SEQ ID NO: 490233 - RNA, 22 nt, Human
gaauacauuggaaaucagaaua

SEQ ID NO: 490234 - RNA, 22 nt, Human
caggacacuacagaugggaggg

SEQ ID NO: 490235 - RNA, 22 nt, Human
uugcccugcggguccugcgcaa

SEQ ID NO: 490236 - RNA, 22 nt, Human
augauauuugcaaugugcuugc

SEQ ID NO: 490237 - RNA, 22 nt, Human
agcuucagugucaggcccgugg

SEQ ID NO: 490238 - RNA, 22 nt, Human
augauauuauucuagcccagag

SEQ ID NO: 490239 - RNA, 18 nt, Human
aaaauaacaaaguuggcu

SEQ ID NO: 490240 - RNA, 22 nt, Human
guagcauucugaguucgcagag

SEQ ID NO: 490241 - RNA, 22 nt, Human
ccagccucacuggcaucaccua

SEQ ID NO: 490242 - RNA, 22 nt, Human
uggcuccucccugugugugcgu

SEQ ID NO: 490243 - RNA, 22 nt, Human
gcagaggugaccagcagcaggg

SEQ ID NO: 490244 - RNA, 22 nt, Human
gccuggcuuggggcucaguggu

SEQ ID NO: 490245 - RNA, 22 nt, Human
cauuugugugggaacccaucag

SEQ ID NO: 490246 - RNA, 22 nt, Human
guccuggugccaccugcgggau

SEQ ID NO: 490247 - RNA, 22 nt, Human
ugugcacauucuaggacuagua

SEQ ID NO: 490248 - RNA, 17 nt, Human
gucaacaggauuucuuu

SEQ ID NO: 490249 - RNA, 19 nt, Human
uccagccugcuguuucucu

SEQ ID NO: 490250 - RNA, 22 nt, Human
caugugugggacccuuagguug

SEQ ID NO: 490251 - RNA, 22 nt, Human
aucugugaucaagacagacagu

SEQ ID NO: 490252 - RNA, 19 nt, Human
ugggcagguucaguaaugg

SEQ ID NO: 490253 - RNA, 22 nt, Human
agaaugauagcuaguauuuacu

SEQ ID NO: 490254 - RNA, 23 nt, Human
acagacauuccauaauguacacc

SEQ ID NO: 490255 - RNA, 22 nt, Human
ugcugaauaaauaaagucuauu

SEQ ID NO: 490256 - RNA, 22 nt, Human
cugggccaucagaggggcugga

SEQ ID NO: 490257 - RNA, 22 nt, Human
aaggccugcucagcugucugug

SEQ ID NO: 490258 - RNA, 22 nt, Human
uauguguguaugacagacagag

SEQ ID NO: 490259 - RNA, 22 nt, Human
uucuggcuccagaugcuucugu

SEQ ID NO: 490260 - RNA, 22 nt, Human
gacagacaggaggcauucaggg

SEQ ID NO: 490261 - RNA, 18 nt, Human
gcacagagcccaggcucu

SEQ ID NO: 490262 - RNA, 22 nt, Human
gcuggcagcauuagacccuggg

SEQ ID NO: 490263 - RNA, 17 nt, Human
guaaggcuugcagaugc

SEQ ID NO: 490264 - RNA, 22 nt, Human
agcuucagguggucuuguuucu

SEQ ID NO: 490265 - RNA, 22 nt, Human
gcuuagcaucuuacaaugcuga

SEQ ID NO: 490266 - RNA, 22 nt, Human
cugggcccaggcggcucucgga

SEQ ID NO: 490267 - RNA, 22 nt, Human
uuuguaaaggccugaauuucag

SEQ ID NO: 490268 - RNA, 19 nt, Human
agcaggcagguggcccagg

SEQ ID NO: 490269 - RNA, 18 nt, Human
ucauuuguuuugcaugaa

SEQ ID NO: 490270 - RNA, 22 nt, Human
gcugcuggcaucuagggggugg

SEQ ID NO: 490271 - RNA, 22 nt, Human
agggccugugaauucucccugc

SEQ ID NO: 490272 - RNA, 22 nt, Human
uuagcauucugccuccuauauc

SEQ ID NO: 490273 - RNA, 22 nt, Human
ccuucagccuagaacuugagag

SEQ ID NO: 490274 - RNA, 22 nt, Human
acaguauaccauugugacuuug

SEQ ID NO: 490275 - RNA, 22 nt, Human
augauguuaccaguacuuagag

SEQ ID NO: 490276 - RNA, 22 nt, Human
uuuuagaaucagguugucuggg

SEQ ID NO: 490277 - RNA, 22 nt, Human
uguguccauucaggcacugacc

SEQ ID NO: 490278 - RNA, 22 nt, Human
uagcuucaguggcccuagacac

SEQ ID NO: 490279 - RNA, 22 nt, Human
cccagccugaucucggccagcu

SEQ ID NO: 490280 - RNA, 17 nt, Human
cagucacaggucuuuuc

SEQ ID NO: 490281 - RNA, 22 nt, Human
uuucuacagcuggugcaacuuu

SEQ ID NO: 490282 - RNA, 22 nt, Human
acuagucauuuaggugauauua

SEQ ID NO: 490283 - RNA, 21 nt, Human
guggcucugccaggacugaaa

SEQ ID NO: 490284 - RNA, 22 nt, Human
uucagugucaauuuuuaaauau

SEQ ID NO: 490285 - RNA, 22 nt, Human
gagcuccacuuagcaaggccac

SEQ ID NO: 490286 - RNA, 22 nt, Human
cucuguuuggcgcugcuccuuc

SEQ ID NO: 490287 - RNA, 22 nt, Human
cuauuauuuccucaucuauaaa

SEQ ID NO: 490288 - RNA, 22 nt, Human
cagcacugcugcuguacacaca

SEQ ID NO: 490289 - RNA, 22 nt, Human
gcacaaggagcaguguaugaaa

SEQ ID NO: 490290 - RNA, 22 nt, Human
uuugcugaccccauucugaguc

SEQ ID NO: 490291 - RNA, 22 nt, Human
uucauguaggcugcaaugcaca

SEQ ID NO: 490292 - RNA, 22 nt, Human
agcaggcaggcccagcggcugg

SEQ ID NO: 490293 - RNA, 23 nt, Human
uauuugcuacugguaauucugga

SEQ ID NO: 490294 - RNA, 22 nt, Human
ccagcacucugucccagcuucc

SEQ ID NO: 490295 - RNA, 21 nt, Human
ucugaugguagaugagaugug

SEQ ID NO: 490296 - RNA, 22 nt, Human
gcuggcugaguucugucgucug

SEQ ID NO: 490297 - RNA, 22 nt, Human
auuuaugacuggugaauagaac

SEQ ID NO: 490298 - RNA, 22 nt, Human
uauuuuugccucucagauaaaa

SEQ ID NO: 490299 - RNA, 22 nt, Human
guaacauuauucaugagauaca

SEQ ID NO: 490300 - RNA, 22 nt, Human
agacagaacagaauaauuguug

SEQ ID NO: 490301 - RNA, 22 nt, Human
ucagcacuauacauuuugaaua

SEQ ID NO: 490302 - RNA, 22 nt, Human
agcuucaguuuucuauuguuaa

SEQ ID NO: 490303 - RNA, 22 nt, Human
auauuugucaucugccuuaguu

SEQ ID NO: 490304 - RNA, 22 nt, Human
uuuugugaauaguuuaucuaag

SEQ ID NO: 490305 - RNA, 22 nt, Human
uggcuucaagucuagguucuac

SEQ ID NO: 490306 - RNA, 22 nt, Human
uuauuuacaacucuucucuucc

SEQ ID NO: 490307 - RNA, 22 nt, Human
cauuuguaguuaaaaaugucuc

SEQ ID NO: 490308 - RNA, 22 nt, Human
gagacacacccaagguuaugag

SEQ ID NO: 490309 - RNA, 22 nt, Human
gcaucuaauccaguccagcauc

SEQ ID NO: 490310 - RNA, 22 nt, Human
uuuugugauggcauuacauuua

SEQ ID NO: 490311 - RNA, 22 nt, Human
ucaagaauuuggauaagaaaug

SEQ ID NO: 490312 - RNA, 22 nt, Human
uacagaagcugagacacugaga

SEQ ID NO: 490313 - RNA, 22 nt, Human
uggcuccuuuccgggucuccag

SEQ ID NO: 490314 - RNA, 19 nt, Human
cuuaugcagcugagcuugg

SEQ ID NO: 490315 - RNA, 22 nt, Human
cugcccugcagcuccacggacu

SEQ ID NO: 490316 - RNA, 22 nt, Human
caugaaauguuagaauuagaca

SEQ ID NO: 490317 - RNA, 22 nt, Human
cugcccugcuggagaucacagu

SEQ ID NO: 490318 - RNA, 21 nt, Human
gcucaggcucuugacagagca

SEQ ID NO: 490319 - RNA, 22 nt, Human
uuagcauuucaguacacauguu

SEQ ID NO: 490320 - RNA, 22 nt, Human
uuuaauuuguauuucuagaggg

SEQ ID NO: 490321 - RNA, 22 nt, Human
cuguccuguacuuugaggcccu

SEQ ID NO: 490322 - RNA, 22 nt, Human
gugugccaccacugacaggauu

SEQ ID NO: 490323 - RNA, 21 nt, Human
cggaaacucggcucugguucc

SEQ ID NO: 490324 - RNA, 22 nt, Human
uagcacuacuuagguacagcca

SEQ ID NO: 490325 - RNA, 20 nt, Human
aagcuucacuucauuugauc

SEQ ID NO: 490326 - RNA, 22 nt, Human
uaugugcauaugcauacacaca

SEQ ID NO: 490327 - RNA, 22 nt, Human
aucuugugcugacaaaacacau

SEQ ID NO: 490328 - RNA, 22 nt, Human
uguccuggaaaaauggagaguu

SEQ ID NO: 490329 - RNA, 22 nt, Human
gggaaacugcaacucagagagg

SEQ ID NO: 490330 - RNA, 22 nt, Human
gccuggcugccggccuuggcaa

SEQ ID NO: 490331 - RNA, 22 nt, Human
ucucugggaaugggccugggua

SEQ ID NO: 490332 - RNA, 22 nt, Human
uuuaaauuuguguuuagagggu

SEQ ID NO: 490333 - RNA, 22 nt, Human
uuugugaacacugcgcagaacu

SEQ ID NO: 490334 - RNA, 22 nt, Human
agguccuguccuuggucucuga

SEQ ID NO: 490335 - RNA, 22 nt, Human
uacaggaagucucaguacagua

SEQ ID NO: 490336 - RNA, 22 nt, Human
uccuggcuaacacggugacacc

SEQ ID NO: 490337 - RNA, 22 nt, Human
gaggguggccuuuagagcccau

SEQ ID NO: 490338 - RNA, 22 nt, Human
agagggggaaaauagagguguu

SEQ ID NO: 490339 - RNA, 22 nt, Human
ugucagggcuggacacagcugc

SEQ ID NO: 490340 - RNA, 22 nt, Human
uagucacaugaucacaggaucg

SEQ ID NO: 490341 - RNA, 22 nt, Human
augcccuggacuagcuauacuu

SEQ ID NO: 490342 - RNA, 22 nt, Human
cucuggcuguuugcagcucaag

SEQ ID NO: 490343 - RNA, 21 nt, Human
gggaaacucugcuuaacagag

SEQ ID NO: 490344 - RNA, 22 nt, Human
auauuuguugaguucuuaugau

SEQ ID NO: 490345 - RNA, 22 nt, Human
gucugggcaagggagauggcgc

SEQ ID NO: 490346 - RNA, 23 nt, Human
gcucuggcagcuugugucagcac

SEQ ID NO: 490347 - RNA, 22 nt, Human
cagcccugcacgcugccuccgc

SEQ ID NO: 490348 - RNA, 22 nt, Human
gcuggcuguguuccuucugcca

SEQ ID NO: 490349 - RNA, 22 nt, Human
aaauacauacacuguacguggc

SEQ ID NO: 490350 - RNA, 22 nt, Human
uugcugaaggccucuugggguu

SEQ ID NO: 490351 - RNA, 22 nt, Human
uucuuacauauuuucauauggu

SEQ ID NO: 490352 - RNA, 22 nt, Human
uacauagaggguaauagcauca

SEQ ID NO: 490353 - RNA, 22 nt, Human
auuagcuuuaaagacuuugauu

SEQ ID NO: 490354 - RNA, 21 nt, Human
cuuguuuugaaaggacuggcc

SEQ ID NO: 490355 - RNA, 22 nt, Human
cacauuauucuaaagagguacu

SEQ ID NO: 490356 - RNA, 22 nt, Human
aaagacauuagcuuagauguca

SEQ ID NO: 490357 - RNA, 22 nt, Human
uccuuggcaagcugcaauggga

SEQ ID NO: 490358 - RNA, 22 nt, Human
cauguguguggacgagcguggc

SEQ ID NO: 490359 - RNA, 22 nt, Human
ugauauuuuucacuggccucug

SEQ ID NO: 490360 - RNA, 22 nt, Human
agagccaggcaggcaauguuga

SEQ ID NO: 490361 - RNA, 22 nt, Human
auacauuagcucauaugauuaa

SEQ ID NO: 490362 - RNA, 22 nt, Human
agagccaguuguuaagcacuua

SEQ ID NO: 490363 - RNA, 22 nt, Human
gcuauugugacagcuuuucgcc

SEQ ID NO: 490364 - RNA, 22 nt, Human
ucagcacugucuauuagugaga

SEQ ID NO: 490365 - RNA, 22 nt, Human
uguguacacaugacaggcaccc

SEQ ID NO: 490366 - RNA, 22 nt, Human
gacacagaaugggugcucagua

SEQ ID NO: 490367 - RNA, 22 nt, Human
uugcugaagugaagguauguuu

SEQ ID NO: 490368 - RNA, 22 nt, Human
uccuuagacaaagagugggcuu

SEQ ID NO: 490369 - RNA, 22 nt, Human
uaauuacagagguuugccaguu

SEQ ID NO: 490370 - RNA, 22 nt, Human
gcuacagguauauagaugaaac

SEQ ID NO: 490371 - RNA, 22 nt, Human
uagaaugaccuccucuuagcuu

SEQ ID NO: 490372 - RNA, 22 nt, Human
uaauuauuaugacaacaauugc

SEQ ID NO: 490373 - RNA, 22 nt, Human
aggaagcuuggggcagggcuac

SEQ ID NO: 490374 - RNA, 22 nt, Human
uuuauucuugagagugagaaga

SEQ ID NO: 490375 - RNA, 19 nt, Human
guguacagcucagugaauu

SEQ ID NO: 490376 - RNA, 15 nt, Human
auuauuugugcucag

SEQ ID NO: 490377 - RNA, 22 nt, Human
gcugccuggagcucagccugcc

SEQ ID NO: 490378 - RNA, 22 nt, Human
agagccagcauuugacacuggc

SEQ ID NO: 490379 - RNA, 22 nt, Human
ccuggcugagggaccucgggua

SEQ ID NO: 490380 - RNA, 22 nt, Human
auuuguugaauaaauuaguauu

SEQ ID NO: 490381 - RNA, 22 nt, Human
gaccacagauuccuaaguggca

SEQ ID NO: 490382 - RNA, 22 nt, Human
guccagccccugacucccaggc

SEQ ID NO: 490383 - RNA, 22 nt, Human
gaauaacagcaaguuugcaggc

SEQ ID NO: 490384 - RNA, 22 nt, Human
ucuggcugcguggccuuuagca

SEQ ID NO: 490385 - RNA, 22 nt, Human
ucagcacucgcuaccuaguaaa

SEQ ID NO: 490386 - RNA, 22 nt, Human
ugccugggaucugugcccuuug

SEQ ID NO: 490387 - RNA, 21 nt, Human
ucugucuuccucagccuaagg

SEQ ID NO: 490388 - RNA, 22 nt, Human
acaaaauagaguucuccccugg

SEQ ID NO: 490389 - RNA, 22 nt, Human
aggcagcauuucugcuuaucca

SEQ ID NO: 490390 - RNA, 22 nt, Human
ggcugccuacuuucccagaguu

SEQ ID NO: 490391 - RNA, 22 nt, Human
cauuguuauagcauuacacacc

SEQ ID NO: 490392 - RNA, 22 nt, Human
agcuucaggaacaggcagccug

SEQ ID NO: 490393 - RNA, 20 nt, Human
gcacagagaugagcaaagua

SEQ ID NO: 490394 - RNA, 22 nt, Human
cucaguccuuauuugccucuac

SEQ ID NO: 490395 - RNA, 22 nt, Human
ugccaggcuccggaacgacagu

SEQ ID NO: 490396 - RNA, 22 nt, Human
uucauuugggaugagucagaag

SEQ ID NO: 490397 - RNA, 22 nt, Human
uugcagcugcaguaaauguuca

SEQ ID NO: 490398 - RNA, 22 nt, Human
cuucauuucaggcugaagaaua

SEQ ID NO: 490399 - RNA, 22 nt, Human
cagcacaucuccaagaauuucu

SEQ ID NO: 490400 - RNA, 22 nt, Human
uagcauuauuuccucuuuuugu

SEQ ID NO: 490401 - RNA, 22 nt, Human
cugcccugugaggguccuuggg

SEQ ID NO: 490402 - RNA, 23 nt, Human
ggcuccuggauucaaauccugcc

SEQ ID NO: 490403 - RNA, 22 nt, Human
auuucugauaaacguaagcugc

SEQ ID NO: 490404 - RNA, 22 nt, Human
guuagcaugacuuagaaucagg

SEQ ID NO: 490405 - RNA, 22 nt, Human
gugauaagacaguaggcacaag

SEQ ID NO: 490406 - RNA, 22 nt, Human
guauuagcugccuuggagcuaa

SEQ ID NO: 490407 - RNA, 22 nt, Human
gguuuuaacuacagaauugcaa

SEQ ID NO: 490408 - RNA, 22 nt, Human
gaaaugaugucugugcugccac

SEQ ID NO: 490409 - RNA, 22 nt, Human
cuccugucagaagcauccugag

SEQ ID NO: 490410 - RNA, 22 nt, Human
cugcccuguuuggacagcccgg

SEQ ID NO: 490411 - RNA, 22 nt, Human
cauuagcaggcacuaagaaggu

SEQ ID NO: 490412 - RNA, 22 nt, Human
gugcccuggcucacagugucuc

SEQ ID NO: 490413 - RNA, 22 nt, Human
acuuguuuacaagcaguucuga

SEQ ID NO: 490414 - RNA, 22 nt, Human
caggcacacugucuacacugag

SEQ ID NO: 490415 - RNA, 20 nt, Human
acacaugucaagcuaaaggc

SEQ ID NO: 490416 - RNA, 22 nt, Human
uuuugugagcuccuuggaggua

SEQ ID NO: 490417 - RNA, 22 nt, Human
uugauauucugagaagcugaag

SEQ ID NO: 490418 - RNA, 22 nt, Human
uuuaaauguguucuuaguagcu

SEQ ID NO: 490419 - RNA, 22 nt, Human
uuauuuguaucaaggacgguug

SEQ ID NO: 490420 - RNA, 23 nt, Human
uagcagcauuuuuagccucuguc

SEQ ID NO: 490421 - RNA, 20 nt, Human
caucuugaaggucuuccaca

SEQ ID NO: 490422 - RNA, 22 nt, Human
ggaaacuuggaugccagcacuc

SEQ ID NO: 490423 - RNA, 23 nt, Human
ucacuagucaagugccuuugagu

SEQ ID NO: 490424 - RNA, 22 nt, Human
agaaaauauucauugagaggcu

SEQ ID NO: 490425 - RNA, 22 nt, Human
ccuggcucaggcacgcauggcu

SEQ ID NO: 490426 - RNA, 22 nt, Human
auaguguguuagugacauaggc

SEQ ID NO: 490427 - RNA, 22 nt, Human
cugaaugaguggauuuuucauu

SEQ ID NO: 490428 - RNA, 22 nt, Human
cauaguaaauaaugcagaugau

SEQ ID NO: 490429 - RNA, 23 nt, Human
agcaggcaucuguggcacaaggc

SEQ ID NO: 490430 - RNA, 22 nt, Human
uguccuggagacacaagguggu

SEQ ID NO: 490431 - RNA, 22 nt, Human
gugcccuggggugaaccccugg

SEQ ID NO: 490432 - RNA, 19 nt, Human
aaugacugaguacauuguc

SEQ ID NO: 490433 - RNA, 22 nt, Human
caguagucuuuuuccuccuaga

SEQ ID NO: 490434 - RNA, 18 nt, Human
uucagcagcagacacacu

SEQ ID NO: 490435 - RNA, 22 nt, Human
cuuuacaaagcaauuuugucuc

SEQ ID NO: 490436 - RNA, 22 nt, Human
aagcacuaggucacacaaguua

SEQ ID NO: 490437 - RNA, 22 nt, Human
ccucuggggugagugggccacu

SEQ ID NO: 490438 - RNA, 21 nt, Human
ucacuagugccuucugucauu

SEQ ID NO: 490439 - RNA, 22 nt, Human
uuuugugacacuucuugagaca

SEQ ID NO: 490440 - RNA, 22 nt, Human
cuggcuucugggccagggcaga

SEQ ID NO: 490441 - RNA, 22 nt, Human
ucugaauguuaggaaacuuucu

SEQ ID NO: 490442 - RNA, 22 nt, Human
cagagacacuuaacaggaaugg

SEQ ID NO: 490443 - RNA, 22 nt, Human
ugcuucaggagaugucaccaug

SEQ ID NO: 490444 - RNA, 22 nt, Human
aaaacauuuuacugccaucuca

SEQ ID NO: 490445 - RNA, 22 nt, Human
uuauuacacugaaagaauugcg

SEQ ID NO: 490446 - RNA, 22 nt, Human
ccucugggcagguagcagcagc

SEQ ID NO: 490447 - RNA, 20 nt, Human
caaagacaugcuaggggugg

SEQ ID NO: 490448 - RNA, 22 nt, Human
gaauuacaugacccugaguaga

SEQ ID NO: 490449 - RNA, 22 nt, Human
cagagccacuuggagaugagaa

SEQ ID NO: 490450 - RNA, 22 nt, Human
agcuucauggaaccugaggcua

SEQ ID NO: 490451 - RNA, 22 nt, Human
cugcccuggucccauggcugau

SEQ ID NO: 490452 - RNA, 22 nt, Human
uaugauaugcacuuuaucagaa

SEQ ID NO: 490453 - RNA, 22 nt, Human
ugaagcuggaaguuagguagac

SEQ ID NO: 490454 - RNA, 17 nt, Human
uuuagaauacaauguuu

SEQ ID NO: 490455 - RNA, 22 nt, Human
ggaaucuuugaaggauuuuaag

SEQ ID NO: 490456 - RNA, 22 nt, Human
accuagaauuuaaaacauugcu

SEQ ID NO: 490457 - RNA, 22 nt, Human
guccucugggcuuugagcaguc

SEQ ID NO: 490458 - RNA, 21 nt, Human
gccuggcuagaagcuccuagc

SEQ ID NO: 490459 - RNA, 22 nt, Human
cugaggucuauuuugaaacugc

SEQ ID NO: 490460 - RNA, 22 nt, Human
ucucaucugccauuugcaggag

SEQ ID NO: 490461 - RNA, 22 nt, Human
uagcauuagucagauauguuuu

SEQ ID NO: 490462 - RNA, 22 nt, Human
acugggccaggugugggugagu

SEQ ID NO: 490463 - RNA, 22 nt, Human
gauaauuauaggcuaagccacu

SEQ ID NO: 490464 - RNA, 23 nt, Human
augugcacaucuccuuguccacc

SEQ ID NO: 490465 - RNA, 22 nt, Human
augcccuggggcuaccucugag

SEQ ID NO: 490466 - RNA, 22 nt, Human
gugccuggaaugcgccucggcg

SEQ ID NO: 490467 - RNA, 22 nt, Human
aggaaacuucagaguuuugguc

SEQ ID NO: 490468 - RNA, 22 nt, Human
uggcuccucuucuggguguccc

SEQ ID NO: 490469 - RNA, 23 nt, Human
uguaccaggaguuucagcagacu

SEQ ID NO: 490470 - RNA, 22 nt, Human
cauacauauguggaugucauau

SEQ ID NO: 490471 - RNA, 22 nt, Human
gcuuagcaaugugacaagaugc

SEQ ID NO: 490472 - RNA, 22 nt, Human
gcucucagaaguaacuugucca

SEQ ID NO: 490473 - RNA, 23 nt, Human
cugggcuguccugaggucaccuc

SEQ ID NO: 490474 - RNA, 22 nt, Human
ugagccaggcccagugggguca

SEQ ID NO: 490475 - RNA, 22 nt, Human
uuuagcaucgaaguaaauuuag

SEQ ID NO: 490476 - RNA, 22 nt, Human
cacaccucagccauguggaggc

SEQ ID NO: 490477 - RNA, 23 nt, Human
uacagaaggaguagucacuaaga

SEQ ID NO: 490478 - RNA, 22 nt, Human
guguccugccacccugggcuuu

SEQ ID NO: 490479 - RNA, 22 nt, Human
uauuuagaacagacaauagaaa

SEQ ID NO: 490480 - RNA, 22 nt, Human
cauaacauguacauauaaaugc

SEQ ID NO: 490481 - RNA, 22 nt, Human
cuuagcuuuuccagcuucuaga

SEQ ID NO: 490482 - RNA, 22 nt, Human
cugccuggguucaaguccuguu

SEQ ID NO: 490483 - RNA, 22 nt, Human
cuggcucauagagcagcuccaa

SEQ ID NO: 490484 - RNA, 22 nt, Human
cacacagaaccgcucgccacuu

SEQ ID NO: 490485 - RNA, 20 nt, Human
auguccuguugcugccccag

SEQ ID NO: 490486 - RNA, 22 nt, Human
uucagcacuuuguuuugcucau

SEQ ID NO: 490487 - RNA, 22 nt, Human
ucauuuguucaucugcucuucu

SEQ ID NO: 490488 - RNA, 22 nt, Human
uccagccuugccacuuuucugu

SEQ ID NO: 490489 - RNA, 21 nt, Human
gccuggcucucacuggccugg

SEQ ID NO: 490490 - RNA, 18 nt, Human
gcugaaugucugcuuugc

SEQ ID NO: 490491 - RNA, 22 nt, Human
acacaguaaauauguauugaau

SEQ ID NO: 490492 - RNA, 22 nt, Human
agagccugugauugucaucacc

SEQ ID NO: 490493 - RNA, 22 nt, Human
aauaauuauuugagagcagacc

SEQ ID NO: 490494 - RNA, 22 nt, Human
caggucagaggcgcagccccca

SEQ ID NO: 490495 - RNA, 22 nt, Human
guuccugaugcuuugaaauuca

SEQ ID NO: 490496 - RNA, 21 nt, Human
ccugggagaucagcugccuuc

SEQ ID NO: 490497 - RNA, 22 nt, Human
auuauuaggugcucucugacaa

SEQ ID NO: 490498 - RNA, 22 nt, Human
ugcccuuaugaaagaggcccaa

SEQ ID NO: 490499 - RNA, 22 nt, Human
uaauuuugucacagugacaugc

SEQ ID NO: 490500 - RNA, 22 nt, Human
agccuguggaucccugcacugg

SEQ ID NO: 490501 - RNA, 22 nt, Human
gugcccugaaagaguuaauuca

SEQ ID NO: 490502 - RNA, 22 nt, Human
aagcaaaugugggugcagaauu

SEQ ID NO: 490503 - RNA, 22 nt, Human
gccuggcugcuuagccuacuuc

SEQ ID NO: 490504 - RNA, 22 nt, Human
uccuggcuccagcagcucuucc

SEQ ID NO: 490505 - RNA, 22 nt, Human
cuuaaauuuucaucuacaagaa

SEQ ID NO: 490506 - RNA, 22 nt, Human
agaauacaauuguucaguaaua

SEQ ID NO: 490507 - RNA, 22 nt, Human
gcugccuccaaucugugccccg

SEQ ID NO: 490508 - RNA, 22 nt, Human
uggcacagaaaaaugcuccauu

SEQ ID NO: 490509 - RNA, 22 nt, Human
caaugauaauggcuguauuuau

SEQ ID NO: 490510 - RNA, 22 nt, Human
caaaugauaccuauuacuaggc

SEQ ID NO: 490511 - RNA, 19 nt, Human
ugugauaagcagaauucca

SEQ ID NO: 490512 - RNA, 22 nt, Human
gaaaucuuuuccaauuguuuag

SEQ ID NO: 490513 - RNA, 22 nt, Human
uuaggcaugcaagauuaagcuc

SEQ ID NO: 490514 - RNA, 22 nt, Human
ucugggcuuuacacugugcuua

SEQ ID NO: 490515 - RNA, 22 nt, Human
uucccuucuaguuuugagagac

SEQ ID NO: 490516 - RNA, 22 nt, Human
uccuguguuacugccuggagcg

SEQ ID NO: 490517 - RNA, 22 nt, Human
gugcccugacacaccuggugug

SEQ ID NO: 490518 - RNA, 22 nt, Human
aagcuucagugugagcauguaa

SEQ ID NO: 490519 - RNA, 22 nt, Human
cagugggugaugaguccugggg

SEQ ID NO: 490520 - RNA, 22 nt, Human
ugagccaugggacuccaaggga

SEQ ID NO: 490521 - RNA, 22 nt, Human
gugcccuguugcacacuugagg

SEQ ID NO: 490522 - RNA, 22 nt, Human
cagcuucuuagucuuuccuugu

SEQ ID NO: 490523 - RNA, 22 nt, Human
gugugcaugcauagacaccaca

SEQ ID NO: 490524 - RNA, 22 nt, Human
ugagccagucugucugggugaa

SEQ ID NO: 490525 - RNA, 22 nt, Human
cuucagcaacuuuggaauguuu

SEQ ID NO: 490526 - RNA, 22 nt, Human
agcugaagcucagcccaguagu

SEQ ID NO: 490527 - RNA, 22 nt, Human
ucugucuuagccaucucaggcu

SEQ ID NO: 490528 - RNA, 22 nt, Human
uuguccuggcccaaaugucaac

SEQ ID NO: 490529 - RNA, 22 nt, Human
gauauuuuugcagacaccuggg

SEQ ID NO: 490530 - RNA, 22 nt, Human
uccuggcucucuacaaaccaga

SEQ ID NO: 490531 - RNA, 22 nt, Human
gggccaaggggagcuggaaggg

SEQ ID NO: 490532 - RNA, 22 nt, Human
caucuugaugcuuugacagguu

SEQ ID NO: 490533 - RNA, 22 nt, Human
uccuggcucuaaguccugagug

SEQ ID NO: 490534 - RNA, 19 nt, Human
agccagaguggcccagggg

SEQ ID NO: 490535 - RNA, 22 nt, Human
ucuggcugcugcgugagugcuu

SEQ ID NO: 490536 - RNA, 22 nt, Human
guugugaauagugccgcaauaa

SEQ ID NO: 490537 - RNA, 22 nt, Human
ucaugccaaaauccaguggcuu

SEQ ID NO: 490538 - RNA, 22 nt, Human
guccuggccucuggggguaugg

SEQ ID NO: 490539 - RNA, 22 nt, Human
uguacauagaucuugaaaauua

SEQ ID NO: 490540 - RNA, 22 nt, Human
uuacuuuggauggucaagaaag

SEQ ID NO: 490541 - RNA, 22 nt, Human
accagggcagccgagguguguc

SEQ ID NO: 490542 - RNA, 22 nt, Human
cccuuagccaggaaaucgaccu

SEQ ID NO: 490543 - RNA, 22 nt, Human
uggccuggcccugaggcccugu

SEQ ID NO: 490544 - RNA, 22 nt, Human
ugagccaggcacugcuccugga

SEQ ID NO: 490545 - RNA, 22 nt, Human
gucagggcacagugacagcucc

SEQ ID NO: 490546 - RNA, 22 nt, Human
ucugcccacugcucugcugccc

SEQ ID NO: 490547 - RNA, 22 nt, Human
auguccuguuuuggcuugcucu

SEQ ID NO: 490548 - RNA, 22 nt, Human
cuuugugauaguguuaagacca

SEQ ID NO: 490549 - RNA, 22 nt, Human
guugcugaaagcccugacuggc

SEQ ID NO: 490550 - RNA, 22 nt, Human
uuuguugaguuacagagaugaa

SEQ ID NO: 490551 - RNA, 22 nt, Human
gcugaaguugccuauuuuaaua

SEQ ID NO: 490552 - RNA, 18 nt, Human
cccuuagccuuuccucuc

SEQ ID NO: 490553 - RNA, 22 nt, Human
agcuucagcuugcagcugugau

SEQ ID NO: 490554 - RNA, 22 nt, Human
cacagaaauuauuaggaugcuu

SEQ ID NO: 490555 - RNA, 22 nt, Human
gauaagcuaacccaagcccuuu

SEQ ID NO: 490556 - RNA, 22 nt, Human
uccuggcucgauugcuaccaau

SEQ ID NO: 490557 - RNA, 22 nt, Human
aauaacuucauguaacauuuaa

SEQ ID NO: 490558 - RNA, 22 nt, Human
caaaaugaugugauuuuauugu

SEQ ID NO: 490559 - RNA, 22 nt, Human
uucuuuuacauuaagauuucag

SEQ ID NO: 490560 - RNA, 22 nt, Human
ugcugaaugggugauuuuggag

SEQ ID NO: 490561 - RNA, 22 nt, Human
uguguacaucucuucucacauu

SEQ ID NO: 490562 - RNA, 22 nt, Human
augccaggaacaaacaguggug

SEQ ID NO: 490563 - RNA, 22 nt, Human
gaaacauuuguugaguacuugc

SEQ ID NO: 490564 - RNA, 22 nt, Human
uucuuucucaacaugaauguuu

SEQ ID NO: 490565 - RNA, 22 nt, Human
aaucuucauuuugacaagauuc

SEQ ID NO: 490566 - RNA, 22 nt, Human
augaugugugcugaucaagcuu

SEQ ID NO: 490567 - RNA, 22 nt, Human
uuuauuuggcaucucugccaag

SEQ ID NO: 490568 - RNA, 22 nt, Human
auauuuguaaaauucugugucu

SEQ ID NO: 490569 - RNA, 22 nt, Human
auugcugaaaguauuuuaugac

SEQ ID NO: 490570 - RNA, 22 nt, Human
cccagguccccaccugucugcu

SEQ ID NO: 490571 - RNA, 22 nt, Human
cuuguuuucuucugcagucuau

SEQ ID NO: 490572 - RNA, 22 nt, Human
aggcagguuacaaaaacuuuau

SEQ ID NO: 490573 - RNA, 22 nt, Human
ugaaugauguauaauauugaga

SEQ ID NO: 490574 - RNA, 22 nt, Human
ucagcacugaaauucuucacau

SEQ ID NO: 490575 - RNA, 22 nt, Human
cauaauuauaaacgcaaguuca

SEQ ID NO: 490576 - RNA, 22 nt, Human
accaggaggccuggagcacaaa

SEQ ID NO: 490577 - RNA, 22 nt, Human
uuccagcccgcgacuuguucag

SEQ ID NO: 490578 - RNA, 22 nt, Human
uuucacaucagagguagauuag

SEQ ID NO: 490579 - RNA, 22 nt, Human
uuugugaacaaacaugaagaug

SEQ ID NO: 490580 - RNA, 22 nt, Human
gagacacaguuaucaggcauac

SEQ ID NO: 490581 - RNA, 22 nt, Human
agacagaccauggcuauucaga

SEQ ID NO: 490582 - RNA, 18 nt, Human
ugggcugccuggccucug

SEQ ID NO: 490583 - RNA, 22 nt, Human
agucagggguuggacggggcca

SEQ ID NO: 490584 - RNA, 22 nt, Human
cagcacuaugacauuuaauucu

SEQ ID NO: 490585 - RNA, 22 nt, Human
agauuacagcaugggaauggga

SEQ ID NO: 490586 - RNA, 22 nt, Human
gcuggcuuugcacugggugcau

SEQ ID NO: 490587 - RNA, 22 nt, Human
gcugccugguuucucagcugca

SEQ ID NO: 490588 - RNA, 22 nt, Human
guugcugaaauuaauauuggag

SEQ ID NO: 490589 - RNA, 22 nt, Human
auuagcauugcuacucucaaga

SEQ ID NO: 490590 - RNA, 22 nt, Human
ugcccuggcuggagugcagugg

SEQ ID NO: 490591 - RNA, 22 nt, Human
uccuuagcugugaaaugagaau

SEQ ID NO: 490592 - RNA, 22 nt, Human
augcuuuuccaggagaaauaua

SEQ ID NO: 490593 - RNA, 22 nt, Human
ugucucugaaauauguggcucc

SEQ ID NO: 490594 - RNA, 22 nt, Human
cucagggcaguauggcugagag

SEQ ID NO: 490595 - RNA, 22 nt, Human
ugcugaaucaaaacaaagguuu

SEQ ID NO: 490596 - RNA, 22 nt, Human
aagcagauuggggauuuccaug

SEQ ID NO: 490597 - RNA, 22 nt, Human
acagauguggaguuugcaugau

SEQ ID NO: 490598 - RNA, 22 nt, Human
guauuagcuguuagcuacauca

SEQ ID NO: 490599 - RNA, 22 nt, Human
auucagcacaucuuuguacagc

SEQ ID NO: 490600 - RNA, 22 nt, Human
caugauauaaaguaguagauaa

SEQ ID NO: 490601 - RNA, 22 nt, Human
gauuagcucuagaucugggcua

SEQ ID NO: 490602 - RNA, 22 nt, Human
auuugucaaaacacagagaaca

SEQ ID NO: 490603 - RNA, 22 nt, Human
ugaggauggcagugugcucagc

SEQ ID NO: 490604 - RNA, 22 nt, Human
uuuauuagauuaucaaagaggu

SEQ ID NO: 490605 - RNA, 22 nt, Human
ggagccagaaaugcugugguug

SEQ ID NO: 490606 - RNA, 22 nt, Human
aaugacuaauaaguuuuacugu

SEQ ID NO: 490607 - RNA, 20 nt, Human
ugcauuaaguggcauugagc

SEQ ID NO: 490608 - RNA, 22 nt, Human
cacaggaccaauucacauucca

SEQ ID NO: 490609 - RNA, 20 nt, Human
agcauuugaaauaugacuau

SEQ ID NO: 490610 - RNA, 22 nt, Human
uuuaaauucugucugccgcuua

SEQ ID NO: 490611 - RNA, 22 nt, Human
gggaaacugaauucaggacucu

SEQ ID NO: 490612 - RNA, 22 nt, Human
ucucugggguagggcccaggac

SEQ ID NO: 490613 - RNA, 21 nt, Human
ugcuggcugaaaggcacagag

SEQ ID NO: 490614 - RNA, 18 nt, Human
uuauuuguuacagcacau

SEQ ID NO: 490615 - RNA, 22 nt, Human
uaucagcaucuccucaaagaua

SEQ ID NO: 490616 - RNA, 22 nt, Human
augugcagcuuuucuagagaag

SEQ ID NO: 490617 - RNA, 22 nt, Human
gugcugauugggagcugggauu

SEQ ID NO: 490618 - RNA, 22 nt, Human
auuuaauuuacauuugacagag

SEQ ID NO: 490619 - RNA, 22 nt, Human
ggcagagucagaggugguucug

SEQ ID NO: 490620 - RNA, 22 nt, Human
uacagagaguacagcauccaca

SEQ ID NO: 490621 - RNA, 22 nt, Human
gcuggauuggagcaauagaguc

SEQ ID NO: 490622 - RNA, 22 nt, Human
aaaugcucuccaaaaugaaagu

SEQ ID NO: 490623 - RNA, 22 nt, Human
aauaagacacacaacugucaag

SEQ ID NO: 490624 - RNA, 22 nt, Human
ucauuuguugcuguuaccugag

SEQ ID NO: 490625 - RNA, 22 nt, Human
cagcagcagagauacugguuuc

SEQ ID NO: 490626 - RNA, 22 nt, Human
aaaaaugaauucuucaguggca

SEQ ID NO: 490627 - RNA, 22 nt, Human
uuaccaagcucugcauguuaag

SEQ ID NO: 490628 - RNA, 22 nt, Human
ugugccuacugauagagccaag

SEQ ID NO: 490629 - RNA, 22 nt, Human
uguccuggaucaugccucugaa

SEQ ID NO: 490630 - RNA, 22 nt, Human
uccuagaacuccaggacagucc

SEQ ID NO: 490631 - RNA, 22 nt, Human
uagcacuauuuuucacuauccu

SEQ ID NO: 490632 - RNA, 22 nt, Human
auuagcuuugguggaaaggagu

SEQ ID NO: 490633 - RNA, 22 nt, Human
ucucugggaucagguggcccag

SEQ ID NO: 490634 - RNA, 22 nt, Human
uguccugggucaaccaggucga

SEQ ID NO: 490635 - RNA, 22 nt, Human
accuggcuucagagucuggcca

SEQ ID NO: 490636 - RNA, 22 nt, Human
cagaugugccuccagggcuuug

SEQ ID NO: 490637 - RNA, 22 nt, Human
caaacauugcuaccagagguuu

SEQ ID NO: 490638 - RNA, 22 nt, Human
cagcagcacucugcgggucccc

SEQ ID NO: 490639 - RNA, 22 nt, Human
cagcagcaguggcugcagaaca

SEQ ID NO: 490640 - RNA, 22 nt, Human
uuguuuguaugcugagaagaau

SEQ ID NO: 490641 - RNA, 22 nt, Human
gccucuggucccucaugcugug

SEQ ID NO: 490642 - RNA, 22 nt, Human
ugauauuugcugacugcauugu

SEQ ID NO: 490643 - RNA, 23 nt, Human
ucugggccacuugucugcacuuc

SEQ ID NO: 490644 - RNA, 22 nt, Human
uugcccugucuuaagcuggcaa

SEQ ID NO: 490645 - RNA, 22 nt, Human
aauaagcugcuaggaacuuagu

SEQ ID NO: 490646 - RNA, 22 nt, Human
cauuuguaucugggcugcugug

SEQ ID NO: 490647 - RNA, 22 nt, Human
cagcacuaauccugcaauuucu

SEQ ID NO: 490648 - RNA, 22 nt, Human
ugcugaaugggauauguugagc

SEQ ID NO: 490649 - RNA, 22 nt, Human
agagccaggccaggccggggca

SEQ ID NO: 490650 - RNA, 22 nt, Human
uguccuggguggaugcuucauu

SEQ ID NO: 490651 - RNA, 22 nt, Human
uccuagaagauggaucagagaa

SEQ ID NO: 490652 - RNA, 22 nt, Human
cugcccuggguuuuaugggagu

SEQ ID NO: 490653 - RNA, 22 nt, Human
acacuaguggaaauugauuugu

SEQ ID NO: 490654 - RNA, 22 nt, Human
ucugaaugcacuuaguuaccaa

SEQ ID NO: 490655 - RNA, 22 nt, Human
ccuggacucaggcugugggcac

SEQ ID NO: 490656 - RNA, 22 nt, Human
uuacaaaguucugaguucaaac

SEQ ID NO: 490657 - RNA, 22 nt, Human
cauuuauugguuaggccagcag

SEQ ID NO: 490658 - RNA, 22 nt, Human
ugauauuuuaugagcuuucaua

SEQ ID NO: 490659 - RNA, 23 nt, Human
aaguagauaacacuguucugaga

SEQ ID NO: 490660 - RNA, 22 nt, Human
ugugugugcaggagagcaggug

SEQ ID NO: 490661 - RNA, 22 nt, Human
uggcuccuucauucuccugcca

SEQ ID NO: 490662 - RNA, 22 nt, Human
uguccugugccaccuuccugag

SEQ ID NO: 490663 - RNA, 22 nt, Human
gccuggcugaggccucugcuaa

SEQ ID NO: 490664 - RNA, 22 nt, Human
uccuggcuccuggagaccugcu

SEQ ID NO: 490665 - RNA, 22 nt, Human
gggaaacuagaagcaggguuau

SEQ ID NO: 490666 - RNA, 20 nt, Human
uccagcacccucacagagaa

SEQ ID NO: 490667 - RNA, 23 nt, Human
ugaaugauuguacugagcuuuua

SEQ ID NO: 490668 - RNA, 20 nt, Human
acaugaacagggcuacagca

SEQ ID NO: 490669 - RNA, 22 nt, Human
uuagcauuuucugggcugaaau

SEQ ID NO: 490670 - RNA, 22 nt, Human
uauguguggcagcugggagugu

SEQ ID NO: 490671 - RNA, 22 nt, Human
agcauguaaagcucuuagcacc

SEQ ID NO: 490672 - RNA, 22 nt, Human
acaggugguaaaauggacuguc

SEQ ID NO: 490673 - RNA, 22 nt, Human
cucugggcaggacgccaggccu

SEQ ID NO: 490674 - RNA, 22 nt, Human
auguguacaaccaagcacuaaa

SEQ ID NO: 490675 - RNA, 22 nt, Human
cuggcuccucaggacugcggga

SEQ ID NO: 490676 - RNA, 21 nt, Human
ugcacagggcccaggagagcc

SEQ ID NO: 490677 - RNA, 22 nt, Human
uguacacaaccuacagucugcu

SEQ ID NO: 490678 - RNA, 22 nt, Human
gaauagauccucauuuauugau

SEQ ID NO: 490679 - RNA, 22 nt, Human
auuauuugaguuccucucuacc

SEQ ID NO: 490680 - RNA, 22 nt, Human
acugggcccagugguguggcug

SEQ ID NO: 490681 - RNA, 22 nt, Human
gcuucagccucacacugauauc

SEQ ID NO: 490682 - RNA, 22 nt, Human
aaugauauagcagacauagccu

SEQ ID NO: 490683 - RNA, 22 nt, Human
aguccaaggccauacaguugug

SEQ ID NO: 490684 - RNA, 22 nt, Human
gcacagagccugguaccgagaa

SEQ ID NO: 490685 - RNA, 22 nt, Human
cacagauaccuagugaaacaua

SEQ ID NO: 490686 - RNA, 22 nt, Human
uuuguuuucaaugugucauuca

SEQ ID NO: 490687 - RNA, 22 nt, Human
cugcccuggccacugugcccag

SEQ ID NO: 490688 - RNA, 22 nt, Human
uugcugaaagguagcugugugg

SEQ ID NO: 490689 - RNA, 23 nt, Human
uuugugaaaguguugagaggaga

SEQ ID NO: 490690 - RNA, 22 nt, Human
uuguuuuaagccagucugccua

SEQ ID NO: 490691 - RNA, 22 nt, Human
agguccugucuaucacccucgc

SEQ ID NO: 490692 - RNA, 22 nt, Human
ucacacagauugguagagcuga

SEQ ID NO: 490693 - RNA, 22 nt, Human
acagagacaggcagacagucuu

SEQ ID NO: 490694 - RNA, 22 nt, Human
cacaguaaccccaggacuggga

SEQ ID NO: 490695 - RNA, 22 nt, Human
acacccuuguccauagcagaug

SEQ ID NO: 490696 - RNA, 22 nt, Human
acuuugcagggcuugauaucca

SEQ ID NO: 490697 - RNA, 22 nt, Human
aagucacaagcauauaugcauu

SEQ ID NO: 490698 - RNA, 20 nt, Human
auuuggcaugaaguauugau

SEQ ID NO: 490699 - RNA, 22 nt, Human
uccugucuuaaugaucucgugc

SEQ ID NO: 490700 - RNA, 22 nt, Human
ucugggcucuuaguguacccuc

SEQ ID NO: 490701 - RNA, 23 nt, Human
aggaagcuaaguguggcugcgga

SEQ ID NO: 490702 - RNA, 22 nt, Human
aauagauacuacuuagauguag

SEQ ID NO: 490703 - RNA, 21 nt, Human
uucugccuucgaggucucagg

SEQ ID NO: 490704 - RNA, 22 nt, Human
gaccacagaagccuugauaggg

SEQ ID NO: 490705 - RNA, 22 nt, Human
cugcccugacugaccuuuugaa

SEQ ID NO: 490706 - RNA, 22 nt, Human
gggaaacuucugcuaaaaccag

SEQ ID NO: 490707 - RNA, 22 nt, Human
caucagucccacggagcagccc

SEQ ID NO: 490708 - RNA, 22 nt, Human
aaagcagaggugauaugacuua

SEQ ID NO: 490709 - RNA, 21 nt, Human
ucauuugugaucugauuucca

SEQ ID NO: 490710 - RNA, 22 nt, Human
auguccagaggugagucagagc

SEQ ID NO: 490711 - RNA, 22 nt, Human
agcugcagcuuccuaguccagc

SEQ ID NO: 490712 - RNA, 22 nt, Human
gagcccgagcgcguacccggcg

SEQ ID NO: 490713 - RNA, 18 nt, Human
cacaggaaggggaauauc

SEQ ID NO: 490714 - RNA, 22 nt, Human
ccagcucuaaacggcucugugg

SEQ ID NO: 490715 - RNA, 22 nt, Human
aggccaggccuuucuccauucc

SEQ ID NO: 490716 - RNA, 22 nt, Human
gaaugauauauuagcagauuuu

SEQ ID NO: 490717 - RNA, 22 nt, Human
uguacagauaaagacuguaaau

SEQ ID NO: 490718 - RNA, 22 nt, Human
cuucagcagaugugcuagagau

SEQ ID NO: 490719 - RNA, 22 nt, Human
ccugggcucaccaugccuugga

SEQ ID NO: 490720 - RNA, 23 nt, Human
ugguccugccaacggugccccuc

SEQ ID NO: 490721 - RNA, 20 nt, Human
acacaugugcguguucagua

SEQ ID NO: 490722 - RNA, 22 nt, Human
ugcugaauuuacauuuuuguag

SEQ ID NO: 490723 - RNA, 20 nt, Human
uuagcuuuggcaauagugac

SEQ ID NO: 490724 - RNA, 22 nt, Human
gaauaacauuuuuuccuuuaca

SEQ ID NO: 490725 - RNA, 22 nt, Human
auuugugggacuauaaugcagg

SEQ ID NO: 490726 - RNA, 22 nt, Human
ucagcacugauagaagucaaua

SEQ ID NO: 490727 - RNA, 22 nt, Human
cuuagcagaauuccaagcuuga

SEQ ID NO: 490728 - RNA, 22 nt, Human
uggcccugcugggucagagcug

SEQ ID NO: 490729 - RNA, 22 nt, Human
ggaaacuuguuauuguauuuuc

SEQ ID NO: 490730 - RNA, 17 nt, Human
agcaggcacgucagcac

SEQ ID NO: 490731 - RNA, 22 nt, Human
gucugggcucccagggucggcg

SEQ ID NO: 490732 - RNA, 22 nt, Human
ugaaugaugguguguucuugcc

SEQ ID NO: 490733 - RNA, 22 nt, Human
gccuuagcaucuuaaagcugug

SEQ ID NO: 490734 - RNA, 21 nt, Human
uccuggcuuuaugcuaccucu

SEQ ID NO: 490735 - RNA, 17 nt, Human
uuacaacgucaucucug

SEQ ID NO: 490736 - RNA, 22 nt, Human
ugugugccagauacaagcacug

SEQ ID NO: 490737 - RNA, 22 nt, Human
uacaggguauagguacagauga

SEQ ID NO: 490738 - RNA, 22 nt, Human
augcugaacugagauguaacuu

SEQ ID NO: 490739 - RNA, 22 nt, Human
ugucuuuagaaagaagcagaca

SEQ ID NO: 490740 - RNA, 22 nt, Human
cagcagcaaggugaggguggag

SEQ ID NO: 490741 - RNA, 22 nt, Human
auguagcugcagaugauaaugc

SEQ ID NO: 490742 - RNA, 22 nt, Human
ugacacacagggggauggaguu

SEQ ID NO: 490743 - RNA, 22 nt, Human
gaauaacauuggaacccugaag

SEQ ID NO: 490744 - RNA, 22 nt, Human
cugaaugauauaagaucuuucu

SEQ ID NO: 490745 - RNA, 22 nt, Human
ggcacaagguuuaaauaacauc

SEQ ID NO: 490746 - RNA, 22 nt, Human
uccuggcuuagguuuccagaac

SEQ ID NO: 490747 - RNA, 18 nt, Human
ucagucuauuguauaaga

SEQ ID NO: 490748 - RNA, 22 nt, Human
ccagcacuccugucucaagucu

SEQ ID NO: 490749 - RNA, 22 nt, Human
uggaaauuaaaauuccucuuaa

SEQ ID NO: 490750 - RNA, 22 nt, Human
cagcagcagccccaggaagguu

SEQ ID NO: 490751 - RNA, 22 nt, Human
cagagccagcaguggggacagg

SEQ ID NO: 490752 - RNA, 22 nt, Human
uguccuggccaaggccuugcuu

SEQ ID NO: 490753 - RNA, 22 nt, Human
guguacauauugagucugcuga

SEQ ID NO: 490754 - RNA, 22 nt, Human
cagucacacaaguggacuuggg

SEQ ID NO: 490755 - RNA, 22 nt, Human
ucugggccugucucagagcugg

SEQ ID NO: 490756 - RNA, 22 nt, Human
agcagcaccuguccucgcugcu

SEQ ID NO: 490757 - RNA, 22 nt, Human
gcugccuguccugaggaguccg

SEQ ID NO: 490758 - RNA, 22 nt, Human
ucaguccucucuggguuucuua

SEQ ID NO: 490759 - RNA, 22 nt, Human
ugcugaaugugcucccuuuuaa

SEQ ID NO: 490760 - RNA, 21 nt, Human
augaaugauuucuacucuuaa

SEQ ID NO: 490761 - RNA, 22 nt, Human
agagccaggcucccauggggca

SEQ ID NO: 490762 - RNA, 22 nt, Human
ugggcuggcugaggcauucacu

SEQ ID NO: 490763 - RNA, 22 nt, Human
uguacagagacuaccauuaaua

SEQ ID NO: 490764 - RNA, 22 nt, Human
uagucacaaccuucaaguuguc

SEQ ID NO: 490765 - RNA, 22 nt, Human
ucaagacauauuaaaugugcga

SEQ ID NO: 490766 - RNA, 22 nt, Human
auuagcaugccaagcuuuuaga

SEQ ID NO: 490767 - RNA, 22 nt, Human
uuuaucuuuggaucuucagaaa

SEQ ID NO: 490768 - RNA, 22 nt, Human
gucuggcuuuauauuugcuauu

SEQ ID NO: 490769 - RNA, 22 nt, Human
ccagcagcuuuauuggcucucc

SEQ ID NO: 490770 - RNA, 22 nt, Human
ugucccugauccacuggacccc

SEQ ID NO: 490771 - RNA, 22 nt, Human
cugcccugugcacaggaaacug

SEQ ID NO: 490772 - RNA, 22 nt, Human
uuugugaaaugaagucacaacu

SEQ ID NO: 490773 - RNA, 22 nt, Human
aguauaugccagagagauagcu

SEQ ID NO: 490774 - RNA, 22 nt, Human
ccagccugaaaugccucauccu

SEQ ID NO: 490775 - RNA, 22 nt, Human
uuuuagaaguucaugugggauu

SEQ ID NO: 490776 - RNA, 22 nt, Human
auguuuuauguuccacucaagg

SEQ ID NO: 490777 - RNA, 21 nt, Human
caauuacagauggcucagggg

SEQ ID NO: 490778 - RNA, 22 nt, Human
uuaagaagguacucaaagaucu

SEQ ID NO: 490779 - RNA, 22 nt, Human
agucacaggguacacaaggauu

SEQ ID NO: 490780 - RNA, 22 nt, Human
augcccugccaagcaggcuaaa

SEQ ID NO: 490781 - RNA, 22 nt, Human
uucuuuuaauagagauccugug

SEQ ID NO: 490782 - RNA, 22 nt, Human
augcuugggacucccuguagca

SEQ ID NO: 490783 - RNA, 22 nt, Human
ugauuacaguauuugagaucca

SEQ ID NO: 490784 - RNA, 17 nt, Human
aggcagguaagaguuau

SEQ ID NO: 490785 - RNA, 22 nt, Human
aaguaacaucugaacaugaugu

SEQ ID NO: 490786 - RNA, 22 nt, Human
uuuguaaauagcaguacucaug

SEQ ID NO: 490787 - RNA, 22 nt, Human
cagucacauagguauacacaua

SEQ ID NO: 490788 - RNA, 22 nt, Human
gcacagaggaagcacagacucu

SEQ ID NO: 490789 - RNA, 20 nt, Human
ugguccugucccacccacuc

SEQ ID NO: 490790 - RNA, 22 nt, Human
ugggcaggggcccugcuuccgu

SEQ ID NO: 490791 - RNA, 22 nt, Human
uuuuuguggugcagacuaaagc

SEQ ID NO: 490792 - RNA, 22 nt, Human
aagaauguggguggauaugaug

SEQ ID NO: 490793 - RNA, 22 nt, Human
ugcaaagaagccuuugccuucu

SEQ ID NO: 490794 - RNA, 20 nt, Human
agcacuagguguggcaggug

SEQ ID NO: 490795 - RNA, 22 nt, Human
acaacacauguguauaugugug

SEQ ID NO: 490796 - RNA, 22 nt, Human
ccugaggucacaacuugcuuau

SEQ ID NO: 490797 - RNA, 22 nt, Human
cuucagcagccucuugcauaaa

SEQ ID NO: 490798 - RNA, 22 nt, Human
gcagggguggaggcuguccugu

SEQ ID NO: 490799 - RNA, 22 nt, Human
uugcccuguggggccuccagcc

SEQ ID NO: 490800 - RNA, 22 nt, Human
aaagacauggcaagagaugggg

SEQ ID NO: 490801 - RNA, 22 nt, Human
uuacauaguuaaauaguacagc

SEQ ID NO: 490802 - RNA, 22 nt, Human
agagccaggcggcugggcaccu

SEQ ID NO: 490803 - RNA, 22 nt, Human
gucccugcaucaccacgggacu

SEQ ID NO: 490804 - RNA, 22 nt, Human
gccuucugauugcuggacugac

SEQ ID NO: 490805 - RNA, 22 nt, Human
cuuuagaaggguaacggaauua

SEQ ID NO: 490806 - RNA, 22 nt, Human
gccuguggccgacugagagccu

SEQ ID NO: 490807 - RNA, 22 nt, Human
acugggccacauagaccugcug

SEQ ID NO: 490808 - RNA, 22 nt, Human
ugggcuccguugccuggggcag

SEQ ID NO: 490809 - RNA, 20 nt, Human
uaugauaauuacaaaauagu

SEQ ID NO: 490810 - RNA, 22 nt, Human
aaucuucauaaaaaucuaguag

SEQ ID NO: 490811 - RNA, 22 nt, Human
uggaaacucuaccucucuaaga

SEQ ID NO: 490812 - RNA, 22 nt, Human
ucuggccugaaaguccaugcuu

SEQ ID NO: 490813 - RNA, 22 nt, Human
cagcuucauugccugaugucuu

SEQ ID NO: 490814 - RNA, 18 nt, Human
uucuggcucacucaugcu

SEQ ID NO: 490815 - RNA, 22 nt, Human
cuuguuuuggcuaguaugaugu

SEQ ID NO: 490816 - RNA, 22 nt, Human
gacagacacaauugauccauga

SEQ ID NO: 490817 - RNA, 22 nt, Human
uugcugaaguaugaaaaagaca

SEQ ID NO: 490818 - RNA, 22 nt, Human
caggccucaugguguguccuuc

SEQ ID NO: 490819 - RNA, 22 nt, Human
ugguccuggccuugaccccagg

SEQ ID NO: 490820 - RNA, 18 nt, Human
guccacagcccucacagc

SEQ ID NO: 490821 - RNA, 22 nt, Human
aggaaacuggguaugguuauac

SEQ ID NO: 490822 - RNA, 22 nt, Human
ugaagcugugggcaguggagcc

SEQ ID NO: 490823 - RNA, 22 nt, Human
cuuugugaugaggccuaagaca

SEQ ID NO: 490824 - RNA, 22 nt, Human
agagccaggcucuaccuggguu

SEQ ID NO: 490825 - RNA, 22 nt, Human
auaugugugaugcauggacuaa

SEQ ID NO: 490826 - RNA, 22 nt, Human
auguccaggaagucuuaacuca

SEQ ID NO: 490827 - RNA, 22 nt, Human
uagauaauuuggcaucauauug

SEQ ID NO: 490828 - RNA, 22 nt, Human
gcugccugcucacccggccugg

SEQ ID NO: 490829 - RNA, 22 nt, Human
uccuagaacagcccaccuggaa

SEQ ID NO: 490830 - RNA, 22 nt, Human
gaauaauagcagaaauuagcag

SEQ ID NO: 490831 - RNA, 19 nt, Human
agagccagacagcauagga

SEQ ID NO: 490832 - RNA, 19 nt, Human
ccagcccugucacuucuug

SEQ ID NO: 490833 - RNA, 22 nt, Human
cacacaugguagcagguacaag

SEQ ID NO: 490834 - RNA, 22 nt, Human
ucauuuguggaagugauugugg

SEQ ID NO: 490835 - RNA, 22 nt, Human
guauuugucuuguuggucucca

SEQ ID NO: 490836 - RNA, 20 nt, Human
ugccuugggacagugccugu

SEQ ID NO: 490837 - RNA, 22 nt, Human
uucuuucucacucuuuaggaag

SEQ ID NO: 490838 - RNA, 22 nt, Human
uccugggcagaaugggauggcu

SEQ ID NO: 490839 - RNA, 22 nt, Human
gcacacaguagggauucaauga

SEQ ID NO: 490840 - RNA, 22 nt, Human
cucaguccgucccgcuaggugc

SEQ ID NO: 490841 - RNA, 22 nt, Human
uuagcauuguacauuugugcuu

SEQ ID NO: 490842 - RNA, 22 nt, Human
cacagguauauguguauauacu

SEQ ID NO: 490843 - RNA, 22 nt, Human
uuacaaagauuauauucaguua

SEQ ID NO: 490844 - RNA, 22 nt, Human
agacuacauaugccacaugaag

SEQ ID NO: 490845 - RNA, 22 nt, Human
auuugugauaauuuguuacagc

SEQ ID NO: 490846 - RNA, 22 nt, Human
gucacuguauccagguuccagc

SEQ ID NO: 490847 - RNA, 22 nt, Human
aucccagauagugacccucagg

SEQ ID NO: 490848 - RNA, 20 nt, Human
aguguacagacacuagaaau

SEQ ID NO: 490849 - RNA, 22 nt, Human
ccagcacugcucucagacugag

SEQ ID NO: 490850 - RNA, 17 nt, Human
gcacauguguucuuuua

SEQ ID NO: 490851 - RNA, 22 nt, Human
ucugggccugauggcuaaagcc

SEQ ID NO: 490852 - RNA, 22 nt, Human
ucuggcugauucccugggacug

SEQ ID NO: 490853 - RNA, 22 nt, Human
uuccuuuagugucauauacuuu

SEQ ID NO: 490854 - RNA, 22 nt, Human
augcagcugugggcaagaaaug

SEQ ID NO: 490855 - RNA, 23 nt, Human
auguccugcauaguugcuucugu

SEQ ID NO: 490856 - RNA, 22 nt, Human
ugaaaugagcauuuauucuuua

SEQ ID NO: 490857 - RNA, 22 nt, Human
gucugggcaccuggccugggaa

SEQ ID NO: 490858 - RNA, 22 nt, Human
uguccuggggcgacuuggggcc

SEQ ID NO: 490859 - RNA, 22 nt, Human
uuauuuguuuucugagaaguau

SEQ ID NO: 490860 - RNA, 22 nt, Human
cuggcucccuggacauggggcc

SEQ ID NO: 490861 - RNA, 22 nt, Human
ugcacaggugagacucaggaag

SEQ ID NO: 490862 - RNA, 22 nt, Human
uuaaaugaugcauaucauuuag

SEQ ID NO: 490863 - RNA, 22 nt, Human
auuagcuucaaagccaucaacc

SEQ ID NO: 490864 - RNA, 22 nt, Human
acagguguugacucacaggccc

SEQ ID NO: 490865 - RNA, 22 nt, Human
aguggcagagcaggugcuggaa

SEQ ID NO: 490866 - RNA, 22 nt, Human
agcugauacauuucuuguagcc

SEQ ID NO: 490867 - RNA, 22 nt, Human
auuagcuuaucacacaagcugc

SEQ ID NO: 490868 - RNA, 22 nt, Human
agggaaacuagacugccuuucu

SEQ ID NO: 490869 - RNA, 22 nt, Human
cugggccuuugcuuauuaauuu

SEQ ID NO: 490870 - RNA, 22 nt, Human
auuagcauaaguguucggugca

SEQ ID NO: 490871 - RNA, 22 nt, Human
gugauauuuuuaaagauuaagg

SEQ ID NO: 490872 - RNA, 22 nt, Human
ugcugauauauucuaguuuucu

SEQ ID NO: 490873 - RNA, 22 nt, Human
ugauucuguucuccuugagaau

SEQ ID NO: 490874 - RNA, 22 nt, Human
acagacauuuuaagacacuuua

SEQ ID NO: 490875 - RNA, 22 nt, Human
ggcugcugugaccucaggugau

SEQ ID NO: 490876 - RNA, 22 nt, Human
cugaaagaauaagauguuuaca

SEQ ID NO: 490877 - RNA, 22 nt, Human
guuuagaagccaagauuugggu

SEQ ID NO: 490878 - RNA, 22 nt, Human
guaaauaacugguaauuggggu

SEQ ID NO: 490879 - RNA, 22 nt, Human
gccuggcuugccagcccuggcg

SEQ ID NO: 490880 - RNA, 22 nt, Human
gugcccugaguggguaggagag

SEQ ID NO: 490881 - RNA, 22 nt, Human
gagccuggccuccugccucagc

SEQ ID NO: 490882 - RNA, 22 nt, Human
ucagcacuuugaagcagaagga

SEQ ID NO: 490883 - RNA, 22 nt, Human
ccagucuguacuuugcucuguu

SEQ ID NO: 490884 - RNA, 21 nt, Human
gccagccuguuuaccuguggu

SEQ ID NO: 490885 - RNA, 22 nt, Human
uuguccugauuuugcaacuucu

SEQ ID NO: 490886 - RNA, 22 nt, Human
uacagaagcuuuugaaaagaug

SEQ ID NO: 490887 - RNA, 20 nt, Human
cuuagcuaguaagaagcugu

SEQ ID NO: 490888 - RNA, 22 nt, Human
cuuagcagaagcuucagcuuca

SEQ ID NO: 490889 - RNA, 22 nt, Human
uuucauuauacagcuucauaaa

SEQ ID NO: 490890 - RNA, 22 nt, Human
cccaguggggagcugagguuca

SEQ ID NO: 490891 - RNA, 22 nt, Human
aaguugagaugucauaggagac

SEQ ID NO: 490892 - RNA, 22 nt, Human
augugugcaucaaugauagauc

SEQ ID NO: 490893 - RNA, 22 nt, Human
acugccuggccuggccucacug

SEQ ID NO: 490894 - RNA, 22 nt, Human
uuacauaaaaguucacguaggc

SEQ ID NO: 490895 - RNA, 22 nt, Human
uuaaaugaggcugauguagauu

SEQ ID NO: 490896 - RNA, 22 nt, Human
gugccugggacuugcuccggau

SEQ ID NO: 490897 - RNA, 22 nt, Human
gcuucagccgggcacuuaauga

SEQ ID NO: 490898 - RNA, 22 nt, Human
uugcccuggggcuggccuggca

SEQ ID NO: 490899 - RNA, 22 nt, Human
uugaaugaagucccuuuuuacu

SEQ ID NO: 490900 - RNA, 22 nt, Human
gaccacagacuggaaagagggc

SEQ ID NO: 490901 - RNA, 22 nt, Human
aaugaagaaauggacaucuuua

SEQ ID NO: 490902 - RNA, 22 nt, Human
auuauuagugauguuguuacug

SEQ ID NO: 490903 - RNA, 22 nt, Human
uacaaugagcuguacaucucca

SEQ ID NO: 490904 - RNA, 22 nt, Human
agaaaguuaaacagugauaaga

SEQ ID NO: 490905 - RNA, 22 nt, Human
guguccuguuucccugucuaua

SEQ ID NO: 490906 - RNA, 22 nt, Human
agacauaagugcuaugacauug

SEQ ID NO: 490907 - RNA, 22 nt, Human
gaucuugaaauaucuuuuccua

SEQ ID NO: 490908 - RNA, 22 nt, Human
ucagcacuuggauuucagagau

SEQ ID NO: 490909 - RNA, 22 nt, Human
ucauuauuuuggacuggagugu

SEQ ID NO: 490910 - RNA, 22 nt, Human
ugacagagcauguagugacagc

SEQ ID NO: 490911 - RNA, 22 nt, Human
gggcaggagagaacagucaugg

SEQ ID NO: 490912 - RNA, 22 nt, Human
uguccuggggacaagaggcccu

SEQ ID NO: 490913 - RNA, 22 nt, Human
aaacacugugggacaucuuacu

SEQ ID NO: 490914 - RNA, 22 nt, Human
cugcccugggccaggaagcggc

SEQ ID NO: 490915 - RNA, 22 nt, Human
uugucugacuucuuuaguuacu

SEQ ID NO: 490916 - RNA, 22 nt, Human
aggacuuagaacauuauguacu

SEQ ID NO: 490917 - RNA, 22 nt, Human
augcccugugguucaugugaga

SEQ ID NO: 490918 - RNA, 22 nt, Human
uaucauuuuacugugacauuuu

SEQ ID NO: 490919 - RNA, 22 nt, Human
acagguguagcaggagcaucaa

SEQ ID NO: 490920 - RNA, 22 nt, Human
uguccuguucuugcuguguccu

SEQ ID NO: 490921 - RNA, 21 nt, Human
ugaaugaugccccagaguugu

SEQ ID NO: 490922 - RNA, 21 nt, Human
auuuagaaggaaauuuugcaa

SEQ ID NO: 490923 - RNA, 22 nt, Human
cacauuuaaagguugaagcuga

SEQ ID NO: 490924 - RNA, 22 nt, Human
acaggacaggcugggcuagacu

SEQ ID NO: 490925 - RNA, 22 nt, Human
uacacaugacaguggacugaga

SEQ ID NO: 490926 - RNA, 22 nt, Human
gggcugccaagccugccugccu

SEQ ID NO: 490927 - RNA, 22 nt, Human
caggcacaagaagcaaauguua

SEQ ID NO: 490928 - RNA, 22 nt, Human
ucacacaggguucuggucucau

SEQ ID NO: 490929 - RNA, 22 nt, Human
cacugauuaagucugcuagagg

SEQ ID NO: 490930 - RNA, 22 nt, Human
uagccacaugcagacuuucaug

SEQ ID NO: 490931 - RNA, 22 nt, Human
ccugguguugccaaucugugcc

SEQ ID NO: 490932 - RNA, 22 nt, Human
uuuauucuagcucagaauaguu

SEQ ID NO: 490933 - RNA, 22 nt, Human
ugcugaauaagacguggcuugu

SEQ ID NO: 490934 - RNA, 22 nt, Human
uguguacacacagauauauaca

SEQ ID NO: 490935 - RNA, 22 nt, Human
gcagcagcucugaaugggcccc

SEQ ID NO: 490936 - RNA, 22 nt, Human
ucugaauguaucgaauugaggc

SEQ ID NO: 490937 - RNA, 20 nt, Human
uaucuaaaugcuuacauuac

SEQ ID NO: 490938 - RNA, 19 nt, Human
cuuauuagagugagagcuu

SEQ ID NO: 490939 - RNA, 22 nt, Human
gccuggcucugaguuucucucc

SEQ ID NO: 490940 - RNA, 22 nt, Human
uugcccugucucacuauguuaa

SEQ ID NO: 490941 - RNA, 22 nt, Human
uugcugaagaaaaaauauguua

SEQ ID NO: 490942 - RNA, 22 nt, Human
gugcuccucacaguguggcccu

SEQ ID NO: 490943 - RNA, 20 nt, Human
uccuaauaaccugaagaaau

SEQ ID NO: 490944 - RNA, 22 nt, Human
ccuuacaaugcaguuuacuuag

SEQ ID NO: 490945 - RNA, 22 nt, Human
guauuuguaguagcauagaauu

SEQ ID NO: 490946 - RNA, 22 nt, Human
aguccuggcucuacgggcuuca

SEQ ID NO: 490947 - RNA, 22 nt, Human
uugcccugcagcggugaguggu

SEQ ID NO: 490948 - RNA, 22 nt, Human
gaagcuucguggcucuucaaau

SEQ ID NO: 490949 - RNA, 23 nt, Human
ugaaacauuuaggguagaauuuc

SEQ ID NO: 490950 - RNA, 22 nt, Human
auucuguguuaggauagauggu

SEQ ID NO: 490951 - RNA, 22 nt, Human
cuuaggauuuaauuucagacuc

SEQ ID NO: 490952 - RNA, 22 nt, Human
ugcuuauuaaacaugcauauuc

SEQ ID NO: 490953 - RNA, 22 nt, Human
uugcuaauaaaguuuuuaugug

SEQ ID NO: 490954 - RNA, 22 nt, Human
uuuugugagcugagaaauguau

SEQ ID NO: 490955 - RNA, 22 nt, Human
ugagagguaggaaaugaacaag

SEQ ID NO: 490956 - RNA, 22 nt, Human
agucacauuugggggugucaaa

SEQ ID NO: 490957 - RNA, 22 nt, Human
guguacaguaagugaaucuagg

SEQ ID NO: 490958 - RNA, 22 nt, Human
uauuuggacaccaaguagaagu

SEQ ID NO: 490959 - RNA, 22 nt, Human
cuucagcaccauagcuccuucu

SEQ ID NO: 490960 - RNA, 22 nt, Human
uagucacacaauuguguacauu

SEQ ID NO: 490961 - RNA, 21 nt, Human
uguccuggucacugcucuccc

SEQ ID NO: 490962 - RNA, 22 nt, Human
cccagccugucuuucccaauga

SEQ ID NO: 490963 - RNA, 22 nt, Human
cagccucuaagcacagccucuc

SEQ ID NO: 490964 - RNA, 22 nt, Human
uuuguagaacuauacuuacauu

SEQ ID NO: 490965 - RNA, 22 nt, Human
auuagcuuuauuugaaauagga

SEQ ID NO: 490966 - RNA, 22 nt, Human
gagcuccagcaucucugccaaa

SEQ ID NO: 490967 - RNA, 22 nt, Human
ucaucacucauuggacaacaga

SEQ ID NO: 490968 - RNA, 22 nt, Human
cugcccugaccugccucagagu

SEQ ID NO: 490969 - RNA, 22 nt, Human
uauuugucuuucuuauaagaau

SEQ ID NO: 490970 - RNA, 22 nt, Human
aaaacaguuuuugcuaacugcu

SEQ ID NO: 490971 - RNA, 22 nt, Human
ugugcauagacuuucaccaccu

SEQ ID NO: 490972 - RNA, 22 nt, Human
uuguccugucaggcugggggcu

SEQ ID NO: 490973 - RNA, 21 nt, Human
ugaaugaucugguugccuuuu

SEQ ID NO: 490974 - RNA, 22 nt, Human
acauauauuacuaguaaagaca

SEQ ID NO: 490975 - RNA, 22 nt, Human
cauaauaucuccgauuacuugc

SEQ ID NO: 490976 - RNA, 22 nt, Human
auguccagaguguccuggaaag

SEQ ID NO: 490977 - RNA, 22 nt, Human
ucauguacauguaagucagaaa

SEQ ID NO: 490978 - RNA, 22 nt, Human
uuagcuuaauuaaauaaucagu

SEQ ID NO: 490979 - RNA, 22 nt, Human
aguucagcuucccaggucacug

SEQ ID NO: 490980 - RNA, 22 nt, Human
ggcugcggaucuaaggcuggga

SEQ ID NO: 490981 - RNA, 22 nt, Human
ugccaccuggacaaccuuaugc

SEQ ID NO: 490982 - RNA, 22 nt, Human
uccuggcuuccugcucuuguca

SEQ ID NO: 490983 - RNA, 22 nt, Human
gccuucugugcuccuggccuuu

SEQ ID NO: 490984 - RNA, 18 nt, Human
ccuguguguguugcaggc

SEQ ID NO: 490985 - RNA, 22 nt, Human
cuggcuccugaggcuuggcccc

SEQ ID NO: 490986 - RNA, 22 nt, Human
uuucacauaugguuguugauug

SEQ ID NO: 490987 - RNA, 23 nt, Human
uuguauuuuuaguagagacaggg

SEQ ID NO: 490988 - RNA, 22 nt, Human
ggcugcucuccaucccaggccu

SEQ ID NO: 490989 - RNA, 20 nt, Human
uccugagugcaguuggcuug

SEQ ID NO: 490990 - RNA, 22 nt, Human
uagcuauuguugguaguuaccc

SEQ ID NO: 490991 - RNA, 22 nt, Human
aguguacaaaaugauagauaaa

SEQ ID NO: 490992 - RNA, 22 nt, Human
cuggcucccaugagcucucacg

SEQ ID NO: 490993 - RNA, 22 nt, Human
uguuuuaagcucuagaagggga

SEQ ID NO: 490994 - RNA, 22 nt, Human
cagauguggaaugcagcaggcu

SEQ ID NO: 490995 - RNA, 22 nt, Human
cauuugugcuuuuauaaaauag

SEQ ID NO: 490996 - RNA, 22 nt, Human
ggaaacuuggcauaauuuuaag

SEQ ID NO: 490997 - RNA, 22 nt, Human
uucuugauuagucucaugccaa

SEQ ID NO: 490998 - RNA, 22 nt, Human
uauaauuaguaaauggcagauu

SEQ ID NO: 490999 - RNA, 22 nt, Human
gucaugccagcggagcucggga

SEQ ID NO: 491000 - RNA, 22 nt, Human
auuuguguuguauuaagcugcu

SEQ ID NO: 491001 - RNA, 22 nt, Human
gcacacagcuagauuaccauuc

SEQ ID NO: 491002 - RNA, 22 nt, Human
ggcuucaggggcccagucagca

SEQ ID NO: 491003 - RNA, 22 nt, Human
auucauuuagguauucacuuac

SEQ ID NO: 491004 - RNA, 22 nt, Human
uguccugggaaugggaugcagu

SEQ ID NO: 491005 - RNA, 22 nt, Human
aaaaugaugcuguaauuuggca

SEQ ID NO: 491006 - RNA, 22 nt, Human
uccuagaaugcaccucugcugu

SEQ ID NO: 491007 - RNA, 22 nt, Human
cugcccugugguuguggguucu

SEQ ID NO: 491008 - RNA, 22 nt, Human
uauuagcuuuagccuuuggaug

SEQ ID NO: 491009 - RNA, 22 nt, Human
acuuggcaaguaucuauaaagu

SEQ ID NO: 491010 - RNA, 20 nt, Human
aaaaugaugggcagggcagg

SEQ ID NO: 491011 - RNA, 22 nt, Human
ccuuagcauuagaagcuguggg

SEQ ID NO: 491012 - RNA, 22 nt, Human
augugcaggauccaggcuccua

SEQ ID NO: 491013 - RNA, 22 nt, Human
cacaugugcaguuacaugaauu

SEQ ID NO: 491014 - RNA, 22 nt, Human
guaacauuuacaguuccuagag

SEQ ID NO: 491015 - RNA, 19 nt, Human
cuguggccuccaggaggga

SEQ ID NO: 491016 - RNA, 22 nt, Human
aagcuucaguggacuguagugu

SEQ ID NO: 491017 - RNA, 22 nt, Human
cuguagcaaguuauucaauaaa

SEQ ID NO: 491018 - RNA, 22 nt, Human
cugccugcacugccuggcucca

SEQ ID NO: 491019 - RNA, 22 nt, Human
auaagccugauucacuugucau

SEQ ID NO: 491020 - RNA, 22 nt, Human
agucuucacucuucacuacuau

SEQ ID NO: 491021 - RNA, 22 nt, Human
aaguugaaucaguaacacaguu

SEQ ID NO: 491022 - RNA, 22 nt, Human
uggcuccguuguacaggcugga

SEQ ID NO: 491023 - RNA, 22 nt, Human
uuuagugauucauuuagaaaaa

SEQ ID NO: 491024 - RNA, 23 nt, Human
cugcccugaucuugaucuauugu

SEQ ID NO: 491025 - RNA, 22 nt, Human
uguccuggaguuauaaugccug

SEQ ID NO: 491026 - RNA, 22 nt, Human
ugccaggcauuugacagacacu

SEQ ID NO: 491027 - RNA, 22 nt, Human
ucaugccaauuucugcauggcu

SEQ ID NO: 491028 - RNA, 22 nt, Human
ugugugugugcgcgcacgcaua

SEQ ID NO: 491029 - RNA, 22 nt, Human
uuagcaucugcuguaagcuuau

SEQ ID NO: 491030 - RNA, 22 nt, Human
cugaggccgucugggucugcag

SEQ ID NO: 491031 - RNA, 22 nt, Human
auacuugagguagcaacuuaag

SEQ ID NO: 491032 - RNA, 18 nt, Human
cugucuuuuuucucucca

SEQ ID NO: 491033 - RNA, 22 nt, Human
uuuguuugccacacaaaacagu

SEQ ID NO: 491034 - RNA, 22 nt, Human
cacagcagaaaguguaggagga

SEQ ID NO: 491035 - RNA, 22 nt, Human
cucagcacuuuggaaggcugau

SEQ ID NO: 491036 - RNA, 22 nt, Human
uaucacuacaccuggcuaauua

SEQ ID NO: 491037 - RNA, 22 nt, Human
uggacuccagugucuguguucu

SEQ ID NO: 491038 - RNA, 22 nt, Human
auauuagcagugaucaaaaugg

SEQ ID NO: 491039 - RNA, 22 nt, Human
uuguccugaggacuguuaucag

SEQ ID NO: 491040 - RNA, 18 nt, Human
uauucuguccuaugaagc

SEQ ID NO: 491041 - RNA, 22 nt, Human
gcacaggaggccgaugcucaug

SEQ ID NO: 491042 - RNA, 22 nt, Human
acaggcacuuugacaugccauc

SEQ ID NO: 491043 - RNA, 22 nt, Human
auauuuguaguggguaagaagu

SEQ ID NO: 491044 - RNA, 20 nt, Human
augcccuguccucuucuguu

SEQ ID NO: 491045 - RNA, 22 nt, Human
auguuauuaaaguacagauucu

SEQ ID NO: 491046 - RNA, 22 nt, Human
cagagccaucaugauauggagu

SEQ ID NO: 491047 - RNA, 22 nt, Human
augcccuggacuucuaguauuc

SEQ ID NO: 491048 - RNA, 22 nt, Human
uccucuggggcgugguccugga

SEQ ID NO: 491049 - RNA, 22 nt, Human
aguggcagagucaggguuugga

SEQ ID NO: 491050 - RNA, 22 nt, Human
aggcacagauuuggggaaagca

SEQ ID NO: 491051 - RNA, 22 nt, Human
caucacagguccugaugacauu

SEQ ID NO: 491052 - RNA, 22 nt, Human
gccuggcugcucagccacucac

SEQ ID NO: 491053 - RNA, 22 nt, Human
gaccacagcagugcaagaggag

SEQ ID NO: 491054 - RNA, 22 nt, Human
uuaauuaaauucaugagcauug

SEQ ID NO: 491055 - RNA, 22 nt, Human
ggcuccuggaggcaccacuggu

SEQ ID NO: 491056 - RNA, 22 nt, Human
cugaaugaggaaaagagugagg

SEQ ID NO: 491057 - RNA, 22 nt, Human
acagagucucaaaccuacaaag

SEQ ID NO: 491058 - RNA, 22 nt, Human
uauacaaguaaugcugaaugau

SEQ ID NO: 491059 - RNA, 22 nt, Human
ccuuugggguccugccugggcu

SEQ ID NO: 491060 - RNA, 22 nt, Human
uuuucauuguuccucgagcauu

SEQ ID NO: 491061 - RNA, 19 nt, Human
ggcuucagggaguuagcau

SEQ ID NO: 491062 - RNA, 22 nt, Human
ugcuagugugugagauguucaa

SEQ ID NO: 491063 - RNA, 22 nt, Human
gugugcaggcuugaggauuagg

SEQ ID NO: 491064 - RNA, 22 nt, Human
gugcugaauugugcucuuuaca

SEQ ID NO: 491065 - RNA, 22 nt, Human
ggucugcccuggguggaggcgc

SEQ ID NO: 491066 - RNA, 20 nt, Human
agacccuguguccuguggcc

SEQ ID NO: 491067 - RNA, 22 nt, Human
auucauguuagcccacauguag

SEQ ID NO: 491068 - RNA, 22 nt, Human
ccugaaugccugacauuucacu

SEQ ID NO: 491069 - RNA, 22 nt, Human
guugcugaaggcaugccagaga

SEQ ID NO: 491070 - RNA, 22 nt, Human
guggcucucgccagccugcggg

SEQ ID NO: 491071 - RNA, 22 nt, Human
acagaaauugggcaaauggaag

SEQ ID NO: 491072 - RNA, 22 nt, Human
uugauuacuauguguugaaagc

SEQ ID NO: 491073 - RNA, 22 nt, Human
agccuauuccaggaugagcuca

SEQ ID NO: 491074 - RNA, 22 nt, Human
gugggcugcccuugaggucagc

SEQ ID NO: 491075 - RNA, 22 nt, Human
gugcccugaucgcuaggcuccc

SEQ ID NO: 491076 - RNA, 22 nt, Human
gaucuugagcaaguuguguaac

SEQ ID NO: 491077 - RNA, 22 nt, Human
cuacagaggacacaaagaucuu

SEQ ID NO: 491078 - RNA, 22 nt, Human
uuugaugaguuuaauaacagcc

SEQ ID NO: 491079 - RNA, 22 nt, Human
auauuuguuuggcagaguucag

SEQ ID NO: 491080 - RNA, 22 nt, Human
gcccuuagccuuauagccucua

SEQ ID NO: 491081 - RNA, 22 nt, Human
ggagcugcacgcucugaagccu

SEQ ID NO: 491082 - RNA, 22 nt, Human
ccugugucaucagcuguggcua

SEQ ID NO: 491083 - RNA, 22 nt, Human
cauuugcagagggugacacucu

SEQ ID NO: 491084 - RNA, 22 nt, Human
augcagcuucaggauuaugaug

SEQ ID NO: 491085 - RNA, 22 nt, Human
ccugggccaggcuugggaaugc

SEQ ID NO: 491086 - RNA, 22 nt, Human
acauagaacuucccagugagca

SEQ ID NO: 491087 - RNA, 22 nt, Human
uucagcaccacuuccagagaag

SEQ ID NO: 491088 - RNA, 22 nt, Human
uugcauuagugucauaaggugg

SEQ ID NO: 491089 - RNA, 22 nt, Human
uugcuaaaggauuuuguauuua

SEQ ID NO: 491090 - RNA, 22 nt, Human
guccacagggauggccacacau

SEQ ID NO: 491091 - RNA, 22 nt, Human
agaaacuucagcuauucuuuug

SEQ ID NO: 491092 - RNA, 22 nt, Human
ucccuggcagcuaagggugguc

SEQ ID NO: 491093 - RNA, 22 nt, Human
ucauuugugugagugauuugac

SEQ ID NO: 491094 - RNA, 22 nt, Human
agaaauggaaauccaagcaacu

SEQ ID NO: 491095 - RNA, 22 nt, Human
cgcauccagggcgcaggaucug

SEQ ID NO: 491096 - RNA, 22 nt, Human
ugcauuaaaaugugccucucuu

SEQ ID NO: 491097 - RNA, 22 nt, Human
ucugggccagugauuuuuccag

SEQ ID NO: 491098 - RNA, 22 nt, Human
uuuucauuuacauuagggaaga

SEQ ID NO: 491099 - RNA, 22 nt, Human
cuuauuugcccauguuucuuua

SEQ ID NO: 491100 - RNA, 22 nt, Human
uuaucugucuaucaagacuagc

SEQ ID NO: 491101 - RNA, 22 nt, Human
uggcuccugcagaccaucugga

SEQ ID NO: 491102 - RNA, 17 nt, Human
guccuggugugugagga

SEQ ID NO: 491103 - RNA, 22 nt, Human
gaauauauuucucuuaccuuua

SEQ ID NO: 491104 - RNA, 22 nt, Human
caucuugaagguuucuuuagcu

SEQ ID NO: 491105 - RNA, 22 nt, Human
auucuacaaaagaacuggaucu

SEQ ID NO: 491106 - RNA, 23 nt, Human
cagaugugcaacucuaggcaaug

SEQ ID NO: 491107 - RNA, 23 nt, Human
guccuagugcuuggugcccaggc

SEQ ID NO: 491108 - RNA, 22 nt, Human
auuuuguggcagaugcagaacc

SEQ ID NO: 491109 - RNA, 22 nt, Human
ugaacagaucaauagaacugac

SEQ ID NO: 491110 - RNA, 22 nt, Human
gcuaaugacugaguuuuuagca

SEQ ID NO: 491111 - RNA, 22 nt, Human
ugcacaggugguccaucugcac

SEQ ID NO: 491112 - RNA, 22 nt, Human
ucugcugacauuuaugaauaga

SEQ ID NO: 491113 - RNA, 22 nt, Human
aacggcuguggcuggcggcagc

SEQ ID NO: 491114 - RNA, 22 nt, Human
ucacuagucaucaacuuccauu

SEQ ID NO: 491115 - RNA, 22 nt, Human
aagcuuacaguuccacguagca

SEQ ID NO: 491116 - RNA, 22 nt, Human
uacuagucuucugcuauucccu

SEQ ID NO: 491117 - RNA, 23 nt, Human
aguaacaugcaaauaacagucug

SEQ ID NO: 491118 - RNA, 23 nt, Human
uccuggcucugcacuugcuaaug

SEQ ID NO: 491119 - RNA, 19 nt, Human
agcauuuggaauucuacac

SEQ ID NO: 491120 - RNA, 22 nt, Human
acaguggugagugacugauagg

SEQ ID NO: 491121 - RNA, 22 nt, Human
ugcaaggcuugcaauggugauc

SEQ ID NO: 491122 - RNA, 22 nt, Human
cuugagcacagcggcuucagga

SEQ ID NO: 491123 - RNA, 22 nt, Human
cuuauuuguacuaauaaaucug

SEQ ID NO: 491124 - RNA, 20 nt, Human
agcuucaggcucaagagaac

SEQ ID NO: 491125 - RNA, 22 nt, Human
gcugggcuucaccuccagaguu

SEQ ID NO: 491126 - RNA, 22 nt, Human
agagccaggaugucuucugggg

SEQ ID NO: 491127 - RNA, 22 nt, Human
guccugguagggcucugugucu

SEQ ID NO: 491128 - RNA, 23 nt, Human
ugaaugauggugcuccucaucuu

SEQ ID NO: 491129 - RNA, 19 nt, Human
cgccuggcaggcccugcgc

SEQ ID NO: 491130 - RNA, 22 nt, Human
aauuugugaaucugucucuuga

SEQ ID NO: 491131 - RNA, 22 nt, Human
uggcuucugcuuucaguggagg

SEQ ID NO: 491132 - RNA, 21 nt, Human
uggcaggcagcuggaagcuug

SEQ ID NO: 491133 - RNA, 22 nt, Human
gcagcagcccagggcucucaga

SEQ ID NO: 491134 - RNA, 22 nt, Human
ugagaggugaggcaugaggcau

SEQ ID NO: 491135 - RNA, 22 nt, Human
auuauuugcuuggcucaucuaa

SEQ ID NO: 491136 - RNA, 22 nt, Human
uuaacauuguccuuagcagauu

SEQ ID NO: 491137 - RNA, 19 nt, Human
acugccugaggcucacagg

SEQ ID NO: 491138 - RNA, 22 nt, Human
guggcucuguaaaaugccugca

SEQ ID NO: 491139 - RNA, 22 nt, Human
auguaucacagcaauguaguca

SEQ ID NO: 491140 - RNA, 22 nt, Human
auuuauuaugggauuuggcaca

SEQ ID NO: 491141 - RNA, 22 nt, Human
ucuauuuguucucaggaucauc

SEQ ID NO: 491142 - RNA, 22 nt, Human
ucacauguuaggucgggcaagg

SEQ ID NO: 491143 - RNA, 22 nt, Human
cuccugugguacucccagggcc

SEQ ID NO: 491144 - RNA, 22 nt, Human
agccucugucaagcuuuucaaa

SEQ ID NO: 491145 - RNA, 22 nt, Human
accuucugaccaguuaucuuga

SEQ ID NO: 491146 - RNA, 22 nt, Human
gaagacaucauggagaggauag

SEQ ID NO: 491147 - RNA, 22 nt, Human
uuauuuguggcauccauguugg

SEQ ID NO: 491148 - RNA, 22 nt, Human
cugcccugggauggucugugcg

SEQ ID NO: 491149 - RNA, 22 nt, Human
uguguacaaacuaacaacauau

SEQ ID NO: 491150 - RNA, 22 nt, Human
cauuuguauagugcuuagacca

SEQ ID NO: 491151 - RNA, 22 nt, Human
uucagcacccucugaggcaucc

SEQ ID NO: 491152 - RNA, 22 nt, Human
auucagcauaaucaguagcuug

SEQ ID NO: 491153 - RNA, 22 nt, Human
agaauuacauaaauacaugaau

SEQ ID NO: 491154 - RNA, 22 nt, Human
cugcccucccaguugguccgug

SEQ ID NO: 491155 - RNA, 22 nt, Human
ugucucugcugcaccuucuggg

SEQ ID NO: 491156 - RNA, 18 nt, Human
ccucggagccuccguguc

SEQ ID NO: 491157 - RNA, 22 nt, Human
cucagucucuugggcugugaag

SEQ ID NO: 491158 - RNA, 20 nt, Human
cugggcucgguggcccuggc

SEQ ID NO: 491159 - RNA, 22 nt, Human
ugugggaggaacacagccagaa

SEQ ID NO: 491160 - RNA, 22 nt, Human
uguaccacucuacuaaggguuc

SEQ ID NO: 491161 - RNA, 22 nt, Human
uguccuggccuccagaaagucg

SEQ ID NO: 491162 - RNA, 18 nt, Human
uccuuagcugagcuuguc

SEQ ID NO: 491163 - RNA, 22 nt, Human
cccucuggcucuucucaggccg

SEQ ID NO: 491164 - RNA, 21 nt, Human
augugcagcaagcagcaugcu

SEQ ID NO: 491165 - RNA, 22 nt, Human
uuuauuugaaucaggggagaau

SEQ ID NO: 491166 - RNA, 20 nt, Human
gucuuuauguuuuaugaccu

SEQ ID NO: 491167 - RNA, 22 nt, Human
auguuuuauuaccaacuuguac

SEQ ID NO: 491168 - RNA, 20 nt, Human
uauuuacaacuuagagccuc

SEQ ID NO: 491169 - RNA, 22 nt, Human
augcugaaugaaagaaauuagu

SEQ ID NO: 491170 - RNA, 22 nt, Human
ugcuucagugugucauuauuua

SEQ ID NO: 491171 - RNA, 22 nt, Human
ugagccagagagguugaggcua

SEQ ID NO: 491172 - RNA, 22 nt, Human
cugggcccacgagggcucuggg

SEQ ID NO: 491173 - RNA, 22 nt, Human
aaguccauucuuccagccagcu

SEQ ID NO: 491174 - RNA, 22 nt, Human
cuguccuggccgcccuugugag

SEQ ID NO: 491175 - RNA, 22 nt, Human
ucagaggagcaaaagaggggau

SEQ ID NO: 491176 - RNA, 20 nt, Human
agguccuguuccuugucucc

SEQ ID NO: 491177 - RNA, 22 nt, Human
acagauguaaucuauucacauu

SEQ ID NO: 491178 - RNA, 22 nt, Human
gcagcagcaggcgcucggccgu

SEQ ID NO: 491179 - RNA, 22 nt, Human
gccagccugugcuuggccaggc

SEQ ID NO: 491180 - RNA, 22 nt, Human
gcagccaggggcugugaccugu

SEQ ID NO: 491181 - RNA, 22 nt, Human
ccuuagcagggagucuguccag

SEQ ID NO: 491182 - RNA, 22 nt, Human
ugccagccagggaagcucaccc

SEQ ID NO: 491183 - RNA, 22 nt, Human
cacacagguauauauauguaca

SEQ ID NO: 491184 - RNA, 22 nt, Human
ucugggccaacccuuccauggg

SEQ ID NO: 491185 - RNA, 22 nt, Human
gcccuuaggcaagcagaagccc

SEQ ID NO: 491186 - RNA, 16 nt, Human
uuguccugucucacug

SEQ ID NO: 491187 - RNA, 22 nt, Human
uagucacaguacaggauaaaga

SEQ ID NO: 491188 - RNA, 22 nt, Human
uaagcuucaaagaacauauugg

SEQ ID NO: 491189 - RNA, 22 nt, Human
ucccagggauuaggacauggau

SEQ ID NO: 491190 - RNA, 22 nt, Human
cuguggagugcuuggcucagug

SEQ ID NO: 491191 - RNA, 19 nt, Human
ucauuuguuaguagaaguu

SEQ ID NO: 491192 - RNA, 22 nt, Human
cauguaauccuggggagaugaa

SEQ ID NO: 491193 - RNA, 22 nt, Human
cacaggaaugaacagggaaaga

SEQ ID NO: 491194 - RNA, 22 nt, Human
caggcacacccacuggugcaga

SEQ ID NO: 491195 - RNA, 22 nt, Human
uuuagcuucauuuggcgugauu

SEQ ID NO: 491196 - RNA, 22 nt, Human
cugcccugcuugaugacagcga

SEQ ID NO: 491197 - RNA, 22 nt, Human
cugcccugcuaaugaguuccaa

SEQ ID NO: 491198 - RNA, 22 nt, Human
caucacugaaccccaacuuucu

SEQ ID NO: 491199 - RNA, 22 nt, Human
cugccuguggucugugaucuaa

SEQ ID NO: 491200 - RNA, 22 nt, Human
uuuauguuugacaaugaucugg

SEQ ID NO: 491201 - RNA, 22 nt, Human
guacagagaagguuacauauga

SEQ ID NO: 491202 - RNA, 22 nt, Human
uauuagcuguguaacucugguu

SEQ ID NO: 491203 - RNA, 22 nt, Human
uccugggcaaagaggggcagug

SEQ ID NO: 491204 - RNA, 22 nt, Human
uucugggcccacuguagcaucc

SEQ ID NO: 491205 - RNA, 22 nt, Human
auuagcuuaucccauuucugaa

SEQ ID NO: 491206 - RNA, 22 nt, Human
cauggacagugggacagugugu

SEQ ID NO: 491207 - RNA, 22 nt, Human
cagcaaggguuauaucaaagau

SEQ ID NO: 491208 - RNA, 22 nt, Human
caaggccugacugcuugucuaa

SEQ ID NO: 491209 - RNA, 22 nt, Human
cacaugugugcugaggacugug

SEQ ID NO: 491210 - RNA, 22 nt, Human
uguccugggucaaauccugguc

SEQ ID NO: 491211 - RNA, 22 nt, Human
ggcuccuguccccucagcugcu

SEQ ID NO: 491212 - RNA, 22 nt, Human
uguuuuaaagccauugccuuuc

SEQ ID NO: 491213 - RNA, 21 nt, Human
ugccuuggcaaaugaccauga

SEQ ID NO: 491214 - RNA, 22 nt, Human
ggaaacuaaagagguguuuuug

SEQ ID NO: 491215 - RNA, 22 nt, Human
cagaaaugacaaaguaagagga

SEQ ID NO: 491216 - RNA, 22 nt, Human
ugggcuggcugaacuucaaccu

SEQ ID NO: 491217 - RNA, 22 nt, Human
ugcugaauauagagcaagaagu

SEQ ID NO: 491218 - RNA, 22 nt, Human
caguacauuucauaugauucua

SEQ ID NO: 491219 - RNA, 20 nt, Human
gugcccugugggcuauuuuc

SEQ ID NO: 491220 - RNA, 22 nt, Human
gcucuggccagacccucagugg

SEQ ID NO: 491221 - RNA, 22 nt, Human
ccuguugucucuuccuguugac

SEQ ID NO: 491222 - RNA, 22 nt, Human
aguccguggccagacucaagag

SEQ ID NO: 491223 - RNA, 22 nt, Human
uguccuccagcagcaugguaug

SEQ ID NO: 491224 - RNA, 22 nt, Human
cucugggcuuguugaccugcac

SEQ ID NO: 491225 - RNA, 22 nt, Human
uuuguagaggguaauugacaga

SEQ ID NO: 491226 - RNA, 22 nt, Human
gagacacacacaggagguggca

SEQ ID NO: 491227 - RNA, 22 nt, Human
guuuagaaaauagugaagcaag

SEQ ID NO: 491228 - RNA, 22 nt, Human
ucugggccuuggaguggggaga

SEQ ID NO: 491229 - RNA, 22 nt, Human
uacacauguauuuauguguaca

SEQ ID NO: 491230 - RNA, 22 nt, Human
ucugggcuuggauuggcucugc

SEQ ID NO: 491231 - RNA, 22 nt, Human
caaaugauacuguuuuuagucu

SEQ ID NO: 491232 - RNA, 22 nt, Human
uuguccugcaaccucacauggc

SEQ ID NO: 491233 - RNA, 22 nt, Human
cuguacaucccgagagccagua

SEQ ID NO: 491234 - RNA, 22 nt, Human
gaaaaugagccucagcuacauu

SEQ ID NO: 491235 - RNA, 22 nt, Human
uauuucugggaguucagaaauu

SEQ ID NO: 491236 - RNA, 22 nt, Human
augagagguuucgucagaggaa

SEQ ID NO: 491237 - RNA, 19 nt, Human
uugaaauuguuugauaugg

SEQ ID NO: 491238 - RNA, 22 nt, Human
uuugugacuugcuucucagaau

SEQ ID NO: 491239 - RNA, 22 nt, Human
gguccugggaagaugcucauga

SEQ ID NO: 491240 - RNA, 21 nt, Human
acagaugugauaugcagucuu

SEQ ID NO: 491241 - RNA, 22 nt, Human
ugaggauggaaugcugugcaag

SEQ ID NO: 491242 - RNA, 22 nt, Human
aagcuucaggcccacccauguc

SEQ ID NO: 491243 - RNA, 18 nt, Human
accuggcugugugagcug

SEQ ID NO: 491244 - RNA, 22 nt, Human
cccgagugucuacucacuccca

SEQ ID NO: 491245 - RNA, 22 nt, Human
augcccugagcaggccuucaag

SEQ ID NO: 491246 - RNA, 22 nt, Human
gccagccuucuguggccugcaa

SEQ ID NO: 491247 - RNA, 22 nt, Human
ugauuacacagcaguaauuuca

SEQ ID NO: 491248 - RNA, 22 nt, Human
uauuugugagacugacugaagu

SEQ ID NO: 491249 - RNA, 19 nt, Human
gggaaauucacuugcuucc

SEQ ID NO: 491250 - RNA, 22 nt, Human
acauguguacauauauaugugc

SEQ ID NO: 491251 - RNA, 22 nt, Human
uuauuagcugggcuucagggug

SEQ ID NO: 491252 - RNA, 22 nt, Human
cagcuucagcgugacaccagug

SEQ ID NO: 491253 - RNA, 22 nt, Human
uuggcucaggaccccugugacu

SEQ ID NO: 491254 - RNA, 22 nt, Human
agcuucagggacuuguggcaga

SEQ ID NO: 491255 - RNA, 17 nt, Human
uugcccugauuuuuaac

SEQ ID NO: 491256 - RNA, 22 nt, Human
ccaguccugcucccugaccacc

SEQ ID NO: 491257 - RNA, 22 nt, Human
gggagacuagugcuauguuuuc

SEQ ID NO: 491258 - RNA, 22 nt, Human
guguccugggucucugauucuu

SEQ ID NO: 491259 - RNA, 22 nt, Human
ggagccaggcauaucggggcac

SEQ ID NO: 491260 - RNA, 22 nt, Human
uagucacaggaaguuucaaugu

SEQ ID NO: 491261 - RNA, 22 nt, Human
ucuggcugucauuggaggcccc

SEQ ID NO: 491262 - RNA, 22 nt, Human
uucagcauagcagcuucaggac

SEQ ID NO: 491263 - RNA, 22 nt, Human
agagccugggcagcuccucugg

SEQ ID NO: 491264 - RNA, 22 nt, Human
gaaggauuugagauuauccuag

SEQ ID NO: 491265 - RNA, 23 nt, Human
cccuucagcgagggcauuaaggu

SEQ ID NO: 491266 - RNA, 22 nt, Human
ccugggcuugcaucugugcugg

SEQ ID NO: 491267 - RNA, 17 nt, Human
gccuucucugcccucac

SEQ ID NO: 491268 - RNA, 22 nt, Human
uguccuggacaacagccccuag

SEQ ID NO: 491269 - RNA, 22 nt, Human
uccuggcugccgucguccugcg

SEQ ID NO: 491270 - RNA, 22 nt, Human
uuuaaauuuagaagaaacacug

SEQ ID NO: 491271 - RNA, 22 nt, Human
ugauuacaaaagauuguuugaa

SEQ ID NO: 491272 - RNA, 22 nt, Human
gccucugucauagcucauguga

SEQ ID NO: 491273 - RNA, 22 nt, Human
aguccugguucugauucugaca

SEQ ID NO: 491274 - RNA, 20 nt, Human
acacaguagaugagugacug

SEQ ID NO: 491275 - RNA, 22 nt, Human
acacuaguagaauaguguuugc

SEQ ID NO: 491276 - RNA, 22 nt, Human
ggcugggucccagcugggagga

SEQ ID NO: 491277 - RNA, 22 nt, Human
cuggcuccauccuugagcucug

SEQ ID NO: 491278 - RNA, 22 nt, Human
acugggccuacccagauuggca

SEQ ID NO: 491279 - RNA, 22 nt, Human
ugaaucauggauaaauagcuua

SEQ ID NO: 491280 - RNA, 22 nt, Human
aauuuguguuaguccacguuca

SEQ ID NO: 491281 - RNA, 22 nt, Human
uuauguugggaaaagucagauu

SEQ ID NO: 491282 - RNA, 22 nt, Human
aggacacaugcacacccugcgu

SEQ ID NO: 491283 - RNA, 22 nt, Human
uccuggcuuuucuuggcucauc

SEQ ID NO: 491284 - RNA, 18 nt, Human
gcagagcagaagcucaag

SEQ ID NO: 491285 - RNA, 22 nt, Human
cuaauuguaagcuccuugaggg

SEQ ID NO: 491286 - RNA, 22 nt, Human
acuuagcaguuuagaauauguc

SEQ ID NO: 491287 - RNA, 22 nt, Human
uuauuuaaaagugguaagauuc

SEQ ID NO: 491288 - RNA, 22 nt, Human
aguaucauguuggaauuaauca

SEQ ID NO: 491289 - RNA, 22 nt, Human
cuguccugaaguuuucaugaga

SEQ ID NO: 491290 - RNA, 22 nt, Human
cagucacauugcccugcauuua

SEQ ID NO: 491291 - RNA, 22 nt, Human
ccaggacaagccagagggacag

SEQ ID NO: 491292 - RNA, 22 nt, Human
acauuucagauucaugaaguga

SEQ ID NO: 491293 - RNA, 22 nt, Human
aaacauuguacauucuguagcu

SEQ ID NO: 491294 - RNA, 22 nt, Human
cggccaagccggggccccgaag

SEQ ID NO: 491295 - RNA, 22 nt, Human
ugagcacagcucgcaccagcuu

SEQ ID NO: 491296 - RNA, 22 nt, Human
ccuccuggugggcgcuucuggc

SEQ ID NO: 491297 - RNA, 22 nt, Human
uuuaguagaaauauuugggccu

SEQ ID NO: 491298 - RNA, 22 nt, Human
gcuggcuguaucaccuggccag

SEQ ID NO: 491299 - RNA, 22 nt, Human
cccagccucagcuuuacuucca

SEQ ID NO: 491300 - RNA, 22 nt, Human
uguccuggugcuccagguggcu

SEQ ID NO: 491301 - RNA, 22 nt, Human
uauuaauaagugacuacuagcu

SEQ ID NO: 491302 - RNA, 22 nt, Human
auguccugggcuggguuauguu

SEQ ID NO: 491303 - RNA, 22 nt, Human
uguuugugguuauaauaaguau

SEQ ID NO: 491304 - RNA, 22 nt, Human
caccagguggaaaugucacagc

SEQ ID NO: 491305 - RNA, 22 nt, Human
uccuggcuucugucuccuuauu

SEQ ID NO: 491306 - RNA, 22 nt, Human
agcacuuaacugacaguacuau

SEQ ID NO: 491307 - RNA, 22 nt, Human
uccacgugagcuucgugugcag

SEQ ID NO: 491308 - RNA, 22 nt, Human
agccacagcaacaagugcaauu

SEQ ID NO: 491309 - RNA, 22 nt, Human
aucauuaaauauaagcuucaca

SEQ ID NO: 491310 - RNA, 22 nt, Human
gcacagagagggaagguaacuu

SEQ ID NO: 491311 - RNA, 22 nt, Human
acacagaguuugacacauggga

SEQ ID NO: 491312 - RNA, 22 nt, Human
cagagccuggcgaugucaugga

SEQ ID NO: 491313 - RNA, 22 nt, Human
uugcagaaaacaguuuucuugu

SEQ ID NO: 491314 - RNA, 22 nt, Human
ccagccuuugcaucccccaucu

SEQ ID NO: 491315 - RNA, 22 nt, Human
agagccuguaacaucuuucuua

SEQ ID NO: 491316 - RNA, 22 nt, Human
agcauuagguguguuucagagg

SEQ ID NO: 491317 - RNA, 22 nt, Human
ccaugccuuucacugaaccagu

SEQ ID NO: 491318 - RNA, 22 nt, Human
cacagcagucuuucacuaaaua

SEQ ID NO: 491319 - RNA, 22 nt, Human
acaggugucuaaggcagacagc

SEQ ID NO: 491320 - RNA, 19 nt, Human
agucacagggaagaggaac

SEQ ID NO: 491321 - RNA, 22 nt, Human
acauucauuccaggucagucag

SEQ ID NO: 491322 - RNA, 22 nt, Human
auuguuaugaaaauaagauguu

SEQ ID NO: 491323 - RNA, 22 nt, Human
cuuagcuuuguccuaggucucu

SEQ ID NO: 491324 - RNA, 22 nt, Human
acauguguacuuuuaaggaugu

SEQ ID NO: 491325 - RNA, 22 nt, Human
ucauuuauaaggaugcaauuaa

SEQ ID NO: 491326 - RNA, 22 nt, Human
gugcugaauccacucuuaggaa

SEQ ID NO: 491327 - RNA, 22 nt, Human
gccuggcugcugguucugagga

SEQ ID NO: 491328 - RNA, 20 nt, Human
aucacuggagaaggaaaccu

SEQ ID NO: 491329 - RNA, 22 nt, Human
uuuagcuuguuggaacaauuga

SEQ ID NO: 491330 - RNA, 22 nt, Human
cagagccaaaugcugugguuau

SEQ ID NO: 491331 - RNA, 22 nt, Human
ugcugaaugguaaagaaguaua

SEQ ID NO: 491332 - RNA, 22 nt, Human
cucagcacaucuuuacauuucc

SEQ ID NO: 491333 - RNA, 22 nt, Human
agcuucagauuuaucuuucugu

SEQ ID NO: 491334 - RNA, 22 nt, Human
uggaaacugggaguuaaaugua

SEQ ID NO: 491335 - RNA, 22 nt, Human
guuuagaauggcaaaauuaagu

SEQ ID NO: 491336 - RNA, 22 nt, Human
gagucacauuaauuuaauuuua

SEQ ID NO: 491337 - RNA, 22 nt, Human
gcuacagacugagcauggcucu

SEQ ID NO: 491338 - RNA, 22 nt, Human
ugcccuuaggaaggcucaccaa

SEQ ID NO: 491339 - RNA, 22 nt, Human
gcccagguuggagagcaguggc

SEQ ID NO: 491340 - RNA, 22 nt, Human
acacaguaccccaaggcugggc

SEQ ID NO: 491341 - RNA, 22 nt, Human
ggucccuggggaacuaggcugu

SEQ ID NO: 491342 - RNA, 22 nt, Human
gccuucugaucgcuggacugac

SEQ ID NO: 491343 - RNA, 22 nt, Human
agagccaguuaagcacuuacag

SEQ ID NO: 491344 - RNA, 22 nt, Human
ccucggagaaaggcagcuccac

SEQ ID NO: 491345 - RNA, 22 nt, Human
ugugaauguauaguuuguauau

SEQ ID NO: 491346 - RNA, 22 nt, Human
ucucuuuaaagacucagagauu

SEQ ID NO: 491347 - RNA, 22 nt, Human
ugcugaauuaaacucuaugugg

SEQ ID NO: 491348 - RNA, 22 nt, Human
ucagaggacuaccuucuccagu

SEQ ID NO: 491349 - RNA, 22 nt, Human
uauuugucacugcacuugaaau

SEQ ID NO: 491350 - RNA, 22 nt, Human
uaguacaguuuuggcacaugga

SEQ ID NO: 491351 - RNA, 20 nt, Human
auuagcuuggagacaguggc

SEQ ID NO: 491352 - RNA, 22 nt, Human
cugaggucagaguuuagucugg

SEQ ID NO: 491353 - RNA, 22 nt, Human
uacagagacuuuauggcacaaa

SEQ ID NO: 491354 - RNA, 22 nt, Human
auauuaaugggauuuagucagg

SEQ ID NO: 491355 - RNA, 22 nt, Human
cuguccugggggugguccuugc

SEQ ID NO: 491356 - RNA, 16 nt, Human
uaugugugugggagug

SEQ ID NO: 491357 - RNA, 22 nt, Human
cagcuucaacugcacagucaac

SEQ ID NO: 491358 - RNA, 22 nt, Human
acuuucaacuuggugggagagc

SEQ ID NO: 491359 - RNA, 22 nt, Human
augaaugaaugagaguagguca

SEQ ID NO: 491360 - RNA, 22 nt, Human
acacuagucucuucuugacuug

SEQ ID NO: 491361 - RNA, 22 nt, Human
ugugugcauucacaugcaugcc

SEQ ID NO: 491362 - RNA, 22 nt, Human
agagcacagaagaauaggugcu

SEQ ID NO: 491363 - RNA, 23 nt, Human
gccagccuugcucuccugcagcc

SEQ ID NO: 491364 - RNA, 22 nt, Human
agaagucaaugaugagagugcu

SEQ ID NO: 491365 - RNA, 22 nt, Human
uuaaaugagauguucagauauu

SEQ ID NO: 491366 - RNA, 22 nt, Human
augugucauuauccagaauaac

SEQ ID NO: 491367 - RNA, 22 nt, Human
augcccugugacucuccuggac

SEQ ID NO: 491368 - RNA, 22 nt, Human
gcuccugcaggacccaggagac

SEQ ID NO: 491369 - RNA, 22 nt, Human
cagaaauggagcccaggaaucu

SEQ ID NO: 491370 - RNA, 23 nt, Human
augcccugugcagaaauguggaa

SEQ ID NO: 491371 - RNA, 22 nt, Human
uugcugagcaguguuuaauugu

SEQ ID NO: 491372 - RNA, 22 nt, Human
agucuugguccaggcucauuuc

SEQ ID NO: 491373 - RNA, 22 nt, Human
gugcccugcaugccccggguau

SEQ ID NO: 491374 - RNA, 22 nt, Human
gcguggcuuagagugggguacc

SEQ ID NO: 491375 - RNA, 22 nt, Human
ucaugccaaacugaacacaguu

SEQ ID NO: 491376 - RNA, 22 nt, Human
gcugaagguaugaguuuuaucu

SEQ ID NO: 491377 - RNA, 22 nt, Human
cacacccuugcuaacacuuguu

SEQ ID NO: 491378 - RNA, 22 nt, Human
cugcaugaagucuuuuuuauag

SEQ ID NO: 491379 - RNA, 22 nt, Human
aguugugagaaacagaaugagc

SEQ ID NO: 491380 - RNA, 22 nt, Human
acagagucaugguagucaaagg

SEQ ID NO: 491381 - RNA, 22 nt, Human
uaauaacaauuguaggacauga

SEQ ID NO: 491382 - RNA, 22 nt, Human
uugcagcuucgagucuaucugu

SEQ ID NO: 491383 - RNA, 22 nt, Human
agagcacacugacgucagucug

SEQ ID NO: 491384 - RNA, 22 nt, Human
augauauuuuaguaaagugaua

SEQ ID NO: 491385 - RNA, 22 nt, Human
uauuuuguauuuaugcaagaaa

SEQ ID NO: 491386 - RNA, 22 nt, Human
aaaacauugaauugcacacuau

SEQ ID NO: 491387 - RNA, 19 nt, Human
ugugugcccucaccacaua

SEQ ID NO: 491388 - RNA, 22 nt, Human
gccuucuguccaaccccacgau

SEQ ID NO: 491389 - RNA, 22 nt, Human
uuucauuaaagucaaaucuggu

SEQ ID NO: 491390 - RNA, 22 nt, Human
ucagcccuuccuggagcuuuua

SEQ ID NO: 491391 - RNA, 22 nt, Human
cauuuaaucuggcucaugagca

SEQ ID NO: 491392 - RNA, 22 nt, Human
gugugcagaagacacaagacau

SEQ ID NO: 491393 - RNA, 22 nt, Human
gaacuguaguuaauacuacaca

SEQ ID NO: 491394 - RNA, 22 nt, Human
ucuagucauauuuuuucaguau

SEQ ID NO: 491395 - RNA, 22 nt, Human
uguauuugaguuaugaaagaga

SEQ ID NO: 491396 - RNA, 22 nt, Human
ggaacacugccuuuuauuuucc

SEQ ID NO: 491397 - RNA, 22 nt, Human
uuagccauuugaggucuucauu

SEQ ID NO: 491398 - RNA, 22 nt, Human
uaucauaaguuaauuaaacagu

SEQ ID NO: 491399 - RNA, 22 nt, Human
gguaaacuaaccauuuuaauuu

SEQ ID NO: 491400 - RNA, 20 nt, Human
auguccugcuucuccucacc

SEQ ID NO: 491401 - RNA, 22 nt, Human
augugugccugagugauggacu

SEQ ID NO: 491402 - RNA, 22 nt, Human
gacagacacagggccaugauug

SEQ ID NO: 491403 - RNA, 22 nt, Human
cugcccugcuuguuuccagugg

SEQ ID NO: 491404 - RNA, 22 nt, Human
augauguugauaaauuacuuua

SEQ ID NO: 491405 - RNA, 22 nt, Human
cauuaauauuguucuucuuuag

SEQ ID NO: 491406 - RNA, 22 nt, Human
uccuguggagaggacuggaggu

SEQ ID NO: 491407 - RNA, 22 nt, Human
ucauuaauuugcuuagacuuau

SEQ ID NO: 491408 - RNA, 22 nt, Human
cugauauucauuauggagcucc

SEQ ID NO: 491409 - RNA, 22 nt, Human
gauauuuuuaggugaugcaggc

SEQ ID NO: 491410 - RNA, 22 nt, Human
uugcccugucaguagaagugca

SEQ ID NO: 491411 - RNA, 22 nt, Human
aggaaacuaacuuaucuuuaua

SEQ ID NO: 491412 - RNA, 22 nt, Human
ccugcccugucacuggcuaggg

SEQ ID NO: 491413 - RNA, 22 nt, Human
uuugugcagugguuaagaccau

SEQ ID NO: 491414 - RNA, 22 nt, Human
cccagccuacucugccauagca

SEQ ID NO: 491415 - RNA, 22 nt, Human
uugcugaaaacaggucaucagg

SEQ ID NO: 491416 - RNA, 19 nt, Human
agacaugagacacaggaug

SEQ ID NO: 491417 - RNA, 22 nt, Human
cugucuuuuacuaucauuuacu

SEQ ID NO: 491418 - RNA, 22 nt, Human
ucacugcuauauuggauacuga

SEQ ID NO: 491419 - RNA, 20 nt, Human
agcuccaugaaguagucacu

SEQ ID NO: 491420 - RNA, 22 nt, Human
auaagcuuuugauucacuucag

SEQ ID NO: 491421 - RNA, 22 nt, Human
uucuggcucuccccugcugggu

SEQ ID NO: 491422 - RNA, 22 nt, Human
ugauacuuuucuuuuagacuaa

SEQ ID NO: 491423 - RNA, 22 nt, Human
guccuggcuagucguccgcgac

SEQ ID NO: 491424 - RNA, 22 nt, Human
cagagcacugcuuggaggauuu

SEQ ID NO: 491425 - RNA, 22 nt, Human
agacacagaacacaaaagcaua

SEQ ID NO: 491426 - RNA, 22 nt, Human
ucagggcugacugcuacucucc

SEQ ID NO: 491427 - RNA, 22 nt, Human
ccucuggggguccucagagucu

SEQ ID NO: 491428 - RNA, 22 nt, Human
uuguuuuaguagguacacugag

SEQ ID NO: 491429 - RNA, 22 nt, Human
agagcacagugcaggauccccg

SEQ ID NO: 491430 - RNA, 20 nt, Human
auaauuauuuacuuuugugc

SEQ ID NO: 491431 - RNA, 22 nt, Human
ugugcacauaaaacaguacuag

SEQ ID NO: 491432 - RNA, 22 nt, Human
gggaaacucaggcauuuccacu

SEQ ID NO: 491433 - RNA, 22 nt, Human
uaacaguauugaagauaaacua

SEQ ID NO: 491434 - RNA, 22 nt, Human
augcugaagaguucaugauuau

SEQ ID NO: 491435 - RNA, 20 nt, Human
cuuuagaagaacccaagcau

SEQ ID NO: 491436 - RNA, 22 nt, Human
uccuguggaagacaguguuggg

SEQ ID NO: 491437 - RNA, 22 nt, Human
uuuugugagcccauaaaugcca

SEQ ID NO: 491438 - RNA, 22 nt, Human
gugacagauuugcugcgcaugg

SEQ ID NO: 491439 - RNA, 22 nt, Human
uucauucacccaggaaacaucu

SEQ ID NO: 491440 - RNA, 22 nt, Human
guccugguggagucucugggga

SEQ ID NO: 491441 - RNA, 22 nt, Human
ucucugggauaaacugggccag

SEQ ID NO: 491442 - RNA, 22 nt, Human
auuuagaacuuuguuugccaau

SEQ ID NO: 491443 - RNA, 22 nt, Human
ggggaaacauguuguucagacc

SEQ ID NO: 491444 - RNA, 22 nt, Human
uacaugugguagggagggcagu

SEQ ID NO: 491445 - RNA, 22 nt, Human
cugacccuagcaucucugugca

SEQ ID NO: 491446 - RNA, 22 nt, Human
ucuuagcaaauacuacuuagaa

SEQ ID NO: 491447 - RNA, 22 nt, Human
acacagaguuauuaugugaacu

SEQ ID NO: 491448 - RNA, 22 nt, Human
cuauuugucaguuuggcuuuaa

SEQ ID NO: 491449 - RNA, 22 nt, Human
uuuauuguguugaaacugaauu

SEQ ID NO: 491450 - RNA, 22 nt, Human
gcccuuauaaacaaggcuucag

SEQ ID NO: 491451 - RNA, 22 nt, Human
uuguauuuggguaguauagaga

SEQ ID NO: 491452 - RNA, 22 nt, Human
ccuggcucccugcacagggcuc

SEQ ID NO: 491453 - RNA, 22 nt, Human
uguccugggaaaucccuuaggc

SEQ ID NO: 491454 - RNA, 22 nt, Human
gacacagagacuugcaguugua

SEQ ID NO: 491455 - RNA, 22 nt, Human
gcuggcugggucccugagaggc

SEQ ID NO: 491456 - RNA, 22 nt, Human
ucucuuuaaguauaaucuuaua

SEQ ID NO: 491457 - RNA, 22 nt, Human
uuuguagacgucagaaguuacu

SEQ ID NO: 491458 - RNA, 22 nt, Human
ugucugaaacuuaugauauacu

SEQ ID NO: 491459 - RNA, 22 nt, Human
ugggcugcggauaggccucgga

SEQ ID NO: 491460 - RNA, 22 nt, Human
ugcccuuacacauggaaaggga

SEQ ID NO: 491461 - RNA, 21 nt, Human
accuucugaauuaccuaccaa

SEQ ID NO: 491462 - RNA, 22 nt, Human
gaucacaugaauggaauagaag

SEQ ID NO: 491463 - RNA, 22 nt, Human
uagcacuauauguuagcuauua

SEQ ID NO: 491464 - RNA, 22 nt, Human
auguguaggugaaucgaggcug

SEQ ID NO: 491465 - RNA, 22 nt, Human
uggacucaaguccaaguucacg

SEQ ID NO: 491466 - RNA, 22 nt, Human
ugcuucagaggaaaggcaaaag

SEQ ID NO: 491467 - RNA, 22 nt, Human
ugcugaauaaagauauauuuuc

SEQ ID NO: 491468 - RNA, 22 nt, Human
uuuugugagaugcguaugaaug

SEQ ID NO: 491469 - RNA, 22 nt, Human
uuuauuagugcuuguaucacug

SEQ ID NO: 491470 - RNA, 20 nt, Human
ccugucuccucuuaccuggc

SEQ ID NO: 491471 - RNA, 20 nt, Human
uguuucugacgguaggagag

SEQ ID NO: 491472 - RNA, 22 nt, Human
augugggccgugcggguguccu

SEQ ID NO: 491473 - RNA, 22 nt, Human
guuuagaacacggaaauacuga

SEQ ID NO: 491474 - RNA, 22 nt, Human
auuagcuuaguguuuccguaau

SEQ ID NO: 491475 - RNA, 22 nt, Human
gugugccaacaaaagacagugc

SEQ ID NO: 491476 - RNA, 22 nt, Human
gucuggcuguccagcuuaucua

SEQ ID NO: 491477 - RNA, 22 nt, Human
ccugggccuggcgggucggcuc

SEQ ID NO: 491478 - RNA, 22 nt, Human
cuuagcaugcaguguucugccc

SEQ ID NO: 491479 - RNA, 17 nt, Human
ugcacaagagacaauag

SEQ ID NO: 491480 - RNA, 22 nt, Human
ucuggcugggaagggggcccga

SEQ ID NO: 491481 - RNA, 22 nt, Human
agcagcacacgggagaaagaca

SEQ ID NO: 491482 - RNA, 22 nt, Human
uguugauuaguguuuagacuua

SEQ ID NO: 491483 - RNA, 22 nt, Human
gccugggugucgaucacuagug

SEQ ID NO: 491484 - RNA, 22 nt, Human
acuauucaagugcucauucaga

SEQ ID NO: 491485 - RNA, 23 nt, Human
auguuauuauuagcagucuugcc

SEQ ID NO: 491486 - RNA, 22 nt, Human
agggcagcucucaccucuggcc

SEQ ID NO: 491487 - RNA, 22 nt, Human
accaaacaaaauugugcacugu

SEQ ID NO: 491488 - RNA, 22 nt, Human
guggcacaggguuguuggucau

SEQ ID NO: 491489 - RNA, 22 nt, Human
cugcccuguggcucugagucau

SEQ ID NO: 491490 - RNA, 22 nt, Human
agcacuagccuguuuugcugug

SEQ ID NO: 491491 - RNA, 22 nt, Human
ggggucugggcuuagcuggaau

SEQ ID NO: 491492 - RNA, 22 nt, Human
gcuggguuuucuuccgggccua

SEQ ID NO: 491493 - RNA, 22 nt, Human
cccagccucuguuugcuccucu

SEQ ID NO: 491494 - RNA, 22 nt, Human
aaggccugggaggccucucuuc

SEQ ID NO: 491495 - RNA, 22 nt, Human
agcaggcacgcucccugcgcga

SEQ ID NO: 491496 - RNA, 22 nt, Human
aaucuugagggacucaugaggu

SEQ ID NO: 491497 - RNA, 22 nt, Human
uguguacagcaugguccagcag

SEQ ID NO: 491498 - RNA, 22 nt, Human
agccuguguuuuuucuauugca

SEQ ID NO: 491499 - RNA, 21 nt, Human
cuucagcaaauacuuggcagg

SEQ ID NO: 491500 - RNA, 22 nt, Human
guccucugucccuggggcacgg

SEQ ID NO: 491501 - RNA, 22 nt, Human
uguguccaucugacaggagagg

SEQ ID NO: 491502 - RNA, 22 nt, Human
ccaggacagggagacgggagcc

SEQ ID NO: 491503 - RNA, 18 nt, Human
gcuggcugcacuucugcu

SEQ ID NO: 491504 - RNA, 22 nt, Human
uuacaaggaggauagcauuucc

SEQ ID NO: 491505 - RNA, 22 nt, Human
cugggcugucccagggcggcag

SEQ ID NO: 491506 - RNA, 22 nt, Human
cugaaugacugaagucacaauu

SEQ ID NO: 491507 - RNA, 22 nt, Human
ucagcacugaaucuggauuugc

SEQ ID NO: 491508 - RNA, 22 nt, Human
uuucacauuuaggcgugaauug

SEQ ID NO: 491509 - RNA, 22 nt, Human
uugcccugcguuaccaucucuu

SEQ ID NO: 491510 - RNA, 22 nt, Human
acuuaaaaagaaucuuuucacg

SEQ ID NO: 491511 - RNA, 22 nt, Human
cuguguuuugauuaaaaagcaa

SEQ ID NO: 491512 - RNA, 22 nt, Human
uucaccuguguuuuguggcuga

SEQ ID NO: 491513 - RNA, 22 nt, Human
auacauauaugguacuuccugg

SEQ ID NO: 491514 - RNA, 22 nt, Human
ugcccuguggguaucugauggc

SEQ ID NO: 491515 - RNA, 22 nt, Human
gcacacaggcaguuuccagcca

SEQ ID NO: 491516 - RNA, 22 nt, Human
ucuuuuaguaauaaauauuugu

SEQ ID NO: 491517 - RNA, 22 nt, Human
uauguguauugagcauuguuac

SEQ ID NO: 491518 - RNA, 22 nt, Human
acacaagaaguuaaugggcaaa

SEQ ID NO: 491519 - RNA, 22 nt, Human
gcuggcugccuuacuuugugga

SEQ ID NO: 491520 - RNA, 22 nt, Human
gaaacauuguguucuacagauu

SEQ ID NO: 491521 - RNA, 22 nt, Human
aucuugaucaaggcuaucauga

SEQ ID NO: 491522 - RNA, 20 nt, Human
uuauuuguuuacuuuggucc

SEQ ID NO: 491523 - RNA, 22 nt, Human
acagagaccaguuacagcgucc

SEQ ID NO: 491524 - RNA, 22 nt, Human
uggagcugaacuuugaggccag

SEQ ID NO: 491525 - RNA, 19 nt, Human
ggcuccuguggcugcagcc

SEQ ID NO: 491526 - RNA, 22 nt, Human
auuuaauuuucucaacagugcu

SEQ ID NO: 491527 - RNA, 22 nt, Human
auuuaugacaaccaaagaguga

SEQ ID NO: 491528 - RNA, 22 nt, Human
gcacuaguucuacugccagcaa

SEQ ID NO: 491529 - RNA, 22 nt, Human
auuuaaaugcuuaagaggguuu

SEQ ID NO: 491530 - RNA, 22 nt, Human
aagaaacuguugcgugacagcg

SEQ ID NO: 491531 - RNA, 22 nt, Human
agcaguuauauuacucucaggu

SEQ ID NO: 491532 - RNA, 22 nt, Human
ugaaugaugcauuuguuuccca

SEQ ID NO: 491533 - RNA, 22 nt, Human
uuacaaucugauugucucaucu

SEQ ID NO: 491534 - RNA, 22 nt, Human
aagcagaucugauagggcccug

SEQ ID NO: 491535 - RNA, 22 nt, Human
cacacccucgugcucccucccg

SEQ ID NO: 491536 - RNA, 17 nt, Human
cccuggcucuaggugga

SEQ ID NO: 491537 - RNA, 22 nt, Human
agugcauuugggguaguggaag

SEQ ID NO: 491538 - RNA, 22 nt, Human
uacauuaucuuguuaucuuuca

SEQ ID NO: 491539 - RNA, 22 nt, Human
ugaggaugacgauggcaauggc

SEQ ID NO: 491540 - RNA, 22 nt, Human
gccuuaauugcagagcaauaua

SEQ ID NO: 491541 - RNA, 22 nt, Human
cugggcccuauggaagaaaggg

SEQ ID NO: 491542 - RNA, 22 nt, Human
ucuuagcauuucauaacaacug

SEQ ID NO: 491543 - RNA, 22 nt, Human
gccuucugauaucucuuggcau

SEQ ID NO: 491544 - RNA, 22 nt, Human
guccuggcugguucuguggggc

SEQ ID NO: 491545 - RNA, 22 nt, Human
ucuagaaugacaugcaagagua

SEQ ID NO: 491546 - RNA, 16 nt, Human
auuguuuucaauuaga

SEQ ID NO: 491547 - RNA, 22 nt, Human
aagcuucaguucuggggcaaug

SEQ ID NO: 491548 - RNA, 22 nt, Human
ccaugugcuugcucuggcaccu

SEQ ID NO: 491549 - RNA, 22 nt, Human
uagcauuucacugaucuucacu

SEQ ID NO: 491550 - RNA, 22 nt, Human
uuuaucuuuaggacuuugcaga

SEQ ID NO: 491551 - RNA, 22 nt, Human
cugcccuguagcuguucuagca

SEQ ID NO: 491552 - RNA, 22 nt, Human
uauguuguggggugcaucaaaa

SEQ ID NO: 491553 - RNA, 22 nt, Human
cccagccuuccacccuggacua

SEQ ID NO: 491554 - RNA, 22 nt, Human
caguauguuugggagacaugac

SEQ ID NO: 491555 - RNA, 22 nt, Human
acacaguauuacaauaggugcu

SEQ ID NO: 491556 - RNA, 22 nt, Human
uuguccuguuacuuguuuggau

SEQ ID NO: 491557 - RNA, 22 nt, Human
guuucugagcacuuuuauugca

SEQ ID NO: 491558 - RNA, 22 nt, Human
gacacagaugaucaggugugga

SEQ ID NO: 491559 - RNA, 22 nt, Human
uggcaaaggaaaugauuuaaga

SEQ ID NO: 491560 - RNA, 22 nt, Human
ucucaggaucuaauacauggua

SEQ ID NO: 491561 - RNA, 22 nt, Human
cugauauuauugaagcuggagu

SEQ ID NO: 491562 - RNA, 22 nt, Human
gaauuacagccagaagaaugaa

SEQ ID NO: 491563 - RNA, 22 nt, Human
aagauuuucagcuaauggugca

SEQ ID NO: 491564 - RNA, 23 nt, Human
uccagccucuugcucucacaugc

SEQ ID NO: 491565 - RNA, 22 nt, Human
uggcugccuagugucugagcag

SEQ ID NO: 491566 - RNA, 21 nt, Human
agcccuuaggacauaagagag

SEQ ID NO: 491567 - RNA, 22 nt, Human
aaauuagucgguuuaggaauuu

SEQ ID NO: 491568 - RNA, 17 nt, Human
ugcuccuguggcagccu

SEQ ID NO: 491569 - RNA, 22 nt, Human
uuguccugagauaaggaacaga

SEQ ID NO: 491570 - RNA, 22 nt, Human
cagcagcaucaggucugugguu

SEQ ID NO: 491571 - RNA, 22 nt, Human
agagcacaaauuuuaaggaggc

SEQ ID NO: 491572 - RNA, 22 nt, Human
auuuauuauugugguuacuucu

SEQ ID NO: 491573 - RNA, 22 nt, Human
gagcuucagaauuuaacagacu

SEQ ID NO: 491574 - RNA, 22 nt, Human
acugggccugauugggucggag

SEQ ID NO: 491575 - RNA, 23 nt, Human
ugcugggcagagcuggugcugag

SEQ ID NO: 491576 - RNA, 22 nt, Human
uagcugaagggcauuuaauaaa

SEQ ID NO: 491577 - RNA, 23 nt, Human
cuucagcagaaacauaaauucuc

SEQ ID NO: 491578 - RNA, 22 nt, Human
guguacaggaugacuguacuua

SEQ ID NO: 491579 - RNA, 19 nt, Human
aauaagcuuggguaaaacu

SEQ ID NO: 491580 - RNA, 21 nt, Human
uuagcaaagcaaacacaugcu

SEQ ID NO: 491581 - RNA, 22 nt, Human
uuuauuugucuugccauuuagu

SEQ ID NO: 491582 - RNA, 22 nt, Human
uuuaucugagcugauagauagu

SEQ ID NO: 491583 - RNA, 22 nt, Human
gaguggguaaaggugcuuggcu

SEQ ID NO: 491584 - RNA, 22 nt, Human
ucaauaauggcaggauaaauuu

SEQ ID NO: 491585 - RNA, 19 nt, Human
aggucugcagcugcaguuu

SEQ ID NO: 491586 - RNA, 22 nt, Human
ccucugggugggaggccgggcg

SEQ ID NO: 491587 - RNA, 22 nt, Human
cauuugaaauucuuagaacaaa

SEQ ID NO: 491588 - RNA, 22 nt, Human
uauuucuguaugcauaaaagga

SEQ ID NO: 491589 - RNA, 22 nt, Human
agucacaguuucccugagagag

SEQ ID NO: 491590 - RNA, 22 nt, Human
aggaagcuaaccagggagugag

SEQ ID NO: 491591 - RNA, 22 nt, Human
uuucugcagguauugcauaagu

SEQ ID NO: 491592 - RNA, 22 nt, Human
ucuuuaagccaagauauauuua

SEQ ID NO: 491593 - RNA, 22 nt, Human
ccugagcuuuaaaagccaugua

SEQ ID NO: 491594 - RNA, 22 nt, Human
uucacaguggcugugccauuug

SEQ ID NO: 491595 - RNA, 22 nt, Human
cuggcccuggagggcugugcga

SEQ ID NO: 491596 - RNA, 22 nt, Human
auagcauauaaguuauaaaacu

SEQ ID NO: 491597 - RNA, 22 nt, Human
cuaagacaugcccugcaugaua

SEQ ID NO: 491598 - RNA, 18 nt, Human
uuuauauggauagagacc

SEQ ID NO: 491599 - RNA, 22 nt, Human
ccuuagcaacugucauagagca

SEQ ID NO: 491600 - RNA, 22 nt, Human
guuaauaaagguauagaaucag

SEQ ID NO: 491601 - RNA, 22 nt, Human
agcauuaagccuggcucagagg

SEQ ID NO: 491602 - RNA, 22 nt, Human
uagcauuaucugucuuaucauu

SEQ ID NO: 491603 - RNA, 22 nt, Human
cagcagcaacaacggaagccuu

SEQ ID NO: 491604 - RNA, 22 nt, Human
auuuagaaccccuuccaaccug

SEQ ID NO: 491605 - RNA, 22 nt, Human
gcuacagagcucugugaagaga

SEQ ID NO: 491606 - RNA, 22 nt, Human
aggagccaguggaguuccugcc

SEQ ID NO: 491607 - RNA, 22 nt, Human
cucuggcugccucucaggccug

SEQ ID NO: 491608 - RNA, 23 nt, Human
cugaggucugcaauucuaguagu

SEQ ID NO: 491609 - RNA, 22 nt, Human
cuucagcagaugcaaaaccccu

SEQ ID NO: 491610 - RNA, 22 nt, Human
uucuuacagauuuggugaauga

SEQ ID NO: 491611 - RNA, 22 nt, Human
gaggccugggagccuguccucc

SEQ ID NO: 491612 - RNA, 22 nt, Human
cuguggcucucagaggcugcug

SEQ ID NO: 491613 - RNA, 22 nt, Human
auuagugauaugugacuagacc

SEQ ID NO: 491614 - RNA, 22 nt, Human
uccuggcuggaauuucucacuc

SEQ ID NO: 491615 - RNA, 22 nt, Human
uuucuuagcgaugcuugauaaa

SEQ ID NO: 491616 - RNA, 22 nt, Human
auuuggcaacauuaauugaauc

SEQ ID NO: 491617 - RNA, 22 nt, Human
uuauuugcccauguuuagcaga

SEQ ID NO: 491618 - RNA, 22 nt, Human
gcugcugggauccugggucuca

SEQ ID NO: 491619 - RNA, 22 nt, Human
uguccugugaccuggcaccaca

SEQ ID NO: 491620 - RNA, 22 nt, Human
uccuggcuuccacuccucuguu

SEQ ID NO: 491621 - RNA, 21 nt, Human
gcuucagcaaggcuugcuggu

SEQ ID NO: 491622 - RNA, 22 nt, Human
uugugugacuccuagaguagag

SEQ ID NO: 491623 - RNA, 22 nt, Human
uuuugugacagaaagauuaagu

SEQ ID NO: 491624 - RNA, 22 nt, Human
acagacagacagagaacuauuc

SEQ ID NO: 491625 - RNA, 22 nt, Human
cuggggcccugggucugcccuc

SEQ ID NO: 491626 - RNA, 22 nt, Human
uuugugaauagguuggcuucca

SEQ ID NO: 491627 - RNA, 22 nt, Human
cauguguggucuguggcuaucu

SEQ ID NO: 491628 - RNA, 22 nt, Human
auauuugucaauucacuguuca

SEQ ID NO: 491629 - RNA, 22 nt, Human
caugugugaaucuugugaucau

SEQ ID NO: 491630 - RNA, 22 nt, Human
uugcugaaugcaaguuggauag

SEQ ID NO: 491631 - RNA, 22 nt, Human
cuuagccagcuaacuuaagcac

SEQ ID NO: 491632 - RNA, 22 nt, Human
ucagcacuuuuacucucuuugc

SEQ ID NO: 491633 - RNA, 22 nt, Human
uuacaaagcaggucagcugaaa

SEQ ID NO: 491634 - RNA, 22 nt, Human
uguguacauauacacaaauaca

SEQ ID NO: 491635 - RNA, 22 nt, Human
cuggcuccacucccugccugac

SEQ ID NO: 491636 - RNA, 22 nt, Human
uauuagcuccaguacuguugcc

SEQ ID NO: 491637 - RNA, 22 nt, Human
aagucacaaagugcuguacaug

SEQ ID NO: 491638 - RNA, 21 nt, Human
gagccuucccucugcccuuuc

SEQ ID NO: 491639 - RNA, 22 nt, Human
agcauuaauaagaaauggcucc

SEQ ID NO: 491640 - RNA, 22 nt, Human
cugccagcaaugugaccaugcu

SEQ ID NO: 491641 - RNA, 22 nt, Human
auuuagaagcuaauuuuucaga

SEQ ID NO: 491642 - RNA, 22 nt, Human
uuguuuuaucuuucuacagacu

SEQ ID NO: 491643 - RNA, 22 nt, Human
gacuagucauuugcauuccguc

SEQ ID NO: 491644 - RNA, 22 nt, Human
gcuggguuuccagcaggcagga

SEQ ID NO: 491645 - RNA, 22 nt, Human
gucccugcaucugcaggccaug

SEQ ID NO: 491646 - RNA, 22 nt, Human
ugcugaauucuaccauccauuu

SEQ ID NO: 491647 - RNA, 22 nt, Human
aguccuggugacacuccucuuc

SEQ ID NO: 491648 - RNA, 22 nt, Human
ugaaugauuucuuaggcaauug

SEQ ID NO: 491649 - RNA, 22 nt, Human
cuggcuccauuacucagcaucu

SEQ ID NO: 491650 - RNA, 23 nt, Human
ugauuacaggaaguucaaguguu

SEQ ID NO: 491651 - RNA, 18 nt, Human
aggcacagagcauacaua

SEQ ID NO: 491652 - RNA, 22 nt, Human
augcccugcaucaagugacacu

SEQ ID NO: 491653 - RNA, 22 nt, Human
uuagcauucucauuugcauaaa

SEQ ID NO: 491654 - RNA, 22 nt, Human
uuuagcuuugaaggauaugguu

SEQ ID NO: 491655 - RNA, 22 nt, Human
ucuagcugaggguaggagaccu

SEQ ID NO: 491656 - RNA, 22 nt, Human
cugcccugagucaugccagaug

SEQ ID NO: 491657 - RNA, 22 nt, Human
uaagcauucaaugcuuagcacu

SEQ ID NO: 491658 - RNA, 22 nt, Human
uguccagggauggggucaggga

SEQ ID NO: 491659 - RNA, 22 nt, Human
cuagcacagcccauucagucua

SEQ ID NO: 491660 - RNA, 22 nt, Human
aaacauuguaauuuuagcaugg

SEQ ID NO: 491661 - RNA, 22 nt, Human
acugccugccuuccagguacug

SEQ ID NO: 491662 - RNA, 22 nt, Human
uacaaaugaguuguaugaacca

SEQ ID NO: 491663 - RNA, 22 nt, Human
gacacagagauaggccuguguu

SEQ ID NO: 491664 - RNA, 22 nt, Human
uuacaugggcuugugaguccuu

SEQ ID NO: 491665 - RNA, 22 nt, Human
uuguuuuauucugcaauuuccc

SEQ ID NO: 491666 - RNA, 22 nt, Human
ucauuaaucccgggguccaggg

SEQ ID NO: 491667 - RNA, 22 nt, Human
cugucuuuucuucucauugaug

SEQ ID NO: 491668 - RNA, 22 nt, Human
agacacaguauaagcacaacaa

SEQ ID NO: 491669 - RNA, 23 nt, Human
ccaagacuguuaggaguggggag

SEQ ID NO: 491670 - RNA, 22 nt, Human
gcucuugucaaaaauuaguuga

SEQ ID NO: 491671 - RNA, 22 nt, Human
cugccugugccaaugcuccuuu

SEQ ID NO: 491672 - RNA, 22 nt, Human
auugcugaaaugaaaggauaug

SEQ ID NO: 491673 - RNA, 22 nt, Human
acaacagagcuggacugagagg

SEQ ID NO: 491674 - RNA, 19 nt, Human
ucuggcugccaaggauuga

SEQ ID NO: 491675 - RNA, 22 nt, Human
acauauguguuguacaugcaug

SEQ ID NO: 491676 - RNA, 22 nt, Human
auagcauuuacuuuucagaaau

SEQ ID NO: 491677 - RNA, 17 nt, Human
cuuguuuuccacuggga

SEQ ID NO: 491678 - RNA, 22 nt, Human
ugggcugcccaagguggccaug

SEQ ID NO: 491679 - RNA, 22 nt, Human
gcaguggcuaagcucgcaugca

SEQ ID NO: 491680 - RNA, 21 nt, Human
ugaaagaggauguggucauuc

SEQ ID NO: 491681 - RNA, 22 nt, Human
guguccugggcauuaggcuuag

SEQ ID NO: 491682 - RNA, 22 nt, Human
auuugcugaaucaaugaauuuu

SEQ ID NO: 491683 - RNA, 22 nt, Human
auguacagccacuucacaguua

SEQ ID NO: 491684 - RNA, 22 nt, Human
uguccuggugcuucuugggauu

SEQ ID NO: 491685 - RNA, 22 nt, Human
gauucaagaccuagcucagcca

SEQ ID NO: 491686 - RNA, 19 nt, Human
cucagcacuuuuacacagg

SEQ ID NO: 491687 - RNA, 22 nt, Human
gcacaugucuuauucacuguua

SEQ ID NO: 491688 - RNA, 22 nt, Human
gugcccugugaacuguaaggaa

SEQ ID NO: 491689 - RNA, 22 nt, Human
gaaacauucagucaacaguguu

SEQ ID NO: 491690 - RNA, 22 nt, Human
uauuugaugguucuaaaacagc

SEQ ID NO: 491691 - RNA, 22 nt, Human
gugugcaggccacaggccaggg

SEQ ID NO: 491692 - RNA, 22 nt, Human
ccucugggaagccaguccugcu

SEQ ID NO: 491693 - RNA, 22 nt, Human
cacauguguauaugugaggggg

SEQ ID NO: 491694 - RNA, 23 nt, Human
ccuggguuucagagcugcuuuuc

SEQ ID NO: 491695 - RNA, 22 nt, Human
aacuagucagugauucucagaa

SEQ ID NO: 491696 - RNA, 22 nt, Human
uccuuagccagggcagcucaaa

SEQ ID NO: 491697 - RNA, 22 nt, Human
ugccaggccaaugaaggcaggg

SEQ ID NO: 491698 - RNA, 22 nt, Human
acugggccuggauuggcguguc

SEQ ID NO: 491699 - RNA, 22 nt, Human
auuuauuaugggauuuggcuca

SEQ ID NO: 491700 - RNA, 22 nt, Human
aaaaugauauccugacuuuuau

SEQ ID NO: 491701 - RNA, 20 nt, Human
cucauguggcaccaggcacu

SEQ ID NO: 491702 - RNA, 20 nt, Human
uuguuuuaaauccuggauga

SEQ ID NO: 491703 - RNA, 22 nt, Human
caugccuguauuucugaucuau

SEQ ID NO: 491704 - RNA, 22 nt, Human
uagaauaaguugaugauauaug

SEQ ID NO: 491705 - RNA, 22 nt, Human
uauuuguccuuauuaagaucug

SEQ ID NO: 491706 - RNA, 22 nt, Human
ccaaggacuggacacacagguu

SEQ ID NO: 491707 - RNA, 22 nt, Human
uacuccugcugauccugccagc

SEQ ID NO: 491708 - RNA, 22 nt, Human
caugugugaagacugcgggcca

SEQ ID NO: 491709 - RNA, 22 nt, Human
cagacaugauguaagcagaggc

SEQ ID NO: 491710 - RNA, 20 nt, Human
cagagccaagagcagcaucu

SEQ ID NO: 491711 - RNA, 22 nt, Human
gauauuuucagucuccuuucaa

SEQ ID NO: 491712 - RNA, 22 nt, Human
ucugggccuauagaagucuacc

SEQ ID NO: 491713 - RNA, 22 nt, Human
aauuaaaagauaacccaugagu

SEQ ID NO: 491714 - RNA, 23 nt, Human
agcauuagagaugccagcccugu

SEQ ID NO: 491715 - RNA, 22 nt, Human
cuuauuugagagaaaagaaacu

SEQ ID NO: 491716 - RNA, 22 nt, Human
guguuuuauuggugcagucaga

SEQ ID NO: 491717 - RNA, 22 nt, Human
ugcugaaagaccguauuuaucu

SEQ ID NO: 491718 - RNA, 22 nt, Human
gcugggccgaccugggcugcag

SEQ ID NO: 491719 - RNA, 22 nt, Human
aaauuauuaugccccucuauaa

SEQ ID NO: 491720 - RNA, 22 nt, Human
uagccauugacuuaaagcuuau

SEQ ID NO: 491721 - RNA, 21 nt, Human
agaagucaauugaacugaaau

SEQ ID NO: 491722 - RNA, 22 nt, Human
uuuaucuggacugugauauaaa

SEQ ID NO: 491723 - RNA, 23 nt, Human
uguguacacaauagaugagguuu

SEQ ID NO: 491724 - RNA, 18 nt, Human
cagacacucugcucugca

SEQ ID NO: 491725 - RNA, 22 nt, Human
uuuggugauagugcagagaaau

SEQ ID NO: 491726 - RNA, 22 nt, Human
guuagcauuuguuuaauaucag

SEQ ID NO: 491727 - RNA, 22 nt, Human
agacacagauuuuggaaaagau

SEQ ID NO: 491728 - RNA, 22 nt, Human
cugccugugccaccgccucauu

SEQ ID NO: 491729 - RNA, 22 nt, Human
agcaguaagcaacugagcuugc

SEQ ID NO: 491730 - RNA, 22 nt, Human
uggcuccuaggauggugccugg

SEQ ID NO: 491731 - RNA, 22 nt, Human
gcuacaggagcugucacaugcu

SEQ ID NO: 491732 - RNA, 22 nt, Human
uguuuuaaucucccauugcucu

SEQ ID NO: 491733 - RNA, 22 nt, Human
ucugggcugggagcguguggac

SEQ ID NO: 491734 - RNA, 20 nt, Human
cugcccugcccuggguccug

SEQ ID NO: 491735 - RNA, 22 nt, Human
ugugcagagcccacaggcagcu

SEQ ID NO: 491736 - RNA, 22 nt, Human
caauaauauccugugcuguuug

SEQ ID NO: 491737 - RNA, 22 nt, Human
ccucuggccuaggccgggagag

SEQ ID NO: 491738 - RNA, 22 nt, Human
uauuagcucaugauuucggugg

SEQ ID NO: 491739 - RNA, 22 nt, Human
augcccugaaagauucaaaggc

SEQ ID NO: 491740 - RNA, 19 nt, Human
uguggucucuguucucagg

SEQ ID NO: 491741 - RNA, 23 nt, Human
accuggcugcucaaccugcaggg

SEQ ID NO: 491742 - RNA, 22 nt, Human
acaccauacucauguugguucc

SEQ ID NO: 491743 - RNA, 22 nt, Human
cacacaugugugcagcuuagaa

SEQ ID NO: 491744 - RNA, 22 nt, Human
agagccagguguagucucggag

SEQ ID NO: 491745 - RNA, 22 nt, Human
aaagacauggaacuagagaugg

SEQ ID NO: 491746 - RNA, 22 nt, Human
caucuugacugggauaagggau

SEQ ID NO: 491747 - RNA, 22 nt, Human
cugggcuggacacacuuaaccu

SEQ ID NO: 491748 - RNA, 22 nt, Human
uuaauuaauuaguuaagcaugu

SEQ ID NO: 491749 - RNA, 18 nt, Human
cagcauuagcagcuucca

SEQ ID NO: 491750 - RNA, 22 nt, Human
gcccugcucuggucucugcccg

SEQ ID NO: 491751 - RNA, 22 nt, Human
aguggcagagccaggguuggga

SEQ ID NO: 491752 - RNA, 22 nt, Human
uccuggcucuucugaguuuucu

SEQ ID NO: 491753 - RNA, 22 nt, Human
cagcagcauugcucuggauucc

SEQ ID NO: 491754 - RNA, 22 nt, Human
cacaugugcaaauacugaggcu

SEQ ID NO: 491755 - RNA, 22 nt, Human
ccucuggcuuacuguuggguuu

SEQ ID NO: 491756 - RNA, 22 nt, Human
uggcuacaucacagagaauucc

SEQ ID NO: 491757 - RNA, 22 nt, Human
augugcacacagugucaugcaa

SEQ ID NO: 491758 - RNA, 22 nt, Human
gcagcacugauccuaaacuuag

SEQ ID NO: 491759 - RNA, 22 nt, Human
cccuggcugcuaccagguagcu

SEQ ID NO: 491760 - RNA, 22 nt, Human
cuguggugagcaacugacugaa

SEQ ID NO: 491761 - RNA, 22 nt, Human
augcccugggagugcuguacca

SEQ ID NO: 491762 - RNA, 22 nt, Human
gaaugauauuauuucgugcugg

SEQ ID NO: 491763 - RNA, 22 nt, Human
uugauauuagaguauuuguuug

SEQ ID NO: 491764 - RNA, 22 nt, Human
uuauuguuuggguauaauuuga

SEQ ID NO: 491765 - RNA, 22 nt, Human
ugggccacucuucccugggucu

SEQ ID NO: 491766 - RNA, 22 nt, Human
cagagucaugggccgucaggca

SEQ ID NO: 491767 - RNA, 22 nt, Human
guguccugaucaauugagcugg

SEQ ID NO: 491768 - RNA, 22 nt, Human
ugggcugcuguuacaggggcug

SEQ ID NO: 491769 - RNA, 22 nt, Human
cauuuaaugccuuugccaucca

SEQ ID NO: 491770 - RNA, 22 nt, Human
ugugugucuggaagcucaggga

SEQ ID NO: 491771 - RNA, 22 nt, Human
gcagcagcucaguucugggagg

SEQ ID NO: 491772 - RNA, 22 nt, Human
gagggcaguagccucguacccu

SEQ ID NO: 491773 - RNA, 22 nt, Human
gagcuucacgggggacagcauu

SEQ ID NO: 491774 - RNA, 22 nt, Human
ugaauaaucuuggguauuaaua

SEQ ID NO: 491775 - RNA, 22 nt, Human
ccuuagcaaauuggcaucuucu

SEQ ID NO: 491776 - RNA, 22 nt, Human
gauauuuuuaguauuucugccu

SEQ ID NO: 491777 - RNA, 22 nt, Human
uaacaguaaaguaaguuagcuu

SEQ ID NO: 491778 - RNA, 22 nt, Human
uucagcacugacugagugguua

SEQ ID NO: 491779 - RNA, 22 nt, Human
aggaaacugauguuuuuuacaa

SEQ ID NO: 491780 - RNA, 22 nt, Human
gcucuggcuacuccacccuguu

SEQ ID NO: 491781 - RNA, 22 nt, Human
auaagcucuggacagccacauu

SEQ ID NO: 491782 - RNA, 19 nt, Human
uuucugcagcccagcagca

SEQ ID NO: 491783 - RNA, 20 nt, Human
uuacaaagaggcaucgcuuu

SEQ ID NO: 491784 - RNA, 18 nt, Human
guuucaugcaugugaaac

SEQ ID NO: 491785 - RNA, 22 nt, Human
ggcaaacuacauuuuugaaaua

SEQ ID NO: 491786 - RNA, 22 nt, Human
uauagcauauacagauaagcug

SEQ ID NO: 491787 - RNA, 22 nt, Human
agagccacaguggauaggagcc

SEQ ID NO: 491788 - RNA, 22 nt, Human
uugaaugauccuaucuagcaca

SEQ ID NO: 491789 - RNA, 22 nt, Human
cuggcucccucucccugaguca

SEQ ID NO: 491790 - RNA, 22 nt, Human
ggggaaacugaggcacagacag

SEQ ID NO: 491791 - RNA, 22 nt, Human
uacuuguguucuacuagagaaa

SEQ ID NO: 491792 - RNA, 22 nt, Human
cagggaugggauggagucaguu

SEQ ID NO: 491793 - RNA, 22 nt, Human
cugcccuggaaaacguaucuua

SEQ ID NO: 491794 - RNA, 22 nt, Human
auauuguguguacaaguaguua

SEQ ID NO: 491795 - RNA, 22 nt, Human
ucauuuguugaacuuuagugcg

SEQ ID NO: 491796 - RNA, 22 nt, Human
agcaggcauagaguagcacuca

SEQ ID NO: 491797 - RNA, 22 nt, Human
uuacaggugggaaaacuaagcu

SEQ ID NO: 491798 - RNA, 22 nt, Human
gauuuguggugugaggaagagc

SEQ ID NO: 491799 - RNA, 22 nt, Human
cccuuagcucacaagcuaaagc

SEQ ID NO: 491800 - RNA, 22 nt, Human
auacuuaugauaaauaauugcu

SEQ ID NO: 491801 - RNA, 23 nt, Human
uuguccugccgaucucugagaau

SEQ ID NO: 491802 - RNA, 22 nt, Human
ccagggcaucacauccaguguu

SEQ ID NO: 491803 - RNA, 22 nt, Human
aauguauuugauguauuagccu

SEQ ID NO: 491804 - RNA, 22 nt, Human
uugcugaaaagcuggccuuugu

SEQ ID NO: 491805 - RNA, 22 nt, Human
auuagcuugguaugccauaaag

SEQ ID NO: 491806 - RNA, 22 nt, Human
gcaguggcuaggagucuggcgu

SEQ ID NO: 491807 - RNA, 22 nt, Human
uuauuuguggcauaugagacga

SEQ ID NO: 491808 - RNA, 21 nt, Human
agagccugagaucuuccagca

SEQ ID NO: 491809 - RNA, 22 nt, Human
ugccaggcccucccacagauua

SEQ ID NO: 491810 - RNA, 23 nt, Human
ggugggagauuauccagaauuau

SEQ ID NO: 491811 - RNA, 22 nt, Human
ugcugaauucucauucccugga

SEQ ID NO: 491812 - RNA, 22 nt, Human
cguggcugguggaccugagggc

SEQ ID NO: 491813 - RNA, 22 nt, Human
ugaugacaaacuuuccugaugc

SEQ ID NO: 491814 - RNA, 22 nt, Human
ucacuagucgcggggggaggua

SEQ ID NO: 491815 - RNA, 22 nt, Human
ugggcuccagcaccugugcucu

SEQ ID NO: 491816 - RNA, 22 nt, Human
ccuuggcugaggagggagcuga

SEQ ID NO: 491817 - RNA, 22 nt, Human
ucagcacugucuuuuauuugaa

SEQ ID NO: 491818 - RNA, 22 nt, Human
agcugccacagagccuggccag

SEQ ID NO: 491819 - RNA, 22 nt, Human
ccagguguuuggccugcaugau

SEQ ID NO: 491820 - RNA, 22 nt, Human
aggccagugcagcuggaacaga

SEQ ID NO: 491821 - RNA, 22 nt, Human
guuguugaucacaugcauaucu

SEQ ID NO: 491822 - RNA, 22 nt, Human
cauuuguauguuccuccuuagg

SEQ ID NO: 491823 - RNA, 22 nt, Human
ugcugaauaauaagauuacuca

SEQ ID NO: 491824 - RNA, 22 nt, Human
caggacacagaauaaggcaguu

SEQ ID NO: 491825 - RNA, 22 nt, Human
caggccagagcgcgugguuggg

SEQ ID NO: 491826 - RNA, 22 nt, Human
agccacagagguugaugugguu

SEQ ID NO: 491827 - RNA, 22 nt, Human
ugcugaaugcugcaugccguau

SEQ ID NO: 491828 - RNA, 22 nt, Human
uuauucuucuucucuugccagg

SEQ ID NO: 491829 - RNA, 22 nt, Human
uucugggcacacaggcccuggu

SEQ ID NO: 491830 - RNA, 21 nt, Human
cuguccucagauguggacgag

SEQ ID NO: 491831 - RNA, 22 nt, Human
ucugggcccuaaaccagcucua

SEQ ID NO: 491832 - RNA, 21 nt, Human
cacaugugaauuacugaacug

SEQ ID NO: 491833 - RNA, 22 nt, Human
agagccaggacugugucucacu

SEQ ID NO: 491834 - RNA, 22 nt, Human
ccuggcucagaccccaguucug

SEQ ID NO: 491835 - RNA, 22 nt, Human
cacaguguaguuaaugugacau

SEQ ID NO: 491836 - RNA, 22 nt, Human
uguccugggaacucacagucca

SEQ ID NO: 491837 - RNA, 19 nt, Human
uagcuucacguggucuaga

SEQ ID NO: 491838 - RNA, 22 nt, Human
ggaaccuuaguguucuuuuacc

SEQ ID NO: 491839 - RNA, 22 nt, Human
cagcccuuguuucuaaagcugc

SEQ ID NO: 491840 - RNA, 22 nt, Human
ugacugaaauugcauuuuaaaa

SEQ ID NO: 491841 - RNA, 22 nt, Human
cuaaauaaucccucuggucuua

SEQ ID NO: 491842 - RNA, 22 nt, Human
agccuugaaugcgcugcauugg

SEQ ID NO: 491843 - RNA, 22 nt, Human
agagccagcauuugggcccugc

SEQ ID NO: 491844 - RNA, 22 nt, Human
gcuggcuguuggagguaccugc

SEQ ID NO: 491845 - RNA, 22 nt, Human
uuguuuguaaggcucuuagaau

SEQ ID NO: 491846 - RNA, 22 nt, Human
gugcccuggagggguugaaggg

SEQ ID NO: 491847 - RNA, 22 nt, Human
gaacuccagaugacucaggaac

SEQ ID NO: 491848 - RNA, 22 nt, Human
agagccaggaucuguuuugggg

SEQ ID NO: 491849 - RNA, 22 nt, Human
auagaauagcauagaaaauuga

SEQ ID NO: 491850 - RNA, 19 nt, Human
aauaauguucaugagauug

SEQ ID NO: 491851 - RNA, 22 nt, Human
caguggguaggaaaggcucuuc

SEQ ID NO: 491852 - RNA, 22 nt, Human
agagccagcaagugaauaguga

SEQ ID NO: 491853 - RNA, 22 nt, Human
cugccuguuuccucuugcuccc

SEQ ID NO: 491854 - RNA, 22 nt, Human
acagagucauucacugaugaag

SEQ ID NO: 491855 - RNA, 22 nt, Human
uuuauuggauauuuacaagaua

SEQ ID NO: 491856 - RNA, 22 nt, Human
augugugugugcgcgcgcagga

SEQ ID NO: 491857 - RNA, 22 nt, Human
uuugcugauauuuugcugauac

SEQ ID NO: 491858 - RNA, 22 nt, Human
uauguacagggauagaacuuga

SEQ ID NO: 491859 - RNA, 22 nt, Human
auaauuaucucagacacuuguu

SEQ ID NO: 491860 - RNA, 22 nt, Human
caucucugguucagucucugug

SEQ ID NO: 491861 - RNA, 22 nt, Human
cuauuacauuucuggacauuca

SEQ ID NO: 491862 - RNA, 22 nt, Human
ccugagcucaaagggugccugg

SEQ ID NO: 491863 - RNA, 22 nt, Human
ggcuccugccgucuuuucugag

SEQ ID NO: 491864 - RNA, 22 nt, Human
uguaaugauguacuuagaagga

SEQ ID NO: 491865 - RNA, 22 nt, Human
gaauaauauugacuuugcaggc

SEQ ID NO: 491866 - RNA, 22 nt, Human
aaugcaaugcagcaccuccuug

SEQ ID NO: 491867 - RNA, 22 nt, Human
uucuuacauuacuuuacaugug

SEQ ID NO: 491868 - RNA, 22 nt, Human
auuaaauuaaguggcuaauuua

SEQ ID NO: 491869 - RNA, 22 nt, Human
ugaaugaucuccgauuaguccu

SEQ ID NO: 491870 - RNA, 22 nt, Human
gucuggcuuuugcccuguguuu

SEQ ID NO: 491871 - RNA, 22 nt, Human
uuacaaagcgcuuuaccucuga

SEQ ID NO: 491872 - RNA, 17 nt, Human
ucagcauacacagagaa

SEQ ID NO: 491873 - RNA, 22 nt, Human
gcuccuggcaggcagugugugu

SEQ ID NO: 491874 - RNA, 22 nt, Human
ugauuuaggaaacagcuacagg

SEQ ID NO: 491875 - RNA, 22 nt, Human
cauuacaaaguuauaaacaguu

SEQ ID NO: 491876 - RNA, 22 nt, Human
uguuuuaagggucaacugucac

SEQ ID NO: 491877 - RNA, 22 nt, Human
gcucaggccucggacacacaau

SEQ ID NO: 491878 - RNA, 22 nt, Human
gcugggcccugggugcccuagc

SEQ ID NO: 491879 - RNA, 22 nt, Human
ccugggucuucagucugcuggu

SEQ ID NO: 491880 - RNA, 20 nt, Human
agucacaggccuggaacaug

SEQ ID NO: 491881 - RNA, 22 nt, Human
cccuagaacacgcagacacuga

SEQ ID NO: 491882 - RNA, 22 nt, Human
gagagcauguggucuaguuuua

SEQ ID NO: 491883 - RNA, 22 nt, Human
cauuuagagaagauuacaagga

SEQ ID NO: 491884 - RNA, 22 nt, Human
ucuuuuagagcauuucugauuc

SEQ ID NO: 491885 - RNA, 22 nt, Human
agaucacaguggcaacucccuu

SEQ ID NO: 491886 - RNA, 21 nt, Human
ucauuuauugagaaaugacug

SEQ ID NO: 491887 - RNA, 22 nt, Human
auuugucaauaagaugaacaua

SEQ ID NO: 491888 - RNA, 22 nt, Human
agaaaugacaagacugaucagg

SEQ ID NO: 491889 - RNA, 22 nt, Human
uucuggcuuauccuaacucuaa

SEQ ID NO: 491890 - RNA, 22 nt, Human
cuuagcuucacugggucucagu

SEQ ID NO: 491891 - RNA, 22 nt, Human
cuauuuguacagcauucgaguu

SEQ ID NO: 491892 - RNA, 22 nt, Human
cauggcacugagcagguaugca

SEQ ID NO: 491893 - RNA, 22 nt, Human
aagaacaacugcuuuaaaagca

SEQ ID NO: 491894 - RNA, 22 nt, Human
aauuagcuuauguguacuuuuc

SEQ ID NO: 491895 - RNA, 22 nt, Human
cauuacaaccccaaauuacaaa

SEQ ID NO: 491896 - RNA, 22 nt, Human
guguccugggggacuucagguu

SEQ ID NO: 491897 - RNA, 22 nt, Human
augcccugaggaaugucacgcu

SEQ ID NO: 491898 - RNA, 22 nt, Human
aaugauaugcaaauuaucauca

SEQ ID NO: 491899 - RNA, 21 nt, Human
agacuucuagaagugagauag

SEQ ID NO: 491900 - RNA, 18 nt, Human
uggcuucuugagcuaaca

SEQ ID NO: 491901 - RNA, 22 nt, Human
aaacagugacugguacauaaua

SEQ ID NO: 491902 - RNA, 22 nt, Human
uuuagcauauccuauaaaacua

SEQ ID NO: 491903 - RNA, 22 nt, Human
uacacccuucuccugagugugu

SEQ ID NO: 491904 - RNA, 22 nt, Human
uauuugcugaaucugauucaga

SEQ ID NO: 491905 - RNA, 22 nt, Human
gccagccugugggggcucugug

SEQ ID NO: 491906 - RNA, 22 nt, Human
gagaacuuucuguguuuuuauc

SEQ ID NO: 491907 - RNA, 22 nt, Human
aguauaauuagauaucaaaagu

SEQ ID NO: 491908 - RNA, 22 nt, Human
auuuagaaauuccaaaaguauu

SEQ ID NO: 491909 - RNA, 22 nt, Human
cugggccagggaggugucugua

SEQ ID NO: 491910 - RNA, 22 nt, Human
gaggccugggagaacuguuuuu

SEQ ID NO: 491911 - RNA, 22 nt, Human
aagaacuuccuaauauauuuuc

SEQ ID NO: 491912 - RNA, 16 nt, Human
uugcccugaggggagg

SEQ ID NO: 491913 - RNA, 19 nt, Human
acagaaauguaagugagac

SEQ ID NO: 491914 - RNA, 22 nt, Human
cuccugucaauaggcuccuggc

SEQ ID NO: 491915 - RNA, 22 nt, Human
cuuagcuucauuauugguggcc

SEQ ID NO: 491916 - RNA, 22 nt, Human
cuuaaauuggaugaguuaaguu

SEQ ID NO: 491917 - RNA, 22 nt, Human
ccugggcuucugucuagauguu

SEQ ID NO: 491918 - RNA, 22 nt, Human
gcagcagcugacagugggugcc

SEQ ID NO: 491919 - RNA, 22 nt, Human
cagccacagcugggugccugac

SEQ ID NO: 491920 - RNA, 22 nt, Human
ccugagcuggcagugaccugga

SEQ ID NO: 491921 - RNA, 22 nt, Human
gccaggguucgaauccguaugg

SEQ ID NO: 491922 - RNA, 22 nt, Human
cugauaugaugggugauuuuca

SEQ ID NO: 491923 - RNA, 22 nt, Human
cauguacaaggaugcucagagu

SEQ ID NO: 491924 - RNA, 22 nt, Human
aggccagggcacugcucuuuag

SEQ ID NO: 491925 - RNA, 22 nt, Human
cuuuauuagauguagacuuucu

SEQ ID NO: 491926 - RNA, 22 nt, Human
cuuagcaugugguguccuugua

SEQ ID NO: 491927 - RNA, 22 nt, Human
auuaaauuuucacuaggcuccc

SEQ ID NO: 491928 - RNA, 22 nt, Human
agcacuagagccaaaauuuggg

SEQ ID NO: 491929 - RNA, 22 nt, Human
cuguuuuaucucaagaguucaa

SEQ ID NO: 491930 - RNA, 22 nt, Human
uuuagcauuacuaaaaugaaaa

SEQ ID NO: 491931 - RNA, 22 nt, Human
auuuaauuuauagauguggaua

SEQ ID NO: 491932 - RNA, 22 nt, Human
agcacuagcuuuaagcauucug

SEQ ID NO: 491933 - RNA, 22 nt, Human
uuuuuugucuugaagaaauggu

SEQ ID NO: 491934 - RNA, 22 nt, Human
auuuauugagagggaggggaau

SEQ ID NO: 491935 - RNA, 22 nt, Human
cauaauuacugauaugcugauu

SEQ ID NO: 491936 - RNA, 22 nt, Human
gagcuccaccaccuucaggcag

SEQ ID NO: 491937 - RNA, 21 nt, Human
uuagcuuucuagaaucuuugu

SEQ ID NO: 491938 - RNA, 22 nt, Human
ccaguccugccacccugucuau

SEQ ID NO: 491939 - RNA, 22 nt, Human
aguccuggcauauagguccuca

SEQ ID NO: 491940 - RNA, 20 nt, Human
aaaugaugggaauaaucuau

SEQ ID NO: 491941 - RNA, 22 nt, Human
uaacaguauagccuaacauuuc

SEQ ID NO: 491942 - RNA, 21 nt, Human
ugugugcauaugcauguacau

SEQ ID NO: 491943 - RNA, 22 nt, Human
aagucacagaacccauuguaac

SEQ ID NO: 491944 - RNA, 22 nt, Human
gugcccuguucauuucucuccc

SEQ ID NO: 491945 - RNA, 22 nt, Human
augugcaguugguggccaggag

SEQ ID NO: 491946 - RNA, 22 nt, Human
aguggcagaagucacuggguag

SEQ ID NO: 491947 - RNA, 22 nt, Human
aauuagcuucagcuuguggggc

SEQ ID NO: 491948 - RNA, 22 nt, Human
ugcuccugcugcaugcaucucc

SEQ ID NO: 491949 - RNA, 22 nt, Human
uacagagacccacaagagacug

SEQ ID NO: 491950 - RNA, 22 nt, Human
cagcagcaaaucuagaagagga

SEQ ID NO: 491951 - RNA, 22 nt, Human
aauagcauccuaaaacauacuu

SEQ ID NO: 491952 - RNA, 22 nt, Human
gucagggcuccacucacccucc

SEQ ID NO: 491953 - RNA, 22 nt, Human
cugcccuggcagccuaccaugg

SEQ ID NO: 491954 - RNA, 22 nt, Human
guccaucuguaggagggacaca

SEQ ID NO: 491955 - RNA, 22 nt, Human
cacuggcugagcuucucuaggg

SEQ ID NO: 491956 - RNA, 22 nt, Human
uugauuuauagaauguucaagc

SEQ ID NO: 491957 - RNA, 22 nt, Human
ugauaugugaagcuauuaguuc

SEQ ID NO: 491958 - RNA, 22 nt, Human
uauacuuaugcuaaaaaauguu

SEQ ID NO: 491959 - RNA, 20 nt, Human
accauuaauguaagcuuugu

SEQ ID NO: 491960 - RNA, 22 nt, Human
cccuggcucuucaccaccugcc

SEQ ID NO: 491961 - RNA, 22 nt, Human
uugugaaugcuuaauauguuuc

SEQ ID NO: 491962 - RNA, 19 nt, Human
agacacacuugauaugugu

SEQ ID NO: 491963 - RNA, 22 nt, Human
gcuggcugaggucuagcucuuu

SEQ ID NO: 491964 - RNA, 22 nt, Human
uuguccugugauuucagggccu

SEQ ID NO: 491965 - RNA, 22 nt, Human
gaugauauuuugacuggagaau

SEQ ID NO: 491966 - RNA, 22 nt, Human
aaagcuucuauucacuuacuug

SEQ ID NO: 491967 - RNA, 22 nt, Human
gcacaugugagaguagaggccu

SEQ ID NO: 491968 - RNA, 22 nt, Human
ccuggguuauuuuggucuagug

SEQ ID NO: 491969 - RNA, 22 nt, Human
aaugaugugaguuuuuauucuc

SEQ ID NO: 491970 - RNA, 22 nt, Human
uuauaauucuggcauaggcugu

SEQ ID NO: 491971 - RNA, 22 nt, Human
cagagacccuucucaguggcca

SEQ ID NO: 491972 - RNA, 22 nt, Human
uuacaauggguauacuuccauu

SEQ ID NO: 491973 - RNA, 22 nt, Human
aucaaaauggaagaauuuggcu

SEQ ID NO: 491974 - RNA, 22 nt, Human
cugcccugcccaggccuugggc

SEQ ID NO: 491975 - RNA, 20 nt, Human
caaggccuggaucuaguugc

SEQ ID NO: 491976 - RNA, 22 nt, Human
cccuggcucugccucagagccc

SEQ ID NO: 491977 - RNA, 22 nt, Human
auuaaauuagcaaacugugaaa

SEQ ID NO: 491978 - RNA, 22 nt, Human
uugcugaaguugcucagcucca

SEQ ID NO: 491979 - RNA, 22 nt, Human
agaccaugaccugccacuaagc

SEQ ID NO: 491980 - RNA, 22 nt, Human
uacagagauuuauugcuaaggc

SEQ ID NO: 491981 - RNA, 22 nt, Human
cugaaaauguuacacaggaaga

SEQ ID NO: 491982 - RNA, 22 nt, Human
ugcaaggcuauucacauguauu

SEQ ID NO: 491983 - RNA, 22 nt, Human
guccagcccgggcuccgccagc

SEQ ID NO: 491984 - RNA, 22 nt, Human
uucacugaauuaauuuccuucu

SEQ ID NO: 491985 - RNA, 22 nt, Human
cugaaugagggauucugagggc

SEQ ID NO: 491986 - RNA, 22 nt, Human
guucagcacaggugcucagaca

SEQ ID NO: 491987 - RNA, 22 nt, Human
ucugucuuggccagccaucugg

SEQ ID NO: 491988 - RNA, 22 nt, Human
ggcacagggggcugaggacuag

SEQ ID NO: 491989 - RNA, 22 nt, Human
cuguggcucaaaaucccaugau

SEQ ID NO: 491990 - RNA, 22 nt, Human
cugugucuucugcuuacagucu

SEQ ID NO: 491991 - RNA, 22 nt, Human
caguggguggcuaaguggcuga

SEQ ID NO: 491992 - RNA, 22 nt, Human
aguuucuugaagacugauguuu

SEQ ID NO: 491993 - RNA, 22 nt, Human
cuuagcagauaaaaaccuucag

SEQ ID NO: 491994 - RNA, 20 nt, Human
gagcuucaacucagcaaaca

SEQ ID NO: 491995 - RNA, 20 nt, Human
auguuuuauaaaagaacggg

SEQ ID NO: 491996 - RNA, 22 nt, Human
guaauaagaaacagcaauuauu

SEQ ID NO: 491997 - RNA, 22 nt, Human
uagaaugagaaaguguagcagg

SEQ ID NO: 491998 - RNA, 21 nt, Human
guuuagaaguagucuggcuca

SEQ ID NO: 491999 - RNA, 22 nt, Human
auuuguagugaagugaaaauaa

SEQ ID NO: 492000 - RNA, 22 nt, Human
uuucuuauacuauauugucauc

SEQ ID NO: 492001 - RNA, 22 nt, Human
ugaaugauauauugggaauaau

SEQ ID NO: 492002 - RNA, 22 nt, Human
uauuucugaggcccaggaagug

SEQ ID NO: 492003 - RNA, 17 nt, Human
gcagccagugcagcagg

SEQ ID NO: 492004 - RNA, 22 nt, Human
uuuauuuggcauccagggagaa

SEQ ID NO: 492005 - RNA, 22 nt, Human
caggcacaaauuucuagauaag

SEQ ID NO: 492006 - RNA, 22 nt, Human
cugcccugggugcuggggaucc

SEQ ID NO: 492007 - RNA, 22 nt, Human
ggccaaggaugguggcucuggu

SEQ ID NO: 492008 - RNA, 22 nt, Human
gugcccugaggucuucacuuug

SEQ ID NO: 492009 - RNA, 22 nt, Human
uccuuagcuuacaagucuucug

SEQ ID NO: 492010 - RNA, 22 nt, Human
ucacacagguuugcaaugauuu

SEQ ID NO: 492011 - RNA, 22 nt, Human
ucauuuguucucauucucuacu

SEQ ID NO: 492012 - RNA, 22 nt, Human
gucugccugcuaguggcugccu

SEQ ID NO: 492013 - RNA, 22 nt, Human
gaaugauagagcugccuucgga

SEQ ID NO: 492014 - RNA, 22 nt, Human
uuguaaauaguaguaagaugcc

SEQ ID NO: 492015 - RNA, 22 nt, Human
ugcagauucaaaugaaaugcaa

SEQ ID NO: 492016 - RNA, 22 nt, Human
uaguuuguagaaaucuagaaau

SEQ ID NO: 492017 - RNA, 22 nt, Human
acugggccggugcagaguaguu

SEQ ID NO: 492018 - RNA, 22 nt, Human
cuauuugucacaacugguguuu

SEQ ID NO: 492019 - RNA, 22 nt, Human
aagcagaugccaagauuuacca

SEQ ID NO: 492020 - RNA, 22 nt, Human
cugcccugcuucugagggaagc

SEQ ID NO: 492021 - RNA, 23 nt, Human
gcuucuagucaauuucaccagga

SEQ ID NO: 492022 - RNA, 22 nt, Human
ucagccuugcuucuggacuggu

SEQ ID NO: 492023 - RNA, 21 nt, Human
gugcccuguucccacaugccc

SEQ ID NO: 492024 - RNA, 18 nt, Human
augcccuguugacuucag

SEQ ID NO: 492025 - RNA, 22 nt, Human
agccugguuuaagcauuuuaua

SEQ ID NO: 492026 - RNA, 22 nt, Human
aaauacauuuacagucguggcu

SEQ ID NO: 492027 - RNA, 22 nt, Human
uguaggaaaaacaaugaucugc

SEQ ID NO: 492028 - RNA, 22 nt, Human
uccuagaaucuuuguaagauug

SEQ ID NO: 492029 - RNA, 22 nt, Human
caugugugguuaccuacuugac

SEQ ID NO: 492030 - RNA, 22 nt, Human
cauuguuaccaucuuuuaccua

SEQ ID NO: 492031 - RNA, 22 nt, Human
uuaguuuucccaucuuuauggu

SEQ ID NO: 492032 - RNA, 22 nt, Human
gcuggcagguaaagccccgggg

SEQ ID NO: 492033 - RNA, 22 nt, Human
acagguguacaaugcaugacag

SEQ ID NO: 492034 - RNA, 22 nt, Human
uauguacauguuaaagggcaaa

SEQ ID NO: 492035 - RNA, 22 nt, Human
cacugaguucccugacauuuca

SEQ ID NO: 492036 - RNA, 22 nt, Human
cuauuuguaagagccccacacc

SEQ ID NO: 492037 - RNA, 22 nt, Human
cuauuuguaaagugccuggugu

SEQ ID NO: 492038 - RNA, 22 nt, Human
gugcuacagacugaguacacuu

SEQ ID NO: 492039 - RNA, 22 nt, Human
auuaaauuggacgcugggggaa

SEQ ID NO: 492040 - RNA, 22 nt, Human
ugggggcuccaggcuccaggga

SEQ ID NO: 492041 - RNA, 22 nt, Human
ugcccuuauaaaggaggccuga

SEQ ID NO: 492042 - RNA, 22 nt, Human
uggagucugugaugcucugggu

SEQ ID NO: 492043 - RNA, 22 nt, Human
uuacaagauaaccugaugcugu

SEQ ID NO: 492044 - RNA, 22 nt, Human
agcaggcaccagggcucguccu

SEQ ID NO: 492045 - RNA, 22 nt, Human
ccugggccuugaccucgugggc

SEQ ID NO: 492046 - RNA, 22 nt, Human
uuauuuguaaggcagggccagu

SEQ ID NO: 492047 - RNA, 22 nt, Human
cugagcauuugugcagcuucuc

SEQ ID NO: 492048 - RNA, 17 nt, Human
ugccagccugucccagg

SEQ ID NO: 492049 - RNA, 22 nt, Human
ggccucacccaucggugccuuu

SEQ ID NO: 492050 - RNA, 22 nt, Human
ugcauuaaaaccaucgaccauc

SEQ ID NO: 492051 - RNA, 22 nt, Human
uauuuagugauagaagcaagga

SEQ ID NO: 492052 - RNA, 22 nt, Human
ugcugagucguauuauuuuuua

SEQ ID NO: 492053 - RNA, 22 nt, Human
aagacaugacugcacagccaaa

SEQ ID NO: 492054 - RNA, 22 nt, Human
guccugguccugccuccccaug

SEQ ID NO: 492055 - RNA, 22 nt, Human
uccuuagcaggcauucaggacc

SEQ ID NO: 492056 - RNA, 22 nt, Human
uuuagcuuuaccucauagauuu

SEQ ID NO: 492057 - RNA, 22 nt, Human
uugauauuuugcacgcuuggua

SEQ ID NO: 492058 - RNA, 22 nt, Human
ucugggccggagccgacggcag

SEQ ID NO: 492059 - RNA, 18 nt, Human
gcacauguaagaguaaag

SEQ ID NO: 492060 - RNA, 22 nt, Human
uccuggcucaggccccuggugc

SEQ ID NO: 492061 - RNA, 22 nt, Human
guguccugguuccuuguggcug

SEQ ID NO: 492062 - RNA, 22 nt, Human
aaauuaguacauugcaaagucc

SEQ ID NO: 492063 - RNA, 22 nt, Human
uggacucagugcugccauuccc

SEQ ID NO: 492064 - RNA, 22 nt, Human
acacaagauuguguauugaauu

SEQ ID NO: 492065 - RNA, 22 nt, Human
ucggggucuuugacacgcucug

SEQ ID NO: 492066 - RNA, 22 nt, Human
ccaggauggggagcagauagaa

SEQ ID NO: 492067 - RNA, 22 nt, Human
cuuuagaauuucauguuugguc

SEQ ID NO: 492068 - RNA, 22 nt, Human
augcugaaaauuggauuugaau

SEQ ID NO: 492069 - RNA, 22 nt, Human
ucuuuacaucacaauuguaugg

SEQ ID NO: 492070 - RNA, 22 nt, Human
uuuaaaaaacuagucugagucu

SEQ ID NO: 492071 - RNA, 22 nt, Human
aguccuggguccagcagguccu

SEQ ID NO: 492072 - RNA, 22 nt, Human
acagagucuuacguggugauaa

SEQ ID NO: 492073 - RNA, 22 nt, Human
cugggcucuagaaaggaaagaa

SEQ ID NO: 492074 - RNA, 22 nt, Human
aagaaugagcucaaagaucuua

SEQ ID NO: 492075 - RNA, 22 nt, Human
ucacagacuguguugcuacuca

SEQ ID NO: 492076 - RNA, 22 nt, Human
ucugggcccugagauguucuuc

SEQ ID NO: 492077 - RNA, 23 nt, Human
ucauaaauauuagcacaguagga

SEQ ID NO: 492078 - RNA, 22 nt, Human
aguacauacuucaaauguacuu

SEQ ID NO: 492079 - RNA, 23 nt, Human
aaacuugcuauggcugaaaucau

SEQ ID NO: 492080 - RNA, 22 nt, Human
cauugcaacuucaaacuccugg

SEQ ID NO: 492081 - RNA, 22 nt, Human
uugaaugagaaguuauugccau

SEQ ID NO: 492082 - RNA, 22 nt, Human
ugcacaggccuugaagggagag

SEQ ID NO: 492083 - RNA, 22 nt, Human
cauuuucagcacccaucugaaa

SEQ ID NO: 492084 - RNA, 18 nt, Human
acagacacuuaguaugag

SEQ ID NO: 492085 - RNA, 22 nt, Human
auagucacugccuuccauuugu

SEQ ID NO: 492086 - RNA, 22 nt, Human
caugugucuuuauggagccaca

SEQ ID NO: 492087 - RNA, 22 nt, Human
gggccuggugcuucugacuccu

SEQ ID NO: 492088 - RNA, 22 nt, Human
auagcauuauuuacaauuagua

SEQ ID NO: 492089 - RNA, 22 nt, Human
aaauaacagucagggacaacau

SEQ ID NO: 492090 - RNA, 22 nt, Human
ggcugcggccgcgggucugugc

SEQ ID NO: 492091 - RNA, 22 nt, Human
uuguccuguuuagggauaagga

SEQ ID NO: 492092 - RNA, 22 nt, Human
guacaacaggauugauguacca

SEQ ID NO: 492093 - RNA, 22 nt, Human
augucacagcaggaguauucuu

SEQ ID NO: 492094 - RNA, 22 nt, Human
gaggccugcuuuggcacucugg

SEQ ID NO: 492095 - RNA, 22 nt, Human
cauuuguaucauauguaucuua

SEQ ID NO: 492096 - RNA, 22 nt, Human
uugcugaaguauugugaauccu

SEQ ID NO: 492097 - RNA, 22 nt, Human
aauuuguguuauaccugcuccu

SEQ ID NO: 492098 - RNA, 22 nt, Human
ugcgcccagccaagucuggcac

SEQ ID NO: 492099 - RNA, 22 nt, Human
cugccccugccaggcagcuguc

SEQ ID NO: 492100 - RNA, 22 nt, Human
gauauuuucauucggaugcuca

SEQ ID NO: 492101 - RNA, 22 nt, Human
uguacagacuuugcagugugca

SEQ ID NO: 492102 - RNA, 22 nt, Human
uuuuauuaucuuugaaugggac

SEQ ID NO: 492103 - RNA, 22 nt, Human
cccagugucugggccugcaggg

SEQ ID NO: 492104 - RNA, 22 nt, Human
uuauuuguaaagguccauagua

SEQ ID NO: 492105 - RNA, 22 nt, Human
uccccugcagaugagggcagug

SEQ ID NO: 492106 - RNA, 22 nt, Human
gugaacagauaauagaaaugaa

SEQ ID NO: 492107 - RNA, 22 nt, Human
agcagcacccagagccaugucu

SEQ ID NO: 492108 - RNA, 22 nt, Human
uaaauuguuuucuagaaguugu

SEQ ID NO: 492109 - RNA, 22 nt, Human
aaauagacaggcuuaaauagga

SEQ ID NO: 492110 - RNA, 22 nt, Human
guccuagugccuggaagcuggg

SEQ ID NO: 492111 - RNA, 22 nt, Human
caaugaaaaugaggacuccugu

SEQ ID NO: 492112 - RNA, 23 nt, Human
guaaugaugggaauuuacuuaga

SEQ ID NO: 492113 - RNA, 22 nt, Human
cuggcugugcugacugagaggg

SEQ ID NO: 492114 - RNA, 22 nt, Human
uccugcugcuaccuggcccacg

SEQ ID NO: 492115 - RNA, 22 nt, Human
uauuuguauguguguacauaua

SEQ ID NO: 492116 - RNA, 22 nt, Human
gccaggugcaccugcccuggcc

SEQ ID NO: 492117 - RNA, 22 nt, Human
auuuagaaguuggagggcaaga

SEQ ID NO: 492118 - RNA, 22 nt, Human
aaagacuuggcuuaugauuugc

SEQ ID NO: 492119 - RNA, 22 nt, Human
uauuuguguggguaucuauaua

SEQ ID NO: 492120 - RNA, 22 nt, Human
gagacacaaacacauuuagagg

SEQ ID NO: 492121 - RNA, 22 nt, Human
uccuuagcccacuaauacuuau

SEQ ID NO: 492122 - RNA, 22 nt, Human
uaaguuucuccaaagcacagaa

SEQ ID NO: 492123 - RNA, 22 nt, Human
uaauacaucauucaucuaagga

SEQ ID NO: 492124 - RNA, 22 nt, Human
cucugcccucgcacaucugcca

SEQ ID NO: 492125 - RNA, 22 nt, Human
ugauuacacuauuugggaauag

SEQ ID NO: 492126 - RNA, 22 nt, Human
augcccugcugcuggggcagug

SEQ ID NO: 492127 - RNA, 22 nt, Human
gggaaacuguccaguucucccc

SEQ ID NO: 492128 - RNA, 22 nt, Human
cauuaauaaacauuucagaaga

SEQ ID NO: 492129 - RNA, 22 nt, Human
ggagccaguauuuaguggucuu

SEQ ID NO: 492130 - RNA, 22 nt, Human
agucacaugcauuuucuucaau

SEQ ID NO: 492131 - RNA, 22 nt, Human
uuugugaauucuuggaagauug

SEQ ID NO: 492132 - RNA, 22 nt, Human
gugcccugaugcaauugucuca

SEQ ID NO: 492133 - RNA, 22 nt, Human
uuauguguauaauuacaggaag

SEQ ID NO: 492134 - RNA, 22 nt, Human
agccacagcauguguguaugua

SEQ ID NO: 492135 - RNA, 18 nt, Human
cucucugggugaggacaa

SEQ ID NO: 492136 - RNA, 21 nt, Human
gugcacaguccugcacacagg

SEQ ID NO: 492137 - RNA, 22 nt, Human
uuuguagaacuguagaacaaug

SEQ ID NO: 492138 - RNA, 22 nt, Human
agccuuaaaugcuagauucaua

SEQ ID NO: 492139 - RNA, 22 nt, Human
uccauguguuuuccuguccaca

SEQ ID NO: 492140 - RNA, 22 nt, Human
ugggcagggagcuggaaccaca

SEQ ID NO: 492141 - RNA, 22 nt, Human
uguccugggaggcgggguccag

SEQ ID NO: 492142 - RNA, 22 nt, Human
aauaagcuggagcuauauugag

SEQ ID NO: 492143 - RNA, 22 nt, Human
cauguguaaggcucacaggcag

SEQ ID NO: 492144 - RNA, 22 nt, Human
acagaaauucugggacagaaaa

SEQ ID NO: 492145 - RNA, 22 nt, Human
uuguccugugucuguuuggauu

SEQ ID NO: 492146 - RNA, 22 nt, Human
uccauguggcaauaggagacag

SEQ ID NO: 492147 - RNA, 22 nt, Human
cucuggcuggcaccugaucuga

SEQ ID NO: 492148 - RNA, 22 nt, Human
cugcccugccuggccagugugg

SEQ ID NO: 492149 - RNA, 22 nt, Human
ugccuccuucaggagggcccgg

SEQ ID NO: 492150 - RNA, 22 nt, Human
ugcugaaugaauggaugguugc

SEQ ID NO: 492151 - RNA, 21 nt, Human
uucauuuguuauagacaaagu

SEQ ID NO: 492152 - RNA, 22 nt, Human
aaagaauacuccuuuugccuug

SEQ ID NO: 492153 - RNA, 22 nt, Human
uggcuccuggcagguguuucaa

SEQ ID NO: 492154 - RNA, 17 nt, Human
agcacuaaaaugcuucc

SEQ ID NO: 492155 - RNA, 22 nt, Human
gagcagcuugcgcugucuucac

SEQ ID NO: 492156 - RNA, 22 nt, Human
uugcccugaagaacgucccaga

SEQ ID NO: 492157 - RNA, 22 nt, Human
ucaguccucacuugguucuaag

SEQ ID NO: 492158 - RNA, 22 nt, Human
ugauuacauugguaauguuuau

SEQ ID NO: 492159 - RNA, 22 nt, Human
ucugggugcccuuugcucuguu

SEQ ID NO: 492160 - RNA, 19 nt, Human
aagcauuagccaaagcauu

SEQ ID NO: 492161 - RNA, 22 nt, Human
gcaaacauguugugagauacca

SEQ ID NO: 492162 - RNA, 22 nt, Human
ugauauggaaggaagauguaca

SEQ ID NO: 492163 - RNA, 21 nt, Human
uucccuucugguuuugagaga

SEQ ID NO: 492164 - RNA, 22 nt, Human
aggaaacugggccucagguuag

SEQ ID NO: 492165 - RNA, 21 nt, Human
auuagcuucaaaagcuugucu

SEQ ID NO: 492166 - RNA, 22 nt, Human
ucagcacugauguuucagaaga

SEQ ID NO: 492167 - RNA, 22 nt, Human
cuucuccuuauaugucccguuc

SEQ ID NO: 492168 - RNA, 19 nt, Human
uuuauuugagacaugccuu

SEQ ID NO: 492169 - RNA, 22 nt, Human
uacagagagauaaguguaaaag

SEQ ID NO: 492170 - RNA, 22 nt, Human
ucauuuguaccauuuuuuaaga

SEQ ID NO: 492171 - RNA, 22 nt, Human
gcccuuagucagcacuuucacu

SEQ ID NO: 492172 - RNA, 22 nt, Human
gggccuguaugggucucagaua

SEQ ID NO: 492173 - RNA, 22 nt, Human
uuagccuuagaagcuuagcaaa

SEQ ID NO: 492174 - RNA, 22 nt, Human
uuugaugaugaugauaaaguuu

SEQ ID NO: 492175 - RNA, 22 nt, Human
uucugugacuccucagagauuu

SEQ ID NO: 492176 - RNA, 22 nt, Human
ggcacauggagacuuggcauca

SEQ ID NO: 492177 - RNA, 22 nt, Human
uccuggcuuccacaccugucau

SEQ ID NO: 492178 - RNA, 22 nt, Human
uuaaauuuuagaaacagacucu

SEQ ID NO: 492179 - RNA, 22 nt, Human
uuuuuuguuggguagaacggaa

SEQ ID NO: 492180 - RNA, 22 nt, Human
ucugggcccacucaacuucacu

SEQ ID NO: 492181 - RNA, 22 nt, Human
aauuucuccaagaaugcuuaga

SEQ ID NO: 492182 - RNA, 22 nt, Human
guguacauagaauugugcuuug

SEQ ID NO: 492183 - RNA, 22 nt, Human
ccuuagcauggcugugcugugu

SEQ ID NO: 492184 - RNA, 22 nt, Human
acaugugugacaacagagguga

SEQ ID NO: 492185 - RNA, 22 nt, Human
uccuggcugcaccagugacccu

SEQ ID NO: 492186 - RNA, 22 nt, Human
gugcugaagugaaauucaucaa

SEQ ID NO: 492187 - RNA, 22 nt, Human
agucucugucguagaucagcgu

SEQ ID NO: 492188 - RNA, 22 nt, Human
uaaaugauaauaaugcuagugu

SEQ ID NO: 492189 - RNA, 22 nt, Human
gaucuugagcaaguugcauccc

SEQ ID NO: 492190 - RNA, 22 nt, Human
cccuuagcuggugagcccagcg

SEQ ID NO: 492191 - RNA, 22 nt, Human
ucagcacuuuuuaaagcagcau

SEQ ID NO: 492192 - RNA, 21 nt, Human
uggcugccuggcucugugguu

SEQ ID NO: 492193 - RNA, 22 nt, Human
ucuuagcacagcuauauaaguu

SEQ ID NO: 492194 - RNA, 22 nt, Human
ugaacagauggcccagcagagg

SEQ ID NO: 492195 - RNA, 22 nt, Human
gucuggcuagagacacccuccc

SEQ ID NO: 492196 - RNA, 22 nt, Human
uuauuugugaaucauuuaucua

SEQ ID NO: 492197 - RNA, 22 nt, Human
cacaguguuccagagcaguggu

SEQ ID NO: 492198 - RNA, 22 nt, Human
gaaguugauagaguacaugauu

SEQ ID NO: 492199 - RNA, 22 nt, Human
ugagccaggaguuugaggcugu

SEQ ID NO: 492200 - RNA, 22 nt, Human
guccuggcccacuggcaggcug

SEQ ID NO: 492201 - RNA, 22 nt, Human
accagggcuuacagcaguagcu

SEQ ID NO: 492202 - RNA, 20 nt, Human
ucagccuucucauccugggg

SEQ ID NO: 492203 - RNA, 22 nt, Human
uuacaugggccauuuagacaug

SEQ ID NO: 492204 - RNA, 22 nt, Human
acuuugugcccaacagaaagaa

SEQ ID NO: 492205 - RNA, 22 nt, Human
uagcauuccaucacucagcacc

SEQ ID NO: 492206 - RNA, 22 nt, Human
ucagcacuguguccagucuccc

SEQ ID NO: 492207 - RNA, 22 nt, Human
auuauuuggaauaggcauugca

SEQ ID NO: 492208 - RNA, 22 nt, Human
auuugugaucgugcgugaugaa

SEQ ID NO: 492209 - RNA, 22 nt, Human
uugcccugccucccugagguga

SEQ ID NO: 492210 - RNA, 18 nt, Human
cucauguguggucccagc

SEQ ID NO: 492211 - RNA, 22 nt, Human
cucuggcucccgcagcccccau

SEQ ID NO: 492212 - RNA, 22 nt, Human
ugggcugcuucuauuggugguc

SEQ ID NO: 492213 - RNA, 22 nt, Human
auguuuuauauuuugcagcagu

SEQ ID NO: 492214 - RNA, 22 nt, Human
augcuuuuaugucacaugguca

SEQ ID NO: 492215 - RNA, 22 nt, Human
gugggcuggacccuccugcucc

SEQ ID NO: 492216 - RNA, 22 nt, Human
ccuggcuuccauauggcacaua

SEQ ID NO: 492217 - RNA, 22 nt, Human
uguccugggccggcgacugguc

SEQ ID NO: 492218 - RNA, 22 nt, Human
uccuggcuccacugagcaggcc

SEQ ID NO: 492219 - RNA, 22 nt, Human
cugaaugaaaucaaggacugag

SEQ ID NO: 492220 - RNA, 22 nt, Human
uuuuaauuuugcaaaucuggug

SEQ ID NO: 492221 - RNA, 22 nt, Human
aacauucaaaacccaguucagu

SEQ ID NO: 492222 - RNA, 22 nt, Human
uccuggcucugcugccuccuag

SEQ ID NO: 492223 - RNA, 22 nt, Human
gggucugccugcugugaaguca

SEQ ID NO: 492224 - RNA, 22 nt, Human
auucuuuucccaacugcuuuaa

SEQ ID NO: 492225 - RNA, 22 nt, Human
agagacagaucugagggaccuc

SEQ ID NO: 492226 - RNA, 22 nt, Human
ucuggccucuugggaugcuccc

SEQ ID NO: 492227 - RNA, 18 nt, Human
uuguuuuaagacucuguc

SEQ ID NO: 492228 - RNA, 22 nt, Human
ccucagucugucugaucugcca

SEQ ID NO: 492229 - RNA, 22 nt, Human
ggcagagugcucugggcagggg

SEQ ID NO: 492230 - RNA, 22 nt, Human
uuagcauuucuggaaucacaag

SEQ ID NO: 492231 - RNA, 22 nt, Human
ugagccagaguggagugugccu

SEQ ID NO: 492232 - RNA, 22 nt, Human
uguccuggagugcuugggggaa

SEQ ID NO: 492233 - RNA, 22 nt, Human
gcagccagccccucugaccucu

SEQ ID NO: 492234 - RNA, 22 nt, Human
gugcccugguccccagcauaua

SEQ ID NO: 492235 - RNA, 22 nt, Human
augugugcuacaggugugggaa

SEQ ID NO: 492236 - RNA, 22 nt, Human
uacaggaacugggcaggacauu

SEQ ID NO: 492237 - RNA, 22 nt, Human
uacagagaugccgaagagugaa

SEQ ID NO: 492238 - RNA, 22 nt, Human
ucacauguguggcagugcaagu

SEQ ID NO: 492239 - RNA, 22 nt, Human
cuuggccugacauguggcaggg

SEQ ID NO: 492240 - RNA, 22 nt, Human
ugcaaugagaauauauuaacca

SEQ ID NO: 492241 - RNA, 22 nt, Human
gugugucagagcucagagaagu

SEQ ID NO: 492242 - RNA, 22 nt, Human
cugcugaaguuguuggucuuuu

SEQ ID NO: 492243 - RNA, 22 nt, Human
uauuggugggggcagagagaga

SEQ ID NO: 492244 - RNA, 22 nt, Human
gcuggcuggcgggugcguccuc

SEQ ID NO: 492245 - RNA, 22 nt, Human
ugccuggcacagagcagguggc

SEQ ID NO: 492246 - RNA, 22 nt, Human
uguccuagauccagcugugcug

SEQ ID NO: 492247 - RNA, 22 nt, Human
caagcagagacuagauagcugu

SEQ ID NO: 492248 - RNA, 22 nt, Human
uugcuuauuugauuaaaugucu

SEQ ID NO: 492249 - RNA, 22 nt, Human
uuugugaagggaacagaagugu

SEQ ID NO: 492250 - RNA, 22 nt, Human
aacauucaaguucugguuuaug

SEQ ID NO: 492251 - RNA, 22 nt, Human
ucuuauuuuuuaaugacagaga

SEQ ID NO: 492252 - RNA, 22 nt, Human
ugcccaggguggagugcagcgg

SEQ ID NO: 492253 - RNA, 22 nt, Human
ugucugcuacuugguucuacca

SEQ ID NO: 492254 - RNA, 22 nt, Human
uguacaagcaaauagaccuuca

SEQ ID NO: 492255 - RNA, 20 nt, Human
acguggccaccaguggcuua

SEQ ID NO: 492256 - RNA, 22 nt, Human
cugcccugagggccuguguguu

SEQ ID NO: 492257 - RNA, 22 nt, Human
aagcuucaaugagauaauuguu

SEQ ID NO: 492258 - RNA, 23 nt, Human
agguccuggacauaugugcauca

SEQ ID NO: 492259 - RNA, 22 nt, Human
gauauuuucgcagggagaauuc

SEQ ID NO: 492260 - RNA, 20 nt, Human
ugcacagggugggaagcaac

SEQ ID NO: 492261 - RNA, 22 nt, Human
acaucucagaacugaguaaccg

SEQ ID NO: 492262 - RNA, 22 nt, Human
uuaauaaguaguaguuauuguu

SEQ ID NO: 492263 - RNA, 22 nt, Human
ggcugccugcucaggugcggcg

SEQ ID NO: 492264 - RNA, 22 nt, Human
caggcacuggccagucagcaca

SEQ ID NO: 492265 - RNA, 23 nt, Human
ucuuguuuccuuugcgcuaucca

SEQ ID NO: 492266 - RNA, 18 nt, Human
uggcuccugccuccugca

SEQ ID NO: 492267 - RNA, 22 nt, Human
cauguguguccaugugacuaag

SEQ ID NO: 492268 - RNA, 19 nt, Human
caggccucuggucugcugu

SEQ ID NO: 492269 - RNA, 22 nt, Human
ucugugcuuucccugccuucuu

SEQ ID NO: 492270 - RNA, 22 nt, Human
uguaaugagucacuuaccuuaa

SEQ ID NO: 492271 - RNA, 22 nt, Human
gguccuggcagcucugugucca

SEQ ID NO: 492272 - RNA, 22 nt, Human
ucucuggguuuuuguccuguac

SEQ ID NO: 492273 - RNA, 22 nt, Human
cauugaauccuuccuucagaag

SEQ ID NO: 492274 - RNA, 22 nt, Human
uggcuucuggcuggugagaaau

SEQ ID NO: 492275 - RNA, 22 nt, Human
cucuggcuccauuucccuaugu

SEQ ID NO: 492276 - RNA, 22 nt, Human
aaaauaacuucuacuauuugca

SEQ ID NO: 492277 - RNA, 22 nt, Human
ucugacccguggcucugccucc

SEQ ID NO: 492278 - RNA, 19 nt, Human
gucccugggcagaggcacc

SEQ ID NO: 492279 - RNA, 22 nt, Human
uuuaauauccaguggauacaaa

SEQ ID NO: 492280 - RNA, 22 nt, Human
agacaucagcuugugugcaggg

SEQ ID NO: 492281 - RNA, 22 nt, Human
gucccugggucuaaggcaguaa

SEQ ID NO: 492282 - RNA, 22 nt, Human
uauuuggaaaggacauguaagu

SEQ ID NO: 492283 - RNA, 22 nt, Human
agaaaugaagcaggaguuauua

SEQ ID NO: 492284 - RNA, 22 nt, Human
ugauauuuaagcaaaaauaugg

SEQ ID NO: 492285 - RNA, 22 nt, Human
uucuggcuugaccccuacuucc

SEQ ID NO: 492286 - RNA, 22 nt, Human
agcccugcaggaugagggaggu

SEQ ID NO: 492287 - RNA, 22 nt, Human
acuccugugggcauggcacccc

SEQ ID NO: 492288 - RNA, 21 nt, Human
uacagaugaggagaccaaggc

SEQ ID NO: 492289 - RNA, 22 nt, Human
acagcacuuauucagcacagug

SEQ ID NO: 492290 - RNA, 22 nt, Human
uuagcauucuucuggggggcac

SEQ ID NO: 492291 - RNA, 22 nt, Human
uuuauucugugcuacaugaaga

SEQ ID NO: 492292 - RNA, 22 nt, Human
agagcacaggcucuggagucua

SEQ ID NO: 492293 - RNA, 22 nt, Human
agagccagagaccuggguucac

SEQ ID NO: 492294 - RNA, 22 nt, Human
aagacauugucauuuuauaauu

SEQ ID NO: 492295 - RNA, 22 nt, Human
cauuuguaguaucuguuuauau

SEQ ID NO: 492296 - RNA, 22 nt, Human
caguggguggccucuugaguca

SEQ ID NO: 492297 - RNA, 22 nt, Human
auuugcugagcucaaagaaaag

SEQ ID NO: 492298 - RNA, 20 nt, Human
cagagacccaggcuucagcu

SEQ ID NO: 492299 - RNA, 22 nt, Human
cuugcugagauaaaugcugucu

SEQ ID NO: 492300 - RNA, 22 nt, Human
ucuuggcuccucacagcaucag

SEQ ID NO: 492301 - RNA, 22 nt, Human
acacaugugucugcaugcagug

SEQ ID NO: 492302 - RNA, 22 nt, Human
agugcaggccccaggccaggcc

SEQ ID NO: 492303 - RNA, 21 nt, Human
aauuuugaaggaagauuaagg

SEQ ID NO: 492304 - RNA, 22 nt, Human
gcuucagagauuucacuaguuu

SEQ ID NO: 492305 - RNA, 22 nt, Human
uucucacaggauuucuuuuagu

SEQ ID NO: 492306 - RNA, 22 nt, Human
ggcucucuccuuggcuuucaga

SEQ ID NO: 492307 - RNA, 18 nt, Human
cccagccucuccuuucua

SEQ ID NO: 492308 - RNA, 23 nt, Human
caugugugacaguaucacuguuu

SEQ ID NO: 492309 - RNA, 22 nt, Human
uuuuagaaggaaugcuauggug

SEQ ID NO: 492310 - RNA, 22 nt, Human
cacagauagaccuuaugagauu

SEQ ID NO: 492311 - RNA, 22 nt, Human
guuuauuauucaacuucauguu

SEQ ID NO: 492312 - RNA, 22 nt, Human
cacuggauuuccaggaauacuc

SEQ ID NO: 492313 - RNA, 22 nt, Human
caaacauucaaguacaagucuu

SEQ ID NO: 492314 - RNA, 22 nt, Human
uuacaaagaaaauuaggcauuu

SEQ ID NO: 492315 - RNA, 22 nt, Human
agagccagauggagccgugugu

SEQ ID NO: 492316 - RNA, 22 nt, Human
auugauaaauugcaauggggcu

SEQ ID NO: 492317 - RNA, 22 nt, Human
auuagcuucugaagcccuugaa

SEQ ID NO: 492318 - RNA, 22 nt, Human
augcuuggcguuucacuuccug

SEQ ID NO: 492319 - RNA, 22 nt, Human
ugaaaugacagucuuaagcucu

SEQ ID NO: 492320 - RNA, 22 nt, Human
uuuuagaagugccuauccuaug

SEQ ID NO: 492321 - RNA, 22 nt, Human
auuaaauuggaucugcauaguu

SEQ ID NO: 492322 - RNA, 22 nt, Human
gaaauaaccucaugcaccauga

SEQ ID NO: 492323 - RNA, 22 nt, Human
uauuucugaauccaaaagguca

SEQ ID NO: 492324 - RNA, 22 nt, Human
gauauuuugagaaauccuauga

SEQ ID NO: 492325 - RNA, 22 nt, Human
agacacaguguugaaggcuagu

SEQ ID NO: 492326 - RNA, 22 nt, Human
uucagcacaagacuagacaggu

SEQ ID NO: 492327 - RNA, 22 nt, Human
cucuggcuuguuaaugcauauu

SEQ ID NO: 492328 - RNA, 22 nt, Human
ugcuggaugcuugauuuugagg

SEQ ID NO: 492329 - RNA, 22 nt, Human
aaucagcuaaauaaacuaguca

SEQ ID NO: 492330 - RNA, 22 nt, Human
augauauauguguugagcuugc

SEQ ID NO: 492331 - RNA, 22 nt, Human
uccuagaauagugugucuggag

SEQ ID NO: 492332 - RNA, 22 nt, Human
cugcccugucugcagccuggcu

SEQ ID NO: 492333 - RNA, 22 nt, Human
uuuaauuguuguggguacauag

SEQ ID NO: 492334 - RNA, 22 nt, Human
aaaugucugucucaugaggaaa

SEQ ID NO: 492335 - RNA, 22 nt, Human
agucagggccuggccugcugaa

SEQ ID NO: 492336 - RNA, 19 nt, Human
cacuagucuagaugggaug

SEQ ID NO: 492337 - RNA, 22 nt, Human
aguacaaguagaaugcuacaag

SEQ ID NO: 492338 - RNA, 22 nt, Human
uuacaaaguguuaugauaaaca

SEQ ID NO: 492339 - RNA, 22 nt, Human
auaagcuuuuaaagcuacuuug

SEQ ID NO: 492340 - RNA, 22 nt, Human
aucaacagugaagagaucaaga

SEQ ID NO: 492341 - RNA, 22 nt, Human
uggccugguuguugcugccguu

SEQ ID NO: 492342 - RNA, 22 nt, Human
ccuggcagcgugccgagcugcg

SEQ ID NO: 492343 - RNA, 22 nt, Human
guugcugauuaacacuuugagu

SEQ ID NO: 492344 - RNA, 22 nt, Human
ugaggaugagaugagauaacac

SEQ ID NO: 492345 - RNA, 22 nt, Human
cugauauucuauuuugcuugcu

SEQ ID NO: 492346 - RNA, 22 nt, Human
gugaaugauagcuucucuuugg

SEQ ID NO: 492347 - RNA, 22 nt, Human
uuagcacuuugauucaugcaga

SEQ ID NO: 492348 - RNA, 22 nt, Human
cagagacauuaagugccaugau

SEQ ID NO: 492349 - RNA, 22 nt, Human
acuagaaaguuuccagaguuau

SEQ ID NO: 492350 - RNA, 22 nt, Human
cagagcacccaaggagcauuug

SEQ ID NO: 492351 - RNA, 22 nt, Human
auuauuagauucuuaauuguaa

SEQ ID NO: 492352 - RNA, 22 nt, Human
gcacagagugggugagaugugg

SEQ ID NO: 492353 - RNA, 22 nt, Human
agcaggcaggaaggcagcacug

SEQ ID NO: 492354 - RNA, 22 nt, Human
uccuggcucggcuuggggacuu

SEQ ID NO: 492355 - RNA, 22 nt, Human
uuguccugcagguggcugggag

SEQ ID NO: 492356 - RNA, 19 nt, Human
ccacuuugcuucucugggu

SEQ ID NO: 492357 - RNA, 22 nt, Human
ggaaugauggugccuagauuau

SEQ ID NO: 492358 - RNA, 22 nt, Human
aagcuucacauugaacuugggu

SEQ ID NO: 492359 - RNA, 22 nt, Human
cuaggcuguaaagagcuaggag

SEQ ID NO: 492360 - RNA, 22 nt, Human
cuuuaauuaggaaguauaauga

SEQ ID NO: 492361 - RNA, 22 nt, Human
uucugugaaacuaaagagagga

SEQ ID NO: 492362 - RNA, 22 nt, Human
caucugcuguuccuuggacuca

SEQ ID NO: 492363 - RNA, 22 nt, Human
ggcucucugaggaaacccuucc

SEQ ID NO: 492364 - RNA, 22 nt, Human
acuuguuuuaucugucaauaga

SEQ ID NO: 492365 - RNA, 22 nt, Human
uauggcuggaauacugaaaggc

SEQ ID NO: 492366 - RNA, 22 nt, Human
caaaugauccuugcaagcugug

SEQ ID NO: 492367 - RNA, 21 nt, Human
uuacaaagcuacagauguugc

SEQ ID NO: 492368 - RNA, 22 nt, Human
uagccauuuuuauuaaugcugg

SEQ ID NO: 492369 - RNA, 22 nt, Human
ugggccaguuucucauugaaau

SEQ ID NO: 492370 - RNA, 22 nt, Human
aacaguaaaaaucauuuaguug

SEQ ID NO: 492371 - RNA, 22 nt, Human
uccuguguaaauagaucugguu

SEQ ID NO: 492372 - RNA, 22 nt, Human
ucccuggccauuccucuaggcc

SEQ ID NO: 492373 - RNA, 22 nt, Human
gugugcagggggccagcgcagc

SEQ ID NO: 492374 - RNA, 22 nt, Human
acagugcucaugugacauggug

SEQ ID NO: 492375 - RNA, 23 nt, Human
agcuccagcugacgugggcagcc

SEQ ID NO: 492376 - RNA, 22 nt, Human
gaaugauaaauggaagcagcau

SEQ ID NO: 492377 - RNA, 22 nt, Human
ggcuguggucugggugcucccc

SEQ ID NO: 492378 - RNA, 22 nt, Human
auuagcuuuggauucagaagau

SEQ ID NO: 492379 - RNA, 22 nt, Human
gcacuagucuaggugcuaagau

SEQ ID NO: 492380 - RNA, 22 nt, Human
agcacuagacauguaagugagc

SEQ ID NO: 492381 - RNA, 17 nt, Human
cccucuggggagggagg

SEQ ID NO: 492382 - RNA, 22 nt, Human
ucugggccagaucuagggaucu

SEQ ID NO: 492383 - RNA, 22 nt, Human
uucacagugagcuaugucuugu

SEQ ID NO: 492384 - RNA, 22 nt, Human
ugcccugguuacacuggagucc

SEQ ID NO: 492385 - RNA, 22 nt, Human
gcacagagguggaggacaaaua

SEQ ID NO: 492386 - RNA, 22 nt, Human
uuugagguuagcuagcagauca

SEQ ID NO: 492387 - RNA, 22 nt, Human
uacacauguccaaggugucacc

SEQ ID NO: 492388 - RNA, 22 nt, Human
gccuggcucccucugcagcucc

SEQ ID NO: 492389 - RNA, 23 nt, Human
augcccuguagaggcugcugacc

SEQ ID NO: 492390 - RNA, 22 nt, Human
uuugacaaaggaaaaaugcaca

SEQ ID NO: 492391 - RNA, 22 nt, Human
gcaguccauugacagaggucuu

SEQ ID NO: 492392 - RNA, 22 nt, Human
cacaguaagaaaugaagaggua

SEQ ID NO: 492393 - RNA, 23 nt, Human
uccugccagaugacuccuuucuu

SEQ ID NO: 492394 - RNA, 22 nt, Human
uugauuuguaggaauggagacc

SEQ ID NO: 492395 - RNA, 22 nt, Human
uucacaguggcccucucugagu

SEQ ID NO: 492396 - RNA, 22 nt, Human
guagucacaaaccauucauaug

SEQ ID NO: 492397 - RNA, 22 nt, Human
uuaauuaacuagccaaccacua

SEQ ID NO: 492398 - RNA, 22 nt, Human
accuucuggucugccugacagc

SEQ ID NO: 492399 - RNA, 22 nt, Human
uggagagccuggagucccugau

SEQ ID NO: 492400 - RNA, 22 nt, Human
ucacauguguuuucucaccaac

SEQ ID NO: 492401 - RNA, 22 nt, Human
ucuuguuuggauuuugggcagu

SEQ ID NO: 492402 - RNA, 22 nt, Human
cuuucuugcauaauuugaaacc

SEQ ID NO: 492403 - RNA, 22 nt, Human
uguggagcucagaaguagcagu

SEQ ID NO: 492404 - RNA, 22 nt, Human
cccagccugugacagccguccu

SEQ ID NO: 492405 - RNA, 23 nt, Human
acugccugcuacuaugcccacgg

SEQ ID NO: 492406 - RNA, 22 nt, Human
cccagccucuggguucugccgg

SEQ ID NO: 492407 - RNA, 22 nt, Human
auaagcuuccuguuagaaaccg

SEQ ID NO: 492408 - RNA, 22 nt, Human
accagggcggcuugaggaggca

SEQ ID NO: 492409 - RNA, 23 nt, Human
uuuagcaugaagcagcuggagaa

SEQ ID NO: 492410 - RNA, 22 nt, Human
uucagcacaguucaagauggua

SEQ ID NO: 492411 - RNA, 22 nt, Human
gucuggcuuugcucagaugcug

SEQ ID NO: 492412 - RNA, 22 nt, Human
acuacagaagucuuauuagaga

SEQ ID NO: 492413 - RNA, 22 nt, Human
uguccagggggcuuaccuggag

SEQ ID NO: 492414 - RNA, 22 nt, Human
uaauaauagcaguagcugccac

SEQ ID NO: 492415 - RNA, 22 nt, Human
uguuuuaagagcgcacuuuaua

SEQ ID NO: 492416 - RNA, 22 nt, Human
ugcccuggugaagugcucuccu

SEQ ID NO: 492417 - RNA, 22 nt, Human
gcacaggaaaugacucauguua

SEQ ID NO: 492418 - RNA, 22 nt, Human
agguccugaggguucgucugca

SEQ ID NO: 492419 - RNA, 22 nt, Human
uauuagcuuguuuggcaggaug

SEQ ID NO: 492420 - RNA, 22 nt, Human
cucugggcuccuucagcccuuu

SEQ ID NO: 492421 - RNA, 22 nt, Human
cagagucauaucagagaauaug

SEQ ID NO: 492422 - RNA, 22 nt, Human
uucuuugugcugaagaagcccu

SEQ ID NO: 492423 - RNA, 22 nt, Human
cuguccugauggugccacuggu

SEQ ID NO: 492424 - RNA, 22 nt, Human
ugcugaaucccacccuccagug

SEQ ID NO: 492425 - RNA, 22 nt, Human
ucagcacuuacuaguggccuuu

SEQ ID NO: 492426 - RNA, 22 nt, Human
caaaugauagagccgauuauca

SEQ ID NO: 492427 - RNA, 22 nt, Human
uuucagcacuuuaggcagcagg

SEQ ID NO: 492428 - RNA, 22 nt, Human
ccacaggaaguuaugaguacua

SEQ ID NO: 492429 - RNA, 22 nt, Human
cuggccugugggcugucuccgg

SEQ ID NO: 492430 - RNA, 22 nt, Human
cuccucuggaaauuccucugcc

SEQ ID NO: 492431 - RNA, 22 nt, Human
gugugcagcagagacaggacuc

SEQ ID NO: 492432 - RNA, 20 nt, Human
cagguccagcacgugcacgg

SEQ ID NO: 492433 - RNA, 22 nt, Human
ccugggcuuacgaccucugacu

SEQ ID NO: 492434 - RNA, 20 nt, Human
acaaaauagguacuggguag

SEQ ID NO: 492435 - RNA, 22 nt, Human
uguaaagaaauagcauuuguag

SEQ ID NO: 492436 - RNA, 22 nt, Human
uuuaaauuauaguuaaugucug

SEQ ID NO: 492437 - RNA, 22 nt, Human
ucucuuguaauuuaaaaaaucu

SEQ ID NO: 492438 - RNA, 22 nt, Human
acugccuguuuggcauggcccc

SEQ ID NO: 492439 - RNA, 17 nt, Human
uauuagcuagcuuccag

SEQ ID NO: 492440 - RNA, 19 nt, Human
auuagcaugcuugaggaug

SEQ ID NO: 492441 - RNA, 22 nt, Human
cucucugagugagggacaagcu

SEQ ID NO: 492442 - RNA, 22 nt, Human
aagcugucaauguaucuagucu

SEQ ID NO: 492443 - RNA, 22 nt, Human
cuggccucagagggucauggug

SEQ ID NO: 492444 - RNA, 22 nt, Human
agcauuaagagagacugaacug

SEQ ID NO: 492445 - RNA, 22 nt, Human
cugccugugauuuuucucuagu

SEQ ID NO: 492446 - RNA, 22 nt, Human
auguccuggggucuucucuuca

SEQ ID NO: 492447 - RNA, 22 nt, Human
cccuggcugcuuguagucuggc

SEQ ID NO: 492448 - RNA, 22 nt, Human
guccugugugagugcaccaccu

SEQ ID NO: 492449 - RNA, 22 nt, Human
guccuggcuuaguucgcuguaa

SEQ ID NO: 492450 - RNA, 22 nt, Human
agcuccagaagccugcaaggua

SEQ ID NO: 492451 - RNA, 22 nt, Human
uuaugagcuaaguuguggcccc

SEQ ID NO: 492452 - RNA, 22 nt, Human
cucagcacugacccaggagaug

SEQ ID NO: 492453 - RNA, 22 nt, Human
ugaaugauuaaaacccggacua

SEQ ID NO: 492454 - RNA, 22 nt, Human
acaggacaacucagcagccagc

SEQ ID NO: 492455 - RNA, 22 nt, Human
ccagggcagcagaauuggggca

SEQ ID NO: 492456 - RNA, 19 nt, Human
cuauuagcuugggcaucau

SEQ ID NO: 492457 - RNA, 22 nt, Human
cugcccuguccuucccgccggc

SEQ ID NO: 492458 - RNA, 22 nt, Human
uuaaauugucauuugagcaaug

SEQ ID NO: 492459 - RNA, 22 nt, Human
guucuuuaaguggagaaggaaa

SEQ ID NO: 492460 - RNA, 22 nt, Human
gaccacagcuacaagggcaagg

SEQ ID NO: 492461 - RNA, 22 nt, Human
uggcuucuggccaggcacagga

SEQ ID NO: 492462 - RNA, 22 nt, Human
gcacagaaaugucuacacaugu

SEQ ID NO: 492463 - RNA, 22 nt, Human
agagugggccucugagucccag

SEQ ID NO: 492464 - RNA, 22 nt, Human
uuauucugacuaauguauaacu

SEQ ID NO: 492465 - RNA, 22 nt, Human
cauaauuagucauguuaugcau

SEQ ID NO: 492466 - RNA, 22 nt, Human
cugcccugauaugauuuagaac

SEQ ID NO: 492467 - RNA, 22 nt, Human
cugcccugucuuuuucugauga

SEQ ID NO: 492468 - RNA, 22 nt, Human
cuuaaauucuuaaugcccucau

SEQ ID NO: 492469 - RNA, 22 nt, Human
uuuguagacuaccaguaauugu

SEQ ID NO: 492470 - RNA, 22 nt, Human
ucauguguguuucauguaugga

SEQ ID NO: 492471 - RNA, 22 nt, Human
accuuagcuguuaaaacuaagu

SEQ ID NO: 492472 - RNA, 22 nt, Human
uugcugaacccugcccucuaau

SEQ ID NO: 492473 - RNA, 22 nt, Human
acagcacuggucccgcaagccu

SEQ ID NO: 492474 - RNA, 22 nt, Human
auauuuguauuucgugugugua

SEQ ID NO: 492475 - RNA, 22 nt, Human
uguagcauuuuauguaauaagu

SEQ ID NO: 492476 - RNA, 22 nt, Human
agggcugguauguccaugaaag

SEQ ID NO: 492477 - RNA, 22 nt, Human
aaagcuucuaggccuauugcuu

SEQ ID NO: 492478 - RNA, 20 nt, Human
uaacaguaagugauguuaca

SEQ ID NO: 492479 - RNA, 22 nt, Human
uaaaaugacuuccuccaacauc

SEQ ID NO: 492480 - RNA, 22 nt, Human
cugcuugggguuaggguguccu

SEQ ID NO: 492481 - RNA, 22 nt, Human
auuuaauuugugucuuuagcug

SEQ ID NO: 492482 - RNA, 22 nt, Human
cauguguggagggcaugcaugg

SEQ ID NO: 492483 - RNA, 22 nt, Human
ugcacuagccacauuucaaaug

SEQ ID NO: 492484 - RNA, 22 nt, Human
uuugugaauaagagaaugacag

SEQ ID NO: 492485 - RNA, 22 nt, Human
agcagacagguaggaggauaaa

SEQ ID NO: 492486 - RNA, 22 nt, Human
uuguuuuaaccuaguguuuaug

SEQ ID NO: 492487 - RNA, 22 nt, Human
gccaggugcauggcugagucuc

SEQ ID NO: 492488 - RNA, 22 nt, Human
uugauuugauugaugaacuaag

SEQ ID NO: 492489 - RNA, 22 nt, Human
aggaaacuuucuuuugcuucau

SEQ ID NO: 492490 - RNA, 22 nt, Human
auuauuauuguugauguuaggg

SEQ ID NO: 492491 - RNA, 22 nt, Human
gagacacagcagauauucaauc

SEQ ID NO: 492492 - RNA, 22 nt, Human
uacacagaaccugguguacagu

SEQ ID NO: 492493 - RNA, 22 nt, Human
acacagguacacauauguaccu

SEQ ID NO: 492494 - RNA, 22 nt, Human
uuagcauuucauuucaagagga

SEQ ID NO: 492495 - RNA, 23 nt, Human
uauuuggaaagagggaagaagac

SEQ ID NO: 492496 - RNA, 22 nt, Human
augaaugacugucuacuuuggg

SEQ ID NO: 492497 - RNA, 22 nt, Human
acagagguaggacaugagauau

SEQ ID NO: 492498 - RNA, 22 nt, Human
aaaaugaauaaguuaacccagg

SEQ ID NO: 492499 - RNA, 22 nt, Human
uuaauuaugagaaagggaaaag

SEQ ID NO: 492500 - RNA, 22 nt, Human
gacagacaugggacuucauacu

SEQ ID NO: 492501 - RNA, 22 nt, Human
aauaauuacccaucuuuuugua

SEQ ID NO: 492502 - RNA, 22 nt, Human
agagccagccuucucagcuuac

SEQ ID NO: 492503 - RNA, 22 nt, Human
cauaauuaggcaguugaucauu

SEQ ID NO: 492504 - RNA, 22 nt, Human
acacaugugauucuaagacagc

SEQ ID NO: 492505 - RNA, 22 nt, Human
guguacaguuagccaccaaauu

SEQ ID NO: 492506 - RNA, 22 nt, Human
augaaugaagaacaucugugcc

SEQ ID NO: 492507 - RNA, 22 nt, Human
agagacauggagaggcaaaguu

SEQ ID NO: 492508 - RNA, 22 nt, Human
gauuugugcucauuuuccauua

SEQ ID NO: 492509 - RNA, 22 nt, Human
ggcuccuggggaggugagcuug

SEQ ID NO: 492510 - RNA, 22 nt, Human
aaauuauuacaagcuaguuggc

SEQ ID NO: 492511 - RNA, 22 nt, Human
uucagacaauaagagucaucuc

SEQ ID NO: 492512 - RNA, 22 nt, Human
ucccagccuggacccugccagu

SEQ ID NO: 492513 - RNA, 18 nt, Human
gguccugggccuggcuca

SEQ ID NO: 492514 - RNA, 22 nt, Human
uauugguguacuuauagcagag

SEQ ID NO: 492515 - RNA, 22 nt, Human
ggcacacagauggagcacuagc

SEQ ID NO: 492516 - RNA, 22 nt, Human
caucuugagacaugaaaggugu

SEQ ID NO: 492517 - RNA, 22 nt, Human
cuguggcuggccugucugacau

SEQ ID NO: 492518 - RNA, 22 nt, Human
auuuagugaaacccauaaagca

SEQ ID NO: 492519 - RNA, 22 nt, Human
uccuggcuguuagagaggcaag

SEQ ID NO: 492520 - RNA, 22 nt, Human
uugaaugaguguuuuacucaug

SEQ ID NO: 492521 - RNA, 22 nt, Human
caaagacugcauaacacaugaa

SEQ ID NO: 492522 - RNA, 22 nt, Human
cagcagcaugaauucgagccac

SEQ ID NO: 492523 - RNA, 22 nt, Human
cauaauuaaauucugggcaaga

SEQ ID NO: 492524 - RNA, 22 nt, Human
aagcuucauuucaacucagggg

SEQ ID NO: 492525 - RNA, 22 nt, Human
aaacaugcuggauuuagaauau

SEQ ID NO: 492526 - RNA, 22 nt, Human
cuucuggggauggagcccagaa

SEQ ID NO: 492527 - RNA, 22 nt, Human
uugcugaaaacaguggguauug

SEQ ID NO: 492528 - RNA, 22 nt, Human
cacuguugaagauacuuccucu

SEQ ID NO: 492529 - RNA, 22 nt, Human
aaggagguuaucccaguggacu

SEQ ID NO: 492530 - RNA, 22 nt, Human
uccuagaauaaucuuugacugc

SEQ ID NO: 492531 - RNA, 19 nt, Human
gcccucaggcagcuccauc

SEQ ID NO: 492532 - RNA, 22 nt, Human
uaauaagcguagaagguauauc

SEQ ID NO: 492533 - RNA, 22 nt, Human
ucaaucacguguuccauguucu

SEQ ID NO: 492534 - RNA, 22 nt, Human
uuguuuuaaugagggagguuga

SEQ ID NO: 492535 - RNA, 22 nt, Human
ugggcugccggcaggcucugcc

SEQ ID NO: 492536 - RNA, 22 nt, Human
auuagcuuaggcaugaagagaa

SEQ ID NO: 492537 - RNA, 21 nt, Human
ugcugaaucugccauauuuuc

SEQ ID NO: 492538 - RNA, 22 nt, Human
cauuuguagcuauuuacuguau

SEQ ID NO: 492539 - RNA, 20 nt, Human
uggaugucaaauuaggcugg

SEQ ID NO: 492540 - RNA, 22 nt, Human
cagacagaggcuguaugagggc

SEQ ID NO: 492541 - RNA, 22 nt, Human
ugaaugaugcaguauaaugaua

SEQ ID NO: 492542 - RNA, 23 nt, Human
uucauuuaggaguucauaagagc

SEQ ID NO: 492543 - RNA, 20 nt, Human
agcuucagcccuaggauugc

SEQ ID NO: 492544 - RNA, 22 nt, Human
aucagcacaacguacagagaaa

SEQ ID NO: 492545 - RNA, 22 nt, Human
auauuuguuagagucuaugugu

SEQ ID NO: 492546 - RNA, 22 nt, Human
caaaugaugcauggcuagugag

SEQ ID NO: 492547 - RNA, 22 nt, Human
uguguguggggaggcagcagau

SEQ ID NO: 492548 - RNA, 22 nt, Human
aggacauguaaauggagaggga

SEQ ID NO: 492549 - RNA, 22 nt, Human
gcugaaugaauguauuuuaaaa

SEQ ID NO: 492550 - RNA, 22 nt, Human
gccuggcuggucacugccuggc

SEQ ID NO: 492551 - RNA, 22 nt, Human
uccuggcuaaugcugcugaugg

SEQ ID NO: 492552 - RNA, 22 nt, Human
cuuauuugaauguaugaguuuu

SEQ ID NO: 492553 - RNA, 22 nt, Human
cugggcugucaauggcccucug

SEQ ID NO: 492554 - RNA, 22 nt, Human
cccauucuucaugguuuccugu

SEQ ID NO: 492555 - RNA, 22 nt, Human
uacuuuuagccuauuugauucu

SEQ ID NO: 492556 - RNA, 20 nt, Human
ugccuuggagcagccaaggu

SEQ ID NO: 492557 - RNA, 22 nt, Human
acagguggcuuauuggcugauu

SEQ ID NO: 492558 - RNA, 22 nt, Human
cuucagcaccucagcuggagag

SEQ ID NO: 492559 - RNA, 22 nt, Human
ugggccaacaggaggucuagga

SEQ ID NO: 492560 - RNA, 22 nt, Human
uccaugugcuuccucaggggaa

SEQ ID NO: 492561 - RNA, 22 nt, Human
acagaacaagaccugcuuauug

SEQ ID NO: 492562 - RNA, 22 nt, Human
uuagucacaugcccaucucuga

SEQ ID NO: 492563 - RNA, 22 nt, Human
ucuuuaauuguggaagagcagc

SEQ ID NO: 492564 - RNA, 22 nt, Human
auuuaaauuuucugauggagag

SEQ ID NO: 492565 - RNA, 22 nt, Human
aaacauugagcacuugcuauuu

SEQ ID NO: 492566 - RNA, 22 nt, Human
acacaguaggauaguuugagga

SEQ ID NO: 492567 - RNA, 22 nt, Human
ucacauguauaugcagcacagc

SEQ ID NO: 492568 - RNA, 22 nt, Human
ccaggccucccuuuuccagcca

SEQ ID NO: 492569 - RNA, 22 nt, Human
cugggcugcaguuccugguccu

SEQ ID NO: 492570 - RNA, 22 nt, Human
aggcaacaggaaaccacaugau

SEQ ID NO: 492571 - RNA, 22 nt, Human
uaaagcaggccacauaugugau

SEQ ID NO: 492572 - RNA, 22 nt, Human
uuagcauucucugugugcauaa

SEQ ID NO: 492573 - RNA, 22 nt, Human
caggccacagcuaaagaggauu

SEQ ID NO: 492574 - RNA, 22 nt, Human
cagcacaucuucugaucuuuug

SEQ ID NO: 492575 - RNA, 22 nt, Human
gcacagagucacuagcuaagca

SEQ ID NO: 492576 - RNA, 22 nt, Human
ugggcacagagucccaucugcc

SEQ ID NO: 492577 - RNA, 22 nt, Human
uggcuucauguaguuugaguug

SEQ ID NO: 492578 - RNA, 22 nt, Human
gccuggcucugagggagcuccu

SEQ ID NO: 492579 - RNA, 20 nt, Human
gcuuagcaggcauaguagcu

SEQ ID NO: 492580 - RNA, 22 nt, Human
gcaguuaaaaauaaaccuucau

SEQ ID NO: 492581 - RNA, 22 nt, Human
ugugaaugucuagguuuuaugu

SEQ ID NO: 492582 - RNA, 22 nt, Human
gcacagagcuggcccuccaggc

SEQ ID NO: 492583 - RNA, 22 nt, Human
cagguacauucguagacccauu

SEQ ID NO: 492584 - RNA, 22 nt, Human
ugggggcuagaacccagggauu

SEQ ID NO: 492585 - RNA, 22 nt, Human
aaagcagagaucauggcuugua

SEQ ID NO: 492586 - RNA, 22 nt, Human
auagauuauuugcucauuacuu

SEQ ID NO: 492587 - RNA, 22 nt, Human
ucuuggcugcagagccggcaag

SEQ ID NO: 492588 - RNA, 22 nt, Human
uggaccucacugucugcuggua

SEQ ID NO: 492589 - RNA, 22 nt, Human
uccugggcuuaguggcuagguc

SEQ ID NO: 492590 - RNA, 22 nt, Human
guccagccagcugguccuugcc

SEQ ID NO: 492591 - RNA, 21 nt, Human
cccgcacagcgguaggccgcc

SEQ ID NO: 492592 - RNA, 22 nt, Human
cuagucacuguaauaaucugcu

SEQ ID NO: 492593 - RNA, 22 nt, Human
cugcccuguaucuucucccaau

SEQ ID NO: 492594 - RNA, 22 nt, Human
cagagacaggaaucagcugcag

SEQ ID NO: 492595 - RNA, 22 nt, Human
cugcauccauguugcugcaaag

SEQ ID NO: 492596 - RNA, 22 nt, Human
cugcugucuaguaucuuaaaaa

SEQ ID NO: 492597 - RNA, 19 nt, Human
uuugugaagaaaaugaugc

SEQ ID NO: 492598 - RNA, 22 nt, Human
gaaaugauuuuaguuuaucaug

SEQ ID NO: 492599 - RNA, 22 nt, Human
auaagcuugauguaacuaacca

SEQ ID NO: 492600 - RNA, 22 nt, Human
ugccagccuccugauaucaucc

SEQ ID NO: 492601 - RNA, 22 nt, Human
ggccaggcuggucucagacuuc

SEQ ID NO: 492602 - RNA, 22 nt, Human
ugucccugguggaggcuggcag

SEQ ID NO: 492603 - RNA, 22 nt, Human
agagcacaaauuaguuggucuu

SEQ ID NO: 492604 - RNA, 22 nt, Human
aaaguaucaagggaagcauuuu

SEQ ID NO: 492605 - RNA, 22 nt, Human
cugcugaaaacaauaaugauga

SEQ ID NO: 492606 - RNA, 22 nt, Human
auguuuuacccuuugcacaaac

SEQ ID NO: 492607 - RNA, 22 nt, Human
gagccuggauagccuuguucca

SEQ ID NO: 492608 - RNA, 22 nt, Human
agacaucaaugaucagagguag

SEQ ID NO: 492609 - RNA, 22 nt, Human
gagcuucagagaccacuuaacu

SEQ ID NO: 492610 - RNA, 22 nt, Human
ugcaaggcccagacaagagcuc

SEQ ID NO: 492611 - RNA, 19 nt, Human
uugcugaaggaagccucug

SEQ ID NO: 492612 - RNA, 22 nt, Human
cugaugauagugauuuauugag

SEQ ID NO: 492613 - RNA, 22 nt, Human
gugugcaugugcuugcacagau

SEQ ID NO: 492614 - RNA, 22 nt, Human
accuggcuuguuucuaccuccu

SEQ ID NO: 492615 - RNA, 20 nt, Human
ugugcccugcagacuucuuu

SEQ ID NO: 492616 - RNA, 23 nt, Human
gcugaauguaauguucuuugggu

SEQ ID NO: 492617 - RNA, 22 nt, Human
cauuuguguccgucccaguucu

SEQ ID NO: 492618 - RNA, 22 nt, Human
acaggacagucuaguaacagua

SEQ ID NO: 492619 - RNA, 18 nt, Human
cugccccuucucugagau

SEQ ID NO: 492620 - RNA, 22 nt, Human
acuuagcaauuugauuaaaaga

SEQ ID NO: 492621 - RNA, 22 nt, Human
ugucuuuacuuagaaguucagg

SEQ ID NO: 492622 - RNA, 22 nt, Human
auauuugugguuuuuggcuccu

SEQ ID NO: 492623 - RNA, 22 nt, Human
accuggcuucuaaucauggcuc

SEQ ID NO: 492624 - RNA, 22 nt, Human
gccuuagccugcacuuccuguu

SEQ ID NO: 492625 - RNA, 22 nt, Human
gaggccuggaauuccagccugg

SEQ ID NO: 492626 - RNA, 22 nt, Human
caaagaguuuuuucauauaaug

SEQ ID NO: 492627 - RNA, 22 nt, Human
uuguccugauuuauaaaaugaa

SEQ ID NO: 492628 - RNA, 22 nt, Human
ugaaugauacagaauuauguag

SEQ ID NO: 492629 - RNA, 22 nt, Human
cagcagcagcuuaguggucccc

SEQ ID NO: 492630 - RNA, 22 nt, Human
cagagccucucagaggucagac

SEQ ID NO: 492631 - RNA, 22 nt, Human
guggcacagagauggggcauga

SEQ ID NO: 492632 - RNA, 22 nt, Human
uuugcugaguugaaguuugagg

SEQ ID NO: 492633 - RNA, 22 nt, Human
agccacagggggugagggacaa

SEQ ID NO: 492634 - RNA, 22 nt, Human
gcauugaauccuaucaggcaaa

SEQ ID NO: 492635 - RNA, 22 nt, Human
gguaacuugaguguguuguuca

SEQ ID NO: 492636 - RNA, 22 nt, Human
gcaugugucuccccaguggagg

SEQ ID NO: 492637 - RNA, 22 nt, Human
aaacaguuuucucauuuagugu

SEQ ID NO: 492638 - RNA, 22 nt, Human
ugaaugauuugggugcauucag

SEQ ID NO: 492639 - RNA, 22 nt, Human
guagggagcccagagcccagug

SEQ ID NO: 492640 - RNA, 22 nt, Human
cacacagacagcucucugaaga

SEQ ID NO: 492641 - RNA, 22 nt, Human
gugcccugucucuugucuccag

SEQ ID NO: 492642 - RNA, 22 nt, Human
ucuuagcauuuguuaauaccca

SEQ ID NO: 492643 - RNA, 22 nt, Human
cugugggcuccugcagcucagg

SEQ ID NO: 492644 - RNA, 22 nt, Human
uauguguguuucaguggaaaug

SEQ ID NO: 492645 - RNA, 22 nt, Human
aggugcagcugguggagucugg

SEQ ID NO: 492646 - RNA, 19 nt, Human
uccugggcugggccagguc

SEQ ID NO: 492647 - RNA, 22 nt, Human
cugagcugcucccgcugcagcg

SEQ ID NO: 492648 - RNA, 23 nt, Human
auguuuuaugucucuagcugcca

SEQ ID NO: 492649 - RNA, 22 nt, Human
gguccuggcagucuuugguugu

SEQ ID NO: 492650 - RNA, 22 nt, Human
uaugauauucuaaauugacacc

SEQ ID NO: 492651 - RNA, 22 nt, Human
aaacaguuuauaacaugauacu

SEQ ID NO: 492652 - RNA, 22 nt, Human
uguggaggauucugaugccagc

SEQ ID NO: 492653 - RNA, 22 nt, Human
uugucacauguaguucauucuc

SEQ ID NO: 492654 - RNA, 22 nt, Human
ggccggccuuugcgagcauucu

SEQ ID NO: 492655 - RNA, 22 nt, Human
caugugugaguauaucuuaucc

SEQ ID NO: 492656 - RNA, 22 nt, Human
uuugaaauaugaggcauuauga

SEQ ID NO: 492657 - RNA, 22 nt, Human
acacaguaugacauuggcagag

SEQ ID NO: 492658 - RNA, 22 nt, Human
cauuuguaauacugacuugcag

SEQ ID NO: 492659 - RNA, 22 nt, Human
cugaaugaaugguuugucuuau

SEQ ID NO: 492660 - RNA, 21 nt, Human
aaacugaccuugccugagaca

SEQ ID NO: 492661 - RNA, 22 nt, Human
ucugggcuugguuagggcuguu

SEQ ID NO: 492662 - RNA, 22 nt, Human
ugaaugaugaggggagaauaau

SEQ ID NO: 492663 - RNA, 22 nt, Human
cugcccugggaguaccuguccu

SEQ ID NO: 492664 - RNA, 22 nt, Human
ggcuucagugagcugagcucac

SEQ ID NO: 492665 - RNA, 22 nt, Human
agagccagcaacucuagcccug

SEQ ID NO: 492666 - RNA, 22 nt, Human
uugcugaaguuaaugcuugcaa

SEQ ID NO: 492667 - RNA, 22 nt, Human
uccugcuguuuucuggcccaca

SEQ ID NO: 492668 - RNA, 22 nt, Human
uaauuuuguauugccauuguag

SEQ ID NO: 492669 - RNA, 22 nt, Human
uauguacacacacaugcaugua

SEQ ID NO: 492670 - RNA, 23 nt, Human
gccucuggagccccagugcucag

SEQ ID NO: 492671 - RNA, 22 nt, Human
uuguuuuaacgacucagcuugu

SEQ ID NO: 492672 - RNA, 22 nt, Human
uccugugugggcaggaugagaa

SEQ ID NO: 492673 - RNA, 22 nt, Human
agccacaggaaacagagacagc

SEQ ID NO: 492674 - RNA, 20 nt, Human
uccaagcccuccuuccauuc

SEQ ID NO: 492675 - RNA, 22 nt, Human
aauuagcuuuaccuaggauugu

SEQ ID NO: 492676 - RNA, 22 nt, Human
cagcccugaaacaaccuccucu

SEQ ID NO: 492677 - RNA, 22 nt, Human
uacacagaagccagaaggccug

SEQ ID NO: 492678 - RNA, 22 nt, Human
aauggcagaaugggccagaagc

SEQ ID NO: 492679 - RNA, 21 nt, Human
aaaaaugaaguuguucaggaa

SEQ ID NO: 492680 - RNA, 22 nt, Human
uuagcugacugugugauuuggc

SEQ ID NO: 492681 - RNA, 22 nt, Human
ccugcgucgugugggcagugac

SEQ ID NO: 492682 - RNA, 22 nt, Human
gagucacaaagccuuucuuauu

SEQ ID NO: 492683 - RNA, 22 nt, Human
ccagcacucuauugaauauucu

SEQ ID NO: 492684 - RNA, 22 nt, Human
cuguggagcuuguggcaguggg

SEQ ID NO: 492685 - RNA, 22 nt, Human
agucaaagaugaccgaguuccu

SEQ ID NO: 492686 - RNA, 22 nt, Human
gcacuagucaagugaacaauuu

SEQ ID NO: 492687 - RNA, 22 nt, Human
cccagccucugggcucacccaa

SEQ ID NO: 492688 - RNA, 22 nt, Human
uuucaaauagaaucuuuccaaa

SEQ ID NO: 492689 - RNA, 22 nt, Human
aaauggaagaagugcaauacug

SEQ ID NO: 492690 - RNA, 20 nt, Human
uugaaugaaugucuggcuca

SEQ ID NO: 492691 - RNA, 19 nt, Human
ucuagucagucagucauuc

SEQ ID NO: 492692 - RNA, 22 nt, Human
aaacaaacaauuaguugugugg

SEQ ID NO: 492693 - RNA, 22 nt, Human
ucagcacuggcgcugggcaggu

SEQ ID NO: 492694 - RNA, 22 nt, Human
ucuuucaaugugaaaccaugua

SEQ ID NO: 492695 - RNA, 22 nt, Human
cccugcucuuagugccugugug

SEQ ID NO: 492696 - RNA, 19 nt, Human
uaauaagcaauauggaagu

SEQ ID NO: 492697 - RNA, 22 nt, Human
uguauuagagcauauaauuuga

SEQ ID NO: 492698 - RNA, 19 nt, Human
ucugaaugggaugaguugg

SEQ ID NO: 492699 - RNA, 19 nt, Human
cuucagcaucuccggagcu

SEQ ID NO: 492700 - RNA, 22 nt, Human
guucagcaaguacucaguccac

SEQ ID NO: 492701 - RNA, 22 nt, Human
cagagcaccagugggagacaag

SEQ ID NO: 492702 - RNA, 22 nt, Human
acaaggaccaugaggcagaccc

SEQ ID NO: 492703 - RNA, 19 nt, Human
gcagccaggugcucuaccu

SEQ ID NO: 492704 - RNA, 22 nt, Human
uaucuaaaggauuuaauuuagu

SEQ ID NO: 492705 - RNA, 22 nt, Human
cuggccuggagccucugggugg

SEQ ID NO: 492706 - RNA, 18 nt, Human
agcuccaucugucagcau

SEQ ID NO: 492707 - RNA, 22 nt, Human
uagcauuaaagguaagacauua

SEQ ID NO: 492708 - RNA, 22 nt, Human
acuuagcagguacuuucauauu

SEQ ID NO: 492709 - RNA, 22 nt, Human
cauaauuagagaauucauguua

SEQ ID NO: 492710 - RNA, 21 nt, Human
gcugaagaacucuuuauuuuc

SEQ ID NO: 492711 - RNA, 22 nt, Human
guccugggcggagggcugcugu

SEQ ID NO: 492712 - RNA, 17 nt, Human
agcuucaguugcaaaac

SEQ ID NO: 492713 - RNA, 22 nt, Human
aaugacaugcuuuuuaauuaua

SEQ ID NO: 492714 - RNA, 22 nt, Human
cugccagcucgccacaaugaca

SEQ ID NO: 492715 - RNA, 22 nt, Human
cagagacaaccugguagagaaa

SEQ ID NO: 492716 - RNA, 22 nt, Human
gaaauaacagcucuggaagagu

SEQ ID NO: 492717 - RNA, 22 nt, Human
agagucaccuuuuccucaggau

SEQ ID NO: 492718 - RNA, 22 nt, Human
cugaauggcgaguuaguuaguu

SEQ ID NO: 492719 - RNA, 22 nt, Human
cugaaugauaaucuuuugcugg

SEQ ID NO: 492720 - RNA, 22 nt, Human
ucuuggcuacuuaggaggauuc

SEQ ID NO: 492721 - RNA, 17 nt, Human
uccuggcucugccacug

SEQ ID NO: 492722 - RNA, 22 nt, Human
uuguccuggagguuaauagagu

SEQ ID NO: 492723 - RNA, 22 nt, Human
caucacugucaccaucuuuccu

SEQ ID NO: 492724 - RNA, 22 nt, Human
ugcugaauuccagggccccacu

SEQ ID NO: 492725 - RNA, 22 nt, Human
uugaaugaggaagagcacuggc

SEQ ID NO: 492726 - RNA, 22 nt, Human
caugugugugagggaaacaugu

SEQ ID NO: 492727 - RNA, 22 nt, Human
ccuccucugugcagcugugggu

SEQ ID NO: 492728 - RNA, 20 nt, Human
ucaagacagacauggaguuu

SEQ ID NO: 492729 - RNA, 22 nt, Human
ugucagugaguuggguccugag

SEQ ID NO: 492730 - RNA, 22 nt, Human
gcuguuggcgaggagcucagcu

SEQ ID NO: 492731 - RNA, 22 nt, Human
guccuuggcugggcuugccucg

SEQ ID NO: 492732 - RNA, 22 nt, Human
agggccagcacuccuggcagga

SEQ ID NO: 492733 - RNA, 22 nt, Human
uucauuuguugacagagacaug

SEQ ID NO: 492734 - RNA, 22 nt, Human
uucuuauucuugaaauguggga

SEQ ID NO: 492735 - RNA, 22 nt, Human
gcacacagacuaaccauauuuc

SEQ ID NO: 492736 - RNA, 22 nt, Human
uggaaacugugguauuucuuua

SEQ ID NO: 492737 - RNA, 22 nt, Human
augcccugcugccaucuggccg

SEQ ID NO: 492738 - RNA, 22 nt, Human
aacauuucauaacuugacuuuu

SEQ ID NO: 492739 - RNA, 22 nt, Human
acagauguuagcaaugaugaug

SEQ ID NO: 492740 - RNA, 22 nt, Human
ucugggcuuuugcacuggccau

SEQ ID NO: 492741 - RNA, 22 nt, Human
aaagacaugacacauuggagag

SEQ ID NO: 492742 - RNA, 22 nt, Human
aggaagcugggguguucuucau

SEQ ID NO: 492743 - RNA, 22 nt, Human
gagacacaaucucauuuacauu

SEQ ID NO: 492744 - RNA, 22 nt, Human
agauauuuguaucuugcuauug

SEQ ID NO: 492745 - RNA, 22 nt, Human
ugcacagggagggggccagcuc

SEQ ID NO: 492746 - RNA, 22 nt, Human
ggagccagugcccucuggugga

SEQ ID NO: 492747 - RNA, 22 nt, Human
aagcagcauaugacagcaucca

SEQ ID NO: 492748 - RNA, 22 nt, Human
cauagugucugguaacauagua

SEQ ID NO: 492749 - RNA, 17 nt, Human
uuacaacaauucaugag

SEQ ID NO: 492750 - RNA, 22 nt, Human
ccucugugggccgggccugcug

SEQ ID NO: 492751 - RNA, 23 nt, Human
uugcacaguguauacacauauuu

SEQ ID NO: 492752 - RNA, 22 nt, Human
gugcauuugugcaugcacaugu

SEQ ID NO: 492753 - RNA, 22 nt, Human
gaaucauagaacauuaauagaa

SEQ ID NO: 492754 - RNA, 22 nt, Human
ccagcccuugaggucuguccau

SEQ ID NO: 492755 - RNA, 22 nt, Human
auuaagugacuaaaguaaugcu

SEQ ID NO: 492756 - RNA, 22 nt, Human
cuguaaauaugaagaauauaug

SEQ ID NO: 492757 - RNA, 22 nt, Human
acgugcaucuuuccauaugugg

SEQ ID NO: 492758 - RNA, 22 nt, Human
guggggagcagccuuagccccu

SEQ ID NO: 492759 - RNA, 22 nt, Human
cuuagcuuuguuuaacacaggg

SEQ ID NO: 492760 - RNA, 22 nt, Human
ggagccagcucccuccuuguga

SEQ ID NO: 492761 - RNA, 22 nt, Human
ccagcucuggcuucuugcuggg

SEQ ID NO: 492762 - RNA, 22 nt, Human
agcauauaggaaauguugaauc

SEQ ID NO: 492763 - RNA, 20 nt, Human
uauuuguauuugggaaaguu

SEQ ID NO: 492764 - RNA, 22 nt, Human
gcugggcuccaggccaggguga

SEQ ID NO: 492765 - RNA, 22 nt, Human
uaggugggugacuuccaugggg

SEQ ID NO: 492766 - RNA, 22 nt, Human
gucaugccuggcuucuuagaca

SEQ ID NO: 492767 - RNA, 22 nt, Human
cauuuguacagaacagcuuuau

SEQ ID NO: 492768 - RNA, 22 nt, Human
cuuguuuucuaaaacaucauuu

SEQ ID NO: 492769 - RNA, 22 nt, Human
uaaugcuuaauuuucacaagcc

SEQ ID NO: 492770 - RNA, 22 nt, Human
aucuguaacaucaguagcagaa

SEQ ID NO: 492771 - RNA, 22 nt, Human
ggcuuuaguguagguuucuguu

SEQ ID NO: 492772 - RNA, 22 nt, Human
cucuggcuuugcucaugcaucc

SEQ ID NO: 492773 - RNA, 19 nt, Human
aggcagcauucuggggcuu

SEQ ID NO: 492774 - RNA, 22 nt, Human
ucagcacaggucuugcaaaaca

SEQ ID NO: 492775 - RNA, 22 nt, Human
uagcauuagagauagaaauagu

SEQ ID NO: 492776 - RNA, 22 nt, Human
cucugcccgcggaugccacguc

SEQ ID NO: 492777 - RNA, 22 nt, Human
uaauuacagguccaaaacaauc

SEQ ID NO: 492778 - RNA, 22 nt, Human
cugggcucagcaggccaaggcc

SEQ ID NO: 492779 - RNA, 22 nt, Human
accuggcuuccaaucuaggagc

SEQ ID NO: 492780 - RNA, 22 nt, Human
acaaaugagaauguagacagag

SEQ ID NO: 492781 - RNA, 22 nt, Human
uuuccagucucagcccuguaac

SEQ ID NO: 492782 - RNA, 22 nt, Human
aagcuucauauaugugugaguc

SEQ ID NO: 492783 - RNA, 22 nt, Human
ccagggcaacgcugucucagag

SEQ ID NO: 492784 - RNA, 22 nt, Human
uuucugcaaacuuccacgucuc

SEQ ID NO: 492785 - RNA, 22 nt, Human
ccuggcuccaaagcugugacuc

SEQ ID NO: 492786 - RNA, 22 nt, Human
cugggcugagccugggcugugu

SEQ ID NO: 492787 - RNA, 20 nt, Human
aaacauucauguacaaguga

SEQ ID NO: 492788 - RNA, 22 nt, Human
agguccugaagauuuuacuaga

SEQ ID NO: 492789 - RNA, 22 nt, Human
agagcacaguaucugcacauca

SEQ ID NO: 492790 - RNA, 22 nt, Human
cuguggagaugcagaccaggcc

SEQ ID NO: 492791 - RNA, 22 nt, Human
gcugcucugggucugcccagcu

SEQ ID NO: 492792 - RNA, 22 nt, Human
caggccucuauggucagcugag

SEQ ID NO: 492793 - RNA, 22 nt, Human
gccuucugcgcucgugucuccg

SEQ ID NO: 492794 - RNA, 22 nt, Human
aauuagcuaauuaauuguagcc

SEQ ID NO: 492795 - RNA, 22 nt, Human
ggcuucagaggggagguagugc

SEQ ID NO: 492796 - RNA, 23 nt, Human
ugauuacaagggccaaagaaagg

SEQ ID NO: 492797 - RNA, 22 nt, Human
auuauuugacuugagaacaggu

SEQ ID NO: 492798 - RNA, 22 nt, Human
uaacacaaaagaauaugugugu

SEQ ID NO: 492799 - RNA, 22 nt, Human
gcagggcagcuuagucccuguc

SEQ ID NO: 492800 - RNA, 22 nt, Human
uggcagccuggaaucucucagc

SEQ ID NO: 492801 - RNA, 22 nt, Human
uuuuagaaagaucccuggcagg

SEQ ID NO: 492802 - RNA, 22 nt, Human
uacagagagagggguuaccagg

SEQ ID NO: 492803 - RNA, 21 nt, Human
ucugggcccaugcugccucac

SEQ ID NO: 492804 - RNA, 22 nt, Human
uccuuagccggagcagcucauc

SEQ ID NO: 492805 - RNA, 22 nt, Human
uugcugaagcugccaaaccagu

SEQ ID NO: 492806 - RNA, 22 nt, Human
gggaaacucacaggugcagggg

SEQ ID NO: 492807 - RNA, 22 nt, Human
cccagccuuugcuuccugguuc

SEQ ID NO: 492808 - RNA, 22 nt, Human
uguacaaggccaucuacaugcu

SEQ ID NO: 492809 - RNA, 22 nt, Human
uucuuuuaaugucuggcuuuca

SEQ ID NO: 492810 - RNA, 22 nt, Human
uaaaugacauucuuaagucuug

SEQ ID NO: 492811 - RNA, 22 nt, Human
guacauauccuuuacguuuugu

SEQ ID NO: 492812 - RNA, 22 nt, Human
aagaguggagcuggaaaguggg

SEQ ID NO: 492813 - RNA, 22 nt, Human
cugggcccacgagggcucuggg

SEQ ID NO: 492814 - RNA, 21 nt, Human
ucauccagguccugcuucuuc

SEQ ID NO: 492815 - RNA, 22 nt, Human
aggcugcagaggugcugccaga

SEQ ID NO: 492816 - RNA, 22 nt, Human
ucagaagcauccauuucaccac

SEQ ID NO: 492817 - RNA, 22 nt, Human
ugccagagaggagaaagcauuu

SEQ ID NO: 492818 - RNA, 22 nt, Human
gacauuuauuggauuuuacgag

SEQ ID NO: 492819 - RNA, 22 nt, Human
acuuuuaaggggccuugauuua

SEQ ID NO: 492820 - RNA, 22 nt, Human
gcucaugggcccagagcagccc

SEQ ID NO: 492821 - RNA, 20 nt, Human
aggcccuccccacuguugcu

SEQ ID NO: 492822 - RNA, 22 nt, Human
ugcccucagcagcagcuccugc

SEQ ID NO: 492823 - RNA, 22 nt, Human
aggucuacaugcuuaauauauc

SEQ ID NO: 492824 - RNA, 22 nt, Human
acacacagaaggaagccccacu

SEQ ID NO: 492825 - RNA, 22 nt, Human
ugcuugucucucugugcccacu

SEQ ID NO: 492826 - RNA, 22 nt, Human
uugcuggaagguggcuggaauc

SEQ ID NO: 492827 - RNA, 22 nt, Human
gaagccaaguccucgaguuuca

SEQ ID NO: 492828 - RNA, 22 nt, Human
gucuggagccacugcugcugcu

SEQ ID NO: 492829 - RNA, 22 nt, Human
aucucccaaauuagccucuuga

SEQ ID NO: 492830 - RNA, 22 nt, Human
aggcccauaguagcucugggca

SEQ ID NO: 492831 - RNA, 22 nt, Human
aggguccugggugcaguugcuu

SEQ ID NO: 492832 - RNA, 17 nt, Human
uccuggccuggugugug

SEQ ID NO: 492833 - RNA, 22 nt, Human
caggccacagcuaaagaggauu

SEQ ID NO: 492834 - RNA, 22 nt, Human
ggaagaggcugaggccaugcug

SEQ ID NO: 492835 - RNA, 19 nt, Human
cucugccauuugcugccug

SEQ ID NO: 492836 - RNA, 22 nt, Human
uuugcuugauuaggauauggaa

SEQ ID NO: 492837 - RNA, 22 nt, Human
ugugaagcgugugcaggggaca

SEQ ID NO: 492838 - RNA, 22 nt, Human
uugggucaugggaucccagcau

SEQ ID NO: 492839 - RNA, 22 nt, Human
gagcaccgccuccacgaugccc

SEQ ID NO: 492840 - RNA, 22 nt, Human
ucuggaaggggaucugugguca

SEQ ID NO: 492841 - RNA, 22 nt, Human
uggcacugaagcuggaaagccu

SEQ ID NO: 492842 - RNA, 22 nt, Human
aagagagaacucccuucgccag

SEQ ID NO: 492843 - RNA, 22 nt, Human
accccagaggcggaggcugcag

SEQ ID NO: 492844 - RNA, 22 nt, Human
ucuccuggcauuugguugagua

SEQ ID NO: 492845 - RNA, 22 nt, Human
cucgccccggcacaguguccgu

SEQ ID NO: 492846 - RNA, 22 nt, Human
ucgggcucgcucuccuagcgga

SEQ ID NO: 492847 - RNA, 22 nt, Human
agugucugcgggcagaggagcg

SEQ ID NO: 492848 - RNA, 22 nt, Human
gcaaggagcaccuuucuggaac

SEQ ID NO: 492849 - RNA, 19 nt, Human
gggugaggaagagcguugc

SEQ ID NO: 492850 - RNA, 22 nt, Human
gcagagucagguccaaggacug

SEQ ID NO: 492851 - RNA, 22 nt, Human
cacucucacaugcccugucagu

SEQ ID NO: 492852 - RNA, 22 nt, Human
aauaucaucucucuuuucugca

SEQ ID NO: 492853 - RNA, 20 nt, Human
ccagguggugccuggagagg

SEQ ID NO: 492854 - RNA, 22 nt, Human
aguaacuuaagcaauuguguau

SEQ ID NO: 492855 - RNA, 22 nt, Human
uaguauuuccuguaagcuauag

SEQ ID NO: 492856 - RNA, 22 nt, Human
cgcagcugcugcucugaaacag

SEQ ID NO: 492857 - RNA, 22 nt, Human
cuuggcugaacuccaggaugca

SEQ ID NO: 492858 - RNA, 22 nt, Human
uacccacugucauauucagggu

SEQ ID NO: 492859 - RNA, 22 nt, Human
agcaccagcucaaggugcaccu

SEQ ID NO: 492860 - RNA, 22 nt, Human
ugucggccacgagggagccgcg

SEQ ID NO: 492861 - RNA, 22 nt, Human
uguaccgccuugugggguuggg

SEQ ID NO: 492862 - RNA, 22 nt, Human
agcucagaacugcagacaugug

SEQ ID NO: 492863 - RNA, 22 nt, Human
uucuguaauucuguuaguuuca

SEQ ID NO: 492864 - RNA, 22 nt, Human
uaaaguuuauuggcaccaccau

SEQ ID NO: 492865 - RNA, 22 nt, Human
aguuggcuucaaaggcagagag

SEQ ID NO: 492866 - RNA, 22 nt, Human
agcaaauaauugucuuugaggg

SEQ ID NO: 492867 - RNA, 21 nt, Human
agaugaggauacugaggccua

SEQ ID NO: 492868 - RNA, 22 nt, Human
uccaggagggggagccgugccg

SEQ ID NO: 492869 - RNA, 22 nt, Human
gguuguaguuggagguuguaua

SEQ ID NO: 492870 - RNA, 23 nt, Human
uggagaauucagucuuuguuuug

SEQ ID NO: 492871 - RNA, 22 nt, Human
acugugugccaggcgcuggucu

SEQ ID NO: 492872 - RNA, 22 nt, Human
agcugaacgugcuucugcagca

SEQ ID NO: 492873 - RNA, 22 nt, Human
aagggccagggcucuagagaua

SEQ ID NO: 492874 - RNA, 22 nt, Human
gcagagcugucuaagucacuuc

SEQ ID NO: 492875 - RNA, 22 nt, Human
uugagacacaaggcacaguaag

SEQ ID NO: 492876 - RNA, 22 nt, Human
agcuccugaaaauccagacugg

SEQ ID NO: 492877 - RNA, 22 nt, Human
aaaacauuuuacugccaucuca

SEQ ID NO: 492878 - RNA, 22 nt, Human
ggaggaggggugacugaaugcu

SEQ ID NO: 492879 - RNA, 22 nt, Human
ccuggggagaagagcuuccccc

SEQ ID NO: 492880 - RNA, 22 nt, Human
ggcuaaggacgggcaaguccca

SEQ ID NO: 492881 - RNA, 22 nt, Human
gccacaggaaagcacccuggag

SEQ ID NO: 492882 - RNA, 20 nt, Human
uccuccuugcagagcccaga

SEQ ID NO: 492883 - RNA, 23 nt, Human
uguguucagucaaggaucagagu

SEQ ID NO: 492884 - RNA, 22 nt, Human
caauguacaaaauaauuacaca

SEQ ID NO: 492885 - RNA, 21 nt, Human
agaaggcaaaagcagacaucu

SEQ ID NO: 492886 - RNA, 22 nt, Human
uuccagaacaauguggacguau

SEQ ID NO: 492887 - RNA, 18 nt, Human
agcugaggggacugaaga

SEQ ID NO: 492888 - RNA, 22 nt, Human
caguuuuacccaagcuuauuuu

SEQ ID NO: 492889 - RNA, 22 nt, Human
agaguguguggggcugagguca

SEQ ID NO: 492890 - RNA, 22 nt, Human
ucccagauuccugcucuuauau

SEQ ID NO: 492891 - RNA, 18 nt, Human
cccacggugcuguagggc

SEQ ID NO: 492892 - RNA, 18 nt, Human
ccucagggagagagacgc

SEQ ID NO: 492893 - RNA, 22 nt, Human
cgcuuuggagucccugcuuuac

SEQ ID NO: 492894 - RNA, 23 nt, Human
gcugccaaggaggcaggggugcc

SEQ ID NO: 492895 - RNA, 22 nt, Human
gccuucugauugcuggacugac

SEQ ID NO: 492896 - RNA, 22 nt, Human
aaggcaguuaauuuggcuagaa

SEQ ID NO: 492897 - RNA, 22 nt, Human
gaaccuggcagcccuauaucug

SEQ ID NO: 492898 - RNA, 22 nt, Human
gggggcgccgccgcucaucuca

SEQ ID NO: 492899 - RNA, 19 nt, Human
ccugugucccacguagaug

SEQ ID NO: 492900 - RNA, 22 nt, Human
gggggcuggacuuucccacaca

SEQ ID NO: 492901 - RNA, 22 nt, Human
gccaaucaggaggcuguacauc

SEQ ID NO: 492902 - RNA, 22 nt, Human
gcccagcgagcagagguggacg

SEQ ID NO: 492903 - RNA, 22 nt, Human
uuggaaaugcauuuguuauuau

SEQ ID NO: 492904 - RNA, 22 nt, Human
ugggggagccuucacaguagcu

SEQ ID NO: 492905 - RNA, 22 nt, Human
cccaggaguaagugacauuguu

SEQ ID NO: 492906 - RNA, 23 nt, Human
uagacugcaggcuccuugagggc

SEQ ID NO: 492907 - RNA, 22 nt, Human
ucugggaguuucugugggagcu

SEQ ID NO: 492908 - RNA, 22 nt, Human
ugcucgagguccccaccggcuc

SEQ ID NO: 492909 - RNA, 22 nt, Human
gccuggcuucccuuggagcauu

SEQ ID NO: 492910 - RNA, 22 nt, Human
gcuucuggugaggccucaggaa

SEQ ID NO: 492911 - RNA, 22 nt, Human
aucuucaaagcacaucguuugu

SEQ ID NO: 492912 - RNA, 22 nt, Human
uagaagaugccuuaaaguugaa

SEQ ID NO: 492913 - RNA, 22 nt, Human
caaauguuugguggcauuuugu

SEQ ID NO: 492914 - RNA, 22 nt, Human
ggaaggguuuaagcaggagagu

SEQ ID NO: 492915 - RNA, 22 nt, Human
cuggccagccucccagguaccc

SEQ ID NO: 492916 - RNA, 22 nt, Human
agugggaauuuucucccaggga

SEQ ID NO: 492917 - RNA, 20 nt, Human
cugcuccacccggcucucag

SEQ ID NO: 492918 - RNA, 22 nt, Human
ggagaggggaacuuguugcuug

SEQ ID NO: 492919 - RNA, 19 nt, Human
ugggcuuccccagggcaga

SEQ ID NO: 492920 - RNA, 22 nt, Human
aaggggggcaccugcaugcccg

SEQ ID NO: 492921 - RNA, 22 nt, Human
agcggcgccgagcuuggccagg

SEQ ID NO: 492922 - RNA, 19 nt, Human
uccuugacuguauucagag

SEQ ID NO: 492923 - RNA, 22 nt, Human
ucguggaucaccgcgucugugu

SEQ ID NO: 492924 - RNA, 22 nt, Human
cugucaccucugcccuuugccc

SEQ ID NO: 492925 - RNA, 22 nt, Human
gcucgguggccagccugaggcc

SEQ ID NO: 492926 - RNA, 21 nt, Human
acccugcuuuaugccguccuc

SEQ ID NO: 492927 - RNA, 22 nt, Human
uccagcuccugaguucacugcu

SEQ ID NO: 492928 - RNA, 22 nt, Human
cagaugaggcaaccucauugcu

SEQ ID NO: 492929 - RNA, 22 nt, Human
cuccuuggguucuuucgguucc

SEQ ID NO: 492930 - RNA, 22 nt, Human
gagccugagcaaugugauguuu

SEQ ID NO: 492931 - RNA, 22 nt, Human
gcaucugauccaauagauauau

SEQ ID NO: 492932 - RNA, 22 nt, Human
uucuuugcccauguuuccuaag

SEQ ID NO: 492933 - RNA, 22 nt, Human
ccugggaaggugaggcccugga

SEQ ID NO: 492934 - RNA, 22 nt, Human
aguguauuugccuauaaaaaug

SEQ ID NO: 492935 - RNA, 22 nt, Human
gccccagcagcaaugcgguuga

SEQ ID NO: 492936 - RNA, 22 nt, Human
uuucgggaaaaacugguaagac

SEQ ID NO: 492937 - RNA, 18 nt, Human
agggcugaugaguuuggg

SEQ ID NO: 492938 - RNA, 22 nt, Human
acagggagucugaggggauagu

SEQ ID NO: 492939 - RNA, 22 nt, Human
aaucaggagugugcacuuugau

SEQ ID NO: 492940 - RNA, 22 nt, Human
acccgcuuccggagcugcagug

SEQ ID NO: 492941 - RNA, 22 nt, Human
agccugugagggaugcugcagu

SEQ ID NO: 492942 - RNA, 18 nt, Human
cagaaaguuauuuacucu

SEQ ID NO: 492943 - RNA, 22 nt, Human
augcaacuacccccaggauuuu

SEQ ID NO: 492944 - RNA, 22 nt, Human
cgcacuggagcuggaacgaguc

SEQ ID NO: 492945 - RNA, 22 nt, Human
ugcuuuggcccaacauugaugc

SEQ ID NO: 492946 - RNA, 22 nt, Human
acauucuacaguuaaccauuag

SEQ ID NO: 492947 - RNA, 22 nt, Human
aguucugggaggugcacgucca

SEQ ID NO: 492948 - RNA, 22 nt, Human
auuauugcaagcagugaaggga

SEQ ID NO: 492949 - RNA, 22 nt, Human
agguucccagagauagagcugu

SEQ ID NO: 492950 - RNA, 20 nt, Human
augcacccucagggucccug

SEQ ID NO: 492951 - RNA, 22 nt, Human
gaagauuaccugagaccacuug

SEQ ID NO: 492952 - RNA, 22 nt, Human
ggccgggcuguggagaaggggu

SEQ ID NO: 492953 - RNA, 22 nt, Human
aguguugucaaacggcucagca

SEQ ID NO: 492954 - RNA, 22 nt, Human
ugaauagagcugcaguggacau

SEQ ID NO: 492955 - RNA, 22 nt, Human
uggccccugaggagcgucagcc

SEQ ID NO: 492956 - RNA, 22 nt, Human
uuccuccagccuggagcacuuc

SEQ ID NO: 492957 - RNA, 22 nt, Human
gccuggagcucggcugagggcg

SEQ ID NO: 492958 - RNA, 22 nt, Human
aaacucuacauggucgcaaaaa

SEQ ID NO: 492959 - RNA, 22 nt, Human
ccucagucuauuuccagcaggu

SEQ ID NO: 492960 - RNA, 22 nt, Human
cggcgcaggcagaccgcgggcu

SEQ ID NO: 492961 - RNA, 22 nt, Human
gguagacaacuuuguaauagcc

SEQ ID NO: 492962 - RNA, 21 nt, Human
auucugaguugucagucuuca

SEQ ID NO: 492963 - RNA, 22 nt, Human
gggcuucuugagcugccggccc

SEQ ID NO: 492964 - RNA, 18 nt, Human
uccuuucaccccuucucu

SEQ ID NO: 492965 - RNA, 22 nt, Human
ggcggcgcguagccggagacuu

SEQ ID NO: 492966 - RNA, 22 nt, Human
gggcuccagccaggugucccca

SEQ ID NO: 492967 - RNA, 22 nt, Human
uagggcucugagaguucagccu

SEQ ID NO: 492968 - RNA, 22 nt, Human
ucuguggcaaacacagugacca

SEQ ID NO: 492969 - RNA, 22 nt, Human
ccugggcugcucauggggauga

SEQ ID NO: 492970 - RNA, 22 nt, Human
cagucucuggugaguugacagu

SEQ ID NO: 492971 - RNA, 22 nt, Human
aagccgggccugagaaaugaca

SEQ ID NO: 492972 - RNA, 22 nt, Human
gcuggccugaccugaggcuggg

SEQ ID NO: 492973 - RNA, 22 nt, Human
gaaaggagaggguuaaggagcu

SEQ ID NO: 492974 - RNA, 22 nt, Human
agccugugcuguguuugcucca

SEQ ID NO: 492975 - RNA, 22 nt, Human
gcugaggcucaauccccuucug

SEQ ID NO: 492976 - RNA, 22 nt, Human
cggagccugcuuguugcagcug

SEQ ID NO: 492977 - RNA, 17 nt, Human
gcguguccccgcgucuc

SEQ ID NO: 492978 - RNA, 22 nt, Human
ggaagcuguuaucaucuguauc

SEQ ID NO: 492979 - RNA, 22 nt, Human
uggcuuuugaaaaggugaugua

SEQ ID NO: 492980 - RNA, 21 nt, Human
cccuugccugcacuccucggc

SEQ ID NO: 492981 - RNA, 23 nt, Human
uguacacuuggucaagguacuua

SEQ ID NO: 492982 - RNA, 22 nt, Human
gauucugaaauuaacagacugg

SEQ ID NO: 492983 - RNA, 22 nt, Human
uccaaggucagcgagagucacu

SEQ ID NO: 492984 - RNA, 22 nt, Human
gggccuuggcgaaguguggugg

SEQ ID NO: 492985 - RNA, 22 nt, Human
ugccaggccucaggagucucca

SEQ ID NO: 492986 - RNA, 22 nt, Human
gcagaagcccggucagcgcacg

SEQ ID NO: 492987 - RNA, 22 nt, Human
ccugcagacacuuguccagcaa

SEQ ID NO: 492988 - RNA, 22 nt, Human
cugcacagccugucugggggcc

SEQ ID NO: 492989 - RNA, 22 nt, Human
agguagcuggugcugggcuccu

SEQ ID NO: 492990 - RNA, 22 nt, Human
cuggccagggugcgaucguggu

SEQ ID NO: 492991 - RNA, 22 nt, Human
ccugaccaacguggugaaaccc

SEQ ID NO: 492992 - RNA, 22 nt, Human
ccaggcccugccugugguuccu

SEQ ID NO: 492993 - RNA, 22 nt, Human
cagcuccagcccaggcagcucc

SEQ ID NO: 492994 - RNA, 21 nt, Human
aaguccaauaccuaaggcucc

SEQ ID NO: 492995 - RNA, 22 nt, Human
gaugugugugcccugggccugc

SEQ ID NO: 492996 - RNA, 22 nt, Human
ggaggugacuggaucaugggca

SEQ ID NO: 492997 - RNA, 22 nt, Human
caggugggagccacagcguaca

SEQ ID NO: 492998 - RNA, 20 nt, Human
uccagccacuuccgcugguc

SEQ ID NO: 492999 - RNA, 22 nt, Human
acaccacaaguaacucuuuucc

SEQ ID NO: 493000 - RNA, 22 nt, Human
cccacugcugcucuccauggca

SEQ ID NO: 493001 - RNA, 22 nt, Human
ccuggccauagggcccaggaaa

SEQ ID NO: 493002 - RNA, 22 nt, Human
uguuuuaagggucaacugucac

SEQ ID NO: 493003 - RNA, 22 nt, Human
agccaggucaggaaagguccca

SEQ ID NO: 493004 - RNA, 22 nt, Human
ugugugcacaaagaguacaugg

SEQ ID NO: 493005 - RNA, 22 nt, Human
ggccucugccccgcggggcucg

SEQ ID NO: 493006 - RNA, 22 nt, Human
cgugcagcggagcuggucacug

SEQ ID NO: 493007 - RNA, 21 nt, Human
ucagagggcccuggaggcuca

SEQ ID NO: 493008 - RNA, 19 nt, Human
caucuggaugauucuccug

SEQ ID NO: 493009 - RNA, 22 nt, Human
gcagaggggaagcugaggaauu

SEQ ID NO: 493010 - RNA, 22 nt, Human
uuuggcgucucucaggagcuca

SEQ ID NO: 493011 - RNA, 23 nt, Human
agggcacugaagcuggaauuggg

SEQ ID NO: 493012 - RNA, 22 nt, Human
gccccgucguggggccagggau

SEQ ID NO: 493013 - RNA, 22 nt, Human
agcgcuggugaucucuauuuug

SEQ ID NO: 493014 - RNA, 22 nt, Human
ggccgcggauuuucccgcuggc

SEQ ID NO: 493015 - RNA, 22 nt, Human
acaaguuucauuguuuagaacc

SEQ ID NO: 493016 - RNA, 22 nt, Human
gggcccuggacguggcggcaga

SEQ ID NO: 493017 - RNA, 22 nt, Human
acacuggacucagaggccagaa

SEQ ID NO: 493018 - RNA, 22 nt, Human
uugcuggaguagaaaacuuaac

SEQ ID NO: 493019 - RNA, 22 nt, Human
aggacagagggaccagagccca

SEQ ID NO: 493020 - RNA, 22 nt, Human
gaggcucagagggacuuucaag

SEQ ID NO: 493021 - RNA, 22 nt, Human
uccugagauaggaguugaaggc

SEQ ID NO: 493022 - RNA, 22 nt, Human
guguuucccuggcacaagaacc

SEQ ID NO: 493023 - RNA, 22 nt, Human
agccccaguccgcugcgggcgg

SEQ ID NO: 493024 - RNA, 22 nt, Human
cuggagaacagagcuguuuaga

SEQ ID NO: 493025 - RNA, 22 nt, Human
augcuuccagauugguaggggu

SEQ ID NO: 493026 - RNA, 22 nt, Human
ugcuccugaacacagcccuaug

SEQ ID NO: 493027 - RNA, 22 nt, Human
aaauugcaaaaguacuuuuagg

SEQ ID NO: 493028 - RNA, 18 nt, Human
gagaggagccagaauuuu

SEQ ID NO: 493029 - RNA, 22 nt, Human
cagaccuggaaaacaggcuugc

SEQ ID NO: 493030 - RNA, 22 nt, Human
uacaucucaucugugcucuccg

SEQ ID NO: 493031 - RNA, 22 nt, Human
ggccugcuucucugggcuuucu

SEQ ID NO: 493032 - RNA, 22 nt, Human
ugggagcaagcuggugcuggag

SEQ ID NO: 493033 - RNA, 18 nt, Human
gagagcccagcagguggu

SEQ ID NO: 493034 - RNA, 22 nt, Human
uccacccugcuuuugucuuuga

SEQ ID NO: 493035 - RNA, 22 nt, Human
ucucaucugccauuugcaggag

SEQ ID NO: 493036 - RNA, 22 nt, Human
ccccacaccugccgggcagcag

SEQ ID NO: 493037 - RNA, 22 nt, Human
aggaagagcuggaccagaggac

SEQ ID NO: 493038 - RNA, 22 nt, Human
ucuuuuccuugaugguuaaaua

SEQ ID NO: 493039 - RNA, 22 nt, Human
aagcauuuuagauaaagcauca

SEQ ID NO: 493040 - RNA, 22 nt, Human
ugggcugcuucuauuggugguc

SEQ ID NO: 493041 - RNA, 22 nt, Human
gucuagggcuccucagugacaa

SEQ ID NO: 493042 - RNA, 22 nt, Human
augugggccgugcggguguccu

SEQ ID NO: 493043 - RNA, 22 nt, Human
guaugucaugagccuugugcgu

SEQ ID NO: 493044 - RNA, 22 nt, Human
agucauguguucaucuuucauu

SEQ ID NO: 493045 - RNA, 22 nt, Human
ccaggcaaagcccaugcaagag

SEQ ID NO: 493046 - RNA, 22 nt, Human
ggggaccuggccacccauccuu

SEQ ID NO: 493047 - RNA, 22 nt, Human
uugagacugagucucgcccugu

SEQ ID NO: 493048 - RNA, 22 nt, Human
ggcaucagcccgguccugggcu

SEQ ID NO: 493049 - RNA, 22 nt, Human
auuaauaucccccgccguucug

SEQ ID NO: 493050 - RNA, 22 nt, Human
uugucgggcuuacgcagggcca

SEQ ID NO: 493051 - RNA, 21 nt, Human
cccgugccuucagcaguccug

SEQ ID NO: 493052 - RNA, 22 nt, Human
uucguuuaguccacaaaugcau

SEQ ID NO: 493053 - RNA, 22 nt, Human
acaagcgggccacagugcuggu

SEQ ID NO: 493054 - RNA, 22 nt, Human
ccaugcagugcuggagcugauu

SEQ ID NO: 493055 - RNA, 22 nt, Human
cuguggcuaggaagcuguggga

SEQ ID NO: 493056 - RNA, 21 nt, Human
uccuccuguagaggguccugg

SEQ ID NO: 493057 - RNA, 22 nt, Human
cuucaugcugauauccucgaug

SEQ ID NO: 493058 - RNA, 20 nt, Human
gcucagggccugggucugga

SEQ ID NO: 493059 - RNA, 18 nt, Human
cuacauucauaggaaagg

SEQ ID NO: 493060 - RNA, 21 nt, Human
ggccuuggcgggggccgaauu

SEQ ID NO: 493061 - RNA, 22 nt, Human
ccuguggccgcgucgggcggcg

SEQ ID NO: 493062 - RNA, 22 nt, Human
accuggaggcagagguugcagu

SEQ ID NO: 493063 - RNA, 22 nt, Human
ugcuugacuuaguuucucauuu

SEQ ID NO: 493064 - RNA, 22 nt, Human
ccugaggaugccagcaugggug

SEQ ID NO: 493065 - RNA, 22 nt, Human
cccaccagaccugcaccggcac

SEQ ID NO: 493066 - RNA, 22 nt, Human
aagcccagcaucccugcaccag

SEQ ID NO: 493067 - RNA, 22 nt, Human
cugcugucuuuauuucacugcu

SEQ ID NO: 493068 - RNA, 22 nt, Human
agaucaaggacaugaagaggcu

SEQ ID NO: 493069 - RNA, 22 nt, Human
agugggagcggcagucggggac

SEQ ID NO: 493070 - RNA, 22 nt, Human
ucggggauggugucugagggag

SEQ ID NO: 493071 - RNA, 22 nt, Human
cugcccaucuggccacacacag

SEQ ID NO: 493072 - RNA, 22 nt, Human
gccagcagcucuugggcgggca

SEQ ID NO: 493073 - RNA, 22 nt, Human
gaguuucuucauggugcagagg

SEQ ID NO: 493074 - RNA, 22 nt, Human
ucuuggcaguucuugugcuuuu

SEQ ID NO: 493075 - RNA, 21 nt, Human
ugagcaccagcugcaugcccc

SEQ ID NO: 493076 - RNA, 22 nt, Human
aguguucuagcgcugugcuugu

SEQ ID NO: 493077 - RNA, 22 nt, Human
acaagucaguggaauuaauauu

SEQ ID NO: 493078 - RNA, 22 nt, Human
uacuuugagaugaugcugaucg

SEQ ID NO: 493079 - RNA, 20 nt, Human
cagcucugggcaggucgagg

SEQ ID NO: 493080 - RNA, 22 nt, Human
gucuggaggaggaagaaggcac

SEQ ID NO: 493081 - RNA, 22 nt, Human
ucacccuucccagcuguccgcc

SEQ ID NO: 493082 - RNA, 22 nt, Human
agggccagcagcuuggccaacc

SEQ ID NO: 493083 - RNA, 22 nt, Human
gaggucaggggagaggcugaug

SEQ ID NO: 493084 - RNA, 23 nt, Human
ggacaugucucuggguauuuuga

SEQ ID NO: 493085 - RNA, 22 nt, Human
caggccgggcacugcgcuaggu

SEQ ID NO: 493086 - RNA, 22 nt, Human
aucaucaucuaaauugugucgc

SEQ ID NO: 493087 - RNA, 22 nt, Human
ugcaaaaagagcgaggagcccu

SEQ ID NO: 493088 - RNA, 22 nt, Human
acagcaucccugaagauaacca

SEQ ID NO: 493089 - RNA, 22 nt, Human
ucauccugaagaaccugcuucc

SEQ ID NO: 493090 - RNA, 22 nt, Human
acauuucuccuacuuguuauuu

SEQ ID NO: 493091 - RNA, 22 nt, Human
gcugucccgaaccccugguaau

SEQ ID NO: 493092 - RNA, 20 nt, Human
agcuggcccccgguggccug

SEQ ID NO: 493093 - RNA, 18 nt, Human
accugauuggcgcagccc

SEQ ID NO: 493094 - RNA, 22 nt, Human
cuagggccaaaggcugugaugc

SEQ ID NO: 493095 - RNA, 22 nt, Human
ggccuuccauugcucuuuucua

SEQ ID NO: 493096 - RNA, 22 nt, Human
aaucccuccccaggcaaguccu

SEQ ID NO: 493097 - RNA, 22 nt, Human
agagggcgcccaggcccacgcc

SEQ ID NO: 493098 - RNA, 22 nt, Human
cagcagcaggcgcacggccguc

SEQ ID NO: 493099 - RNA, 22 nt, Human
uggcaaggccacaggugcaguu

SEQ ID NO: 493100 - RNA, 22 nt, Human
ggcagccagagggcagcuggau

SEQ ID NO: 493101 - RNA, 22 nt, Human
aguuuccacuggagacacugug

SEQ ID NO: 493102 - RNA, 22 nt, Human
gauguauagcuuuaacugaccc

SEQ ID NO: 493103 - RNA, 23 nt, Human
agcccagcagagaaccuaggucc

SEQ ID NO: 493104 - RNA, 22 nt, Human
uccuucagaggacggcagccag

SEQ ID NO: 493105 - RNA, 22 nt, Human
cgggcacucagggucgaggugg

SEQ ID NO: 493106 - RNA, 22 nt, Human
gggggaaaguggagguucguga

SEQ ID NO: 493107 - RNA, 22 nt, Human
cuggagcucagcccagguucca

SEQ ID NO: 493108 - RNA, 22 nt, Human
caugucacaauucuuaauggga

SEQ ID NO: 493109 - RNA, 22 nt, Human
ggcgcucaguguugccccagag

SEQ ID NO: 493110 - RNA, 22 nt, Human
ucuuccagauacuuccugacuu

SEQ ID NO: 493111 - RNA, 22 nt, Human
uguagggaggaaggguuggaaa

SEQ ID NO: 493112 - RNA, 22 nt, Human
uccuucccaggugucgccgccu

SEQ ID NO: 493113 - RNA, 22 nt, Human
ccuggagacccacuucugccaa

SEQ ID NO: 493114 - RNA, 22 nt, Human
cuggagaggcugggaacagguu

SEQ ID NO: 493115 - RNA, 22 nt, Human
gccagagaggccuuagaaucca

SEQ ID NO: 493116 - RNA, 22 nt, Human
ugugagacguaggccaucgagg

SEQ ID NO: 493117 - RNA, 22 nt, Human
gcucugugccccugccguggac

SEQ ID NO: 493118 - RNA, 22 nt, Human
uccucccugcacucagugaagu

SEQ ID NO: 493119 - RNA, 22 nt, Human
aaauguucccaauaugaagcug

SEQ ID NO: 493120 - RNA, 22 nt, Human
gugaccaucaucucagcuaguu

SEQ ID NO: 493121 - RNA, 22 nt, Human
uucccagauuggagggcagggg

SEQ ID NO: 493122 - RNA, 22 nt, Human
gggagccccaccucggugcccg

SEQ ID NO: 493123 - RNA, 22 nt, Human
gcuucauagcauucauugccug

SEQ ID NO: 493124 - RNA, 22 nt, Human
agccacccuaccagcccugaaa

SEQ ID NO: 493125 - RNA, 22 nt, Human
cggggccuagucuaccucggca

SEQ ID NO: 493126 - RNA, 22 nt, Human
ucaggccuagggagaaaauuca

SEQ ID NO: 493127 - RNA, 22 nt, Human
uggcuguagaaucagagacuug

SEQ ID NO: 493128 - RNA, 18 nt, Human
gacaaaaguacagacaga

SEQ ID NO: 493129 - RNA, 22 nt, Human
gacuggcucuaucuccuuggcg

SEQ ID NO: 493130 - RNA, 22 nt, Human
uguggaagaacuucuugcuugg

SEQ ID NO: 493131 - RNA, 22 nt, Human
gcuggguuuucuuccgggccua

SEQ ID NO: 493132 - RNA, 22 nt, Human
cccgggaggaggaaguugcagu

SEQ ID NO: 493133 - RNA, 22 nt, Human
aggagccauugcaggauggcag

SEQ ID NO: 493134 - RNA, 22 nt, Human
caccugagcaacccugugcggg

SEQ ID NO: 493135 - RNA, 22 nt, Human
cauggccagauucuuucuucuc

SEQ ID NO: 493136 - RNA, 22 nt, Human
cugagggccuucuaugcugagc

SEQ ID NO: 493137 - RNA, 22 nt, Human
uggccuugcccagcgccuaggu

SEQ ID NO: 493138 - RNA, 22 nt, Human
ucagaagguacugaagacaugg

SEQ ID NO: 493139 - RNA, 22 nt, Human
gugcagcugugguggagccagg

SEQ ID NO: 493140 - RNA, 22 nt, Human
ucugaauucuuagaauuaaagg

SEQ ID NO: 493141 - RNA, 22 nt, Human
ugccuguggaaaggcuggugcu

SEQ ID NO: 493142 - RNA, 22 nt, Human
gaaacauuuguugaguacuugc

SEQ ID NO: 493143 - RNA, 22 nt, Human
uuugcuggagaugagcgugggu

SEQ ID NO: 493144 - RNA, 22 nt, Human
ugcaugcagcuggucgggcgcc

SEQ ID NO: 493145 - RNA, 22 nt, Human
uggagcagccuuuucuaagcaa

SEQ ID NO: 493146 - RNA, 22 nt, Human
gguccccguggaggcuggagcg

SEQ ID NO: 493147 - RNA, 22 nt, Human
aggcaguguguagcuggaagag

SEQ ID NO: 493148 - RNA, 22 nt, Human
cccaggaggcagaaguugcagu

SEQ ID NO: 493149 - RNA, 22 nt, Human
ccugugauauuguucauaauau

SEQ ID NO: 493150 - RNA, 22 nt, Human
cacucacccgguccuucccagu

SEQ ID NO: 493151 - RNA, 22 nt, Human
ggcuggacuugguccuguuuug

SEQ ID NO: 493152 - RNA, 22 nt, Human
aaagaugucauacacauuaaga

SEQ ID NO: 493153 - RNA, 22 nt, Human
gaagcuucgaaagagugauuuc

SEQ ID NO: 493154 - RNA, 19 nt, Human
uggcucugucgaaggcaca

SEQ ID NO: 493155 - RNA, 21 nt, Human
gccaccucaaucuucuagcgc

SEQ ID NO: 493156 - RNA, 22 nt, Human
agcuccugaaaagcgcuugcuu

SEQ ID NO: 493157 - RNA, 22 nt, Human
ccacagcaugcaggccugacac

SEQ ID NO: 493158 - RNA, 22 nt, Human
uuucugugauaggcugcgacgc

SEQ ID NO: 493159 - RNA, 22 nt, Human
gguguuguacauucuguggauu

SEQ ID NO: 493160 - RNA, 22 nt, Human
aaagcacauuacaagcucaguc

SEQ ID NO: 493161 - RNA, 22 nt, Human
uuguuuaaagaacuucugacuu

SEQ ID NO: 493162 - RNA, 22 nt, Human
caccucucauuucuacagauuc

SEQ ID NO: 493163 - RNA, 22 nt, Human
aucauuuaguggggcauuggaa

SEQ ID NO: 493164 - RNA, 22 nt, Human
auuuccagcagcauauuugucu

SEQ ID NO: 493165 - RNA, 22 nt, Human
uguguggcaagcuguaugcuag

SEQ ID NO: 493166 - RNA, 22 nt, Human
uggccucuccuggcagcaucca

SEQ ID NO: 493167 - RNA, 22 nt, Human
acaggaucgcccuguugcccag

SEQ ID NO: 493168 - RNA, 22 nt, Human
augcugccuccucuucagccgc

SEQ ID NO: 493169 - RNA, 22 nt, Human
agggugugcuguugggucuuuc

SEQ ID NO: 493170 - RNA, 22 nt, Human
aguuauguccucagcaaaucaa

SEQ ID NO: 493171 - RNA, 22 nt, Human
aucaacuuguccuugauguuaa

SEQ ID NO: 493172 - RNA, 22 nt, Human
cucgagagauccucuugccacc

SEQ ID NO: 493173 - RNA, 22 nt, Human
augaacaguacaaagcacagac

SEQ ID NO: 493174 - RNA, 22 nt, Human
gacaggugcuaagggaccuggc

SEQ ID NO: 493175 - RNA, 19 nt, Human
uccuggggaggggcauggc

SEQ ID NO: 493176 - RNA, 22 nt, Human
gcggcccggguccccagcagca

SEQ ID NO: 493177 - RNA, 22 nt, Human
gccaggaccucagaugcagggc

SEQ ID NO: 493178 - RNA, 22 nt, Human
aaaugcucgccuuggccgagac

SEQ ID NO: 493179 - RNA, 22 nt, Human
uacugcugagcuggguagaagg

SEQ ID NO: 493180 - RNA, 22 nt, Human
uggugaagucagcggagcccgg

SEQ ID NO: 493181 - RNA, 22 nt, Human
agccagcauauauauaguugaa

SEQ ID NO: 493182 - RNA, 22 nt, Human
ugucaaguuguuaaguucuggg

SEQ ID NO: 493183 - RNA, 22 nt, Human
accaggcccuccagcugcgugg

SEQ ID NO: 493184 - RNA, 22 nt, Human
cagcuggaggagcagcuuccag

SEQ ID NO: 493185 - RNA, 22 nt, Human
gcuaugggaugugcuguggaug

SEQ ID NO: 493186 - RNA, 22 nt, Human
acccggaggcgggggaugcagu

SEQ ID NO: 493187 - RNA, 22 nt, Human
ugauucaguacuuucucuaacu

SEQ ID NO: 493188 - RNA, 22 nt, Human
ucuccccaguauggauucucug

SEQ ID NO: 493189 - RNA, 22 nt, Human
ucccugggguaucgcugaggca

SEQ ID NO: 493190 - RNA, 22 nt, Human
aggccuuccucggagacaggga

SEQ ID NO: 493191 - RNA, 22 nt, Human
gaguggggcccacugcugggug

SEQ ID NO: 493192 - RNA, 17 nt, Human
uagauuaaacacggcca

SEQ ID NO: 493193 - RNA, 22 nt, Human
ccuccugggccuugcucuguga

SEQ ID NO: 493194 - RNA, 22 nt, Human
caugggcucuucuggacugcac

SEQ ID NO: 493195 - RNA, 22 nt, Human
gaagguuuuguuugcaaaucau

SEQ ID NO: 493196 - RNA, 22 nt, Human
uccagguccuacuggcccauag

SEQ ID NO: 493197 - RNA, 22 nt, Human
gcugggcugcgucggggaagcc

SEQ ID NO: 493198 - RNA, 22 nt, Human
uccuggccucugagucaagaac

SEQ ID NO: 493199 - RNA, 22 nt, Human
ccucguccacaauccuugcaca

SEQ ID NO: 493200 - RNA, 22 nt, Human
ggcagaggaagcuggaaguggg

SEQ ID NO: 493201 - RNA, 19 nt, Human
uggugcgcuguuccugagc

SEQ ID NO: 493202 - RNA, 22 nt, Human
aagcauuucagguagagauauu

SEQ ID NO: 493203 - RNA, 18 nt, Human
uggcagccagcugcuccu

SEQ ID NO: 493204 - RNA, 21 nt, Human
uggcccuggccacggcugcca

SEQ ID NO: 493205 - RNA, 22 nt, Human
auuggccagacuuauccuucag

SEQ ID NO: 493206 - RNA, 22 nt, Human
accaggaguuuugaccaggggc

SEQ ID NO: 493207 - RNA, 22 nt, Human
cccaugcacccucuaagaagga

SEQ ID NO: 493208 - RNA, 17 nt, Human
acuuguauugugcuuua

SEQ ID NO: 493209 - RNA, 22 nt, Human
guucuucaaagugacaacuaaa

SEQ ID NO: 493210 - RNA, 22 nt, Human
uugggauacaucuugcugagcc

SEQ ID NO: 493211 - RNA, 22 nt, Human
aguguccaacucagcuugucaa

SEQ ID NO: 493212 - RNA, 22 nt, Human
agagcgagucuggggcucggau

SEQ ID NO: 493213 - RNA, 22 nt, Human
agccuggacagcuacggagaac

SEQ ID NO: 493214 - RNA, 22 nt, Human
agaauaagccugacgaaaccua

SEQ ID NO: 493215 - RNA, 21 nt, Human
ucgaccugcugggcucgggcu

SEQ ID NO: 493216 - RNA, 22 nt, Human
aggcucagcaucugauucauau

SEQ ID NO: 493217 - RNA, 22 nt, Human
guucuccaggggcuguucaucu

SEQ ID NO: 493218 - RNA, 22 nt, Human
aggccagggcacugcucuuuag

SEQ ID NO: 493219 - RNA, 21 nt, Human
ccuggagacaaagacagggug

SEQ ID NO: 493220 - RNA, 19 nt, Human
acacaccagugccugugac

SEQ ID NO: 493221 - RNA, 20 nt, Human
guccugggagccacagcaca

SEQ ID NO: 493222 - RNA, 22 nt, Human
auucccauagccauccggagag

SEQ ID NO: 493223 - RNA, 22 nt, Human
cccaugacucucauucacaguc

SEQ ID NO: 493224 - RNA, 22 nt, Human
aaggagucugggccauucagag

SEQ ID NO: 493225 - RNA, 20 nt, Human
ucugugugccaucaccuaac

SEQ ID NO: 493226 - RNA, 22 nt, Human
uacagugaguggcagagccaga

SEQ ID NO: 493227 - RNA, 22 nt, Human
uuuacaaggcaguuauuuuccu

SEQ ID NO: 493228 - RNA, 22 nt, Human
gcguggcuuagagugggguacc

SEQ ID NO: 493229 - RNA, 17 nt, Human
ucugcagggggccgugu

SEQ ID NO: 493230 - RNA, 20 nt, Human
uggccucugagaugccacgg

SEQ ID NO: 493231 - RNA, 23 nt, Human
aguguucagcauguaguaaauac

SEQ ID NO: 493232 - RNA, 19 nt, Human
ugcuugccugccuuuccca

SEQ ID NO: 493233 - RNA, 22 nt, Human
ugcccuggcuccucccacgcug

SEQ ID NO: 493234 - RNA, 23 nt, Human
ccucaaauguagccuuuuuccca

SEQ ID NO: 493235 - RNA, 22 nt, Human
gggcucaucaagccucuccgcc

SEQ ID NO: 493236 - RNA, 22 nt, Human
acagagggucugggcacaggac

SEQ ID NO: 493237 - RNA, 22 nt, Human
cagggccucugugggcucucuc

SEQ ID NO: 493238 - RNA, 22 nt, Human
ugggccagauccauggcaauaa

SEQ ID NO: 493239 - RNA, 22 nt, Human
gcugccaucuccugaggacagg

SEQ ID NO: 493240 - RNA, 22 nt, Human
gggcucggcaucuguggacucu

SEQ ID NO: 493241 - RNA, 22 nt, Human
ccagcugcugcaccgugcaugg

SEQ ID NO: 493242 - RNA, 22 nt, Human
uggagccagcaggacucagagg

SEQ ID NO: 493243 - RNA, 22 nt, Human
cucugcguggcugggcccaggg

SEQ ID NO: 493244 - RNA, 22 nt, Human
gccagguaugaauuacgcacga

SEQ ID NO: 493245 - RNA, 22 nt, Human
ucaucuccauacggucucgcag

SEQ ID NO: 493246 - RNA, 22 nt, Human
cgccccagccaguugagcggcg

SEQ ID NO: 493247 - RNA, 22 nt, Human
ccagagagggcgccaccuggag

SEQ ID NO: 493248 - RNA, 21 nt, Human
uggacauuuacccuucaggga

SEQ ID NO: 493249 - RNA, 22 nt, Human
acacaucagaaauaugaaugag

SEQ ID NO: 493250 - RNA, 22 nt, Human
ugguggggccagacuucagcuc

SEQ ID NO: 493251 - RNA, 22 nt, Human
gcgcugccucugcucuccccac

SEQ ID NO: 493252 - RNA, 22 nt, Human
ccugcucaacgaauauggcgau

SEQ ID NO: 493253 - RNA, 22 nt, Human
cuccagaggcgacuugcaucac

SEQ ID NO: 493254 - RNA, 22 nt, Human
cgcgcugcagacagcggaggcc

SEQ ID NO: 493255 - RNA, 22 nt, Human
cccgaccucgcaaagcgcacuc

SEQ ID NO: 493256 - RNA, 19 nt, Human
gggccucacccacaccucc

SEQ ID NO: 493257 - RNA, 22 nt, Human
cacuuggaggaaggccuauuca

SEQ ID NO: 493258 - RNA, 22 nt, Human
gcgaguccacuggggggcgcag

SEQ ID NO: 493259 - RNA, 22 nt, Human
accaaauaggcuuccuggguug

SEQ ID NO: 493260 - RNA, 22 nt, Human
cccaccacgugcuuugcuggag

SEQ ID NO: 493261 - RNA, 22 nt, Human
gaggggcugggguugacuccaa

SEQ ID NO: 493262 - RNA, 22 nt, Human
ccugcgcgucugggucugucuc

SEQ ID NO: 493263 - RNA, 20 nt, Human
cucuuuucacucucaguggu

SEQ ID NO: 493264 - RNA, 22 nt, Human
ccugugacucugucugaugguc

SEQ ID NO: 493265 - RNA, 22 nt, Human
ugucuuggccacuaggagugcc

SEQ ID NO: 493266 - RNA, 22 nt, Human
auccuggguaaguuccuuuuaa

SEQ ID NO: 493267 - RNA, 22 nt, Human
augcaggaagagcccuggagcu

SEQ ID NO: 493268 - RNA, 22 nt, Human
gagcagcaggccagguugcagg

SEQ ID NO: 493269 - RNA, 22 nt, Human
aggcagagaaaaaccagauaug

SEQ ID NO: 493270 - RNA, 22 nt, Human
gcuaagggauaggcugccuccu

SEQ ID NO: 493271 - RNA, 22 nt, Human
ugcacccacuuagcugaaguuc

SEQ ID NO: 493272 - RNA, 23 nt, Human
cguguccuucagggagagugugg

SEQ ID NO: 493273 - RNA, 22 nt, Human
augcggagccccaagcuugaag

SEQ ID NO: 493274 - RNA, 22 nt, Human
cauuggcuccugugggacauga

SEQ ID NO: 493275 - RNA, 22 nt, Human
gcaguaaauugagagucauguu

SEQ ID NO: 493276 - RNA, 22 nt, Human
uccaggauugucagccagaagg

SEQ ID NO: 493277 - RNA, 22 nt, Human
gugaccagacagagucuagccc

SEQ ID NO: 493278 - RNA, 22 nt, Human
gaccacuggggugagggccauc

SEQ ID NO: 493279 - RNA, 22 nt, Human
cuagcagaagcuccuugagggu

SEQ ID NO: 493280 - RNA, 22 nt, Human
uucugagguccaugcaguacug

SEQ ID NO: 493281 - RNA, 22 nt, Human
cuggagucggcgccccaacaga

SEQ ID NO: 493282 - RNA, 22 nt, Human
guacacucccccugugaaguug

SEQ ID NO: 493283 - RNA, 22 nt, Human
uuaugggcgaugcaaaccugau

SEQ ID NO: 493284 - RNA, 22 nt, Human
cagagccaaaccucagggcccg

SEQ ID NO: 493285 - RNA, 22 nt, Human
aguacuuuuuguucaauugugc

SEQ ID NO: 493286 - RNA, 22 nt, Human
ggucauagagcuggaaauuggc

SEQ ID NO: 493287 - RNA, 22 nt, Human
auggggagcucaccaccuguuu

SEQ ID NO: 493288 - RNA, 22 nt, Human
cucaucuggcuucaguaacagu

SEQ ID NO: 493289 - RNA, 22 nt, Human
gguggcaagggcagccaguaac

SEQ ID NO: 493290 - RNA, 20 nt, Human
ucaggguuucccauucuugg

SEQ ID NO: 493291 - RNA, 22 nt, Human
gagagagacauguaaacgcggu

SEQ ID NO: 493292 - RNA, 22 nt, Human
uugucaggaacuaugauuaugc

SEQ ID NO: 493293 - RNA, 22 nt, Human
acaaagugaaaagcaucgaauu

SEQ ID NO: 493294 - RNA, 22 nt, Human
augugauacuccuucuagugga

SEQ ID NO: 493295 - RNA, 22 nt, Human
uggggcaugugaaccuggaugu

SEQ ID NO: 493296 - RNA, 22 nt, Human
gcaccagccugagccucuugca

SEQ ID NO: 493297 - RNA, 22 nt, Human
ucagguagugguuaaguucugu

SEQ ID NO: 493298 - RNA, 22 nt, Human
agcccugaccuguccuguucug

SEQ ID NO: 493299 - RNA, 22 nt, Human
uugcacgcuugcgguuccugcc

SEQ ID NO: 493300 - RNA, 22 nt, Human
ccagacuggggcuccuugaggg

SEQ ID NO: 493301 - RNA, 22 nt, Human
cauuuuacgacauagggcaggc

SEQ ID NO: 493302 - RNA, 22 nt, Human
gcgcuccucccggcccuggugg

SEQ ID NO: 493303 - RNA, 22 nt, Human
cuucucggccguguggaugcgc

SEQ ID NO: 493304 - RNA, 22 nt, Human
agcggcgccggagggaggugcg

SEQ ID NO: 493305 - RNA, 22 nt, Human
cucugggguggaggaggcugac

SEQ ID NO: 493306 - RNA, 22 nt, Human
gaccuccguguacaccucccag

SEQ ID NO: 493307 - RNA, 22 nt, Human
ggggcuuccagcgcccgccggu

SEQ ID NO: 493308 - RNA, 22 nt, Human
auaguguguaaagugcagugau

SEQ ID NO: 493309 - RNA, 22 nt, Human
acagacuccccagguuaucuca

SEQ ID NO: 493310 - RNA, 20 nt, Human
ggccggggagcucuccaggg

SEQ ID NO: 493311 - RNA, 22 nt, Human
cuugccagggacucagucaggg

SEQ ID NO: 493312 - RNA, 22 nt, Human
cauaggcucuucagagaacuga

SEQ ID NO: 493313 - RNA, 19 nt, Human
gaauggguucuguagggag

SEQ ID NO: 493314 - RNA, 22 nt, Human
agaaaucugacugcugugcaca

SEQ ID NO: 493315 - RNA, 22 nt, Human
caguuuuaugaaugcuuauuag

SEQ ID NO: 493316 - RNA, 22 nt, Human
gcaggcuuauggggagacagag

SEQ ID NO: 493317 - RNA, 22 nt, Human
ggcagguguggugaccagagau

SEQ ID NO: 493318 - RNA, 22 nt, Human
cuggacacuggggaugcgcagu

SEQ ID NO: 493319 - RNA, 22 nt, Human
agccagugucgugugacaugag

SEQ ID NO: 493320 - RNA, 22 nt, Human
caagcagauauuuuagucaaga

SEQ ID NO: 493321 - RNA, 22 nt, Human
cacugggagcagcuccaacauu

SEQ ID NO: 493322 - RNA, 22 nt, Human
ggucccugcccaaagcccuugg

SEQ ID NO: 493323 - RNA, 22 nt, Human
caggccugugacaccgugucug

SEQ ID NO: 493324 - RNA, 22 nt, Human
cagcugacaagaguccuuggag

SEQ ID NO: 493325 - RNA, 23 nt, Human
acugccugugccgaucucucuca

SEQ ID NO: 493326 - RNA, 22 nt, Human
gaaagcagaugaaauugcaaca

SEQ ID NO: 493327 - RNA, 22 nt, Human
cugaugcucuggauguagucaa

SEQ ID NO: 493328 - RNA, 22 nt, Human
auggccagcaagguagggcaau

SEQ ID NO: 493329 - RNA, 22 nt, Human
gccuucugaucgcuggacugac

SEQ ID NO: 493330 - RNA, 22 nt, Human
cguggggcggguggacacuugc

SEQ ID NO: 493331 - RNA, 22 nt, Human
gccccagcguggcuguguuagg

SEQ ID NO: 493332 - RNA, 22 nt, Human
cagguguugcaguugaagacug

SEQ ID NO: 493333 - RNA, 22 nt, Human
cagaguccugcaccagcuccag

SEQ ID NO: 493334 - RNA, 22 nt, Human
gaucggguggguucugccauca

SEQ ID NO: 493335 - RNA, 22 nt, Human
ugacucauauuucauggauacg

SEQ ID NO: 493336 - RNA, 22 nt, Human
aggacaggauugagcugaacug

SEQ ID NO: 493337 - RNA, 22 nt, Human
uuccugguaacaaucucaaagu

SEQ ID NO: 493338 - RNA, 22 nt, Human
aacaugaugacauuguaagcuu

SEQ ID NO: 493339 - RNA, 22 nt, Human
agcuuuggcaucugacuagccg

SEQ ID NO: 493340 - RNA, 22 nt, Human
aggacucaucccugcuugucag

SEQ ID NO: 493341 - RNA, 22 nt, Human
ggugcggagacuccaugaggcc

SEQ ID NO: 493342 - RNA, 22 nt, Human
cccuugagccuggaggagcucu

SEQ ID NO: 493343 - RNA, 21 nt, Human
uggagagugauuucagugugg

SEQ ID NO: 493344 - RNA, 22 nt, Human
ggugagaggcagugcuguggaa

SEQ ID NO: 493345 - RNA, 22 nt, Human
cuugaaagucagcagaguggau

SEQ ID NO: 493346 - RNA, 22 nt, Human
acuuugccuucuuacuguguug

SEQ ID NO: 493347 - RNA, 23 nt, Human
gggugcugccuguagucaugcug

SEQ ID NO: 493348 - RNA, 22 nt, Human
gugccugguuuggggaauguuc

SEQ ID NO: 493349 - RNA, 22 nt, Human
agguggucuuguggaugccgca

SEQ ID NO: 493350 - RNA, 22 nt, Human
accugccagaaugcuaguccug

SEQ ID NO: 493351 - RNA, 22 nt, Human
agccucucuguuagucacuggg

SEQ ID NO: 493352 - RNA, 22 nt, Human
acagccaacgucuuucuuacuu

SEQ ID NO: 493353 - RNA, 22 nt, Human
aaguuugucucauuugaucuuc

SEQ ID NO: 493354 - RNA, 22 nt, Human
ggagaggguagggguccugccc

SEQ ID NO: 493355 - RNA, 22 nt, Human
uuguagucuaggauagauuuuu

SEQ ID NO: 493356 - RNA, 22 nt, Human
aagcagaaaaacugagcuccaa

SEQ ID NO: 493357 - RNA, 22 nt, Human
augcaauaguaauucuagucug

SEQ ID NO: 493358 - RNA, 22 nt, Human
ugcacauggccugagugccuga

SEQ ID NO: 493359 - RNA, 22 nt, Human
gucagcaggguccccuugagug

SEQ ID NO: 493360 - RNA, 22 nt, Human
gccagagggauuccuggugugu

SEQ ID NO: 493361 - RNA, 22 nt, Human
aacccgggagguggagguuaug

SEQ ID NO: 493362 - RNA, 22 nt, Human
augauugaaaaugacauugcca

SEQ ID NO: 493363 - RNA, 22 nt, Human
ccuggccuccuggccuucucau

SEQ ID NO: 493364 - RNA, 22 nt, Human
aagggggaaauccuagcgccgc

SEQ ID NO: 493365 - RNA, 22 nt, Human
cugggagaugacucagagcagg

SEQ ID NO: 493366 - RNA, 18 nt, Human
ggugagggagcuggaagc

SEQ ID NO: 493367 - RNA, 17 nt, Human
ggccugcaccuccugcu

SEQ ID NO: 493368 - RNA, 22 nt, Human
agcgcuugccgcacuccaagca

SEQ ID NO: 493369 - RNA, 22 nt, Human
uguggccaccagagcugcuauu

SEQ ID NO: 493370 - RNA, 22 nt, Human
ugaacaggugccuucagggagu

SEQ ID NO: 493371 - RNA, 22 nt, Human
cugguggaauggcagagggaac

SEQ ID NO: 493372 - RNA, 18 nt, Human
uccaggcuccaggcuaac

SEQ ID NO: 493373 - RNA, 22 nt, Human
uccucauucuuggugcaucaaa

SEQ ID NO: 493374 - RNA, 22 nt, Human
gcugccgacccacagggguuaa

SEQ ID NO: 493375 - RNA, 23 nt, Human
ugucuggauucgacugugguugg

SEQ ID NO: 493376 - RNA, 22 nt, Human
ugggugccaaccucugguggcc

SEQ ID NO: 493377 - RNA, 22 nt, Human
ggccaaggcucuugagggcuga

SEQ ID NO: 493378 - RNA, 22 nt, Human
gcaggggcugagcaccagcggg

SEQ ID NO: 493379 - RNA, 22 nt, Human
ugcagcaccuauggacacuugu

SEQ ID NO: 493380 - RNA, 22 nt, Human
ugcaugacaauugccgucaagu

SEQ ID NO: 493381 - RNA, 19 nt, Human
ggaggcuucuuggggucgg

SEQ ID NO: 493382 - RNA, 22 nt, Human
aggcgaagggaccagacgguag

SEQ ID NO: 493383 - RNA, 22 nt, Human
uggaaggggccaggcgcggagu

SEQ ID NO: 493384 - RNA, 22 nt, Human
ucucucugcagcccgggacacu

SEQ ID NO: 493385 - RNA, 23 nt, Human
gcauccagagcucaguccccuuu

SEQ ID NO: 493386 - RNA, 22 nt, Human
uguccagcugaaggcagccuca

SEQ ID NO: 493387 - RNA, 22 nt, Human
uaggugcaggucacaagggaug

SEQ ID NO: 493388 - RNA, 16 nt, Human
aggcucagaggcugga

SEQ ID NO: 493389 - RNA, 22 nt, Human
cuucucugucacaggguuacgu

SEQ ID NO: 493390 - RNA, 22 nt, Human
accuccuccaaggagccauagg

SEQ ID NO: 493391 - RNA, 22 nt, Human
cugggaccugugugccugggcc

SEQ ID NO: 493392 - RNA, 22 nt, Human
agcugugaccuucaagagcuac

SEQ ID NO: 493393 - RNA, 22 nt, Human
ccagagaggccuuggcaagaca

SEQ ID NO: 493394 - RNA, 22 nt, Human
uauucacaaaaugagguccuca

SEQ ID NO: 493395 - RNA, 22 nt, Human
ccucccagaugugcccaaugga

SEQ ID NO: 493396 - RNA, 22 nt, Human
gcuggguggaucggaggcucug

SEQ ID NO: 493397 - RNA, 21 nt, Human
gcaggguuugugcugugaguu

SEQ ID NO: 493398 - RNA, 22 nt, Human
uugcaaucagcaguguuuucac

SEQ ID NO: 493399 - RNA, 22 nt, Human
cuggcuuucauggcgcaguuga

SEQ ID NO: 493400 - RNA, 22 nt, Human
agaguuuacagaaauaagcugu

SEQ ID NO: 493401 - RNA, 22 nt, Human
ggugugucugccaggaacugca

SEQ ID NO: 493402 - RNA, 17 nt, Human
aacaguuaaugggggaa

SEQ ID NO: 493403 - RNA, 17 nt, Human
ugggggcccuguguaga

SEQ ID NO: 493404 - RNA, 22 nt, Human
cacgccuggacggcggagggug

SEQ ID NO: 493405 - RNA, 22 nt, Human
gcggccuuguggcggagcaggc

SEQ ID NO: 493406 - RNA, 22 nt, Human
gcagaagcugggcagcgaggug

SEQ ID NO: 493407 - RNA, 22 nt, Human
ugaacaugcuguugauggccug

SEQ ID NO: 493408 - RNA, 22 nt, Human
ucaggccccaucccagacuuau

SEQ ID NO: 493409 - RNA, 22 nt, Human
augaggccacaguuauagauuu

SEQ ID NO: 493410 - RNA, 22 nt, Human
uucacauaaucugcagcaagcg

SEQ ID NO: 493411 - RNA, 22 nt, Human
ggcggugguugagaggacggcg

SEQ ID NO: 493412 - RNA, 22 nt, Human
aggcaaucaguguagaguaaca

SEQ ID NO: 493413 - RNA, 22 nt, Human
agccacagucuguagccagcuu

SEQ ID NO: 493414 - RNA, 21 nt, Human
cuuuggcaagggagaagucac

SEQ ID NO: 493415 - RNA, 22 nt, Human
cugcccugcagcuccacggacu

SEQ ID NO: 493416 - RNA, 22 nt, Human
ggagucugugucuugaagcagu

SEQ ID NO: 493417 - RNA, 22 nt, Human
ccuaggccgcccggugcguggg

SEQ ID NO: 493418 - RNA, 22 nt, Human
ucacugaauuucaagcuagugg

SEQ ID NO: 493419 - RNA, 22 nt, Human
cugggccacaagccugugugau

SEQ ID NO: 493420 - RNA, 22 nt, Human
caaccugaugugcaugccacgg

SEQ ID NO: 493421 - RNA, 22 nt, Human
gcucugugcaguucagggacac

SEQ ID NO: 493422 - RNA, 22 nt, Human
guuucuccucugugucuuguuu

SEQ ID NO: 493423 - RNA, 22 nt, Human
augcacaagguagauuauuauu

SEQ ID NO: 493424 - RNA, 22 nt, Human
aauucauacucuauauugcuuu

SEQ ID NO: 493425 - RNA, 22 nt, Human
uugucucuacagagaguaguag

SEQ ID NO: 493426 - RNA, 22 nt, Human
uggguguguccauauuuugacu

SEQ ID NO: 493427 - RNA, 17 nt, Human
agccugcugaucucaca

SEQ ID NO: 493428 - RNA, 22 nt, Human
gcucagagauguucaguagcuu

SEQ ID NO: 493429 - RNA, 22 nt, Human
ccagaaugugugaaauuugaug

SEQ ID NO: 493430 - RNA, 22 nt, Human
cucagcuucuaccuccugagug

SEQ ID NO: 493431 - RNA, 22 nt, Human
ccggcucggcgaccaggcugaa

SEQ ID NO: 493432 - RNA, 22 nt, Human
gugggugucaguaucuuuaacg

SEQ ID NO: 493433 - RNA, 22 nt, Human
uaggccacagagaggagauuuc

SEQ ID NO: 493434 - RNA, 22 nt, Human
gagacagagagguacucaacau

SEQ ID NO: 493435 - RNA, 17 nt, Human
gcccgugggcuacggua

SEQ ID NO: 493436 - RNA, 22 nt, Human
cuguggccagagcgccguugac

SEQ ID NO: 493437 - RNA, 20 nt, Human
gggcucugcauccaucagcc

SEQ ID NO: 493438 - RNA, 22 nt, Human
uccucacagcugguucauucag

SEQ ID NO: 493439 - RNA, 22 nt, Human
guggaaggaauuaacagacuag

SEQ ID NO: 493440 - RNA, 22 nt, Human
gccugagauucccggagccgug

SEQ ID NO: 493441 - RNA, 22 nt, Human
ccaggcagccugcuccauucug

SEQ ID NO: 493442 - RNA, 22 nt, Human
aggagucauugagagggguccu

SEQ ID NO: 493443 - RNA, 22 nt, Human
cuggucagggcucuuugggagc

SEQ ID NO: 493444 - RNA, 20 nt, Human
gugugaccuccuguggaugc

SEQ ID NO: 493445 - RNA, 21 nt, Human
agcaucugaggcaguuuccua

SEQ ID NO: 493446 - RNA, 22 nt, Human
cugggccucacccuagaccaau

SEQ ID NO: 493447 - RNA, 22 nt, Human
ggggaagaaauagaacauuuug

SEQ ID NO: 493448 - RNA, 22 nt, Human
uuucugaggaauuaauacagaa

SEQ ID NO: 493449 - RNA, 22 nt, Human
uggguagggagcuggaauccua

SEQ ID NO: 493450 - RNA, 23 nt, Human
cauuugauccucacaauaaaugg

SEQ ID NO: 493451 - RNA, 22 nt, Human
gccacaggucggcuagaggguc

SEQ ID NO: 493452 - RNA, 21 nt, Human
ucaggaagagccaguucaugc

SEQ ID NO: 493453 - RNA, 22 nt, Human
cugcaucaguggauaugauggu

SEQ ID NO: 493454 - RNA, 22 nt, Human
aggggagguguccccaaaucuc

SEQ ID NO: 493455 - RNA, 18 nt, Human
uccauccucugcucuuca

SEQ ID NO: 493456 - RNA, 22 nt, Human
caucaggaauaaaugaggcugu

SEQ ID NO: 493457 - RNA, 22 nt, Human
gcugccaauccagcugugggag

SEQ ID NO: 493458 - RNA, 23 nt, Human
cugagggcuggucugaagucugc

SEQ ID NO: 493459 - RNA, 22 nt, Human
cuccagauuccguuuauucagg

SEQ ID NO: 493460 - RNA, 22 nt, Human
cugcuucacccugccugagaac

SEQ ID NO: 493461 - RNA, 22 nt, Human
gcuacaggggucaguccuuugc

SEQ ID NO: 493462 - RNA, 22 nt, Human
gggcuaagcagagugggaacag

SEQ ID NO: 493463 - RNA, 22 nt, Human
ccgaggcuggccucagggcugu

SEQ ID NO: 493464 - RNA, 22 nt, Human
ucuggacaggggcgcuuugggg

SEQ ID NO: 493465 - RNA, 22 nt, Human
gcagagcacccugcagugguau

SEQ ID NO: 493466 - RNA, 22 nt, Human
ggagcagggaauuacagcgcag

SEQ ID NO: 493467 - RNA, 22 nt, Human
gaugaguucuuucuauucuauu

SEQ ID NO: 493468 - RNA, 22 nt, Human
ucuccagaguaaccuuggagca

SEQ ID NO: 493469 - RNA, 22 nt, Human
cccugcacagccuggcucucuu

SEQ ID NO: 493470 - RNA, 20 nt, Human
ggggcccaagcccucuugcc

SEQ ID NO: 493471 - RNA, 22 nt, Human
caguggguccugcgucugccag

SEQ ID NO: 493472 - RNA, 22 nt, Human
ggugucagugaagguagaguuu

SEQ ID NO: 493473 - RNA, 22 nt, Human
gaacuuuaauuagcuuuugucu

SEQ ID NO: 493474 - RNA, 22 nt, Human
accagaagcuggagcacaagga

SEQ ID NO: 493475 - RNA, 22 nt, Human
aggacugggugcagagggcauc

SEQ ID NO: 493476 - RNA, 19 nt, Human
gcuuccagcacugcaggag

SEQ ID NO: 493477 - RNA, 22 nt, Human
ccucuucuaggacguccuugug

SEQ ID NO: 493478 - RNA, 21 nt, Human
ucucuccucaagcucgacccc

SEQ ID NO: 493479 - RNA, 22 nt, Human
aggcucccaagcacugacccca

SEQ ID NO: 493480 - RNA, 22 nt, Human
ggugaccucaccuggucccacc

SEQ ID NO: 493481 - RNA, 22 nt, Human
uucaguaagcacuucuagagcu

SEQ ID NO: 493482 - RNA, 22 nt, Human
ugcgccugcgcaaagguuucug

SEQ ID NO: 493483 - RNA, 22 nt, Human
acaugcacccaguuacacucuc

SEQ ID NO: 493484 - RNA, 22 nt, Human
ugauuugaaaccuuuggcaaga

SEQ ID NO: 493485 - RNA, 22 nt, Human
gcauucuugguggagugcuaaa

SEQ ID NO: 493486 - RNA, 22 nt, Human
uuggauggagguucaagcacua

SEQ ID NO: 493487 - RNA, 22 nt, Human
acccggagucggagguugcagu

SEQ ID NO: 493488 - RNA, 22 nt, Human
ccugaaaugaguucugcucacu

SEQ ID NO: 493489 - RNA, 22 nt, Human
aauagcaaaugcucauuugaaa

SEQ ID NO: 493490 - RNA, 22 nt, Human
ugagcugcuucuuauaaugugu

SEQ ID NO: 493491 - RNA, 22 nt, Human
gcccagcugcacccuggugggu

SEQ ID NO: 493492 - RNA, 22 nt, Human
ggacauugaagcuggaaaggga

SEQ ID NO: 493493 - RNA, 22 nt, Human
caugcuggucagccaguggaug

SEQ ID NO: 493494 - RNA, 22 nt, Human
cagacaggguccuguccgucac

SEQ ID NO: 493495 - RNA, 22 nt, Human
agggcuccuaugccccauggac

SEQ ID NO: 493496 - RNA, 22 nt, Human
cuccagcagaaagggcgagugg

SEQ ID NO: 493497 - RNA, 21 nt, Human
caaaagagacugauucuugga

SEQ ID NO: 493498 - RNA, 22 nt, Human
cuggugcuguagccugauugag

SEQ ID NO: 493499 - RNA, 22 nt, Human
cacggccacugcagcaccccag

SEQ ID NO: 493500 - RNA, 22 nt, Human
acugguuuuggaaaucaguaca

SEQ ID NO: 493501 - RNA, 22 nt, Human
gugggggcaggcagugcuagga

SEQ ID NO: 493502 - RNA, 22 nt, Human
ggaccugaacauaaaacgaggc

SEQ ID NO: 493503 - RNA, 22 nt, Human
agauggcagggguaccuggaag

SEQ ID NO: 493504 - RNA, 22 nt, Human
accagagcuggcagaguaucaa

SEQ ID NO: 493505 - RNA, 22 nt, Human
ucaggccaggagaucagauuga

SEQ ID NO: 493506 - RNA, 22 nt, Human
cagucucuugcuucauuaguug

SEQ ID NO: 493507 - RNA, 22 nt, Human
aaggccaucuacuuacggaauu

SEQ ID NO: 493508 - RNA, 22 nt, Human
uggcugggagcuggaacugggc

SEQ ID NO: 493509 - RNA, 22 nt, Human
ucugcgcccugucgccugcucc

SEQ ID NO: 493510 - RNA, 22 nt, Human
ggcaauuacguauuagucaugu

SEQ ID NO: 493511 - RNA, 22 nt, Human
cccugaaaguacacugggacgg

SEQ ID NO: 493512 - RNA, 20 nt, Human
acguggccaccaguggcuua

SEQ ID NO: 493513 - RNA, 22 nt, Human
uuguugcugcucaaccucuaua

SEQ ID NO: 493514 - RNA, 22 nt, Human
gucugcugacagagcauggacc

SEQ ID NO: 493515 - RNA, 22 nt, Human
ccucuaaauuguuugaaguugg

SEQ ID NO: 493516 - RNA, 22 nt, Human
aggcucucucugccagccgugc

SEQ ID NO: 493517 - RNA, 22 nt, Human
ugcugcgggacccacugugggc

SEQ ID NO: 493518 - RNA, 22 nt, Human
agagccuguucggaggcgcccc

SEQ ID NO: 493519 - RNA, 22 nt, Human
uuagaaaaaggcuguggucuua

SEQ ID NO: 493520 - RNA, 22 nt, Human
gguagacugagcuccuugagga

SEQ ID NO: 493521 - RNA, 22 nt, Human
aggagucaccugcccaaaguca

SEQ ID NO: 493522 - RNA, 22 nt, Human
agagcuauuucuuaaaagcugu

SEQ ID NO: 493523 - RNA, 22 nt, Human
ggcagaggagcuggaaacaugg

SEQ ID NO: 493524 - RNA, 15 nt, Human
gccccaggaaucaaa

SEQ ID NO: 493525 - RNA, 22 nt, Human
acggccgaugacuccagcaugg

SEQ ID NO: 493526 - RNA, 22 nt, Human
aucauccauggcugaucauaaa

SEQ ID NO: 493527 - RNA, 22 nt, Human
ccauggccugaaggagugcauc

SEQ ID NO: 493528 - RNA, 22 nt, Human
ggggucugggcuuagcuggaau

SEQ ID NO: 493529 - RNA, 22 nt, Human
gcagcugcgaagaagucuaucu

SEQ ID NO: 493530 - RNA, 22 nt, Human
cccaggaguuagagguuguggu

SEQ ID NO: 493531 - RNA, 22 nt, Human
aguccggggucuggacaccugg

SEQ ID NO: 493532 - RNA, 22 nt, Human
gcaaaacagucgaugccuccca

SEQ ID NO: 493533 - RNA, 22 nt, Human
aggcucgcaugcccugcaccac

SEQ ID NO: 493534 - RNA, 22 nt, Human
ccaggacacgauuuuuagucug

SEQ ID NO: 493535 - RNA, 18 nt, Human
gccagcccuccaaccucc

SEQ ID NO: 493536 - RNA, 22 nt, Human
ucucauuuacuuccacaggcug

SEQ ID NO: 493537 - RNA, 22 nt, Human
cccuguccugcuaggcccuggu

SEQ ID NO: 493538 - RNA, 22 nt, Human
guccaucuaaguauccagccug

SEQ ID NO: 493539 - RNA, 22 nt, Human
aagaaaagguaaccgcuuaucu

SEQ ID NO: 493540 - RNA, 22 nt, Human
gugccaccagaugcuguugcua

SEQ ID NO: 493541 - RNA, 22 nt, Human
ccucauucucgcguguguuucu

SEQ ID NO: 493542 - RNA, 22 nt, Human
gagcugagggucuaggaggguu

SEQ ID NO: 493543 - RNA, 22 nt, Human
agaauccuggagaagcuguacc

SEQ ID NO: 493544 - RNA, 22 nt, Human
ccaagaggggaagggccgcagc

SEQ ID NO: 493545 - RNA, 22 nt, Human
uuugccaguauuuuauugauga

SEQ ID NO: 493546 - RNA, 22 nt, Human
ucaguguagcagacuuguagcc

SEQ ID NO: 493547 - RNA, 22 nt, Human
cgucaggguugagcagguagau

SEQ ID NO: 493548 - RNA, 22 nt, Human
ccucuuccuucucacuguggaa

SEQ ID NO: 493549 - RNA, 22 nt, Human
gggcuuggcuggggccaccaga

SEQ ID NO: 493550 - RNA, 21 nt, Human
aggcaugagcccugcauggac

SEQ ID NO: 493551 - RNA, 22 nt, Human
gcccagggcugcaaguggacgc

SEQ ID NO: 493552 - RNA, 21 nt, Human
cagaggggcuagccuggcugc

SEQ ID NO: 493553 - RNA, 22 nt, Human
agggugcccaccgcuucugccc

SEQ ID NO: 493554 - RNA, 23 nt, Human
uggcucuguggaucccucaggag

SEQ ID NO: 493555 - RNA, 22 nt, Human
agugagaguauuaaugugaacu

SEQ ID NO: 493556 - RNA, 22 nt, Human
uuuggagagaugaaguucugug

SEQ ID NO: 493557 - RNA, 22 nt, Human
ucugcccaggaggucccauggg

SEQ ID NO: 493558 - RNA, 22 nt, Human
agaagcagaaggaagcagggcc

SEQ ID NO: 493559 - RNA, 22 nt, Human
cuauuuucccauaugguugaca

SEQ ID NO: 493560 - RNA, 22 nt, Human
ggggucccugcaccagcauguc

SEQ ID NO: 493561 - RNA, 23 nt, Human
caccccacccugaggaggaggga

SEQ ID NO: 493562 - RNA, 22 nt, Human
ugagaauacugcauuguuagga

SEQ ID NO: 493563 - RNA, 22 nt, Human
cuguggaguccuggggaaugga

SEQ ID NO: 493564 - RNA, 22 nt, Human
aggugcccaugagcuccauggc

SEQ ID NO: 493565 - RNA, 22 nt, Human
ggagaagggaacugaguuuuug

SEQ ID NO: 493566 - RNA, 22 nt, Human
gagucucugaccagggugccaa

SEQ ID NO: 493567 - RNA, 22 nt, Human
caggggacacuccugcuugggc

SEQ ID NO: 493568 - RNA, 22 nt, Human
gaugggcaucaaacaugacgug

SEQ ID NO: 493569 - RNA, 22 nt, Human
uaugcgugccucugucugucug

SEQ ID NO: 493570 - RNA, 22 nt, Human
uagcugggacuacuggcccugc

SEQ ID NO: 493571 - RNA, 22 nt, Human
auggucacuucacccaugagcu

SEQ ID NO: 493572 - RNA, 22 nt, Human
aggcaguguggagggcuguugc

SEQ ID NO: 493573 - RNA, 18 nt, Human
gccugccagccgagggac

SEQ ID NO: 493574 - RNA, 22 nt, Human
cagagcugacccaaggauugaa

SEQ ID NO: 493575 - RNA, 22 nt, Human
aggggcagccucacaauccucu

SEQ ID NO: 493576 - RNA, 20 nt, Human
acuagaaagucacugggggg

SEQ ID NO: 493577 - RNA, 22 nt, Human
uauuaugguuguagguuaacaa

SEQ ID NO: 493578 - RNA, 22 nt, Human
ucucugucucccguguguccgg

SEQ ID NO: 493579 - RNA, 22 nt, Human
auugucgucaauggacacauag

SEQ ID NO: 493580 - RNA, 22 nt, Human
ugaguguuguaaccauaugauu

SEQ ID NO: 493581 - RNA, 22 nt, Human
cuugcuacuaugccuggcuaau

SEQ ID NO: 493582 - RNA, 23 nt, Human
ggaggcacuuaggcagagcagag

SEQ ID NO: 493583 - RNA, 22 nt, Human
ccugggugaugugcugcccucg

SEQ ID NO: 493584 - RNA, 22 nt, Human
cccucuggcucuucucaggccg

SEQ ID NO: 493585 - RNA, 22 nt, Human
ugcuccguucuucugcuucuug

SEQ ID NO: 493586 - RNA, 22 nt, Human
caagucugaccucugggugaag

SEQ ID NO: 493587 - RNA, 22 nt, Human
cuucuggguauuccagauaccu

SEQ ID NO: 493588 - RNA, 22 nt, Human
auguaguauuuggaaauguaaa

SEQ ID NO: 493589 - RNA, 22 nt, Human
agguggcuaugaggaugcaguc

SEQ ID NO: 493590 - RNA, 22 nt, Human
ccuggggaccugccucagcccu

SEQ ID NO: 493591 - RNA, 22 nt, Human
ggugaccagggucaguagcuuu

SEQ ID NO: 493592 - RNA, 22 nt, Human
aggccugaggaccagauaaaug

SEQ ID NO: 493593 - RNA, 22 nt, Human
gcucugagucacacugcccugu

SEQ ID NO: 493594 - RNA, 22 nt, Human
uccucuccaggugagccgaaau

SEQ ID NO: 493595 - RNA, 23 nt, Human
ccacuggagaaaguggcaggugg

SEQ ID NO: 493596 - RNA, 22 nt, Human
acagauccugguuacagccauu

SEQ ID NO: 493597 - RNA, 22 nt, Human
ucugaaauuuuaguuauagaaa

SEQ ID NO: 493598 - RNA, 22 nt, Human
guccagagaguaaaggggguaa

SEQ ID NO: 493599 - RNA, 22 nt, Human
ggacuggucugagagggauuca

SEQ ID NO: 493600 - RNA, 22 nt, Human
cugcucucuguuccccuggauc

SEQ ID NO: 493601 - RNA, 22 nt, Human
ccagcaggagacuagcaacaua

SEQ ID NO: 493602 - RNA, 22 nt, Human
uuugaagauaaauauggagaaa

SEQ ID NO: 493603 - RNA, 22 nt, Human
gcagcagcggggccccugcgcg

SEQ ID NO: 493604 - RNA, 23 nt, Human
gguucugccgcuuacugcugugc

SEQ ID NO: 493605 - RNA, 22 nt, Human
uguggugccgagagucuggacg

SEQ ID NO: 493606 - RNA, 16 nt, Human
ggcagcagcuccgugc

SEQ ID NO: 493607 - RNA, 22 nt, Human
ggcagccuccagggcacuggug

SEQ ID NO: 493608 - RNA, 22 nt, Human
ggcggccugugggucggccuca

SEQ ID NO: 493609 - RNA, 22 nt, Human
uccaggaggacugagggggcug

SEQ ID NO: 493610 - RNA, 22 nt, Human
uuggaggacuaguuaagagacc

SEQ ID NO: 493611 - RNA, 22 nt, Human
caguuaaacagauugaguguua

SEQ ID NO: 493612 - RNA, 22 nt, Human
caauuuuuaaacuaugaaguug

SEQ ID NO: 493613 - RNA, 20 nt, Human
ucauccaguugguuuauggu

SEQ ID NO: 493614 - RNA, 22 nt, Human
agagaccuuccugacuccagag

SEQ ID NO: 493615 - RNA, 22 nt, Human
uggaucugcucuaugaacugcu

SEQ ID NO: 493616 - RNA, 22 nt, Human
gaaagagaaccugggccuagau

SEQ ID NO: 493617 - RNA, 22 nt, Human
accaguuaaagaauaugaggcc

SEQ ID NO: 493618 - RNA, 21 nt, Human
guucaauagcucuuugaaugc

SEQ ID NO: 493619 - RNA, 21 nt, Human
acucaucuuuuuggagaccag

SEQ ID NO: 493620 - RNA, 22 nt, Human
aagcucuuuccacuaaaccacu

SEQ ID NO: 493621 - RNA, 22 nt, Human
uggacccaccccagggccugcu

SEQ ID NO: 493622 - RNA, 22 nt, Human
ucuacaacgugguuuuguugua

SEQ ID NO: 493623 - RNA, 22 nt, Human
uccucagcaaacacuucacucu

SEQ ID NO: 493624 - RNA, 22 nt, Human
gcggggggcagcagucgcucag

SEQ ID NO: 493625 - RNA, 22 nt, Human
ccacugugcccagccucauggg

SEQ ID NO: 493626 - RNA, 22 nt, Human
ucuccaggggcagggucuggag

SEQ ID NO: 493627 - RNA, 22 nt, Human
uugagacucgagucucucagac

SEQ ID NO: 493628 - RNA, 22 nt, Human
uccucuucaaaauagcucugaa

SEQ ID NO: 493629 - RNA, 20 nt, Human
ggccugagcauggcuggcag

SEQ ID NO: 493630 - RNA, 22 nt, Human
uaucuguagucucaugguuccu

SEQ ID NO: 493631 - RNA, 19 nt, Human
agcucaggcccaucguccc

SEQ ID NO: 493632 - RNA, 22 nt, Human
aucccaggcggcacagguugca

SEQ ID NO: 493633 - RNA, 22 nt, Human
ucuguggcauguugcacuugua

SEQ ID NO: 493634 - RNA, 23 nt, Human
auaugucaugcaccagcacuuua

SEQ ID NO: 493635 - RNA, 22 nt, Human
caggccagcagggccuccgugg

SEQ ID NO: 493636 - RNA, 22 nt, Human
aggcugagguaggaggaucgcu

SEQ ID NO: 493637 - RNA, 22 nt, Human
gugcucuggccaagcgcgugcg

SEQ ID NO: 493638 - RNA, 22 nt, Human
ggguuguagagcuggaagggga

SEQ ID NO: 493639 - RNA, 22 nt, Human
aacuuucagaauccuaugcauu

SEQ ID NO: 493640 - RNA, 20 nt, Human
ccagagcugauggcugcccg

SEQ ID NO: 493641 - RNA, 22 nt, Human
uagcauuuagaacaccuugaga

SEQ ID NO: 493642 - RNA, 22 nt, Human
cccaggucgucagcaguguggu

SEQ ID NO: 493643 - RNA, 22 nt, Human
ucucugagguuguuuccagcac

SEQ ID NO: 493644 - RNA, 22 nt, Human
ccagguggacggcgaguacagg

SEQ ID NO: 493645 - RNA, 22 nt, Human
cugcgggcugucaggcgugcca

SEQ ID NO: 493646 - RNA, 22 nt, Human
accccacuccucuguuuuaacu

SEQ ID NO: 493647 - RNA, 19 nt, Human
ugccuggcaccagcuccac

SEQ ID NO: 493648 - RNA, 22 nt, Human
ucccugccuccuggcagugcca

SEQ ID NO: 493649 - RNA, 22 nt, Human
aggccacucagggggccaagau

SEQ ID NO: 493650 - RNA, 22 nt, Human
ugcucccaggcauucucuguug

SEQ ID NO: 493651 - RNA, 22 nt, Human
accuggaccugccaccuaugag

SEQ ID NO: 493652 - RNA, 22 nt, Human
gugcaggacagcacaucuccug

SEQ ID NO: 493653 - RNA, 22 nt, Human
ggacagacuuuacagccccggg

SEQ ID NO: 493654 - RNA, 22 nt, Human
gcagcaaucuucacagugucau

SEQ ID NO: 493655 - RNA, 22 nt, Human
ccuucuagcaaaucaacauaaa

SEQ ID NO: 493656 - RNA, 22 nt, Human
ccacugauucugccaggucucu

SEQ ID NO: 493657 - RNA, 22 nt, Human
cucaggcuaagaaggccaagug

SEQ ID NO: 493658 - RNA, 22 nt, Human
uuucuagguguucacagagcau

SEQ ID NO: 493659 - RNA, 22 nt, Human
ugcccuccacaguggcuccacc

SEQ ID NO: 493660 - RNA, 22 nt, Human
gaauguuuaaaaggugcaguuu

SEQ ID NO: 493661 - RNA, 22 nt, Human
aggagacaguuuggacguguag

SEQ ID NO: 493662 - RNA, 22 nt, Human
ucugaggacagugcugugccug

SEQ ID NO: 493663 - RNA, 22 nt, Human
agcaugucuaacucuucagggu

SEQ ID NO: 493664 - RNA, 22 nt, Human
gguuccaggcauggcaggaugu

SEQ ID NO: 493665 - RNA, 22 nt, Human
uggcugaggcacagcugccgcc

SEQ ID NO: 493666 - RNA, 22 nt, Human
cgugcggccucggggcccggcu

SEQ ID NO: 493667 - RNA, 19 nt, Human
agcagggagugguuguggg

SEQ ID NO: 493668 - RNA, 22 nt, Human
caaagcccagaggccucacuuu

SEQ ID NO: 493669 - RNA, 22 nt, Human
uucacagcucauacuguucuca

SEQ ID NO: 493670 - RNA, 22 nt, Human
gcugggugauucauuuccauaa

SEQ ID NO: 493671 - RNA, 22 nt, Human
ugagaccuuggacuccauccuu

SEQ ID NO: 493672 - RNA, 21 nt, Human
acauguccccuaugcuuaagg

SEQ ID NO: 493673 - RNA, 22 nt, Human
caagaaguugacagccagguga

SEQ ID NO: 493674 - RNA, 22 nt, Human
cgggaagguggagguugcagug

SEQ ID NO: 493675 - RNA, 22 nt, Human
agagauuccuuuggggaaagca

SEQ ID NO: 493676 - RNA, 22 nt, Human
cuguccagcgacuaggggaugg

SEQ ID NO: 493677 - RNA, 22 nt, Human
ucaucagcuccaugagguacuc

SEQ ID NO: 493678 - RNA, 19 nt, Human
ugugaaagcuaguguucuu

SEQ ID NO: 493679 - RNA, 22 nt, Human
gcaggcaggcuuccuugaacug

SEQ ID NO: 493680 - RNA, 22 nt, Human
gcucccacgcaauucuuuucag

SEQ ID NO: 493681 - RNA, 22 nt, Human
ccugaggacagugugaccaugg

SEQ ID NO: 493682 - RNA, 22 nt, Human
cagggccaagccccuuuggcug

SEQ ID NO: 493683 - RNA, 22 nt, Human
ccugcaagagcggagaagccag

SEQ ID NO: 493684 - RNA, 22 nt, Human
aaaaagacagaggaugaggcag

SEQ ID NO: 493685 - RNA, 22 nt, Human
uuuaaauuuagaagaaacacug

SEQ ID NO: 493686 - RNA, 22 nt, Human
agccuggccacucagggccuga

SEQ ID NO: 493687 - RNA, 22 nt, Human
guagggacaauauguuauuaga

SEQ ID NO: 493688 - RNA, 22 nt, Human
ucuauuuguucucaggaucauc

SEQ ID NO: 493689 - RNA, 22 nt, Human
uggcuucuugucuaauuuguua

SEQ ID NO: 493690 - RNA, 22 nt, Human
cccucuacagggaagcgcuuuc

SEQ ID NO: 493691 - RNA, 22 nt, Human
gagauuuccauauuuuguaaca

SEQ ID NO: 493692 - RNA, 22 nt, Human
acaggcaggcuucggccagagc

SEQ ID NO: 493693 - RNA, 22 nt, Human
cgcagcagccccgugguaggug

SEQ ID NO: 493694 - RNA, 22 nt, Human
ucuugagugcgcuuggguguuc

SEQ ID NO: 493695 - RNA, 22 nt, Human
uagggacaaagagcugaggccu

SEQ ID NO: 493696 - RNA, 22 nt, Human
ucuauaauccuauuucaacugc

SEQ ID NO: 493697 - RNA, 22 nt, Human
ucuggcuccacaccucacugca

SEQ ID NO: 493698 - RNA, 22 nt, Human
aauucaaucuaagaaaugauca

SEQ ID NO: 493699 - RNA, 22 nt, Human
ugaaggaauggaggaucagagc

SEQ ID NO: 493700 - RNA, 19 nt, Human
ucugggcagggccagcacc

SEQ ID NO: 493701 - RNA, 22 nt, Human
gcaggggaguggcaggcccgga

SEQ ID NO: 493702 - RNA, 22 nt, Human
guuagaaagugucugcuugggu

SEQ ID NO: 493703 - RNA, 22 nt, Human
ucugagagucucugaggcagau

SEQ ID NO: 493704 - RNA, 22 nt, Human
cauugcuuugugcauauuuaaa

SEQ ID NO: 493705 - RNA, 22 nt, Human
ccaggccuggccaggggaugcc

SEQ ID NO: 493706 - RNA, 22 nt, Human
gcuuuggaaggggcugguggag

SEQ ID NO: 493707 - RNA, 22 nt, Human
uuugcauuuccagaguagcaga

SEQ ID NO: 493708 - RNA, 22 nt, Human
aaugacaagacauagucucuga

SEQ ID NO: 493709 - RNA, 22 nt, Human
ucuggcucauaggaaggccauu

SEQ ID NO: 493710 - RNA, 22 nt, Human
ggcagcuccucaaaaaauuaaa

SEQ ID NO: 493711 - RNA, 22 nt, Human
cccugggagaaguugagggcug

SEQ ID NO: 493712 - RNA, 22 nt, Human
caggucccgccccgggcugacc

SEQ ID NO: 493713 - RNA, 22 nt, Human
cagcacugcuucgcagccaggg

SEQ ID NO: 493714 - RNA, 22 nt, Human
gagagcuggguucaaguagcug

SEQ ID NO: 493715 - RNA, 22 nt, Human
cagagugaaauaggggaucaag

SEQ ID NO: 493716 - RNA, 23 nt, Human
cuccucguaacucuguggugggu

SEQ ID NO: 493717 - RNA, 22 nt, Human
ugcuggcuguauaugugagagu

SEQ ID NO: 493718 - RNA, 22 nt, Human
acagggcagagggcaguuggua

SEQ ID NO: 493719 - RNA, 22 nt, Human
guuuuccuucucagccauugcc

SEQ ID NO: 493720 - RNA, 22 nt, Human
ugcuggccaacaaggcuccaag

SEQ ID NO: 493721 - RNA, 22 nt, Human
uggagcugguaaacagugacau

SEQ ID NO: 493722 - RNA, 22 nt, Human
cccagagauguccugagugaua

SEQ ID NO: 493723 - RNA, 22 nt, Human
ggcucaggccuguaauccuagc

SEQ ID NO: 493724 - RNA, 22 nt, Human
caagauggacauaaggagagaa

SEQ ID NO: 493725 - RNA, 21 nt, Human
uuagcaaagcaaacacaugcu

SEQ ID NO: 493726 - RNA, 22 nt, Human
ucucaggcuaccuugcacaagg

SEQ ID NO: 493727 - RNA, 22 nt, Human
uucuggcuguaugauauuuaau

SEQ ID NO: 493728 - RNA, 22 nt, Human
ucagaggagccaaaguucugag

SEQ ID NO: 493729 - RNA, 22 nt, Human
ucauuuguacuugugugcuugu

SEQ ID NO: 493730 - RNA, 22 nt, Human
gaauucuuuucuuucugaaagu

SEQ ID NO: 493731 - RNA, 22 nt, Human
ucucacuuuccagacuuuucaa

SEQ ID NO: 493732 - RNA, 22 nt, Human
ccauggaguuccucuggucuau

SEQ ID NO: 493733 - RNA, 22 nt, Human
ugccccucuaggcccuguucua

SEQ ID NO: 493734 - RNA, 22 nt, Human
auaacagaugugaagugcuaau

SEQ ID NO: 493735 - RNA, 22 nt, Human
caggagccacauuccaccuuga

SEQ ID NO: 493736 - RNA, 20 nt, Human
agcuggagaagggcccuucc

SEQ ID NO: 493737 - RNA, 22 nt, Human
gacaggggucccucugggcugu

SEQ ID NO: 493738 - RNA, 22 nt, Human
ccugggcuuugagggcaggaug

SEQ ID NO: 493739 - RNA, 19 nt, Human
uucugggcagcacaugaau

SEQ ID NO: 493740 - RNA, 22 nt, Human
uagagcagccuucagagcaguu

SEQ ID NO: 493741 - RNA, 22 nt, Human
uggcaggucaugaguggccacc

SEQ ID NO: 493742 - RNA, 22 nt, Human
uuccaagagcuuuaauuguuga

SEQ ID NO: 493743 - RNA, 22 nt, Human
uuucuaaggugagguagaaaau

SEQ ID NO: 493744 - RNA, 22 nt, Human
gagguauguaugcuacauucuu

SEQ ID NO: 493745 - RNA, 22 nt, Human
ugccuugguucucuacuuggag

SEQ ID NO: 493746 - RNA, 21 nt, Human
gagcauggcuuacaucagcag

SEQ ID NO: 493747 - RNA, 22 nt, Human
acccagcuaacccuacccugga

SEQ ID NO: 493748 - RNA, 22 nt, Human
cuuuagaauuugauauaaucaa

SEQ ID NO: 493749 - RNA, 20 nt, Human
agaaucugacccagagagac

SEQ ID NO: 493750 - RNA, 22 nt, Human
ucccagauuguugauggcuuaa

SEQ ID NO: 493751 - RNA, 22 nt, Human
ugggcucucuuuaccucauaac

SEQ ID NO: 493752 - RNA, 22 nt, Human
cagcugccaagaaucuuuucua

SEQ ID NO: 493753 - RNA, 22 nt, Human
uaucuauuccaaauaucagcgu

SEQ ID NO: 493754 - RNA, 22 nt, Human
uuguacaaauaggaaccucuga

SEQ ID NO: 493755 - RNA, 20 nt, Human
ucccuccugcagauagagaa

SEQ ID NO: 493756 - RNA, 22 nt, Human
uaauccacaauagagauuaucu

SEQ ID NO: 493757 - RNA, 22 nt, Human
guucuugccagcauccucaggu

SEQ ID NO: 493758 - RNA, 22 nt, Human
uuauuugugaaucauuuaucua

SEQ ID NO: 493759 - RNA, 22 nt, Human
agaacuguccuuggaggagagu

SEQ ID NO: 493760 - RNA, 22 nt, Human
cauuaugugggaaaauguucuu

SEQ ID NO: 493761 - RNA, 20 nt, Human
ccacaggaguccagucgacc

SEQ ID NO: 493762 - RNA, 21 nt, Human
uucucuggcuucuguagcugg

SEQ ID NO: 493763 - RNA, 22 nt, Human
aguuuagaguucaaauuaguuc

SEQ ID NO: 493764 - RNA, 18 nt, Human
uggcucugcagccagaug

SEQ ID NO: 493765 - RNA, 22 nt, Human
ccuggcucuagaggccacuccu

SEQ ID NO: 493766 - RNA, 22 nt, Human
cuggagcucuccagagccccgu

SEQ ID NO: 493767 - RNA, 22 nt, Human
aagguuuuuuuccaguaucucu

SEQ ID NO: 493768 - RNA, 22 nt, Human
ggcuggcuuucucuccgcaccu

SEQ ID NO: 493769 - RNA, 22 nt, Human
ugcugccuucuaggcgugcccu

SEQ ID NO: 493770 - RNA, 22 nt, Human
uuaaauuauuucuagugaggug

SEQ ID NO: 493771 - RNA, 22 nt, Human
ugucaaugaagauaugaauaau

SEQ ID NO: 493772 - RNA, 22 nt, Human
gcuucugguagaauucaauaga

SEQ ID NO: 493773 - RNA, 20 nt, Human
aaaugcuguaauguuuggga

SEQ ID NO: 493774 - RNA, 22 nt, Human
caaauucucaagguuuauccca

SEQ ID NO: 493775 - RNA, 22 nt, Human
ucaaguaguacccaaugcgugg

SEQ ID NO: 493776 - RNA, 22 nt, Human
uagccucucuccuccacaaccu

SEQ ID NO: 493777 - RNA, 22 nt, Human
cuccuuccugguuagcaccuua

SEQ ID NO: 493778 - RNA, 19 nt, Human
cugguccugacugaggggu

SEQ ID NO: 493779 - RNA, 22 nt, Human
caggguggggcuggcuaucaaa

SEQ ID NO: 493780 - RNA, 22 nt, Human
uaaaaugaucucucauguucuu

SEQ ID NO: 493781 - RNA, 22 nt, Human
gcucugagauugagccuuuggu

SEQ ID NO: 493782 - RNA, 22 nt, Human
cuacauaaucuggauuugucug

SEQ ID NO: 493783 - RNA, 22 nt, Human
ggucucugcucagaugccacuu

SEQ ID NO: 493784 - RNA, 22 nt, Human
ucuguacacuucagcaugcauc

SEQ ID NO: 493785 - RNA, 22 nt, Human
ugauuaacugucuauuaaucau

SEQ ID NO: 493786 - RNA, 22 nt, Human
ggcacuuugauuuugagaugca

SEQ ID NO: 493787 - RNA, 22 nt, Human
cuuccucaggcauuagcuggac

SEQ ID NO: 493788 - RNA, 22 nt, Human
uuuuauuaguggcuagaugggg

SEQ ID NO: 493789 - RNA, 22 nt, Human
aucaaaguaggcauauguuuuu

SEQ ID NO: 493790 - RNA, 21 nt, Human
aggugggagaccauguagguc

SEQ ID NO: 493791 - RNA, 22 nt, Human
uagagcuggaaaacugcaggua

SEQ ID NO: 493792 - RNA, 22 nt, Human
gaaggcccagcuugaaugcugc

SEQ ID NO: 493793 - RNA, 22 nt, Human
cauggcacugagcagguaugca

SEQ ID NO: 493794 - RNA, 22 nt, Human
cauauaaauacaacauguguua

SEQ ID NO: 493795 - RNA, 22 nt, Human
cugcccaggggagugcugucgg

SEQ ID NO: 493796 - RNA, 22 nt, Human
gaaugaauagguguccagaugg

SEQ ID NO: 493797 - RNA, 21 nt, Human
cccgcacagcgguaggccgcc

SEQ ID NO: 493798 - RNA, 22 nt, Human
gucugaggucauuagcucucuu

SEQ ID NO: 493799 - RNA, 22 nt, Human
cauuuagagaagauuacaagga

SEQ ID NO: 493800 - RNA, 22 nt, Human
uggcagguuggccuuugguuca

SEQ ID NO: 493801 - RNA, 22 nt, Human
ggcagugaaugaaacagaggcu

SEQ ID NO: 493802 - RNA, 17 nt, Human
ggucuggggccauuggc

SEQ ID NO: 493803 - RNA, 17 nt, Human
auggcuuccauugacca

SEQ ID NO: 493804 - RNA, 22 nt, Human
cagggccaccguguuugcugcu

SEQ ID NO: 493805 - RNA, 22 nt, Human
aaagugcugaaauuacaggggu

SEQ ID NO: 493806 - RNA, 21 nt, Human
aaaaugugagcgugaugcuua

SEQ ID NO: 493807 - RNA, 22 nt, Human
ugcaaggguagaagugauggca

SEQ ID NO: 493808 - RNA, 22 nt, Human
gucuggcuuuugcccuguguuu

SEQ ID NO: 493809 - RNA, 22 nt, Human
cuggggacgucgggcaguguuc

SEQ ID NO: 493810 - RNA, 22 nt, Human
auccuugagccuuaucuuuugu

SEQ ID NO: 493811 - RNA, 17 nt, Human
gacaagacagaauucau

SEQ ID NO: 493812 - RNA, 22 nt, Human
cucagggacuuggauccuggcc

SEQ ID NO: 493813 - RNA, 22 nt, Human
gcuccuggcucuggccaaggga

SEQ ID NO: 493814 - RNA, 22 nt, Human
cagcaggauuggauacaucuca

SEQ ID NO: 493815 - RNA, 22 nt, Human
agagccaguuguuaagcacuua

SEQ ID NO: 493816 - RNA, 22 nt, Human
agggugcagaaggagccuagga

SEQ ID NO: 493817 - RNA, 22 nt, Human
acaugcuacacagagcuccucg

SEQ ID NO: 493818 - RNA, 22 nt, Human
uggcugggagcuggaacugggc

SEQ ID NO: 493819 - RNA, 22 nt, Human
ucauuuacacuucacaaaugga

SEQ ID NO: 493820 - RNA, 22 nt, Human
gaggcagaaguugcagugagca

SEQ ID NO: 493821 - RNA, 21 nt, Human
gcccucaggggaggauggccu

SEQ ID NO: 493822 - RNA, 22 nt, Human
cccaccucucagagagccuugc

SEQ ID NO: 493823 - RNA, 20 nt, Human
uuguugagcucuucaaagaa

SEQ ID NO: 493824 - RNA, 22 nt, Human
caaaguauauuggauugaaugg

SEQ ID NO: 493825 - RNA, 22 nt, Human
cucugggugugacagcaccugg

SEQ ID NO: 493826 - RNA, 20 nt, Human
ucauuucuugggguuccaag

SEQ ID NO: 493827 - RNA, 22 nt, Human
uccauuuuguagguaugcuaca

SEQ ID NO: 493828 - RNA, 22 nt, Human
aguccggggucuggacaccugg

SEQ ID NO: 493829 - RNA, 23 nt, Human
cagggcugguagggaagagcgug

SEQ ID NO: 493830 - RNA, 22 nt, Human
ugggggcuagaacccagggauu

SEQ ID NO: 493831 - RNA, 22 nt, Human
aaugcauuuuauuauaugugac

SEQ ID NO: 493832 - RNA, 22 nt, Human
caugaagcccucaucagucuga

SEQ ID NO: 493833 - RNA, 22 nt, Human
gugccagcaguuauggugauuu

SEQ ID NO: 493834 - RNA, 22 nt, Human
uccagggagauggcagaggcug

SEQ ID NO: 493835 - RNA, 22 nt, Human
aguucacauuccgagguacugg

SEQ ID NO: 493836 - RNA, 22 nt, Human
uugacguccucgauggggaacu

SEQ ID NO: 493837 - RNA, 22 nt, Human
ggcuccugauaggagaaugcgg

SEQ ID NO: 493838 - RNA, 22 nt, Human
uuguauuagcuguaaauuuucu

SEQ ID NO: 493839 - RNA, 22 nt, Human
cuuuggaacauacugcugagcu

SEQ ID NO: 493840 - RNA, 22 nt, Human
uaacuugauaaguauucucugc

SEQ ID NO: 493841 - RNA, 17 nt, Human
caggucugaggccaggc

SEQ ID NO: 493842 - RNA, 22 nt, Human
ugagaaagguauuucaugcacu

SEQ ID NO: 493843 - RNA, 19 nt, Human
aaaaggaauauucuuuggg

SEQ ID NO: 493844 - RNA, 22 nt, Human
caggaggaaaugugacccugcu

SEQ ID NO: 493845 - RNA, 19 nt, Human
ugggagaggcaacagagua

SEQ ID NO: 493846 - RNA, 22 nt, Human
ggcacuuugccuuuaugcacug

SEQ ID NO: 493847 - RNA, 22 nt, Human
cuggagccggcgagccccagcc

SEQ ID NO: 493848 - RNA, 22 nt, Human
agcauggggcuccgcaaugaac

SEQ ID NO: 493849 - RNA, 22 nt, Human
ccucaggggucacugugaggag

SEQ ID NO: 493850 - RNA, 22 nt, Human
augcccugugguucaugugaga

SEQ ID NO: 493851 - RNA, 22 nt, Human
uggagaggaaagugcaguuuug

SEQ ID NO: 493852 - RNA, 22 nt, Human
ccagcaucuaacgcuccuggga

SEQ ID NO: 493853 - RNA, 22 nt, Human
agggacaguuacaucaucagac

SEQ ID NO: 493854 - RNA, 22 nt, Human
agugugagaacggacuaauaaa

SEQ ID NO: 493855 - RNA, 22 nt, Human
acuuuucaaaugggaaacucag

SEQ ID NO: 493856 - RNA, 22 nt, Human
gagccaggucgggccgcggcga

SEQ ID NO: 493857 - RNA, 22 nt, Human
ucaaagcagcacauucgcaagc

SEQ ID NO: 493858 - RNA, 22 nt, Human
uacacaucccagacucccagga

SEQ ID NO: 493859 - RNA, 22 nt, Human
uccugcagccaagggucaucga

SEQ ID NO: 493860 - RNA, 22 nt, Human
cagggcggggucugccggcccu

SEQ ID NO: 493861 - RNA, 22 nt, Human
ccucugccaccucccacgaggc

SEQ ID NO: 493862 - RNA, 22 nt, Human
gaaaugaugucugugcugccac

SEQ ID NO: 493863 - RNA, 17 nt, Human
gcucuggcacaggauug

SEQ ID NO: 493864 - RNA, 22 nt, Human
cacagcccugcgccccaguuug

SEQ ID NO: 493865 - RNA, 22 nt, Human
guucacaucacuucacugaacc

SEQ ID NO: 493866 - RNA, 22 nt, Human
cugaggcacugucagcugaggc
